United States Patent 11,332,783 (SAMPLE ANALYSIS, PRESENCE DETERMINATION OF A TARGET SEQUENCE) - sequence listing, part 4

SEQ ID NO: 58549 - DNA, 75 bp, Artificial Sequence
  Synthetic
agccctccaacggtcctaaaatagtgcctgtggacagcgtcgcctgcatgaacttagaagctaacgtagatgtga

SEQ ID NO: 58550 - DNA, 75 bp, Artificial Sequence
  Synthetic
ggagcatttacagttagcagcagaagtgtactatgacactgagccagaggcagtaggaactggaatctcaaaaga

SEQ ID NO: 58551 - DNA, 75 bp, Artificial Sequence
  Synthetic
gatcaaacaaattagtgatacagtctttgatgactacagttaaaattagcctgaaaaactgtaaggtcgtagtca

SEQ ID NO: 58552 - DNA, 75 bp, Artificial Sequence
  Synthetic
tgagtacatcaaggtcgcaatgaaagacaatgaatggggaggttccttggaagcttcaatgttatcaaagcatct

SEQ ID NO: 58553 - DNA, 75 bp, Artificial Sequence
  Synthetic
attctagacagtgcatccatcagcaaacaggctctggtgttatcaaagtcccaaaattcgaaaagcagcagggtg

SEQ ID NO: 58554 - DNA, 75 bp, Artificial Sequence
  Synthetic
ccaaacaaccatcatcttgtgggtggtcaattcgacagaacaggttacggccgctattaagtttggaccaggcag

SEQ ID NO: 58555 - DNA, 75 bp, Artificial Sequence
  Synthetic
gaacttggtcaagctacatcgccggggtatacacagcaaccattgacctgttagatgaaaacaaccaaaactgca

SEQ ID NO: 58556 - DNA, 75 bp, Artificial Sequence
  Synthetic
ggtatcaacagctctaaatcttatgcatgttggtcgcacacacttcgatgcgcttaggataatagaacagctgga

SEQ ID NO: 58557 - DNA, 75 bp, Artificial Sequence
  Synthetic
agctatttacagaatgtattgtcaaaggtagagagttggttaaaggacaaagtgaacttaagtccttcaatatag

SEQ ID NO: 58558 - DNA, 75 bp, Artificial Sequence
  Synthetic
gaacaaccaacctcaagacaggaataggctagacatagcagacagaattgcagctgcggaggtttatgtgagaca

SEQ ID NO: 58559 - DNA, 75 bp, Artificial Sequence
  Synthetic
aagtcctcctaccgagagtgatgaagactagaagaaagctgttagctgtcactgatggtagcactgaatgtaact

SEQ ID NO: 58560 - DNA, 75 bp, Artificial Sequence
  Synthetic
gtctatagaggacaatttgcaagaggacgaattctttgactacgcaagagaggatgagatttcagaagatgtcag

SEQ ID NO: 58561 - DNA, 75 bp, Artificial Sequence
  Synthetic
cagggacacagctaattgaaggaaagtccatagaggtccacaaacaagacataggagggccggggaaaaaactga

SEQ ID NO: 58562 - DNA, 75 bp, Artificial Sequence
  Synthetic
tgcaccaggaggctccagagaagcaactgaactaaaaaagaaggcaatacttttaaacaaaactgttaaaagagg

SEQ ID NO: 58563 - DNA, 75 bp, Artificial Sequence
  Synthetic
ccatttgtaacggcactagtgttctcgatgtacccctggatgaaggacatggatgctacaccattaatgtaatca

SEQ ID NO: 58564 - DNA, 75 bp, Artificial Sequence
  Synthetic
agaaaacataccaataagggtaggcagagtccttgactgtctattcagctgcaagattgcagttagtttagatga

SEQ ID NO: 58565 - DNA, 75 bp, Artificial Sequence
  Synthetic
cgtccaaaagggcatgcagaccaaagaacagcaagttacagtgttcaattgacaaagagcttaagccttgtgact

SEQ ID NO: 58566 - DNA, 75 bp, Artificial Sequence
  Synthetic
agggctactctatttgagacctgaaaccagggaaagtgaagccacctcaatttctctaagacaacttggacacaa

SEQ ID NO: 58567 - DNA, 75 bp, Artificial Sequence
  Synthetic
caggcaagtgtttgagtatcagccaaaaaggagcaggccacattaaggtgagcagagggaaaaccattcttatta

SEQ ID NO: 58568 - DNA, 75 bp, Artificial Sequence
  Synthetic
gctactcacccgtgataggcacattaaaatggaatatgctagatccaaactctatgtgaccagggatctcataga

SEQ ID NO: 58569 - DNA, 75 bp, Artificial Sequence
  Synthetic
ctgaatgcaaagaacactgccagatcccagtaccaactggaaaaggggatataatggtggactgctcaggaggcc

SEQ ID NO: 58570 - DNA, 75 bp, Artificial Sequence
  Synthetic
tcacctagatataggtggcttgcttagatcatcatttcctggcttaggattagagaggtacatacagctgttgca

SEQ ID NO: 58571 - DNA, 75 bp, Artificial Sequence
  Synthetic
gtcagcactatttggaggtgaacatcgttgatatccactgccctaacacaaaattcttaggaggaataatgcttt

SEQ ID NO: 58572 - DNA, 75 bp, Artificial Sequence
  Synthetic
ctcagagcttgtgttagacttggtaacagtagtgcttgctgtactattatcaactttcttgtatggctcaaacaa

SEQ ID NO: 58573 - DNA, 75 bp, Artificial Sequence
  Synthetic
atttctgtagaatgtcaagcagacctacagtagcattgcttcttggcatctggattggctgcggctatatactca

SEQ ID NO: 58574 - DNA, 75 bp, Artificial Sequence
  Synthetic
caagaataaaaaacagtttataacaaactgtttattaaatactaagctttcaggcaaaagagtgtttaaagcatt

SEQ ID NO: 58575 - DNA, 75 bp, Artificial Sequence
  Synthetic
catgcatcttctcatttttgctataccacttaattttattctttgcaaactgtataaaacagtgcagaaagaaag

SEQ ID NO: 58576 - DNA, 75 bp, Artificial Sequence
  Synthetic
atcaaaattaactggtcaaatgttgtatcgtactccaaaaagggcagtatcaattgtgtctcaagagctctatgg

SEQ ID NO: 58577 - DNA, 75 bp, Artificial Sequence
  Synthetic
gagagaggcttggagaaatctgtgtcaagtgcgagcagcaaacagttaaccttatggaccaagagttgcatgacc

SEQ ID NO: 58578 - DNA, 75 bp, Artificial Sequence
  Synthetic
gaaactaatgctaaaggtgaagaacaacttagagggaatgggaccaataagcatgctagcattaaggaatctaaa

SEQ ID NO: 58579 - DNA, 75 bp, Artificial Sequence
  Synthetic
tcaattgcaatttcaatctttgtccttattgctgcaatcgaatgtcagacgaaggtatgagcaggcatgtaggta

SEQ ID NO: 58580 - DNA, 75 bp, Artificial Sequence
  Synthetic
ctttgataatatgcagcttcaagactatctggaaatgttatctgaaatgtccaagattgataattctgatgttga

SEQ ID NO: 58581 - DNA, 75 bp, Artificial Sequence
  Synthetic
agtgtcctaaaagattagaaagacttaatgaaatagagctctatctaactacaagcgagtgcctctgcctaagtg

SEQ ID NO: 58582 - DNA, 75 bp, Artificial Sequence
  Synthetic
atatactcacagagaaataagtgaccttcatacattagttgaaaggctaagtaaacttcagaagtctcaagatgt

SEQ ID NO: 58583 - DNA, 75 bp, Artificial Sequence
  Synthetic
tatgctatcaacttctaataagcgtaggcattttcttgaaaagaacaacttggctggttgtacttctggttctgt

SEQ ID NO: 58584 - DNA, 75 bp, Artificial Sequence
  Synthetic
taacgaactcaagctatggtttaaggaagaggtgttaacaaaaaggtcacaaaggagtgttggcaatgcctttga

SEQ ID NO: 58585 - DNA, 75 bp, Artificial Sequence
  Synthetic
tagggttagccatttcaccagttcaaggagctccaacagaggtcagtaatgttaagcaggacggtgactacagta

SEQ ID NO: 58586 - DNA, 75 bp, Artificial Sequence
  Synthetic
gtttttaatcaatgattactttaagaagaaggacattatgaagtttgtttctacatcagggaaagcatcaagtac

SEQ ID NO: 58587 - DNA, 75 bp, Artificial Sequence
  Synthetic
tctgctattttatttttggttgtttggtgacagctgcacttttgttgaaggtcaagagaacaaactctaatggca

SEQ ID NO: 58588 - DNA, 75 bp, Artificial Sequence
  Synthetic
tggaaacattggaaatgtgctatcatatgcacacaacctgtacctcagtaaggaaagtcttagaatgacctctga

SEQ ID NO: 58589 - DNA, 75 bp, Artificial Sequence
  Synthetic
ttgtggtagtggtcgatagctttggaaggtgtccatactgtaatgaattcactgattcattgtttgaggaagtgc

SEQ ID NO: 58590 - DNA, 75 bp, Artificial Sequence
  Synthetic
agatgttactcaattactaatagaaatcagaaagttgcataaactacaaggtgatcttagtattgagccagtggc

SEQ ID NO: 58591 - DNA, 75 bp, Artificial Sequence
  Synthetic
ttcacgatacactatgcagtctctgtgtctgtcctttctgtgagaaacaggctcttgatctggtgacccttgaag

SEQ ID NO: 58592 - DNA, 75 bp, Artificial Sequence
  Synthetic
cataatttgcgacaagctagaggaccaattcagaaagctattcagggagctgcctgaagaatgcagcagcgaatg

SEQ ID NO: 58593 - DNA, 75 bp, Artificial Sequence
  Synthetic
aacatgtcaaagaatgctacaaagttgcaactaggaaggacatattcaagatattagggagaaagttcaccaatg

SEQ ID NO: 58594 - DNA, 75 bp, Artificial Sequence
  Synthetic
ccagacactatttaatgacatacgcaactctccaagccacagtgttgcgtggaaacatgctcttagactgaaagg

SEQ ID NO: 58595 - DNA, 75 bp, Artificial Sequence
  Synthetic
ctctagttagaagggaaaaactgttcacaacaggactgcagctcttcataaataaaacaaatgttgtcgtctttg

SEQ ID NO: 58596 - DNA, 75 bp, Artificial Sequence
  Synthetic
aacagcatatgaggggatgtttgcaaaacaatatggttggtcgtacatctcagaagatattaaacctagtttaac

SEQ ID NO: 58597 - DNA, 75 bp, Artificial Sequence
  Synthetic
ctctcattatgtgcttcttgctactgttaacaggacataacgcaagtgcttttgattctggtgacttgccagatg

SEQ ID NO: 58598 - DNA, 75 bp, Artificial Sequence
  Synthetic
aatgattgttcagactcttttcccagagtcctttgaggcatttttggataggactcagctacatccagagtttcg

SEQ ID NO: 58599 - DNA, 75 bp, Artificial Sequence
  Synthetic
gggtatgggaagaatcaagccaacttgttaagtcatgtacacagttttgttatatagaagaagatgtctgctact

SEQ ID NO: 58600 - DNA, 75 bp, Artificial Sequence
  Synthetic
ggatcttacccctgattatgctctaactcagaaaatattctttcccagaaacacaatacctagaacagaaaacag

SEQ ID NO: 58601 - DNA, 75 bp, Artificial Sequence
  Synthetic
gccctgctgaggatggcgtaggaaggaaattgctgttcttcaatggccttcagaattcagtgaaaagactttcag

SEQ ID NO: 58602 - DNA, 75 bp, Artificial Sequence
  Synthetic
acagcttgcaatagatgtctcactggaaggctctgttgaggctgtacccattgtggaaaaaagaatgtttcctct

SEQ ID NO: 58603 - DNA, 75 bp, Artificial Sequence
  Synthetic
attctcacaagttgttgacaagtgtctcaattgatgcaccttggggtcgaattaatgttgaatcaacttggaaac

SEQ ID NO: 58604 - DNA, 75 bp, Artificial Sequence
  Synthetic
tcctgaggttccaattggagaggctaactcaatcagtagagttatgaatatattcaaggagaaaagggaagagag

SEQ ID NO: 58605 - DNA, 75 bp, Artificial Sequence
  Synthetic
caacactggcagcatccaacattgccatgagctggagctccactgacatcaaaggtgagaaggtcatactatcag

SEQ ID NO: 58606 - DNA, 75 bp, Artificial Sequence
  Synthetic
catgcaaaagaaacttgagcatgatagacaggcagaagcgaatcgactaaaaagtgctggattaagtgcctccaa

SEQ ID NO: 58607 - DNA, 75 bp, Artificial Sequence
  Synthetic
gaaggagcacatccataataaagcttaaagaaaaaactggtgtgatgtggaagctcgttgggtcaggactagcat

SEQ ID NO: 58608 - DNA, 75 bp, Artificial Sequence
  Synthetic
ggcagagcaggaagtttgcaacagcgctcaagacagaaaagaggaaaaagaaagaaccacagagcctgctggaaa

SEQ ID NO: 58609 - DNA, 75 bp, Artificial Sequence
  Synthetic
cagaaaaaaagaaaccttttaggtttccgataatggattttgcccaagtctacaattcagtattccagtacataa

SEQ ID NO: 58610 - DNA, 75 bp, Artificial Sequence
  Synthetic
acagcagagaacagaagaccttgttgtcattgagggcaaccaagatgaaggtgatagtgatccacagaaaaaagt

SEQ ID NO: 58611 - DNA, 75 bp, Artificial Sequence
  Synthetic
caggtgatagactactaagtgaatggccaaaagccgtctgcacaggagattgtcctcatagatgtggctgccaaa

SEQ ID NO: 58612 - DNA, 75 bp, Artificial Sequence
  Synthetic
cgatgaaaagacagttccgggggagtcaaaacagcactccaaaagcagtggatcaagtagcacgaaccaaatgag

SEQ ID NO: 58613 - DNA, 75 bp, Artificial Sequence
  Synthetic
catcaacttgtatggccaaagagtgccacacacaagaatgcgtgtcaacccacatggtgttgggaattggtactg

SEQ ID NO: 58614 - DNA, 75 bp, Artificial Sequence
  Synthetic
ccaaaaagttgtagatgttccctcagtagaagatagctccgatcaagcacctggtgattttccagattatggata

SEQ ID NO: 58615 - DNA, 75 bp, Artificial Sequence
  Synthetic
gttgcacctgctgtggtatggatgtggaaaggccatttaataaatatcttggtgttaagtggtcaacagaatatc

SEQ ID NO: 58616 - DNA, 75 bp, Artificial Sequence
  Synthetic
ctactttaaaagaattgtcatggatgagagtggcacagtgctgactgaagaggcacaattagaaaagagacagtt

SEQ ID NO: 58617 - DNA, 75 bp, Artificial Sequence
  Synthetic
ttagaactgaggtgttggtctgcgtggaggtcacggaggaggagaggcactgtgaaattgtcgaggcaggaacca

SEQ ID NO: 58618 - DNA, 75 bp, Artificial Sequence
  Synthetic
actctttattgaagtaggctaccagacagatgttgacggcaaaattactacagattacaagaagtggaaggacat

SEQ ID NO: 58619 - DNA, 75 bp, Artificial Sequence
  Synthetic
gattcaacattggccctataacaataacgatttctgatccccaaaacattggaagtaagcttccagaaagtttaa

SEQ ID NO: 58620 - DNA, 75 bp, Artificial Sequence
  Synthetic
tctgaggttgctagagcttctaaacattaaatgctcctttattgcatgtgcagactgttcttcaacaccatcgaa

SEQ ID NO: 58621 - DNA, 75 bp, Artificial Sequence
  Synthetic
tgacagtccaagaaattgatgacagcaactttgtcgacataatgcatgttggtaatgttatctctgctgacaaca

SEQ ID NO: 58622 - DNA, 75 bp, Artificial Sequence
  Synthetic
caactggtggattagtgaagataaagttaggcttttaaaaaattcaattagtcatctgttttcaaaactgaccca

SEQ ID NO: 58623 - DNA, 75 bp, Artificial Sequence
  Synthetic
gttgtaggcttcaaagctgcactcatggcagtgcggtgactaccagatttacagcactgacagctttaatcaaag

SEQ ID NO: 58624 - DNA, 75 bp, Artificial Sequence
  Synthetic
gaattctcctgcagatgtcacagacatagtagttggttccataagcacacaaaaagttagaagctatttaaagtc

SEQ ID NO: 58625 - DNA, 75 bp, Artificial Sequence
  Synthetic
atgatcacagttctggactcaacctagctgtgttagatcccaaagtcaatagtagctggctatcatgggaagggt

SEQ ID NO: 58626 - DNA, 75 bp, Artificial Sequence
  Synthetic
tggtacagcaactaagacacccatttcactaaaggatgtgcaggaaacatggtctaaaatgaaggactacatagt

SEQ ID NO: 58627 - DNA, 75 bp, Artificial Sequence
  Synthetic
gtgacatggactactactgtaatgttggcgattggccaacctgtacctacactggtgtagtgactcaaaaactca

SEQ ID NO: 58628 - DNA, 75 bp, Artificial Sequence
  Synthetic
aaacaggccaactggaatttcactgaacaaagagctggttggtgccctttatcaaggtcttgtggaaggagcaat

SEQ ID NO: 58629 - DNA, 75 bp, Artificial Sequence
  Synthetic
gagagtttctcaaacttgatcaacatagaaaaagattacacacaacgctttcattttcactcaaaaagaatctca

SEQ ID NO: 58630 - DNA, 75 bp, Artificial Sequence
  Synthetic
aattagtaaagaaggcacagtcaacttaatacagatgttaaaagacaagcaggaaagaatcacagatgagtttga

SEQ ID NO: 58631 - DNA, 75 bp, Artificial Sequence
  Synthetic
gcaaaaggtcacacacttcagttagacttgaaggcaagaccgtaaccaggatggaggtgaaagtgacagcactga

SEQ ID NO: 58632 - DNA, 75 bp, Artificial Sequence
  Synthetic
aagaacaaagttaaaacatgaagtcaatgaagatgtcaagacaagtgagaaattactgttaggttggttaatgga

SEQ ID NO: 58633 - DNA, 75 bp, Artificial Sequence
  Synthetic
ttgaagttgatggtatggagttacattcaaagacaataaggctaagtggtataagactaactggactgaaatgca

SEQ ID NO: 58634 - DNA, 75 bp, Artificial Sequence
  Synthetic
agacctcaaaggctgccgttgcatgggatgtttaactaaaataaaagaactctctgaatcaatgtcagtaaacca

SEQ ID NO: 58635 - DNA, 75 bp, Artificial Sequence
  Synthetic
gtggttgttttagttgcacttctggcatatcatgcagcgtcaatgccaagttgacttctccagacgaatttacac

SEQ ID NO: 58636 - DNA, 75 bp, Artificial Sequence
  Synthetic
ggataggctggagtacttgtcaaccaactgccaaacaaagagtcactgcactgaatgccacccaagaagcttaga

SEQ ID NO: 58637 - DNA, 75 bp, Artificial Sequence
  Synthetic
tgcatctgaggagcaccagtcccaatgtggtagtggcagaaactagcataattgcaagaaagggtccaagtgcca

SEQ ID NO: 58638 - DNA, 75 bp, Artificial Sequence
  Synthetic
gtatagaaatatttcaaatgtggacaatagggttcccagcatgcagagagtcagtcattcaagaaatgaaggttt

SEQ ID NO: 58639 - DNA, 75 bp, Artificial Sequence
  Synthetic
caactagcaggtttaaagtgttctctgttcgtgatacaaagaaaatttgctttgaggtagtggaaagagaatact

SEQ ID NO: 58640 - DNA, 75 bp, Artificial Sequence
  Synthetic
tgaagatacaaatgagacactcactgaactagataggcttgtaagattaacactgccaggtaagacagagaaaga

SEQ ID NO: 58641 - DNA, 75 bp, Artificial Sequence
  Synthetic
gcaaagattgtactcctgatgaactcactacatgcactggtgttgagttagaacctaccaaagacatattgttag

SEQ ID NO: 58642 - DNA, 75 bp, Artificial Sequence
  Synthetic
gagaagagtgaaacgtaatgttgaaggtctaatcaggttcatgatgcaacagtcaagcttagactgtataaagct

SEQ ID NO: 58643 - DNA, 75 bp, Artificial Sequence
  Synthetic
aacatagaggaacaatagtacagcaccaaaacgacacttgcaaatctaagattgactgttggtcaaattctataa

SEQ ID NO: 58644 - DNA, 75 bp, Artificial Sequence
  Synthetic
accatctggacaaataattgctcacagatgcagtaaaaaatttaaaaacagttcagaagctgaagagaagtgcaa

SEQ ID NO: 58645 - DNA, 75 bp, Artificial Sequence
  Synthetic
gttcattcgcatctggtataggagatttttttaagcattacattggaagcattgctgtcggagtacttggcacgg

SEQ ID NO: 58646 - DNA, 75 bp, Artificial Sequence
  Synthetic
cgaaagatttgagaggttaatgaaagaattatcagagcagaagcttaagccctactcagatcatgtaaggaagac

SEQ ID NO: 58647 - DNA, 75 bp, Artificial Sequence
  Synthetic
ttcttcctttcgcccttttaattctttttttcatatacggtgacaaaatgctttggcctttcaaagttttttgta

SEQ ID NO: 58648 - DNA, 75 bp, Artificial Sequence
  Synthetic
aatcacaagttcattaaaaaaaacagacaagcaagcaggttctaagtgtgctgtaccaaggttgtggctagaaac

SEQ ID NO: 58649 - DNA, 75 bp, Artificial Sequence
  Synthetic
ggccatgtagaaggtgctgtagaaaaaatgaaggatacaacaaactggctgaagaagaagagctgagagacataa

SEQ ID NO: 58650 - DNA, 75 bp, Artificial Sequence
  Synthetic
actaatcagagacttgagggttcctacaaaggatgaggagattcttctcaacatacgcacaagtatgcaaagtaa

SEQ ID NO: 58651 - DNA, 75 bp, Artificial Sequence
  Synthetic
ttagaaagttcagtaaaagtggtgaacttatcaacaaagatgcaaaagataagagaactcttgcaagactattca

SEQ ID NO: 58652 - DNA, 75 bp, Artificial Sequence
  Synthetic
gaccaacttcatcagaaataatgataaactcattatcagaagtaataaggaaattgctgattacttagaaactaa

SEQ ID NO: 58653 - DNA, 75 bp, Artificial Sequence
  Synthetic
tgtctgacaacccaaaattaaaaaaggaaaaaaaactttctgaaattgcttaacaggtactaaaagctaggtgta

SEQ ID NO: 58654 - DNA, 75 bp, Artificial Sequence
  Synthetic
aaggaaaaatttgttgtcagaaaaggcctctgataaaatcttttcatctgattgtatacttttcaaagaggttat

SEQ ID NO: 58655 - DNA, 75 bp, Artificial Sequence
  Synthetic
ctcaccacaaccacctaaatcaagaagacctagtgaattttatatagttctaacttgctcacagtttaaagttct

SEQ ID NO: 58656 - DNA, 75 bp, Artificial Sequence
  Synthetic
tgcggaagctctcaggaggtactacagtactccctatgaaggtgtgccagaaacaatagtaaaactcatcaactt

SEQ ID NO: 58657 - DNA, 75 bp, Artificial Sequence
  Synthetic
tttaacttacttactctattaatccactatgcctgcttttgctaactctagttttaaaacttgctgtgccgccac

SEQ ID NO: 58658 - DNA, 75 bp, Artificial Sequence
  Synthetic
ctctattaatccactatgcctgcttttgctaactctagttttaaaacttgctgtgccgccacgctatctttgaga

SEQ ID NO: 58659 - DNA, 75 bp, Artificial Sequence
  Synthetic
tttgtgcacatttggttggtttcaggaggtagtcttatacagcaagatctgtgaaacttttttgagatgttgtac

SEQ ID NO: 58660 - DNA, 75 bp, Artificial Sequence
  Synthetic
agagtttagtagatcaggaattaaactggtaaaggtgagacactgcgacaccaacttatcaataaaactgccatc

SEQ ID NO: 58661 - DNA, 75 bp, Artificial Sequence
  Synthetic
accaaaaaagagtttgatgagtggttcaaaccttttagcgataagctccaattaagatcaaccctcacaaactcc

SEQ ID NO: 58662 - DNA, 75 bp, Artificial Sequence
  Synthetic
aaataaaaaagaaaacatgctctgctgtctttacgataagaacatgtccctcttaaaaggcccttttttcctaaa

SEQ ID NO: 58663 - DNA, 75 bp, Artificial Sequence
  Synthetic
gcatctctctgtgatagagtgcctgacttagctctagcagaaatgaaaatggcccttgctacagatgataaagaa

SEQ ID NO: 58664 - DNA, 75 bp, Artificial Sequence
  Synthetic
cagaagacaagcaattctcggcagtgcctatccttacatactaataactttgtacattcaagttctgcagcaaca

SEQ ID NO: 58665 - DNA, 75 bp, Artificial Sequence
  Synthetic
aaggactcaatcttttctaatgctctggtggaggcaacacgattctgtgctccaatctatgaatgtgcttggacc

SEQ ID NO: 58666 - DNA, 75 bp, Artificial Sequence
  Synthetic
cagatgtctagaagtgttaaacagtgttaatgacagagttgttggcaatattaacacctgcaccagcaatcttct

SEQ ID NO: 58667 - DNA, 75 bp, Artificial Sequence
  Synthetic
tgcagcacaggcgtggtgcagaaaagcttaagctggtttgacaagaacaaagacttcatcaagctctgggatgca

SEQ ID NO: 58668 - DNA, 75 bp, Artificial Sequence
  Synthetic
gaacacagttaaagcagaactaacactggtaaactctggactttttgaaaaagcatatgagtgtagaacagagca

SEQ ID NO: 58669 - DNA, 75 bp, Artificial Sequence
  Synthetic
aaatatatggatctcagaaagggaatccctgaaccagagcagctagtatcataccagcaagcagctcaaaagtgg

SEQ ID NO: 58670 - DNA, 75 bp, Artificial Sequence
  Synthetic
gtgtaggttaggaggcaactttttgaacagaagtagtagagaccatttcatttcaactgtatcaggccttaatgt

SEQ ID NO: 58671 - DNA, 75 bp, Artificial Sequence
  Synthetic
aggaaagacattggttatgagattaatcaattcacaaggtctctcacacatccggttgttgcagaatacaaggtg

SEQ ID NO: 58672 - DNA, 75 bp, Artificial Sequence
  Synthetic
tgtctacggtgcattgattaaagacaatctgctagctaattctcagccgcagaacaagcaattacagatgctcag

SEQ ID NO: 58673 - DNA, 75 bp, Artificial Sequence
  Synthetic
cctggagagattgctgttgatgtcaaggaaatgctatctgacatgatcagacgcagaaatgtcttgctgaatgga

SEQ ID NO: 58674 - DNA, 75 bp, Artificial Sequence
  Synthetic
atttggcatgttatgcgggctaagcagattgtccagcgctctagagctaggtaagaagttctctacaagctgcag

SEQ ID NO: 58675 - DNA, 75 bp, Artificial Sequence
  Synthetic
gatggagaaaatgcagggaaaaaaggtcctatcagcagagagcatgtctcttggggccgtgagctggcaggggga

SEQ ID NO: 58676 - DNA, 75 bp, Artificial Sequence
  Synthetic
aaggattgaggataacattatgagactgtatttgcagtcaacaatctactctgcaaacagagatgtaagtcagaa

SEQ ID NO: 58677 - DNA, 75 bp, Artificial Sequence
  Synthetic
aaattccaagttgtgtttaatcctccttggggagatataaacaagtgtggcaaatcaggcatccctctagcagcc

SEQ ID NO: 58678 - DNA, 75 bp, Artificial Sequence
  Synthetic
tgtgcaaaactggaagatgaaagatttatgccctgatattactatcccttgtttctcagtttatggtctctttgt

SEQ ID NO: 58679 - DNA, 75 bp, Artificial Sequence
  Synthetic
actgcaatggtgaaagttgcagagctggatgggtccaaaaaacttgaagatattaggcaggcccttctggatcta

SEQ ID NO: 58680 - DNA, 75 bp, Artificial Sequence
  Synthetic
taacagtgaccggcagcgcatattcgacatttacaatgtacatatttacaacaaagagatggacaactttgacga

SEQ ID NO: 58681 - DNA, 75 bp, Artificial Sequence
  Synthetic
aaaaaatggattgaggacaacaaggatgcactggaggatggaaaaggcaatgaactcattcagaccatgacaaag

SEQ ID NO: 58682 - DNA, 75 bp, Artificial Sequence
  Synthetic
ggggtgcattacagtcttagaggagacagctgaaaggcatatgctttgggaacttgaccttctaagatctttgga

SEQ ID NO: 58683 - DNA, 75 bp, Artificial Sequence
  Synthetic
cacctggctcaagcagtggaactgtccaagaagtccaatgcccttcgcgcacaaggagcacaaatagacactccc

SEQ ID NO: 58684 - DNA, 75 bp, Artificial Sequence
  Synthetic
gggagacactagggatgttcgagcagcaaggctcctgctaggttgtcccaatataaggaaggcaactgacaaaga

SEQ ID NO: 58685 - DNA, 75 bp, Artificial Sequence
  Synthetic
ttttcagccttttactgggcttggagcgccggagttaagccagagacttttttcactttgtctcaattcctcttt

SEQ ID NO: 58686 - DNA, 75 bp, Artificial Sequence
  Synthetic
tggaaacaggctaatgaaaaagggaattacagatgactggagggaagaagctggtagtgactcctctagtattag

SEQ ID NO: 58687 - DNA, 75 bp, Artificial Sequence
  Synthetic
gagatgggacaaagtgctagaggaggcaaaaaaatgatcaaagcactgacatccacaccactaaggtggggtaaa

SEQ ID NO: 58688 - DNA, 75 bp, Artificial Sequence
  Synthetic
tggcagaaggtcatatgcctcgagtggaaccagagtgaaaagcatgttcggcaaatacaattcttctcaaaaacc

SEQ ID NO: 58689 - DNA, 75 bp, Artificial Sequence
  Synthetic
ggattgattaacttgtttgcagatgatgacttttctggcaacagactatacatgcacccggcagttctaactcct

SEQ ID NO: 58690 - DNA, 75 bp, Artificial Sequence
  Synthetic
atttgagcttaagcctggtctagaagtggtaaatgaccctcttcatgattataagcaggctgtacaagatagctt

SEQ ID NO: 58691 - DNA, 75 bp, Artificial Sequence
  Synthetic
ggtcgaatgagtgagatgggtgcatgcttcggggttattcctgttgcaagcccagaggatgcaatcttgggctca

SEQ ID NO: 58692 - DNA, 75 bp, Artificial Sequence
  Synthetic
ctgttactcagaatacacccctaacacagaaagcgtgttaaaggactgcattcatataattagaacaaatccaag

SEQ ID NO: 58693 - DNA, 75 bp, Artificial Sequence
  Synthetic
ggacactcaaaaaacatattgaacttcaagattgacaccagtgtgcaaaacccatgtgcatcaacaatagtgcaa

SEQ ID NO: 58694 - DNA, 75 bp, Artificial Sequence
  Synthetic
tcacacaatgggttcatatgagttaattcaagcagtgacggaaaatgcgagacgaaaatatcctccagaaaatat

SEQ ID NO: 58695 - DNA, 75 bp, Artificial Sequence
  Synthetic
ctatacagaatccagaaatctggctttgatctggaaagcttagaggtcgtgtccactgaacaccttttgcaccaa

SEQ ID NO: 58696 - DNA, 75 bp, Artificial Sequence
  Synthetic
agaaagagcaagaaaggatcccaaaaactgggtcagcatatctgaggtcactgaaacaacaagcatcgtctcaca

SEQ ID NO: 58697 - DNA, 75 bp, Artificial Sequence
  Synthetic
tcatttgttggtaaaaggtgcccaactcagaatgcctacaaggtgagaggcaacgcaaccaatgttaacatcatc

SEQ ID NO: 58698 - DNA, 75 bp, Artificial Sequence
  Synthetic
acctagaacacattttatgctcaaagactgctataaagttctattaggaacagagaacaaaaaaattgtgaagat

SEQ ID NO: 58699 - DNA, 75 bp, Artificial Sequence
  Synthetic
taaaagctggcattgtgtggcctgccctaacactctaggcatgctgcacatcagcaaaaggtcacaaaaagtttt

SEQ ID NO: 58700 - DNA, 75 bp, Artificial Sequence
  Synthetic
gctgagaggtaagctcaagaaactaggtgcaatgaggacagatattgagataggaaagaaggattgtctagatct

SEQ ID NO: 58701 - DNA, 75 bp, Artificial Sequence
  Synthetic
ccttcttttatcttcatattccctttttctttatatattagttttgcttttttaactaacatactaaaatagtat

SEQ ID NO: 58702 - DNA, 75 bp, Artificial Sequence
  Synthetic
gttgacaactgttgatggtctgtctgaggaacagtgtaagaatatagtaaatggtatatttgagccttccaaact

SEQ ID NO: 58703 - DNA, 75 bp, Artificial Sequence
  Synthetic
aaatagtataagttgtaatcaatttgctaattctgcttaatacaggggggctgtgcggcaacgatctctttgaga

SEQ ID NO: 58704 - DNA, 75 bp, Artificial Sequence
  Synthetic
atctttctatcactggaaggatcttctaaagaaagaattaagtgaggttttactaactgatgatggtaactacat

SEQ ID NO: 58705 - DNA, 75 bp, Artificial Sequence
  Synthetic
ttattgctggctcaaaacattatcttcaatggtcaaacactcgttgaaaaaagacttgcggttcatgacaggtaa

SEQ ID NO: 58706 - DNA, 75 bp, Artificial Sequence
  Synthetic
aaattccttggatataaagccagaaatgttcacagacgaagaatattcagctctgaacattatgaagttagaatt

SEQ ID NO: 58707 - DNA, 75 bp, Artificial Sequence
  Synthetic
gttgggcgaacatactgatggaatacagggcaaaactgacttcctcttgagttcttggaaaaaatgtgccctaaa

SEQ ID NO: 58708 - DNA, 75 bp, Artificial Sequence
  Synthetic
gcccaaagaaggccagtcaatattaaatgtagggctaaatagtctggctgcactacatgatgagctctatgatat

SEQ ID NO: 58709 - DNA, 75 bp, Artificial Sequence
  Synthetic
tagattgcagcatcttgagctaacccgaataaagaaagagaacccaactgttagcttcacaaaagaagaaatttt

SEQ ID NO: 58710 - DNA, 75 bp, Artificial Sequence
  Synthetic
agtcaagcggcttgaaaaaggattcttaaacaagtataagaaagaggtgatggaggcagtcaatttaatctttta

SEQ ID NO: 58711 - DNA, 75 bp, Artificial Sequence
  Synthetic
ttgctgcttaacagcgccttggtgtctgcactacaaatcactagaggcataccttgtccgacacccagagatact

SEQ ID NO: 58712 - DNA, 75 bp, Artificial Sequence
  Synthetic
tgaaacagagtgcatcaaagaaaatgacatacctcttctagacttaactgtcaccagtctaattaggagcctcat

SEQ ID NO: 58713 - DNA, 75 bp, Artificial Sequence
  Synthetic
tgatgatattgaaggtgagtcaagctttaatgattcttcagatattaaagtccgctttgcagttaagtatttaat

SEQ ID NO: 58714 - DNA, 75 bp, Artificial Sequence
  Synthetic
aaccctgtttactgcaaatggagagccattttccctcagtttaaatgatggtgggctcaatgatgatcttcagtt

SEQ ID NO: 58715 - DNA, 75 bp, Artificial Sequence
  Synthetic
gacaactgatgagaagctactatatcaaacaaaaaaagtttttgctaaacttggcctctcaggaaataattatga

SEQ ID NO: 58716 - DNA, 75 bp, Artificial Sequence
  Synthetic
ttttatttggactttgcagatgattgccaacagcaattttaacgtgtgtaaaaggcttacaggcagaacaactgg

SEQ ID NO: 58717 - DNA, 75 bp, Artificial Sequence
  Synthetic
ggagaggttaccaagaagtgtaaggagcaaagtcatctacgaaatggttaagctagtaggggaaactggaatggc

SEQ ID NO: 58718 - DNA, 75 bp, Artificial Sequence
  Synthetic
aatactacagcagttagcattttctcaagccttgaactacgaccatagattttatgcagtcttggcacccaaagc

SEQ ID NO: 58719 - DNA, 75 bp, Artificial Sequence
  Synthetic
acaacttggtggctctcgagacttgctagttcaggaaacaggcactaaagtaattcatgccacaacagagatgtt

SEQ ID NO: 58720 - DNA, 75 bp, Artificial Sequence
  Synthetic
tagcaggaatttgcttaagacgacatctgacgatggccttacaaacccacatctgaaagaaacaagattaaacat

SEQ ID NO: 58721 - DNA, 75 bp, Artificial Sequence
  Synthetic
tggacttgacatgttaagtacagccagagcactggacgggaagcaggtttctgacgatagcaacctgttaaattt

SEQ ID NO: 58722 - DNA, 75 bp, Artificial Sequence
  Synthetic
ctttaagacagtctgcatatctggtgataacaccaagtggggcccaatccattgctgttcttttttttcaggtat

SEQ ID NO: 58723 - DNA, 75 bp, Artificial Sequence
  Synthetic
gatgcagcaactactcaaggatgttcaagactggagttcgttctacaagttgacatttattaaaaacttatgcag

SEQ ID NO: 58724 - DNA, 75 bp, Artificial Sequence
  Synthetic
gcaaattgagatccctgcacctagcattaggaaaatactgaatgtacttagattcaagctgagtgacaagggagg

SEQ ID NO: 58725 - DNA, 75 bp, Artificial Sequence
  Synthetic
tgtagaaaagctttcagaagaggccataaggtcagaattaatcaacaatctagcagaatgggaagggaacgatac

SEQ ID NO: 58726 - DNA, 75 bp, Artificial Sequence
  Synthetic
tgttaaatttttaataacaacctacatcagtaaaggcattatggcaatgaatagctacaaccatatgggacaggg

SEQ ID NO: 58727 - DNA, 75 bp, Artificial Sequence
  Synthetic
cattcatcatgccacttcttcattgttaacatccatgatggcagagacatttgaagaacttgctgttgattatat

SEQ ID NO: 58728 - DNA, 75 bp, Artificial Sequence
  Synthetic
gaagaagcattttccaggcctcacagtgaatgtagaccacgcaggaagttcagatgactatgctaagtgtataat

SEQ ID NO: 58729 - DNA, 75 bp, Artificial Sequence
  Synthetic
agtttctggtctggtttccaaagacatgtataaaaggtatgatggagttttttggagacacatgtgtagactcaa

SEQ ID NO: 58730 - DNA, 75 bp, Artificial Sequence
  Synthetic
aaatttcttagctgcggtacgacgctgctgtcagatgaaagatagtgcaaaaaccctagttggagattgtttctt

SEQ ID NO: 58731 - DNA, 75 bp, Artificial Sequence
  Synthetic
agagttttacagtgaatttatgatgggaaatcgagtaactccagcagtcattaaatttatatttacaggattaat

SEQ ID NO: 58732 - DNA, 75 bp, Artificial Sequence
  Synthetic
aaacagttctgtcacttctccccaaagcctggttcaggcttgtcatgtttctagtcaacagggcatgtacaatag

SEQ ID NO: 58733 - DNA, 75 bp, Artificial Sequence
  Synthetic
tgtccccttggtaacaaatgctgcttttacaattcttagacaacaaatcttttacaaccatgttgaggattttat

SEQ ID NO: 58734 - DNA, 75 bp, Artificial Sequence
  Synthetic
acaaatgtaacacccctacaatggatgctgaaagaattgtctttaaggtccgtaatcagctagtctctgtaaaac

SEQ ID NO: 58735 - DNA, 75 bp, Artificial Sequence
  Synthetic
cagaggtcatctctgatcagtatgagtacaaatatcctgctattactgataagaagaagcctagtatcacacttg

SEQ ID NO: 58736 - DNA, 75 bp, Artificial Sequence
  Synthetic
aagaagaagcctagtatcacacttggaagggctccggacttgaagacagcgtacaagtccatcttatcggggatg

SEQ ID NO: 58737 - DNA, 75 bp, Artificial Sequence
  Synthetic
aatgccgccaagctggatccagatgacgtatgttcatacttagcaggtgctatgattttgtttgagggtgtgtgt

SEQ ID NO: 58738 - DNA, 75 bp, Artificial Sequence
  Synthetic
acgtatgttcatacttagcaggtgctatgattttgtttgagggtgtgtgtcccgaagattgggttagttatggaa

SEQ ID NO: 58739 - DNA, 75 bp, Artificial Sequence
  Synthetic
actgggctcagacggggggtcaggaattaactagagatccaacaatctcagaacatgcatcattggtaggacttt

SEQ ID NO: 58740 - DNA, 75 bp, Artificial Sequence
  Synthetic
gaacatgcatcattggtaggacttttactttgcctatataggttaagcaaaattgtaggacagaacacagggaat

SEQ ID NO: 58741 - DNA, 75 bp, Artificial Sequence
  Synthetic
tactttgcctatataggttaagcaaaattgtaggacagaacacagggaattataagacgaatgtggctgaccgga

SEQ ID NO: 58742 - DNA, 75 bp, Artificial Sequence
  Synthetic
tggaacagatttttgaaactgctccattcgtcaagatagtcgagcaccacacattaatgaccactcacaaaatgt

SEQ ID NO: 58743 - DNA, 75 bp, Artificial Sequence
  Synthetic
gtgcgaattggagcacaatacccaattttagatttcttgcaggaacatatgacatgttcttctccagggtggatc

SEQ ID NO: 58744 - DNA, 75 bp, Artificial Sequence
  Synthetic
atttgtactcggctattagggttgggacggtagttactgcatatgaagattgttcaggtttagtctcctttactg

SEQ ID NO: 58745 - DNA, 75 bp, Artificial Sequence
  Synthetic
ggtttatcaagcagattaacttgaccgctagagaagccatattatacttctttcacaagaactttgaggaggaga

SEQ ID NO: 58746 - DNA, 75 bp, Artificial Sequence
  Synthetic
tcaaaagaatgtttgagcccggacaggagactgctgtgcctcactcctacttcatccactttagatccttaggtc

SEQ ID NO: 58747 - DNA, 75 bp, Artificial Sequence
  Synthetic
tgggtcaaatcagatcattaaacgctacagttatccaaagttgtgccccgcatgagatgtccgtattgggaggtt

SEQ ID NO: 58748 - DNA, 75 bp, Artificial Sequence
  Synthetic
atttgggagaggaattcttcggaaaggggacctttgagagacgattctttcgggacgagaaagagctgcaagact

SEQ ID NO: 58749 - DNA, 75 bp, Artificial Sequence
  Synthetic
atgaagaagcagaggccactaagattgaggctgcattggctgatgatggaactgtgaactccgacgatgaagact

SEQ ID NO: 58750 - DNA, 75 bp, Artificial Sequence
  Synthetic
actgtgaactccgacgatgaagactttttctccggagatacaagaagtccagaagctgtttacacaaggatcatg

SEQ ID NO: 58751 - DNA, 75 bp, Artificial Sequence
  Synthetic
ttttctccggagatacaagaagtccagaagctgtttacacaaggatcatgatgaacggagggcgattaaagggag

SEQ ID NO: 58752 - DNA, 75 bp, Artificial Sequence
  Synthetic
cacacataagaaggtacgtctctgtaagttctagtcaccaagcaagaccaaactcctttgcagagttcctcaaca

SEQ ID NO: 58753 - DNA, 75 bp, Artificial Sequence
  Synthetic
agacctactccagtgactccagataagactctgctcaaagcaaaacaatgaggcatcaattccgctcaattagac

SEQ ID NO: 58754 - DNA, 75 bp, Artificial Sequence
  Synthetic
atgaaaaaaactaacaccactccgctggtccatcaatcatcatgagcaagatttttatcaatcctagtgacattc

SEQ ID NO: 58755 - DNA, 75 bp, Artificial Sequence
  Synthetic
gatcaggacttgcagatcttgagatggctgaagagaccgtcgaattggtcaaccggaacatggaagacagtcaag

SEQ ID NO: 58756 - DNA, 75 bp, Artificial Sequence
  Synthetic
ctcatctccaaggggtccccatagatgtggagaccctccctgaggatattcagagactccacatcacagatcctc

SEQ ID NO: 58757 - DNA, 75 bp, Artificial Sequence
  Synthetic
aagccagcctccgacaggatatggttgatgagcaaaaacaccgggaggatgaggacttttaccttacaggaagag

SEQ ID NO: 58758 - DNA, 75 bp, Artificial Sequence
  Synthetic
gaggacttttaccttacaggaagagaaaaccctctttctccgtttcagacacatcttgatgctataggacttcgc

SEQ ID NO: 58759 - DNA, 75 bp, Artificial Sequence
  Synthetic
attgtgaggaagatgaagacaggggaaggttttttcaagatatggtcacaggcagtggaggacatcgtctcttat

SEQ ID NO: 58760 - DNA, 75 bp, Artificial Sequence
  Synthetic
ggcagtggaggacatcgtctcttatgtagcccttaacttctccattccagtgaacaagctgttcgaagacaagtc

SEQ ID NO: 58761 - DNA, 75 bp, Artificial Sequence
  Synthetic
aactcagactgttactgaaaagtctcaacaggcctctgcctcatcggctccaaatcggcatgagaaatcatctca

SEQ ID NO: 58762 - DNA, 75 bp, Artificial Sequence
  Synthetic
gagcgccagggtcaactccaaggatgcatcaggtcctgcagctctagactggactgccagcaatgaagcagatga

SEQ ID NO: 58763 - DNA, 75 bp, Artificial Sequence
  Synthetic
cgagtcagtcgaagctgagatagctcatcagattgcagaaagcttctctaaaaagtacaagttcccgtctagatc

SEQ ID NO: 58764 - DNA, 75 bp, Artificial Sequence
  Synthetic
ctcagggattttcttatggaactttgaacaattgaaaatgaacttggatgaaatagttcgggaggtcaaggaaat

SEQ ID NO: 58765 - DNA, 75 bp, Artificial Sequence
  Synthetic
tcccggagtgatcaagatggcgaaagacgggatgaagctgcctctcaggtgtatgctgggaggagtggcttctac

SEQ ID NO: 58766 - DNA, 75 bp, Artificial Sequence
  Synthetic
ccactctcgaaggttccagattctcgtgaatccggaaaaacttggaaaagttatgcaggaggatcttgacaaata

SEQ ID NO: 58767 - DNA, 75 bp, Artificial Sequence
  Synthetic
gtgaatccggaaaaacttggaaaagttatgcaggaggatcttgacaaatacctgacctattagattaggttctga

SEQ ID NO: 58768 - DNA, 75 bp, Artificial Sequence
  Synthetic
taatacacaagacaaccatctcattcagttgtagcatagtcatggaaaaaacatgcaacaccactgacaaaatga

SEQ ID NO: 58769 - DNA, 75 bp, Artificial Sequence
  Synthetic
acatcatccgtaagatagtaaaaagctgcaaagaggaggaggagcaaaagcccagtccggtttcagcccccccag

SEQ ID NO: 58770 - DNA, 75 bp, Artificial Sequence
  Synthetic
atgacgatgacctgtggcttccccctccagagtatgtccctctgtcagagatcgctaataagaagaacatgagga

SEQ ID NO: 58771 - DNA, 75 bp, Artificial Sequence
  Synthetic
tccagagtatgtccctctgtcagagatcgctaataagaagaacatgaggaatttctgtgtcaatggtgaaattaa

SEQ ID NO: 58772 - DNA, 75 bp, Artificial Sequence
  Synthetic
gaacagaagaatgattggactggttaaggtggtgattggattggccttgtcaggggcacctgtccctgatgggat

SEQ ID NO: 58773 - DNA, 75 bp, Artificial Sequence
  Synthetic
gaactgggtttacaaaattagacgcactttaatatttcaatgggcagactcatcaggccctcttgatggtgagga

SEQ ID NO: 58774 - DNA, 75 bp, Artificial Sequence
  Synthetic
acttgaatactctcaggaaataacttgggatgatgattccgagtttgtaggactgcaaataagagtgagtgcaag

SEQ ID NO: 58775 - DNA, 75 bp, Artificial Sequence
  Synthetic
acaatgtcatatccaagggagaatttggtgtatcaacatgaactcacgggcgtgtcaactctggtctgacatgtc

SEQ ID NO: 58776 - DNA, 75 bp, Artificial Sequence
  Synthetic
tctcaaaacccagcagtctgatgaagacaagaacacctctctcctgttggaatgactatctattaaaatcattgt

SEQ ID NO: 58777 - DNA, 75 bp, Artificial Sequence
  Synthetic
gcactgatagacactggtgacttccactcgtctccgcgagcaatagaacaacatatgttatggtgccacacaata

SEQ ID NO: 58778 - DNA, 75 bp, Artificial Sequence
  Synthetic
acatatgttatggtgccacacaatagctgcataacttcaaacttgtgatccagagccttcctaagtaagatctta

SEQ ID NO: 58779 - DNA, 75 bp, Artificial Sequence
  Synthetic
gctgcataacttcaaacttgtgatccagagccttcctaagtaagatcttagcaatgtgaaaaaaacaggcaacac

SEQ ID NO: 58780 - DNA, 75 bp, Artificial Sequence
  Synthetic
gcaatgtgaaaaaaacaggcaacacccctcaaggagttcaagcgccatgccactcaatgcagtcatctttactct

SEQ ID NO: 58781 - DNA, 75 bp, Artificial Sequence
  Synthetic
cactcaatgcagtcatctttactcttctcctcagatgttccatctgcctgggaaagtttccattttatacgatcc

SEQ ID NO: 58782 - DNA, 75 bp, Artificial Sequence
  Synthetic
ctgacaaattggggccatggagccctatagacatacatcatctcagttgcccaaataacttggttgtggaagacg

SEQ ID NO: 58783 - DNA, 75 bp, Artificial Sequence
  Synthetic
aaggatgtacaactctaacccctttttcatacatggagttaaaggtaggttacattacatcaataaaggtgtccg

SEQ ID NO: 58784 - DNA, 75 bp, Artificial Sequence
  Synthetic
gttttacctgcactggggtagtgactgaagctgagacttataccaatttcgttgggtatgtgacgacaacattta

SEQ ID NO: 58785 - DNA, 75 bp, Artificial Sequence
  Synthetic
gaagaagacatttccgtccatcagtcaactcttgtagagatgcatacaattggaagatcgcaggagaccctaggt

SEQ ID NO: 58786 - DNA, 75 bp, Artificial Sequence
  Synthetic
atgaagaatcactacacaacccttatccagactctcactggctcagaactgtcaagactacaaaagaatctcttt

SEQ ID NO: 58787 - DNA, 75 bp, Artificial Sequence
  Synthetic
gtcaagactacaaaagaatctcttttgataatctcccccagcgtggctgacatggatgcgtatgacaagaagctt

SEQ ID NO: 58788 - DNA, 75 bp, Artificial Sequence
  Synthetic
tactccaagattgtttccaacggaaggtgttcggaaatatctcctgggtcccctttctgtcccaccaatcatgaa

SEQ ID NO: 58789 - DNA, 75 bp, Artificial Sequence
  Synthetic
tacactatctggatgcccgagagctcaaaccccggaatatcctgtgacatattcacaagaagcatggggaagaaa

SEQ ID NO: 58790 - DNA, 75 bp, Artificial Sequence
  Synthetic
gccaccaaagatggacagttatgtgggtttgtagatgagagaggactgtacaaatctctgaagggagcttgtaga

SEQ ID NO: 58791 - DNA, 75 bp, Artificial Sequence
  Synthetic
ttaagactctgtgggatcagcggactgagactgatggacgggtcatgggtttcactcccacaggttaacaactca

SEQ ID NO: 58792 - DNA, 75 bp, Artificial Sequence
  Synthetic
gaatggtgctccccagaccaacttgttaacattcacgacttccattcagatgagatagagcatctcgtcgcagat

SEQ ID NO: 58793 - DNA, 75 bp, Artificial Sequence
  Synthetic
gtctagacgcccttgaaactatcctcttcaccaaatctataagtttccggcgtttaagccatcttcggaagctag

SEQ ID NO: 58794 - DNA, 75 bp, Artificial Sequence
  Synthetic
ttccaggctttggtaaggcatatactatcataaataggacccttatggaagcagaggctcattacaagtcagtgc

SEQ ID NO: 58795 - DNA, 75 bp, Artificial Sequence
  Synthetic
gggagtggaaggaaattattccatccaaggggtgtctgaaggcaggagggaggtgctatcctcatcacaatggaa

SEQ ID NO: 58796 - DNA, 75 bp, Artificial Sequence
  Synthetic
aggtgctatcctcatcacaatggaattttcttcaacgggatcattctgggtccgggaggggagatcttcattccg

SEQ ID NO: 58797 - DNA, 75 bp, Artificial Sequence
  Synthetic
gagatgcagtctgccttgctccaacagcacattgagctgttagagtcctctgtagttcccctcaaacaccccctg

SEQ ID NO: 58798 - DNA, 75 bp, Artificial Sequence
  Synthetic
gcagacccttcgactgtcttcaagaacgatgatgaagcggagagtttcgtagatgttcaccttcctgatacaaac

SEQ ID NO: 58799 - DNA, 75 bp, Artificial Sequence
  Synthetic
caaaaaatatctggaattgacttagggttgccagagtggaaacgttacttcctaataggagtctcagcagttgct

SEQ ID NO: 58800 - DNA, 75 bp, Artificial Sequence
  Synthetic
cctaataggagtctcagcagttgctttgttggctttatctataattatcgctgtctgttgcaaaaggttcaggaa

SEQ ID NO: 58801 - DNA, 75 bp, Artificial Sequence
  Synthetic
ttgttggctttatctataattatcgctgtctgttgcaaaaggttcaggaaaaggaagaaatccaaacccggtcca

SEQ ID NO: 58802 - DNA, 75 bp, Artificial Sequence
  Synthetic
gtagaattgactagaaaagtgtctgtcatatccaaaggaaatggaccggtcccttcctgggaatcttataaagaa

SEQ ID NO: 58803 - DNA, 75 bp, Artificial Sequence
  Synthetic
cccttcctgggaatcttataaagaaggaaccacaggagatgttcgtaatacgactccatcaacaagggagtgaga

SEQ ID NO: 58804 - DNA, 75 bp, Artificial Sequence
  Synthetic
ggccagatgatgcttgaggaggtccggatggatacattctttatgatttacctcatctcttaagagcggtacact

SEQ ID NO: 58805 - DNA, 75 bp, Artificial Sequence
  Synthetic
tgattgatataatgtttgaagatttacatcacattgtctgagaagacttaagagatcacaagaaagtttcatcat

SEQ ID NO: 58806 - DNA, 75 bp, Artificial Sequence
  Synthetic
ttgattttaacacccatccctccaataacgttggtgctcattacaatcaagacaaaatttgattagtagatggaa

SEQ ID NO: 58807 - DNA, 75 bp, Artificial Sequence
  Synthetic
tgacgcgggaatttgaaaggcaatcatggtcaatgatttatatatgctacattagtataatttccacctttgtgt

SEQ ID NO: 58808 - DNA, 75 bp, Artificial Sequence
  Synthetic
gttttgcacatttttgagggtacgcattagccttataactaacccagggggaggtgtgatgagatcttactacag

SEQ ID NO: 58809 - DNA, 75 bp, Artificial Sequence
  Synthetic
attagccttataactaacccagggggaggtgtgatgagatcttactacagatccattgcctcaatcaagatgaga

SEQ ID NO: 58810 - DNA, 75 bp, Artificial Sequence
  Synthetic
acacagagcttcggatttatggatgcgtgctcatgaaaaaaacatcacaaagaggaatagaaagaaaataaaaaa

SEQ ID NO: 58811 - DNA, 75 bp, Artificial Sequence
  Synthetic
gttaacacccctcctttgagcgatcatttttcagcatgctggagtccacagaggtgtacgatgaccctctggatc

SEQ ID NO: 58812 - DNA, 75 bp, Artificial Sequence
  Synthetic
atttttcagcatgctggagtccacagaggtgtacgatgaccctctggatcctgttgaaccggagtcagatctcaa

SEQ ID NO: 58813 - DNA, 75 bp, Artificial Sequence
  Synthetic
gacaaactccgtcgtaccaaacattttaagaaactcagactacaatctgaactctcccctcttagaagatccttc

SEQ ID NO: 58814 - DNA, 75 bp, Artificial Sequence
  Synthetic
aaaactgatgctcgagtggctgatgactggaaacaaaccacacagactcaacttgacagataacttgctcagatc

SEQ ID NO: 58815 - DNA, 75 bp, Artificial Sequence
  Synthetic
atacaaagtcttgaaaggatatttcaagagattggacacgggttcgttgagagttggttctgtagggtcccaagc

SEQ ID NO: 58816 - DNA, 75 bp, Artificial Sequence
  Synthetic
gatggtgaccctgtggctccatgggtcccattctgaatcaacaagaagtagaaaatgccttgcggagttgtctca

SEQ ID NO: 58817 - DNA, 75 bp, Artificial Sequence
  Synthetic
gttctacaaaaaatcagctccaatagagacattgctgaactgcacactggagaacaggggcttgagaacaccccc

SEQ ID NO: 58818 - DNA, 75 bp, Artificial Sequence
  Synthetic
ggaaggggttctgtcttgtcttgacaaagttcactatgatcaagcgttcgggcggtacctgggcaacacttattc

SEQ ID NO: 58819 - DNA, 75 bp, Artificial Sequence
  Synthetic
ttcatatctgttcttccatgtgatggttctgtatatgaacgccttagattgggatgaggaaaagaccattctatc

SEQ ID NO: 58820 - DNA, 75 bp, Artificial Sequence
  Synthetic
tctgtggagggatatctcctccatagacatcaagaatgacttagtgaagttcaaagatcagatatgggggacttt

SEQ ID NO: 58821 - DNA, 75 bp, Artificial Sequence
  Synthetic
ggttgtcacgaaggatttcatatactcccagagtgcaaattgtctatttgacaggaattacaccctcatgcttaa

SEQ ID NO: 58822 - DNA, 75 bp, Artificial Sequence
  Synthetic
agaccttttcctgtcccgcttcaactcatttctgatattgctctcacctccagaagcaagatattcagatgactt

SEQ ID NO: 58823 - DNA, 75 bp, Artificial Sequence
  Synthetic
agtatctaacttgtgtcaactttacatagcaggcgacagggtattgtctgtgtgtggaaactctggattcgacgt

SEQ ID NO: 58824 - DNA, 75 bp, Artificial Sequence
  Synthetic
aatcaagttgttagagccgtacatagtaaacaagttagtacaaagggcagagaggttccgtcctctcatacactc

SEQ ID NO: 58825 - DNA, 75 bp, Artificial Sequence
  Synthetic
tctgggggatttccctcaatttattaaagacaagacaacccagctcgaagggaccttcggccccagtgccaagga

SEQ ID NO: 58826 - DNA, 75 bp, Artificial Sequence
  Synthetic
gttcttccaaactatggactccctagacaatgtacatgacttggtgtttgtgtacggatgctatagacactgggg

SEQ ID NO: 58827 - DNA, 75 bp, Artificial Sequence
  Synthetic
ccatccatatatagactatagaagagggctgtctaaactgtatgatcaggtccacctcaagaagacaatagacaa

SEQ ID NO: 58828 - DNA, 75 bp, Artificial Sequence
  Synthetic
gagttatcaggagtgtttagccagtgacttagccaaaagaattctcagatgggggtttgataagtattccagatg

SEQ ID NO: 58829 - DNA, 75 bp, Artificial Sequence
  Synthetic
gacttagccaaaagaattctcagatgggggtttgataagtattccagatggtatgtagaccccaatttgttgcaa

SEQ ID NO: 58830 - DNA, 75 bp, Artificial Sequence
  Synthetic
aatgatcatcccctggttccatatgtgagaacccaaacatggcctccaaaacatgtggttgatgttgtgggagac

SEQ ID NO: 58831 - DNA, 75 bp, Artificial Sequence
  Synthetic
acatggcacaatctccccattacccagatatttgaaatacctgagtctatggacccctccgagattttagatgac

SEQ ID NO: 58832 - DNA, 75 bp, Artificial Sequence
  Synthetic
cagaggggggccggtccccagtgagaaggtcataatcacagccttgtccagacccccagtgaatcctagagagtt

SEQ ID NO: 58833 - DNA, 75 bp, Artificial Sequence
  Synthetic
cctcaggtctattgatgtcagtgggttgcctgatgatgatctaatcataggtctaaaaccaaaggaaagagaatt

SEQ ID NO: 58834 - DNA, 75 bp, Artificial Sequence
  Synthetic
gaagatagagggccgattcttcgcactcatgtcctggaatctgaggctttattttgtcatcacagagaagctttt

SEQ ID NO: 58835 - DNA, 75 bp, Artificial Sequence
  Synthetic
ggccacatacatcctgcctctatttgactctctaaccatgacagacaacctgaacaaagtcttcaaaaagttgat

SEQ ID NO: 58836 - DNA, 75 bp, Artificial Sequence
  Synthetic
cgacagagtgacaggacaagggttgttagactactcgcgagttacatatgcatttcatctcgactatgagaagtg

SEQ ID NO: 58837 - DNA, 75 bp, Artificial Sequence
  Synthetic
gaacaatcaccagagactagagtctaccatagatgtcttctcagttctagataaggtattcgggcttaaaaaagt

SEQ ID NO: 58838 - DNA, 75 bp, Artificial Sequence
  Synthetic
cttctctagaacccatgagttctttcaaaaatcctggatctattattctgacagatcagacctcattggcctgtg

SEQ ID NO: 58839 - DNA, 75 bp, Artificial Sequence
  Synthetic
gagagatcagatatactgcctagacatgagcaatggccccacatgctggaacggtcaggacggtggacttgaagg

SEQ ID NO: 58840 - DNA, 75 bp, Artificial Sequence
  Synthetic
tctaagacaaaaagggtggagtctagtaagtctcttaatgattgacagagaatcacaaacccgcaacacaagaac

SEQ ID NO: 58841 - DNA, 75 bp, Artificial Sequence
  Synthetic
gtaagtctcttaatgattgacagagaatcacaaacccgcaacacaagaaccaagattttggcacagggagacaat

SEQ ID NO: 58842 - DNA, 75 bp, Artificial Sequence
  Synthetic
caggtgttatgtcccacatatatgttgtctcctgggttgaacaaggaggggcttctctatgaactagacagcata

SEQ ID NO: 58843 - DNA, 75 bp, Artificial Sequence
  Synthetic
tctaggaatgccatctctatatatagggccattgaagatggagctgcaaagcttggtctgataatcaaaaaggaa

SEQ ID NO: 58844 - DNA, 75 bp, Artificial Sequence
  Synthetic
gcttggtctgataatcaaaaaggaagagacaatgtgcagttatgactttttgatttatgggaagacccctttgtt

SEQ ID NO: 58845 - DNA, 75 bp, Artificial Sequence
  Synthetic
tcgaggcaacatactggtgccagaatctaagcgatgggctagagtctcatgtatttccaacgatcagattgttaa

SEQ ID NO: 58846 - DNA, 75 bp, Artificial Sequence
  Synthetic
gtatttccaacgatcagattgttaatttggcaaacattatgtcgacggtatctaccaatgcattgactgtcgccc

SEQ ID NO: 58847 - DNA, 75 bp, Artificial Sequence
  Synthetic
agcactcccaatccttgataaaaccaatgagagatttccttttgatgtctgttcaagctgtctttcactatcttt

SEQ ID NO: 58848 - DNA, 75 bp, Artificial Sequence
  Synthetic
tatttagtccgatcttgaagaatagagtatacaaaatccttgtggctgatggaactgaattcttgctggcgatgt

SEQ ID NO: 58849 - DNA, 75 bp, Artificial Sequence
  Synthetic
caaggataatttatttggacccttccctgggtggggtctcagggatgtctctaggaaggttccacatccgccaat

SEQ ID NO: 58850 - DNA, 75 bp, Artificial Sequence
  Synthetic
cctgggtggggtctcagggatgtctctaggaaggttccacatccgccaattctctgatccggtgtccgagggctt

SEQ ID NO: 58851 - DNA, 75 bp, Artificial Sequence
  Synthetic
agttcctccgagacttggattcactccctgtgtcaagaagcagggaatccagatcttggtgaaaggagtttagaa

SEQ ID NO: 58852 - DNA, 75 bp, Artificial Sequence
  Synthetic
agtttcacgaggcttttagaagatccgactaccctgaatatcagaggaggggcaagtcccaccatcctactcaaa

SEQ ID NO: 58853 - DNA, 75 bp, Artificial Sequence
  Synthetic
ggcaagtcccaccatcctactcaaagaggcaatcagaaaagcattatacgacgaggtcgacaaagttgagaactc

SEQ ID NO: 58854 - DNA, 75 bp, Artificial Sequence
  Synthetic
agaattcagagaagcaatcttgctatccaaaactcaccgggacaactttatattgttcttaaggtctgtggagcc

SEQ ID NO: 58855 - DNA, 75 bp, Artificial Sequence
  Synthetic
tattgttcttaaggtctgtggagcctctgtttccaagatttctcagtgagttgttcagctcatctttcctgggca

SEQ ID NO: 58856 - DNA, 75 bp, Artificial Sequence
  Synthetic
ttgttcagctcatctttcctgggcatccctgagtcaatcataggtctcatccaaaattcaagaacaattaggaga

SEQ ID NO: 58857 - DNA, 75 bp, Artificial Sequence
  Synthetic
cagtttaggaagagtctatctcggactctagaggagtctttcttcagctcagagattcacggaatcagtcgagtg

SEQ ID NO: 58858 - DNA, 75 bp, Artificial Sequence
  Synthetic
acccaagtggctcaaaaaataggaagggtttggaggtgttccgcagagagggcagaccagctccgggaaatatcc

SEQ ID NO: 58859 - DNA, 75 bp, Artificial Sequence
  Synthetic
tggggcaggaaagttgtggggacaactgtccctcacccatccgagatgttgtccatgatacctaagtcgtccatc

SEQ ID NO: 58860 - DNA, 75 bp, Artificial Sequence
  Synthetic
tcctgcacctgtggacagctagaagatgacaatccccgtatctctgtgtccgtccttccgtccttcgaccaaact

SEQ ID NO: 58861 - DNA, 75 bp, Artificial Sequence
  Synthetic
atgacaatccccgtatctctgtgtccgtccttccgtccttcgaccaaacttttttctcccgagggcccctcaaag

SEQ ID NO: 58862 - DNA, 75 bp, Artificial Sequence
  Synthetic
cccttcctttcctcttgaggaggctccagtgttcaaaaggactggatctgctctgcatcgtttcaagtctgccag

SEQ ID NO: 58863 - DNA, 75 bp, Artificial Sequence
  Synthetic
atacagtgaagggggatactcttccatttgtcccaatctattgtcccacatctctgtgagtacagataccatgtc

SEQ ID NO: 58864 - DNA, 75 bp, Artificial Sequence
  Synthetic
atttgtcccaatctattgtcccacatctctgtgagtacagataccatgtcagatctcacgcaagatgggacaaac

SEQ ID NO: 58865 - DNA, 75 bp, Artificial Sequence
  Synthetic
tttgactttatgttccagcctttaatgctttatgcccaaacgtggacctctgagctggtccaaaaggacttgaga

SEQ ID NO: 58866 - DNA, 75 bp, Artificial Sequence
  Synthetic
tgagctggtccaaaaggacttgagactgaaggattccacattccattggcatctcagatgtgtcagatgtgtcag

SEQ ID NO: 58867 - DNA, 75 bp, Artificial Sequence
  Synthetic
gccccgaatgtcttctcctttccagatgtttctagaagaatatctcgaatggtatcaggggctgttcctcaattc

SEQ ID NO: 58868 - DNA, 75 bp, Artificial Sequence
  Synthetic
atgtttctagaagaatatctcgaatggtatcaggggctgttcctcaattccaaaaactgccagaaatctctttga

SEQ ID NO: 58869 - DNA, 75 bp, Artificial Sequence
  Synthetic
caaaaactgccagaaatctctttgaagccaggtaagttcgagaccctcagtgggaaagatcaatccaaacacatt

SEQ ID NO: 58870 - DNA, 75 bp, Artificial Sequence
  Synthetic
gggacagcccagggtctcttgtactctatattggcggctatccatgattcagggtacaatgatggaaccgttttc

SEQ ID NO: 58871 - DNA, 75 bp, Artificial Sequence
  Synthetic
ccagtcaacatatacaagagagtgtctcccagagactatctcagagggttagcgagaggtgtcttgatagggtcc

SEQ ID NO: 58872 - DNA, 75 bp, Artificial Sequence
  Synthetic
tccatttgcttcttaacccggatgaccagcattaacatcaatcgcccgttggagctgatttctggagtcatctct

SEQ ID NO: 58873 - DNA, 75 bp, Artificial Sequence
  Synthetic
ggagctgatttctggagtcatctcttacattttgttgagactcgacaaccacccctccctgtatgtcatgttgaa

SEQ ID NO: 58874 - DNA, 75 bp, Artificial Sequence
  Synthetic
tacattttgttgagactcgacaaccacccctccctgtatgtcatgttgaaagaaccctctctcaggcttgagata

SEQ ID NO: 58875 - DNA, 75 bp, Artificial Sequence
  Synthetic
ttttccatccctcaaaaaatacccgctgcgtatccgacaaccatgaaggagggcaacaggtctgtcttatgctat

SEQ ID NO: 58876 - DNA, 75 bp, Artificial Sequence
  Synthetic
ctgcaacatgtgctgagatatgaaagagaagccataacagcatcaccagagtgcgactggttgtggattttctct

SEQ ID NO: 58877 - DNA, 75 bp, Artificial Sequence
  Synthetic
gagaagccataacagcatcaccagagtgcgactggttgtggattttctctgatttcagaagcattaagatgactt

SEQ ID NO: 58878 - DNA, 75 bp, Artificial Sequence
  Synthetic
atttaactctgatcacatatcagtctcaccttttactgcaaaaaatagataggaacttatcaaagcagatgagag

SEQ ID NO: 58879 - DNA, 75 bp, Artificial Sequence
  Synthetic
tccagttgaggcaactgaattccctgatgagacaggtgttaggtgggcatggagaaggctctttagactctgctg

SEQ ID NO: 58880 - DNA, 75 bp, Artificial Sequence
  Synthetic
acgacattcacgggttgttaagagacgctctacaacgaacacgatgggttgaccaggaggtccgccatgcagcca

SEQ ID NO: 58881 - DNA, 75 bp, Artificial Sequence
  Synthetic
aggcgatgaaatgtgactacagtcctcaaaagagatcatcaaggaaagctagtagttctgaatggatatgctcag

SEQ ID NO: 58882 - DNA, 75 bp, Artificial Sequence
  Synthetic
ctcaacagattgccatatcgacctcttcaaatcctgccccgacatctgagattgatatcagagcattgtctagga

SEQ ID NO: 58883 - DNA, 75 bp, Artificial Sequence
  Synthetic
agttgcaaaatcctcttatttctggccttcgagttgttcaatgggctactggagcccattataagcttaaaccga

SEQ ID NO: 58884 - DNA, 75 bp, Artificial Sequence
  Synthetic
tcctcaacgagctagatacatatcccacattgtgtttggtagtgggtgatggttccgggggaatttcaagggcag

SEQ ID NO: 58885 - DNA, 75 bp, Artificial Sequence
  Synthetic
tgctgagcatgttccctgatgctaaattagtttttaatagtctcttggaggtcagtgacttgatggcttcaggga

SEQ ID NO: 58886 - DNA, 75 bp, Artificial Sequence
  Synthetic
tctcgagttattgacttccagtccatctgggagaagccttcagatttgagaaacccatcaacttggaggtatttc

SEQ ID NO: 58887 - DNA, 75 bp, Artificial Sequence
  Synthetic
caaagtgtccaacaaaccaccaacatgtcatatgatctgataatttgtgatgcagaagttacagacatttcctcg

SEQ ID NO: 58888 - DNA, 75 bp, Artificial Sequence
  Synthetic
tacgggacaatgttggttaatccagactacagggctattcagcatctctctagggcattcccttcagcagcaggg

SEQ ID NO: 58889 - DNA, 75 bp, Artificial Sequence
  Synthetic
tatataacgcaggtgacctcttcattctcttcagaactttacttgaagttctcaaagcgagggaagttttttaga

SEQ ID NO: 58890 - DNA, 75 bp, Artificial Sequence
  Synthetic
gaccctgagcatttaacatcatctaccttgagagaaatgagcctggtgctctttaattgcagcagctccaagagc

SEQ ID NO: 58891 - DNA, 75 bp, Artificial Sequence
  Synthetic
ccttgagagaaatgagcctggtgctctttaattgcagcagctccaagagcgagatgctgagagcaagatcattaa

SEQ ID NO: 58892 - DNA, 75 bp, Artificial Sequence
  Synthetic
actatcaagatcttgtgaggggatttccagaagaaatcatatcaaatccatacaatgagatgataataaccctca

SEQ ID NO: 58893 - DNA, 75 bp, Artificial Sequence
  Synthetic
tagataacgatgtagagtcattccttgttcacaagatgattgatgacctggagcttcaacgaggggcgttctcca

SEQ ID NO: 58894 - DNA, 75 bp, Artificial Sequence
  Synthetic
aactgtcaatcatactaaccatcatggtggtgttttctaatagagtgttcaatgtgtctaagcctttgacagaca

SEQ ID NO: 58895 - DNA, 75 bp, Artificial Sequence
  Synthetic
ggtggtgttttctaatagagtgttcaatgtgtctaagcctttgacagacactaagttttacccaccgtcagaccc

SEQ ID NO: 58896 - DNA, 75 bp, Artificial Sequence
  Synthetic
gaagatcttgaaacacttcaatatctgttgtagcactctcttgtacttatcagttgctttgggtgatgtcctcaa

SEQ ID NO: 58897 - DNA, 75 bp, Artificial Sequence
  Synthetic
cagttgctttgggtgatgtcctcaactttgcccgactccatgaactttacaacaaccctataacatattatttta

SEQ ID NO: 58898 - DNA, 75 bp, Artificial Sequence
  Synthetic
ctttgcccgactccatgaactttacaacaaccctataacatattattttaggaagcaagtgataggagggagaat

SEQ ID NO: 58899 - DNA, 75 bp, Artificial Sequence
  Synthetic
cttgcaactcaaatctgagtctgtcatctcactggattcggctgatctataaagtcgtcaaaacaacaagactca

SEQ ID NO: 58900 - DNA, 75 bp, Artificial Sequence
  Synthetic
ctggaagccccaaggacctgtctcgagagatggaaagacatctaaagagctacaacagatggatcaactttgatg

SEQ ID NO: 58901 - DNA, 75 bp, Artificial Sequence
  Synthetic
aaaaacattcgaaacattctgtacttctgccctcttgactcattttgtgtcttgtttgttttttttgttaagcgt

SEQ ID NO: 58902 - DNA, 75 bp, Artificial Sequence
  Synthetic
acgcttaacaacaaaatcataaaaggggcagacatgttcatttgtataacacaaatgtaacacccctacaatgga

SEQ ID NO: 58903 - DNA, 75 bp, Artificial Sequence
  Synthetic
aagaagaagcctagtatcacacttggaagggctccggacttgaagacagcatacaagtccatcttgtcggggatg

SEQ ID NO: 58904 - DNA, 75 bp, Artificial Sequence
  Synthetic
tccacattgcccggaaaggcgataaaataacccctgctacgttagttgacatagttagaacaaatacagagggta

SEQ ID NO: 58905 - DNA, 75 bp, Artificial Sequence
  Synthetic
ttagcggcaagtctccttactcctccaatgctgtcggacatgtgttcaacttgatccattttgtaggttgttaca

SEQ ID NO: 58906 - DNA, 75 bp, Artificial Sequence
  Synthetic
ttttctccggagatacgagaagtccagaagctgtttacacaaggatcatgatgaacggagggcggttaaaggggg

SEQ ID NO: 58907 - DNA, 75 bp, Artificial Sequence
  Synthetic
cacccagactgttactgaaaagtctcaacaggcctctgcctcgtcggctccaaatcggcatgagaaatcatctca

SEQ ID NO: 58908 - DNA, 75 bp, Artificial Sequence
  Synthetic
agtgtgtagtccgaacgggtattcttttcgaattcttaggcacatcttaagatcctttgaaggggtatattcagg

SEQ ID NO: 58909 - DNA, 75 bp, Artificial Sequence
  Synthetic
cactcaatgcagtcatctttactcttctcctcagatgttccatctgccttggaaagtttcccatttatacgatcc

SEQ ID NO: 58910 - DNA, 75 bp, Artificial Sequence
  Synthetic
catggatgcttatgacaagaagctttactccaagatgtttcctaacggaaggtgttcggaaatatctcctggttc

SEQ ID NO: 58911 - DNA, 75 bp, Artificial Sequence
  Synthetic
tactccaagatgtttcctaacggaaggtgttcggaaatatctcctggttcccccttttgtcccaccaatcacgaa

SEQ ID NO: 58912 - DNA, 75 bp, Artificial Sequence
  Synthetic
gaatggtgctccccagaccaactcgtcaacattcacgacttccattcagatgagatagagcatcttgtcgcagat

SEQ ID NO: 58913 - DNA, 75 bp, Artificial Sequence
  Synthetic
gagttggtgaaaaagagagaggattgtctagacgcccttgaaactatcatcttcaccaaatctataagtttccgg

SEQ ID NO: 58914 - DNA, 75 bp, Artificial Sequence
  Synthetic
gtctagacgcccttgaaactatcatcttcaccaaatctataagtttccggcggttaagccgtcttcggaagctgg

SEQ ID NO: 58915 - DNA, 75 bp, Artificial Sequence
  Synthetic
aggtgctatcctcatcacaatggaattttcttcaacgggatcattctgggtccgggaggggagatcttgatccct

SEQ ID NO: 58916 - DNA, 75 bp, Artificial Sequence
  Synthetic
ttgttggctttatctataattatcgctgtctgttgcaaaaggttcaggaaaaggaggaaatccaaacccagtcca

SEQ ID NO: 58917 - DNA, 75 bp, Artificial Sequence
  Synthetic
ggaaccacaggagatgttcgtaatacgactccatcaacaagggagtgagaggccggatgatgcttgaggatgtcc

SEQ ID NO: 58918 - DNA, 75 bp, Artificial Sequence
  Synthetic
agatggatacattctttatgatttacctcatcacttaagagcggtacacttgattgatataatgtttgaagattt

SEQ ID NO: 58919 - DNA, 75 bp, Artificial Sequence
  Synthetic
agagatcacaagaaagtttcatcattatccattgatttctgctgcatagcgaggttgatttgtgccaaagattgt

SEQ ID NO: 58920 - DNA, 75 bp, Artificial Sequence
  Synthetic
gaggttgatttgtgccaaagattgtttgattttaacacccacccctccaataacgttggtgctcattacgatcaa

SEQ ID NO: 58921 - DNA, 75 bp, Artificial Sequence
  Synthetic
taacgttggtgctcattacgatcaagacaaaatttaattagtagatggagtgacgcgggaatttgaaaggcaatc

SEQ ID NO: 58922 - DNA, 75 bp, Artificial Sequence
  Synthetic
cgtgctcatgaaaaaaacatcacaaagaggaatagaaagaaaataaaaaaagttaacacccctcctttgagcgat

SEQ ID NO: 58923 - DNA, 75 bp, Artificial Sequence
  Synthetic
agaggtgtacgatgaccctctggatcctgttgaaccggagttcgatctcaagacaaactccgtcgtaccaaacat

SEQ ID NO: 58924 - DNA, 75 bp, Artificial Sequence
  Synthetic
caagtcacactcatttacaagaaccaagctagcttcttggctttctgaacacagaggggggccggtccccagtga

SEQ ID NO: 58925 - DNA, 75 bp, Artificial Sequence
  Synthetic
atttggcaaacataatgtcgacggtatctaccaatgcattgactgttgcccagcactcccaatccctgataaaac

SEQ ID NO: 58926 - DNA, 75 bp, Artificial Sequence
  Synthetic
tccctgtgtcaagaagcagggaatccagatcttggtgaaaggagtttagagagtttcacgaggctcttagaagat

SEQ ID NO: 58927 - DNA, 75 bp, Artificial Sequence
  Synthetic
atccctgagtctatcattggtctcatccaaaactcaagaacaattagaagacagtttaggaagagtctatctcgg

SEQ ID NO: 58928 - DNA, 75 bp, Artificial Sequence
  Synthetic
gatgacaatccccgtatctctgtgtcagtccttccgtccttcgaccaaacttttttctcccgagggcctctcaaa

SEQ ID NO: 58929 - DNA, 75 bp, Artificial Sequence
  Synthetic
ggttatttgggttcttccacctctatgtccactcagttgttccatgcatgggaaaaagtcacaaacgttcatgtg

SEQ ID NO: 58930 - DNA, 75 bp, Artificial Sequence
  Synthetic
gtcaagagagccctatctcttaaggaatcaatcaactggttcatatcgagagactctaatttggcgcacacattg

SEQ ID NO: 58931 - DNA, 75 bp, Artificial Sequence
  Synthetic
agactctaatttggcgcacacattgattcgtaatattgtatctctgactggcccttcctttcctcttgaggaggc

SEQ ID NO: 58932 - DNA, 75 bp, Artificial Sequence
  Synthetic
acacacccattacctccctccgcgttggtaagtggaggagaggatatcatatctcgagttattgacttccagtcc

SEQ ID NO: 58933 - DNA, 75 bp, Artificial Sequence
  Synthetic
gatcaacaagataaccttgttaatgtctgatttctccctgtcgatcaatggtcctctgagtttaattttcaagac

SEQ ID NO: 58934 - DNA, 75 bp, Artificial Sequence
  Synthetic
ttacgggacaatgttggttaatcctgactacagggctattcagcatctctctagggcattcccttcagcagcagg

SEQ ID NO: 58935 - DNA, 75 bp, Artificial Sequence
  Synthetic
tgtatttggcctggagctggtcacacagtacatcggtctttaagagagttgcttgcaactcaaatctgagtctgt

SEQ ID NO: 58936 - DNA, 75 bp, Artificial Sequence
  Synthetic
ccgcgcactggattcggctgatctataaagtcgtcaagacaacaagactcactggaggccccaaggacctgtctc

SEQ ID NO: 58937 - DNA, 75 bp, Artificial Sequence
  Synthetic
aaaaaacatttgaaacattctgtacttctgcccccttgactcattttgtgtcttgtttgttttttttgttaagcg

SEQ ID NO: 58938 - DNA, 75 bp, Artificial Sequence
  Synthetic
aaaaacatttgaaacattctgtacttctgcccccttgactcattttgtgtcttgtttgttttttttgttaagcgt

SEQ ID NO: 58939 - DNA, 75 bp, Artificial Sequence
  Synthetic
acgcttaacaacaaaatcagagaaggggcagacatgttcatttgtataacacaaatgtaacacccctacaatgga

SEQ ID NO: 58940 - DNA, 75 bp, Artificial Sequence
  Synthetic
tgccgaaagaattgtctttaaagtccgtaatcagctagtctctgtgaaaccggaggtcatctcagatcagtatga

SEQ ID NO: 58941 - DNA, 75 bp, Artificial Sequence
  Synthetic
gtataagtatcctgctattactgacaagaagaagccaagtatcacacttggaagggctccagatttaaagacagc

SEQ ID NO: 58942 - DNA, 75 bp, Artificial Sequence
  Synthetic
atacaagtccatcctatcgggaatgaatgctgcaaagctggacccggatgacgtgtgttcatacctagcaggtgc

SEQ ID NO: 58943 - DNA, 75 bp, Artificial Sequence
  Synthetic
catggttttatttgagggagtgtgtcccgaagactggtttagttatgggatccatattgcccggaaaggtgacaa

SEQ ID NO: 58944 - DNA, 75 bp, Artificial Sequence
  Synthetic
aataaccccggctacgttagttgatatagttagaacaaatacagagggtaactgggctcaaacaggaggtcaaga

SEQ ID NO: 58945 - DNA, 75 bp, Artificial Sequence
  Synthetic
cctgactagagatccaactatctccgaacatgcatcattggtaggactcttgctctgcctatataggttgagcaa

SEQ ID NO: 58946 - DNA, 75 bp, Artificial Sequence
  Synthetic
aatcgtaggacaaaatacagggaattacaagacgaatgtggcagacaggatggaacagatttttgaaaccgcccc

SEQ ID NO: 58947 - DNA, 75 bp, Artificial Sequence
  Synthetic
atttgttaagatagtcgaacaccacaccttgatgaccactcacaaaatgtgtgccaattggagcacaatacccaa

SEQ ID NO: 58948 - DNA, 75 bp, Artificial Sequence
  Synthetic
ttttagatttcttgcagggacttatgacatgtttttctctagggtggaccatttgtactcggcgattagggttgg

SEQ ID NO: 58949 - DNA, 75 bp, Artificial Sequence
  Synthetic
gacggtagtcactgcatatgaagattgttcaggtttagtctcctttaccgggttcatcaagcagattaatttgac

SEQ ID NO: 58950 - DNA, 75 bp, Artificial Sequence
  Synthetic
tgccagagaagctatattatacttctttcataagaactttgaggaggaaatcaaaagaatgtttgaacccggaca

SEQ ID NO: 58951 - DNA, 75 bp, Artificial Sequence
  Synthetic
ggagactgctgtacctcactcttatttcattcacttcagatccttgggtcttagcggcaagtctccttactcctc

SEQ ID NO: 58952 - DNA, 75 bp, Artificial Sequence
  Synthetic
caatgctgttggacatgtattcaacttgattcattttgtgggttgttacatgggtcaaattagatcgttaaacgc

SEQ ID NO: 58953 - DNA, 75 bp, Artificial Sequence
  Synthetic
tactgtcatccaaagttgtgccccacatgagatgtccgtgttgggaggttatttaggagaggaattcttcggaaa

SEQ ID NO: 58954 - DNA, 75 bp, Artificial Sequence
  Synthetic
ggggacttttgagagacggttctttcgggatgagaaagagctacaagactatgaagaagcagaggccactaagat

SEQ ID NO: 58955 - DNA, 75 bp, Artificial Sequence
  Synthetic
tgaggctgcattggctgatgatggaactgtgaactctgacgacgaagactttttctccggagatacacgaagtcc

SEQ ID NO: 58956 - DNA, 75 bp, Artificial Sequence
  Synthetic
agaagctgtttatacaaggatcatgatgaatggggggcggctaaaaggggcacatataagaaggtatgtctctgt

SEQ ID NO: 58957 - DNA, 75 bp, Artificial Sequence
  Synthetic
gagttctagtcaccaggcaagaccaaactcctttgcagagttcctcaacaagacctattctagtgactccagata

SEQ ID NO: 58958 - DNA, 75 bp, Artificial Sequence
  Synthetic
aaactctgccccagactaaataatgggacatcaatcctgctcaattgggcatgaaaaaaactaacaccactccgc

SEQ ID NO: 58959 - DNA, 75 bp, Artificial Sequence
  Synthetic
tggtccatcaatcatcatgagcaagattttcatcaatcctagtgatattcgatcaggacttgctgatcttgagat

SEQ ID NO: 58960 - DNA, 75 bp, Artificial Sequence
  Synthetic
ggctgaagagacagtcgatttggtcaaccggaacatggaagatagtcaggctcatctccaaggagttcctataga

SEQ ID NO: 58961 - DNA, 75 bp, Artificial Sequence
  Synthetic
tgtggagaccctccctgaagatattcgaagactccatatcaccgatcctcaagccagtctcagacaggagatgat

SEQ ID NO: 58962 - DNA, 75 bp, Artificial Sequence
  Synthetic
tgaggagcaaaaacatcaagaggatgaggacttttatcttacagaaagagaaaaccctctgtcttcgtttcagac

SEQ ID NO: 58963 - DNA, 75 bp, Artificial Sequence
  Synthetic
gaggacttttatcttacagaaagagaaaaccctctgtcttcgtttcagacgcatcttgatgctgtaggacttcga

SEQ ID NO: 58964 - DNA, 75 bp, Artificial Sequence
  Synthetic
gtagccctcaacttctccattccagtgaacaagctttttgaagataagtccactcagactgtcactgaaaagtct

SEQ ID NO: 58965 - DNA, 75 bp, Artificial Sequence
  Synthetic
caacaggtctctgcctcgtcggctcccagtcgacatgacaaatcatctcaaggtgccagggtcgactccaaagat

SEQ ID NO: 58966 - DNA, 75 bp, Artificial Sequence
  Synthetic
gcatcaggtcctccagctttagactggactgtcagtaatgaagcagatgacgagtcagttgaagctgagatagct

SEQ ID NO: 58967 - DNA, 75 bp, Artificial Sequence
  Synthetic
catcagattgcagaaagtttctctaaaaagtacaagttcccatctagatcctcagggattttcttatggaacttt

SEQ ID NO: 58968 - DNA, 75 bp, Artificial Sequence
  Synthetic
gaacagttgaaaatgaatctagatgaaatagttcgagaggtcaaggaaattcccggagtgatcaagatggcgaaa

SEQ ID NO: 58969 - DNA, 75 bp, Artificial Sequence
  Synthetic
gatgggatgaagctgcctcttagatgtatgttggggggggtggcttccacccactcccgaaggttccaaattctc

SEQ ID NO: 58970 - DNA, 75 bp, Artificial Sequence
  Synthetic
gtgaacccagaaaaacttgggaaagttatgcaggaggaccttgacaaataccttacctattagattgagttttga

SEQ ID NO: 58971 - DNA, 75 bp, Artificial Sequence
  Synthetic
aaacacacatgatgatcatttaatccaattgtagcacagccatgaaaagaacatgtaacaccactgacaaaatga

SEQ ID NO: 58972 - DNA, 75 bp, Artificial Sequence
  Synthetic
acatcatccgtaagatagtaaagagctgcaaagaagaggacgagcaaaagcccagtccggtttcagccccccctg

SEQ ID NO: 58973 - DNA, 75 bp, Artificial Sequence
  Synthetic
atgacgatgatctctggcttccccctccagagtatgtccctctgtcagagattactaataagaagaacatgagaa

SEQ ID NO: 58974 - DNA, 75 bp, Artificial Sequence
  Synthetic
atttctgtgtcaacggtgaaattaaagtgtgtagcccgaacgggtattcttttcggattcttagacacatcttga

SEQ ID NO: 58975 - DNA, 75 bp, Artificial Sequence
  Synthetic
gatcctttgagggggtatattcagggaatagaagaatgattggactggtcaaagtggtgatcggattggccttgt

SEQ ID NO: 58976 - DNA, 75 bp, Artificial Sequence
  Synthetic
gaatagaagaatgattggactggtcaaagtggtgatcggattggccttgtcaggggcacctgttcctgatgggat

SEQ ID NO: 58977 - DNA, 75 bp, Artificial Sequence
  Synthetic
acttgaatactctcaggaaataacttgggatgatgattctgagtttgtaggattacaaataagagtgagtgcgag

SEQ ID NO: 58978 - DNA, 75 bp, Artificial Sequence
  Synthetic
acagtgtcatattcaagggagaatctggtgtatcaacatgaactcacgagcgtgtcaactttggtccgacatgtc

SEQ ID NO: 58979 - DNA, 75 bp, Artificial Sequence
  Synthetic
tctcaaaacccagcagtctgatgaagacaagaacacctctctcctgttggaatgactatctatttaaaatcattg

SEQ ID NO: 58980 - DNA, 75 bp, Artificial Sequence
  Synthetic
tgcactgatagacactggtgacttccactcgtctctgcgagcaatagaacaacatacgttatggtgccacacaat

SEQ ID NO: 58981 - DNA, 75 bp, Artificial Sequence
  Synthetic
cccctcaaggagttcaagcgccatgcctctcaatgcagtcatccttgcctttttcctcagatgttccatctgctt

SEQ ID NO: 58982 - DNA, 75 bp, Artificial Sequence
  Synthetic
tgggaagtttcccatttatacaatccctgacaagttggggccttggagccctatagacatacatcatcttagttg

SEQ ID NO: 58983 - DNA, 75 bp, Artificial Sequence
  Synthetic
cccaaacaacttagttgtggaagacgaaggatgtacaaccctcacccctttctcatacatggagttaaaggtagg

SEQ ID NO: 58984 - DNA, 75 bp, Artificial Sequence
  Synthetic
ttacataacatcaataaaagtatccggtttcacatgcactggggtagtgactgaagctgagacttacacaaactt

SEQ ID NO: 58985 - DNA, 75 bp, Artificial Sequence
  Synthetic
cgttgggtatgtgacgacaacctttagaagaagacacttccgtccatcagtcaactcttgtagagatgcatacaa

SEQ ID NO: 58986 - DNA, 75 bp, Artificial Sequence
  Synthetic
ttggaagattgcaggagaccctagatatgaagaatcgctacacaacccttatccagactctcactggctcagaac

SEQ ID NO: 58987 - DNA, 75 bp, Artificial Sequence
  Synthetic
cgtcaagactacaaaagaatctctcttaataatctctcccagtgtggctgatatggatgcctatgacaagaaact

SEQ ID NO: 58988 - DNA, 75 bp, Artificial Sequence
  Synthetic
ttattctaaaatgtttcccaatggaaggtgtccagaaatatctccaggatctcccttctgtcccaccaaccatga

SEQ ID NO: 58989 - DNA, 75 bp, Artificial Sequence
  Synthetic
atacaccctctggatgcctgagagctcaaaccccggaatatcttgtgacatattcacaagaagtatggggaagaa

SEQ ID NO: 58990 - DNA, 75 bp, Artificial Sequence
  Synthetic
agccaccaaaaatggacagttgtgtggttttgtggatgagagaggattgtacaaatccttaaagggggcttgtag

SEQ ID NO: 58991 - DNA, 75 bp, Artificial Sequence
  Synthetic
attgagactctgtggaataagtgggctgagactgatggacggatcatgggtttcactcccacaggtgaacaactc

SEQ ID NO: 58992 - DNA, 75 bp, Artificial Sequence
  Synthetic
agaatggtgctccccagaccaactcgtcaacattcatgacttccatgcagatgagatggagcatctcatcgccga

SEQ ID NO: 58993 - DNA, 75 bp, Artificial Sequence
  Synthetic
cgagttggtgaaaaagagagaggaatgtctagacgcccttgaaactatcatctttaccaagtctataagtttccg

SEQ ID NO: 58994 - DNA, 75 bp, Artificial Sequence
  Synthetic
gcggttgagctatcttcgaaagctagttcccggctttgggaaagcatacactatcataaacaagactcttatgga

SEQ ID NO: 58995 - DNA, 75 bp, Artificial Sequence
  Synthetic
agcagaggctcattataagacagtgagagaatggaaagaaatcattccatccaaagggtgtctaaaggcaggagg

SEQ ID NO: 58996 - DNA, 75 bp, Artificial Sequence
  Synthetic
gaggtgttacccccatcacaatggaatcttctttaatgggattatcctgggtccgggaggagagatcttaatccc

SEQ ID NO: 58997 - DNA, 75 bp, Artificial Sequence
  Synthetic
agagatgcagtctgccttactccagcagcacattgagctgttagagtcctccgtggttcccctgatacacccctt

SEQ ID NO: 58998 - DNA, 75 bp, Artificial Sequence
  Synthetic
ggcagacccttcgactgtcttcaagaatgatgacgaggcagagaatttcgtagaagttcaccttcctgatacaaa

SEQ ID NO: 58999 - DNA, 75 bp, Artificial Sequence
  Synthetic
ccaaaaaatatctggaattgacttagggctgccagagtggaaacgttactttctgataggggtctcagcagttgc

SEQ ID NO: 59000 - DNA, 75 bp, Artificial Sequence
  Synthetic
tttgttggcttcatctataatcatcgctgtctgttgcaaaaggttcaagaaaaggaggaaatccaaacccaatcc

SEQ ID NO: 59001 - DNA, 75 bp, Artificial Sequence
  Synthetic
agtagagttaacccggaaggtgtctgttatatccaaaggaaatggaccggtcccttcctgggagtcttacaaaga

SEQ ID NO: 59002 - DNA, 75 bp, Artificial Sequence
  Synthetic
aggggccacaggagagcttcgtaagactactccctcaacaatagattgagaggttgaatgatgcttgagggtgtc

SEQ ID NO: 59003 - DNA, 75 bp, Artificial Sequence
  Synthetic
cagaacaatacattctttatgatttacctcatccacccaagaacggtacatttaactgatataatgtttaaagct

SEQ ID NO: 59004 - DNA, 75 bp, Artificial Sequence
  Synthetic
ttacatcaaatcataggagaatacttaggagatgacgagaaggtgttgtcattatccattgatttctgctgcatt

SEQ ID NO: 59005 - DNA, 75 bp, Artificial Sequence
  Synthetic
gcggagttgatttgtgccaataattgtttaattttaacgcccattctttcaacaacgctggtgctcattatgatc

SEQ ID NO: 59006 - DNA, 75 bp, Artificial Sequence
  Synthetic
aagacaaaattaggttaatagatggagtgatgcggggatttgaaaggaaatcatgatcaatgatttatatatgct

SEQ ID NO: 59007 - DNA, 75 bp, Artificial Sequence
  Synthetic
acattagtatactttctacctttgtgtgttttgcacatgtttgagggtacgcatttgccttgtcactaacccagg

SEQ ID NO: 59008 - DNA, 75 bp, Artificial Sequence
  Synthetic
gtgaggtgtaataaggtcttaccatagatccatcgcctcaatctggataagcacacaggccttcagatttatgga

SEQ ID NO: 59009 - DNA, 75 bp, Artificial Sequence
  Synthetic
tgcgtgctcatgaaaaaaacatcacaaggaggaataggaagaaaatgaaagagttaacacccctcctttgatcga

SEQ ID NO: 59010 - DNA, 75 bp, Artificial Sequence
  Synthetic
tcctctttcaatatgcttgagtctacagaggtgtatgatgaccctctagatcctgttgaaccggagtcagatctc

SEQ ID NO: 59011 - DNA, 75 bp, Artificial Sequence
  Synthetic
aagacaaactccgtcgttccaaacatcttaagaaattctgactacaatctgaactctcccctcttagaagacccc

SEQ ID NO: 59012 - DNA, 75 bp, Artificial Sequence
  Synthetic
tcaagactgatgcttgagtggctgatgactggaaacaaaccacacagactcaacttaacagacaacttgcttagg

SEQ ID NO: 59013 - DNA, 75 bp, Artificial Sequence
  Synthetic
tcatacaaagttttgaagggatatttcaaaagattggacacaggttcgttgagagttggttctacagggtctcag

SEQ ID NO: 59014 - DNA, 75 bp, Artificial Sequence
  Synthetic
gcgatggtgaccctgtggttgcatgggtcccattctgaatcaacgagaagtagaaaatgcctcacagaattatct

SEQ ID NO: 59015 - DNA, 75 bp, Artificial Sequence
  Synthetic
cagttctacaagaaatcagctcccatagagacgttgttgaactacacactggagaacaggggcttgagaacgccc

SEQ ID NO: 59016 - DNA, 75 bp, Artificial Sequence
  Synthetic
caggagggggttctgtcttgtcttgacaaagttcattatgatcaagcattcgggaggtacctgggcaacacctat

SEQ ID NO: 59017 - DNA, 75 bp, Artificial Sequence
  Synthetic
tcttcatatctgttcttccatgtaatggttctgtacatgaatgccttagattgggatgaagaaaagaccattctg

SEQ ID NO: 59018 - DNA, 75 bp, Artificial Sequence
  Synthetic
tctctgtggagggatatctcttctatagacgtcaaaaatgacttggtgaagttcagagatcagatatgggggact

SEQ ID NO: 59019 - DNA, 75 bp, Artificial Sequence
  Synthetic
ttggttgtcacgaaagatttcatatactctcagagtgcaaattgtctatttgacaggaattacaccctcatgctc

SEQ ID NO: 59020 - DNA, 75 bp, Artificial Sequence
  Synthetic
aaagacctttttctatcccgcttcaactcgtttctgatattgctctcacccccagaggagagatattcagatgac

SEQ ID NO: 59021 - DNA, 75 bp, Artificial Sequence
  Synthetic
ttaatatccaacttgtgtcaactttacatagcaggtgaccgggtgctgtctgtatgtggaaactctggattcgac

SEQ ID NO: 59022 - DNA, 75 bp, Artificial Sequence
  Synthetic
gtaatcaaattgttagagccgtacatagtaaacaagctagtccaaagggcagagaggttccgccctctgatacac

SEQ ID NO: 59023 - DNA, 75 bp, Artificial Sequence
  Synthetic
tctctgggggattttcctcaatttattaaggacaaaaccaaccaactcgaggggactttcggtcccagtgcaaag

SEQ ID NO: 59024 - DNA, 75 bp, Artificial Sequence
  Synthetic
gagtttttccaaactatggactctctagacaatgtgcatgatttggtgttcgtgtacggatgttacagacactgg

SEQ ID NO: 59025 - DNA, 75 bp, Artificial Sequence
  Synthetic
ggccatccatacatagactatagaaaagggctatccaaactgtatgatcaagttcatctcaagaagacaatagac

SEQ ID NO: 59026 - DNA, 75 bp, Artificial Sequence
  Synthetic
aagatttatcaggagtgtttggcgagtgatttggccaaaagaatcctcagatgggggtttgataagtattccaga

SEQ ID NO: 59027 - DNA, 75 bp, Artificial Sequence
  Synthetic
tggtatgtagaccccaatttgttgcaaaacgatcatccgttggttccatatgtgaagacccaaacatggcctcca

SEQ ID NO: 59028 - DNA, 75 bp, Artificial Sequence
  Synthetic
aaacatgtagtcgatgttgtgggagacacatggcacaacctccccatcacccaaatatttgagatacctgagtct

SEQ ID NO: 59029 - DNA, 75 bp, Artificial Sequence
  Synthetic
atggacccatcagagattttggatgacaagtcacactcattcactagaactaagctagcttcttggctctctgaa

SEQ ID NO: 59030 - DNA, 75 bp, Artificial Sequence
  Synthetic
cacagaggagggccggtccctagtgaaaaagtcataatcacagccttgtcaagaccccccgtgaatcctagggag

SEQ ID NO: 59031 - DNA, 75 bp, Artificial Sequence
  Synthetic
ttcctcaggtccgttgacgtcagtgggttgcccgatgatgacctgattataggtctaaaaccaaaagaaagagag

SEQ ID NO: 59032 - DNA, 75 bp, Artificial Sequence
  Synthetic
ttgaagatagaaggccgattttttgcactcatgtcctggaacttgaggctttattttgtcatcacagagaagctt

SEQ ID NO: 59033 - DNA, 75 bp, Artificial Sequence
  Synthetic
ttggctacatacatcttgcctctatttgatgctctgaccatgacagataacctgaacaaagtcttcaaaaagttg

SEQ ID NO: 59034 - DNA, 75 bp, Artificial Sequence
  Synthetic
attgacagagtgaccggacaagggttattagactattcgcgagtcacatatgcatttcatctcgactacgagaag

SEQ ID NO: 59035 - DNA, 75 bp, Artificial Sequence
  Synthetic
tggaacaatcaccagagactagagtccaccatagatgtcttttcggttttagataaagtgttcgggcttaaaaag

SEQ ID NO: 59036 - DNA, 75 bp, Artificial Sequence
  Synthetic
gtcttctctagaacccatgagttttttcaaaagtcctggatctactattcagacagatcagacctcataggctta

SEQ ID NO: 59037 - DNA, 75 bp, Artificial Sequence
  Synthetic
tggagagatcagatatattgcctggacatgagcaatggccccacatgctggaacggtcaggacggtggacttgaa

SEQ ID NO: 59038 - DNA, 75 bp, Artificial Sequence
  Synthetic
gggctgagacaaaaagggtggagtctagtaagtcttttgatgattgacagagagtcacaaactcgcaacacaaga

SEQ ID NO: 59039 - DNA, 75 bp, Artificial Sequence
  Synthetic
accaagatcttggcacaaggagacaatcaggtgttatgccccacatatatgttgtctcccggattgaacaaggag

SEQ ID NO: 59040 - DNA, 75 bp, Artificial Sequence
  Synthetic
gggcttctctatgaattagacagcatatctagaaatgctatttctatatatagagccattgaagatggggctgca

SEQ ID NO: 59041 - DNA, 75 bp, Artificial Sequence
  Synthetic
aagcttggtctgatcatcaaaaaggaagagacaatgtgcagttatgactttttaatctacgggaagacccccttg

SEQ ID NO: 59042 - DNA, 75 bp, Artificial Sequence
  Synthetic
tttcggggcaacatactggtgcccgagtctaagcgatgggctagagtctcatgtatttccaacgatcagattgtc

SEQ ID NO: 59043 - DNA, 75 bp, Artificial Sequence
  Synthetic
aacctagctaatattatgtcgacggtgtcaaccaatgcattgactgtcgctcagcactctcagtccttgataaaa

SEQ ID NO: 59044 - DNA, 75 bp, Artificial Sequence
  Synthetic
ccaatgagagacttccttttgatgtctgttcaagctgtttttcactatcttttgtttagtcctatcctgaagaat

SEQ ID NO: 59045 - DNA, 75 bp, Artificial Sequence
  Synthetic
agagtatacaaaatccttgtatctgatgggactgaattcttattggcaatgtcaaggataatttatcttgaccct

SEQ ID NO: 59046 - DNA, 75 bp, Artificial Sequence
  Synthetic
tctttgggtggggtgtcagggatgtctctaggcaggttccacattcgccaattttctgatccggtatctgaaggc

SEQ ID NO: 59047 - DNA, 75 bp, Artificial Sequence
  Synthetic
ctctaggcaggttccacattcgccaattttctgatccggtatctgaaggcttgtcattttggagagagatttggt

SEQ ID NO: 59048 - DNA, 75 bp, Artificial Sequence
  Synthetic
caagttcctctgagacttggattcactccctgtgtcaagaagcagggaatccagacctaggtgaaaggagcttgg

SEQ ID NO: 59049 - DNA, 75 bp, Artificial Sequence
  Synthetic
agagtttcacacggctcttggaagatccaaccaccctgaacatcagaggaggggcaagtccaaccattttactca

SEQ ID NO: 59050 - DNA, 75 bp, Artificial Sequence
  Synthetic
aagaggcaatcagaaaagcattatacgatgaagtcgacaaagttgagaactctgagttcagagaagcaatcttgt

SEQ ID NO: 59051 - DNA, 75 bp, Artificial Sequence
  Synthetic
tatccaaaacccaccgggacaacttcatattattcttaaggtctgtggagcctttgtttccaagatttctcagtg

SEQ ID NO: 59052 - DNA, 75 bp, Artificial Sequence
  Synthetic
agttgttcagctcatctttcctaggcattcctgagtctattattggtctcatccaaaactcaagaacaattagaa

SEQ ID NO: 59053 - DNA, 75 bp, Artificial Sequence
  Synthetic
gacagtttaggaagagtctatctaggactctagaagagtctttcttcagttcagagattcatggaatcagtcgga

SEQ ID NO: 59054 - DNA, 75 bp, Artificial Sequence
  Synthetic
tgacccaagtggctcaaaaaataggaagggtctggaggtgttccgcagagagggcagaccagcttcgagaaatat

SEQ ID NO: 59055 - DNA, 75 bp, Artificial Sequence
  Synthetic
cctggggcaggaaagttgtgggaacaactgtccctcacccatccgaaatgttgtccatgatacccaaatcgtcta

SEQ ID NO: 59056 - DNA, 75 bp, Artificial Sequence
  Synthetic
tttcctgcacatgtggacagctagaagatgacaatccccgtatctctgtgtcagtccttccgtccttcgatcaaa

SEQ ID NO: 59057 - DNA, 75 bp, Artificial Sequence
  Synthetic
cttttttctcccgaggacctctcaaaggatacctggggtcctcaacttctatgtctactcagttgttccatgctt

SEQ ID NO: 59058 - DNA, 75 bp, Artificial Sequence
  Synthetic
gggaaaaagtcacaaatgttcatgtggtcaagagagccctgtctctcaaggaatctatcaactggttcatagcga

SEQ ID NO: 59059 - DNA, 75 bp, Artificial Sequence
  Synthetic
gagactccaatttggcacagacattgattcgtaatattgtatccctgaccggcccttcttttcctcttgaagagg

SEQ ID NO: 59060 - DNA, 75 bp, Artificial Sequence
  Synthetic
ctcctgtgttcaagagaactggatctgctctgcatcgtttcaagtctgccagatacagtgaagggggatactcct

SEQ ID NO: 59061 - DNA, 75 bp, Artificial Sequence
  Synthetic
ccatttgtcctaacctattatcccacatttccgtgagtacagatacaatgtcggatctcacacaagatggaacaa

SEQ ID NO: 59062 - DNA, 75 bp, Artificial Sequence
  Synthetic
catttccgtgagtacagatacaatgtcggatctcacacaagatggaacaaactttgactttatgttccagccttt

SEQ ID NO: 59063 - DNA, 75 bp, Artificial Sequence
  Synthetic
aggccgatagatgatatcactctagaggccccgaatgtcttctcctttccagatgtttctagaagaatatctcga

SEQ ID NO: 59064 - DNA, 75 bp, Artificial Sequence
  Synthetic
gaagccaggtaagttcgaaaccctcagcgggaaagatcaatctaaacacattggaacggcccagggtctcctgta

SEQ ID NO: 59065 - DNA, 75 bp, Artificial Sequence
  Synthetic
ctctatattggtggctatccatgattcagggtacaatgatggaactgttttcccggtcaacatatacaagagagt

SEQ ID NO: 59066 - DNA, 75 bp, Artificial Sequence
  Synthetic
atctcccagggactatcttagagggttagctagaggtgttttgataggatcctctatttgtttcttaacccgaat

SEQ ID NO: 59067 - DNA, 75 bp, Artificial Sequence
  Synthetic
gaccagtattaacatcaatcgtcctttggagctgatctccggagtcatctcctacattttgttgagacttgacaa

SEQ ID NO: 59068 - DNA, 75 bp, Artificial Sequence
  Synthetic
ccacccctcattgtatgtcatgatgaaagagccctctctcaggcatgagatattttccatccctcaaaaaatacc

SEQ ID NO: 59069 - DNA, 75 bp, Artificial Sequence
  Synthetic
cgctgcgtatccaacaaccatgaaagaaggcaacaggtctgttctatgctatttacaacatgtactgagatatga

SEQ ID NO: 59070 - DNA, 75 bp, Artificial Sequence
  Synthetic
gagagaagccataacagcatcaccagagtgtgactggttatggattttctccgatttcagaagcattaaaatgac

SEQ ID NO: 59071 - DNA, 75 bp, Artificial Sequence
  Synthetic
ctatctaactctgattacataccagtctcaccttttactgcaaaaaatagataggaacctatcgaagcagatgag

SEQ ID NO: 59072 - DNA, 75 bp, Artificial Sequence
  Synthetic
agtccaattgaggcaactgaattcacttatgaggcaggtattaggtgggcatggagaaggctctctagactctgc

SEQ ID NO: 59073 - DNA, 75 bp, Artificial Sequence
  Synthetic
cgacgaaattcacggattgttgagagaagctctacaacgaacaagatgggttgaccaggaggtccgtcacgcagc

SEQ ID NO: 59074 - DNA, 75 bp, Artificial Sequence
  Synthetic
aaaggcaatgaaatgtgatttcagcccccacaagaggtcatcaaggaaagttagtagttctgagtggatatgttc

SEQ ID NO: 59075 - DNA, 75 bp, Artificial Sequence
  Synthetic
agctcaacagattgccgtatctacctcttcaaatcctgctccgacatcagagatcgacatcagagcattgtctag

SEQ ID NO: 59076 - DNA, 75 bp, Artificial Sequence
  Synthetic
tcttcaaatcctgctccgacatcagagatcgacatcagagcattgtctaggaagttgcaaaatcctcttatttct

SEQ ID NO: 59077 - DNA, 75 bp, Artificial Sequence
  Synthetic
ggccttcgagttgttcaatgggctactggagcccattataagcttaaaccgatcctcaacgatctggatgcatgc

SEQ ID NO: 59078 - DNA, 75 bp, Artificial Sequence
  Synthetic
cccacattgtgcttagtagtgggagatggctccggggggatttcaagggcagtactgagcatgttccctgatgcc

SEQ ID NO: 59079 - DNA, 75 bp, Artificial Sequence
  Synthetic
agattagttttcaacagtctcttagaggtcagtgacttgatggcctcagggacacacccattgcctccctccgca

SEQ ID NO: 59080 - DNA, 75 bp, Artificial Sequence
  Synthetic
ttggtaagtggaggagaggatatcgtatctcgagtcattgatttccaatctatctgggaaaagccttcagatttg

SEQ ID NO: 59081 - DNA, 75 bp, Artificial Sequence
  Synthetic
agaaacccatccacctggaggtatttccaaagtgtccagcaagctaccaacatgtcctatgatttgataatttgt

SEQ ID NO: 59082 - DNA, 75 bp, Artificial Sequence
  Synthetic
gacgcagaagtcacagacatttcttctatcaacaaaataaccttgttaatgtctgatttctccctgtcaatcaat

SEQ ID NO: 59083 - DNA, 75 bp, Artificial Sequence
  Synthetic
ggtcctctaagtttaattttcaagacttatggaacaatgttggtcaatccggactacagggccattcagcatctc

SEQ ID NO: 59084 - DNA, 75 bp, Artificial Sequence
  Synthetic
tctagagcattcccttcagcagcagggtatataacgcaggtaacctcttcattctcctcagaactctacttgaag

SEQ ID NO: 59085 - DNA, 75 bp, Artificial Sequence
  Synthetic
ttctcgaaacgagggaagttttttagagaccctgagcatttgacatcatccactttgagagaaatgagtttggtc

SEQ ID NO: 59086 - DNA, 75 bp, Artificial Sequence
  Synthetic
ctcttcaattgcagcagctccaagagcgagatgctgagagcaagatcgttaaactatcaagaccttgtcagggga

SEQ ID NO: 59087 - DNA, 75 bp, Artificial Sequence
  Synthetic
tttccagaagaaatcatatcgaatccatacaatgaaatgataataaccctcatagataatgacgttgagtcattc

SEQ ID NO: 59088 - DNA, 75 bp, Artificial Sequence
  Synthetic
cttgtccacaaaatgatcgatgacctagagcttcaacgaggagcgttctccaaactgtcaatcatactaaccatc

SEQ ID NO: 59089 - DNA, 75 bp, Artificial Sequence
  Synthetic
atggtggttttctctaatagagtgttcaatgtgtccaagcctctgacagactctaagttttacccaccgtcagac

SEQ ID NO: 59090 - DNA, 75 bp, Artificial Sequence
  Synthetic
ccgaagatcttaaaacacttcaatatttgttgtagcactcttttgtacttatcagttgctttgggggatgtcctc

SEQ ID NO: 59091 - DNA, 75 bp, Artificial Sequence
  Synthetic
aactttgccagactccatgaactttacaacaaccctataacatattattttaagaagcaagtgataggagggaga

SEQ ID NO: 59092 - DNA, 75 bp, Artificial Sequence
  Synthetic
atgtacttagcttggagttggtcacacagcacatcagtcttcaagagagttgcttgcaactctaatttgagtttg

SEQ ID NO: 59093 - DNA, 75 bp, Artificial Sequence
  Synthetic
tcagctcactggattcggctaatctataaagttgtcaagacaacaagactcactggaagtcccaaggacctgtcc

SEQ ID NO: 59094 - DNA, 75 bp, Artificial Sequence
  Synthetic
cgagagatggaaagacatctaaaaagctacaacagatggatcaactccgacgatctccgatccagaacatctctg

SEQ ID NO: 59095 - DNA, 75 bp, Artificial Sequence
  Synthetic
ctggattatagtggtctttgagtattcctgaccacaatgtcacatatgtcctcaaaagccataccagagaacatg

SEQ ID NO: 59096 - DNA, 75 bp, Artificial Sequence
  Synthetic
aaaaaaacattagaaacgttctgtactcctgccgttttgactcgttttgtgtcttgtttgttttttttgttaagc

SEQ ID NO: 59097 - DNA, 75 bp, Artificial Sequence
  Synthetic
aaaaacattagaaacgttctgtactcctgccgttttgactcgttttgtgtcttgtttgttttttttgttaagcgt

SEQ ID NO: 59098 - DNA, 75 bp, Artificial Sequence
  Synthetic
atagttagaacaaatacagagggtaactgggctcagacgggaggtcaggatttaactggagatccaacaatctca

SEQ ID NO: 59099 - DNA, 75 bp, Artificial Sequence
  Synthetic
gaggacttttaccttacaggaagagaaaaccctctttccccgtttcagacacatcttgatgctatagggcttcgc

SEQ ID NO: 59100 - DNA, 75 bp, Artificial Sequence
  Synthetic
gaacagaagaatgattggactggttaaggtagtgattggattggctttgtcaggagcacctgtccctgatgggat

SEQ ID NO: 59101 - DNA, 75 bp, Artificial Sequence
  Synthetic
tactccaagatgtttcctaacggaaggtgttcggaaatatctcctgggtctcccttctgtcccaccaatcatgaa

SEQ ID NO: 59102 - DNA, 75 bp, Artificial Sequence
  Synthetic
ttaagactctgtgggatcagtggactgagactgatggacggatcctgggtttcactcccacaggttaacaactca

SEQ ID NO: 59103 - DNA, 75 bp, Artificial Sequence
  Synthetic
ggaaccacaggagatgttcgtaatatgactccatcaacaagggagtgagaggccggataatgcttgaggatgtcc

SEQ ID NO: 59104 - DNA, 75 bp, Artificial Sequence
  Synthetic
cctcatcacttaagagcggtacacttgattgatataatgtttgaagatttacatcacatcatctgataagactta

SEQ ID NO: 59105 - DNA, 75 bp, Artificial Sequence
  Synthetic
attagccttataactaacccagggggaggtgtgatgagatcttactacagatccatcgcctcaatcaagatgata

SEQ ID NO: 59106 - DNA, 75 bp, Artificial Sequence
  Synthetic
gacttagccaaaagaattctcagatgggggtttgataagtattccagatggtatgtcgatcccaatttgttgcaa

SEQ ID NO: 59107 - DNA, 75 bp, Artificial Sequence
  Synthetic
gtcattctggagagagatttggtcaagttcctctgagacttggattcactccctgtgtcaagaagcagggaatcc

SEQ ID NO: 59108 - DNA, 75 bp, Artificial Sequence
  Synthetic
agatctcggtgaaaggagtttagaaagtttcacgaggctcttagaagatccaactaccctgaatatcagaggagg

SEQ ID NO: 59109 - DNA, 75 bp, Artificial Sequence
  Synthetic
ctgaaggattccacattccattggcatctcagatgtgtcagatgtgttaggccgatagatgatatcactctagag

SEQ ID NO: 59110 - DNA, 75 bp, Artificial Sequence
  Synthetic
gggacagcccagggtcttttgtactctatattggtggctatccatgattcagggtacaatgatggaaccgtcttc

SEQ ID NO: 59111 - DNA, 75 bp, Artificial Sequence
  Synthetic
tacattttgttgagactcgacaaccacccctccctgtatgtcatgttgaaagaaccctctcttaggcttgaaata

SEQ ID NO: 59112 - DNA, 75 bp, Artificial Sequence
  Synthetic
ctttgcccgactccatgaactttacaacaaccctataacatattattttaggaagcagatgataggagggagaat

SEQ ID NO: 59113 - DNA, 75 bp, Artificial Sequence
  Synthetic
atctccgatccagatcatctctgttggattatagtggtctttaagtatctctgaccataatatcatatatgtccc

SEQ ID NO: 59114 - DNA, 75 bp, Artificial Sequence
  Synthetic
ctgaccataatatcatatatgtccccaaaagccataccagagaacatgaaaaaaacatttgaaacattctgtact

SEQ ID NO: 59115 - DNA, 75 bp, Artificial Sequence
  Synthetic
acgcttaacaacaaaatcaaaaaaggggtagacacgttcatcgatagaacagaaatgtaacacccctacaatgga

SEQ ID NO: 59116 - DNA, 75 bp, Artificial Sequence
  Synthetic
gggtagacacgttcatcgatagaacagaaatgtaacacccctacaatggatgttaacagggttgtttttaaggtc

SEQ ID NO: 59117 - DNA, 75 bp, Artificial Sequence
  Synthetic
cataatcagttggtctcggtaaaacctgaggtgatttctgatcagtatgagtacaaataccctgccatcaaagac

SEQ ID NO: 59118 - DNA, 75 bp, Artificial Sequence
  Synthetic
ctgaggtgatttctgatcagtatgagtacaaataccctgccatcaaagacaagaagaaaccgagcatcactctcg

SEQ ID NO: 59119 - DNA, 75 bp, Artificial Sequence
  Synthetic
gaaaagatcccgacttgaaaacagcctacaagtctatcttgtcagggatgaatgctgctaaattggatccagatg

SEQ ID NO: 59120 - DNA, 75 bp, Artificial Sequence
  Synthetic
aatgctgctaaattggatccagatgacgtctgctcttatttagctggagccatggtcttgtttgagggtatatgc

SEQ ID NO: 59121 - DNA, 75 bp, Artificial Sequence
  Synthetic
tcaacattgctaagaaaggtgacaagataacacctgctacgttagtggacatcaatcggacgaacactgagggca

SEQ ID NO: 59122 - DNA, 75 bp, Artificial Sequence
  Synthetic
actgggctcaaacaggaggtcaagatctcactcgggaccctacgacacctgaacatgcatctctggttggacttc

SEQ ID NO: 59123 - DNA, 75 bp, Artificial Sequence
  Synthetic
tctcactcgggaccctacgacacctgaacatgcatctctggttggacttcttctttgtctctacaggctaagtaa

SEQ ID NO: 59124 - DNA, 75 bp, Artificial Sequence
  Synthetic
acattgatgaccacccacaagatgtgtgccaactggagcactatacctaattttagattcttggcaggggcttat

SEQ ID NO: 59125 - DNA, 75 bp, Artificial Sequence
  Synthetic
gacatgttttttgccagaattgagcacctgtattctgcaattcgggttgggacagtggttactgcttatgaggat

SEQ ID NO: 59126 - DNA, 75 bp, Artificial Sequence
  Synthetic
gacagtggttactgcttatgaggattgttcagggttggtgtccttcacagggttcatcaagcaaatcaatctgac

SEQ ID NO: 59127 - DNA, 75 bp, Artificial Sequence
  Synthetic
agccagggaggccatactatacttcttccacaagaacttcgaggaagagatcaagagaatgtttgagccagggca

SEQ ID NO: 59128 - DNA, 75 bp, Artificial Sequence
  Synthetic
ttccacaagaacttcgaggaagagatcaagagaatgtttgagccagggcaagaaacagctgttccgcactcatat

SEQ ID NO: 59129 - DNA, 75 bp, Artificial Sequence
  Synthetic
tcaagagaatgtttgagccagggcaagaaacagctgttccgcactcatatttcatccacttcagatcattgggac

SEQ ID NO: 59130 - DNA, 75 bp, Artificial Sequence
  Synthetic
ttagtgggaagtctccttattcatccaatgcggtagggcatgtgtttaacctgattcactttgtgggttgttata

SEQ ID NO: 59131 - DNA, 75 bp, Artificial Sequence
  Synthetic
caatgcggtagggcatgtgtttaacctgattcactttgtgggttgttatatgggccaaatcagatctttaaatgc

SEQ ID NO: 59132 - DNA, 75 bp, Artificial Sequence
  Synthetic
tactgtcattcagagttgtgcaccccatgaaatgtcagtcttggggggttacctaggggaggagtttttcgggaa

SEQ ID NO: 59133 - DNA, 75 bp, Artificial Sequence
  Synthetic
gggcacatttgaaaggcgattcttccgagacgagaaagagttacaggattacgaggcagcagaaagcaccaaggt

SEQ ID NO: 59134 - DNA, 75 bp, Artificial Sequence
  Synthetic
cgagacgagaaagagttacaggattacgaggcagcagaaagcaccaaggttgacgtagcattggcagatgatggg

SEQ ID NO: 59135 - DNA, 75 bp, Artificial Sequence
  Synthetic
acagtgaattcagatgatgaagacttcttttcgggagacacgagaagcccagaggctgtatacaccaggattatg

SEQ ID NO: 59136 - DNA, 75 bp, Artificial Sequence
  Synthetic
tcttttcgggagacacgagaagcccagaggctgtatacaccaggattatgatgaacggagggaggttaaaaaggt

SEQ ID NO: 59137 - DNA, 75 bp, Artificial Sequence
  Synthetic
atgaacggagggaggttaaaaaggtctcacataaagagatatgtctcagtgagtgcaaaccatcaggccaggcct

SEQ ID NO: 59138 - DNA, 75 bp, Artificial Sequence
  Synthetic
gagtgcaaaccatcaggccaggcctaattcctttgcagagtttctcaacaagacgtattctagtgatcccagata

SEQ ID NO: 59139 - DNA, 75 bp, Artificial Sequence
  Synthetic
agacgtattctagtgatcccagataatcccccgatgggataagggatcatgatgtgattgaataatccaattgaa

SEQ ID NO: 59140 - DNA, 75 bp, Artificial Sequence
  Synthetic
cacttagatccggcttggctgacttggagatggctgaagagacagtggatttggtgaataaaaacatggaggata

SEQ ID NO: 59141 - DNA, 75 bp, Artificial Sequence
  Synthetic
gatattaggaggctcaaaatagcagactacaaacaagggcaacaggaagaggatgcctcgagacaagaggaggga

SEQ ID NO: 59142 - DNA, 75 bp, Artificial Sequence
  Synthetic
gaggacgaggacttctacatgaccgagagtgagaactcatacgttcctctccagtcttatcttgatgctgtgggg

SEQ ID NO: 59143 - DNA, 75 bp, Artificial Sequence
  Synthetic
atgcagattgtcagaaagatgaaaaccggggatggattcttcaagatatgggcacaagcagtggaggacatcgta

SEQ ID NO: 59144 - DNA, 75 bp, Artificial Sequence
  Synthetic
ccggggatggattcttcaagatatgggcacaagcagtggaggacatcgtatcttacgtggccaccaacttccccg

SEQ ID NO: 59145 - DNA, 75 bp, Artificial Sequence
  Synthetic
caagtcaactcagaccacactggagaaagtcaagcaagccacatcctcttctgcccctagcaagagagagggacc

SEQ ID NO: 59146 - DNA, 75 bp, Artificial Sequence
  Synthetic
atcttcaaacgtgaaccttgactcccaggagtcatcgggtcctccaggattagactgggctgccagcaatgatga

SEQ ID NO: 59147 - DNA, 75 bp, Artificial Sequence
  Synthetic
tagactgggctgccagcaatgatgaggatgatggatctattgaggcagagattgcccatcagatagccgagagct

SEQ ID NO: 59148 - DNA, 75 bp, Artificial Sequence
  Synthetic
attgcccatcagatagccgagagcttttccaagaagtataaattcccttctcgatcatccgggatattcctttgg

SEQ ID NO: 59149 - DNA, 75 bp, Artificial Sequence
  Synthetic
tttccaagaagtataaattcccttctcgatcatccgggatattcctttggaactttgagcaactgaaaatgaatc

SEQ ID NO: 59150 - DNA, 75 bp, Artificial Sequence
  Synthetic
tccggtgcatgctggggagtgtggcgtccaatcattccaagaggttccaaattctagtcaattcggcgaaattag

SEQ ID NO: 59151 - DNA, 75 bp, Artificial Sequence
  Synthetic
gcaaactcatgcaggatgatctcaacagatatcttgcgtattgatccaaaattggctactgtcacactaggacaa

SEQ ID NO: 59152 - DNA, 75 bp, Artificial Sequence
  Synthetic
aaaaaaacatgtaacaccactggcaagatgaatatcattcggaaaattgttaagagctgtaaggacgatgagatg

SEQ ID NO: 59153 - DNA, 75 bp, Artificial Sequence
  Synthetic
tccccctcccgaatatgtcccgctgtcagagatgactgggaaaaagaacatgaggaacttttgtatcaacgaaga

SEQ ID NO: 59154 - DNA, 75 bp, Artificial Sequence
  Synthetic
aatcaaagtatgcagcccaaatgggtattcattcaggatcatcagacatatcttgagctccttcgagggggtgta

SEQ ID NO: 59155 - DNA, 75 bp, Artificial Sequence
  Synthetic
tggaatgaattgggtttataagatcaggcgcacccttatattccagtgggctgagtcatcgggccctctagatgg

SEQ ID NO: 59156 - DNA, 75 bp, Artificial Sequence
  Synthetic
agactctggtgtatcaacatgaactccagagcatgccagctgtggtctgacatgtctctaaaaactcagcagtct

SEQ ID NO: 59157 - DNA, 75 bp, Artificial Sequence
  Synthetic
catgtctctaaaaactcagcagtctgacgaagacaagaacacttccttactcctcgaatgaccatcactccaagc

SEQ ID NO: 59158 - DNA, 75 bp, Artificial Sequence
  Synthetic
cactgctcaatcagttacctccacatgatgatatatacaaccacactcttccgtccttccgcgagcaatagaaca

SEQ ID NO: 59159 - DNA, 75 bp, Artificial Sequence
  Synthetic
tgatgatatatacaaccacactcttccgtccttccgcgagcaatagaacaacgtatgttatggtgccacacaata

SEQ ID NO: 59160 - DNA, 75 bp, Artificial Sequence
  Synthetic
tgcaatgtgaaaaaaacaaataacatccctcaaaagattcaaaagccatgttactctctaccgccatattcgcct

SEQ ID NO: 59161 - DNA, 75 bp, Artificial Sequence
  Synthetic
gggaaagttcccaatctacaccatcccggataaaatcggaccgtggagtcctattgatataaaccatctcagctg

SEQ ID NO: 59162 - DNA, 75 bp, Artificial Sequence
  Synthetic
ccggataaaatcggaccgtggagtcctattgatataaaccatctcagctgcccaaacaacttgatcgtggaagat

SEQ ID NO: 59163 - DNA, 75 bp, Artificial Sequence
  Synthetic
gagggatgcacaactctcaccccattctcgtacatggaactgaaagtgggatatataacaacaataaaaatagag

SEQ ID NO: 59164 - DNA, 75 bp, Artificial Sequence
  Synthetic
tgtagggtatgtgactacaaccttcaagaggaagcatttccggccaactgtgagcgcctgtagagatgcatacaa

SEQ ID NO: 59165 - DNA, 75 bp, Artificial Sequence
  Synthetic
tgtgaagaccaccaaagagtctcttctgattatctctcctagtgtagttgacatggacgcatatgacaaaaatct

SEQ ID NO: 59166 - DNA, 75 bp, Artificial Sequence
  Synthetic
ctgattatctctcctagtgtagttgacatggacgcatatgacaaaaatctctattccaaaatgttccccaatggt

SEQ ID NO: 59167 - DNA, 75 bp, Artificial Sequence
  Synthetic
aaatgtctggcttcacccccaagtgccacatgttgtccgacaaatcatgactacaccatttggattccagagaat

SEQ ID NO: 59168 - DNA, 75 bp, Artificial Sequence
  Synthetic
ctacaccatttggattccagagaatcctaagcccgggctgtcctgtgatatattcacgactagcaaaggaaagaa

SEQ ID NO: 59169 - DNA, 75 bp, Artificial Sequence
  Synthetic
acaaatccttgaagggggcttgcaagctgagactctgtggggtccctggcatgagattgatggatggatcatggg

SEQ ID NO: 59170 - DNA, 75 bp, Artificial Sequence
  Synthetic
atgagattgatggatggatcatgggtatctcttcagaaaaccgaagctccagaatggtgctctccagaccagctt

SEQ ID NO: 59171 - DNA, 75 bp, Artificial Sequence
  Synthetic
atgaaattgaacaccttgtggttgaagaattggtgaagaagagggaagagtgtttggatgctttagagaccatca

SEQ ID NO: 59172 - DNA, 75 bp, Artificial Sequence
  Synthetic
agaattggtgaagaagagggaagagtgtttggatgctttagagaccatcattacaactaagtccataagtttcag

SEQ ID NO: 59173 - DNA, 75 bp, Artificial Sequence
  Synthetic
acgtctcagtcatttcaggaaactggttcctgggttcggaaaggcatacactctcatcaacaagactctcatgga

SEQ ID NO: 59174 - DNA, 75 bp, Artificial Sequence
  Synthetic
agcagatgcccattacaagtctgtaagagaatggacagaagtgatcccatctaaagggtgtttgatggcgggggg

SEQ ID NO: 59175 - DNA, 75 bp, Artificial Sequence
  Synthetic
gagatgccatcctcactacagtggaatattcttcaatgggatcatactgagtccagggggggatgtattcattcc

SEQ ID NO: 59176 - DNA, 75 bp, Artificial Sequence
  Synthetic
atattcttcaatgggatcatactgagtccagggggggatgtattcattccggagatgcagtcggccttgttacag

SEQ ID NO: 59177 - DNA, 75 bp, Artificial Sequence
  Synthetic
cagcacattgagctgctagaatcctcaatgattcctctcagacatcctttggctgacccttccacggtgttcaag

SEQ ID NO: 59178 - DNA, 75 bp, Artificial Sequence
  Synthetic
ccttcttgccttagcaataattactgcggcgtgttgcaagaggttcaagaggagaaggaggccgaagccaaaccc

SEQ ID NO: 59179 - DNA, 75 bp, Artificial Sequence
  Synthetic
gatagagttgatcaggaaggtctctgtaacctctcaaagtggaagggcagttccatcttgggagtcttacaaagt

SEQ ID NO: 59180 - DNA, 75 bp, Artificial Sequence
  Synthetic
gtaacctctcaaagtggaagggcagttccatcttgggagtcttacaaagtggggactactagtgagtcataagca

SEQ ID NO: 59181 - DNA, 75 bp, Artificial Sequence
  Synthetic
tgtcttgtccatagatcctgtgacaacagaggaaactatgcgatgaatctgatgagagctttaaaaatcacctca

SEQ ID NO: 59182 - DNA, 75 bp, Artificial Sequence
  Synthetic
acagaggaaactatgcgatgaatctgatgagagctttaaaaatcacctcatttaatcattatatgaatcactgcc

SEQ ID NO: 59183 - DNA, 75 bp, Artificial Sequence
  Synthetic
tttgcatattaaatcgggcaagggattgagatcagaagggccatctaaggaatatccccccacatatggccagct

SEQ ID NO: 59184 - DNA, 75 bp, Artificial Sequence
  Synthetic
gacatgatcctcttaattcatgcttgagaattcttgagtttaatttacatctatctgagatgttggtgctttaat

SEQ ID NO: 59185 - DNA, 75 bp, Artificial Sequence
  Synthetic
gagaattcttgagtttaatttacatctatctgagatgttggtgctttaattggcctaattagacgttagcaggct

SEQ ID NO: 59186 - DNA, 75 bp, Artificial Sequence
  Synthetic
acttgaatgatataaacaataacaagacaatcatagtcaatagtgtacactaactacatcggtgtgcttagcata

SEQ ID NO: 59187 - DNA, 75 bp, Artificial Sequence
  Synthetic
gacaatcatagtcaatagtgtacactaactacatcggtgtgcttagcataacccccgcttttagtataagctcag

SEQ ID NO: 59188 - DNA, 75 bp, Artificial Sequence
  Synthetic
agccttgccactctcttaacccatttataaagatattggaaggggattacgctcagataaagggttaatcttctg

SEQ ID NO: 59189 - DNA, 75 bp, Artificial Sequence
  Synthetic
tataaagatattggaaggggattacgctcagataaagggttaatcttctgatgtgtagacagacaaagagcctcc

SEQ ID NO: 59190 - DNA, 75 bp, Artificial Sequence
  Synthetic
taaccaagattatgtactcctgaaaaaaacattaatatgtaagaggagccaacacccctcctcggagatcttcaa

SEQ ID NO: 59191 - DNA, 75 bp, Artificial Sequence
  Synthetic
aaaacattaatatgtaagaggagccaacacccctcctcggagatcttcaaatgcaaaatgattgactctaccgag

SEQ ID NO: 59192 - DNA, 75 bp, Artificial Sequence
  Synthetic
gtttacgatgatccggtggatcctgttgagccagaagcagacctgagaagcagttccgttgtgccaaacatcttg

SEQ ID NO: 59193 - DNA, 75 bp, Artificial Sequence
  Synthetic
ttgagccagaagcagacctgagaagcagttccgttgtgccaaacatcttgagaaactcagattataatctgaatt

SEQ ID NO: 59194 - DNA, 75 bp, Artificial Sequence
  Synthetic
ccccacttttggaggacccttcgagactgatgatagaatggttaacaacgggaaacagacccagccgactaaact

SEQ ID NO: 59195 - DNA, 75 bp, Artificial Sequence
  Synthetic
caaggttctgagaggctattttaagaagttagatgtcgggtcaatgcgggcaggaggtctaggcgcacaagccat

SEQ ID NO: 59196 - DNA, 75 bp, Artificial Sequence
  Synthetic
aagttagatgtcgggtcaatgcgggcaggaggtctaggcgcacaagccatgataaccttgtggctacacgggtcc

SEQ ID NO: 59197 - DNA, 75 bp, Artificial Sequence
  Synthetic
caggaggtctaggcgcacaagccatgataaccttgtggctacacgggtcccactccgagtccacgcgcagcagaa

SEQ ID NO: 59198 - DNA, 75 bp, Artificial Sequence
  Synthetic
agtgcctcacagaactctcacagttctataagaaatcatcccctatagagaagttgttaaactataccctagaga

SEQ ID NO: 59199 - DNA, 75 bp, Artificial Sequence
  Synthetic
aagttgttaaactataccctagagaacagaggactgaagactccgacagagggggtgctatctagcatcaacaaa

SEQ ID NO: 59200 - DNA, 75 bp, Artificial Sequence
  Synthetic
gggggtgctatctagcatcaacaaagtccagtatgaccaggcattcggtaggtatctaggcaatacttattcctc

SEQ ID NO: 59201 - DNA, 75 bp, Artificial Sequence
  Synthetic
ctgtatatgaacgcccttgactgggatgaggagaagaccatcttggccttatggaaagagattgcctcaatagac

SEQ ID NO: 59202 - DNA, 75 bp, Artificial Sequence
  Synthetic
gaaactataccctaatgcttaaggacttgtttttgtcaagattcaactcacttttaatcttgatctctcccccgg

SEQ ID NO: 59203 - DNA, 75 bp, Artificial Sequence
  Synthetic
cttgtttttgtcaagattcaactcacttttaatcttgatctctcccccggaatcaagatattcagatgacttggt

SEQ ID NO: 59204 - DNA, 75 bp, Artificial Sequence
  Synthetic
aacaagttggtacagaaagcagagaggttcagacctctaattcactccttgggagattttcctcagttcattcgt

SEQ ID NO: 59205 - DNA, 75 bp, Artificial Sequence
  Synthetic
ggttcagacctctaattcactccttgggagattttcctcagttcattcgtgacaaaaccaatcagcttgagggga

SEQ ID NO: 59206 - DNA, 75 bp, Artificial Sequence
  Synthetic
cttttgggcccagtgccagagagttttttcagactatggacttgttagataacatacatgacttggtgttcgttt

SEQ ID NO: 59207 - DNA, 75 bp, Artificial Sequence
  Synthetic
ttttcagactatggacttgttagataacatacatgacttggtgttcgtttacggctgctacagacattggggcca

SEQ ID NO: 59208 - DNA, 75 bp, Artificial Sequence
  Synthetic
aacatacatgacttggtgttcgtttacggctgctacagacattggggccatccttatattgactacagaaagggg

SEQ ID NO: 59209 - DNA, 75 bp, Artificial Sequence
  Synthetic
ttgtctaagttgtatgatcaggtccatgtcaagaaaatcatagacaggaattatcaagagtgtctggcgagcgat

SEQ ID NO: 59210 - DNA, 75 bp, Artificial Sequence
  Synthetic
aaacccagacttggcctccaaagcatgtggttgacatggttggggacacttggcatagcctccccataacccaaa

SEQ ID NO: 59211 - DNA, 75 bp, Artificial Sequence
  Synthetic
aggcggaccagtccctagtgagaaggtgatcattacagcactctctagacctccagtcaatcctcgagagttcct

SEQ ID NO: 59212 - DNA, 75 bp, Artificial Sequence
  Synthetic
atgtcttggaatctaaggctttatttcgtcataacagagaaactgttggccacatatatcctgcccttgtttgac

SEQ ID NO: 59213 - DNA, 75 bp, Artificial Sequence
  Synthetic
tcgtcataacagagaaactgttggccacatatatcctgcccttgtttgacgccttaacgatgactgacaatttga

SEQ ID NO: 59214 - DNA, 75 bp, Artificial Sequence
  Synthetic
acaaggtatttaaaaagttgattgatcgagtcacagggcagggcttgttagattattcccgggtgacttatgcat

SEQ ID NO: 59215 - DNA, 75 bp, Artificial Sequence
  Synthetic
ctctcggacacacgagttcttccaaaaatcgtgggtttactactcagatagatctgacttaattggattgtggag

SEQ ID NO: 59216 - DNA, 75 bp, Artificial Sequence
  Synthetic
gatctgacttaattggattgtggagggatcagatctactgcctggatatgaccaatggccccacctgctggaacg

SEQ ID NO: 59217 - DNA, 75 bp, Artificial Sequence
  Synthetic
gccaggacgggggacttgaagggttgagacagaaagggtggagtttggtcagtcttctaatgatagacagagagt

SEQ ID NO: 59218 - DNA, 75 bp, Artificial Sequence
  Synthetic
aatcctagcacagggggacaatcaagtcttgtgcccgacttacatgctgtcgtccggattaaacaaggagggcct

SEQ ID NO: 59219 - DNA, 75 bp, Artificial Sequence
  Synthetic
ggggcttatcattaagaaggaggagactatgtgcagttatgactttctcatatacgggaaaactccattgtttag

SEQ ID NO: 59220 - DNA, 75 bp, Artificial Sequence
  Synthetic
tatacgggaaaactccattgtttaggggtaatatcctggtcccggagtctaagagatgggccagagtctcatgta

SEQ ID NO: 59221 - DNA, 75 bp, Artificial Sequence
  Synthetic
actaatgccttgacagtagctcaacactcacaatccttgatcaagcccatgagagactttctcctgatgtctgtc

SEQ ID NO: 59222 - DNA, 75 bp, Artificial Sequence
  Synthetic
actgagtttctgttggcaatgtcaaggataatttatctggacccgtctcttggtggagtctcagggatgtccttg

SEQ ID NO: 59223 - DNA, 75 bp, Artificial Sequence
  Synthetic
tcctcagaatcgtggattcatgcgctatgccaagaagcgggaaaccctgacctgggggacagaagcttagagagc

SEQ ID NO: 59224 - DNA, 75 bp, Artificial Sequence
  Synthetic
ttcaccaggctactggaagaccccacgacactgaacataagaggaggagcaagtccgaccatcctgttaaaggag

SEQ ID NO: 59225 - DNA, 75 bp, Artificial Sequence
  Synthetic
aagtccgaccatcctgttaaaggaggctattcggaaggctttgtatgatgaggttgacaaggtagaaaattctga

SEQ ID NO: 59226 - DNA, 75 bp, Artificial Sequence
  Synthetic
tgtttttgagatctgtagaacctttattccctcgatttcttagtgaattgttcagctcttcatttcttggaattc

SEQ ID NO: 59227 - DNA, 75 bp, Artificial Sequence
  Synthetic
ctgaatcaatcatcggattaatccagaactccagaaccatccgacgccaattcaggagaagcttgtcgagaaccc

SEQ ID NO: 59228 - DNA, 75 bp, Artificial Sequence
  Synthetic
gaactccagaaccatccgacgccaattcaggagaagcttgtcgagaaccctggaggagtcatttttcagctctga

SEQ ID NO: 59229 - DNA, 75 bp, Artificial Sequence
  Synthetic
ggcaggaaggtagtaggcacaactgtcccccacccatctgagatgttggcactaatccccaagtcatcgatttcc

SEQ ID NO: 59230 - DNA, 75 bp, Artificial Sequence
  Synthetic
tcccccacccatctgagatgttggcactaatccccaagtcatcgatttcctgcacctgtggacagtcaggggatg

SEQ ID NO: 59231 - DNA, 75 bp, Artificial Sequence
  Synthetic
acagcccaagaatatctgtgtcagttcttccgtctctcgatcagtccttcttctccagaggtcccctcaagggat

SEQ ID NO: 59232 - DNA, 75 bp, Artificial Sequence
  Synthetic
cactcagttgttccacgcttgggagaaagtaactaatgttcatgtcgtcaagagggccctgtccctcaaggagtc

SEQ ID NO: 59233 - DNA, 75 bp, Artificial Sequence
  Synthetic
tatcaactggttcatcacgagagactcaaaccttgctcagaccttgattcgaaacatagtttcgttgacaggtcc

SEQ ID NO: 59234 - DNA, 75 bp, Artificial Sequence
  Synthetic
gtgtttaagagaactggatctgccctccaccgcttcaaatcagcaagatacagtgaggggggttattcttccata

SEQ ID NO: 59235 - DNA, 75 bp, Artificial Sequence
  Synthetic
tgccctaacctgttgtctcatatctctgtgagtaccgatacaatgtctgacctcacacaagatggaacaaacttc

SEQ ID NO: 59236 - DNA, 75 bp, Artificial Sequence
  Synthetic
ctgtgagtaccgatacaatgtctgacctcacacaagatggaacaaacttcgacttcatgtttcagcctctcatgc

SEQ ID NO: 59237 - DNA, 75 bp, Artificial Sequence
  Synthetic
agagactctacctttcattggcatctcagatgtctcaaatgtatccgaccgatagatgacatcaccttggaagcc

SEQ ID NO: 59238 - DNA, 75 bp, Artificial Sequence
  Synthetic
actgctcaggggctcttgtactccattttggttgctactcatgattcagggtataatgatggaaccatattcccg

SEQ ID NO: 59239 - DNA, 75 bp, Artificial Sequence
  Synthetic
ctagagactatctaagagggttggccaggggagtattgataggctcttctatttgctttttgaccagaatgacca

SEQ ID NO: 59240 - DNA, 75 bp, Artificial Sequence
  Synthetic
atattaatatcaatcgccccttggagttgatttctggagtcatttcttatatacttttgaggcttgacaatcacc

SEQ ID NO: 59241 - DNA, 75 bp, Artificial Sequence
  Synthetic
cctatcccaccaccatgaaggagggcaacagatctgttttatgttatttacagcatgtgcttcgctatgagcgag

SEQ ID NO: 59242 - DNA, 75 bp, Artificial Sequence
  Synthetic
taactttaataacttaccagtcccatatcctgcttcagaggattgataggaacttgtccaaacagatgagggttc

SEQ ID NO: 59243 - DNA, 75 bp, Artificial Sequence
  Synthetic
tatcctgcttcagaggattgataggaacttgtccaaacagatgagggttcgattgagacaactgaactccctgat

SEQ ID NO: 59244 - DNA, 75 bp, Artificial Sequence
  Synthetic
gcgacaggtcctaggaggtcatggagaaggcacgttagactcagatgaggatatccaagggctattgagagacgc

SEQ ID NO: 59245 - DNA, 75 bp, Artificial Sequence
  Synthetic
caagaggtccgtcatgccgcgaaaacgatgaagtgtgattatagtccaagtaagagagtgtcacggaaggcagga

SEQ ID NO: 59246 - DNA, 75 bp, Artificial Sequence
  Synthetic
taaccccgcacccatctcggagattgacatcagggcattgtccaagaagctgcagaatccgctgatatctggtct

SEQ ID NO: 59247 - DNA, 75 bp, Artificial Sequence
  Synthetic
tgcagaatccgctgatatctggtctcagggttgtccaatgggcaactggagctcattacaagttgaagccgatac

SEQ ID NO: 59248 - DNA, 75 bp, Artificial Sequence
  Synthetic
tgagcatgtttcctgacgccaaattggtgttcaacagtctcttggaggtcaatgatcttatggcgtctgggacgc

SEQ ID NO: 59249 - DNA, 75 bp, Artificial Sequence
  Synthetic
atcccctacctccttccgcattgatgagtggtggggaggatatagtatcaagagtgattgactttaactccatct

SEQ ID NO: 59250 - DNA, 75 bp, Artificial Sequence
  Synthetic
gggagaaaccctcagatctaaggaatccgtctacctggaggtatttccagaccgtccagagtaccgccaacatgt

SEQ ID NO: 59251 - DNA, 75 bp, Artificial Sequence
  Synthetic
aacaaaataactctgctaatgtcagacttctcgctgtccatcaatggccctctcagtctgatcttcaaaacttat

SEQ ID NO: 59252 - DNA, 75 bp, Artificial Sequence
  Synthetic
gggaccatgctagtcaatccagactataaagcagttcagcatctctccagggctttcccttcagtcacagggtat

SEQ ID NO: 59253 - DNA, 75 bp, Artificial Sequence
  Synthetic
tgagggaaatgagtttagtgcttttcaactgtagcagttctaaaagtgaaatgctaagagccagatcattaaatt

SEQ ID NO: 59254 - DNA, 75 bp, Artificial Sequence
  Synthetic
caactgtagcagttctaaaagtgaaatgctaagagccagatcattaaattatcaagaccttgtaagagggtttcc

SEQ ID NO: 59255 - DNA, 75 bp, Artificial Sequence
  Synthetic
ccacaagatggtcgatgaccttgagcttaggcagggagcattctcaaaaatgtcaatcatattgacaatcatgat

SEQ ID NO: 59256 - DNA, 75 bp, Artificial Sequence
  Synthetic
tgtggtaccctaatatatctatccgcagccttaggagatgtgctgaactttgccagactccatgagctgtacaac

SEQ ID NO: 59257 - DNA, 75 bp, Artificial Sequence
  Synthetic
aatcctgtgacctattacttcaagaagcagacattggggggaagaatgtacttggcctggagctggacagacaac

SEQ ID NO: 59258 - DNA, 75 bp, Artificial Sequence
  Synthetic
ggttgaacagcacctcaaaaactacaatcggtggatcaatttcagtgatctaagatccagatcatccctattgga

SEQ ID NO: 59259 - DNA, 75 bp, Artificial Sequence
  Synthetic
aatcggtggatcaatttcagtgatctaagatccagatcatccctattggattacagttgcttatgatcctatccg

SEQ ID NO: 59260 - DNA, 75 bp, Artificial Sequence
  Synthetic
tcaacatgccttccacactgtagcctagtcgaatcaagaaatgtgaaaaaaacatctccttcatccgggtctttt

SEQ ID NO: 59261 - DNA, 75 bp, Artificial Sequence
  Synthetic
aaaaaacatctccttcatccgggtcttttacatctttggctcatctctgttttttttgttttttttgttaagcgt

SEQ ID NO: 59262 - DNA, 75 bp, Artificial Sequence
  Synthetic
tgttaacaaggttgtgtttaaggtccataatcagctggtctcagtaagacctgaggtgatctctgatcagtatga

SEQ ID NO: 59263 - DNA, 75 bp, Artificial Sequence
  Synthetic
gtataagtaccctgctattaaagataagaagaaaccaagcatcactctcggaaaagatcccgatttgaaaacagc

SEQ ID NO: 59264 - DNA, 75 bp, Artificial Sequence
  Synthetic
ctacaagtctatcttgtcagggatgaatgctgctaaattagacccagatgacgtctgctcttatttagctggagc

SEQ ID NO: 59265 - DNA, 75 bp, Artificial Sequence
  Synthetic
gataacacctgctacgttagtggacattcacaggacgaacactgagggcaactgggctcaaacaggaggtcaaga

SEQ ID NO: 59266 - DNA, 75 bp, Artificial Sequence
  Synthetic
tctcactcgggaccctacgacacctgaacatgcatctctggttggacttcttctttgtctttataggctcagtaa

SEQ ID NO: 59267 - DNA, 75 bp, Artificial Sequence
  Synthetic
gatagtaggacagaatacggggaactataagaccaatgtggcagatagaatggaacagatctttgagactgcccc

SEQ ID NO: 59268 - DNA, 75 bp, Artificial Sequence
  Synthetic
tataagaccaatgtggcagatagaatggaacagatctttgagactgccccatttgtcaagattgtggaacaccac

SEQ ID NO: 59269 - DNA, 75 bp, Artificial Sequence
  Synthetic
gacagtggttactgcttatgaggattgttcggggttggtgtctttcacagggttcatcaagcaaataaatttgac

SEQ ID NO: 59270 - DNA, 75 bp, Artificial Sequence
  Synthetic
tcaagagaatgtttgagccagggcaagaaacagctgttccgcactcgtatttcatccacttcagatcacttggac

SEQ ID NO: 59271 - DNA, 75 bp, Artificial Sequence
  Synthetic
caatgcggttgggcatgtgtttaacctgattcactttgtgggttgttacatgggccaaatcagatctttaaatgc

SEQ ID NO: 59272 - DNA, 75 bp, Artificial Sequence
  Synthetic
cactgtcattcagagttgtgcaccccatgaaatgtcagttttggggggttatttaggggaggagtttttcgggaa

SEQ ID NO: 59273 - DNA, 75 bp, Artificial Sequence
  Synthetic
catgaaatgtcagttttggggggttatttaggggaggagtttttcgggaaggggacatttgaaaggcggttcttc

SEQ ID NO: 59274 - DNA, 75 bp, Artificial Sequence
  Synthetic
atgaggcagcagaaagcactaaggttgatgtagcattggcagatgatgggacagtgaattcggatgatgaagatt

SEQ ID NO: 59275 - DNA, 75 bp, Artificial Sequence
  Synthetic
aattcctttgcagagtttctcaacaagacatattctagtgatcccagataatcccctgattagataaaggatcat

SEQ ID NO: 59276 - DNA, 75 bp, Artificial Sequence
  Synthetic
gatgtaattaaataatccaattggaaagaaaaaaactaacaccactccgctggttccatcatcatcatgagcaag

SEQ ID NO: 59277 - DNA, 75 bp, Artificial Sequence
  Synthetic
aagaaaaaaactaacaccactccgctggttccatcatcatcatgagcaagatctttgtcaatcctagtgcactca

SEQ ID NO: 59278 - DNA, 75 bp, Artificial Sequence
  Synthetic
gatccggcttggctgacttggagatggctgaggagacagtggatttggtgaataaaaacatggaggatagtcaag

SEQ ID NO: 59279 - DNA, 75 bp, Artificial Sequence
  Synthetic
ggctgaggagacagtggatttggtgaataaaaacatggaggatagtcaagcccaccttcaaggaatccctataga

SEQ ID NO: 59280 - DNA, 75 bp, Artificial Sequence
  Synthetic
cgtggaaacacttcctgaggatattaagaggctcagaatagcagactacaaacaggggcaacaggaagaggatgc

SEQ ID NO: 59281 - DNA, 75 bp, Artificial Sequence
  Synthetic
ttcgagacaagaagagggtgaggacgaggacttctacatgaccgagagtgaaaactcatacgtccctctccagtc

SEQ ID NO: 59282 - DNA, 75 bp, Artificial Sequence
  Synthetic
gaggacttctacatgaccgagagtgaaaactcatacgtccctctccagtcttatcttgatgctgtgggaatgcag

SEQ ID NO: 59283 - DNA, 75 bp, Artificial Sequence
  Synthetic
atggattcttcaagatatgggcacaagcagtggaggatatcgtatcctatgtggccaccaacttccctgcccctg

SEQ ID NO: 59284 - DNA, 75 bp, Artificial Sequence
  Synthetic
tcaacaagctccaggccgacaagtcaactcagaccacactggagaaggtcaagcaaaccgcctcctcttctgccc

SEQ ID NO: 59285 - DNA, 75 bp, Artificial Sequence
  Synthetic
aactcagaccacactggagaaggtcaagcaaaccgcctcctcttctgcccctagcaagagggagggacccttttc

SEQ ID NO: 59286 - DNA, 75 bp, Artificial Sequence
  Synthetic
gggctgccagcaatgatgaggatgatggatctattgaggcagagattgctcatcagatagccgagagcttttcca

SEQ ID NO: 59287 - DNA, 75 bp, Artificial Sequence
  Synthetic
agaagtataagttcccttctcgatcatccgggatattcctttggaattttgagcaactgaaaatgaatcttgatg

SEQ ID NO: 59288 - DNA, 75 bp, Artificial Sequence
  Synthetic
atatagtgagagaggtcaaaggaatccccggggtgacaagaatggctcgggatggcatgaagttgcccctccggt

SEQ ID NO: 59289 - DNA, 75 bp, Artificial Sequence
  Synthetic
gatggcatgaagttgcccctccggtgcatgctggggggtgtggcatccaatcattccaaaaggttccaaattcta

SEQ ID NO: 59290 - DNA, 75 bp, Artificial Sequence
  Synthetic
tcatgcaggatgatttaaacagatatcttgcgtattgatctaaaattggccactgtcacaccagaacaaacaaat

SEQ ID NO: 59291 - DNA, 75 bp, Artificial Sequence
  Synthetic
acatgtaacaccactggcaagatgaatatcattcggaaaattgttaagagctgtaaggatgatgagatgcaaaag

SEQ ID NO: 59292 - DNA, 75 bp, Artificial Sequence
  Synthetic
atatcattcggaaaattgttaagagctgtaaggatgatgagatgcaaaagcccaacccagtctctgcccctcctg

SEQ ID NO: 59293 - DNA, 75 bp, Artificial Sequence
  Synthetic
atgactgggaagaagaacatgagaaacttttgtatcaacggggaagtcaaagtgtgcagcccaaatggatattca

SEQ ID NO: 59294 - DNA, 75 bp, Artificial Sequence
  Synthetic
ccggggcccctgttccagatggaatgaattgggtttacaagatcaggcgcacccttatattccagtgggctgagt

SEQ ID NO: 59295 - DNA, 75 bp, Artificial Sequence
  Synthetic
gaattgggtttacaagatcaggcgcacccttatattccagtgggctgagtcatcgggccccctggatggggagga

SEQ ID NO: 59296 - DNA, 75 bp, Artificial Sequence
  Synthetic
tactcttaatatatattatccaataccttcacatgtgaaatcgctgcaatgtgaaaaaaacaaataacatccctc

SEQ ID NO: 59297 - DNA, 75 bp, Artificial Sequence
  Synthetic
tctaccgccatattcgcctttttcttgaactgtgctccttgtctggcaaagttcccaatctacaccatcccggat

SEQ ID NO: 59298 - DNA, 75 bp, Artificial Sequence
  Synthetic
gttcccaatctacaccatcccggataagattggaccgtggagtcctattgacataaaccatctcagctgcccgaa

SEQ ID NO: 59299 - DNA, 75 bp, Artificial Sequence
  Synthetic
caacttgatcgtggaagacgagggatgcacgactctcacccccttctcgtacatggaactgaaagtgggatatat

SEQ ID NO: 59300 - DNA, 75 bp, Artificial Sequence
  Synthetic
acatgcactggtgtgataacagaggcagagacctacacaaactttgtagggtatgtgactacaaccttcaagagg

SEQ ID NO: 59301 - DNA, 75 bp, Artificial Sequence
  Synthetic
cctgtagagatgcctacaactggaagattactggtgatccgagatatgaagagtcactgcacaatccttaccctg

SEQ ID NO: 59302 - DNA, 75 bp, Artificial Sequence
  Synthetic
actctcactggttgagaactgtgaagactaccaaggagtctcttctgatcatctcccctagtgtagtcgacatgg

SEQ ID NO: 59303 - DNA, 75 bp, Artificial Sequence
  Synthetic
caaaatgttccctaacggtaaatgtctagcttcacccccgagtgccatatgttgtccgacaaatcatgattacac

SEQ ID NO: 59304 - DNA, 75 bp, Artificial Sequence
  Synthetic
catttggattccagagaatcctaaacccgggctgtcctgtgatatattcacaactagcaaaggaaagaaagcaac

SEQ ID NO: 59305 - DNA, 75 bp, Artificial Sequence
  Synthetic
cccgggctgtcctgtgatatattcacaactagcaaaggaaagaaagcaaccaaagacgggaggctgtgtggattc

SEQ ID NO: 59306 - DNA, 75 bp, Artificial Sequence
  Synthetic
actctgtggggtccctggcatgagattgatggatggatcatgggtatcccttcagaaaaccgaagctccagaatg

SEQ ID NO: 59307 - DNA, 75 bp, Artificial Sequence
  Synthetic
ttcagaaaaccgaagctccagaatggtgctctccggatcagcttgttagtgtccatgatttccatacagatgaaa

SEQ ID NO: 59308 - DNA, 75 bp, Artificial Sequence
  Synthetic
tcaacaagactctcatggaagcagatgcccattacaagtctgtaagagaatggaaagaagtgatcccatctaaag

SEQ ID NO: 59309 - DNA, 75 bp, Artificial Sequence
  Synthetic
ccatccccactacagtggtatattcttcaatgggatcatactgagtccagggggggatgtactcattccggagat

SEQ ID NO: 59310 - DNA, 75 bp, Artificial Sequence
  Synthetic
gcagtcagctttgttacagcagcacattgagctgctagaatcctcgatgattcctctcagacatcccttggctga

SEQ ID NO: 59311 - DNA, 75 bp, Artificial Sequence
  Synthetic
ttcctctcagacatcccttggctgatccttccacggtgttcaagagagatgatgaggcagaggactttgttgaga

SEQ ID NO: 59312 - DNA, 75 bp, Artificial Sequence
  Synthetic
ttcaccttccagacacccaaaaactcatatcaggcatagatttgggttttcccgaatggaagcgttactttctta

SEQ ID NO: 59313 - DNA, 75 bp, Artificial Sequence
  Synthetic
cccgaatggaagcgttactttcttataggaatatctgtacttgcccttcttgccttagcaataattactgcagca

SEQ ID NO: 59314 - DNA, 75 bp, Artificial Sequence
  Synthetic
tgccttagcaataattactgcagcatgttgcaaaaggttcaagaggagaaggaggcctaagccaaacccaataga

SEQ ID NO: 59315 - DNA, 75 bp, Artificial Sequence
  Synthetic
ggaggcctaagccaaacccaatagagttgatcaggaaagtctctgtaacctctcaaagtggaagggcaattccat

SEQ ID NO: 59316 - DNA, 75 bp, Artificial Sequence
  Synthetic
tctcaaagtggaagggcaattccatcttgggagtcatacaaagtgggggccgctggtgagtcataagcatgtctt

SEQ ID NO: 59317 - DNA, 75 bp, Artificial Sequence
  Synthetic
gtccatagatcatgtgacaacagaggcaactatgcgatgaatctgatgaaagctttaaaaatcacctcatttaat

SEQ ID NO: 59318 - DNA, 75 bp, Artificial Sequence
  Synthetic
cattatatgaattactgcctttgcatattgaaccgggcaagggattgagatcagaaaggtcatctaaggagtatc

SEQ ID NO: 59319 - DNA, 75 bp, Artificial Sequence
  Synthetic
tattgaaccgggcaagggattgagatcagaaaggtcatctaaggagtatcctcccatatatggccagctgacata

SEQ ID NO: 59320 - DNA, 75 bp, Artificial Sequence
  Synthetic
atccttttgattcatgcttgagaattcttgagtttaatttacatctatctgagatgttggtgctttaattagcct

SEQ ID NO: 59321 - DNA, 75 bp, Artificial Sequence
  Synthetic
tcttgagtttaatttacatctatctgagatgttggtgctttaattagcctaattagatgttagcaggctacttga

SEQ ID NO: 59322 - DNA, 75 bp, Artificial Sequence
  Synthetic
atgatagaaacaataacaagacaatcatagtcaatagtgtacactaactacatcggtatgcttagcataacccct

SEQ ID NO: 59323 - DNA, 75 bp, Artificial Sequence
  Synthetic
catagtcaatagtgtacactaactacatcggtatgcttagcataacccctgcttttagtataagctcagagcctt

SEQ ID NO: 59324 - DNA, 75 bp, Artificial Sequence
  Synthetic
gccactctctttacccatttataagaatagtgaaaggggattacgctcggctaaagggtcaatcttctgatgtgt

SEQ ID NO: 59325 - DNA, 75 bp, Artificial Sequence
  Synthetic
aatagtgaaaggggattacgctcggctaaagggtcaatcttctgatgtgtagaaagacaaagagcctcctagcca

SEQ ID NO: 59326 - DNA, 75 bp, Artificial Sequence
  Synthetic
agattatgtactcctgaaaaaaacattaatatgcaagaggagccaacacccctcctcatagatcttcaaatgcaa

SEQ ID NO: 59327 - DNA, 75 bp, Artificial Sequence
  Synthetic
ttaatatgcaagaggagccaacacccctcctcatagatcttcaaatgcaaaatgattgactctactgaggtttac

SEQ ID NO: 59328 - DNA, 75 bp, Artificial Sequence
  Synthetic
cagaagcagacctgagaagcaattcagttgtgccaaacatcttaagaaactcagattataatctgaattccccac

SEQ ID NO: 59329 - DNA, 75 bp, Artificial Sequence
  Synthetic
ttttggaagatccttcaagactgatgatagaatggttaacaacggggaacaggcccagccgactaaatttgacag

SEQ ID NO: 59330 - DNA, 75 bp, Artificial Sequence
  Synthetic
gatgtcgggtcaatgcgggcaggaggtctaggcgcacaaactatgataaccctgtggctacatgggtcccactct

SEQ ID NO: 59331 - DNA, 75 bp, Artificial Sequence
  Synthetic
gagtctacgcgtagcagaaagtgtctcacagaactctcacagttctacaagaagtcatcccctatagagaagttg

SEQ ID NO: 59332 - DNA, 75 bp, Artificial Sequence
  Synthetic
tatgaccaggcattcggtaggtatctaggcaatacttattcctcttacttgtttttccatgtaataattctgtat

SEQ ID NO: 59333 - DNA, 75 bp, Artificial Sequence
  Synthetic
agcgatttagtaaagtttagggatcagatatgggggtctcttgtcataaccaaagactttgtatactctcaaagt

SEQ ID NO: 59334 - DNA, 75 bp, Artificial Sequence
  Synthetic
gacaaggtattgtctgcatgtggaaactccggatacgacgtgataaagctgctggagccttatatcgtgaataag

SEQ ID NO: 59335 - DNA, 75 bp, Artificial Sequence
  Synthetic
ttggtacagaaagcagagaggtttagacctctaattcactccttgggagatttccctcagttcattcgtgacaaa

SEQ ID NO: 59336 - DNA, 75 bp, Artificial Sequence
  Synthetic
gactatggacttgttagataacatacatgacttggtgttcgtttacggctgctatagacattggggtcatcctta

SEQ ID NO: 59337 - DNA, 75 bp, Artificial Sequence
  Synthetic
tattgactacagaaaggggttgtccaagttgtatgatcaggtccacatcaagaaaatcatagacaggaattatca

SEQ ID NO: 59338 - DNA, 75 bp, Artificial Sequence
  Synthetic
aagttgtatgatcaggtccacatcaagaaaatcatagacaggaattatcaagaatgtctggcgagcgatttggcc

SEQ ID NO: 59339 - DNA, 75 bp, Artificial Sequence
  Synthetic
aagaggatacttaggtggggatttgacaaatactcccgctggtatctagactctcatttgctgccgggtgatcat

SEQ ID NO: 59340 - DNA, 75 bp, Artificial Sequence
  Synthetic
ctctcatttgctgccgggtgatcatcctttgtctccctatgtgaaaacccagacttggcctccgaaacatgtggt

SEQ ID NO: 59341 - DNA, 75 bp, Artificial Sequence
  Synthetic
tgacatggttggggacacttggcatagcctcccaataacccaaatctttgaaatcccggagtccatggatccttc

SEQ ID NO: 59342 - DNA, 75 bp, Artificial Sequence
  Synthetic
catggctttcggagaatagaggcggaccagtccctagtgagaaagtgatcattacagcgctttccagacctccag

SEQ ID NO: 59343 - DNA, 75 bp, Artificial Sequence
  Synthetic
caaaagaacgagagcttaagatagaggggagattcttcgcactgatgtcttggaatctaaggctttattttgtca

SEQ ID NO: 59344 - DNA, 75 bp, Artificial Sequence
  Synthetic
ggggagattcttcgcactgatgtcttggaatctaaggctttattttgtcataacagagaaactgttggctacata

SEQ ID NO: 59345 - DNA, 75 bp, Artificial Sequence
  Synthetic
tggaatctaaggctttattttgtcataacagagaaactgttggctacatatatcttgcccctgtttgacgccttg

SEQ ID NO: 59346 - DNA, 75 bp, Artificial Sequence
  Synthetic
tagattatgaaaagtggaacaaccatcaacgactggagtcgacaaaagatgtgttttctgtcttggacaaggtat

SEQ ID NO: 59347 - DNA, 75 bp, Artificial Sequence
  Synthetic
ggtcctacctgttggaacggccaggacgggggacttgaaggtttgagacaaaaaggctggagtttggtcagtctt

SEQ ID NO: 59348 - DNA, 75 bp, Artificial Sequence
  Synthetic
agcgcagggggacaatcaagtcttgtgcccgacttacatgctgtcgtccggattgaacaaggagggcttgctgta

SEQ ID NO: 59349 - DNA, 75 bp, Artificial Sequence
  Synthetic
tgagttggacagtatatcaaggaatgccatctcgatctatagagctattgaagatggggcttccaagttggggct

SEQ ID NO: 59350 - DNA, 75 bp, Artificial Sequence
  Synthetic
tatcattaagaaagaggagactatgtgcagttatgactttctcatatacgggaaaactccattgtttaggggcaa

SEQ ID NO: 59351 - DNA, 75 bp, Artificial Sequence
  Synthetic
tgcagttatgactttctcatatacgggaaaactccattgtttaggggcaatatcctggttccggagtctaagaga

SEQ ID NO: 59352 - DNA, 75 bp, Artificial Sequence
  Synthetic
tatcctggttccggagtctaagagatgggccagagtctcatgtatatccaatgaccagatagtcaacctagcaaa

SEQ ID NO: 59353 - DNA, 75 bp, Artificial Sequence
  Synthetic
ctttctcctgatgtctgtccaggcagtgtaccattaccttctgttcagccctatcttgaaggatagagtttacaa

SEQ ID NO: 59354 - DNA, 75 bp, Artificial Sequence
  Synthetic
cagtctctgagggattatctttctggagggagatctggctgagctcctcagaatcatggattcatgcgctatgcc

SEQ ID NO: 59355 - DNA, 75 bp, Artificial Sequence
  Synthetic
gagggagatctggctgagctcctcagaatcatggattcatgcgctatgccaagaagcaggaaaccctgacctggg

SEQ ID NO: 59356 - DNA, 75 bp, Artificial Sequence
  Synthetic
aggctgctggaggaccccacaacattgaacataagaggaggagcaagcccgaccatcctgttaaaggaagccatt

SEQ ID NO: 59357 - DNA, 75 bp, Artificial Sequence
  Synthetic
cggaaggccttgtatgatgaggtcgacaaggtagaaaattctgaatttcgggaggccatattattgtccaagaca

SEQ ID NO: 59358 - DNA, 75 bp, Artificial Sequence
  Synthetic
acaaggtagaaaattctgaatttcgggaggccatattattgtccaagacacacagagacaactttatattgtttt

SEQ ID NO: 59359 - DNA, 75 bp, Artificial Sequence
  Synthetic
agaagcttgtcaagaaccctagaggagtcgttttttaactctgaaatccacggaatcagcaggatgactcaggtt

SEQ ID NO: 59360 - DNA, 75 bp, Artificial Sequence
  Synthetic
cggaatcagcaggatgactcaggttcctcagagaatagggagggtgtggagctgttccgctgagcgagcagatca

SEQ ID NO: 59361 - DNA, 75 bp, Artificial Sequence
  Synthetic
cctcagagaatagggagggtgtggagctgttccgctgagcgagcagatcagttgagagagatatcatggggcagg

SEQ ID NO: 59362 - DNA, 75 bp, Artificial Sequence
  Synthetic
agagatcccctcaagggatatctgggatcttctacctctatgtctactcagttgttccatgcttgggaaaaagta

SEQ ID NO: 59363 - DNA, 75 bp, Artificial Sequence
  Synthetic
actaatgttcatgtcgtcaagagggccttgtccctcaaggaatctatcaattggttcattacgagagactcgaac

SEQ ID NO: 59364 - DNA, 75 bp, Artificial Sequence
  Synthetic
cttgctcagaccttgatccgaaacatagtgtcgttgacaggcccctttttccccctagaggaagctcctgtgttt

SEQ ID NO: 59365 - DNA, 75 bp, Artificial Sequence
  Synthetic
aacctgttgtctcatatctctgtgagtacagatacaatgtctgacctcacacaagatggaacaaacttcgacttc

SEQ ID NO: 59366 - DNA, 75 bp, Artificial Sequence
  Synthetic
atgtttcagcctctcatgctctatgctcaaacttggacttcagaactggttcagaaagacctccgattaagagac

SEQ ID NO: 59367 - DNA, 75 bp, Artificial Sequence
  Synthetic
ctcaaacttggacttcagaactggttcagaaagacctccgattaagagactccacctttcattggcaccttagat

SEQ ID NO: 59368 - DNA, 75 bp, Artificial Sequence
  Synthetic
gtctcaaatgtatccgaccgatagatgacatcaccttggaagccccaaaaatcttctcctttcccgacgtatcaa

SEQ ID NO: 59369 - DNA, 75 bp, Artificial Sequence
  Synthetic
agcagtgcctcagttcagaaagctgcctgagataggactgaagccagggaagtttgactcattgaaggaaaaaga

SEQ ID NO: 59370 - DNA, 75 bp, Artificial Sequence
  Synthetic
caaatccagacatatagggactgctcaggggctcctgtactccattttggttgctactcacgattcagggtacaa

SEQ ID NO: 59371 - DNA, 75 bp, Artificial Sequence
  Synthetic
caggggctcctgtactccattttggttgctactcacgattcagggtacaatgacggaaccatattcccggtaaat

SEQ ID NO: 59372 - DNA, 75 bp, Artificial Sequence
  Synthetic
atctacggaaaagtctctcctagagactatctaagagggttggccaggggagtattgataggctcttctatttgc

SEQ ID NO: 59373 - DNA, 75 bp, Artificial Sequence
  Synthetic
ttctggagtcatttcttatatacttctgaggcttgacaatcacccctcattgtatgttatgctgaaagagccatc

SEQ ID NO: 59374 - DNA, 75 bp, Artificial Sequence
  Synthetic
tctgagatctgagatattctccatccctcagaaaatacctgctgcctatcccaccaccatgaaggagggcaacag

SEQ ID NO: 59375 - DNA, 75 bp, Artificial Sequence
  Synthetic
agtataaagatgacctatctaactttgataacttatcagtcccatatcttgcttcaaaggattgacaggaatttg

SEQ ID NO: 59376 - DNA, 75 bp, Artificial Sequence
  Synthetic
acattagattcagatgaggatatccaagggctattgagagacgctttacagaggacgagatgggtggatcaagag

SEQ ID NO: 59377 - DNA, 75 bp, Artificial Sequence
  Synthetic
gtccgtcatgccgcgaaaacgatgaaatgtgattatagtccaagtaagagagtgtcacggaaggcaggctgttca

SEQ ID NO: 59378 - DNA, 75 bp, Artificial Sequence
  Synthetic
gaatggatatgctctgcacaacaagttgcggtgtccacatcatctaaccccgcacccatctcagagattgacatc

SEQ ID NO: 59379 - DNA, 75 bp, Artificial Sequence
  Synthetic
atcttgaagcataccccacattgtgtttagtggtaggagatggctcaggaggaatatccagagctgtactaagca

SEQ ID NO: 59380 - DNA, 75 bp, Artificial Sequence
  Synthetic
tttagtggtaggagatggctcaggaggaatatccagagctgtactaagcatgtttcctgatgctaaattggtgtt

SEQ ID NO: 59381 - DNA, 75 bp, Artificial Sequence
  Synthetic
taacagtctcttggaggtcaatgatcttatggcatctggaacgcatcccctacctccttccgcattgatgagtgg

SEQ ID NO: 59382 - DNA, 75 bp, Artificial Sequence
  Synthetic
cttatggcatctggaacgcatcccctacctccttccgcattgatgagtggtggggaagatatagtgtcaagagtg

SEQ ID NO: 59383 - DNA, 75 bp, Artificial Sequence
  Synthetic
attgactttaactccatctgggagaaaccctctgatttgaggaatccatctacctggaggtatttccagaccgtc

SEQ ID NO: 59384 - DNA, 75 bp, Artificial Sequence
  Synthetic
tacctggaggtatttccagaccgtccagagtgcggccaacatgtcctacgacttaataatctgtgatgcggaagt

SEQ ID NO: 59385 - DNA, 75 bp, Artificial Sequence
  Synthetic
acttaataatctgtgatgcggaagtgaccgacatcccatcaataaacaaaataactctgttaatgtcagacttct

SEQ ID NO: 59386 - DNA, 75 bp, Artificial Sequence
  Synthetic
tctgatcttcaaaacttatgggaccatgctggtcaatccagactataaagcagttcagcatctctccagggcttt

SEQ ID NO: 59387 - DNA, 75 bp, Artificial Sequence
  Synthetic
aactctatttgaaattctccaagagagggaagttcttcagagactcggagtatttgacatcatctaccttgaggg

SEQ ID NO: 59388 - DNA, 75 bp, Artificial Sequence
  Synthetic
atgattataactctcatagacaatgatgtagagtcctttctcgtccacaagatggtcgatgacctcgagcttagg

SEQ ID NO: 59389 - DNA, 75 bp, Artificial Sequence
  Synthetic
cagggagcattctcaaagatgtcaatcatattgacaattatgatggtgttttccaacagagtgttcaatgtgtca

SEQ ID NO: 59390 - DNA, 75 bp, Artificial Sequence
  Synthetic
tcatattgacaattatgatggtgttttccaacagagtgttcaatgtgtcaaaacctctgaacgaccctaaatttt

SEQ ID NO: 59391 - DNA, 75 bp, Artificial Sequence
  Synthetic
accctccgtcagatcccaaaattttgaggcactttaatatttgctgtggtaccctaatatatctatcagcagcct

SEQ ID NO: 59392 - DNA, 75 bp, Artificial Sequence
  Synthetic
gaggcactttaatatttgctgtggtaccctaatatatctatcagcagccttaggagatgtgctgaactttgccag

SEQ ID NO: 59393 - DNA, 75 bp, Artificial Sequence
  Synthetic
cattggggggaagaatgtacttggcatggagttggacagacaacactccagtattcaaaagagttgcctgtaact

SEQ ID NO: 59394 - DNA, 75 bp, Artificial Sequence
  Synthetic
gtattcaaaagagttgcctgtaactctagtttgagcctgtcgtcacactggataaggctgatttataaaattgtg

SEQ ID NO: 59395 - DNA, 75 bp, Artificial Sequence
  Synthetic
ctagtttgagcctgtcgtcacactggataaggctgatttataaaattgtgaagaccacaaggcttgtagggagtg

SEQ ID NO: 59396 - DNA, 75 bp, Artificial Sequence
  Synthetic
ctaaagatctctcccaagaggttgaaaaacaccttaaaagctacaatcggtggatcaacttcagtgatttgagat

SEQ ID NO: 59397 - DNA, 75 bp, Artificial Sequence
  Synthetic
aaaacaccttaaaagctacaatcggtggatcaacttcagtgatttgagatccagatcctccctattagattacag

SEQ ID NO: 59398 - DNA, 75 bp, Artificial Sequence
  Synthetic
ttgcttgtgatcccatctgtcaacatgcttttcacactgtggcctagttgaaccaagagatgtgaaaaaaacatt

SEQ ID NO: 59399 - DNA, 75 bp, Artificial Sequence
  Synthetic
aaaaacatttctttcatcctggtcttttacatttttggctcattctctgttttttttgttttttttgttaagcgt

SEQ ID NO: 59400 - DNA, 75 bp, Artificial Sequence
  Synthetic
gtacaaataccctgccattaaagacaagaagaaaccgagcatcactctcggaaaagatcctgatttgaaaacagc

SEQ ID NO: 59401 - DNA, 75 bp, Artificial Sequence
  Synthetic
tcaagagaatgtttgagccagggcaagaaacagctgttccgcactcatatttcatccacttccgatcattaggac

SEQ ID NO: 59402 - DNA, 75 bp, Artificial Sequence
  Synthetic
agagacgagaaagagttacaggattacgaggcagcagaaagcaccaaggttgatgtagcattggcagacgatggg

SEQ ID NO: 59403 - DNA, 75 bp, Artificial Sequence
  Synthetic
aattcctttgctgagtttctcaacaagacgtattctagtgatccgagataatcccccgattggataagggattat

SEQ ID NO: 59404 - DNA, 75 bp, Artificial Sequence
  Synthetic
agacgtattctagtgatccgagataatcccccgattggataagggattatgatgtgattaaataatccaattgaa

SEQ ID NO: 59405 - DNA, 75 bp, Artificial Sequence
  Synthetic
aagaaaaaaactaacaccactccgctggttccaccatcatcatgagcaagatctttgtcaatcctagtgcactta

SEQ ID NO: 59406 - DNA, 75 bp, Artificial Sequence
  Synthetic
ggctgaagagacagtggatttggtgaataaaaacatggaggatagtcaagcccaccttcaaggaatccctataga

SEQ ID NO: 59407 - DNA, 75 bp, Artificial Sequence
  Synthetic
aagaggctcagaatagcagactacaaacaagggcaacaggaagaggatgcttcaagacaagaggaaggtgaggac

SEQ ID NO: 59408 - DNA, 75 bp, Artificial Sequence
  Synthetic
gaggacttctacatgaccgagagtgagaactcatacgtccctctccagtcttatcttgacgctgtgggggtgcag

SEQ ID NO: 59409 - DNA, 75 bp, Artificial Sequence
  Synthetic
gtggccaccaacttccccgcccctgtcaacaagccccatgccgacaagtcaactcagaccacactggagaaggtc

SEQ ID NO: 59410 - DNA, 75 bp, Artificial Sequence
  Synthetic
tcaacaagccccatgccgacaagtcaactcagaccacactggagaaggtcaagcaagccacatcctcctctgccc

SEQ ID NO: 59411 - DNA, 75 bp, Artificial Sequence
  Synthetic
gagcaactgaaaatgaatctagacgatatagtgagagaggtcaaaggaatccccggagtgacaagaatggctcga

SEQ ID NO: 59412 - DNA, 75 bp, Artificial Sequence
  Synthetic
gcatgctggggagtgtggcgtccaaccattccaagaggttccaaattctagtcaattcggcgaaattaggcaaac

SEQ ID NO: 59413 - DNA, 75 bp, Artificial Sequence
  Synthetic
ttatgcaagatgatctcaacagatatcttgcgtattgatccaaattggctacggtcacactaagacagacaaatc

SEQ ID NO: 59414 - DNA, 75 bp, Artificial Sequence
  Synthetic
gactgttatcaaatcatgaaaaaaacatgtaacaccactggcaagatgaatatcattcggaaaattgttaagagc

SEQ ID NO: 59415 - DNA, 75 bp, Artificial Sequence
  Synthetic
tatcattcggaaaattgttaagagctgtaaggatgatgagatgcaaaagcccagcccagtctctgcccctcctga

SEQ ID NO: 59416 - DNA, 75 bp, Artificial Sequence
  Synthetic
cgacgatgatctgtggcttccccctcctgaatatgtcccgctgtcagagatgactgggaagaagaacatgaggaa

SEQ ID NO: 59417 - DNA, 75 bp, Artificial Sequence
  Synthetic
ttggaatactctcaagagattacatgggatgatgattctgagtttgtcggtttgcagataagggtgagtgcaaga

SEQ ID NO: 59418 - DNA, 75 bp, Artificial Sequence
  Synthetic
tgaaaaaaacaaataacacccctcaaaagattcaaaagccatgttactctctaccgcaatattcgcctttttctt

SEQ ID NO: 59419 - DNA, 75 bp, Artificial Sequence
  Synthetic
gcacgactctcaccccattctcgtacatggaactgaaagtgggatatataacaacaataaaaatagaaggattta

SEQ ID NO: 59420 - DNA, 75 bp, Artificial Sequence
  Synthetic
attactggtgatccgagatatgaagagtcactgcacaatccttaccctgactctcattggttgagaactgtgaag

SEQ ID NO: 59421 - DNA, 75 bp, Artificial Sequence
  Synthetic
ccgggctgtcctgtgatatattcacgactagcaaaggaaagaaagcaaccaaggatgggaagctgtgtggatttg

SEQ ID NO: 59422 - DNA, 75 bp, Artificial Sequence
  Synthetic
tccatgatttccatacagatgaaattgaacaccttgtggttgaagaattggtgaagaagagggaagagtgtttgg

SEQ ID NO: 59423 - DNA, 75 bp, Artificial Sequence
  Synthetic
tgaacaccttgtggttgaagaattggtgaagaagagggaagagtgtttggatgcgttagagaccatcatcacaac

SEQ ID NO: 59424 - DNA, 75 bp, Artificial Sequence
  Synthetic
gcccattacaagtctgtgagagaatggacagaagtgatcccatctaaagggtgtctgatggcaggggggagatgc

SEQ ID NO: 59425 - DNA, 75 bp, Artificial Sequence
  Synthetic
atgaggcagaggattttgttgaggttcaccttccagacacccaaaaactcatatcaggcatagatttgggttttc

SEQ ID NO: 59426 - DNA, 75 bp, Artificial Sequence
  Synthetic
ctgaatggaagcgttactttcttatagggatatctgtgcttgcccttcttgccttagcaataattactgcagcgt

SEQ ID NO: 59427 - DNA, 75 bp, Artificial Sequence
  Synthetic
agggatatctgtgcttgcccttcttgccttagcaataattactgcagcgtgttgcaagaggttcaaaaggaaaaa

SEQ ID NO: 59428 - DNA, 75 bp, Artificial Sequence
  Synthetic
gaggccgaagccaaacccgatagagttgatcaggaaagtctctgtaacttctcaaagtggaagggcagttccatc

SEQ ID NO: 59429 - DNA, 75 bp, Artificial Sequence
  Synthetic
ctcaaagtggaagggcagttccatcttgggagtcttacaaggtggggactgctagtgagtcctaagcatgtctag

SEQ ID NO: 59430 - DNA, 75 bp, Artificial Sequence
  Synthetic
caactatgcgatgaatctgatgagagctttaaaaatcacctcatttaatcattatatgaattactgcctttgcat

SEQ ID NO: 59431 - DNA, 75 bp, Artificial Sequence
  Synthetic
attaaaccgggcaagggattgggatcagaagggccatctaaggagtgttctctcacatagggccagctgacatga

SEQ ID NO: 59432 - DNA, 75 bp, Artificial Sequence
  Synthetic
atagtcaatagtgtacactaactacatcggtgtgcttagcataaccccgcttttagtatgagcttagagccttgc

SEQ ID NO: 59433 - DNA, 75 bp, Artificial Sequence
  Synthetic
cactctctttacacacttataaagatattgaaaggggattacgctcaaataaagggttaatcttctgatgtgtag

SEQ ID NO: 59434 - DNA, 75 bp, Artificial Sequence
  Synthetic
tattgaaaggggattacgctcaaataaagggttaatcttctgatgtgtagacagacgaagagcctcctaaccaag

SEQ ID NO: 59435 - DNA, 75 bp, Artificial Sequence
  Synthetic
attacgtgctcctgaaaaaaacattaatatgcaagaggagccaacacccctcctcggagatcttcaaatgaaaaa

SEQ ID NO: 59436 - DNA, 75 bp, Artificial Sequence
  Synthetic
aacttgctccgatcctacaaggttctgagaggctattttaagaagttagatgtcgggtcaatgcgggcaggaggt

SEQ ID NO: 59437 - DNA, 75 bp, Artificial Sequence
  Synthetic
tgtcgggtcaatgcgggcaggaggtccaggcgcacaagccatgataaccttgtggctacacgggtcccactctga

SEQ ID NO: 59438 - DNA, 75 bp, Artificial Sequence
  Synthetic
acagaactctcacagttctacaagaaatcatcccctatagagaagttgttaaactataccctagagaacagggga

SEQ ID NO: 59439 - DNA, 75 bp, Artificial Sequence
  Synthetic
cgacttggtaaagttcagggatcagatatgggggtcccttgtcataaccaaagactttgtatactcccaaagtgc

SEQ ID NO: 59440 - DNA, 75 bp, Artificial Sequence
  Synthetic
cttgatctctcccccggaatcaagatattcagatgacttggtgtccaatttgtgtcaactctacatcgcgggaga

SEQ ID NO: 59441 - DNA, 75 bp, Artificial Sequence
  Synthetic
ggtacagaaagcagagaggttcagacctttaattcactccctgggagattttcctcagttcattcgtgacaagac

SEQ ID NO: 59442 - DNA, 75 bp, Artificial Sequence
  Synthetic
cccagtgccagagagttttttcagactatggacttgttagataacatacatgacttggtgttcgtttacggctgc

SEQ ID NO: 59443 - DNA, 75 bp, Artificial Sequence
  Synthetic
ctatggacttgttagataacatacatgacttggtgttcgtttacggctgctatagacattggggccacccttata

SEQ ID NO: 59444 - DNA, 75 bp, Artificial Sequence
  Synthetic
gaggatacttagatggggattcgacaaatattcccgctggtatttagactctaatttgctgccaggtgatcatcc

SEQ ID NO: 59445 - DNA, 75 bp, Artificial Sequence
  Synthetic
atcccggagtccatggatccctcagagattctggatgacaaatctcactcgttcactaggactaggctggcctca

SEQ ID NO: 59446 - DNA, 75 bp, Artificial Sequence
  Synthetic
agattctggatgacaaatctcactcgttcactaggactaggctggcctcatggctttcggagaatagaggcggac

SEQ ID NO: 59447 - DNA, 75 bp, Artificial Sequence
  Synthetic
tggctttcggagaatagaggcggaccagtccctagtgagaaggtgatcattacagcactctccagacctccagtc

SEQ ID NO: 59448 - DNA, 75 bp, Artificial Sequence
  Synthetic
ttgatgtgggaggactgccagatgatgacttgataatcggtctgaagccaaaagaacgagagctcaagatagagg

SEQ ID NO: 59449 - DNA, 75 bp, Artificial Sequence
  Synthetic
gattatgaaaaatggaacaaccatcaacgactagagtcaacaaaagatgtgttttctgtcttggacaaggtgttt

SEQ ID NO: 59450 - DNA, 75 bp, Artificial Sequence
  Synthetic
agaaacaccagaacaaaaatcctagcacagggggacaatcaagtcttgtgcccgacttacatgctgtcgtccgga

SEQ ID NO: 59451 - DNA, 75 bp, Artificial Sequence
  Synthetic
tcctggtcccggagtctaagagatgggccagagtctcatgtatatccaatgaccagatagtcaacctggcaaata

SEQ ID NO: 59452 - DNA, 75 bp, Artificial Sequence
  Synthetic
ttctcctgatgtctgtccaggcagtgttccattaccttttgttcagccctatcttgaaggatagagtgtacaaga

SEQ ID NO: 59453 - DNA, 75 bp, Artificial Sequence
  Synthetic
tctcagggatgtccttgggacgattccatattcgtcagttttcggacccagtctctgagggattatctttctgga

SEQ ID NO: 59454 - DNA, 75 bp, Artificial Sequence
  Synthetic
aggccatattattgtccaagacacatagagacaactttatattgtttttgagatctgtagaacccttattccctc

SEQ ID NO: 59455 - DNA, 75 bp, Artificial Sequence
  Synthetic
tagagacaactttatattgtttttgagatctgtagaacccttattccctcgatttctcagtgaattgttcagctc

SEQ ID NO: 59456 - DNA, 75 bp, Artificial Sequence
  Synthetic
ctcatttcttggaattcctgaatcaatcatcggattaatccagaactccagaaccatcagacgccaattcaggag

SEQ ID NO: 59457 - DNA, 75 bp, Artificial Sequence
  Synthetic
gaaccatcagacgccaattcaggagaagtttgtcgagaaccctggaggagtcgtttttcagctctgaaatccacg

SEQ ID NO: 59458 - DNA, 75 bp, Artificial Sequence
  Synthetic
gaatcagcaggatgactcaggttcctcagagaatagggagggtgtggagctgttccgcagagcgagcagatcagt

SEQ ID NO: 59459 - DNA, 75 bp, Artificial Sequence
  Synthetic
agaatatctgtgtcagttcttccgtctcttgatcagtccttcttctccagaggtcccctcaagggatacttggga

SEQ ID NO: 59460 - DNA, 75 bp, Artificial Sequence
  Synthetic
ggttcatcacgagagactcaaaccttgctcagaccttgattcgaaacatagtgtcgttgacaggtccccttttcc

SEQ ID NO: 59461 - DNA, 75 bp, Artificial Sequence
  Synthetic
tgctcagaccttgattcgaaacatagtgtcgttgacaggtccccttttccctctagaggaagcccccgtgtttaa

SEQ ID NO: 59462 - DNA, 75 bp, Artificial Sequence
  Synthetic
gagaaccggatctgccctccaccgcttcaaatcagcaagatacagtgaggggggttattcgtccatatgccctaa

SEQ ID NO: 59463 - DNA, 75 bp, Artificial Sequence
  Synthetic
tctgttgtctcatatatctgtgagcacagatacaatgtctgaacttacacaagatggaacaaacttcgacttcat

SEQ ID NO: 59464 - DNA, 75 bp, Artificial Sequence
  Synthetic
acagatacaatgtctgaacttacacaagatggaacaaacttcgacttcatgtttcagcctcttatgctttatgct

SEQ ID NO: 59465 - DNA, 75 bp, Artificial Sequence
  Synthetic
caaacttggacttcagaactagttcagaaagaccttcgattaagagactctacctttcattggcatctcagatgt

SEQ ID NO: 59466 - DNA, 75 bp, Artificial Sequence
  Synthetic
tgagataggcctgaagccagggaagtttgactcattgaaggaaaaagataagtccagacatatagggactgccca

SEQ ID NO: 59467 - DNA, 75 bp, Artificial Sequence
  Synthetic
ggggctcctgtactccgttttggttgctactcatgattcagggtataatgacggaaccatattcccggtaaatat

SEQ ID NO: 59468 - DNA, 75 bp, Artificial Sequence
  Synthetic
ttacggaaaagtctcccctagagactatctaagagggttggccaggggagtgttgataggctcttctatttgctt

SEQ ID NO: 59469 - DNA, 75 bp, Artificial Sequence
  Synthetic
atcaatcgccccttggagttgatttctggagtcatttcttatatacttttgaggcttgacaatcacccctcattg

SEQ ID NO: 59470 - DNA, 75 bp, Artificial Sequence
  Synthetic
gaggcttgacaatcacccctcattgtatgtcatgctaaaggagccatctctgagatcagagatattctccatccc

SEQ ID NO: 59471 - DNA, 75 bp, Artificial Sequence
  Synthetic
caaacagatgagggttcggttgagacaattgaactccctgatgcggcaggtcctaggaggtcacggagaaggcac

SEQ ID NO: 59472 - DNA, 75 bp, Artificial Sequence
  Synthetic
tgtgattatagtccaagtaagagagtgtcacggaaggcaggatgttcagaatggatatgctctgcacagcaagtt

SEQ ID NO: 59473 - DNA, 75 bp, Artificial Sequence
  Synthetic
tccaatgggcaactggagctcattacaagttgaagccgatactcaacgaccttgaggcataccccacattgtgtt

SEQ ID NO: 59474 - DNA, 75 bp, Artificial Sequence
  Synthetic
tagtggtaggagatggctcaggaggaatatccagggctgtactgagcatgtttcctgacgctaaattggtgttca

SEQ ID NO: 59475 - DNA, 75 bp, Artificial Sequence
  Synthetic
aatatccagggctgtactgagcatgtttcctgacgctaaattggtgttcaacagtctcttggaggtcaatgatct

SEQ ID NO: 59476 - DNA, 75 bp, Artificial Sequence
  Synthetic
gggaggatatagtatcaagagtgattgactttaactccatctgggaaaaaccttctgatctgaggaatccatcta

SEQ ID NO: 59477 - DNA, 75 bp, Artificial Sequence
  Synthetic
cctggaggtatttccagaccgtccagagtaccaccaacatgtcctacgatttaataatctgtgatgcggaagtga

SEQ ID NO: 59478 - DNA, 75 bp, Artificial Sequence
  Synthetic
taatctctaatccatataatgaaatgatcataactctcatagacaatgatgtagagtcctttctcgtccacaaga

SEQ ID NO: 59479 - DNA, 75 bp, Artificial Sequence
  Synthetic
gtagagtcctttctcgtccacaagatggtcgatgacctcgagcttaggcagggagcattctcaaaaatgtcaatc

SEQ ID NO: 59480 - DNA, 75 bp, Artificial Sequence
  Synthetic
ggcactttaatatttgttgtggtaccctaatatatttatcagcagccttgggagatgtgctgaactttgccagac

SEQ ID NO: 59481 - DNA, 75 bp, Artificial Sequence
  Synthetic
agtttgagcttgtcgtcacactggataaggctaatttataaaattgtgaagactacgaggcttgtggggagtgct

SEQ ID NO: 59482 - DNA, 75 bp, Artificial Sequence
  Synthetic
aaagatctctccaaggaggttgaaaagcacctcaaaagctacaatcggtggatcaatttcagtgatttgagatcc

SEQ ID NO: 59483 - DNA, 75 bp, Artificial Sequence
  Synthetic
agcacctcaaaagctacaatcggtggatcaatttcagtgatttgagatccagatcatccctattggattacagtt

SEQ ID NO: 59484 - DNA, 75 bp, Artificial Sequence
  Synthetic
gcttatgatcctatctgttaacatgcctttcacactgtggcctagtagaatcaagaaatgtgaaaaaaacatctc

SEQ ID NO: 59485 - DNA, 75 bp, Artificial Sequence
  Synthetic
aaaaacatctccttcatccgggtcttctacatttttggctcattctctgttttttttgttttttttgttaagcgt

SEQ ID NO: 59486 - DNA, 75 bp, Artificial Sequence
  Synthetic
tgttaacaaggttgtttttaaggtccataatcagctggtctcggtaagacctgaggtgatttctgatcagtatga

SEQ ID NO: 59487 - DNA, 75 bp, Artificial Sequence
  Synthetic
agaaacagctgttccgcactcgtatttcatccacttcagatcacttggactcagtggaaagtctccttattcatc

SEQ ID NO: 59488 - DNA, 75 bp, Artificial Sequence
  Synthetic
catgaaatgtcagttttggggggttatctaggggaggagtttttcgggaagggaacatttgagaggcggttcttc

SEQ ID NO: 59489 - DNA, 75 bp, Artificial Sequence
  Synthetic
agagatgagaaagagctacaggattacgaggcagcagaaagcactaaggttgatgtagcattggcagatgatggg

SEQ ID NO: 59490 - DNA, 75 bp, Artificial Sequence
  Synthetic
acagtgaattcggatgatgaagacttcttttcgggagacacgagaagcccagaggcagtatacaccaggattatg

SEQ ID NO: 59491 - DNA, 75 bp, Artificial Sequence
  Synthetic
aattcctttgcagagtttctcaacaagacgtattctagtgatcccagataatcccctgattagataagggatcat

SEQ ID NO: 59492 - DNA, 75 bp, Artificial Sequence
  Synthetic
attgtcagaaagatgaaaactggagatggattcttcaagatatgggcacaagcagtggaggacatcgtatcttat

SEQ ID NO: 59493 - DNA, 75 bp, Artificial Sequence
  Synthetic
aactcggaccacactggagaaggtcaagcaagccgcctcctcttctgcccctagcaagagggagggaccatcctc

SEQ ID NO: 59494 - DNA, 75 bp, Artificial Sequence
  Synthetic
tcattccaaaaggttccaaattctagtcaattcggcgaaactgggcaaactcatgcaggatgatctaaacagata

SEQ ID NO: 59495 - DNA, 75 bp, Artificial Sequence
  Synthetic
tcatgcaggatgatctaaacagatatcttgcgtattgatctaaaattggccactgtcacaccaggacaaataaat

SEQ ID NO: 59496 - DNA, 75 bp, Artificial Sequence
  Synthetic
ttcaggatcatcagacatatcttgagctccttcgaaggggtgtattctgggaatagaaggatgatagggctggtg

SEQ ID NO: 59497 - DNA, 75 bp, Artificial Sequence
  Synthetic
gctccttcgaaggggtgtattctgggaatagaaggatgatagggctggtgaaggttgtcattgggttggcactgt

SEQ ID NO: 59498 - DNA, 75 bp, Artificial Sequence
  Synthetic
catgccagctgtggtctgacatgtctctaaaaactcagcagtctgacgaagacaagaacacttccttgctcctcg

SEQ ID NO: 59499 - DNA, 75 bp, Artificial Sequence
  Synthetic
cagagacctacacaaactttgtagggtatgtgactacaaccttcaagaggaaacatttccggccaactgtgagcg

SEQ ID NO: 59500 - DNA, 75 bp, Artificial Sequence
  Synthetic
actctcattggttgagaactgtgaagaccaccaaggagtctcttctgatcatctctcctagtgtagtcgacatgg

SEQ ID NO: 59501 - DNA, 75 bp, Artificial Sequence
  Synthetic
acgcatatgacaaaaacctctactccaaaatgttccctaatggtaaatgtctagcttcacccccgagtgccatat

SEQ ID NO: 59502 - DNA, 75 bp, Artificial Sequence
  Synthetic
ttgatggatggatcatgggtatctcttcagaaaactgaagctccggaatggtgctctccagatcagcttgttaat

SEQ ID NO: 59503 - DNA, 75 bp, Artificial Sequence
  Synthetic
tgcccattacaagtctgtaagagaatggaaagaagtgatcccatctaaagggtgtctgatggcaggggggagatg

SEQ ID NO: 59504 - DNA, 75 bp, Artificial Sequence
  Synthetic
ccatcctcactacagtggtatattcttcaatgggatcatactgagtccagggggtgatgtactcattccggagat

SEQ ID NO: 59505 - DNA, 75 bp, Artificial Sequence
  Synthetic
attgagctgctagaatcctcgatgattcctctcagacatcccttggctgacccttccacggtgttcaagagagat

SEQ ID NO: 59506 - DNA, 75 bp, Artificial Sequence
  Synthetic
gttgatcaggaaagtttctgtaacctctcaaagtggaagggcaattccatcttgggagtcgtacaaagtgggggc

SEQ ID NO: 59507 - DNA, 75 bp, Artificial Sequence
  Synthetic
tctcaaagtggaagggcaattccatcttgggagtcgtacaaagtgggggccactggtgagtcataagtatgtctt

SEQ ID NO: 59508 - DNA, 75 bp, Artificial Sequence
  Synthetic
tattgaaccgagcgagggattgagattagaaaggtcatctaaggagtatcttcccatatatggccagctgacatg

SEQ ID NO: 59509 - DNA, 75 bp, Artificial Sequence
  Synthetic
gcttttagtataagctcagagccttgccacgctctttacccatttataagaatagtgaagggggattacgctcag

SEQ ID NO: 59510 - DNA, 75 bp, Artificial Sequence
  Synthetic
ctaaagggtcaatcttctgatgtgtagacagacaaagaacctcctaaccaagattgtgtactcctgaaaaaaaca

SEQ ID NO: 59511 - DNA, 75 bp, Artificial Sequence
  Synthetic
gatgatccggtggatcctgttgagccagaagcagacctgagaagcaattcagttgtgccaaacatcttaagaaac

SEQ ID NO: 59512 - DNA, 75 bp, Artificial Sequence
  Synthetic
ttttggaagatccttcaagattaatgatagaatggttaacgacggggaacaggcccagccgactaaatttaacag

SEQ ID NO: 59513 - DNA, 75 bp, Artificial Sequence
  Synthetic
tctgagaggctattttaagaagttagatgtcgggtcaatgcgggcaggaggtctaggcgcacaagctatgataac

SEQ ID NO: 59514 - DNA, 75 bp, Artificial Sequence
  Synthetic
atgaacgcccttgactgggatgaagagaaaaccatcttggccttatggaaagagattgcctccatagacgtgaag

SEQ ID NO: 59515 - DNA, 75 bp, Artificial Sequence
  Synthetic
agcgatttggtaaagttcagggatcagatatgggggtctcttgtcataactaaagactttgtatactctcaaagt

SEQ ID NO: 59516 - DNA, 75 bp, Artificial Sequence
  Synthetic
ttggtacagaaagcagagaagtttagacctttaattcactccttgggagatttccctcagttcattcgtgacaaa

SEQ ID NO: 59517 - DNA, 75 bp, Artificial Sequence
  Synthetic
aagttgtatgatcaggtccacgtcaagaaaatcatagacaggaattatcaagagtgtctggcgagcgatttggct

SEQ ID NO: 59518 - DNA, 75 bp, Artificial Sequence
  Synthetic
aagaggatacttaggtggggatttgacaaatattcccgctggtatctagactctaatttgctgccgggtgatcac

SEQ ID NO: 59519 - DNA, 75 bp, Artificial Sequence
  Synthetic
tcgttcactaggactaggctggcctcatggctttcggagaatagaggcggaccagtccctagtgagaaagtgatc

SEQ ID NO: 59520 - DNA, 75 bp, Artificial Sequence
  Synthetic
tcaatcctcgagagttcctccggtcaattgatgtgggaggactgccggatgatgacttgataatcggtctgaagc

SEQ ID NO: 59521 - DNA, 75 bp, Artificial Sequence
  Synthetic
tcggcctcaagaaagtattctctcggacacacgagttcttccaaaaatcgtgggtttactattcagacagatctg

SEQ ID NO: 59522 - DNA, 75 bp, Artificial Sequence
  Synthetic
gacacacgagttcttccaaaaatcgtgggtttactattcagacagatctgacttaattggattgtggagggatca

SEQ ID NO: 59523 - DNA, 75 bp, Artificial Sequence
  Synthetic
gaccatcctgttaagggaagctattcggaaggccttgtatgatgaggttgacaaggtagaaaattctgaatttcg

SEQ ID NO: 59524 - DNA, 75 bp, Artificial Sequence
  Synthetic
caatcatcggattaatccaaaactcccgaaccatccgacgccaattcaggagaagcttgtcaagaaccctagagg

SEQ ID NO: 59525 - DNA, 75 bp, Artificial Sequence
  Synthetic
acccatctgagatgttggccctaattcccaagtcatcgatttcctgcacctgtggacagtcaggggatgatagcc

SEQ ID NO: 59526 - DNA, 75 bp, Artificial Sequence
  Synthetic
caagaatatctgtgtcagttctcccgtctctcgaccagtccttcttctccagaggtcccctcaagggatacctgg

SEQ ID NO: 59527 - DNA, 75 bp, Artificial Sequence
  Synthetic
ccccctagaggaagctcctgtgtttaagagaactggatctgccctccaccgcttcaaatcagcaagatacagcga

SEQ ID NO: 59528 - DNA, 75 bp, Artificial Sequence
  Synthetic
aagagaactggatctgccctccaccgcttcaaatcagcaagatacagcgaggggggttactcttccatatgcccc

SEQ ID NO: 59529 - DNA, 75 bp, Artificial Sequence
  Synthetic
aacctgttgtctcatatctctgtgagtacagatacaatgtctgacctcacacaagatggaacgaactttgacttc

SEQ ID NO: 59530 - DNA, 75 bp, Artificial Sequence
  Synthetic
atcttctcctttcccgacgtatcaaagagaatatcaaggatggtgtcaggagcagtgcctcagttcagaaagctg

SEQ ID NO: 59531 - DNA, 75 bp, Artificial Sequence
  Synthetic
ttctggagtcatttcttatatacttctgaggcttgacaatcacccctcattgtatgtcatgctaaaagagccatc

SEQ ID NO: 59532 - DNA, 75 bp, Artificial Sequence
  Synthetic
taataacttatcagtcccatctcttgcttcaaagaattgataggaatttgtccaaacagatgagggttcgattga

SEQ ID NO: 59533 - DNA, 75 bp, Artificial Sequence
  Synthetic
tccaaacagatgagggttcgattgagacaactgaactccctgatgcggcaggtcttaggaggtcatggagaaggg

SEQ ID NO: 59534 - DNA, 75 bp, Artificial Sequence
  Synthetic
ggtcttaggaggtcatggagaagggacattagattcagatgaggatatccaagggctactgagagacgctctaca

SEQ ID NO: 59535 - DNA, 75 bp, Artificial Sequence
  Synthetic
gaggacgagatgggtggatcaagaggtccgtcatgccgcgaaaacgatgaagtgtgattatagtccaagtaagag

SEQ ID NO: 59536 - DNA, 75 bp, Artificial Sequence
  Synthetic
gaatggatatgctctgcacaacaagttgcggtgtccacctcatctaaccccgcacccatctcagagattgatatc

SEQ ID NO: 59537 - DNA, 75 bp, Artificial Sequence
  Synthetic
atgctggtcaatccagattataaagcagttcagcatctctccagggcttttccttcagttacagggtatataact

SEQ ID NO: 59538 - DNA, 75 bp, Artificial Sequence
  Synthetic
cagatgacctcatccttttcatcagaactctatttgaaattctccaagagggggaagttcttcagagactcggag

SEQ ID NO: 59539 - DNA, 75 bp, Artificial Sequence
  Synthetic
aaatgagtttggtgcttttcaactgtagcagttctaaaagtgaaatgctaagagccagatcattaaattatcaag

SEQ ID NO: 59540 - DNA, 75 bp, Artificial Sequence
  Synthetic
ttccaacagagtattcaatgtgtcaaaacctctgaacgaccctaaattttaccctccgtcagaccccaaaatttt

SEQ ID NO: 59541 - DNA, 75 bp, Artificial Sequence
  Synthetic
actccatgagctgtacaacaatcctgtgacctattacttcaagaagcagacattggggggaagaatgtacttggc

SEQ ID NO: 59542 - DNA, 75 bp, Artificial Sequence
  Synthetic
gtattcaaaagagttgcctgtaactccagtttgagcttgtcgtcacactggataaggctgatttataaaattgtg

SEQ ID NO: 59543 - DNA, 75 bp, Artificial Sequence
  Synthetic
ccagtttgagcttgtcgtcacactggataaggctgatttataaaattgtgaagactacaaggcttgtggggagtg

SEQ ID NO: 59544 - DNA, 75 bp, Artificial Sequence
  Synthetic
ccagatcctccctattggattacagttgcttgtgatcccatctgtcaacatgcttttcacactgtggcctagtcg

SEQ ID NO: 59545 - DNA, 75 bp, Artificial Sequence
  Synthetic
aaaaacatctccttcatcctggtcttttacatttttggctcattctctgttttttttgttttttttgttaagcgt

SEQ ID NO: 59546 - DNA, 75 bp, Artificial Sequence
  Synthetic
acgcttaacaacaaaaacaaaaaaggggtagacacgttcatcgatagaacagatatgtaacacctctacaatgga

SEQ ID NO: 59547 - DNA, 75 bp, Artificial Sequence
  Synthetic
agaaacagctgttccgcactcgtatttcatccacttcagatcacttggactcagtgggaagtctccttactcatc

SEQ ID NO: 59548 - DNA, 75 bp, Artificial Sequence
  Synthetic
ctagcaagagggagggaccattttcaaacatgaaccctggctcccaggagtcatcaggtcctccaggattggact

SEQ ID NO: 59549 - DNA, 75 bp, Artificial Sequence
  Synthetic
ttgaacaccttgtggttgaagagttggtgaagaagagggaagagtgtttggatgctttagaaactatcatcacga

SEQ ID NO: 59550 - DNA, 75 bp, Artificial Sequence
  Synthetic
tttgtgtcaactctacatcgcgggagacaaggtattgtctgcatgtggaaactccggatacgacgtgataaagct

SEQ ID NO: 59551 - DNA, 75 bp, Artificial Sequence
  Synthetic
aatatactgcctggatatgacaaatggtcctacctgttggaacggccaggacgggggacttgaagggttgagaca

SEQ ID NO: 59552 - DNA, 75 bp, Artificial Sequence
  Synthetic
tgagatctgtagaacctttattccctcgatttctcagtgaattgttcagctcctcattccttggaattcctgaat

SEQ ID NO: 59553 - DNA, 75 bp, Artificial Sequence
  Synthetic
tgtggacagtcaggggatgacagcccaagaatatctgtgtcagttctcccgtctctcgatcagtccttcttctcc

SEQ ID NO: 59554 - DNA, 75 bp, Artificial Sequence
  Synthetic
catggtcttgtttgagggcatctgcccggaagattggactagttacggaatcaacattgctaagaaaggtgacaa

SEQ ID NO: 59555 - DNA, 75 bp, Artificial Sequence
  Synthetic
ccggaagattggactagttacggaatcaacattgctaagaaaggtgacaagataacacctgctacgttagtggac

SEQ ID NO: 59556 - DNA, 75 bp, Artificial Sequence
  Synthetic
ttcgagacaagaagagggtgaggatgaagacttctacatgaccgagagtgaaaactcatacgtccctctccaatc

SEQ ID NO: 59557 - DNA, 75 bp, Artificial Sequence
  Synthetic
gtggccaccaacttccccgcccctgtcaacaagctccaggccgacaagtcaactcagaccacactggagaaggtc

SEQ ID NO: 59558 - DNA, 75 bp, Artificial Sequence
  Synthetic
aaacatgaaccttgactcccaggagtcatcaggtcctccaggattagactgggctgccagcaatgatgaggatga

SEQ ID NO: 59559 - DNA, 75 bp, Artificial Sequence
  Synthetic
tcatgcaggatgatctaaacagatatcttgcgtattgatttaaaattggccaccgtcacaccaggacaaacaaat

SEQ ID NO: 59560 - DNA, 75 bp, Artificial Sequence
  Synthetic
acgacgatgacctatggcttccccctcctgaatatgttccgctgtcagagatgactgggaagaagaacatgagga

SEQ ID NO: 59561 - DNA, 75 bp, Artificial Sequence
  Synthetic
gttagaatactctcaggagattacatgggatgatgattctgagtttgtcggcttgcagatgagggtgagtgcaag

SEQ ID NO: 59562 - DNA, 75 bp, Artificial Sequence
  Synthetic
tctcaaagtggaagggcaattccatcttgggagtcgtacaaagtgggggccaccggtgagtcataagcatgtctt

SEQ ID NO: 59563 - DNA, 75 bp, Artificial Sequence
  Synthetic
tattgaaccgggcgaggaattgagatcagaaaggtcatctaaggagtatcttcccatatatggccagctgacgtg

SEQ ID NO: 59564 - DNA, 75 bp, Artificial Sequence
  Synthetic
gcttttagtataagctcagagccttgctacactctttacccatttataagaatagtgaaaggggattacgctcag

SEQ ID NO: 59565 - DNA, 75 bp, Artificial Sequence
  Synthetic
ttaatatgcaagaggagccaacacccctcctcatagatccttaaatgcaaaatgattgactcgaccgaggtttac

SEQ ID NO: 59566 - DNA, 75 bp, Artificial Sequence
  Synthetic
gcaaactgtctgttcgatagaaactataccctaatgcttaaggacttgtttttgtcaagatttaactcgctttta

SEQ ID NO: 59567 - DNA, 75 bp, Artificial Sequence
  Synthetic
acaaatattcccgctggtatctagactctaatttgctgccgggtgatcatcctttgtctccttatgtaaaaaccc

SEQ ID NO: 59568 - DNA, 75 bp, Artificial Sequence
  Synthetic
agacttggcctccaaaacatgtagttgacatggttggggacacttggcacagcctccccataacccaaatcttcg

SEQ ID NO: 59569 - DNA, 75 bp, Artificial Sequence
  Synthetic
ctaatgatagacagagagtcacagactagaaacactaggacgaaaatcctagcgcagggggacaatcaagtcttg

SEQ ID NO: 59570 - DNA, 75 bp, Artificial Sequence
  Synthetic
ggacagaagcctagagagcttcaccaggctgctggaagaccccacaacattgaacataagaggaggagcaagccc

SEQ ID NO: 59571 - DNA, 75 bp, Artificial Sequence
  Synthetic
aaggtagtgggcacaactgtcccccacccatctgagatgttggccctaattcccaagtcatcgatttcctgcacc

SEQ ID NO: 59572 - DNA, 75 bp, Artificial Sequence
  Synthetic
gatcttctacctcaatgtctactcagttgttccatgcttgggagaaagtaactaatgttcatgtcgtcaagaggg

SEQ ID NO: 59573 - DNA, 75 bp, Artificial Sequence
  Synthetic
actaatgttcatgtcgtcaagagggccttgtccctcaaggaatccatcaattggttcattataagagactcgaac

SEQ ID NO: 59574 - DNA, 75 bp, Artificial Sequence
  Synthetic
tccacctttcattggcaccttagatgtcccaaatgtatccgaccgatagatgacatcacattagaagccccaaaa

SEQ ID NO: 59575 - DNA, 75 bp, Artificial Sequence
  Synthetic
taacaacatccccggagaatgactggctttggatattctcggacttcaggagtataaagatgacctatctaactt

SEQ ID NO: 59576 - DNA, 75 bp, Artificial Sequence
  Synthetic
gtccgtcatgccgcgaaaacgatgaagtgtgattatagtccaagtaagagagtgtcacggaaggcgggttgttca

SEQ ID NO: 59577 - DNA, 75 bp, Artificial Sequence
  Synthetic
gaatgggtatgctctgcacaacaagttacggtgtccacctcatctaaccccgcacctatctcagagattgacatc

SEQ ID NO: 59578 - DNA, 75 bp, Artificial Sequence
  Synthetic
acgcttaacgacaaaaccagaaaaggaatagacacaatcgtctgtagagcagaaatgcaacacccctacaatgga

SEQ ID NO: 59579 - DNA, 75 bp, Artificial Sequence
  Synthetic
tttactccggagggacaagaacccctgaagctgtgtacaccaggatcatggtcaatgggggaaaactaaaaaaat

SEQ ID NO: 59580 - DNA, 75 bp, Artificial Sequence
  Synthetic
caatctgggccgcattcaatgaaccattcaagtgggagaggatgcagtagacttgccaaatcatatatacaatgt

SEQ ID NO: 59581 - DNA, 75 bp, Artificial Sequence
  Synthetic
tgagttctttgatgccaaaagactaatcggatagatgatgctcagcaatttttattaactaactgtatatacgga

SEQ ID NO: 59582 - DNA, 75 bp, Artificial Sequence
  Synthetic
aaaaagctccggacttgaacagagcttataagtccattctgtccggaataaatgccgctaggttggatcctgatg

SEQ ID NO: 59583 - DNA, 75 bp, Artificial Sequence
  Synthetic
ttataagtccattctgtccggaataaatgccgctaggttggatcctgatgatgtgtgttcctatctggctgcagc

SEQ ID NO: 59584 - DNA, 75 bp, Artificial Sequence
  Synthetic
tatggctctatttgaggggatttgtcctgacgattgggagagctacgggattctcattgctaggaaaggggacaa

SEQ ID NO: 59585 - DNA, 75 bp, Artificial Sequence
  Synthetic
gcaagaagcaactcagtagtgcctaatattctcaggaattcggattacaaccttaattctcccctgatagaggac

SEQ ID NO: 59586 - DNA, 75 bp, Artificial Sequence
  Synthetic
aataaccccagccaatttagtcaatattcagagaacagatgtggaaggcaattgggcactggcagggggccaaga

SEQ ID NO: 59587 - DNA, 75 bp, Artificial Sequence
  Synthetic
ccttcaaagcttatgctggattggctaataacaggaaacaagcccgctcgattgaatctgactgacaactctttg

SEQ ID NO: 59588 - DNA, 75 bp, Artificial Sequence
  Synthetic
attgaatctgactgacaactctttgagatcatataaggtcttgaagagttacttcaagaaattggatgttggatc

SEQ ID NO: 59589 - DNA, 75 bp, Artificial Sequence
  Synthetic
cgtaataaaagatccgaccacagccgagcatgcatctttggtgggacttctcctttgtctttacagactaagcaa

SEQ ID NO: 59590 - DNA, 75 bp, Artificial Sequence
  Synthetic
cagaggatatgagcaagcttcaaatcagtgaaaggaggcctgctcagttctctgacaacacaggcgggaaagaag

SEQ ID NO: 59591 - DNA, 75 bp, Artificial Sequence
  Synthetic
tcctttgtctttacagactaagcaaggtgtcaggacagaacacagggaattacaagaccaacgtagctgacagaa

SEQ ID NO: 59592 - DNA, 75 bp, Artificial Sequence
  Synthetic
ggtgtcaggacagaacacagggaattacaagaccaacgtagctgacagaatggaacaaatctttgagactgcccc

SEQ ID NO: 59593 - DNA, 75 bp, Artificial Sequence
  Synthetic
gcgccaactggagtacaattcccaactttagatccttggctgggacatatgacatgtttttctctagaatagagc

SEQ ID NO: 59594 - DNA, 75 bp, Artificial Sequence
  Synthetic
caatcatccaaaatcaagacaatctctcaggaatcctcaggtccacctgcgctggaatggtccaccaccaatgat

SEQ ID NO: 59595 - DNA, 75 bp, Artificial Sequence
  Synthetic
ctcaggaatcctcaggtccacctgcgctggaatggtccaccaccaatgatgaagaaaatgcatctgtggaggcag

SEQ ID NO: 59596 - DNA, 75 bp, Artificial Sequence
  Synthetic
atctatactctgccattcgagtcgggacagtagtgactgcatatgaagattgttcagggctagtctctttcacag

SEQ ID NO: 59597 - DNA, 75 bp, Artificial Sequence
  Synthetic
tactcatcttacctgttttttcatgtcataatcctgtatatgaacgctttggattgggaggaggagaagacaatt

SEQ ID NO: 59598 - DNA, 75 bp, Artificial Sequence
  Synthetic
ggttcatcagacagatcaacttgacggcgaaggaggccatactgtatttctttcataagaactttgaggaagaga

SEQ ID NO: 59599 - DNA, 75 bp, Artificial Sequence
  Synthetic
tcaagagaatgttcgagccggggcaggagacagctgtcccacattcttacttcatacacttcaggtcattaggac

SEQ ID NO: 59600 - DNA, 75 bp, Artificial Sequence
  Synthetic
ggctgaaggattcagaccgatgattcattccctaggggattttcctactttcatcaaggacaaagtgagccagct

SEQ ID NO: 59601 - DNA, 75 bp, Artificial Sequence
  Synthetic
tgggtcaagtcaggtcattgaatgcgacggtcattgccacctgtgcacctcacgagatgtccgtgttgggaggtt

SEQ ID NO: 59602 - DNA, 75 bp, Artificial Sequence
  Synthetic
tctatggatccatctgagatcttagatgataaatctcactctttcactagaaccaagttggcttcttggctatcc

SEQ ID NO: 59603 - DNA, 75 bp, Artificial Sequence
  Synthetic
atctcggggaggaattctttggcaagggaacatttgaaagaagattcttcagggacgagagggaacttgcagagc

SEQ ID NO: 59604 - DNA, 75 bp, Artificial Sequence
  Synthetic
aagaacatgaggaacttctgtgttaacggagaggtaaaggtgtgcagccctaatggttactcatttagaatcttg

SEQ ID NO: 59605 - DNA, 75 bp, Artificial Sequence
  Synthetic
gtgagaaagtcataattacagcgctctcaaggcctcctgtcaaccccagggaattcttaaaatctattgatctgg

SEQ ID NO: 59606 - DNA, 75 bp, Artificial Sequence
  Synthetic
atgaggcaatcgaatcaaccaagactgatgtggccctggcagatgatgggaccgtaaattcagacgatgaggagc

SEQ ID NO: 59607 - DNA, 75 bp, Artificial Sequence
  Synthetic
taatggttactcatttagaatcttgaggcatatcctcaggtctttcgacggggtatactctggaaatcagaggat

SEQ ID NO: 59608 - DNA, 75 bp, Artificial Sequence
  Synthetic
atgataaatctcactctttcactagaaccaagttggcttcttggctatccgatcacagaggaggccccgtcccca

SEQ ID NO: 59609 - DNA, 75 bp, Artificial Sequence
  Synthetic
aatcggcttgaaaccaaaggaaagggaattgaagatagaagggaggttctttgcgctgatgtcgtggaatttgag

SEQ ID NO: 59610 - DNA, 75 bp, Artificial Sequence
  Synthetic
gggtatactctggaaatcagaggatgagaggattggtcaaagttgttattggtctggctctctcgggaggaccga

SEQ ID NO: 59611 - DNA, 75 bp, Artificial Sequence
  Synthetic
gtcaatgggggaaagctacaaaaatcccacatcaaaagatatgtgtcagtcagctcgaatcatcaggccagacct

SEQ ID NO: 59612 - DNA, 75 bp, Artificial Sequence
  Synthetic
cccacatcaaaagatatgtgtcagtcagctcgaatcatcaggccagacctaactcctttgcagaattcttgaaca

SEQ ID NO: 59613 - DNA, 75 bp, Artificial Sequence
  Synthetic
ttgttggcgaactacatcttacccctttttgatgctttaactatgaccgacaacttgaacaaagtatttaagaag

SEQ ID NO: 59614 - DNA, 75 bp, Artificial Sequence
  Synthetic
agacttattcgagtgatccaagataaaaggcaagacctctatttataatttgtttcatccaccatccccatatca

SEQ ID NO: 59615 - DNA, 75 bp, Artificial Sequence
  Synthetic
gggtgagtgccagacagtgccatattcaagggaggatttggtgcattaacatgaactcaagagcatgtcaattat

SEQ ID NO: 59616 - DNA, 75 bp, Artificial Sequence
  Synthetic
gaagaaggggaaagaaaaaaactaacacccctcttcctgctccatcccaaccatgagcaagatctttgtcaaccc

SEQ ID NO: 59617 - DNA, 75 bp, Artificial Sequence
  Synthetic
cacccctcttcctgctccatcccaaccatgagcaagatctttgtcaacccgagtgcaattcgagctggcttggct

SEQ ID NO: 59618 - DNA, 75 bp, Artificial Sequence
  Synthetic
gcagtcggatgaggacaggaacacttccctgctgctagaataacccttcctctccacagtcactcactcgtttac

SEQ ID NO: 59619 - DNA, 75 bp, Artificial Sequence
  Synthetic
gaccttgagatggcggaagagacggttgacttagtcaacaaaaacatcgaggacaaccaagctcatctccaaggg

SEQ ID NO: 59620 - DNA, 75 bp, Artificial Sequence
  Synthetic
gagccgattgaggttgatgctcttccagaggatatgagcaagcttcaaatcagtgaaaggaggcctgctcagttc

SEQ ID NO: 59621 - DNA, 75 bp, Artificial Sequence
  Synthetic
cagaggatatgagcaagcttcaaatcagtgaaaggaggcctgctcagttcattgacaacacaggcgggaaagaag

SEQ ID NO: 59622 - DNA, 75 bp, Artificial Sequence
  Synthetic
aaggaagcgatgaggacttctacatggctgaaagcgaagacccttatattcctctacaatcctaccttgagggtg

SEQ ID NO: 59623 - DNA, 75 bp, Artificial Sequence
  Synthetic
ccgtcattggggggagtctctgggatgtctttaggtcgtttccacatccgtcagttctccgatcccgtgtctgag

SEQ ID NO: 59624 - DNA, 75 bp, Artificial Sequence
  Synthetic
ttgggatccaactcgtgagacagatgaagaccggagaaagattcttcaagatatggtcccaggcagtggaggaga

SEQ ID NO: 59625 - DNA, 75 bp, Artificial Sequence
  Synthetic
gggttagccttctggaaagagatatggtccagctcatctgaatcgtggatccactccttgtgtcaagaagcaggc

SEQ ID NO: 59626 - DNA, 75 bp, Artificial Sequence
  Synthetic
aactcagaaatccatgggatcaacagaatgactcaggtgccccagagggtcgggagggtgtggaactgctcagct

SEQ ID NO: 59627 - DNA, 75 bp, Artificial Sequence
  Synthetic
gaagataagtccacccaaactcctgaggagaagttcaaaccaagccctcagcaggcagtcaccaagaaggagagt

SEQ ID NO: 59628 - DNA, 75 bp, Artificial Sequence
  Synthetic
ccgtctcctgtgtttgtaagcagacgggggaggacagtcctagaatatctgtttctgtgttgccatccttcgatc

SEQ ID NO: 59629 - DNA, 75 bp, Artificial Sequence
  Synthetic
caatcatccaagatcaagacaatctctcaggaatcctccggtccacctgcgctggaatggtccaccaccaatgat

SEQ ID NO: 59630 - DNA, 75 bp, Artificial Sequence
  Synthetic
ctcaggaatcctccggtccacctgcgctggaatggtccaccaccaatgatgaagaaaatgcatctgttgaagcag

SEQ ID NO: 59631 - DNA, 75 bp, Artificial Sequence
  Synthetic
aaatagcgcatcagattgcagagagcttctcaaagaagtacaaattcccatccagatcctctggaatatttctgt

SEQ ID NO: 59632 - DNA, 75 bp, Artificial Sequence
  Synthetic
ccgagatatgaggaatccttacacaatccctatccagactctcactggctaaggacagttaccaccaccaaagag

SEQ ID NO: 59633 - DNA, 75 bp, Artificial Sequence
  Synthetic
cctgggagaaggtaaccaacgtccatgttgtcaagagggcgttatccctcaaggagtccattaactggttcattg

SEQ ID NO: 59634 - DNA, 75 bp, Artificial Sequence
  Synthetic
ttaacttcgaacagctaaagatgaatcttgacgacatcgtgaaagaggctaaaaagattcctggggtagtgcgcc

SEQ ID NO: 59635 - DNA, 75 bp, Artificial Sequence
  Synthetic
tggcacaggatggattcaggctccctctaagatgcatattggggggagtaggttcggtcaattcaaagaagttcc

SEQ ID NO: 59636 - DNA, 75 bp, Artificial Sequence
  Synthetic
aacttttggtcaattcagacaaattgggcaagataatgcaagatgatctcaatcggtatctggcatattgatcct

SEQ ID NO: 59637 - DNA, 75 bp, Artificial Sequence
  Synthetic
ccccgtcttgagactttataattatcataagctagatattgatctgtctagctcatgaaaaaaacatgtaacacc

SEQ ID NO: 59638 - DNA, 75 bp, Artificial Sequence
  Synthetic
actaacgcaatgaactttctccgcaagatagtgagaggttgcagggatgaggaggatcagaagcccgctctggtg

SEQ ID NO: 59639 - DNA, 75 bp, Artificial Sequence
  Synthetic
tctgctcctccagatgatgatgacctatggctccctcctccagagtatgtccccttgacagagattacaggcaga

SEQ ID NO: 59640 - DNA, 75 bp, Artificial Sequence
  Synthetic
gactccggctacaacgatgccacaatttttcccatgaacatatatagcaagatctctcccagggattatctgaga

SEQ ID NO: 59641 - DNA, 75 bp, Artificial Sequence
  Synthetic
cctctagagttaatatctggagttatatcctacatcttgttgaggctagacaatcatccctcgttgtatgtcatg

SEQ ID NO: 59642 - DNA, 75 bp, Artificial Sequence
  Synthetic
aggcatatcctcaggtctttcgacggggtatactctgggaatcagaggatgagagggttggtcaaagttgttatt

SEQ ID NO: 59643 - DNA, 75 bp, Artificial Sequence
  Synthetic
aagctagtccctgggtttgggaaagcttacaccattatcaacaaaacactcatggaagctgatgctcattacaag

SEQ ID NO: 59644 - DNA, 75 bp, Artificial Sequence
  Synthetic
agatattctcaattcctcaaaagatccccgcagcttacccaacaacaatgaaagaaggcaacagatccgtcttat

SEQ ID NO: 59645 - DNA, 75 bp, Artificial Sequence
  Synthetic
gggtatactctgggaatcagaggatgagagggttggtcaaagttgttattggtttggctctctcggggggaccga

SEQ ID NO: 59646 - DNA, 75 bp, Artificial Sequence
  Synthetic
ttccagagggaatgaactgggtttacaaggtaagacgcaccctggtgtttcaatgggcagagtcccgtggtcccc

SEQ ID NO: 59647 - DNA, 75 bp, Artificial Sequence
  Synthetic
gagaatccgactcaggcagttgagttctttgatgaggcagatcctaggaggtcacggggaagacaccctagactc

SEQ ID NO: 59648 - DNA, 75 bp, Artificial Sequence
  Synthetic
tagatggggaagagttggagtattcccaagagattacctgggacgatgattctgagtttgtaggatcgcaaatca

SEQ ID NO: 59649 - DNA, 75 bp, Artificial Sequence
  Synthetic
ggtccgacatggctctaaagactcagcagtcagatgaggacaggaacacttccctgctgctagaataacccttcc

SEQ ID NO: 59650 - DNA, 75 bp, Artificial Sequence
  Synthetic
attttgttgaagtccaccttcctgacgtgcaaaagcagatctcggggattgacctaggtcttcccgagtggaaga

SEQ ID NO: 59651 - DNA, 75 bp, Artificial Sequence
  Synthetic
acagtcactcactcgtttacctctgcacaaaatatgtacacaatttgtcttctaccttttatgagcaatagaaca

SEQ ID NO: 59652 - DNA, 75 bp, Artificial Sequence
  Synthetic
ggtatttcatgatcggggtgtcggctttggctttccttgccttgatgatatttattgccgcctgctgtaggagag

SEQ ID NO: 59653 - DNA, 75 bp, Artificial Sequence
  Synthetic
tacccgtctctatgtctggttgtgggtgatggatccggtggaatctccagaactgtactaagtatgttcccagat

SEQ ID NO: 59654 - DNA, 75 bp, Artificial Sequence
  Synthetic
aaaccatgttatggtgccgcacaactgctgcattttcttgaaacacccgactgaacaccttcacatgtgaaacct

SEQ ID NO: 59655 - DNA, 75 bp, Artificial Sequence
  Synthetic
aactgtactaagtatgttcccagatgctaagttagtctttaacagtttattggaggtgaatgacttcatggcctc

SEQ ID NO: 59656 - DNA, 75 bp, Artificial Sequence
  Synthetic
tttggctttccttgccttgatgatatttattgccgcctgctgtaggagagttaaacgtaagaaaagagccaaacc

SEQ ID NO: 59657 - DNA, 75 bp, Artificial Sequence
  Synthetic
ctgtaatgtgaaaaaaacatttaacatccctcaaagatctcaggaatcatgccatttcaagctgttttgtctgct

SEQ ID NO: 59658 - DNA, 75 bp, Artificial Sequence
  Synthetic
tttattgccgcctgctgtaggagagttaaacgtaagaaaagagccaaacccaacccagtagaactaatccgaaaa

SEQ ID NO: 59659 - DNA, 75 bp, Artificial Sequence
  Synthetic
caaggtagagacggggggtcagtcttaagtcagacttgcttgtctaatggaccaaatacctgacagcctattctc

SEQ ID NO: 59660 - DNA, 75 bp, Artificial Sequence
  Synthetic
cttctttcggccctcacactctgcgtcggcaagtttcccatctacacaatccctgataagttaggcccgtggagc

SEQ ID NO: 59661 - DNA, 75 bp, Artificial Sequence
  Synthetic
acatataccataaactttctcaatcataaaaaacctttttcaagctgttcataatcggaataggaggaggatctc

SEQ ID NO: 59662 - DNA, 75 bp, Artificial Sequence
  Synthetic
cccattgacattcatcatcttagctgcccgaacaatattgttgtagaggatgagggatgtacgaccctaacagta

SEQ ID NO: 59663 - DNA, 75 bp, Artificial Sequence
  Synthetic
ttctcatatatggagttgaaagtaggatatataacaaccataaaagtgaacggatttacatgtactggggtggtg

SEQ ID NO: 59664 - DNA, 75 bp, Artificial Sequence
  Synthetic
gatatataacaaccataaaagtgaacggatttacatgtactggggtggtgacagaggcagagacttatactaact

SEQ ID NO: 59665 - DNA, 75 bp, Artificial Sequence
  Synthetic
ttatatcaattattggtgcttcagtcaatctgggccgcattcaatgaaccattcaagtgggagaggatgcaatag

SEQ ID NO: 59666 - DNA, 75 bp, Artificial Sequence
  Synthetic
ttgttggttatgtaactaccacgttcaagagaaagcatttccgtcccagccctagtgcatgcagagatgcatata

SEQ ID NO: 59667 - DNA, 75 bp, Artificial Sequence
  Synthetic
atttaccaaatcatatatacaatgtaaattcgtcaacattctccagaggatagtcgccccttattgataagattg

SEQ ID NO: 59668 - DNA, 75 bp, Artificial Sequence
  Synthetic
ggctaaaatgtccatcattatcgccatcgtgatggtgttctctaacagagtgtttaatgtatctaagcctttgac

SEQ ID NO: 59669 - DNA, 75 bp, Artificial Sequence
  Synthetic
gttggaagactgcaggtgatccgagatatgaggaatccttacacaatccctatccagactctcactggctaaaga

SEQ ID NO: 59670 - DNA, 75 bp, Artificial Sequence
  Synthetic
tgggttctttgatgccaaaagactaatcagatagatgatgctcagcaatttttattaactaactgtatatacgga

SEQ ID NO: 59671 - DNA, 75 bp, Artificial Sequence
  Synthetic
gtgatactacttctgtctttaagaaagttgcctgcaattcgaatctaagtttgtcatcccactggatccgactga

SEQ ID NO: 59672 - DNA, 75 bp, Artificial Sequence
  Synthetic
atatgaggaatccttacacaatccctatccagactctcactggctaaagacagttaccaccacccaagagtccgt

SEQ ID NO: 59673 - DNA, 75 bp, Artificial Sequence
  Synthetic
caatgggtcaattcatctaagttgtatcatcatgaaaaaaacgtcccgttggaaaggaacaacacctctcttcag

SEQ ID NO: 59674 - DNA, 75 bp, Artificial Sequence
  Synthetic
agttgcctgcaattcgaatctaagtttgtcatcccactggatccgactgatttacaagattgttagaaccactcg

SEQ ID NO: 59675 - DNA, 75 bp, Artificial Sequence
  Synthetic
tttattctaaaatatttttaaatgggaaatgctcaggagtctctcaagtctctcccttctgctcaaccaatcatg

SEQ ID NO: 59676 - DNA, 75 bp, Artificial Sequence
  Synthetic
gaaatgctcaggagtctctcaagtctctcccttctgctcaaccaatcatgattacacaatctggatgcccgagaa

SEQ ID NO: 59677 - DNA, 75 bp, Artificial Sequence
  Synthetic
tcccaacccgggtgtgtcttgcgacatattcacgaccagcaaggggaagaaagctacaaaagatggcaaactgtg

SEQ ID NO: 59678 - DNA, 75 bp, Artificial Sequence
  Synthetic
ccttaattctcccctgatagaggacccttcaaagcttatgctggactggctaataacaggaaacaagcctgctcg

SEQ ID NO: 59679 - DNA, 75 bp, Artificial Sequence
  Synthetic
cggatttgtcgatgagagaggactctacaaatcattaaagggggcttgtaaactgaaactgtgtggaatctctgg

SEQ ID NO: 59680 - DNA, 75 bp, Artificial Sequence
  Synthetic
tatgaggttgatggatgggtcatgggtgtctattcaaaatcacgatgaggcaaaatggtgctcccccgatcaact

SEQ ID NO: 59681 - DNA, 75 bp, Artificial Sequence
  Synthetic
tgtgaacatccatgactttcactcagatgaggtagaacacctcattgcggaggagcttgttaaaaagagagagga

SEQ ID NO: 59682 - DNA, 75 bp, Artificial Sequence
  Synthetic
gtgtttagatgcgttagagtcaatcatgactaccaagtcaataagctttcgccgtcttagtcatttaagaaagct

SEQ ID NO: 59683 - DNA, 75 bp, Artificial Sequence
  Synthetic
aagctgatgctcattacaagtctatcagagaatggaccgatgtgatcccctctaagggatgtctgatggcaggag

SEQ ID NO: 59684 - DNA, 75 bp, Artificial Sequence
  Synthetic
gccgatgttatcctcatcacaatggagtcttctttaacggtataatattgagtccggatgggcacgtgttaatcc

SEQ ID NO: 59685 - DNA, 75 bp, Artificial Sequence
  Synthetic
ctggctttgtggaaggacctaaattctgtagacatcaagagagatcaagtgaagttcagagatcaaatatgggga

SEQ ID NO: 59686 - DNA, 75 bp, Artificial Sequence
  Synthetic
ctgtagacatcaagagagatcaagtgaagttcagagatcaaatatggggatctcttttggtaactaaagactttg

SEQ ID NO: 59687 - DNA, 75 bp, Artificial Sequence
  Synthetic
cagagatgcagtctgcaatgcttcaacagcatatagagttgttagagtcatcggtgatacctctcatgcatccct

SEQ ID NO: 59688 - DNA, 75 bp, Artificial Sequence
  Synthetic
tcggtgatacctctcatgcatcccttggctgacccatccactatctttaagaaggatgatggtgctgaggatttt

SEQ ID NO: 59689 - DNA, 75 bp, Artificial Sequence
  Synthetic
gttgaagtccatcttcctgacgtgcaaaagcagatctcggggattgacctaggtcttcccgagtggaagaggtac

SEQ ID NO: 59690 - DNA, 75 bp, Artificial Sequence
  Synthetic
tccccctgaacccagatactcagaagacctaatatcccagctttgccaactctacattgcaggagacaatgtcct

SEQ ID NO: 59691 - DNA, 75 bp, Artificial Sequence
  Synthetic
gacctaatatcccagctttgccaactctacattgcaggagacaatgtcctgtcaacatgcggcaactctgggtat

SEQ ID NO: 59692 - DNA, 75 bp, Artificial Sequence
  Synthetic
ttcctgatcggggtgtcggctttggctttccttgccttgatgatattcattgccgcctgctgtaggagagtgaaa

SEQ ID NO: 59693 - DNA, 75 bp, Artificial Sequence
  Synthetic
cgtaaaaagagagccaaacccaacccagtggaactaatccgaaaagtgtctgtcacttcccaaagtgggagaccg

SEQ ID NO: 59694 - DNA, 75 bp, Artificial Sequence
  Synthetic
cagtggaactaatccgaaaagtgtctgtcacttcccaaagtgggagaccgattccttcatgggagtcttacaagg

SEQ ID NO: 59695 - DNA, 75 bp, Artificial Sequence
  Synthetic
attccttcatgggagtcttacaaggtcgagacggggggtcagtcttaagtcagacttgcttgtctaatggaccaa

SEQ ID NO: 59696 - DNA, 75 bp, Artificial Sequence
  Synthetic
atacctgacaacctattctcacatataccatgaactttctcaatcataaaaaacctttcccaagctgttcacaat

SEQ ID NO: 59697 - DNA, 75 bp, Artificial Sequence
  Synthetic
taccatgaactttctcaatcataaaaaacctttcccaagctgttcacaatcagaataggaggaggatctcgcctt

SEQ ID NO: 59698 - DNA, 75 bp, Artificial Sequence
  Synthetic
tggggccatccttacatagactatcggaaaggcttatccaagttatacgatcaggtccatgtgaagaaggttatc

SEQ ID NO: 59699 - DNA, 75 bp, Artificial Sequence
  Synthetic
gatcggatccgcttgagaataccggtacacagggtcttgcaatagttatatcaattactggtgcttcagtcaatc

SEQ ID NO: 59700 - DNA, 75 bp, Artificial Sequence
  Synthetic
tcaattactggtgcttcagtcaatctgggccgcattcaatgaaccattcaagtgggagaggatgcaatcgactta

SEQ ID NO: 59701 - DNA, 75 bp, Artificial Sequence
  Synthetic
ccaaatcatatatacaatgtaaattcgtcaacattctccagaggatagtcgctcattattgacaagattgtgagt

SEQ ID NO: 59702 - DNA, 75 bp, Artificial Sequence
  Synthetic
gctcattattgacaagattgtgagttctttgatgccaaaagactaatcagatagatgatgctcagctattttatt

SEQ ID NO: 59703 - DNA, 75 bp, Artificial Sequence
  Synthetic
aactaactgtatatacggacaatgggtcaattcatctaagttgtatcatcatgaaaaaaacgtcctgtcggaaag

SEQ ID NO: 59704 - DNA, 75 bp, Artificial Sequence
  Synthetic
gaacaacacctctcttcagagagatcatttcaagatgattgatcccctggaggtttatgatgaccctgtggaccc

SEQ ID NO: 59705 - DNA, 75 bp, Artificial Sequence
  Synthetic
catttcaagatgattgatcccctggaggtttatgatgaccctgtggacccggtcgaaccggagatagatgcaaga

SEQ ID NO: 59706 - DNA, 75 bp, Artificial Sequence
  Synthetic
ctcaaggcctcctgtcaaccccagggaattcttgaaatctattgatctgggaggtttgccagatgatgatctcat

SEQ ID NO: 59707 - DNA, 75 bp, Artificial Sequence
  Synthetic
tcagaaattcggattacaaccttaattctcccctgatagaggacccttcaaagcttatgctagattggctaacaa

SEQ ID NO: 59708 - DNA, 75 bp, Artificial Sequence
  Synthetic
caggaaacaagcctgctcgactgaatctgactgacaactctttgagatcgtataaagtcttgaagagttacttca

SEQ ID NO: 59709 - DNA, 75 bp, Artificial Sequence
  Synthetic
agaaactggatgttggatctttacgggtaggaggtttaggcgcacaatccatgatgtctctatggctccatggag

SEQ ID NO: 59710 - DNA, 75 bp, Artificial Sequence
  Synthetic
cccactctgaatccaccagaagtcgaaagtgcctctctgatctagccctattctatcaaagatcggcgcctattg

SEQ ID NO: 59711 - DNA, 75 bp, Artificial Sequence
  Synthetic
aaaaattgctgaattataccttagagaatagaggtcttgcaattccaacagatggagttctctccagtttgaaaa

SEQ ID NO: 59712 - DNA, 75 bp, Artificial Sequence
  Synthetic
aggtcaattatgatagagcatttggacgatatctgggtaatttatactcatcttacctgtttttccatgtcataa

SEQ ID NO: 59713 - DNA, 75 bp, Artificial Sequence
  Synthetic
tcctgtatatgaacgctttggactgggaagaggagaagacaattctggctctgtggaaggacctaaattctgtag

SEQ ID NO: 59714 - DNA, 75 bp, Artificial Sequence
  Synthetic
ctgtggaaggacctaaattctgtagacatcaagaaagatcaggtgaagttcagagatcagatatggggatctctt

SEQ ID NO: 59715 - DNA, 75 bp, Artificial Sequence
  Synthetic
ttggtaactaaagactttgtgtattctcagagtgccaactgtctgtttgacagaaactacactctcatgttgaaa

SEQ ID NO: 59716 - DNA, 75 bp, Artificial Sequence
  Synthetic
gagggactcatatatgaattggatagcatatcgaggaatgcactgtcgatatatcgggctattgaggaaggggca

SEQ ID NO: 59717 - DNA, 75 bp, Artificial Sequence
  Synthetic
gcatatcgaggaatgcactgtcgatatatcgggctattgaggaaggggcatctaaactggggcttatcataaaga

SEQ ID NO: 59718 - DNA, 75 bp, Artificial Sequence
  Synthetic
gacttatttctgtctaggttcaactccctcctgattctgctctctccccctgaacccagatactcagaagaccta

SEQ ID NO: 59719 - DNA, 75 bp, Artificial Sequence
  Synthetic
tgaacccagatactcagaagacctaatatcccagctttgccagctctacattgcaggagacaatgtcctatcaac

SEQ ID NO: 59720 - DNA, 75 bp, Artificial Sequence
  Synthetic
atgcggcaattctgggtatgacgtcatcaagatgctggaaccatacgtagtaaacagtttagtgcagagggctga

SEQ ID NO: 59721 - DNA, 75 bp, Artificial Sequence
  Synthetic
aggacaaagtgagccagcttgaaggaacatttggacccagtgcaagaaactttttctttgttttggatcaactcg

SEQ ID NO: 59722 - DNA, 75 bp, Artificial Sequence
  Synthetic
tttttctttgttttggatcaactcgataacattcatgatttggtgttcgtgtatggttgttacagacactggggc

SEQ ID NO: 59723 - DNA, 75 bp, Artificial Sequence
  Synthetic
gtatggttgttacagacactggggccatccctacatagactatcgaaaaggcttatccaagttatacgatcaagt

SEQ ID NO: 59724 - DNA, 75 bp, Artificial Sequence
  Synthetic
ccatgtgaagaaggttatcgatggagactaccaggagtgcttagcgagtgacctggctaaacggatcctcaggtg

SEQ ID NO: 59725 - DNA, 75 bp, Artificial Sequence
  Synthetic
gggttggccttctggaaagagatatggtccagctcatctgaatcgtggatccactccttgtgtcaggaagcgggc

SEQ ID NO: 59726 - DNA, 75 bp, Artificial Sequence
  Synthetic
gggtttcgacaaatactccaaatggtatttggaccctaaactgttagaaaaagaccaccctttgatcccatatat

SEQ ID NO: 59727 - DNA, 75 bp, Artificial Sequence
  Synthetic
aacccggacttgggtgatagaagtttggaaagtttcactcgtcttctcgaggatccaacgactctcaatataaga

SEQ ID NO: 59728 - DNA, 75 bp, Artificial Sequence
  Synthetic
ccaaacacagacttggcctccaaaacacatagtggatatagtagggaacacctggcacaagctccctataaccca

SEQ ID NO: 59729 - DNA, 75 bp, Artificial Sequence
  Synthetic
cacatagtggatatagtagggaacacctggcacaagctccctataacccaaatttttgagatacctgagtctatg

SEQ ID NO: 59730 - DNA, 75 bp, Artificial Sequence
  Synthetic
aactctgagttcagagaggctatcttgctgtccaaaacccatcgggacaacttcatattgttcttgaaatctatt

SEQ ID NO: 59731 - DNA, 75 bp, Artificial Sequence
  Synthetic
tgctgtccaaaacccatcgggacaacttcatattgttcttgaaatctattgagccactcttcccgagattcctca

SEQ ID NO: 59732 - DNA, 75 bp, Artificial Sequence
  Synthetic
gcctcctgtcaaccccagggaattcttaaaatctattgatctgggaggtctgccagatgatgatctcataatcgg

SEQ ID NO: 59733 - DNA, 75 bp, Artificial Sequence
  Synthetic
aagatagaagggaggttctttgcgctgatgtcgtggaatttgaggctctactttgtgataaccgaaaagctgttg

SEQ ID NO: 59734 - DNA, 75 bp, Artificial Sequence
  Synthetic
ctttgtgataaccgaaaagctgttggcgaactacatcttacccctttttgatgccttaactatgactgacaactt

SEQ ID NO: 59735 - DNA, 75 bp, Artificial Sequence
  Synthetic
gagagggctgatctgttgagagagatctcttgggggagaaaggtggtcgggaccactgttcctcatccaggggag

SEQ ID NO: 59736 - DNA, 75 bp, Artificial Sequence
  Synthetic
gaacaaagtgtttaagaagctgatcgacagagtcacgggacaaggtctgcaagattattcgagggtgacatatgc

SEQ ID NO: 59737 - DNA, 75 bp, Artificial Sequence
  Synthetic
tttccacctagactacgagaagtggaataatcaccagagactagagtctactaaagatgtattctctgtactaga

SEQ ID NO: 59738 - DNA, 75 bp, Artificial Sequence
  Synthetic
ttatgtttttgggttaaaaaaggttttttccaggacccatgagttttttcagaagtcgtgggtatattactctga

SEQ ID NO: 59739 - DNA, 75 bp, Artificial Sequence
  Synthetic
ttttccaggacccatgagttttttcagaagtcgtgggtatattactctgacagatcagatctaataggactgtgg

SEQ ID NO: 59740 - DNA, 75 bp, Artificial Sequence
  Synthetic
agtcgtttttctctcgaggcccgttaaagggatatttagggtcatcaacatccatgtcaactcagctattccacg

SEQ ID NO: 59741 - DNA, 75 bp, Artificial Sequence
  Synthetic
cctgggagaaggtaaccaacgtccatgttgtcaagagggcgttatccctaaaggagtccatcaactggttcattg

SEQ ID NO: 59742 - DNA, 75 bp, Artificial Sequence
  Synthetic
gaggatcaaatttactgtttagacatgtcagatggtcccacctgctggaatggtcaggatggaggtctcgagggg

SEQ ID NO: 59743 - DNA, 75 bp, Artificial Sequence
  Synthetic
ctagggactcaaatctggcacagacattgatcaagaacatcacctccttgacgggtccacagttccccctcgagg

SEQ ID NO: 59744 - DNA, 75 bp, Artificial Sequence
  Synthetic
ttgaggcagaagggttggagtctagtgagcctcttaatgatcgacagagaatctcaaaccaggaatacaagaacc

SEQ ID NO: 59745 - DNA, 75 bp, Artificial Sequence
  Synthetic
acgggtccacagttccccctcgaggagacccctgtgtttaagaggaccggatcggcactccatcgattcaagtca

SEQ ID NO: 59746 - DNA, 75 bp, Artificial Sequence
  Synthetic
aagattctagcacagggagacaaccaagtcttgtgccctacatatatgctatcctccgggttgacccaagaggga

SEQ ID NO: 59747 - DNA, 75 bp, Artificial Sequence
  Synthetic
tcatatttccgttagcacagacaccatgtcagatttgactcaagatgggaagaacttcgactttatgtttcaacc

SEQ ID NO: 59748 - DNA, 75 bp, Artificial Sequence
  Synthetic
cgaggaatgcactgtcgatatatcgggctattgaggaaggggcatccaaactggggcttattataaagaaagagg

SEQ ID NO: 59749 - DNA, 75 bp, Artificial Sequence
  Synthetic
agaacttcgactttatgtttcaacctttaatgctgtacgcacaaacctggacctctgagcttgtgcaaaaagaca

SEQ ID NO: 59750 - DNA, 75 bp, Artificial Sequence
  Synthetic
ctggggcttattataaagaaagaggagacaatgtgcagctatgatttcctcatatatggaaaaacaccgttattc

SEQ ID NO: 59751 - DNA, 75 bp, Artificial Sequence
  Synthetic
agaggcaacatactagtccccgagtctaagagatgggccagggtgtcatgcatctcaaatgatcagattgtcaat

SEQ ID NO: 59752 - DNA, 75 bp, Artificial Sequence
  Synthetic
cttgcgaacatcatgtccactgtttctaccaatgcactgactgtcgcacagcattcacaatctctgataaagcct

SEQ ID NO: 59753 - DNA, 75 bp, Artificial Sequence
  Synthetic
aggatggtgtctggggcagtgccgcaatttcagaggcttccggagatcaacctaaagcccggcaagtttgaggcc

SEQ ID NO: 59754 - DNA, 75 bp, Artificial Sequence
  Synthetic
atgagggacttcttattgatggcagtccaggcggtatttcactatttgcttttcagtcccatcttgaaagacaga

SEQ ID NO: 59755 - DNA, 75 bp, Artificial Sequence
  Synthetic
cttaacagtaaagacaaatctcgacatatagggactgctcaagggctcttgtattccatcctggttgcaattcat

SEQ ID NO: 59756 - DNA, 75 bp, Artificial Sequence
  Synthetic
gtttataagatactcagtgcagagggggataactttctacttgcgatgtcaaggataatttacttggacccgtca

SEQ ID NO: 59757 - DNA, 75 bp, Artificial Sequence
  Synthetic
gactccggctacaacgatgccacaatttttcccgtgaacatatatggcaagatctctcccagggattatctgaga

SEQ ID NO: 59758 - DNA, 75 bp, Artificial Sequence
  Synthetic
ttggggggagtctctgggatgtctttaggtcgtttccacatccgtcagttctccgatcccgtgtcagaggggtta

SEQ ID NO: 59759 - DNA, 75 bp, Artificial Sequence
  Synthetic
gccttctggaaagagatctggtccagctcgtctgaatcgtggattcactccttgtgtcaagaagcaggcaacccg

SEQ ID NO: 59760 - DNA, 75 bp, Artificial Sequence
  Synthetic
cttgtgtcaagaagcaggcaacccggacttgggtgatagaagtctggaaagtttcactcgtattctcgaggatcc

SEQ ID NO: 59761 - DNA, 75 bp, Artificial Sequence
  Synthetic
ttaagggaaccctctcttcgatctgagatattctcaattcctcaaaagattcccgcagcttacccaacaacaatg

SEQ ID NO: 59762 - DNA, 75 bp, Artificial Sequence
  Synthetic
gacgactctcaatataagaggaggagcaagtccaaccattctgcttaaggaggccataaggaaagccttgtatga

SEQ ID NO: 59763 - DNA, 75 bp, Artificial Sequence
  Synthetic
gcaagtccaaccattctgcttaaggaggccataaggaaagccttgtatgatgaggtggacaaggttgagaactct

SEQ ID NO: 59764 - DNA, 75 bp, Artificial Sequence
  Synthetic
agatattctcaattcctcaaaagattcccgcagcttacccaacaacaatgaaagaaggcaacagatctgtcttat

SEQ ID NO: 59765 - DNA, 75 bp, Artificial Sequence
  Synthetic
tgaggtggacaaggttgagaactctgagttcagagaggcgattttgttgtccaaaacccatcgggacaacttcat

SEQ ID NO: 59766 - DNA, 75 bp, Artificial Sequence
  Synthetic
gttatctacagcacgtgcttcgttatgagagggatgtgattacagcttcccctgaaaacgactggctctggatat

SEQ ID NO: 59767 - DNA, 75 bp, Artificial Sequence
  Synthetic
gagttcagagaggcgattttgttgtccaaaacccatcgggacaacttcatactgttcctgaaatctattgagcca

SEQ ID NO: 59768 - DNA, 75 bp, Artificial Sequence
  Synthetic
ctcttcccgagattcctcagtgaattgtttagctcatccttcctcggaatacctgagtctattatagggttgatc

SEQ ID NO: 59769 - DNA, 75 bp, Artificial Sequence
  Synthetic
caaaactctcgaacaattcgacggcaatttagaagaagcctctccaggactttagaggagtccttcttcaactca

SEQ ID NO: 59770 - DNA, 75 bp, Artificial Sequence
  Synthetic
tgatgaggacattcaggggttgttgcgagatgctttacagagaactagatgggtcgaccaagaggtccgtcatgc

SEQ ID NO: 59771 - DNA, 75 bp, Artificial Sequence
  Synthetic
gctgatttgttgagagagatctcttgggggagaaaggtggtcgggaccactgttcctcatccaggggagatgttg

SEQ ID NO: 59772 - DNA, 75 bp, Artificial Sequence
  Synthetic
agccctagcaagaaagtgtcccggaaggctgggtgttctgagtggatatgttctgctcagcaagtagcaatctcg

SEQ ID NO: 59773 - DNA, 75 bp, Artificial Sequence
  Synthetic
gggggagaaaggtggtcgggaccactgttcctcatccaggggagatgttggtgttgttacctaagtcatccgtct

SEQ ID NO: 59774 - DNA, 75 bp, Artificial Sequence
  Synthetic
ttctgctcagcaagtagcaatctcgacctcttctaaccctgctccgacttcagaaatggatgtgagggcattatc

SEQ ID NO: 59775 - DNA, 75 bp, Artificial Sequence
  Synthetic
gtgttgccatccttcgatcagtcgtttttctctcgaggcccgttaaagggatatctagggtcatcaacatccatg

SEQ ID NO: 59776 - DNA, 75 bp, Artificial Sequence
  Synthetic
tcaactcagctgttccacgcctgggagaaggtaaccaacgtccatgttgtcaagagggcgttatccctcaaggag

SEQ ID NO: 59777 - DNA, 75 bp, Artificial Sequence
  Synthetic
gctaagttagtctttaacagtttgttagaggtgaatgacctcatggcctcaggaacacatccgttgcctccatct

SEQ ID NO: 59778 - DNA, 75 bp, Artificial Sequence
  Synthetic
caagaacatcacctccttgacgggtccacagttccccctcgaggagacccctgtgtttaagaggaccgggtcagc

SEQ ID NO: 59779 - DNA, 75 bp, Artificial Sequence
  Synthetic
actccatcgattcaagtcagctaggtacagtgaagggggttactcctctatctgtcccaacctattatctcatat

SEQ ID NO: 59780 - DNA, 75 bp, Artificial Sequence
  Synthetic
ttcagttagcacagacaccatgtcagatttgacacaagacgggaagaacttcgactttatgtttcaacctttgat

SEQ ID NO: 59781 - DNA, 75 bp, Artificial Sequence
  Synthetic
gctatacgcacaaacctggacctctgagcttgtgcaaaaagacattagattgagggactcaacatttcattggca

SEQ ID NO: 59782 - DNA, 75 bp, Artificial Sequence
  Synthetic
tctcagatgtctcaagtgcatccgaccgatagacgacataacccttgatgcacctcaagtcttcatgttcccgga

SEQ ID NO: 59783 - DNA, 75 bp, Artificial Sequence
  Synthetic
tgtctctaagagaatatctaggatggtgtctggggcagtgccgcaatttcagaagcttccggagatcaacctaaa

SEQ ID NO: 59784 - DNA, 75 bp, Artificial Sequence
  Synthetic
gtgtctggggcagtgccgcaatttcagaagcttccggagatcaacctaaaacccggcaagtttgaggctcttaac

SEQ ID NO: 59785 - DNA, 75 bp, Artificial Sequence
  Synthetic
tcagagatgcagagtatctaacatcatccacattgcgggagatgagtctggtgttatttaattgcagcagtccca

SEQ ID NO: 59786 - DNA, 75 bp, Artificial Sequence
  Synthetic
agtaaagacaaatctcgacatatagggactgctcaagggctcttgtattccatcctggttgcaattcatgactcc

SEQ ID NO: 59787 - DNA, 75 bp, Artificial Sequence
  Synthetic
ggactgctcaagggctcttgtattccatcctggttgcaattcatgactccggctacaacgatgccacaatttttc

SEQ ID NO: 59788 - DNA, 75 bp, Artificial Sequence
  Synthetic
catcctggttgcaattcatgactccggctacaacgatgccacaatttttcccgtaaacatatatagcaagatctc

SEQ ID NO: 59789 - DNA, 75 bp, Artificial Sequence
  Synthetic
tcccagggattatctgagaggattatcgagaggtattctgatcggatcctctatatgtttcctgacaagaatgac

SEQ ID NO: 59790 - DNA, 75 bp, Artificial Sequence
  Synthetic
caacatcaacataaacagacctctagagttaatatctggagttatatcctacatcttgttgaggctagacaatca

SEQ ID NO: 59791 - DNA, 75 bp, Artificial Sequence
  Synthetic
acatcttgttgaggctagacaatcatccctcattgtatgtcatgttaagggaaccctcacttcgatctgagatat

SEQ ID NO: 59792 - DNA, 75 bp, Artificial Sequence
  Synthetic
gaccccaagattttaagacacttcaatatctgctgcagcaccctgatgtatttatcaactgctttaggagatgtc

SEQ ID NO: 59793 - DNA, 75 bp, Artificial Sequence
  Synthetic
agcttacccaacaacaatgaaagaaggcaacagatccgtcttatgttatctacaacatgtgcttcgttatgagag

SEQ ID NO: 59794 - DNA, 75 bp, Artificial Sequence
  Synthetic
ggatgtgattacagcttcccctgaaaacgattggctctggatattctctgacttcagaagtgcgaagatgactta

SEQ ID NO: 59795 - DNA, 75 bp, Artificial Sequence
  Synthetic
tctaacattggtcacttatcaatcgcacatcctgctccaaaagattgagaagaaccttcctaaacagatgagaat

SEQ ID NO: 59796 - DNA, 75 bp, Artificial Sequence
  Synthetic
gtgacagtacttctgtctttaagaaagttgcctgtaattcgaatctaagtttgtcatcccactggatccgactaa

SEQ ID NO: 59797 - DNA, 75 bp, Artificial Sequence
  Synthetic
agttgcctgtaattcgaatctaagtttgtcatcccactggatccgactaatttacaagattgttaggaccactcg

SEQ ID NO: 59798 - DNA, 75 bp, Artificial Sequence
  Synthetic
ggacattcaggggttgttgcgggatgctttacagagaactagatgggtcgaccaagaggtccgtcatgcggccaa

SEQ ID NO: 59799 - DNA, 75 bp, Artificial Sequence
  Synthetic
gctttacagagaactagatgggtcgaccaagaggtccgtcatgcggccaagactatgactggggatcacagccct

SEQ ID NO: 59800 - DNA, 75 bp, Artificial Sequence
  Synthetic
gcaggacatgtgccacttacgaaacagcagtttccctaaggagaacgggcgtgaaaaaaacaatatctgaagtca

SEQ ID NO: 59801 - DNA, 75 bp, Artificial Sequence
  Synthetic
ggtgttcagagtggatatgttctgctcagcaagtagcaatctcgacctcttccaatcccgctccgacttcagaaa

SEQ ID NO: 59802 - DNA, 75 bp, Artificial Sequence
  Synthetic
tggatgtgagggcattatctagaaggtttcagaaccctctgatctcaggcttgagagtggtacagtgggccacag

SEQ ID NO: 59803 - DNA, 75 bp, Artificial Sequence
  Synthetic
gtgctcattacaagttgaaaccaatccttgataacctggaggcttacccgtctctatgtctggttgtgggtgatg

SEQ ID NO: 59804 - DNA, 75 bp, Artificial Sequence
  Synthetic
tgaatgacctcatggcctcaggaacacatccgttgcctccatctgccatcgtgagtggaggtgacgatattgtgt

SEQ ID NO: 59805 - DNA, 75 bp, Artificial Sequence
  Synthetic
acatccgttgcctccatctgccatcgtgagtggaggtgacgatattgtgtctagggtgatagactttgaatccat

SEQ ID NO: 59806 - DNA, 75 bp, Artificial Sequence
  Synthetic
agtgtccggacagaacacagggaattacaaaaccaacgtggctgacagaatggaacaaatctttgaaacagcccc

SEQ ID NO: 59807 - DNA, 75 bp, Artificial Sequence
  Synthetic
ctgggaaaagccgtcggacttgagaaatctatccacatggagatatttccagtcaattcaaactgtcaacaatat

SEQ ID NO: 59808 - DNA, 75 bp, Artificial Sequence
  Synthetic
agtcaattcaaactgtcaacaatatgtcttacgacctaattgtttgtgatgcggaggttacagacataccctctg

SEQ ID NO: 59809 - DNA, 75 bp, Artificial Sequence
  Synthetic
ttaacaaaatcactttattgatgtctgatttttcactctcgatcaatggtccactcaacctaatattcaagacct

SEQ ID NO: 59810 - DNA, 75 bp, Artificial Sequence
  Synthetic
atggaaccatgttggtgaacccagactacaaggccattcagcacctctcaagagcatttccttctgtgactggtt

SEQ ID NO: 59811 - DNA, 75 bp, Artificial Sequence
  Synthetic
atatcactcagatgacctcctccttctcgtctgagctgtatttaaagttttctaaaagaggcaaattcttcagag

SEQ ID NO: 59812 - DNA, 75 bp, Artificial Sequence
  Synthetic
tctaaaagaggcaaattcttcagagatgcagagtatctaacatcatccacattacgggaaatgagtctggtgtta

SEQ ID NO: 59813 - DNA, 75 bp, Artificial Sequence
  Synthetic
tttaattgcagcagtcccaagagtgagatgcagagggctcgttcattgaattatcaagatctggtacgaggtttc

SEQ ID NO: 59814 - DNA, 75 bp, Artificial Sequence
  Synthetic
cagaggatatgagcaagcttcaaatcagtgagaggaggcctgctcagttcaccgacaacacaggcgggaaagaag

SEQ ID NO: 59815 - DNA, 75 bp, Artificial Sequence
  Synthetic
ccagaagaaattatatctaacccttacaacgaaatgatcataactctgatagatagtgaagtcgagtcattccta

SEQ ID NO: 59816 - DNA, 75 bp, Artificial Sequence
  Synthetic
agatagtgaagtcgagtcattcctagtccacaagatggtggatgatctagagcttcaaagagggaccttggctaa

SEQ ID NO: 59817 - DNA, 75 bp, Artificial Sequence
  Synthetic
atatggtcccaggcagtggaggagatcatttcctatgtgaccgttcacttccctatgccgttgggaaaatccact

SEQ ID NO: 59818 - DNA, 75 bp, Artificial Sequence
  Synthetic
atggtgttctctaacagagtgtttaatgtatctaagcctttgactgatccaatgttttacccgccttcagacccc

SEQ ID NO: 59819 - DNA, 75 bp, Artificial Sequence
  Synthetic
aatgttttacccgccttcagaccccaagattttaagacacttcaacatctgctgcagcactttgatgtatttatc

SEQ ID NO: 59820 - DNA, 75 bp, Artificial Sequence
  Synthetic
aactgctttaggagatgtcttgaactttgcaaggcttcacgaattatataacaatcctataacttactactttaa

SEQ ID NO: 59821 - DNA, 75 bp, Artificial Sequence
  Synthetic
acaatcctataacttactactttaagaagcaagtcatacgaggaagcatatatttgtcttggagctggtgtgata

SEQ ID NO: 59822 - DNA, 75 bp, Artificial Sequence
  Synthetic
gggtatactctggaaatcagaggatgagagggttggtcaaagttgtcattggtctggctctctcggggggaccga

SEQ ID NO: 59823 - DNA, 75 bp, Artificial Sequence
  Synthetic
gtacttctgtctttaagaaagtgacctgcaattcgaatctaagtttatcatctcactggatccgactaatttaca

SEQ ID NO: 59824 - DNA, 75 bp, Artificial Sequence
  Synthetic
agattgttaggaccactcgacttgccggtagtagcaatgatctgtcaaaggaagtggagaaacacttgaaagggt

SEQ ID NO: 59825 - DNA, 75 bp, Artificial Sequence
  Synthetic
acaacagatggatcagtttcaatgacataagatcacgatcctccttgctggattatagttgcttgtgaggcagga

SEQ ID NO: 59826 - DNA, 75 bp, Artificial Sequence
  Synthetic
gattatagttgcttgtgaggcaggacatgtgccacttatgaaacagcaatttccctaaggaaaatgggcgtgaaa

SEQ ID NO: 59827 - DNA, 75 bp, Artificial Sequence
  Synthetic
aaaaacaatatctgaagtcaggatatgtacctgtttggatggtcttcttttttctatgttttttttgttaagcgt

SEQ ID NO: 59828 - DNA, 75 bp, Artificial Sequence
  Synthetic
tgctgacagaattgtcttcaaagtccataatcagttggtgtctgtaaagccagaagtaattgtagatcagtatga

SEQ ID NO: 59829 - DNA, 75 bp, Artificial Sequence
  Synthetic
cagaagtaattgtagatcagtatgagtacaaataccctgccattaaagatcggaaaaaacccagcataacccttg

SEQ ID NO: 59830 - DNA, 75 bp, Artificial Sequence
  Synthetic
gaaaagctccggacctgaacagagcttataagtccattctgtccggaataaatgctgctaggttggatcccgatg

SEQ ID NO: 59831 - DNA, 75 bp, Artificial Sequence
  Synthetic
ttataagtccattctgtccggaataaatgctgctaggttggatcccgatgatgtgtgttcttatctggctgcagc

SEQ ID NO: 59832 - DNA, 75 bp, Artificial Sequence
  Synthetic
tccgtcttgataatctcccccagtgtggccgatatggatgcgtatgacaaaactctttattctaaaatattttta

SEQ ID NO: 59833 - DNA, 75 bp, Artificial Sequence
  Synthetic
agtgtcaggacagaacacagggaattacaagaccaacgtagctgacagaatggaacaaatcttcgaaacagcccc

SEQ ID NO: 59834 - DNA, 75 bp, Artificial Sequence
  Synthetic
gtttgtcaaaattgtagagcatcacactttgatgactactcacaagatgtgcgccaactggagtacaattcccaa

SEQ ID NO: 59835 - DNA, 75 bp, Artificial Sequence
  Synthetic
tgagtggaaaatctccttactcgtcgaatgcagtaggacatgtattcaacctcattcattttgtcgggagttaca

SEQ ID NO: 59836 - DNA, 75 bp, Artificial Sequence
  Synthetic
caaggtagagacggggggtcagtcttaagtcagacttgcttgtctaatggaccaaatgcctgacaacctattctc

SEQ ID NO: 59837 - DNA, 75 bp, Artificial Sequence
  Synthetic
acatataccataaactttctcaatcataagaaaccttttccaagctgttcataatcaaaataggaggaggatctc

SEQ ID NO: 59838 - DNA, 75 bp, Artificial Sequence
  Synthetic
accgtaaattcagacgatgaggagctttactccggagggacaagaacccctgaagctgtgtacaccaggatcatg

SEQ ID NO: 59839 - DNA, 75 bp, Artificial Sequence
  Synthetic
gcctttccctcacataattctggactgccagatcggatccgcttgagaataccggtacacagggtcttgcaatag

SEQ ID NO: 59840 - DNA, 75 bp, Artificial Sequence
  Synthetic
agaactttggcaagccagatatatctgcaaaggacctacgagacatcatgtatgaccacctaccaggcttcggta

SEQ ID NO: 59841 - DNA, 75 bp, Artificial Sequence
  Synthetic
cggcttttcaccaactggtccaggtaatttgcaagctaggaaaagacaattctgcattggacattattcatgctg

SEQ ID NO: 59842 - DNA, 75 bp, Artificial Sequence
  Synthetic
ctcagtttaagatatacactgaaattgagattgagattctcctctttgctattctgtaactttccctggttgtaa

SEQ ID NO: 59843 - DNA, 75 bp, Artificial Sequence
  Synthetic
attctgtaactttccctggttgtaacaattgaatcagttttatctattaccaattaccatcaacaaggtatatct

SEQ ID NO: 59844 - DNA, 75 bp, Artificial Sequence
  Synthetic
agttccaagccagccttgctgaaggtgattctccccaatgtgccctgatccaaataacaaaacggatccccatct

SEQ ID NO: 59845 - DNA, 75 bp, Artificial Sequence
  Synthetic
agtgatcttgggactcttcttcatctggtttttcctagagctctgaatccattttgcgagaagttcatccaaacg

SEQ ID NO: 59846 - DNA, 75 bp, Artificial Sequence
  Synthetic
tccaggatgccactccgcccacaattcacatccgctctcgtggtgacatcccacgtgcctgccaaaaaagtctcc

SEQ ID NO: 59847 - DNA, 75 bp, Artificial Sequence
  Synthetic
tggtttttcctagagctctgaatccattttgcgagaagttcatccaaacgattcagtgtctgaaaatataaaagg

SEQ ID NO: 59848 - DNA, 75 bp, Artificial Sequence
  Synthetic
ttcccctttccgtcaagtttaaggggttgttttgattgtgtgtagatcttataatcctagagtgccaaggagttg

SEQ ID NO: 59849 - DNA, 75 bp, Artificial Sequence
  Synthetic
gtccagttcctccatcaccaaaaatagacagaggttgggtttgcattttccaattgcaggacgggaagacacttg

SEQ ID NO: 59850 - DNA, 75 bp, Artificial Sequence
  Synthetic
ggctcaagatatagggtcccccagtcaaagacacgtgcggtcccatcctccctcaccttcagacatcaacgcatg

SEQ ID NO: 59851 - DNA, 75 bp, Artificial Sequence
  Synthetic
cgtgtcatcattgattgggaagatcaggaaaacaatctattccaataatatcgtacatcttgactaagttaaaca

SEQ ID NO: 59852 - DNA, 75 bp, Artificial Sequence
  Synthetic
aggggaagtcgatatggatcgtgggaccagaagaatctgggtgtcgcaaaatcaaggtgatactgatttagatta

SEQ ID NO: 59853 - DNA, 75 bp, Artificial Sequence
  Synthetic
gcagtcccaaacaccggtgagggaggcgcccggcgacaacacatgatgataggctgatcttcgggataagagaca

SEQ ID NO: 59854 - DNA, 75 bp, Artificial Sequence
  Synthetic
tgaaaaaccaaaaagccgtttacatccagatccaagatcaagagtggcttggaaataaggggcacttgttctttg

SEQ ID NO: 59855 - DNA, 75 bp, Artificial Sequence
  Synthetic
actgttcaacaaggaattgtcaggcagaaaataatttctgtatatcttgttgataacttggaggctatgtgtcaa

SEQ ID NO: 59856 - DNA, 75 bp, Artificial Sequence
  Synthetic
tctcaaaggacttacaaaaacaagggtgatgaagattaagaaaaagcctccttcagttgcaaggagctaattctt

SEQ ID NO: 59857 - DNA, 75 bp, Artificial Sequence
  Synthetic
ttggtaatacaagcctttgaggccggaattgatttccaagaaaatgccgacagcttccttctgatgctttgccta

SEQ ID NO: 59858 - DNA, 75 bp, Artificial Sequence
  Synthetic
gaattgatttccaagaaaatgccgacagcttccttctgatgctttgcctacatcatgcttaccaaggtgattata

SEQ ID NO: 59859 - DNA, 75 bp, Artificial Sequence
  Synthetic
aaaacttcatctagactaaggataaatcgattccaatcacgatgaggagaatcatcctacccacggcaccacctg

SEQ ID NO: 59860 - DNA, 75 bp, Artificial Sequence
  Synthetic
aattgttcttggagagcaatgccgtacagtatttggaaggtcatggattcaaatttgagctccggaagagggacg

SEQ ID NO: 59861 - DNA, 75 bp, Artificial Sequence
  Synthetic
aatacatggaggctgtttacccaatgagaacaatgaattctggtgcagacaacactgccagtggccctaattaca

SEQ ID NO: 59862 - DNA, 75 bp, Artificial Sequence
  Synthetic
aaatttgagctccggaagagggacggtgtcaatcggctcgaggaattgcttcctgctgcaacgagtggaaaaaac

SEQ ID NO: 59863 - DNA, 75 bp, Artificial Sequence
  Synthetic
caacaactggtgtgatgacaaatgatactccctctaattcactccgaccagttgcagatgataatattgatcatc

SEQ ID NO: 59864 - DNA, 75 bp, Artificial Sequence
  Synthetic
atcaggcgtacgttggccgcattgcctgaagaggagactacagaagcaaatgcagggcaatttctctcatttgcg

SEQ ID NO: 59865 - DNA, 75 bp, Artificial Sequence
  Synthetic
cgagccacacgcctaacagtgttgcctctgcatttatattggaagctatggtgaatgtaatatctggcccgaaag

SEQ ID NO: 59866 - DNA, 75 bp, Artificial Sequence
  Synthetic
agtttgtttcttcccaaactggttgtgggagaaaaggcttgcttggaaaaagtccagcgacaaattcaggttcat

SEQ ID NO: 59867 - DNA, 75 bp, Artificial Sequence
  Synthetic
tgggagaaaaggcttgcttggaaaaagtccagcgacaaattcaggttcatgcagaacagggtttaattcaatatc

SEQ ID NO: 59868 - DNA, 75 bp, Artificial Sequence
  Synthetic
tgctgatgaagcaaatcccaatctggcttcctctgggtgtctctgaccagaagacatatagctttgattcaacca

SEQ ID NO: 59869 - DNA, 75 bp, Artificial Sequence
  Synthetic
ccactgcatggcaatcagttggacacatgatggtaatctttagattgatgaggactaatttcttgattaaatatt

SEQ ID NO: 59870 - DNA, 75 bp, Artificial Sequence
  Synthetic
ctgctgccattatgctagcatcatataccatcactcattttggcaaaacctcaaatccccttgtgagaatcaacc

SEQ ID NO: 59871 - DNA, 75 bp, Artificial Sequence
  Synthetic
tactgatccaccagggcatgcatatggtagctggccacgatgccaatgatgctgtcattgctaattcagttgctc

SEQ ID NO: 59872 - DNA, 75 bp, Artificial Sequence
  Synthetic
ggtagctggccacgatgccaatgatgctgtcattgctaattcagttgctcaggctcgcttttcaggactcctaat

SEQ ID NO: 59873 - DNA, 75 bp, Artificial Sequence
  Synthetic
gacttggtcctggcatacctgatcacccactacgactcctaagaataggaaatcaagccttcctacaagagtttg

SEQ ID NO: 59874 - DNA, 75 bp, Artificial Sequence
  Synthetic
tgtcaaaaccgttcttgaccatattctgcaaaaaaccgaccaaggagtaagacttcaccctttggcccgaacagc

SEQ ID NO: 59875 - DNA, 75 bp, Artificial Sequence
  Synthetic
ctgcaaaaaaccgaccaaggagtaagacttcaccctttggcccgaacagccaaagtgcgtaatgaggttaatgca

SEQ ID NO: 59876 - DNA, 75 bp, Artificial Sequence
  Synthetic
tgctacctcctgtacaactgccacaatacttcacttttgatctgacagcgctgaagctgatcacccagccactcc

SEQ ID NO: 59877 - DNA, 75 bp, Artificial Sequence
  Synthetic
cagcggcaacctggacagatgaaactccagctgtgtcaactggcacgctccgcccagggatctcattccatccca

SEQ ID NO: 59878 - DNA, 75 bp, Artificial Sequence
  Synthetic
tttaaggccgccctaagctcacttgctaagcacggggaatatgccccttttgctcgccttctcaatctctcggga

SEQ ID NO: 59879 - DNA, 75 bp, Artificial Sequence
  Synthetic
aattaaggcctatcctgctaccaggaagagctggaaagaagggctccaactccgatctaacatctcctgacaaaa

SEQ ID NO: 59880 - DNA, 75 bp, Artificial Sequence
  Synthetic
gttaacaaccttgaacatggtctctacccacagttatcagcaattgctcttggagttgccacagcacatggtagc

SEQ ID NO: 59881 - DNA, 75 bp, Artificial Sequence
  Synthetic
tccaggctataatgaatttcctacaagacctcaaaattgtaccaatcgatccaaccaagaatatcatgggtattg

SEQ ID NO: 59882 - DNA, 75 bp, Artificial Sequence
  Synthetic
aagtgccagaactcctggttcacaggctgactgggaagaagacaactaccaagaatggtcaaccaatcattccaa

SEQ ID NO: 59883 - DNA, 75 bp, Artificial Sequence
  Synthetic
caacaatatgctgagtccagagaactcgacagcctaggcctagacgatcaggaaagaagaatactaatgaacttc

SEQ ID NO: 59884 - DNA, 75 bp, Artificial Sequence
  Synthetic
ttctgctaccaaagtacattggtcttgatcctctatctcaaggtgatctcacaatggtgatcactcaggactgtg

SEQ ID NO: 59885 - DNA, 75 bp, Artificial Sequence
  Synthetic
attcctgccactccccggccagtcttcccccagtcaatgaaaaatgaccatgagactcaacatcacactgccaga

SEQ ID NO: 59886 - DNA, 75 bp, Artificial Sequence
  Synthetic
gcacctcaccgcaagtctatacaacaatcaaccccggcatctacaacctgcaaaaaccagcccatctgatactcc

SEQ ID NO: 59887 - DNA, 75 bp, Artificial Sequence
  Synthetic
tggcatcgggggcaagacaaggcagccaagcagcagcccccgagccgagcccaaacccattacacccgagcccaa

SEQ ID NO: 59888 - DNA, 75 bp, Artificial Sequence
  Synthetic
atggtgattttgaaaattacaatggctatcatgatgatgaagttgggacggcaggtgacttggtcctgttcgatc

SEQ ID NO: 59889 - DNA, 75 bp, Artificial Sequence
  Synthetic
ctatcatgatgatgaagttgggacggcaggtgacttggtcctgttcgatcttgacgatcatgaggatgacaataa

SEQ ID NO: 59890 - DNA, 75 bp, Artificial Sequence
  Synthetic
cacccatccagcaacccacaaccgtcaaacgcacagatggacaagcaaagaacatcaagccaggagcaacacaga

SEQ ID NO: 59891 - DNA, 75 bp, Artificial Sequence
  Synthetic
ccccaagtctaagctgatcaacccctcccgcaatcccaccaacgccagcaaaaatcccccaactcgataccaacc

SEQ ID NO: 59892 - DNA, 75 bp, Artificial Sequence
  Synthetic
gagaaagattaattcatccacccctaggcaacaacaaggacgacaatcgggcttcagacaacaatcaacaatcag

SEQ ID NO: 59893 - DNA, 75 bp, Artificial Sequence
  Synthetic
ccaagcaaatcagctcaaaccgtctatctctccccgcttcactccacaccccagattcagcaaacgatcaacgca

SEQ ID NO: 59894 - DNA, 75 bp, Artificial Sequence
  Synthetic
aggcaacaacaaggacgacaatcgggcttcagacaacaatcaacaatcagcagattctgaggaacaagaagatcg

SEQ ID NO: 59895 - DNA, 75 bp, Artificial Sequence
  Synthetic
cttcttatgccacagcttatattaagaaaaagaacttgatgaagattaaggcaaccagtggtgctatcttcatct

SEQ ID NO: 59896 - DNA, 75 bp, Artificial Sequence
  Synthetic
atacaacaggcaccgaggcccagaacgtacgaccgccaatcgaagactctcaccagtgtacgaggaggacaccct

SEQ ID NO: 59897 - DNA, 75 bp, Artificial Sequence
  Synthetic
ctttgatttgagtcttaagtgaatacacaggttctaatactgttcttctgtccaacggtataattcagccaggcc

SEQ ID NO: 59898 - DNA, 75 bp, Artificial Sequence
  Synthetic
atgatgacgatgcatcaagtagccaacaagatccagattatacagctgttgcccctcctgctcctgtataccgca

SEQ ID NO: 59899 - DNA, 75 bp, Artificial Sequence
  Synthetic
taagacagtagctaatcacagtcatcatgggagcgtcagggattctgcaattgccccgtgagcgcttcaggaaaa

SEQ ID NO: 59900 - DNA, 75 bp, Artificial Sequence
  Synthetic
gcccctcctgctcctgtataccgcagtgcagaagcccacgagcctccccacaaatcctcgaacgagccagctgaa

SEQ ID NO: 59901 - DNA, 75 bp, Artificial Sequence
  Synthetic
catctttctttgtttgggtaataatcctattccataaagtcttttcaatcccgttgggggttgtacacaacaata

SEQ ID NO: 59902 - DNA, 75 bp, Artificial Sequence
  Synthetic
acatcacaattgaatgaagaccctgatatcggtcaatcaaagtctatgcaaaaattagaagagacatatcaccat

SEQ ID NO: 59903 - DNA, 75 bp, Artificial Sequence
  Synthetic
ccctacaagtgagtgatattgacaagtttgtgtgccgagacaaactctcttcaactagccaattgaagtcagtcg

SEQ ID NO: 59904 - DNA, 75 bp, Artificial Sequence
  Synthetic
gaaggatgagccggtaatatttagcactgatgatgggaaggaatacacctacccggattcacttgaggaagccta

SEQ ID NO: 59905 - DNA, 75 bp, Artificial Sequence
  Synthetic
ggttgaacttggagggcaatggagtagcaactgatgtaccaacggcaaccaaaagatggggttttcgagctggtg

SEQ ID NO: 59906 - DNA, 75 bp, Artificial Sequence
  Synthetic
acccggattcacttgaggaagcctatcctccatggctcaccgagaaagaacgactggacaatgagaatcgataca

SEQ ID NO: 59907 - DNA, 75 bp, Artificial Sequence
  Synthetic
tcctccatggctcaccgagaaagaacgactggacaatgagaatcgatacatttacataaataatcaacagttctt

SEQ ID NO: 59908 - DNA, 75 bp, Artificial Sequence
  Synthetic
ttccaccaaaggtggtaaattgcgaagctggagaatgggctgagaactgttataacctggctataaagaaagttg

SEQ ID NO: 59909 - DNA, 75 bp, Artificial Sequence
  Synthetic
atggtagtgagtgcctaccagaagcccctgagggagtgagggattttccccgttgccgctatgtacacaaagtct

SEQ ID NO: 59910 - DNA, 75 bp, Artificial Sequence
  Synthetic
aagtttcttgcaatcttgcagcaccatcagtaaccacagcacaaagcgcggtccacttcgtaaagctaaatacac

SEQ ID NO: 59911 - DNA, 75 bp, Artificial Sequence
  Synthetic
caggaactggaccatgcccaggaggactcgcctttcacaaagaaggagccttcttcctgtatgaccgactcgcat

SEQ ID NO: 59912 - DNA, 75 bp, Artificial Sequence
  Synthetic
caacaatcatttatcggggtacaacctttgccgaaggagttattgcatttctgatcttgcctaaggcgcgaaagg

SEQ ID NO: 59913 - DNA, 75 bp, Artificial Sequence
  Synthetic
taatctaaggccattaagagtttaagcaatatacatatatacttacactggtttatccaagatgtggctcaatgt

SEQ ID NO: 59914 - DNA, 75 bp, Artificial Sequence
  Synthetic
attttttccagtctcctccattgcatgagcctgccaacatgaccacggatccctccagttactatcacacgacaa

SEQ ID NO: 59915 - DNA, 75 bp, Artificial Sequence
  Synthetic
caataaactacgtggttgataattttggaaccaacaccacagagtttctgttccaagtcgatcatttgacgtatg

SEQ ID NO: 59916 - DNA, 75 bp, Artificial Sequence
  Synthetic
attgtggattgacccattctgcttaaaatgctttgcccgttaaaaatgtgatctaatagatagccctgactagca

SEQ ID NO: 59917 - DNA, 75 bp, Artificial Sequence
  Synthetic
aaatgctttgcccgttaaaaatgtgatctaatagatagccctgactagcaaaattaagaaaaacatttgatgaag

SEQ ID NO: 59918 - DNA, 75 bp, Artificial Sequence
  Synthetic
tgcagctcgaggcaagattcacaccacaattccttgtcctcctaaatgaaaccatctactctgataaccgcagaa

SEQ ID NO: 59919 - DNA, 75 bp, Artificial Sequence
  Synthetic
attaaaaccttcatcgccagtaaatgatcatattgtctgtagacaggtgtttactccacctcaaagtcggaaata

SEQ ID NO: 59920 - DNA, 75 bp, Artificial Sequence
  Synthetic
gtaacacaacaggaaaactaatctggaaaataaatcccactgttgataccagcatgggtgagtgggctttctggg

SEQ ID NO: 59921 - DNA, 75 bp, Artificial Sequence
  Synthetic
tcctaccttaggaccattgtcaagaggtgcataggcattaccatccttgagaatatgtacaataataaattgaag

SEQ ID NO: 59922 - DNA, 75 bp, Artificial Sequence
  Synthetic
aaaataaaaaaacttcacaaaaaccctttcaagtgaagagttgtctttcgtacctgtaccagaaacccagaacca

SEQ ID NO: 59923 - DNA, 75 bp, Artificial Sequence
  Synthetic
atatgttcaggcccagaaacgactggatggatttctgagcaactaatgacaggtaagattccagtaactgatata

SEQ ID NO: 59924 - DNA, 75 bp, Artificial Sequence
  Synthetic
ggtccttgacacgacagcgacggtctctcctcccatctccgcccacaaccacgcagccgaagaccacaaagaatt

SEQ ID NO: 59925 - DNA, 75 bp, Artificial Sequence
  Synthetic
ttcattgatattgataacaagccagatcaaatggaagtccgactcaaaccatcatcaaggagctcaacaagaact

SEQ ID NO: 59926 - DNA, 75 bp, Artificial Sequence
  Synthetic
ggtttcagaggattccactccagtggttcagatgcaaaacatcaagggaaaggacacaatgccaaccacagtgac

SEQ ID NO: 59927 - DNA, 75 bp, Artificial Sequence
  Synthetic
gggtgtaccaacaaccacaccctctccatttccaatcaatgctcgcaacactgatcataccaaatcatttatcgg

SEQ ID NO: 59928 - DNA, 75 bp, Artificial Sequence
  Synthetic
ctgcaatcgaggcccttgaaaaccgcctcagcacacttgagagtagcttaaagccaatccaagacatgggtaaag

SEQ ID NO: 59929 - DNA, 75 bp, Artificial Sequence
  Synthetic
cctggaggggccccaagaagaccacagcaccacacagcctgccaagaccaccagccaaccaaccaacagcacaga

SEQ ID NO: 59930 - DNA, 75 bp, Artificial Sequence
  Synthetic
aagccaatccaagacatgggtaaagtgatttcatcattgaatcgcagttgtgccgaaatggtggcaaaatatgat

SEQ ID NO: 59931 - DNA, 75 bp, Artificial Sequence
  Synthetic
atcgacgacactaaacccaacatcagagccctccagtagaggcacgggaccatccagccccacggtccccaacac

SEQ ID NO: 59932 - DNA, 75 bp, Artificial Sequence
  Synthetic
cttctagttatgacaactggacgggctacttcaactgcagctgcagtagatgcgtactggaaagagcacaaacag

SEQ ID NO: 59933 - DNA, 75 bp, Artificial Sequence
  Synthetic
cacagaaagccacgccgaacttggcaagacaaccccaaccacactcccagaacagcacactgccgccagtgccat

SEQ ID NO: 59934 - DNA, 75 bp, Artificial Sequence
  Synthetic
cgatgatccaaacagctatgtaccagatgctgtgcaggaggcttacaagaaccttgacagtacatcgaccctgac

SEQ ID NO: 59935 - DNA, 75 bp, Artificial Sequence
  Synthetic
tccaagagccgtgcaccccgacgaactcagtggacctggcttcctgacgaacacaatacggggggttacaaatct

SEQ ID NO: 59936 - DNA, 75 bp, Artificial Sequence
  Synthetic
cctgacaggatccagaagaaagcgaagggatgtcactcccaatacacaacccaaatgcaacccaaacctgcacta

SEQ ID NO: 59937 - DNA, 75 bp, Artificial Sequence
  Synthetic
tcatgtatgatcatctacctggttttgggactgcctttcaccaacttgttcaagtgatttgtaaaataggaaagg

SEQ ID NO: 59938 - DNA, 75 bp, Artificial Sequence
  Synthetic
tgggactgcctttcaccaacttgttcaagtgatttgtaaaataggaaaggataacaaccttttggacacaattca

SEQ ID NO: 59939 - DNA, 75 bp, Artificial Sequence
  Synthetic
ttggacagccttggatgagggtgctgccataggtttagcctggataccatacttcgggccagcagctgagggaat

SEQ ID NO: 59940 - DNA, 75 bp, Artificial Sequence
  Synthetic
tgctgagttccaggcaagtctagcagatggtgactctcctcaatgtgcactcatacagataaccaaaagagtccc

SEQ ID NO: 59941 - DNA, 75 bp, Artificial Sequence
  Synthetic
ttacactgaaggcataatggagaatcaaaatggattgatctgtggattgaggcagctggccaacgaaacgacaca

SEQ ID NO: 59942 - DNA, 75 bp, Artificial Sequence
  Synthetic
tcatacagataaccaaaagagtcccaatctttcaggatgtgccgcccccgacaatccacattagatctcgtggtg

SEQ ID NO: 59943 - DNA, 75 bp, Artificial Sequence
  Synthetic
agctcttcaattgttcttaagggcaactactgagttgcgtacattctctatactaaatcggaaagcaatagactt

SEQ ID NO: 59944 - DNA, 75 bp, Artificial Sequence
  Synthetic
atatcccacgagcatgccaaaagagtctccgaccagcaccaccatcacccaaaattgatcgtggttgggtttgtt

SEQ ID NO: 59945 - DNA, 75 bp, Artificial Sequence
  Synthetic
cttgctccaaagatggggaggaacatgtcacattctagggcctgattgttgcattgaaccccaagattggaccaa

SEQ ID NO: 59946 - DNA, 75 bp, Artificial Sequence
  Synthetic
tgtttaagatgcaagatggtaaaacgcttggacttaagatctaaggatcaagatttatttaacaaggcaagccac

SEQ ID NO: 59947 - DNA, 75 bp, Artificial Sequence
  Synthetic
aaatatcactgataaaattgatcaaataatccatgactttgtcgataataatcttccaaatcagaatgatggcag

SEQ ID NO: 59948 - DNA, 75 bp, Artificial Sequence
  Synthetic
agatttatttaacaaggcaagccacaaccttagacggaacctcagccagaccattgaactattaacgctgttgat

SEQ ID NO: 59949 - DNA, 75 bp, Artificial Sequence
  Synthetic
caactggtggactggatggaaacaatgggttcctgctggaataggaatcacaggagtaatcattgctattattgc

SEQ ID NO: 59950 - DNA, 75 bp, Artificial Sequence
  Synthetic
gataatatataattaatggtcatatttgaatatgataacatcttgcttcttgttctgtcttgtagctctttgaat

SEQ ID NO: 59951 - DNA, 75 bp, Artificial Sequence
  Synthetic
tttgctgtgcatttgcaaattcatgctttgaactaatatagcatcatactttctaatattcccccaatatgaatt

SEQ ID NO: 59952 - DNA, 75 bp, Artificial Sequence
  Synthetic
tggaagatcattccaaacgtacaaacatgcacaagatgttatggtttagcaaagaattgataggagtactggtat

SEQ ID NO: 59953 - DNA, 75 bp, Artificial Sequence
  Synthetic
tttgttttcgattttatttaatgatatatcctctgtatacctcactaatgtactcgagcataatttccctgatag

SEQ ID NO: 59954 - DNA, 75 bp, Artificial Sequence
  Synthetic
acttgattgtatttgatgattaaggacctcacaaaattcctggggattgaaaagaactggataactcaataaatt

SEQ ID NO: 59955 - DNA, 75 bp, Artificial Sequence
  Synthetic
ttatgctaggaccacaaatacacttgatgaagattaagaaaaagataatcttatgattatcattgatcttcatct

SEQ ID NO: 59956 - DNA, 75 bp, Artificial Sequence
  Synthetic
ataccttaaatactctattcaaggagagtatgacaaaaccaagtagtattggataaacttgtcctgcattcaaat

SEQ ID NO: 59957 - DNA, 75 bp, Artificial Sequence
  Synthetic
ggcagtgccaggggcagatgttccatcaaactccatgagaccagtggctgatgataacattgatcactcaagcca

SEQ ID NO: 59958 - DNA, 75 bp, Artificial Sequence
  Synthetic
atgataacattgatcactcaagccatactccaagcggagtagcttctgcctttatattagaagctacagtgaatg

SEQ ID NO: 59959 - DNA, 75 bp, Artificial Sequence
  Synthetic
ctgaagacatacggcttatctattcactattgtattagaaaatctagggaatatcatttgaaactaattagtgac

SEQ ID NO: 59960 - DNA, 75 bp, Artificial Sequence
  Synthetic
taatttcgggaacaaaagtcctgatgaagcaaatacctatttggcttccactgggtgtagccgatcagaagatat

SEQ ID NO: 59961 - DNA, 75 bp, Artificial Sequence
  Synthetic
taaaacacacaactcaagtcggccagaatggaagttgttcatgaaagaggtcgctccaggatctcccgacaaaac

SEQ ID NO: 59962 - DNA, 75 bp, Artificial Sequence
  Synthetic
gaagcaaatacctatttggcttccactgggtgtagccgatcagaagatatacagctttgattcaacaacagccgc

SEQ ID NO: 59963 - DNA, 75 bp, Artificial Sequence
  Synthetic
acaagggatggacctagtcatttagtacgggcgagatcatcctctcgagctagttatcgaagtgaataccataca

SEQ ID NO: 59964 - DNA, 75 bp, Artificial Sequence
  Synthetic
ccaaggagtgcctcgcagatccgtgtccccactgtctttcatcggaaaaagacagatttattgacagttccacca

SEQ ID NO: 59965 - DNA, 75 bp, Artificial Sequence
  Synthetic
cccaggaatacccgatcatccgctacgactcctaaggttgggcaatcaggcattccttcaagagtttgttcttcc

SEQ ID NO: 59966 - DNA, 75 bp, Artificial Sequence
  Synthetic
gcacctaaagatgtatgcccgactttaaagaaagggtttctatgtgacagcaatttctgtaaaaaggatcaccaa

SEQ ID NO: 59967 - DNA, 75 bp, Artificial Sequence
  Synthetic
acatttgatctaacagctctaaagttcatcactcaaccattgccagctgcaacctggacagacgaaactccagca

SEQ ID NO: 59968 - DNA, 75 bp, Artificial Sequence
  Synthetic
cttgaaagcttaacagatagagagttactcttgctgattgcacgcaagacatgtggatccacggaacaacaacta

SEQ ID NO: 59969 - DNA, 75 bp, Artificial Sequence
  Synthetic
ggagcagtcaatgttcttcgtcctgggctttcactccatcccaagcttcgtccaattcttctgccagggaagaca

SEQ ID NO: 59970 - DNA, 75 bp, Artificial Sequence
  Synthetic
agcatagttgctccaaaagattcacgtctggctaatcctattgctgaggatttccaacaaaaagatgggcctaag

SEQ ID NO: 59971 - DNA, 75 bp, Artificial Sequence
  Synthetic
gtaacactgtcgatgcttatagagacagcagagtattggtccaaacaggacattaagaacatcgatgattcaaga

SEQ ID NO: 59972 - DNA, 75 bp, Artificial Sequence
  Synthetic
ttaagagctttattgaccctttgtgctgttatgacgcgcaaattttcaaaatctcaacttagcttgctatgtgaa

SEQ ID NO: 59973 - DNA, 75 bp, Artificial Sequence
  Synthetic
gccaaccaattattccagttcttcttccgaaatatgttggacttgatcctatatcgccaggggacttaaccatgg

SEQ ID NO: 59974 - DNA, 75 bp, Artificial Sequence
  Synthetic
agccacttacggcgagaaggacttggtcaagaccaatcagagtcagttctggaggtatatcaacgcttacacagc

SEQ ID NO: 59975 - DNA, 75 bp, Artificial Sequence
  Synthetic
gataaaggtgggaatttcgaggcagcactatggcagcagtgggatcggcaatcattgataatgttcataacagca

SEQ ID NO: 59976 - DNA, 75 bp, Artificial Sequence
  Synthetic
tttttaaatattgcattacaattaccatgtgagagttcatctgttgttatttcaggtttgagaatgctgataccc

SEQ ID NO: 59977 - DNA, 75 bp, Artificial Sequence
  Synthetic
atcaatagactaaaaatctgattgtgtaaaattataaaagaatcaagcagaggcaacagacccacagcttacgcc

SEQ ID NO: 59978 - DNA, 75 bp, Artificial Sequence
  Synthetic
cagtcggaagccactgaggttgtaaccccctccgaaacctgcacatggtcagaaggaggaagttcccattgaagc

SEQ ID NO: 59979 - DNA, 75 bp, Artificial Sequence
  Synthetic
tagataactaatattaaggagtcctttaatcgaattttccagtcttaagtaataatcatttcttttgtaattaat

SEQ ID NO: 59980 - DNA, 75 bp, Artificial Sequence
  Synthetic
cccaaatcacaaggcgagctaaaaaatcccttttgaacatgcataacatcacatacaatttcaaaggcattggaa

SEQ ID NO: 59981 - DNA, 75 bp, Artificial Sequence
  Synthetic
tatgaatttgttagcttatcggtgcgagattcccttgagaacccggcggagcttctactatctgcagtaaccaga

SEQ ID NO: 59982 - DNA, 75 bp, Artificial Sequence
  Synthetic
taaatggtgatttcaggaagattagtgtttgccctcaaaatcagatccgagcaataatcatctactctacagcca

SEQ ID NO: 59983 - DNA, 75 bp, Artificial Sequence
  Synthetic
gagattcccttgagaacccggcggagcttctactatctgcagtaaccagaggagaagttcaacctagtcaaaact

SEQ ID NO: 59984 - DNA, 75 bp, Artificial Sequence
  Synthetic
gttaatttctaatataaaggttaaaaaaatgctgcaggccagctattgttccacaggtcccaattcttcttgtta

SEQ ID NO: 59985 - DNA, 75 bp, Artificial Sequence
  Synthetic
aattgtaggagctagcacaagtgatgcaattaaatgatactagtatatacaatgccaccaacttaattctaagat

SEQ ID NO: 59986 - DNA, 75 bp, Artificial Sequence
  Synthetic
gatgaagattaaggcgacaacgagccgaaacttcatctcttttaaatatctaacattacccgttccaaagtcata

SEQ ID NO: 59987 - DNA, 75 bp, Artificial Sequence
  Synthetic
tttgtatatctcggaaattcaaaattaaatgctacgttattgattcaattaagaaaaagacaatggaccatcaaa

SEQ ID NO: 59988 - DNA, 75 bp, Artificial Sequence
  Synthetic
caaggacacattcaaatcagggattgtaagctgctatttcttacctccccaaattacctatacaacatggggtca

SEQ ID NO: 59989 - DNA, 75 bp, Artificial Sequence
  Synthetic
attagttcaatacctgaactaatgcacttatagaaacaggagaaccagccagacagcagacaaataacaatgaac

SEQ ID NO: 59990 - DNA, 75 bp, Artificial Sequence
  Synthetic
aaattacctatacaacatggggtcagggtatcaacttctccaattgcctcggggacgttttcgtcaaacttcgct

SEQ ID NO: 59991 - DNA, 75 bp, Artificial Sequence
  Synthetic
cacaatatgttactgctataatgaagttcgttaattcaaaaacaaatgatgaagattaatgcagatgtctaaagg

SEQ ID NO: 59992 - DNA, 75 bp, Artificial Sequence
  Synthetic
cttagtatgggtaatcatcctcttccagcgagcaatctccatgccgcttggtatagtgacaaatagcactctcaa

SEQ ID NO: 59993 - DNA, 75 bp, Artificial Sequence
  Synthetic
gtatagtgacaaatagcactctcaaagcaacagaaattgatcaattggtttgtcgggacaaactgtcatcaacca

SEQ ID NO: 59994 - DNA, 75 bp, Artificial Sequence
  Synthetic
ataaacactccatgcatcagtgttataattgggctctgtagaaaatcttcatctcctccaacctacctcaaagaa

SEQ ID NO: 59995 - DNA, 75 bp, Artificial Sequence
  Synthetic
agcaacagaaattgatcaattggtttgtcgggacaaactgtcatcaaccagtcagctcaagtccgtggggctgaa

SEQ ID NO: 59996 - DNA, 75 bp, Artificial Sequence
  Synthetic
ggattttaccgcgattgggagttataacgacaatagggacaaccacctttgacactagccaagcttgtcgtgggc

SEQ ID NO: 59997 - DNA, 75 bp, Artificial Sequence
  Synthetic
acacagcattttatcttgcaacgtcgacattcccatcaatctgaggagtaacagctatcaaaacaacgcatatgt

SEQ ID NO: 59998 - DNA, 75 bp, Artificial Sequence
  Synthetic
agacattgtcggtaatagtactgcctaagacaactatttataataacagttggaattcattttttcacccaagct

SEQ ID NO: 59999 - DNA, 75 bp, Artificial Sequence
  Synthetic
ggtgtacgaggattccctagatgtcgctatgtccacaaagttcaaggaacaggtccttgtcccggtgacttagct

SEQ ID NO: 60000 - DNA, 75 bp, Artificial Sequence
  Synthetic
attctcaagttaacagttgaaacaggactcgacccaggacaactccggatacgtaacataagaaaagaacaaccc

SEQ ID NO: 60001 - DNA, 75 bp, Artificial Sequence
  Synthetic
ttccataaaaatggggcttttttcttgtatgatagattggcctcaactgtcatctaccgtgggacaacttttgct

SEQ ID NO: 60002 - DNA, 75 bp, Artificial Sequence
  Synthetic
ttgacccagagtgaacaagctcatactatcaaggctaatcctcgggcctgcctggagtccacaatggccaaggct

SEQ ID NO: 60003 - DNA, 75 bp, Artificial Sequence
  Synthetic
gaaggtgtcgtagcttttttaattctgtcagagcccaagaagcatttttggaaggctacaccagctcatgaaccg

SEQ ID NO: 60004 - DNA, 75 bp, Artificial Sequence
  Synthetic
actgggaggtacaaccttatctccccaaagaaagatcttgaaaaagggctggttctgaatgacctttgcactctc

SEQ ID NO: 60005 - DNA, 75 bp, Artificial Sequence
  Synthetic
tgtcagagcccaagaagcatttttggaaggctacaccagctcatgaaccggtgaacacaacagatgattccacaa

SEQ ID NO: 60006 - DNA, 75 bp, Artificial Sequence
  Synthetic
tcagtggcccagacggtccagggatggaaggttacctgggctgggattgaatttgatgttacacagaaagggatg

SEQ ID NO: 60007 - DNA, 75 bp, Artificial Sequence
  Synthetic
tagacaaccacacatatgtgcaactagatcgtccacacactccgcagttccttgttcagctcaatgaaacacttc

SEQ ID NO: 60008 - DNA, 75 bp, Artificial Sequence
  Synthetic
gccttattgcacaggctcaagaccagtgattttgctccagcctggtcaatgaccaggaacttatttccacatctc

SEQ ID NO: 60009 - DNA, 75 bp, Artificial Sequence
  Synthetic
tttcaaaacccgaactctacaattgagtcgccactttgggcactgcgggtcatactagcagcaggtattcaagat

SEQ ID NO: 60010 - DNA, 75 bp, Artificial Sequence
  Synthetic
tacagggagattgacttggacattggatcctaaaattgaaccagatgttggtgagtgggccttctgggaaactaa

SEQ ID NO: 60011 - DNA, 75 bp, Artificial Sequence
  Synthetic
cagctaattgatcaatcgttgatcgaacccttggcaggagcgctaggcttaattgctgattggcttcttactact

SEQ ID NO: 60012 - DNA, 75 bp, Artificial Sequence
  Synthetic
ggaacaaaccactttcaaatgcgcacacaacaggctaaggagcaactaagtctaaaaatgttgtccctggtgcga

SEQ ID NO: 60013 - DNA, 75 bp, Artificial Sequence
  Synthetic
atcaacccacaccaacaactcctcagatcagagcccagcgggaactgtccaaggaaaaattggcttccacccacc

SEQ ID NO: 60014 - DNA, 75 bp, Artificial Sequence
  Synthetic
tcaaacatcctaaagttcatcaaccaactagatgcactacatgttgtgaattacaatggacttctcagtagcatt

SEQ ID NO: 60015 - DNA, 75 bp, Artificial Sequence
  Synthetic
tgctcactgcaggacggacagaggaaatgtcgacccaaggtccaaccaacggagagacaatcacaggtttcaccg

SEQ ID NO: 60016 - DNA, 75 bp, Artificial Sequence
  Synthetic
gaaattggcaccaaaagccatacaattataattacccggacaaatatgggttttttggtagagttgcaagagcct

SEQ ID NO: 60017 - DNA, 75 bp, Artificial Sequence
  Synthetic
aatgtcgacccaaggtccaaccaacggagagacaatcacaggtttcaccgcgaacccaatgacaaccaccattgc

SEQ ID NO: 60018 - DNA, 75 bp, Artificial Sequence
  Synthetic
cgaacccaatgacaaccaccattgccccaagtccaaccatgacaagcgaggttgataacaatgtaccaagtgaac

SEQ ID NO: 60019 - DNA, 75 bp, Artificial Sequence
  Synthetic
gacaaatcagccatgaacaccagaaaaccaggaccagtcaaattctccctcctccatgaatcaaccttgaagaca

SEQ ID NO: 60020 - DNA, 75 bp, Artificial Sequence
  Synthetic
aaccgaacagcacagcatccattgaaaactcccccccatcggcgagcaacgggacaatcaaccgccccgagatga

SEQ ID NO: 60021 - DNA, 75 bp, Artificial Sequence
  Synthetic
cttgctaaaaaacctgcgacccagatgcaagcactaatcttagaattcaatagttctctcgctatttaactcaac

SEQ ID NO: 60022 - DNA, 75 bp, Artificial Sequence
  Synthetic
atccgacccaaggaccgaacaactccgcccagagcccacagaccaagaccacgccagcacccacagcatccccga

SEQ ID NO: 60023 - DNA, 75 bp, Artificial Sequence
  Synthetic
tcatcaaaatgctaacttgtgatccttaagctgcaccttagacttttgataagaatactaactattgatgattgt

SEQ ID NO: 60024 - DNA, 75 bp, Artificial Sequence
  Synthetic
cgacccaggacccgcaagaaacgaccaacagcagcaaaccaggaaccagcccaggaagcacagccgaaccaagtc

SEQ ID NO: 60025 - DNA, 75 bp, Artificial Sequence
  Synthetic
ctttgacatgaggataagaacactgcccattagatagatggggttcaccattaatacacaattacccaatcatgt

SEQ ID NO: 60026 - DNA, 75 bp, Artificial Sequence
  Synthetic
agcccggattcaccacaaatacagtaagtaaggtagctgattcagtgagtaccaccaggaaacaaaagcgatcga

SEQ ID NO: 60027 - DNA, 75 bp, Artificial Sequence
  Synthetic
taacagcagttagatccctcaagtatatcaagttcattctaccctttgcattgtcactctaattaaatcacctga

SEQ ID NO: 60028 - DNA, 75 bp, Artificial Sequence
  Synthetic
ttcgccaaaacaccgctaacaaatgtaacccagatcttcactattggacagctgttgatgagggcgcagcagtag

SEQ ID NO: 60029 - DNA, 75 bp, Artificial Sequence
  Synthetic
tacaattatgttaattagctagattctctcatttttagacttgtttgctagaataattgatcatccacttgatta

SEQ ID NO: 60030 - DNA, 75 bp, Artificial Sequence
  Synthetic
gattggcatggattccatattttggacctgcagcagaaggcatctacattgagggtgtaatgcataatcagaatg

SEQ ID NO: 60031 - DNA, 75 bp, Artificial Sequence
  Synthetic
cacatccaactagggtctagttcatagattgctaataatctttagttcaatactaatgacaaagagattagatta

SEQ ID NO: 60032 - DNA, 75 bp, Artificial Sequence
  Synthetic
gctatagcttgaggaagattaagaaaaagtgtctgtggggtctttccgtgtagaagggcacacagccataattct

SEQ ID NO: 60033 - DNA, 75 bp, Artificial Sequence
  Synthetic
caattgtttctgcgggccacaacagaactgaggacttactcacttcttaatagaaaagctattgattttcttctt

SEQ ID NO: 60034 - DNA, 75 bp, Artificial Sequence
  Synthetic
tcctctttatacaacatggctacacaacatacgcaatatccagacgcaaggttatcatcacctatagttttagat

SEQ ID NO: 60035 - DNA, 75 bp, Artificial Sequence
  Synthetic
gccacatgattggacaaaaaatattactgatgaaattaaccaaattaaacatgactttattgacaatcccctacc

SEQ ID NO: 60036 - DNA, 75 bp, Artificial Sequence
  Synthetic
cagtgtgatcttgtcactcgtgcttgtggattgtattccgcatactccttaaatccccaactaaagaactgtaga

SEQ ID NO: 60037 - DNA, 75 bp, Artificial Sequence
  Synthetic
agaccacggagatgatcttaatctatggacaggttggagacaatggatcccggctggaattgggattattggagt

SEQ ID NO: 60038 - DNA, 75 bp, Artificial Sequence
  Synthetic
ctaccgaaacatatataccgactaaaatatgacaccactgttacagagtttttgagtgatgtgccggtagcaaca

SEQ ID NO: 60039 - DNA, 75 bp, Artificial Sequence
  Synthetic
ttgccagcggattttttagtacctacatttcttaggactctatcaggaaatggttcttgtccaattgatccaaaa

SEQ ID NO: 60040 - DNA, 75 bp, Artificial Sequence
  Synthetic
tgcagtcaatttttagaagaaattgtcaattatactctacaagatattcgcttcctaaactattacctcaatcga

SEQ ID NO: 60041 - DNA, 75 bp, Artificial Sequence
  Synthetic
atctcagggttactccaaggagaaatattatctctaaggtttacttgaatgctgaccacttatcttaaatgagca

SEQ ID NO: 60042 - DNA, 75 bp, Artificial Sequence
  Synthetic
gctgaccacttatcttaaatgagcaactaataatatgtttttctgcttcttagcttgattcacaatatgatattt

SEQ ID NO: 60043 - DNA, 75 bp, Artificial Sequence
  Synthetic
gccggagtgcataacgatcatgtggatagggattttggacaaaaaattcgcaatctaatttgcgacaatgaggtt

SEQ ID NO: 60044 - DNA, 75 bp, Artificial Sequence
  Synthetic
ctcttaataatgattaatatattaagaaaaacttatgatgaagattaaaggggaggatcgctaacgtgaaaatct

SEQ ID NO: 60045 - DNA, 75 bp, Artificial Sequence
  Synthetic
ttacatcaaatgtttcactggtatgatcttgcaattctagcacgtagagggcgactaaatagagggaataatcgc

SEQ ID NO: 60046 - DNA, 75 bp, Artificial Sequence
  Synthetic
cccatctcgcttgtcgaagccacgttggtggtgcttgcagctgagaacaactccagagattgtaggtagaaagga

SEQ ID NO: 60047 - DNA, 75 bp, Artificial Sequence
  Synthetic
tggtggtgcttgcagctgagaacaactccagagattgtaggtagaaaggaccagcatttataggtaggggtcaga

SEQ ID NO: 60048 - DNA, 75 bp, Artificial Sequence
  Synthetic
tcaacatggtttgcaagtgataatttggtagatatcctaggttatggagattatattttttggaaaataccatta

SEQ ID NO: 60049 - DNA, 75 bp, Artificial Sequence
  Synthetic
aagcaacaataaccataaaaggagagcctgacattgctatttagtatcctagaacctgatttctaggttctagtt

SEQ ID NO: 60050 - DNA, 75 bp, Artificial Sequence
  Synthetic
tcactactaccagtggatacacaaggcctcccacatgcagccaaggactggtatcatgaatcggttttcaaggag

SEQ ID NO: 60051 - DNA, 75 bp, Artificial Sequence
  Synthetic
gtacaatccggatgatggagcattcaagagaacggggtagatctagcaacatgcgacataatagccgggaaccat

SEQ ID NO: 60052 - DNA, 75 bp, Artificial Sequence
  Synthetic
gctattcaaggccatacacacatcgtgtccatctctacagcagatgtcttaatcatgtgtaaggacataatcacc

SEQ ID NO: 60053 - DNA, 75 bp, Artificial Sequence
  Synthetic
acgaaaatccatcaaggtctcgctcattatctcgggaccctaatcaggttgatcgtaggcagcctcgaagtgcat

SEQ ID NO: 60054 - DNA, 75 bp, Artificial Sequence
  Synthetic
tgtcgatttaatactttactgattgctgctgtggcaaatctagaggattcagttcattcagattaccctttacca

SEQ ID NO: 60055 - DNA, 75 bp, Artificial Sequence
  Synthetic
gaaacagtgtctgacctatacaaagcaggagattatttaatctcattgctaggatcagaaggttacaaagtcata

SEQ ID NO: 60056 - DNA, 75 bp, Artificial Sequence
  Synthetic
cccaaattcgtgttccgaatctgttccatcggaaaaagactgatacgctcatagttcctccggctcctaaggata

SEQ ID NO: 60057 - DNA, 75 bp, Artificial Sequence
  Synthetic
tatgcccaacactcaaaaaaggattcctctgcgatagtaaattttgcaaaaaagaccaccaattggatagcttaa

SEQ ID NO: 60058 - DNA, 75 bp, Artificial Sequence
  Synthetic
aaattccttgagccgttatgcttagcaaagatccaactctgctcaaattacactgagaggaaaggaagattcctc

SEQ ID NO: 60059 - DNA, 75 bp, Artificial Sequence
  Synthetic
atgatcatgaattactactgctaattgcaagaagaacatgtggaattatcgagagcaattcgcagatcacatccc

SEQ ID NO: 60060 - DNA, 75 bp, Artificial Sequence
  Synthetic
actcaaatgcatttagctgtaaatcatacacttgaggaacttacagggtcccgagaattaaggccacaacagatt

SEQ ID NO: 60061 - DNA, 75 bp, Artificial Sequence
  Synthetic
cggaaggtaagggaattccatcaaatgctgataaaccttaaggcaactcctcaacaactctgtgagttgttttca

SEQ ID NO: 60062 - DNA, 75 bp, Artificial Sequence
  Synthetic
aatagtcctaaattaacacttgcagtccttcttcaaattgctgaacattgggcaaccagagacctaaggcaaatt

SEQ ID NO: 60063 - DNA, 75 bp, Artificial Sequence
  Synthetic
gtgcaaaagcattgggggcaccctgtcttgcatagcgaaaaggctatccaaaaagtaaagaagcatgcaacagtg

SEQ ID NO: 60064 - DNA, 75 bp, Artificial Sequence
  Synthetic
gaggactctaaacttagagctcttttaaccctttgtgccgtattaacaaggaaattttctaaatcccaactgggt

SEQ ID NO: 60065 - DNA, 75 bp, Artificial Sequence
  Synthetic
ataaaagcattgcgcccaataataatctttgaaacatattgtgtgtttaaatacagcattgcaaaacattatttt

SEQ ID NO: 60066 - DNA, 75 bp, Artificial Sequence
  Synthetic
cttctatgtgagacccacctacggcatgagggcctcggacaggaccaagctgattctgtattagaggtctaccaa

SEQ ID NO: 60067 - DNA, 75 bp, Artificial Sequence
  Synthetic
atgagggcctcggacaggaccaagctgattctgtattagaggtctaccaaagactccacagtgataaaggaggga

SEQ ID NO: 60068 - DNA, 75 bp, Artificial Sequence
  Synthetic
gatagtcagggtacgtggtacagtgtgacttctgacagatgcttaacaccaggcctttcctcttacatcaaaaga

SEQ ID NO: 60069 - DNA, 75 bp, Artificial Sequence
  Synthetic
attttgaggctgccttgtggcaacaatgggaccgacagtcattaataatgttcatctctgcttttctcaacattg

SEQ ID NO: 60070 - DNA, 75 bp, Artificial Sequence
  Synthetic
aaccaatttcctccactacctatgatcaaagaacttttgtgggaattttatcacttagatcatcctccgttattc

SEQ ID NO: 60071 - DNA, 75 bp, Artificial Sequence
  Synthetic
ctctccagacaccttgtgaaagttctagtgtcgtagtctcaggtcttgccacattgtacccagcacaagacaatt

SEQ ID NO: 60072 - DNA, 75 bp, Artificial Sequence
  Synthetic
tccaccaaagtgattagtgatttgagtatctttattaaagatcgtgctactgcagtcgagaaaacatgctgggac

SEQ ID NO: 60073 - DNA, 75 bp, Artificial Sequence
  Synthetic
gcagtttttgaacccaatgttcttggttataacccaccgaataaatttgctacaaaaagggtacctgagcaattc

SEQ ID NO: 60074 - DNA, 75 bp, Artificial Sequence
  Synthetic
cttgaacaggagaatttctcaatagagagtgtcctacattatgctcaacgtctggaatatcttctcccggagtac

SEQ ID NO: 60075 - DNA, 75 bp, Artificial Sequence
  Synthetic
gtgcaattgtcaagggttccatttagtaataatgatccttaaaacagtctactatcgcaattatcgatggattta

SEQ ID NO: 60076 - DNA, 75 bp, Artificial Sequence
  Synthetic
cggaacttctctttttcactcaaggagaaggagttaaacattggacgagcttttgggaaattgccatatccaaca

SEQ ID NO: 60077 - DNA, 75 bp, Artificial Sequence
  Synthetic
ccctatttgacggtacatgacttgaatgcaataaggtaagttggtatttgaggtattttgtctagggtatactca

SEQ ID NO: 60078 - DNA, 75 bp, Artificial Sequence
  Synthetic
cgcaatgttcaaactctgtgcgaagctttgttagcagatggtttggcgaaagcattcccaagcaatatgatggtt

SEQ ID NO: 60079 - DNA, 75 bp, Artificial Sequence
  Synthetic
aagtcgtatgtctagcaaattatcaatagcaaagttaaattctcataacctcatattttgattaagtaatcatga

SEQ ID NO: 60080 - DNA, 75 bp, Artificial Sequence
  Synthetic
gtgacagagcgcgagcaaaaagaaagccttttgcatcaagcgtcttggcatcacacaagtgatgattttggtgag

SEQ ID NO: 60081 - DNA, 75 bp, Artificial Sequence
  Synthetic
tcatattttgattaagtaatcatgattttatgataactctttgcagattatcagtttaatctttattaagaaaaa

SEQ ID NO: 60082 - DNA, 75 bp, Artificial Sequence
  Synthetic
aatgctactgttagaggcagtagttttgtaacagacttggaaaaatacaatttagcattccgatatgagtttaca

SEQ ID NO: 60083 - DNA, 75 bp, Artificial Sequence
  Synthetic
atcatgattgtagacaatttactggtagtccttgggtatccaagtttatgaacagagctagagagaatttgctac

SEQ ID NO: 60084 - DNA, 75 bp, Artificial Sequence
  Synthetic
tcagtttaatctttattaagaaaaaatcatgattgtagacaatttactggtagtccttgggtatccaagtttatg

SEQ ID NO: 60085 - DNA, 75 bp, Artificial Sequence
  Synthetic
gctccttttattgaatactgtaatcgttgttacggtgtaagaaatttgtttaattggatgcactacactatacca

SEQ ID NO: 60086 - DNA, 75 bp, Artificial Sequence
  Synthetic
ttccgaggtataactttattatttgctacttcgaatgcctaaaaccagtaatgcaggatgaagattaattgcgga

SEQ ID NO: 60087 - DNA, 75 bp, Artificial Sequence
  Synthetic
cagtgttatatacatgtgagtgattattataaccccccacatggagtctctctcgaaaaccgagaaaatccacca

SEQ ID NO: 60088 - DNA, 75 bp, Artificial Sequence
  Synthetic
gaaggtccaagctcttaccgtggtcatctaggcgggattgagggacttcaacaaaaactctggacaagcatctca

SEQ ID NO: 60089 - DNA, 75 bp, Artificial Sequence
  Synthetic
tcattagcttctaaggtgattatattttagtattaaattttgttaattgcttgctataaagttgaaatgtctaat

SEQ ID NO: 60090 - DNA, 75 bp, Artificial Sequence
  Synthetic
tgtgcacagatttcattagttgaaatcaaaaccggttttaaactgcgatctgcggtaatgggtgacaatcaatgt

SEQ ID NO: 60091 - DNA, 75 bp, Artificial Sequence
  Synthetic
ttgctataaagttgaaatgtctaatgcttaaatgaacatttttgaagctgacatacgactacatcatatcatatg

SEQ ID NO: 60092 - DNA, 75 bp, Artificial Sequence
  Synthetic
aaaacatcgtaattagagcgtccttgaagtctggcattgacagttaccaggctgttctcagtagtctgtccttgg

SEQ ID NO: 60093 - DNA, 75 bp, Artificial Sequence
  Synthetic
ataactgtactctctgtatttcccctcgaaactgagtctagtgagcaagaattaagttctgaagataatgccgct

SEQ ID NO: 60094 - DNA, 75 bp, Artificial Sequence
  Synthetic
gaagtctggcattgacagttaccaggctgttctcagtagtctgtccttggaagctcttggggagacaaaagaggt

SEQ ID NO: 60095 - DNA, 75 bp, Artificial Sequence
  Synthetic
agagtagctgctagcttagcaaaagtcacaagtgcctgcggcatctttttaaaacctgatgaaacttttgttcac

SEQ ID NO: 60096 - DNA, 75 bp, Artificial Sequence
  Synthetic
cccagagagtcccaacaggttggcataaggtcattaacaccagcatagtcggctcgatcaagactgtaagcgagt

SEQ ID NO: 60097 - DNA, 75 bp, Artificial Sequence
  Synthetic
tcaggtttcatttattttggcaaaaaacaatatttgaatggagtacaattacctcaatcactgaaaactgctact

SEQ ID NO: 60098 - DNA, 75 bp, Artificial Sequence
  Synthetic
ggctcgatcaagactgtaagcgagtcgatttcaactaaaaagattatttcttgttgtctaaacaaattcctttgt

SEQ ID NO: 60099 - DNA, 75 bp, Artificial Sequence
  Synthetic
gtgagacatcttcaaggcacaagatggctaaagccacaggccgatacaatctcgtgcccccaaagaaagatatgg

SEQ ID NO: 60100 - DNA, 75 bp, Artificial Sequence
  Synthetic
agaattgcacccttgtcagatgctatctttgatgatcttcaagggacactagctagcataggcacggcttttgaa

SEQ ID NO: 60101 - DNA, 75 bp, Artificial Sequence
  Synthetic
aaaagggagtgatttttagtgatctttgtaatttcttgattactcaaaccctgcaaggttggaaggtttattggg

SEQ ID NO: 60102 - DNA, 75 bp, Artificial Sequence
  Synthetic
agatctatctccgaaactaggcacgtagtcccttgtagagtagcagctgcattccatacctttttttccgtaaga

SEQ ID NO: 60103 - DNA, 75 bp, Artificial Sequence
  Synthetic
caggaattgagtttgatgtaagtcaaaaaggcatggctcttctgacaagactcaaaacaaatgactttgctcctg

SEQ ID NO: 60104 - DNA, 75 bp, Artificial Sequence
  Synthetic
atcttacaatatcatcatcttggcttcaacaagggaacagacctgggtcaattgtcattaagcaagccattagat

SEQ ID NO: 60105 - DNA, 75 bp, Artificial Sequence
  Synthetic
cctgggcgatgacaagaaatcttttcccacatctgttccaaaacccaaattcggttattcaatctcccatctggg

SEQ ID NO: 60106 - DNA, 75 bp, Artificial Sequence
  Synthetic
cccacatctgttccaaaacccaaattcggttattcaatctcccatctgggctttgagggtaattttggcagccgg

SEQ ID NO: 60107 - DNA, 75 bp, Artificial Sequence
  Synthetic
tttggaactataactttggccttggcagtaccacaagtcttgggtggcttatcattcctaaatccagaaaaatgt

SEQ ID NO: 60108 - DNA, 75 bp, Artificial Sequence
  Synthetic
ttttatagaaatctgggtgatcctgttacttcagggctgtttcagctcaagacatatcttcaaatgatccacatg

SEQ ID NO: 60109 - DNA, 75 bp, Artificial Sequence
  Synthetic
attgcaggatcagttgttagaccattcattggttgagcccttgacaggggctctcggtctaatttctgattggct

SEQ ID NO: 60110 - DNA, 75 bp, Artificial Sequence
  Synthetic
gatgatttgtttttacctttgatcgcaaagaacccagggaactgtagcgcaattgactttgtgttaaaccctagt

SEQ ID NO: 60111 - DNA, 75 bp, Artificial Sequence
  Synthetic
cctaactacaacgtcaacacatttcaatcttcgtactagaagcgtaaaggaccagcttagtcttcgtatgttatc

SEQ ID NO: 60112 - DNA, 75 bp, Artificial Sequence
  Synthetic
gggttaaacgtaccggggtcacaggatttgacatccttcctacgtcagatagtgcgccgaacaattactctaagt

SEQ ID NO: 60113 - DNA, 75 bp, Artificial Sequence
  Synthetic
tttgattaggtcaaacatcttgcagttcatcaacaagcttgacgccctgcatgttgtcaattacaatggtttact

SEQ ID NO: 60114 - DNA, 75 bp, Artificial Sequence
  Synthetic
atgttgtcaattacaatggtttactcagtagtattgagatcgggacctctacacacacaatcattataactcgta

SEQ ID NO: 60115 - DNA, 75 bp, Artificial Sequence
  Synthetic
gctaaaaataaattaataaacactttgttccattcttctgctgatttagaagatgaaatggtttgcaaatggttg

SEQ ID NO: 60116 - DNA, 75 bp, Artificial Sequence
  Synthetic
caaacatgggttttctcgtggaagttcaggagcctgacaaatcagctatgaattctaagcgcccaggaccagtca

SEQ ID NO: 60117 - DNA, 75 bp, Artificial Sequence
  Synthetic
ctttcttctacaccagtcatgagtaggtttgccgccgatatattttctcgcactcccagtgggaaacgtttacag

SEQ ID NO: 60118 - DNA, 75 bp, Artificial Sequence
  Synthetic
tcaggagcctgacaaatcagctatgaattctaagcgcccaggaccagtcaagttctcattacttcatgagtctgc

SEQ ID NO: 60119 - DNA, 75 bp, Artificial Sequence
  Synthetic
atcttaggttaccttgaagggactagaacattgttagcctctaaaattataaatcataatactgagacacctatc

SEQ ID NO: 60120 - DNA, 75 bp, Artificial Sequence
  Synthetic
ctagatcgattgaggaaaattacgctgcaaaggtggagcctgtggtttagttatctcgaccactgtgatcaagtt

SEQ ID NO: 60121 - DNA, 75 bp, Artificial Sequence
  Synthetic
ctggctgatgccctaactcagataacctgcactgtggacttagcacagattcttcgcgagtacacctgggcacac

SEQ ID NO: 60122 - DNA, 75 bp, Artificial Sequence
  Synthetic
cttgcctagcattgttgagttagctatctaatctattttcgctaattacattgaacactgttaataggtttgtat

SEQ ID NO: 60123 - DNA, 75 bp, Artificial Sequence
  Synthetic
atactagagggaaggcagctcattggagcaacacttccttgtatactagaacaactaaatgtcatctggctcaaa

SEQ ID NO: 60124 - DNA, 75 bp, Artificial Sequence
  Synthetic
cacgttaaagatttagagtgtatgaattgtgcagatttaaacctgggttttgccttatgcttcataggtggcctt

SEQ ID NO: 60125 - DNA, 75 bp, Artificial Sequence
  Synthetic
ccatatgagcattgccctaaatgtgcaaagtcagcaaaccctaaaggggaaccttttgtttctattgcaattaaa

SEQ ID NO: 60126 - DNA, 75 bp, Artificial Sequence
  Synthetic
tttgaaatggggattatcagcatttcttcaataggaggagttagcaatcaggaattgaagagaaatggacatcgg

SEQ ID NO: 60127 - DNA, 75 bp, Artificial Sequence
  Synthetic
ggaattgaagagaaatggacatcgggatagaacgatgcttaactattgggcagcttccatttttacatgtgtgta

SEQ ID NO: 60128 - DNA, 75 bp, Artificial Sequence
  Synthetic
aaacatgtagtaagtgcttggcctgatcaatcacgacttagttggacaattggagatggcatcccttatatcgga

SEQ ID NO: 60129 - DNA, 75 bp, Artificial Sequence
  Synthetic
taaccaatcttttcctatctttgcttatattggtgtaactttattttaataacatgtcaatgctatactgttaag

SEQ ID NO: 60130 - DNA, 75 bp, Artificial Sequence
  Synthetic
tctcgaacagaggataagattgggcagccagccatcaaaccaaaatgcccttcagcagccttacgtgaagcaatt

SEQ ID NO: 60131 - DNA, 75 bp, Artificial Sequence
  Synthetic
gagttgacatcaagattgacttgggttactcaaggtggagcaaacagcgacttactagttaaacccttcatagaa

SEQ ID NO: 60132 - DNA, 75 bp, Artificial Sequence
  Synthetic
gcacgagtaaatttaagcgtacaggaaattctccaaatgacaccttctcattactccggcaacattgtgcatcga

SEQ ID NO: 60133 - DNA, 75 bp, Artificial Sequence
  Synthetic
tataatgatcaatatagtccacactcatttatggcaaataggatgagtaattctgctactaggttagttgtttcg

SEQ ID NO: 60134 - DNA, 75 bp, Artificial Sequence
  Synthetic
tctctaaatcctcaactaaggcaatgtaaattaccaaaacatatatatcgacttaagttcgacacaatagtatcc

SEQ ID NO: 60135 - DNA, 75 bp, Artificial Sequence
  Synthetic
acaaacactcttggagaattttcaggaggaggtcagtcagcaagagatagtaatattatcttccagaatgtcatt

SEQ ID NO: 60136 - DNA, 75 bp, Artificial Sequence
  Synthetic
aaattcctaagtgatacacctgtagcaacactgccgatagactatttagtaccaattctcctgcgttccctaacg

SEQ ID NO: 60137 - DNA, 75 bp, Artificial Sequence
  Synthetic
aattttgctgttgcactttttgatctacgatttaggaacgtggctacttcttctatacaacatcatcgggctcat

SEQ ID NO: 60138 - DNA, 75 bp, Artificial Sequence
  Synthetic
gggcacggtgataggccgttgaccccgacttgcaatcaattccttgatgaaattattaattacactcttcatgat

SEQ ID NO: 60139 - DNA, 75 bp, Artificial Sequence
  Synthetic
cgacttgcaatcaattccttgatgaaattattaattacactcttcatgatgcagcctttcttgattactatctca

SEQ ID NO: 60140 - DNA, 75 bp, Artificial Sequence
  Synthetic
cttcatttgtcaaagtgttgcacgcgagaggttccagcccaatatttagtttatacatcaacattgccattggac

SEQ ID NO: 60141 - DNA, 75 bp, Artificial Sequence
  Synthetic
cttacacggtatcgggataatgagttgatttacgatgacaatccattaagaggtggtttaaattgcaatctttct

SEQ ID NO: 60142 - DNA, 75 bp, Artificial Sequence
  Synthetic
attatgtccatcaattgttcttctggcatgacctttctattttggctcgacgtgggcgtctgaatcgcgggaaca

SEQ ID NO: 60143 - DNA, 75 bp, Artificial Sequence
  Synthetic
tttgataatccgcttttcaagggccagagacttaacataattgaagaagacttgattagactaccttacttatca

SEQ ID NO: 60144 - DNA, 75 bp, Artificial Sequence
  Synthetic
accgttcaacctggtttgttcatgatgaattcattgatattttaggatatggcgattatattttttggaaaatac

SEQ ID NO: 60145 - DNA, 75 bp, Artificial Sequence
  Synthetic
ggatgggagctagctaaaactgttatccaatctataatttctgacagcaacaattcatcaacggatccaatcagt

SEQ ID NO: 60146 - DNA, 75 bp, Artificial Sequence
  Synthetic
ggcgattatattttttggaaaatacctttatcattattaccggttactatagacggggtcccacacgcagcaact

SEQ ID NO: 60147 - DNA, 75 bp, Artificial Sequence
  Synthetic
agtggggaaacacgatcattcaccactcacttcttgacatatcctaagattggactactatatagttttggtgca

SEQ ID NO: 60148 - DNA, 75 bp, Artificial Sequence
  Synthetic
gactggtatcaaccgactctttttaaagaatccatcctagggcacagccaaatcctatctgtgtcaacagctgaa

SEQ ID NO: 60149 - DNA, 75 bp, Artificial Sequence
  Synthetic
ctcatcagttattatctaggcaacaccattattagaaccaaaaaattgactcttaacaacttcatatattaccta

SEQ ID NO: 60150 - DNA, 75 bp, Artificial Sequence
  Synthetic
gattgcatccattgcaaaattagaagatgtagatgtgtctgattatcctgacccgagtgatattcttaagatata

SEQ ID NO: 60151 - DNA, 75 bp, Artificial Sequence
  Synthetic
gctactcaaatacataatttacctcatcgctcgttgagaatccttaaacctactttgaaacacgctagtgttatc

SEQ ID NO: 60152 - DNA, 75 bp, Artificial Sequence
  Synthetic
caatgctggagactatgtaatatctattctcggctcagagggttataagataataaagtaccttgaaccactttg

SEQ ID NO: 60153 - DNA, 75 bp, Artificial Sequence
  Synthetic
tcgagattaataagtattgactctcacttctcaatttatattggaggaactgctggtgatcgaggactttccgat

SEQ ID NO: 60154 - DNA, 75 bp, Artificial Sequence
  Synthetic
tttggccaaaatccaactttgctctaaattcacagaaagaaaaggtcgtttcctcacacagatgcatttatcagt

SEQ ID NO: 60155 - DNA, 75 bp, Artificial Sequence
  Synthetic
gcggcaagattgtttcttagaactgccattactgtcttccttcaattcgttagaaagtggatagttgaacgcaag

SEQ ID NO: 60156 - DNA, 75 bp, Artificial Sequence
  Synthetic
aataaatgatcttcgggagttgatttctaaccgcaggttaaaggactatcagcgagagaagattagggattttca

SEQ ID NO: 60157 - DNA, 75 bp, Artificial Sequence
  Synthetic
acagctattccactgtgggtcatctaccctctagaaggtcaaagtcctagtccgatcaacagttttctacaccac

SEQ ID NO: 60158 - DNA, 75 bp, Artificial Sequence
  Synthetic
caaaatattattacaattgcaattatctcctcaacagttttgtgaattattctctgttcaaaaacattgggggca

SEQ ID NO: 60159 - DNA, 75 bp, Artificial Sequence
  Synthetic
gtcatcgcattgttgcaacatgagtcctcccacgatcatgtttgtgctgcagaagcccacagtcgagtggagaca

SEQ ID NO: 60160 - DNA, 75 bp, Artificial Sequence
  Synthetic
tccaattttgcatagtgagaaagctatacaaaaagtaaaacggcatgcaaccatccttaaggctctcagacctaa

SEQ ID NO: 60161 - DNA, 75 bp, Artificial Sequence
  Synthetic
tttgataatttagtttatatgtgtaaaagcacagcaagtaacttctttcatgcttcattagcatactggagaagt

SEQ ID NO: 60162 - DNA, 75 bp, Artificial Sequence
  Synthetic
cgatctaaaaatcaagacaaaagagagatgacaaagatattatctttgacgcaaacggaaaagaaaaattcattc

SEQ ID NO: 60163 - DNA, 75 bp, Artificial Sequence
  Synthetic
atttcgacagccaaggaacttggtacagtgtgatctcagacaggaatttaactccaggactcaattcctttataa

SEQ ID NO: 60164 - DNA, 75 bp, Artificial Sequence
  Synthetic
ggctatacagcacatccagaaagcactgctgttcttggttccctccagaccagccttgctccacctccatctgct

SEQ ID NO: 60165 - DNA, 75 bp, Artificial Sequence
  Synthetic
aacgtaatcactttccttcactacccatgattaaggatcttctatgggaattctatcatcttaatcaccctccgt

SEQ ID NO: 60166 - DNA, 75 bp, Artificial Sequence
  Synthetic
gacgaggctacatatgataggaaaaacaaagttttgaaagcttccagacctggcaagtattcccagaatacaacc

SEQ ID NO: 60167 - DNA, 75 bp, Artificial Sequence
  Synthetic
tattctctacaaaggtgattagtgacttaagtattttcatcaaggatagggccactgctgttgaacagacatgtt

SEQ ID NO: 60168 - DNA, 75 bp, Artificial Sequence
  Synthetic
aaagccccacccaaccaaaccagttgtcgcgatgtatctcccaatatcacaggcacagatgggtgcccttctgcc

SEQ ID NO: 60169 - DNA, 75 bp, Artificial Sequence
  Synthetic
gggatgcagtctttgaacccaatgtgctaggttacaatcctccaaacaaattctccactaaaagggtgccggaac

SEQ ID NO: 60170 - DNA, 75 bp, Artificial Sequence
  Synthetic
gctaggttacaatcctccaaacaaattctccactaaaagggtgccggaacaatttctagaacaagaggatttttc

SEQ ID NO: 60171 - DNA, 75 bp, Artificial Sequence
  Synthetic
aatgagggttctaacagcaataacaataatttagtctcgcacagaattgtactgccgttttttacattgtctcat

SEQ ID NO: 60172 - DNA, 75 bp, Artificial Sequence
  Synthetic
aattataacgaaagaccctctatcagaaagtctgaggggacaacagagattgtaaggcttactcggcagctgagg

SEQ ID NO: 60173 - DNA, 75 bp, Artificial Sequence
  Synthetic
gcaataccagacaccacaatatattgccgcttcacgggaatagtttcttcaatgcactataagctcgatgaagtc

SEQ ID NO: 60174 - DNA, 75 bp, Artificial Sequence
  Synthetic
cgaacatttgggaagctaccatatctcacacggaatgtccaaactttatgtgaggccctgttagcagatggactg

SEQ ID NO: 60175 - DNA, 75 bp, Artificial Sequence
  Synthetic
ctttgggaatttgataattttaagtctgctataacacttgccgaaggtgaaggttcgggtgcattactcttatta

SEQ ID NO: 60176 - DNA, 75 bp, Artificial Sequence
  Synthetic
ggagagccttcttcatcaggcatcatggcaccacaccagtgatgattttggagagaatgctaccgttcgagggag

SEQ ID NO: 60177 - DNA, 75 bp, Artificial Sequence
  Synthetic
caaaaatataaagtagaaaccttgttttttaatacactagccacagaacacagcattgaagcagaaattatttct

SEQ ID NO: 60178 - DNA, 75 bp, Artificial Sequence
  Synthetic
gagagaatgctaccgttcgagggagtagttttgtaactgatttagagaagtacaatcttgcatttcgctatgagt

SEQ ID NO: 60179 - DNA, 75 bp, Artificial Sequence
  Synthetic
ggaataactacaccaagaatgcttctccctattatgtctaggttccatggtggacaaataaaagtcactttaaac

SEQ ID NO: 60180 - DNA, 75 bp, Artificial Sequence
  Synthetic
tcactgcaccatttattgagtactgcaaccattgctatggtgtgcgtaatgtctttaattggatgcattatttaa

SEQ ID NO: 60181 - DNA, 75 bp, Artificial Sequence
  Synthetic
aattctgcaagccagattaccgatattactaatccaagttggttggcagaccaaaaatctaggatccctaagcaa

SEQ ID NO: 60182 - DNA, 75 bp, Artificial Sequence
  Synthetic
tcccgcagtgttacatgcatgtaagtgattattataatccgcctcacaatgttaatcttagcaatcgagaatatc

SEQ ID NO: 60183 - DNA, 75 bp, Artificial Sequence
  Synthetic
gtagagattataaccatggatgctgaaacaacagaaaacattaatcggtcaaaattgtacgaagcagtccaacag

SEQ ID NO: 60184 - DNA, 75 bp, Artificial Sequence
  Synthetic
ctgattgtctcacatattgatccgaatgcactcaaagttgtggttcttaaagttttcttaagtgacattgatgga

SEQ ID NO: 60185 - DNA, 75 bp, Artificial Sequence
  Synthetic
tatcctgtgcacaaatctccttggtggaaattaaaactggttttaagttacgatcagcggtcatgggagacaatc

SEQ ID NO: 60186 - DNA, 75 bp, Artificial Sequence
  Synthetic
ggaaattaaaactggttttaagttacgatcagcggtcatgggagacaatcagtgtataactgtattatctgtttt

SEQ ID NO: 60187 - DNA, 75 bp, Artificial Sequence
  Synthetic
atcctatggctgaatgataaccttacccctttgtttgggctgggttacttgatcaagccgatcacctctagccca

SEQ ID NO: 60188 - DNA, 75 bp, Artificial Sequence
  Synthetic
tccacttgaaacagatcctgaagagcaggagcaaagcgccgaagacaatgctgcaagagtagcagcaagtcttgc

SEQ ID NO: 60189 - DNA, 75 bp, Artificial Sequence
  Synthetic
aaatctagtgagtggtacctatgtctctcaaaccttctttcaacttcaagacgattacctcatcagagtcatact

SEQ ID NO: 60190 - DNA, 75 bp, Artificial Sequence
  Synthetic
aaaagtaaccagtgcatgtgggatctttcttaaaccagaagagacatttgtacactcaggtttcatttatttcgg

SEQ ID NO: 60191 - DNA, 75 bp, Artificial Sequence
  Synthetic
acttgcatgcatgttattcaaacagcactccagctacaaattcagaggagctcatattggcttagccaccttgtc

SEQ ID NO: 60192 - DNA, 75 bp, Artificial Sequence
  Synthetic
aaaaaaacaatatctcaatggtgtacaattaccgcaatcactcaaaacagcagcaagaatggcaccactctctga

SEQ ID NO: 60193 - DNA, 75 bp, Artificial Sequence
  Synthetic
cagtatgccaatcataatttgcatttagattatattaatctcggtttcccttcattggagagggttttataccat

SEQ ID NO: 60194 - DNA, 75 bp, Artificial Sequence
  Synthetic
tgctatattcgatgatctacaaggaacacttgccagtattggaactgccttcgaacgtgctatatcggaaacgcg

SEQ ID NO: 60195 - DNA, 75 bp, Artificial Sequence
  Synthetic
agatacaatttagtcgattctcagaaaggccctttgacttccattgtccaacatctagcgcacctgcagaccgag

SEQ ID NO: 60196 - DNA, 75 bp, Artificial Sequence
  Synthetic
acatatcctcccatgtcgtattgtagcagctttccatacgtatttcgccgttcggattttacaatatcaccatct

SEQ ID NO: 60197 - DNA, 75 bp, Artificial Sequence
  Synthetic
attagggagttggttaatgactataatcaacaaagacaaagtcgaacccaaacatatcatttcattaaaacaata

SEQ ID NO: 60198 - DNA, 75 bp, Artificial Sequence
  Synthetic
tggatttaataaaggcatcgatttaggacagttgtcacttagtaaaccattagactatgggactattactctaac

SEQ ID NO: 60199 - DNA, 75 bp, Artificial Sequence
  Synthetic
aaaggtcgtattacaaaattggtaaatgattaccttaagttctttctaataatacaagccttaaagcacaattgc

SEQ ID NO: 60200 - DNA, 75 bp, Artificial Sequence
  Synthetic
attggcggttccacaagtccttgggggattgtcttttctaaatccagaaaagtgtttttatcggaacttcggaga

SEQ ID NO: 60201 - DNA, 75 bp, Artificial Sequence
  Synthetic
acatggcaagaggaactaagagctcttccagatctaattagtgtctgcactcgattctatcatactcgaaactgt

SEQ ID NO: 60202 - DNA, 75 bp, Artificial Sequence
  Synthetic
tcatgtgaaaaccggttcctagtacagactttatacttatcacgcatgcaggattcggaaatcaaactaatagat

SEQ ID NO: 60203 - DNA, 75 bp, Artificial Sequence
  Synthetic
acatgaaagacctattttgtccattaatatcgaaaaatccaggaaattgtagtgccattgattttgtcttaaatc

SEQ ID NO: 60204 - DNA, 75 bp, Artificial Sequence
  Synthetic
agattgaccggccttcttagtctatgtccaaatggtttttttcggtaaggactcttgacgtacaaactccacata

SEQ ID NO: 60205 - DNA, 75 bp, Artificial Sequence
  Synthetic
catccggattaaatgttccaggatcacaagacttgacatcctttttgcgacagatcgttaggcgtagtattacac

SEQ ID NO: 60206 - DNA, 75 bp, Artificial Sequence
  Synthetic
gttatacaatggtaccaggacactatatgtaaattgaccctaagaaagagtaattcgacacacagagttctcaag

SEQ ID NO: 60207 - DNA, 75 bp, Artificial Sequence
  Synthetic
taactgcaagaaataagttaattaacactctcttccatgcctctgctgatttggaagatgagatggtttgtaaat

SEQ ID NO: 60208 - DNA, 75 bp, Artificial Sequence
  Synthetic
tgaaacccctcatctcagattatctgtggttgcaattctaatatccgattgttaccccgtgagtataactccaga

SEQ ID NO: 60209 - DNA, 75 bp, Artificial Sequence
  Synthetic
ggctcctttcatcaaaccctgtcatgagtcgctttgcagcggatattttttccaggacacctagtggtaaacgtc

SEQ ID NO: 60210 - DNA, 75 bp, Artificial Sequence
  Synthetic
ttaatataagaaaataccttttgtcctgcaaatttatcttaaattcaagtacatacgctccaaatcgtataaaat

SEQ ID NO: 60211 - DNA, 75 bp, Artificial Sequence
  Synthetic
tccaggacacctagtggtaaacgtctccaaatattaggttatcttgaagggacccggactctattggcctccaaa

SEQ ID NO: 60212 - DNA, 75 bp, Artificial Sequence
  Synthetic
attaagaaaaagttaatctgcttgctttaattataactttaatattcgacaaatagttaacggtctcatcactca

SEQ ID NO: 60213 - DNA, 75 bp, Artificial Sequence
  Synthetic
atcataaacaacaacagtgagacacctgtactcgataagctgaggaagatcaccctacaaagatggaatctgtgg

SEQ ID NO: 60214 - DNA, 75 bp, Artificial Sequence
  Synthetic
aaaatttcattaacaaaagaagtactctgagtatattcacatatcatatgtgattaacatataagcaacgcatga

SEQ ID NO: 60215 - DNA, 75 bp, Artificial Sequence
  Synthetic
ttcagttatttggaccattgtgaccaattactagcagatgctctacaaaaaattagttgcacggtggatttggcc

SEQ ID NO: 60216 - DNA, 75 bp, Artificial Sequence
  Synthetic
tgcgccttcctcttacttattgtgttgtcacgcagtcgttgtactacctcgaaaattccaaacaataaatcgtgt

SEQ ID NO: 60217 - DNA, 75 bp, Artificial Sequence
  Synthetic
cagattttgcgtgagtatacatggtcacacatcttagagggtagaccattgatcggagcgacattaccatgtatg

SEQ ID NO: 60218 - DNA, 75 bp, Artificial Sequence
  Synthetic
cacacatcttagagggtagaccattgatcggagcgacattaccatgtatggtggagcaattcaaagttaagtggc

SEQ ID NO: 60219 - DNA, 75 bp, Artificial Sequence
  Synthetic
ctatcccgcatttagtgtctttaatttaagatctcaaatccaaaaaactgggtttatgttgatgtaaatcaataa

SEQ ID NO: 60220 - DNA, 75 bp, Artificial Sequence
  Synthetic
taggacaatatgaaccttgtccagaatgtctcaacaaaaaaggctcaaatgcttatgtctcagttgcagtcaaag

SEQ ID NO: 60221 - DNA, 75 bp, Artificial Sequence
  Synthetic
taccgaaattgcttgatattaaaataaagcttaaaggatttttccttaaacggtgatgttaggtatataggaaag

SEQ ID NO: 60222 - DNA, 75 bp, Artificial Sequence
  Synthetic
atcaagtggtcagtgcttggcctaatacttctcgaataagttggacaatagggagtggtgtcccctatatagggt

SEQ ID NO: 60223 - DNA, 75 bp, Artificial Sequence
  Synthetic
ctcgatcacgatgtcccttactcagaaaaagaaaaacggaagccctattggccatttaatcgtacacaaaaatat

SEQ ID NO: 60224 - DNA, 75 bp, Artificial Sequence
  Synthetic
caagaaccgaggataaaatcggacagcctgctatcaagccgcgatgcccttcatctgccctcaaggaggctatag

SEQ ID NO: 60225 - DNA, 75 bp, Artificial Sequence
  Synthetic
acggaagccctattggccatttaatcgtacacaaaaatatctttaccaaattgttttctcttttttgtgtgtcca

SEQ ID NO: 60226 - DNA, 75 bp, Artificial Sequence
  Synthetic
agtcctgcaaatgacaccatcacattattcaggaaatattgtccatcgatataatgaccaatatagcccgcactc

SEQ ID NO: 60227 - DNA, 75 bp, Artificial Sequence
  Synthetic
tggatatataaaaagaaagaaaagttttttatattttttgtgtgtgaataattatgaggaagattaattattttt

SEQ ID NO: 60228 - DNA, 75 bp, Artificial Sequence
  Synthetic
tttaaatttaaattaatattaatattgagattgattttattatttattaattggagataatttaattagttaatt

SEQ ID NO: 60229 - DNA, 75 bp, Artificial Sequence
  Synthetic
tggagggcaggctgccagggacagcaatataattttccagaatgttataaatttagcagttgccctttatgatat

SEQ ID NO: 60230 - DNA, 75 bp, Artificial Sequence
  Synthetic
aatataattttccagaatgttataaatttagcagttgccctttatgatattagattccggaatacgaacacctct

SEQ ID NO: 60231 - DNA, 75 bp, Artificial Sequence
  Synthetic
ttttatttgggggtatttttaaagtgttgtaaaggtatgtgggttgtattgttttgtttttttttaatttggttt

SEQ ID NO: 60232 - DNA, 75 bp, Artificial Sequence
  Synthetic
tttttataattttaatttgtttgataagtgtgattatttgagtaatagattaattttgttttggtaattagtatt

SEQ ID NO: 60233 - DNA, 75 bp, Artificial Sequence
  Synthetic
ttttagtaaaattaatattattttaagttttaagagaaggtgagaagagggttttgaggtatttttttagtttat

SEQ ID NO: 60234 - DNA, 75 bp, Artificial Sequence
  Synthetic
aaaatttagttaattttagttgagtggattgattatttttattatatgttaattattaagggtttatttgagagt

SEQ ID NO: 60235 - DNA, 75 bp, Artificial Sequence
  Synthetic
ggaggattgaactgcaatttaacaatggatagtcctttagtgaagggtcctaggcttaacatgattgaagatgat

SEQ ID NO: 60236 - DNA, 75 bp, Artificial Sequence
  Synthetic
taggcttaacatgattgaagatgatcttctccgctttccacacctttctggatgggagttagcgaaaacggtggt

SEQ ID NO: 60237 - DNA, 75 bp, Artificial Sequence
  Synthetic
ttataatatggataaatgggtgagaggtttatgggttttgggaggataatttgaagttgattttgattattataa

SEQ ID NO: 60238 - DNA, 75 bp, Artificial Sequence
  Synthetic
gatgggagttagcgaaaacggtggtgcaatccatcatctcagacaatagcaactcatcaacagatccaatcagta

SEQ ID NO: 60239 - DNA, 75 bp, Artificial Sequence
  Synthetic
aatattaatagttgggtttttggtttaataagggattgtgtgataaagagttattttggtatatgttgtgagtga

SEQ ID NO: 60240 - DNA, 75 bp, Artificial Sequence
  Synthetic
gtggagaaacacgctctttcacaactcattttctcacttatcctcagattggtctcctttacagtttcggggcag

SEQ ID NO: 60241 - DNA, 75 bp, Artificial Sequence
  Synthetic
ttttgagggtatttgttaatatattatttaggtttttgaagtaggtgtagatttttaagataatgttgatagttt

SEQ ID NO: 60242 - DNA, 75 bp, Artificial Sequence
  Synthetic
tattatgcttttatctaggcaatactatcctatggactaaaaaacttgattatgaacagtttctatattatttgc

SEQ ID NO: 60243 - DNA, 75 bp, Artificial Sequence
  Synthetic
ttttttatttttatgtttatattatgtttattaaggagattataggtttttttttaaaagtgatgtagtttaata

SEQ ID NO: 60244 - DNA, 75 bp, Artificial Sequence
  Synthetic
tttagagggttatggttttaggtttgaggtttgagaaaaggagaatgtgtattgtttggatgaattgttgtttaa

SEQ ID NO: 60245 - DNA, 75 bp, Artificial Sequence
  Synthetic
cccgactaatggaaattgactccaacttctcaatttatattggcgggacatctggagatcgagggttgtctgatg

SEQ ID NO: 60246 - DNA, 75 bp, Artificial Sequence
  Synthetic
tgttattggtggaaaaaattttaggagaatattggttgtaatgtttgaagaggagataatagaagttaatgttgg

SEQ ID NO: 60247 - DNA, 75 bp, Artificial Sequence
  Synthetic
ctgctcgattgtttcttcggacagcaatcgcgagttttttacaatttcttaagagctggatcatcgatcgccaaa

SEQ ID NO: 60248 - DNA, 75 bp, Artificial Sequence
  Synthetic
ttagtttttattttttgttagtttgtttttatttaaatttgttgttggggagaaagtgtgtttggaaaaagtata

SEQ ID NO: 60249 - DNA, 75 bp, Artificial Sequence
  Synthetic
aatcgcgagttttttacaatttcttaagagctggatcatcgatcgccaaaaaacaatccctttatggatagtata

SEQ ID NO: 60250 - DNA, 75 bp, Artificial Sequence
  Synthetic
aaggtagatttaggtttatgtagaataagggtttatttaatatttaattttttggtaattagttggatatatgat

SEQ ID NO: 60251 - DNA, 75 bp, Artificial Sequence
  Synthetic
ttttaggtctgctcaaacaaggccccaaaagtattccaaaggaggtcagcattcaaaatgatggacatttggatt

SEQ ID NO: 60252 - DNA, 75 bp, Artificial Sequence
  Synthetic
ggtgattttttgtttgatgagaataaattttttaattaagtttttattaatatattaggggatgtatatggttgt

SEQ ID NO: 60253 - DNA, 75 bp, Artificial Sequence
  Synthetic
aggttatgatgtgaatgatatagtaatatttaattttgttgtttaagtaaggttttttggttttttgattgtaaa

SEQ ID NO: 60254 - DNA, 75 bp, Artificial Sequence
  Synthetic
ttccatgcatccttagcttactggagaagtaggaaatctcggaaaactcaagaccataatgatttctcaagaggg

SEQ ID NO: 60255 - DNA, 75 bp, Artificial Sequence
  Synthetic
gattgttttggattatattttataaaaaatagattttggagtatgattttatttattggttaggatagtaaaagt

SEQ ID NO: 60256 - DNA, 75 bp, Artificial Sequence
  Synthetic
agaccataatgatttctcaagagggaatggaacacttacagaacccgtgcgtaagttctcaagcaatcaacagtc

SEQ ID NO: 60257 - DNA, 75 bp, Artificial Sequence
  Synthetic
taagaatgaggttagtttatttaaggtagtttttggtttatttgttaagtatggagaatatgttttatttgtatg

SEQ ID NO: 60258 - DNA, 75 bp, Artificial Sequence
  Synthetic
tttttttaatttttttggagttaataatttggaatatgggttttatttataatttttagttattgttttgggtgt

SEQ ID NO: 60259 - DNA, 75 bp, Artificial Sequence
  Synthetic
agtaatcatcgtaagaaagggaagttccacaagtggaatccctgcaaagtgttaatggagaatcaaaggggaact

SEQ ID NO: 60260 - DNA, 75 bp, Artificial Sequence
  Synthetic
tgtaattgtttatgggagtatgttggttggtgttaatgtaggggagtaatattagtaattgtgtgaggttgttat

SEQ ID NO: 60261 - DNA, 75 bp, Artificial Sequence
  Synthetic
gttctaacagagggtgactactttcaagacaatactccaccaacagatgttgtatcaagtcctcatcgactcatt

SEQ ID NO: 60262 - DNA, 75 bp, Artificial Sequence
  Synthetic
tgaagttgaaaagtaattttaataatatgttgaaatatgtgagttggataattttgggtttgatgaataggaaaa

SEQ ID NO: 60263 - DNA, 75 bp, Artificial Sequence
  Synthetic
gaagatttttatgagtttttattagaagaagaatgagattagtttttagtaaattaatgtaatggtaattttgag

SEQ ID NO: 60264 - DNA, 75 bp, Artificial Sequence
  Synthetic
ctatgttggacaccactatatattgtagattcacagggattgtctcatccatgcattacaaattggacgaagttc

SEQ ID NO: 60265 - DNA, 75 bp, Artificial Sequence
  Synthetic
tagattcacagggattgtctcatccatgcattacaaattggacgaagttcttctagaatacaatagtttcgattc

SEQ ID NO: 60266 - DNA, 75 bp, Artificial Sequence
  Synthetic
gaaagagtggttggttaaattgattgaagttattatgattgtattaaagattaaggttggagattgttattttga

SEQ ID NO: 60267 - DNA, 75 bp, Artificial Sequence
  Synthetic
tgataatgatattttattttttgggttgatttatgatgaaatttattttaatttttttgatgataattttgatga

SEQ ID NO: 60268 - DNA, 75 bp, Artificial Sequence
  Synthetic
tttgaacacattggcaacagaacacagtatagagtcagaggttgtatcaggtttttctactccgagaatgttgtt

SEQ ID NO: 60269 - DNA, 75 bp, Artificial Sequence
  Synthetic
tttatgtgatataattattttaggtggtgttgttgatttgtatgatgatgagagtaataattattttgattatga

SEQ ID NO: 60270 - DNA, 75 bp, Artificial Sequence
  Synthetic
ggatttggttgaaggtattataggagattttgatttttttaatttggatgatgatgatgatgatagttaattagg

SEQ ID NO: 60271 - DNA, 75 bp, Artificial Sequence
  Synthetic
attcggcaagtcagataactgacataactagctcaaagtggttaagtaatcaaaaatataatctaccttgtcaag

SEQ ID NO: 60272 - DNA, 75 bp, Artificial Sequence
  Synthetic
attattagatagggggtagagtaaggaaagagtggtttggatatatggtttttaagatttgattttggatggagt

SEQ ID NO: 60273 - DNA, 75 bp, Artificial Sequence
  Synthetic
caaaaatataatctaccttgtcaagttgaaatcattacgatggatgctgaaacaacagagaacttaaacaggtcc

SEQ ID NO: 60274 - DNA, 75 bp, Artificial Sequence
  Synthetic
gaaaaaggtgttggagttgattttaggtttttattaattaggtaatttttatattattaagttgggtttaaatat

SEQ ID NO: 60275 - DNA, 75 bp, Artificial Sequence
  Synthetic
caactctaccgagcagtatataacttaatacttgatcacattgatccgcagtatctcaaggtggtggtactcaaa

SEQ ID NO: 60276 - DNA, 75 bp, Artificial Sequence
  Synthetic
taattaattataaggtaatatgttatttattttttagagtatgatttttatataggaagaattagagtttgatga

SEQ ID NO: 60277 - DNA, 75 bp, Artificial Sequence
  Synthetic
gtattcctgagtgatatagaaggaatattatggattaatgattacttggctccattattcggggctggttacttg

SEQ ID NO: 60278 - DNA, 75 bp, Artificial Sequence
  Synthetic
ttagaaagatgatgatgatgagagttttatattttttgattttgaaggtgatgaagatgttgagagtgtattagg

SEQ ID NO: 60279 - DNA, 75 bp, Artificial Sequence
  Synthetic
attaaaccgattacatcaagtgcccggtcaagtgaatggtacctttgcttatcaaatttgatatctactaacagg

SEQ ID NO: 60280 - DNA, 75 bp, Artificial Sequence
  Synthetic
ggagaataatttaattgtagttttattagtattagtttataaagatattggagtagatattaattagtaaaatgg

SEQ ID NO: 60281 - DNA, 75 bp, Artificial Sequence
  Synthetic
attaagtaatgttgtagatggttaaggttttgaaagtgaagtttttttaattaattttgaaaagggatttgtatt

SEQ ID NO: 60282 - DNA, 75 bp, Artificial Sequence
  Synthetic
ggaagaaatatattattattttttaaaaatatagggtttatttgaggtaattaattattattatttaatgagtga

SEQ ID NO: 60283 - DNA, 75 bp, Artificial Sequence
  Synthetic
tgagtttattgtttttagtattgaaagtggtaaggaatatatttttttagatttttttgaagaagtttatttgtt

SEQ ID NO: 60284 - DNA, 75 bp, Artificial Sequence
  Synthetic
catttaactaacctccaggcagagatacgagacttagtattagattataccctgatgagagagagtcgcactcaa

SEQ ID NO: 60285 - DNA, 75 bp, Artificial Sequence
  Synthetic
ttggttgagtgagaaggaggttttagagaaagaaaattgttatttggttattgatggttagtaatttttttggtt

SEQ ID NO: 60286 - DNA, 75 bp, Artificial Sequence
  Synthetic
acgtaccattttattaagactgcaaaaggcagaatcacaaagttagtcaatgactttctgaagttttctttaatt

SEQ ID NO: 60287 - DNA, 75 bp, Artificial Sequence
  Synthetic
agtaatgagtttataggataagttttttgttgttttttaatatgattgaggatttatgattagtagattttgttt

SEQ ID NO: 60288 - DNA, 75 bp, Artificial Sequence
  Synthetic
attttgagtttgattataattgttttgataatttaagtatgagtaattaatttgaaatataaattttattttagt

SEQ ID NO: 60289 - DNA, 75 bp, Artificial Sequence
  Synthetic
aatgtcaggaaaaattctttgtccagacgctttatttacagcgcctacgcgatgcagaaatcaagctaattgaac

SEQ ID NO: 60290 - DNA, 75 bp, Artificial Sequence
  Synthetic
tatgaggaaattaaataaataatttgtaagttgtaggattatgaagagttgtttgtgttaatttattatgggtta

SEQ ID NO: 60291 - DNA, 75 bp, Artificial Sequence
  Synthetic
gccttaccgggttaatgcgattttatccagaagggttaatatgttccaaccatacataggtactagatcatcata

SEQ ID NO: 60292 - DNA, 75 bp, Artificial Sequence
  Synthetic
atatttatattgtaagaataattatttagtaattttgattagtttatgatatgtattaataggaaaatattatag

SEQ ID NO: 60293 - DNA, 75 bp, Artificial Sequence
  Synthetic
gtatgaggaataaaataatgataatccctgacgacagttttagttccgattctaagtatatcggaagagagtatg

SEQ ID NO: 60294 - DNA, 75 bp, Artificial Sequence
  Synthetic
tattaaaatataaagtattttttgatgagtttaggaggataatattttgatgaattttatagaatttaggattaa

SEQ ID NO: 60295 - DNA, 75 bp, Artificial Sequence
  Synthetic
gaaaaaatttatgatgaagattaaaatttttattattttttaaaaagagagttattttttatttgaatgttttta

SEQ ID NO: 60296 - DNA, 75 bp, Artificial Sequence
  Synthetic
acatcataactttatgacgattttgcatttctaatcctagtatttattagaatgtactatcagagaaatgacccc

SEQ ID NO: 60297 - DNA, 75 bp, Artificial Sequence
  Synthetic
ttaatgtttaagagttattattttgtatttttttagtttagatattgtttagtatataagttatgtagtaggata

SEQ ID NO: 60298 - DNA, 75 bp, Artificial Sequence
  Synthetic
catttctaatcctagtatttattagaatgtactatcagagaaatgaccccagttcctatctttaaataataattg

SEQ ID NO: 60299 - DNA, 75 bp, Artificial Sequence
  Synthetic
ggatttatagatattatggatttgaagtgtttggttggttttttgagtaattaatgattggtaaaatattgttaa

SEQ ID NO: 60300 - DNA, 75 bp, Artificial Sequence
  Synthetic
tgtgtattaagttgttagtttattaagtttatgagttggttacacagtgagtattagtaattgaggattaggtag

SEQ ID NO: 60301 - DNA, 75 bp, Artificial Sequence
  Synthetic
tagaggtgtttgttgatgttgaaaataaattaagttttgttttgataattattattagtaagaattttaagataa

SEQ ID NO: 60302 - DNA, 75 bp, Artificial Sequence
  Synthetic
tatgtaaaagtgataagtaagtttaaatagatgatgttagtagtttattgatagaagaagttaaggttgttataa

SEQ ID NO: 60303 - DNA, 75 bp, Artificial Sequence
  Synthetic
aaaagtataaaataaatttaattaaacttcaaagtgcttaaatgataaagatcttgggaactcgatataacctca

SEQ ID NO: 60304 - DNA, 75 bp, Artificial Sequence
  Synthetic
atttggtgatattagttgtgtgttggtaaattaatgttattgaattattagaaggttgagtaataatttttgagg

SEQ ID NO: 60305 - DNA, 75 bp, Artificial Sequence
  Synthetic
ttagtttaaaatttgtttaagatatggtaaagattatattatttttgaattgtagttgtgttgaaatggttgtaa

SEQ ID NO: 60306 - DNA, 75 bp, Artificial Sequence
  Synthetic
tagttaagatcaaatgcaaacattataagaatgttaagcgcacacaaaaacattataaaaaaccaattttttcct

SEQ ID NO: 60307 - DNA, 75 bp, Artificial Sequence
  Synthetic
aatgcaaacattataagaatgttaagcgcacacaaaaacattataaaaaaccaattttttcctttttgtgtgtcc

SEQ ID NO: 60308 - DNA, 75 bp, Artificial Sequence
  Synthetic
aatatgatttattggtgatgattattgggtgagtaattgttattgttgtagtaatagaagtatattggaatgaat

SEQ ID NO: 60309 - DNA, 75 bp, Artificial Sequence
  Synthetic
atggataagtatttttaggtttattattgtatgaggatgatgttattaaggttaaattgaaagatttgaatggga

SEQ ID NO: 60310 - DNA, 75 bp, Artificial Sequence
  Synthetic
aggttttagaaagtgttaaataggtttatataaatttagatagtataagtgtttttaatgaggaaaattttgggt

SEQ ID NO: 60311 - DNA, 75 bp, Artificial Sequence
  Synthetic
cgattgagccagttttatctattaccaattaccgtcaacatggtatgtctagtggtcttgggactcttcttcatc

SEQ ID NO: 60312 - DNA, 75 bp, Artificial Sequence
  Synthetic
gattttatattttagtaaaagattttaaggaaattatttatgattattttttaggatttgggatagttttttatt

SEQ ID NO: 60313 - DNA, 75 bp, Artificial Sequence
  Synthetic
agtggtcttgggactcttcttcatctggtgtttcctagagctctgaatcgattttgcgagaagttcatccgaatg

SEQ ID NO: 60314 - DNA, 75 bp, Artificial Sequence
  Synthetic
acccagtgtctgaaaatacaaaaggttcccctttccgtcaagtttaaggggttgttttgattgtgtgtagatttt

SEQ ID NO: 60315 - DNA, 75 bp, Artificial Sequence
  Synthetic
agttggtgtaggttatttgtaaaattggtaaggataataatattttagatataatttatgtagaattttaagtaa

SEQ ID NO: 60316 - DNA, 75 bp, Artificial Sequence
  Synthetic
gtttggttgagggagattttttttagtgtgtattaatttagataataaaatggatttttgttttttaagatgttt

SEQ ID NO: 60317 - DNA, 75 bp, Artificial Sequence
  Synthetic
cgtgtcatcattgattgggaagatcaaggaaacaatttgttccaataatatcatacatcttgactaagtcgaaca

SEQ ID NO: 60318 - DNA, 75 bp, Artificial Sequence
  Synthetic
tttttttaattgtgtatattaagttttgaggagatatatttaaagtttgttagaaaagtttttggttggttttat

SEQ ID NO: 60319 - DNA, 75 bp, Artificial Sequence
  Synthetic
tcatacatcttgactaagtcgaacaaggggaattcgatatggatcgtgggaccagaagaatctgggtgtcgcaga

SEQ ID NO: 60320 - DNA, 75 bp, Artificial Sequence
  Synthetic
tgttattaaagattgatagaggttgggtttgtattttttaattttaagatgggaaggtttttgggttaaaaatat

SEQ ID NO: 60321 - DNA, 75 bp, Artificial Sequence
  Synthetic
gatatagaagtaaggtaagtttattttgtgatggttaaatgatatttatgattgtttaaaattaagttagattaa

SEQ ID NO: 60322 - DNA, 75 bp, Artificial Sequence
  Synthetic
tagtttattgtgttataagtttataagttagttttaaattttttttttattttaattaattgataatgttgttaa

SEQ ID NO: 60323 - DNA, 75 bp, Artificial Sequence
  Synthetic
tagggaaatttttttgtattgtaataagattttattaatatattttttttgtttagtattatgtagaaatttttg

SEQ ID NO: 60324 - DNA, 75 bp, Artificial Sequence
  Synthetic
agtaaattaaaattgatgaagattaagaaaaagagggatttttttaggaaaaatttttttttttatttttatttt

SEQ ID NO: 60325 - DNA, 75 bp, Artificial Sequence
  Synthetic
atttaaataaatttaggatttaggaaaaatgagaagggttattgtgttgattgtattatttgtttatgttgatat

SEQ ID NO: 60326 - DNA, 75 bp, Artificial Sequence
  Synthetic
tggttattttatgagtatgttttttattaagttaagtagggttgtgagtggaatttaatagaaataagaggtttt

SEQ ID NO: 60327 - DNA, 75 bp, Artificial Sequence
  Synthetic
ttttggaatggatatattattaaattttatgagatttgttgttgatgataatattgattatataagttatatttt

SEQ ID NO: 60328 - DNA, 75 bp, Artificial Sequence
  Synthetic
gaatggagtggttttagtatttattttggaggtaattgttaatgtgattttggggtttaaagtttttatgaaata

SEQ ID NO: 60329 - DNA, 75 bp, Artificial Sequence
  Synthetic
aatttttatttggttgttatttggaattgttgattaaaaaatgtatagttttgatttaataatagtagtaattat

SEQ ID NO: 60330 - DNA, 75 bp, Artificial Sequence
  Synthetic
gtttgtattttatatgattatttattttggaaaggttaataatttttttgttagagtgaattgatttggttaggg

SEQ ID NO: 60331 - DNA, 75 bp, Artificial Sequence
  Synthetic
aatattggattatttatttagattgtttaggatggggaattaggtttttttttaagagtttgtgttattattagt

SEQ ID NO: 60332 - DNA, 75 bp, Artificial Sequence
  Synthetic
acccttgcaggagttaatgttggtgagcagtatcagcagcttagagaggctgcaactgaagctgagaagcaactc

SEQ ID NO: 60333 - DNA, 75 bp, Artificial Sequence
  Synthetic
ttaattgttgtaatattttatttttgatttgattgtatttaaattagtgatatagtttttttttgttgtaatatg

SEQ ID NO: 60334 - DNA, 75 bp, Artificial Sequence
  Synthetic
gatagatgagattttgagtaattttttaggagttttttgttttgggtttttattttatttaaagttgagatttgt

SEQ ID NO: 60335 - DNA, 75 bp, Artificial Sequence
  Synthetic
catcagaagaaaaatgaaattagtttccagcagaccaatgcaatggtaacccttaggaaagagcgactggctaaa

SEQ ID NO: 60336 - DNA, 75 bp, Artificial Sequence
  Synthetic
tccagcagaccaatgcaatggtaacccttaggaaagagcgactggctaaattaacagaagctataacgctggcct

SEQ ID NO: 60337 - DNA, 75 bp, Artificial Sequence
  Synthetic
tttatttttaggtaagatgggaaagaaagggtatgtttttgatttgattgttttagataaaatttagataattgt

SEQ ID NO: 60338 - DNA, 75 bp, Artificial Sequence
  Synthetic
caagacctaacctcgggtctagacaagatgacgacaatgaaataccgttccttgggcctataaacaacaacccag

SEQ ID NO: 60339 - DNA, 75 bp, Artificial Sequence
  Synthetic
gaatttgatgtaagattttaaaattgtgttaattgatttagttaagagtattattgggattgaggttttagaatt

SEQ ID NO: 60340 - DNA, 75 bp, Artificial Sequence
  Synthetic
accgagatcatctggaggatgatcctagaaactccagagacaccatcattcctagtggtgcaattgaccctgagg

SEQ ID NO: 60341 - DNA, 75 bp, Artificial Sequence
  Synthetic
gttggtttataagtttattgggaagaaaatgagttagaagaatggatagtttataatttttgttttatttttaaa

SEQ ID NO: 60342 - DNA, 75 bp, Artificial Sequence
  Synthetic
atatattgggttagatttaattttatttggagatttgattatggttataatattagattatgatgattgttattt

SEQ ID NO: 60343 - DNA, 75 bp, Artificial Sequence
  Synthetic
agcttttgagccacaggacagctcaccgcaatcccgaagggaaatagaaagagaaagattaattcatccaccccc

SEQ ID NO: 60344 - DNA, 75 bp, Artificial Sequence
  Synthetic
atttgttagttgtttttattttagtgaaaagtgatttttataaagtgagagaaatatttttagtaaagaaattaa

SEQ ID NO: 60345 - DNA, 75 bp, Artificial Sequence
  Synthetic
gagcaacaacaaggacgacaatcgggtctcagccaacaatcaacaatcagcaagttttgaggaacaagaagatca

SEQ ID NO: 60346 - DNA, 75 bp, Artificial Sequence
  Synthetic
attttatttatagtaatttaattgatttttaggaagttagtagtttatatattatgggataatttaatttttttg

SEQ ID NO: 60347 - DNA, 75 bp, Artificial Sequence
  Synthetic
ttaaaatgtattaattgggttaaggaatttttattgattaagtttgaatttaagatagaattagtttaaagggtt

SEQ ID NO: 60348 - DNA, 75 bp, Artificial Sequence
  Synthetic
caccagtgtacgaagaggacacccttatggatcacggcgatgatgatccctcaagcttaccttcgctggaatctg

SEQ ID NO: 60349 - DNA, 75 bp, Artificial Sequence
  Synthetic
tttttagagttttttataagtttagttaattaattaatatgtataagtgatttatattttgtttaattagtgttt

SEQ ID NO: 60350 - DNA, 75 bp, Artificial Sequence
  Synthetic
gcccctcctgctcctgtataccgcagtgcagaagcccacgagcctcctcataactcctcgaacgagccagctgaa

SEQ ID NO: 60351 - DNA, 75 bp, Artificial Sequence
  Synthetic
gatgtttatttttttaagttttttttttagtaaattgatttagttgtattaagagatttttttagtttttttttt

SEQ ID NO: 60352 - DNA, 75 bp, Artificial Sequence
  Synthetic
aaataatttgatttttgagggttatatttttattattttatgtttattttatttaaatataaaatgaaatgtttt

SEQ ID NO: 60353 - DNA, 75 bp, Artificial Sequence
  Synthetic
aaaattagaagagacatatcaccatctgctgaggactcaaggtccatttgaggccatcagttattatcacatgat

SEQ ID NO: 60354 - DNA, 75 bp, Artificial Sequence
  Synthetic
aatatgattgtattattaagaaaaataaatttgatgaagattaagtttgatgaaggtttaatttttattttttta

SEQ ID NO: 60355 - DNA, 75 bp, Artificial Sequence
  Synthetic
ttataattttgtttttagtattatttgataagggtatatttgttaatatgtttttattttaagggttttgtaatg

SEQ ID NO: 60356 - DNA, 75 bp, Artificial Sequence
  Synthetic
cgactggacaaagagaatcaatacatttacataaataatcaacagttcttctggcctgtaatgagcttcagagac

SEQ ID NO: 60357 - DNA, 75 bp, Artificial Sequence
  Synthetic
gggggttttagtttattttaattgtttagggataaattttggaaaagttttttttttgtttgggttattatttta

SEQ ID NO: 60358 - DNA, 75 bp, Artificial Sequence
  Synthetic
ttttaaaaggttttttttatgtttttgggtgttgtgattaatagtattttagaagtaatagagattgattagtta

SEQ ID NO: 60359 - DNA, 75 bp, Artificial Sequence
  Synthetic
tcaagacttgaccgactcatctacaagaactaatccattataacttgttagtactacctttctataagtgattct

SEQ ID NO: 60360 - DNA, 75 bp, Artificial Sequence
  Synthetic
gtttgtaaggattattttgtatttattgattagttgaaattagttggttttaattttgaggggagtggagtattt

SEQ ID NO: 60361 - DNA, 75 bp, Artificial Sequence
  Synthetic
agaactaatccattataacttgttagtactacctttctataagtgattcttgatttaaggccattaagagtttaa

SEQ ID NO: 60362 - DNA, 75 bp, Artificial Sequence
  Synthetic
attgatattttatttgtaataaagtgttggggttttagatttggtgttttttttaaggtggttagttatgaagtg

SEQ ID NO: 60363 - DNA, 75 bp, Artificial Sequence
  Synthetic
tcttaatttgaacatagtcataaggaaataaatgatactttctgtttctgattgtagattgactcattctgctta

SEQ ID NO: 60364 - DNA, 75 bp, Artificial Sequence
  Synthetic
ggagaatgggttgaaaattgttataattttgaaataaagaagttggatgggagtgaatgtttatttttattgtta

SEQ ID NO: 60365 - DNA, 75 bp, Artificial Sequence
  Synthetic
gatggtgttagaggttttttaaggtgttgttatgtttataaagtttaaggaattgggttttgtttaggtgattat

SEQ ID NO: 60366 - DNA, 75 bp, Artificial Sequence
  Synthetic
gttttttataaggatggagttttttttttttatgataggttggttttaattgtaatttatagaggagttaatttt

SEQ ID NO: 60367 - DNA, 75 bp, Artificial Sequence
  Synthetic
gattatattgtctgtaggcaggtgtttactccaccttaaatttggaaatatcctgccttaggaccattgttaaga

SEQ ID NO: 60368 - DNA, 75 bp, Artificial Sequence
  Synthetic
gttgagggggtaattgtatttttgatattggttaaattaaaagaaatgtttttttagttattttttatttgagag

SEQ ID NO: 60369 - DNA, 75 bp, Artificial Sequence
  Synthetic
gtagtaaattatattgaaaatatattaagttattatgttatattttatttggagtatgaaattgaaaattttggt

SEQ ID NO: 60370 - DNA, 75 bp, Artificial Sequence
  Synthetic
ttcactgatattgataacaagctagatcaaatggaagttcgactcaaaccatcagcaaggagctcaacaagaact

SEQ ID NO: 60371 - DNA, 75 bp, Artificial Sequence
  Synthetic
gtttaatattttatgattttttttaaaattgataataatatttttgtttgtttggataggttttatatgttttag

SEQ ID NO: 60372 - DNA, 75 bp, Artificial Sequence
  Synthetic
ttttttttttagttgaatgatattatttatttttattaatagttgagtaatataattgggagattaatttggata

SEQ ID NO: 60373 - DNA, 75 bp, Artificial Sequence
  Synthetic
ttagatgttaatattaatgttgatattggtgaatgggttttttgggaaaataaaaaaatttttttgaataattat

SEQ ID NO: 60374 - DNA, 75 bp, Artificial Sequence
  Synthetic
gtggagaagagttgttttttgaagttttattgtttaatgagatagaagatgatgatgtggtattgttgagaatta

SEQ ID NO: 60375 - DNA, 75 bp, Artificial Sequence
  Synthetic
taaagggaagaatttttgattgggttattaggaagtatttggatttggttttaaagaatttttttgggatggttt

SEQ ID NO: 60376 - DNA, 75 bp, Artificial Sequence
  Synthetic
tgcgtattggaaagagcacaaacagccaccaccagggccagcactgtacgaagagaatgcgcttaaaggaaaaat

SEQ ID NO: 60377 - DNA, 75 bp, Artificial Sequence
  Synthetic
tattgtatatattagaaggggaaataatattgttgttttagaatttgatagaaggttgaagagtaggtgtgaata

SEQ ID NO: 60378 - DNA, 75 bp, Artificial Sequence
  Synthetic
tttaggagattattatagagatagttgtaataattataggtattaatggtaattatatgtagatttttattattg

SEQ ID NO: 60379 - DNA, 75 bp, Artificial Sequence
  Synthetic
ggataagattgagttttagttaaattttgagttttttattgattatggtattaagttttgaggtttagattttta

SEQ ID NO: 60380 - DNA, 75 bp, Artificial Sequence
  Synthetic
taatttatatattaggtttattagtgatggttattgaggaattaataatattattgggaagtttttttggtttaa

SEQ ID NO: 60381 - DNA, 75 bp, Artificial Sequence
  Synthetic
taatagaagtatttatttttattattttagaaaatataataatagtggttaaaattgttttgttataggagttta

SEQ ID NO: 60382 - DNA, 75 bp, Artificial Sequence
  Synthetic
tgtttaagatgcaagatggtaaaacgctaggacttaagatctaagaatcgagatttatttaacaagacaagccac

SEQ ID NO: 60383 - DNA, 75 bp, Artificial Sequence
  Synthetic
taagtaatggtttaataattttaatagtaatagggatttttgggagttttgggttttgaaaatgtagtagaagat

SEQ ID NO: 60384 - DNA, 75 bp, Artificial Sequence
  Synthetic
agatttatttaacaagacaagccacaaccttagatgaagccccagccagaccattgaaccattgacgctgttgat

SEQ ID NO: 60385 - DNA, 75 bp, Artificial Sequence
  Synthetic
aaattaatattaaagttatgggtaagtgtaattttaatttatattattggattgtataagaataatataatgttg

SEQ ID NO: 60386 - DNA, 75 bp, Artificial Sequence
  Synthetic
ttgggattgtttggattttgtattttggattgggtgtggaaggtatatatattgaaggtttgatgtataattaaa

SEQ ID NO: 60387 - DNA, 75 bp, Artificial Sequence
  Synthetic
atgttttagtttgtggatttaggtaatttgtaaatgaaataatttaagttttgtagttttttttaagagttataa

SEQ ID NO: 60388 - DNA, 75 bp, Artificial Sequence
  Synthetic
tggagttgtggatatatattatatttaataggaaggttatagatttttttttgtgatgatggggtgggatatgta

SEQ ID NO: 60389 - DNA, 75 bp, Artificial Sequence
  Synthetic
catcaaaaaatgaagcgcggagtgttaccgacggctcctccagcatataatgatattgcataccctgtgagcata

SEQ ID NO: 60390 - DNA, 75 bp, Artificial Sequence
  Synthetic
ggattttgggattagattgttgtattgagttatatgattggataaaaaatattattgataaaattaattaaatta

SEQ ID NO: 60391 - DNA, 75 bp, Artificial Sequence
  Synthetic
tttatgattttattgataattttttatttaattaggataatgatgataattggtggatgggttggagatagtgga

SEQ ID NO: 60392 - DNA, 75 bp, Artificial Sequence
  Synthetic
tttttgtaggaataggtattattggaattattattgtaattattgtttttttttgtgtttgtaagttgttttgtt

SEQ ID NO: 60393 - DNA, 75 bp, Artificial Sequence
  Synthetic
gaatattaatttgaattattaatttaagtttgatatatttttagtattttaaattataaattgatattgatattt

SEQ ID NO: 60394 - DNA, 75 bp, Artificial Sequence
  Synthetic
gaaaattaggttaatgttaagttttgtgtaaaatttgaaagtaggtttataaaaattttttggattggaatgttt

SEQ ID NO: 60395 - DNA, 75 bp, Artificial Sequence
  Synthetic
tgatatttttttttaatattatataagtttttttttaagaataatattgatgaagattaagaaaaagtgatattg

SEQ ID NO: 60396 - DNA, 75 bp, Artificial Sequence
  Synthetic
tccaggaatacccgatcatccgctgcgactcctaaagttgggcaatcaggcattccttcaagagtttgtgcttcc

SEQ ID NO: 60397 - DNA, 75 bp, Artificial Sequence
  Synthetic
tgtttatttttgtaatttttatttatttatatatttatatttaggaatttttgaattaatttttatatttgttta

SEQ ID NO: 60398 - DNA, 75 bp, Artificial Sequence
  Synthetic
ggaaagagtttattttttataagaattttgaggtggtaatttagttaattttatattaagataatatttattttt

SEQ ID NO: 60399 - DNA, 75 bp, Artificial Sequence
  Synthetic
aacctggacagacgaaactcctgcaggagcagtcaatgttcttcgtcctggactctcactccatcccaagcttcg

SEQ ID NO: 60400 - DNA, 75 bp, Artificial Sequence
  Synthetic
aagattatagataattatattattaatttttattataaatatggagaggggttgtgagtgtgggagattaaggaa

SEQ ID NO: 60401 - DNA, 75 bp, Artificial Sequence
  Synthetic
tccaattcttctgccggggaagataggaaagaaaggacatgcttcagacttaacatcacctgacaagattcaaac

SEQ ID NO: 60402 - DNA, 75 bp, Artificial Sequence
  Synthetic
tttatgtgttgattagtaaaatttaataggtttttaatttaggataagatttattttttgggataagataataat

SEQ ID NO: 60403 - DNA, 75 bp, Artificial Sequence
  Synthetic
agaacatagttggaattgaggttccagaattactggttcaaaggttgaccggcaaaaaaccacaaccccaaaatg

SEQ ID NO: 60404 - DNA, 75 bp, Artificial Sequence
  Synthetic
agattattgtagtagttgaagtattttgtaagttagagtttttatggttttttataagaaaggtattgggatttt

SEQ ID NO: 60405 - DNA, 75 bp, Artificial Sequence
  Synthetic
tattgtttttttagtatttaaggatgtttgttttatttttagaaaaggatttttatgtgatagtaatttttgtaa

SEQ ID NO: 60406 - DNA, 75 bp, Artificial Sequence
  Synthetic
ttatcacccaggattgtgattcatgccactctccagccagttatccgtatcacatggacaagcagaatagttact

SEQ ID NO: 60407 - DNA, 75 bp, Artificial Sequence
  Synthetic
aaaggattattaatttgaaagtttaattgattgggagtttttattttttatagtatggaagatttgtggattaat

SEQ ID NO: 60408 - DNA, 75 bp, Artificial Sequence
  Synthetic
aataatttaaattccattcgagctattattctgctagtaatcccaacgggctcaatagactaaaaatctgattgt

SEQ ID NO: 60409 - DNA, 75 bp, Artificial Sequence
  Synthetic
tgatttattgtttaatatagttgtttttaaagatttaagattagtaaattttatggttgatgattttaagtaaga

SEQ ID NO: 60410 - DNA, 75 bp, Artificial Sequence
  Synthetic
ctcaatagactaaaaatctgattgtatagaattataaaagaattaagcaggggcaacagaatcacagcttacgcc

SEQ ID NO: 60411 - DNA, 75 bp, Artificial Sequence
  Synthetic
tggtagtttaaaattaattttaaaattattagttgagattgttgagttttgggttaattagaatattaatgaagt

SEQ ID NO: 60412 - DNA, 75 bp, Artificial Sequence
  Synthetic
tagataactaatattaaggagttttttaatctaattttccagtcttaagtaataatcatttcttttgtaattaat

SEQ ID NO: 60413 - DNA, 75 bp, Artificial Sequence
  Synthetic
agatgatgtaaaattttgtgtttttttgatgttgagtgttgttttagtgtggaaattttttaagttatagtttag

SEQ ID NO: 60414 - DNA, 75 bp, Artificial Sequence
  Synthetic
tatgcatttgttaacttatcgatgtgagatttccttgggaacccggcggggcccctactatccgcagtaaccaga

SEQ ID NO: 60415 - DNA, 75 bp, Artificial Sequence
  Synthetic
ttaattatgtgagagttattttaggagggaaaatttaggataagattaagttgaattagtttttgaggtttatta

SEQ ID NO: 60416 - DNA, 75 bp, Artificial Sequence
  Synthetic
agagaagttcaacccagtcacaaccaaaccaagcaatattctgaacgccctataatctattctaaccagaggcat

SEQ ID NO: 60417 - DNA, 75 bp, Artificial Sequence
  Synthetic
atgtttatatagtgataaaggaggtgtttttgaggtagtattatggtaatagtgggatagataattattaattat

SEQ ID NO: 60418 - DNA, 75 bp, Artificial Sequence
  Synthetic
aacaatggctaatatttcaatgactcgttaacaatcgttagcaattttaatctccagattaagaaaaagatatac

SEQ ID NO: 60419 - DNA, 75 bp, Artificial Sequence
  Synthetic
gtttatatttgtttttttttatgtagtattgtaatttttttgtgagagttttattgtagtgatattaggtttatg

SEQ ID NO: 60420 - DNA, 75 bp, Artificial Sequence
  Synthetic
gatgaagattaaggcaataacgagccgaaacttcatctttcttaaagatctaacatcatctgttccaaagtcata

SEQ ID NO: 60421 - DNA, 75 bp, Artificial Sequence
  Synthetic
cgaaacttcatctttcttaaagatctaacatcatctgttccaaagtcatacaaggacacattcaaatcaggggtt

SEQ ID NO: 60422 - DNA, 75 bp, Artificial Sequence
  Synthetic
tttatttgtttttttaagtgttaatgaagggtttttttttgtattaggggaatatatttggttagaagatagtat

SEQ ID NO: 60423 - DNA, 75 bp, Artificial Sequence
  Synthetic
aatttagtttgtagggaggataagtaaaataagatgtttttattttttatagatggtatttttagagagggggat

SEQ ID NO: 60424 - DNA, 75 bp, Artificial Sequence
  Synthetic
agggatgttttcgtaaaacttcgttctttgtatgggtaatcatcctcttccagcgagcaatctctatgccgcttg

SEQ ID NO: 60425 - DNA, 75 bp, Artificial Sequence
  Synthetic
aggataggaataaagataatgattaaagttaatataaagatatgaatataagtagaaattaaaatagaaattaaa

SEQ ID NO: 60426 - DNA, 75 bp, Artificial Sequence
  Synthetic
ataatttttttttatttaatatgaaatataatagtgagtatttgttttatgatgttaattatttattgttaaaaa

SEQ ID NO: 60427 - DNA, 75 bp, Artificial Sequence
  Synthetic
gtcagctcaagtctgtggggctgaatttggaaggaaatggaattgcaaccgatgttctatcagcaacaaaacgct

SEQ ID NO: 60428 - DNA, 75 bp, Artificial Sequence
  Synthetic
taaataaagttagtaagagtgttaggattgttatattgtaaggattttttttagaagtgttgaattattttaagt

SEQ ID NO: 60429 - DNA, 75 bp, Artificial Sequence
  Synthetic
gattgttatattgtaaggattttttttagaagtgttgaattattttaagtagtttagaataagaatagtagagta

SEQ ID NO: 60430 - DNA, 75 bp, Artificial Sequence
  Synthetic
tttggaaggaaatggaattgcaaccgatgttctatcagcaacaaaacgctggggatttcgttcaggtgtgccccc

SEQ ID NO: 60431 - DNA, 75 bp, Artificial Sequence
  Synthetic
tttatggatatattttagtattgaggatggggtttttttgatgatagtatagttttaggtatagggtagttttat

SEQ ID NO: 60432 - DNA, 75 bp, Artificial Sequence
  Synthetic
atgtattatattatatagtttaaatttgtaaaattaaattataagaatatgatgaaaattaatgagaaggtttta

SEQ ID NO: 60433 - DNA, 75 bp, Artificial Sequence
  Synthetic
agattgattttaatttaaatattttgttttgttaatttttatttttttaagatatatgattttgtttttgtgaga

SEQ ID NO: 60434 - DNA, 75 bp, Artificial Sequence
  Synthetic
gaaggtgtcgtagcttttttaattctgtcggaacccaagaagcatttttggaaggccacaccagctcatgaaccg

SEQ ID NO: 60435 - DNA, 75 bp, Artificial Sequence
  Synthetic
taaggttattaaatagggtgtgtattttttttatatatttgggtttttattaggttagggtttatagttaaggaa

SEQ ID NO: 60436 - DNA, 75 bp, Artificial Sequence
  Synthetic
atgaacacaacagatgattccacaggccactatatgaccctgacactcagctacgaggtgtcaaattttgggggc

SEQ ID NO: 60437 - DNA, 75 bp, Artificial Sequence
  Synthetic
gccactatatgaccctgacactcagctacgaggtgtcaaattttgggggcaatgaaagtaacacccttttaaagg

SEQ ID NO: 60438 - DNA, 75 bp, Artificial Sequence
  Synthetic
gatttattatattttttattgaattagtttatttgtagaattttattgggaatagaaattagaatatttgtgata

SEQ ID NO: 60439 - DNA, 75 bp, Artificial Sequence
  Synthetic
ttttgattataggaaataatttttaatattatttgagattaggttatttttttaatttattttgtaagtaattgt

SEQ ID NO: 60440 - DNA, 75 bp, Artificial Sequence
  Synthetic
tacagggagattgatttggatattggatcctgagattgaacccgatgttgatgagtgggccttctgggaaactaa

SEQ ID NO: 60441 - DNA, 75 bp, Artificial Sequence
  Synthetic
ttagtattataataataatgttataatttaagaattaagttttgtaatagaaataaagataatagaaagaatttt

SEQ ID NO: 60442 - DNA, 75 bp, Artificial Sequence
  Synthetic
tattatatgggtttattaattttataggagaagttttttttataagtttaagattttattagagataattagaat

SEQ ID NO: 60443 - DNA, 75 bp, Artificial Sequence
  Synthetic
ggttaaagttataggttggtataatttggtaatattaaaatgggagttagagtaaggagttgtgtttagtgattt

SEQ ID NO: 60444 - DNA, 75 bp, Artificial Sequence
  Synthetic
atgtaattttttagtgattttaattgtgtaaggatggaaggtttattgggttggatttgagtttgatgttaatta

SEQ ID NO: 60445 - DNA, 75 bp, Artificial Sequence
  Synthetic
cgaccccagtgacaaccaccattgccccaagtccaaccatgacaagcaaggctgataacaatgtaccaagtgaac

SEQ ID NO: 60446 - DNA, 75 bp, Artificial Sequence
  Synthetic
aaagggtattattttgttaaattgttttaaagtgaatgattttgtttttgtatgggtgatgatttggaatttttt

SEQ ID NO: 60447 - DNA, 75 bp, Artificial Sequence
  Synthetic
agccgaacaacacagaatccattgaatactcccccccatcggtgagcaacgagacaactgaccaccccgagatga

SEQ ID NO: 60448 - DNA, 75 bp, Artificial Sequence
  Synthetic
tttatatttgtttaaaaattaatagtttgaagtttaaatttttatttgggttttgagggtaatttttgttgttgg

SEQ ID NO: 60449 - DNA, 75 bp, Artificial Sequence
  Synthetic
acttgatccaaggcccgaacaactccgcccagagcccacagaccaagaccacgtcagcacccacagcatctccga

SEQ ID NO: 60450 - DNA, 75 bp, Artificial Sequence
  Synthetic
gatttttgattaattaatggattatttttttattgagttgttattaggggttttgaatttaattgttgattggtt

SEQ ID NO: 60451 - DNA, 75 bp, Artificial Sequence
  Synthetic
tgacccaggacccgcaagcgacggtcaacagcagcaaatcaggaaccagcccaggaagtgcagccgaaccaagtc

SEQ ID NO: 60452 - DNA, 75 bp, Artificial Sequence
  Synthetic
attaataatatttattaattattttaatatgagaatttaatgagtaaaggattaattgagtatgaggatgttatt

SEQ ID NO: 60453 - DNA, 75 bp, Artificial Sequence
  Synthetic
agcccggactcatcataaatacagtaagtgaggtagctggttcactgagccccaccaggaaacaaaagcaatcag

SEQ ID NO: 60454 - DNA, 75 bp, Artificial Sequence
  Synthetic
ttttataaggttaaatattattaattttataaataagtttgagattttttatgttgttaattataagggattttt

SEQ ID NO: 60455 - DNA, 75 bp, Artificial Sequence
  Synthetic
ctcgacaaaacactgccaataaatgtaatccagatcttcactattggacagctgttgatgagggggcagcagtag

SEQ ID NO: 60456 - DNA, 75 bp, Artificial Sequence
  Synthetic
aagtagtgttgagataggaatattaagttatgtaattattattattaggattaatatgggttattttgttgaggt

SEQ ID NO: 60457 - DNA, 75 bp, Artificial Sequence
  Synthetic
ttaggaattagataaatttgtgatggatatatgatattttggttttgttaaattttttttattatatgaattgat

SEQ ID NO: 60458 - DNA, 75 bp, Artificial Sequence
  Synthetic
atttaaatttgttgttatttttaaattattaagtattattttattgattatggagtttaatagttttttggtaat

SEQ ID NO: 60459 - DNA, 75 bp, Artificial Sequence
  Synthetic
ttaattgttgtaataaaaattgtatgatagggttaatattgattttataatttattgtaggatagaattattttt

SEQ ID NO: 60460 - DNA, 75 bp, Artificial Sequence
  Synthetic
ttgtatgattttagtttaatttttttttatataatgattaataaggagtttgtttaaaatgttataaaagtatat

SEQ ID NO: 60461 - DNA, 75 bp, Artificial Sequence
  Synthetic
tgtttgaatttttagtatttttgtaaatatttttatttaattttttgtttttatatgtgtagttatttgtatagt

SEQ ID NO: 60462 - DNA, 75 bp, Artificial Sequence
  Synthetic
aaaccacggagatgatctcattctatggacaggttggagacaatggatcccggctggaattgggattatcggggt

SEQ ID NO: 60463 - DNA, 75 bp, Artificial Sequence
  Synthetic
atgattttagttatgtttttaattaatatttaatttaatagttaatataatgtataattttttatgtttaaagag

SEQ ID NO: 60464 - DNA, 75 bp, Artificial Sequence
  Synthetic
tagttaaaataatgtgagatttagttttatttatagtatttatttattatttatagtatgatgagtttaaattaa

SEQ ID NO: 60465 - DNA, 75 bp, Artificial Sequence
  Synthetic
atctcagggttactctaaggagaaatattatttttaagatttacttgaatgttgaccacttatcttgaatgagca

SEQ ID NO: 60466 - DNA, 75 bp, Artificial Sequence
  Synthetic
tattatttttaagatttacttgaatgttgaccacttatcttgaatgagcaattaacaatatgtttttctgcttct

SEQ ID NO: 60467 - DNA, 75 bp, Artificial Sequence
  Synthetic
tatggtagaggtttagatttattaatagaatgaggaagattaagaaaaagtttataatgttggggaggtaatttt

SEQ ID NO: 60468 - DNA, 75 bp, Artificial Sequence
  Synthetic
ttacttgatttacaatatgatatttctcttaataatgattaatatattaagaaaaacgtatgacgaagattaaag

SEQ ID NO: 60469 - DNA, 75 bp, Artificial Sequence
  Synthetic
tgttattataggatttttttaatttttttattttatgatggttatttaatatatataatattttgatgtaagatt

SEQ ID NO: 60470 - DNA, 75 bp, Artificial Sequence
  Synthetic
gggaggatcgttaacggaaaaacttcccatctcgttcgtcgaagtcacgttggtggtgcttgcagctgagaacaa

SEQ ID NO: 60471 - DNA, 75 bp, Artificial Sequence
  Synthetic
gttttttttaattgttttagattaatgtgatttagtgataagagtatgtggattttattttgagtatttgttgaa

SEQ ID NO: 60472 - DNA, 75 bp, Artificial Sequence
  Synthetic
ccccagagattgtaggtagataagaccaacacttataggtaggggtcagaaagtaacaataaccataaaaggagg

SEQ ID NO: 60473 - DNA, 75 bp, Artificial Sequence
  Synthetic
ttttaaattaaagatatgttgtttattgaaatatatttatagattaaaatatgatattattgttttatgatttat

SEQ ID NO: 60474 - DNA, 75 bp, Artificial Sequence
  Synthetic
gcctgatattgctatttaatatcctagcacctgatttctaggttctagttgtacaatccgaatgatggagcattc

SEQ ID NO: 60475 - DNA, 75 bp, Artificial Sequence
  Synthetic
tagtgatgtttttgtagttataattttaatagattatattgttttgatgttaataaatgttttggtagatagtaa

SEQ ID NO: 60476 - DNA, 75 bp, Artificial Sequence
  Synthetic
aagagaacggggtagatctcgcaacatacgacataatagccgggaaccatatgaaaatccatcaaggtctcgctc

SEQ ID NO: 60477 - DNA, 75 bp, Artificial Sequence
  Synthetic
aaatgtattattggaatttttttgtttgagttttttggatgaaatagttaattatattgtgtaggatgtagtttt

SEQ ID NO: 60478 - DNA, 75 bp, Artificial Sequence
  Synthetic
atgaaaatccatcaaggtctcgctcattatctcgggaccccaatcagatcgatcgtagacagcctcgaagtgcat

SEQ ID NO: 60479 - DNA, 75 bp, Artificial Sequence
  Synthetic
ttttaattattatatgaattagattaaaatataggaaggagtaattatagattaattaaaatagaatatttgtag

SEQ ID NO: 60480 - DNA, 75 bp, Artificial Sequence
  Synthetic
ggttatttataaaaatagatatttatttgttttatttttttggtatgattttgttatttttatttgttgagggag

SEQ ID NO: 60481 - DNA, 75 bp, Artificial Sequence
  Synthetic
aatgaattgaggaaatgtgtgttttatttggtttgtaatgaatgaggttgttgatattttaggatatggtgatta

SEQ ID NO: 60482 - DNA, 75 bp, Artificial Sequence
  Synthetic
tattttttggaagatttttattgttttattattaatgaatatagttaatgttttatatgtattaattgattggta

SEQ ID NO: 60483 - DNA, 75 bp, Artificial Sequence
  Synthetic
ttaatttaatatttttaaggaggttatttaaggatatatatatattattttagtttttatagttgaggtttttat

SEQ ID NO: 60484 - DNA, 75 bp, Artificial Sequence
  Synthetic
tatgtgtaaggattttgttataagttgttttaatatttttttgattgttgagttagttaggttggaagatttagt

SEQ ID NO: 60485 - DNA, 75 bp, Artificial Sequence
  Synthetic
gtttgttgattatttattagtagataatatttaatttttgtataatgtaggagattatttgttgtttatattggg

SEQ ID NO: 60486 - DNA, 75 bp, Artificial Sequence
  Synthetic
attagaggggtataaaataattaaatattttgaatttttgtgtttggttaagatttaattatgtttttaatatat

SEQ ID NO: 60487 - DNA, 75 bp, Artificial Sequence
  Synthetic
agaatgaaaagggtggtttttaatttagatgtattttgtagttatttagatattgtgtgaatttttttttaatag

SEQ ID NO: 60488 - DNA, 75 bp, Artificial Sequence
  Synthetic
agggttgaaaaaattataattgtttaaaatttgtgagttttattaattgttgtttagattttgatttatattata

SEQ ID NO: 60489 - DNA, 75 bp, Artificial Sequence
  Synthetic
ataattatgtgaattatttttaatttaaaaatattggggttatttagttttgtatagtgaaaaggttatttaaaa

SEQ ID NO: 60490 - DNA, 75 bp, Artificial Sequence
  Synthetic
atgtaataaggtgagttggtatctgaggtattttgtctagagtatactcaaaattgtgtgtcgagcaaattatca

SEQ ID NO: 60491 - DNA, 75 bp, Artificial Sequence
  Synthetic
ggttaaaaattatgtaatagttttaaaggtattgtggttgattattatttttgaaatgtattgtgtatttaagta

SEQ ID NO: 60492 - DNA, 75 bp, Artificial Sequence
  Synthetic
ataacaaagttaaattctcctaacctcacattttgatcaagtaatcatgattttacgataattctttgcagatta

SEQ ID NO: 60493 - DNA, 75 bp, Artificial Sequence
  Synthetic
tagtgttgtaaaatatttttttgatagttaaggtatttggtatagtgtgatattagattgatgtttaatgttggg

SEQ ID NO: 60494 - DNA, 75 bp, Artificial Sequence
  Synthetic
attgaatttttatattaggtgaaattaattttttttatttttaatgattaaagattttttatgggaattttatta

SEQ ID NO: 60495 - DNA, 75 bp, Artificial Sequence
  Synthetic
ttccgatgtataattttattatttgctacttcaagtgcctaaaaccagtaacgcaggatgaagattaattgcgga

SEQ ID NO: 60496 - DNA, 75 bp, Artificial Sequence
  Synthetic
tttggattattttttattattttttatgaagattattagtgattttagtatttttattaaagattgtgtaatagt

SEQ ID NO: 60497 - DNA, 75 bp, Artificial Sequence
  Synthetic
ggaatcaggaattcaactttaattccttaaggcctcatccgaatcttcatcagttagcacgttcttttatagaag

SEQ ID NO: 60498 - DNA, 75 bp, Artificial Sequence
  Synthetic
agttgaataaatttgttgggatgtagtttttgagtttaatgttttgggttatagtttattttattgatttaatat

SEQ ID NO: 60499 - DNA, 75 bp, Artificial Sequence
  Synthetic
ccattagcttctagagtgattatattttagtattaaattttgctaattgcttgctataaagttgaaatgtctaat

SEQ ID NO: 60500 - DNA, 75 bp, Artificial Sequence
  Synthetic
taaatgtgtatttgaataatttttggagtaagaggatttttttattgagagtgttttataatatgtttaagaatt

SEQ ID NO: 60501 - DNA, 75 bp, Artificial Sequence
  Synthetic
gtttaaatgaacatttttttgaagctgacatacgaatacatcatatcatatgaaaacatcgcagttagagcatcc

SEQ ID NO: 60502 - DNA, 75 bp, Artificial Sequence
  Synthetic
taggtatttattgttttagaattgaaattttttttttttattgaaggaaaaagaattaaatgttggtaggatatt

SEQ ID NO: 60503 - DNA, 75 bp, Artificial Sequence
  Synthetic
ttgaaatctggtattgacagccaccaggctgttctcagtagtctgtccttagaagctcttggggagacaaaaagg

SEQ ID NO: 60504 - DNA, 75 bp, Artificial Sequence
  Synthetic
tggaaaattgttttatttaattaggaatgtttaaattttttgtgaagtattatttgtagatggtttggttaaagt

SEQ ID NO: 60505 - DNA, 75 bp, Artificial Sequence
  Synthetic
agtcccagagagtcctaacaggttggcataaggtcattaacaccagcatagtcggctcgatcaaggctgcaagcg

SEQ ID NO: 60506 - DNA, 75 bp, Artificial Sequence
  Synthetic
ttttttaagtaatatgatggttgttatagagagggaataaaaggagagttttttttattaagtattttggtatta

SEQ ID NO: 60507 - DNA, 75 bp, Artificial Sequence
  Synthetic
agtcgatctcaactaaaaagattattttttattgcttaaacaaattccttttgtgtgagacatcctcaaggcaca

SEQ ID NO: 60508 - DNA, 75 bp, Artificial Sequence
  Synthetic
tataagtgatgattttggagagtatgttatagtttgtggaagtagttttgttatagatttggaaaaatataattt

SEQ ID NO: 60509 - DNA, 75 bp, Artificial Sequence
  Synthetic
aaatggctaaagccacaggccgatacaatctcgtgtctccaaagaaagatatggaaaagggagtgattttgagtg

SEQ ID NO: 60510 - DNA, 75 bp, Artificial Sequence
  Synthetic
ggtttttaggtatgaatttatagttttttttattaaatattgtaattaatgttatggggtttgtaatgtttttga

SEQ ID NO: 60511 - DNA, 75 bp, Artificial Sequence
  Synthetic
ttggatgtattttttaattttgtaatgttatatgtatgttagtgattattataatttattatataatgtaatttt

SEQ ID NO: 60512 - DNA, 75 bp, Artificial Sequence
  Synthetic
agagaatagggaatatttttttgaaggattaagtgtttatagaggttattttggtggtattgaggggttttaata

SEQ ID NO: 60513 - DNA, 75 bp, Artificial Sequence
  Synthetic
aaagttatggattagtattttatgtgtttaaattttattggtagagattaagattgggtttaaattgtgattagt

SEQ ID NO: 60514 - DNA, 75 bp, Artificial Sequence
  Synthetic
agttatgggggataattaatgtattatagtattattagtttttttattagaatttagtttgaatgagtaggagag

SEQ ID NO: 60515 - DNA, 75 bp, Artificial Sequence
  Synthetic
atgtgtagaagataatgtagttagagtggttgttagtttggttaaagttataagtgtttgtgggatattttttaa

SEQ ID NO: 60516 - DNA, 75 bp, Artificial Sequence
  Synthetic
gtttgatgagatttttgtatatttaggttttatttattttggtaaaaagtaatatttgaatggaatttaattatt

SEQ ID NO: 60517 - DNA, 75 bp, Artificial Sequence
  Synthetic
ttaattatttaagatagtagttaggatggttttttttttagatgtaatttttgatgatttgtaaggtatatttgt

SEQ ID NO: 60518 - DNA, 75 bp, Artificial Sequence
  Synthetic
tagtataggaattgtttttgagtgattaatttttgaaattagatatattttattatgttgtgttgtagttgtttt

SEQ ID NO: 60519 - DNA, 75 bp, Artificial Sequence
  Synthetic
ttatatatatttttttgtttggattttataatattattattttggtttttataagggtttagattttggataatt

SEQ ID NO: 60520 - DNA, 75 bp, Artificial Sequence
  Synthetic
tccacaatctgggatgcaatcattaataatggagttcaacagcttgttagcaatttaacaagatgatcttaaaat

SEQ ID NO: 60521 - DNA, 75 bp, Artificial Sequence
  Synthetic
ggtaattaataaattttttgattttgggattattgtattatttttagtagttttttaggtattgggtggattatt

SEQ ID NO: 60522 - DNA, 75 bp, Artificial Sequence
  Synthetic
gggtcttatctagcattgctgagttagctatctaatctattttcactaattgctttaagcactgctaataggttt

SEQ ID NO: 60523 - DNA, 75 bp, Artificial Sequence
  Synthetic
ttttttaaatttagaaaagtgtttttattgtaatttgggtgattttgtaattttaggtttattttagttgaagta

SEQ ID NO: 60524 - DNA, 75 bp, Artificial Sequence
  Synthetic
ttatttgttaatggtgggtatgagtgatattttttatgtatttattgtaaaaagtttagggaattgtagtgtaat

SEQ ID NO: 60525 - DNA, 75 bp, Artificial Sequence
  Synthetic
atttctttaatgggaggagttagcaatcagaaattgaagatagatgggcatcgggatagaacaatgcctaactat

SEQ ID NO: 60526 - DNA, 75 bp, Artificial Sequence
  Synthetic
tgattttgttttaaatttaggtgggttaaatgtttttggattataggatttaatattttttttttgttagattgt

SEQ ID NO: 60527 - DNA, 75 bp, Artificial Sequence
  Synthetic
tgggtggcttccatttttacatgtgtatatcaccaattttttcctatctttgcttatattggtgtaactttattt

SEQ ID NO: 60528 - DNA, 75 bp, Artificial Sequence
  Synthetic
tagaaggagtattatatttttggtaaggaataagttaattaatatgttattttatgtttttgtagattttgaaga

SEQ ID NO: 60529 - DNA, 75 bp, Artificial Sequence
  Synthetic
aaataacatgtcaatgctatactgttaagggaaggtctgaggaagattaagaaaaaggccttgtgttcacttggt

SEQ ID NO: 60530 - DNA, 75 bp, Artificial Sequence
  Synthetic
tgaattagtatgtaaatggttattttttttaatgtttgtgatgagttgttttgtagttgatatttttttatgaat

SEQ ID NO: 60531 - DNA, 75 bp, Artificial Sequence
  Synthetic
tgccgtcaagtatcctgtggtctttttctacctagcttcctcatgccatatggccacccagcatacccagtaccc

SEQ ID NO: 60532 - DNA, 75 bp, Artificial Sequence
  Synthetic
attaagtgggaaaagattataaattttgggatattttgagggaattagaattttattagtatttaaaatgataag

SEQ ID NO: 60533 - DNA, 75 bp, Artificial Sequence
  Synthetic
taataatgtagagatattaattttggagaggtttagaaaaataatattttaaagatggaatttatggtttagtta

SEQ ID NO: 60534 - DNA, 75 bp, Artificial Sequence
  Synthetic
tttagattattgtgatttagttttaatggaagtaatttaattaattaagtgtattgttgatattgtttaaatttt

SEQ ID NO: 60535 - DNA, 75 bp, Artificial Sequence
  Synthetic
tagagaatatttttgggtttatatttttgatggtagatagttaataggggtaatattgttatgtatatttgagta

SEQ ID NO: 60536 - DNA, 75 bp, Artificial Sequence
  Synthetic
gttttaaattatatggttaaaattttatgagtaatgtgtggaatgtttatttataaataattttagtttatatgt

SEQ ID NO: 60537 - DNA, 75 bp, Artificial Sequence
  Synthetic
attagttgtattaaaaaggaatgtggttagtgtttggtttgatgtatttagattggggtggatgattggtgatgg

SEQ ID NO: 60538 - DNA, 75 bp, Artificial Sequence
  Synthetic
gattttttatataggtttaagaattgaggataaaataggttagtttgttattaagttgaggtgtttattagttgt

SEQ ID NO: 60539 - DNA, 75 bp, Artificial Sequence
  Synthetic
attaagagaagttattgaattgatttttaggttgatttgggttatttaaggtagtgtaaatagtgattagttaat

SEQ ID NO: 60540 - DNA, 75 bp, Artificial Sequence
  Synthetic
ttgttttttttttgaggtaagagtaaatttgagtgtataagagattttttaaatgatttttttatattattttgg

SEQ ID NO: 60541 - DNA, 75 bp, Artificial Sequence
  Synthetic
atacctttatcattattaccagttactatagacggagttccacacgcagcaacagactggtatcaaccgactctt

SEQ ID NO: 60542 - DNA, 75 bp, Artificial Sequence
  Synthetic
taatattgtgtattggtataatgattagtatagtttttatttttttatggttaattgtatgagtaatatagtaat

SEQ ID NO: 60543 - DNA, 75 bp, Artificial Sequence
  Synthetic
tgagatactaattatgtgtaaagatattatcacctgtaggtttaatacatcactgattgcatccattgcaaaatt

SEQ ID NO: 60544 - DNA, 75 bp, Artificial Sequence
  Synthetic
gtgtttgatggtatttattaatatattaggagagttttttggagggggttaggttgtatgtgatagtaatattat

SEQ ID NO: 60545 - DNA, 75 bp, Artificial Sequence
  Synthetic
attttaaaatgtgattaattttgtagtggttttgtatgatattaggttttggaatatttgtatattttttattta

SEQ ID NO: 60546 - DNA, 75 bp, Artificial Sequence
  Synthetic
atattatagggtttatatttatttgatgaattgttgtatgagggaagtattggtttaatatttaatatatataat

SEQ ID NO: 60547 - DNA, 75 bp, Artificial Sequence
  Synthetic
tatgttaaatttagatttgagtaagtattgtaataatgaattgatttatgatttagatttattaagaggaggttt

SEQ ID NO: 60548 - DNA, 75 bp, Artificial Sequence
  Synthetic
taattgtaatttattgattgatagttttttgatgaagggtttatgtttaaatattattgaggatgatttaatatg

SEQ ID NO: 60549 - DNA, 75 bp, Artificial Sequence
  Synthetic
gttgttatatttatttggttgggaattagtaaaaatagttttgtaattaataatttttgatagtagtaatttatt

SEQ ID NO: 60550 - DNA, 75 bp, Artificial Sequence
  Synthetic
aatagattttattagtagtggtgaaataagattttttataatttattttttaatgtattttaaaatagggttttt

SEQ ID NO: 60551 - DNA, 75 bp, Artificial Sequence
  Synthetic
atatagttttggagtttttataagtttttatttgggtaatattattttatgtatgaaaaagattggatttataga

SEQ ID NO: 60552 - DNA, 75 bp, Artificial Sequence
  Synthetic
atttttatattatttttagaattagatttataatttattatatagatttttttgaatttttaaattgatatttag

SEQ ID NO: 60553 - DNA, 75 bp, Artificial Sequence
  Synthetic
atatttaagtgttatgtttaggttgatggatatagattttaattttttaatatatattggtgggattgtaggtga

SEQ ID NO: 60554 - DNA, 75 bp, Artificial Sequence
  Synthetic
ttgtggattattggatgttgtaagattatttttttgaattgtaattttaatttttttgagttttgttgaggagtg

SEQ ID NO: 60555 - DNA, 75 bp, Artificial Sequence
  Synthetic
ggttatttttaggaaggtaaatattttattatgggttatttatttttttgaaggttaatgttttgatttttttgg

SEQ ID NO: 60556 - DNA, 75 bp, Artificial Sequence
  Synthetic
tgaatttttgaattgagtaaaatttttaattgttgggattgaagatgataaaaataaaggttttatatttttaag

SEQ ID NO: 60557 - DNA, 75 bp, Artificial Sequence
  Synthetic
ctcttaaagaaaaggaattaaatattggacgaacatttgggaagctaccatatctcacacggaatgtccaaactt

SEQ ID NO: 60558 - DNA, 75 bp, Artificial Sequence
  Synthetic
atttggagagaaatgttttttaaatttagtttataattgtaagagtatagtaagtaattttttttatgtattatt

SEQ ID NO: 60559 - DNA, 75 bp, Artificial Sequence
  Synthetic
ggtttattggagaggttgatatagatttaagaagattataggtgtaattaatgtgataatagttttatatattat

SEQ ID NO: 60560 - DNA, 75 bp, Artificial Sequence
  Synthetic
tttgttattgggaaattttgattgattgtttggtttagattttaataggaataatgatatttttatttttattag

SEQ ID NO: 60561 - DNA, 75 bp, Artificial Sequence
  Synthetic
aattaaatagatagtttaaggagattttagaaatgatagaatgattattatgagatttttatttaaaagtaggtt

SEQ ID NO: 60562 - DNA, 75 bp, Artificial Sequence
  Synthetic
tattttaatattagtaattgagttttttataaaaatgtatgagggtttgataatttattaagggaaattaataga

SEQ ID NO: 60563 - DNA, 75 bp, Artificial Sequence
  Synthetic
caatgttaatcttagcaatcgagagtatcctcctgaaggcccgagttcataccgagggcatttaggaggcataga

SEQ ID NO: 60564 - DNA, 75 bp, Artificial Sequence
  Synthetic
tatatatttggatgaggattataatgttaaagagtttttatttaatttgtattgtttagtagtattattttttaa

SEQ ID NO: 60565 - DNA, 75 bp, Artificial Sequence
  Synthetic
attaataaaagatggggaatatagtattgaatttttttttgaagaaagttgtagtaatataaaagggttatttta

SEQ ID NO: 60566 - DNA, 75 bp, Artificial Sequence
  Synthetic
atatttaagaattatggttgatattattatatattgttgttttattggaattgttttattaatgtattataagtt

SEQ ID NO: 60567 - DNA, 75 bp, Artificial Sequence
  Synthetic
agatgaagtattatgggaatataataaatttgaattagttgtaattttagtagaaggggagggtttaggtgtttt

SEQ ID NO: 60568 - DNA, 75 bp, Artificial Sequence
  Synthetic
attattgatttaaaaatatggtgttaagaagttatttttgaatatatttgttattgaatatagtattgagagtga

SEQ ID NO: 60569 - DNA, 75 bp, Artificial Sequence
  Synthetic
agtgatattaggttatattattttaaggatgttatttttaattatgtttaaaatatattgtggtgagttagaggt

SEQ ID NO: 60570 - DNA, 75 bp, Artificial Sequence
  Synthetic
tatattaaataatttagttagttaaataattgatattatatattgagattggtttttaaattaaaaaaataggat

SEQ ID NO: 60571 - DNA, 75 bp, Artificial Sequence
  Synthetic
tttaaatgatgttgatattattattatggatgttgaaattatagaaaatttagattgttttagattatatgaagt

SEQ ID NO: 60572 - DNA, 75 bp, Artificial Sequence
  Synthetic
agtatatatgattatttgtaattatattaattttaaaattttgaaagtggttattttaaaagttttttttagtga

SEQ ID NO: 60573 - DNA, 75 bp, Artificial Sequence
  Synthetic
tttggatgggatgtgttggattaataattattttgtttttatgtttggattaggatatttaattaaatttataat

SEQ ID NO: 60574 - DNA, 75 bp, Artificial Sequence
  Synthetic
attaagtgtaaagttaagtgagtggtatttatgtttatttaatttatttttaattttgagaattatttagtatta

SEQ ID NO: 60575 - DNA, 75 bp, Artificial Sequence
  Synthetic
aatttaggtaaattgtttttatgttgtataatgtgttttttaatagtaagtataaagagggttatattggttaag

SEQ ID NO: 60576 - DNA, 75 bp, Artificial Sequence
  Synthetic
ttattttattaaatatattataagtagattgtataatagttatattgtatttggtttttttttattagagaaggt

SEQ ID NO: 60577 - DNA, 75 bp, Artificial Sequence
  Synthetic
tttatattataggtataattttgttgatttgagaaatggattattagtttttataatgagatattttgttttttt

SEQ ID NO: 60578 - DNA, 75 bp, Artificial Sequence
  Synthetic
ttaaattgagatttgggagttggtaattgattataattagttgtgataaagttgaatttagatttattattttat

SEQ ID NO: 60579 - DNA, 75 bp, Artificial Sequence
  Synthetic
aaaaatatttaagggatggataattaaattagtgaatgattatttaagatttgagttggttatatgggtttttaa

SEQ ID NO: 60580 - DNA, 75 bp, Artificial Sequence
  Synthetic
aaataattttatatggtattatgagttatatttgttattagaatttataggtgtttgttattgatttaattatat

SEQ ID NO: 60581 - DNA, 75 bp, Artificial Sequence
  Synthetic
atgtaattgtatatgtagtgaaaggtttttggtttaaattttatatttatattgaatgagtgatgttgagataaa

SEQ ID NO: 60582 - DNA, 75 bp, Artificial Sequence
  Synthetic
atttatggattggtttattagtttagttaatatgttttttgaaggttttaggtttagtttagtttaattttaatt

SEQ ID NO: 60583 - DNA, 75 bp, Artificial Sequence
  Synthetic
gtattaaaggttttaaaaatattttaaataattaggtgtatattaaagttaatataagtgtaaaaataatatgta

SEQ ID NO: 60584 - DNA, 75 bp, Artificial Sequence
  Synthetic
agggattatatttaggattagtttattgatttttttaatatatagagttggaagtattgatttaaggtttttaag

SEQ ID NO: 60585 - DNA, 75 bp, Artificial Sequence
  Synthetic
atgttttattgattatgttgataatgtaaataatagttttttttgtttattatgatttaaataattatatttata

SEQ ID NO: 60586 - DNA, 75 bp, Artificial Sequence
  Synthetic
atagaattagcctcaaggctcacttgggttacacaaggaggttctaatagtgaacaattaatccggcctttcttg

SEQ ID NO: 60587 - DNA, 75 bp, Artificial Sequence
  Synthetic
atgattattatagttaagttgttgttttagtttatatattaaattaaaatttagaagttaggttgattttaatta

SEQ ID NO: 60588 - DNA, 75 bp, Artificial Sequence
  Synthetic
tataagtattaagaaaaaattattaagattaatatttttatgttaagaattagtaatgtgttttatatgatagat

SEQ ID NO: 60589 - DNA, 75 bp, Artificial Sequence
  Synthetic
tatttttaatattaaattgtaattttaattttaaagttaagtttaatatttatatagttaaaatattttataggg

SEQ ID NO: 60590 - DNA, 75 bp, Artificial Sequence
  Synthetic
caggtggagggcaggccgccagggatagcaatataattttccagaatgttataaatttagcagttgccctttatg

SEQ ID NO: 60591 - DNA, 75 bp, Artificial Sequence
  Synthetic
ttgatgggaataatataagaggaatatgattaatgaattttttattttaattaggtagttgattgataatttata

SEQ ID NO: 60592 - DNA, 75 bp, Artificial Sequence
  Synthetic
aattttataagatgtttttatgatatttttttgtttttaattttaatgttaatgatttaataagtaataataaaa

SEQ ID NO: 60593 - DNA, 75 bp, Artificial Sequence
  Synthetic
aaattatattaaagatgtaggaagattttgattttgttaggaaaattaagtgtatataaataaattaaaaaattt

SEQ ID NO: 60594 - DNA, 75 bp, Artificial Sequence
  Synthetic
gatttaagccgttatcgtgataatgaactaatatatgactcaaatccactgaagggaggattgaactgcaattta

SEQ ID NO: 60595 - DNA, 75 bp, Artificial Sequence
  Synthetic
tggatatataaaaaagagaaaatatagattttttaatttatttgtgtgtgtttaatttttttggtgaggttaaga

SEQ ID NO: 60596 - DNA, 75 bp, Artificial Sequence
  Synthetic
ttttgattttgttaggaaaattaagtgtatataaataaattaaaaaatttgtatttttttttttttgtgtgttta

SEQ ID NO: 60597 - DNA, 75 bp, Artificial Sequence
  Synthetic
tttttttgtatttttaatgtgatttttttattattatttattaaattattgatattgagattaaaaataaaagaa

SEQ ID NO: 60598 - DNA, 75 bp, Artificial Sequence
  Synthetic
tattgtaagaatattttatggaatttgtagattattaattaattgtttagttggaataaagggtttattgattat

SEQ ID NO: 60599 - DNA, 75 bp, Artificial Sequence
  Synthetic
caactcattttctcacttaccctcagattggccttctttacagtttcggggcagtattatgcttttatctaggca

SEQ ID NO: 60600 - DNA, 75 bp, Artificial Sequence
  Synthetic
gttttttttatgttatttttattggttttatgaaatattttggttgtataggtgttaaatttagttttaaaattg

SEQ ID NO: 60601 - DNA, 75 bp, Artificial Sequence
  Synthetic
aaattgtaatttagtgttagaaataatttgttatgtgaaatatattattagtttttggtatgagagtattagttt

SEQ ID NO: 60602 - DNA, 75 bp, Artificial Sequence
  Synthetic
tagtaatttttttttaatatttatgtaattagagttaatttagtttttaaattttaatttaatatatgaattagg

SEQ ID NO: 60603 - DNA, 75 bp, Artificial Sequence
  Synthetic
gtaatgatttagttgtgatggttgttatagatatgattatttaagttataatagataggaaaagttattatttat

SEQ ID NO: 60604 - DNA, 75 bp, Artificial Sequence
  Synthetic
attattaatataattgatagggtgttttagaaattttgaattggtgtttttaattttgtgtattggaagagttaa

SEQ ID NO: 60605 - DNA, 75 bp, Artificial Sequence
  Synthetic
taaattgattttaaatgtggttttttgtatattgtttttatatttgtattgattttgatatatatttggttattt

SEQ ID NO: 60606 - DNA, 75 bp, Artificial Sequence
  Synthetic
aaaattttgggtctgctcaagcaaggccccaaaagtattccaaaggaggtcagcattcaaaataatgggcatttg

SEQ ID NO: 60607 - DNA, 75 bp, Artificial Sequence
  Synthetic
aaaatatttttagagtttttggtgtagttagaattagattgaattagatttgaaatttttaggaaatatattgat

SEQ ID NO: 60608 - DNA, 75 bp, Artificial Sequence
  Synthetic
taggttggtgagttggtttataagttttattttagtattatttatttggtgtagatataaagtttgaattaggaa

SEQ ID NO: 60609 - DNA, 75 bp, Artificial Sequence
  Synthetic
tggagaggtaggaaatctcggaagactcaagaccataatgatttctcaagtggggatggaacattcacagaaccc

SEQ ID NO: 60610 - DNA, 75 bp, Artificial Sequence
  Synthetic
ttttttattgtatgtatagttatgtgtatgattaaattgatggtaaatatttataagttttggtagtaagtataa

SEQ ID NO: 60611 - DNA, 75 bp, Artificial Sequence
  Synthetic
gtgcgtaagttctcaagcaatcatcagtcagatgagaagtactacaaagtgacatgtggaaagtcaccgaaaccg

SEQ ID NO: 60612 - DNA, 75 bp, Artificial Sequence
  Synthetic
tttatggtgttatgtagaattatttttaagagtttgtataattaatttaaattttagataattatttattagttt

SEQ ID NO: 60613 - DNA, 75 bp, Artificial Sequence
  Synthetic
caagaacgcaaagacttctcgcaacacagactcagcaataacgggcaaacaatgagtaatcatcgtaagaaaggg

SEQ ID NO: 60614 - DNA, 75 bp, Artificial Sequence
  Synthetic
aatgagtaatcatcgtaagaaagggaagttccacaagtggaatccctgcaaagtgttaatggagagtcaaagggg

SEQ ID NO: 60615 - DNA, 75 bp, Artificial Sequence
  Synthetic
agttatttgttttttggatgtttttatgaaatgataagtttgggtttgattttgttgtagttgattataattagt

SEQ ID NO: 60616 - DNA, 75 bp, Artificial Sequence
  Synthetic
tattaatttttggattttagtttggaggagggtaaggtgttttgttatagaaattaatggtttattttttgaatt

SEQ ID NO: 60617 - DNA, 75 bp, Artificial Sequence
  Synthetic
aataaggttatatttatgatataggattttttttaatgaaggaaaattaaatgtaatataattattgtgtaattt

SEQ ID NO: 60618 - DNA, 75 bp, Artificial Sequence
  Synthetic
cattctaccattttttaaattgggaaatcacaatcatgcacatggtcaagatgaccaagaattgatgaatcaaaa

SEQ ID NO: 60619 - DNA, 75 bp, Artificial Sequence
  Synthetic
atttgtggtgtatttggtaagatgatttagttaatatgattttttttgtatttgttgttgaagagtatattgtat

SEQ ID NO: 60620 - DNA, 75 bp, Artificial Sequence
  Synthetic
attgtagattcacagggattgtctcatccatgcattacaaattagacgaagttcttatggaatacaatagtttcg

SEQ ID NO: 60621 - DNA, 75 bp, Artificial Sequence
  Synthetic
gatatggagatagtttgtttgggtttgatgttgagtagtttttaaggttgaaagtagattagataagtataaata

SEQ ID NO: 60622 - DNA, 75 bp, Artificial Sequence
  Synthetic
ttatttatttgattttgtatttgatgttataggtttgattaaatattttgatttaaatataggagtaagataatt

SEQ ID NO: 60623 - DNA, 75 bp, Artificial Sequence
  Synthetic
gttaatttagtatattttatttaaattgttgaggaagatttttaagatgattatttttaaagttttaggattgat

SEQ ID NO: 60624 - DNA, 75 bp, Artificial Sequence
  Synthetic
atgattataaataattgtatatattgttttatataatttggaatgatttaagttttttgtagttttagtatttat

SEQ ID NO: 60625 - DNA, 75 bp, Artificial Sequence
  Synthetic
ggtaataatattagtattatttggaattttatttttttgatttgaaaattaattttgatgtgtaatattagttat

SEQ ID NO: 60626 - DNA, 75 bp, Artificial Sequence
  Synthetic
ttgattagttgagttatttaatatgatttttagtttattatgatgtgttttaggtataattgggagtagtatttt

SEQ ID NO: 60627 - DNA, 75 bp, Artificial Sequence
  Synthetic
tggagtggtgtaatttgatattattttatttttaatattatgtttagtagtaagtgtatttaaaaataatttttt

SEQ ID NO: 60628 - DNA, 75 bp, Artificial Sequence
  Synthetic
caaagtatttctgagtgatatagaaggaatattatggattaatgattacttggctccactgttcggagctggtta

SEQ ID NO: 60629 - DNA, 75 bp, Artificial Sequence
  Synthetic
ggaatattatggattaatgattacttggctccactgttcggagctggttacttgattaagccgattacatcaagt

SEQ ID NO: 60630 - DNA, 75 bp, Artificial Sequence
  Synthetic
aatgttgtatttttggattagtagtaaggtatttgaattttttttttttgttagggttatagttgatttaaattt

SEQ ID NO: 60631 - DNA, 75 bp, Artificial Sequence
  Synthetic
attatatttttatagtattttatttaatttataatgtattgatgaaataattttagtgaagtgataatatatggt

SEQ ID NO: 60632 - DNA, 75 bp, Artificial Sequence
  Synthetic
aggcgtgtactggttgagtcacatcgcacagtatgctacaaagaatctccattgtgaatacatatgccttggttt

SEQ ID NO: 60633 - DNA, 75 bp, Artificial Sequence
  Synthetic
agtattaattatggtttttaaatgttgaagtaatttttttatattattgtggttttttttaggagaaggtttgat

SEQ ID NO: 60634 - DNA, 75 bp, Artificial Sequence
  Synthetic
gttgtattttttattttttgttaatttaaagaatggtattattaaatgatgtggattggatgggaattttttggt

SEQ ID NO: 60635 - DNA, 75 bp, Artificial Sequence
  Synthetic
attgtgatttttatttaaatgtgtatttgttaattttttttggtgggttgttgaatttttatatatttttgtagg

SEQ ID NO: 60636 - DNA, 75 bp, Artificial Sequence
  Synthetic
aggtttggttgttgatgttggagtggatttatttttgggtggaaattttgtggtggttgttttgttgtttttaga

SEQ ID NO: 60637 - DNA, 75 bp, Artificial Sequence
  Synthetic
gtttttttggattatttgtttaattttggtaggaatgaaagtattattgtttttattaaggtttaggttaggtgg

SEQ ID NO: 60638 - DNA, 75 bp, Artificial Sequence
  Synthetic
ttgattagaattttttagtggtaaaatgatatgtggagttgttgttgtgttagttgtatttatagtttttttagg

SEQ ID NO: 60639 - DNA, 75 bp, Artificial Sequence
  Synthetic
taatcgattttatcatactcacggttgcgaatgtcaggaaaaattctttgtccagacgctttatttacaacgcct

SEQ ID NO: 60640 - DNA, 75 bp, Artificial Sequence
  Synthetic
tttatgttgatttttttagtaagttaatgatgtatggaaaaaattgtttgttgtatttttgtaattataaattag

SEQ ID NO: 60641 - DNA, 75 bp, Artificial Sequence
  Synthetic
atttgaagagtatttttttttagattttgaaagtatagagtttttatttttattatttttagttttaataattag

SEQ ID NO: 60642 - DNA, 75 bp, Artificial Sequence
  Synthetic
agattttatttggtttaaaaatttgttaggaggattagagtgttggtttttgagaggatagataatttatagtgg

SEQ ID NO: 60643 - DNA, 75 bp, Artificial Sequence
  Synthetic
ctattctaagtatatcgaaagagagtatgccaatcttaattattaaaggtaacaagctattatttactacttatt

SEQ ID NO: 60644 - DNA, 75 bp, Artificial Sequence
  Synthetic
gatgtttgtttttttaaagataatttattttttaataaagtttaagaaagttgaaattgtaatttggagaaataa

SEQ ID NO: 60645 - DNA, 75 bp, Artificial Sequence
  Synthetic
ttttgtagtgtttgataatttatggttatttgtagttttattaatatatattgagaagttggggtttatatttat

SEQ ID NO: 60646 - DNA, 75 bp, Artificial Sequence
  Synthetic
ttagaatgtactatcagagaaatggccccagttcctatctttaaataatgattgtgtgttttaaattattatttt

SEQ ID NO: 60647 - DNA, 75 bp, Artificial Sequence
  Synthetic
taatttggatatgatatttgagtgtttaaatgttggtttgaagatttgaagggatttatgtgataagttgtggat

SEQ ID NO: 60648 - DNA, 75 bp, Artificial Sequence
  Synthetic
attaggtttatgagttggtcacacagtgagtatcagtgattgaggattatgtagataggtaatctaacactgaat

SEQ ID NO: 60649 - DNA, 75 bp, Artificial Sequence
  Synthetic
gtagataggtaatctaacactgaatcacctatctgatgtcaccataccctaatgttgtgctagttgcatttaaac

SEQ ID NO: 60650 - DNA, 75 bp, Artificial Sequence
  Synthetic
ttgattttggagatagtatagaaattttgtgagtttgattttttttgtgtatagaatagtattatttaaataaaa

SEQ ID NO: 60651 - DNA, 75 bp, Artificial Sequence
  Synthetic
atttatgagggttttaaaattgtatagaagttttattttgggatatgttaagaagtgggttgtgaaggattttgt

SEQ ID NO: 60652 - DNA, 75 bp, Artificial Sequence
  Synthetic
ttgaacttcaaaatgattaaatgataatgatcttgggaactcaatatgacctcaagtcaaaaataatgtcaatat

SEQ ID NO: 60653 - DNA, 75 bp, Artificial Sequence
  Synthetic
tttattgttgttaatgggatttgttgatgaattgttattattagagattattgattgtaagattgtttttgttaa

SEQ ID NO: 60654 - DNA, 75 bp, Artificial Sequence
  Synthetic
aattatttagtaatatgagtgataatgtaaattttgataattaactaactgtagtaattaaggtcaaatgcaaac

SEQ ID NO: 60655 - DNA, 75 bp, Artificial Sequence
  Synthetic
tttttagttggataaatgtggtaattgtattaagttatttttaataatatttaaatgtgggttttttattaaagg

SEQ ID NO: 60656 - DNA, 75 bp, Artificial Sequence
  Synthetic
cggacacacaaaaagaatgaaggattttgaatctttattgtgtgcgagtaactacgaggaagattaaagattttc

SEQ ID NO: 60657 - DNA, 75 bp, Artificial Sequence
  Synthetic
aatatgagtgataatgtaaattttgataattaactaactgtagtaattaaggtcaaatgcaaacattataagaat

SEQ ID NO: 60658 - DNA, 75 bp, Artificial Sequence
  Synthetic
attgttaattgataagttgtagttgagatttttttttagtggatttgaattataaattagtttattattatggta

SEQ ID NO: 60659 - DNA, 75 bp, Artificial Sequence
  Synthetic
ctctcattgaaattgaaattgagattctaatctcgacggatcgatccccaataccaacactgagaattggcctga

SEQ ID NO: 60660 - DNA, 75 bp, Artificial Sequence
  Synthetic
tttatttaaatttagatttagtgtggttgtgtatgttaagtattgggttggtattttttttgtataataatttgt

SEQ ID NO: 60661 - DNA, 75 bp, Artificial Sequence
  Synthetic
agaagtcatctgctccttggcaaaaccaagagcaggcccaaagggccattaggccacatctgttgagcctgcaga

SEQ ID NO: 60662 - DNA, 75 bp, Artificial Sequence
  Synthetic
taggtgaatatgggttttgtgatattgaatagaagatgtataagtgttttgaaatttaatgttatataaggttat

SEQ ID NO: 60663 - DNA, 75 bp, Artificial Sequence
  Synthetic
acacgcaggacttacttagcagaagagagcgcgtgccgaagccagccaacaaattgacacagctgctcactctga

SEQ ID NO: 60664 - DNA, 75 bp, Artificial Sequence
  Synthetic
tgtaaagttaattatattttgaaatataatgttgttattatgtgtagtttgattttttttggaaaatttttttag

SEQ ID NO: 60665 - DNA, 75 bp, Artificial Sequence
  Synthetic
ccctgaattcataaacaatattaagttgacaacagagatactaatccaatatttggatcaagaatcaaaatagtg

SEQ ID NO: 60666 - DNA, 75 bp, Artificial Sequence
  Synthetic
tgtgttggtagatattattaagtgtgttgttgtgttatttatgtggttagttataaaggagtgagggttatattg

SEQ ID NO: 60667 - DNA, 75 bp, Artificial Sequence
  Synthetic
aaacgactgactatccctccttagaattagcaaagatccttttgtagactattgtgctacattttctatccaaga

SEQ ID NO: 60668 - DNA, 75 bp, Artificial Sequence
  Synthetic
attattatattgatgtataatattattggagtaatgtgagggggttatttgaagaattttttgtatatttaagtt

SEQ ID NO: 60669 - DNA, 75 bp, Artificial Sequence
  Synthetic
cctcaaaatggatcctcgtccaatcagaacctggatgatgcataacacatctgaagttgaagcagactaccataa

SEQ ID NO: 60670 - DNA, 75 bp, Artificial Sequence
  Synthetic
tatttttgttttaagaaaagggtgaattaattgattgttgtttgtattattttgagtgatttaggttaatttaga

SEQ ID NO: 60671 - DNA, 75 bp, Artificial Sequence
  Synthetic
gattttaactgccggattgtccgtccagcaaggcattgtgagacaaagaatcattcctgtttaccaaatctcaaa

SEQ ID NO: 60672 - DNA, 75 bp, Artificial Sequence
  Synthetic
ggttaatttaatagttttttttaatgtagttgatgggtattttggtttaatagtgggttgatttattttgttttt

SEQ ID NO: 60673 - DNA, 75 bp, Artificial Sequence
  Synthetic
cctggaggaagtatgtcaactcatcatacaggcattcgaggccggtgtcgacttccaggatagtgcagatagctt

SEQ ID NO: 60674 - DNA, 75 bp, Artificial Sequence
  Synthetic
agtttttgagtttatgtagggaattttattattaattgtttattttaatttagatgtattaggttaagtattaat

SEQ ID NO: 60675 - DNA, 75 bp, Artificial Sequence
  Synthetic
tttgttaatgctatgtctgcatcatgcctatcaaggggattataaacaatttttggaaagtaatgcggtaaaata

SEQ ID NO: 60676 - DNA, 75 bp, Artificial Sequence
  Synthetic
tatgtttttttttaatgtaattgatatatatggattagaattgtttgtggatgaatattttatatattgtttgta

SEQ ID NO: 60677 - DNA, 75 bp, Artificial Sequence
  Synthetic
ccttgaaggtcatggattccgttttgagatgaagaaaaaggaaggtgtcaagcgcctggaggaactactccctgc

SEQ ID NO: 60678 - DNA, 75 bp, Artificial Sequence
  Synthetic
aggttttaattatgtggtttggaattgtttaggtatatatggtagtgttgtttttattaattgtttattattaag

SEQ ID NO: 60679 - DNA, 75 bp, Artificial Sequence
  Synthetic
tgcctcgagtggaaagaacatcaagagaacattggctgcaatgcccgaggaggaaacaacagaagcaaatgctgg

SEQ ID NO: 60680 - DNA, 75 bp, Artificial Sequence
  Synthetic
gatatgagtttaggagtattttttaagaatttgagtaatattaatagtatatttaattggttgaattgtttttat

SEQ ID NO: 60681 - DNA, 75 bp, Artificial Sequence
  Synthetic
acaatttctttcatttgctagtctgtttctcccaaaattggttgtcggagaaaaggcctgtctggagaaggttca

SEQ ID NO: 60682 - DNA, 75 bp, Artificial Sequence
  Synthetic
taaagttgggttataatggtttaggtaattaaattatagattttatttttgaagtgttatttttttgagtttttt

SEQ ID NO: 60683 - DNA, 75 bp, Artificial Sequence
  Synthetic
acgacaaatccaagtgcacgcagaacaaggtctgattcaatatccgacatcttggcaatcggtgggacatatgat

SEQ ID NO: 60684 - DNA, 75 bp, Artificial Sequence
  Synthetic
taagattggtgtttttgtattattgtttattattttggatgttaataaagttttggtttttttgaggtattttaa

SEQ ID NO: 60685 - DNA, 75 bp, Artificial Sequence
  Synthetic
ggtcatcttcagactaatgcgaaccaacttcctgattaagttcctcctaatacatcagggaatgcatatggttgc

SEQ ID NO: 60686 - DNA, 75 bp, Artificial Sequence
  Synthetic
gatttgtaatttttttttgtttggtgtttgtgagaaaatattggttgtaaaatggtttattatgggtgttgaaga

SEQ ID NO: 60687 - DNA, 75 bp, Artificial Sequence
  Synthetic
agggcatgatgctaatgatgccgtcattgccaactctgtagctcaagctcgtttctccggattgttgatagtcaa

SEQ ID NO: 60688 - DNA, 75 bp, Artificial Sequence
  Synthetic
aagtaattatttatatattaatttgtttttaagatttgtagaagtgtgaaataatgtgttgattaatttgttttt

SEQ ID NO: 60689 - DNA, 75 bp, Artificial Sequence
  Synthetic
aacagtgcttgatcatatcctccaaaaaacagagcacggagttcgcctgcatcccttggcgcgaacagccaaagt

SEQ ID NO: 60690 - DNA, 75 bp, Artificial Sequence
  Synthetic
tgttgaaagtgtgatattttttttgataatttgatgaaggaaagatgttaaattttgtgatttagggatatttaa

SEQ ID NO: 60691 - DNA, 75 bp, Artificial Sequence
  Synthetic
caaaaatgaggtaagctcttttaaggccgctttagcctcactagcacaacatggagaatatgccccgttcgctcg

SEQ ID NO: 60692 - DNA, 75 bp, Artificial Sequence
  Synthetic
tttgtttgggtttagaataaagttaattgtgttataattttttgggttttttgtaataagtgtatgaaagatatt

SEQ ID NO: 60693 - DNA, 75 bp, Artificial Sequence
  Synthetic
tctgctgaatctatctggggttaacaatcttgagcatgggcttttccctcaactttctgcaattgctttgggagt

SEQ ID NO: 60694 - DNA, 75 bp, Artificial Sequence
  Synthetic
atttatatttattattgatagataatgttttaattgaaataggtttgaagttataggattatttaagttgtgata

SEQ ID NO: 60695 - DNA, 75 bp, Artificial Sequence
  Synthetic
agcaactgcacatgggagcactctggcaggagtcaatgtaggagagcaataccaacaactgcgagaagcagccac

SEQ ID NO: 60696 - DNA, 75 bp, Artificial Sequence
  Synthetic
aaggtatttttttggatttaggaaggataatttatttaatatttgaggaattgttaaggatagtgtaatggtttt

SEQ ID NO: 60697 - DNA, 75 bp, Artificial Sequence
  Synthetic
tgaggccgaaaagcagttgcagaaatatgctgaatctcgtgaacttgatcacctaggtcttgatgatcaggaaaa

SEQ ID NO: 60698 - DNA, 75 bp, Artificial Sequence
  Synthetic
gaaattaagaggtttattgattgttaattgtttaaggtttgaatttttatggaaattaaggtgatgatgttgtaa

SEQ ID NO: 60699 - DNA, 75 bp, Artificial Sequence
  Synthetic
gaaaatcctaaaagacttccatcagaaaaagaatgagatcagcttccagcagacgacagccatggtcacactgcg

SEQ ID NO: 60700 - DNA, 75 bp, Artificial Sequence
  Synthetic
aaaaagaatgagatcagcttccagcagacgacagccatggtcacactgcggaaagagagattggccaaattgact

SEQ ID NO: 60701 - DNA, 75 bp, Artificial Sequence
  Synthetic
gatttgaatagagaaatatgtatgaaaggtagttgtaatatggtatggtaaaatatgtttagttttggagattga

SEQ ID NO: 60702 - DNA, 75 bp, Artificial Sequence
  Synthetic
gaagctattacttccacctccatcctcaaaacaggaaggcggtatgatgatgacaatgacataccctttccaggg

SEQ ID NO: 60703 - DNA, 75 bp, Artificial Sequence
  Synthetic
ttgtttaaaggtagtttttatattggtaagtgtattttgtaagttattaaaaattgtatttgagagaggggttat

SEQ ID NO: 60704 - DNA, 75 bp, Artificial Sequence
  Synthetic
ccaatcaatgataacgagaactctggtcagaacgatgacgatccaacagactcccaggataccacaatcccggat

SEQ ID NO: 60705 - DNA, 75 bp, Artificial Sequence
  Synthetic
tttagttgttgttttgagtgattgaggtaattgaattttgtttaagtattgttttttgttaaaatagataaagtt

SEQ ID NO: 60706 - DNA, 75 bp, Artificial Sequence
  Synthetic
gtaataatcgatccaaacgatggtgggtataataactacagcgattatgcaaatgatgctgcaagtgctcctgat

SEQ ID NO: 60707 - DNA, 75 bp, Artificial Sequence
  Synthetic
tgagtgtatgaaagttttattaggtttgaggaatattttataggtatttgtgattttggttaagttagtagttat

SEQ ID NO: 60708 - DNA, 75 bp, Artificial Sequence
  Synthetic
gacctagttctttttgaccttgaggacgaggatgatgctgataacccggctcagaacacgccagaaaaaaatgat

SEQ ID NO: 60709 - DNA, 75 bp, Artificial Sequence
  Synthetic
tttggttgtattgttttttgtgtattttttttgtttatttggattagattttagtggaaagattgataatattgt

SEQ ID NO: 60710 - DNA, 75 bp, Artificial Sequence
  Synthetic
tcagaacacgccagaaaaaaatgatagaccagcaacaacaaagctgagaaatggacgggaccaggatggaaacca

SEQ ID NO: 60711 - DNA, 75 bp, Artificial Sequence
  Synthetic
agaccagcaacaacaaagctgagaaatggacgggaccaggatggaaaccaaagcgaaactgcatccccacgggca

SEQ ID NO: 60712 - DNA, 75 bp, Artificial Sequence
  Synthetic
aatatattgattattttttatgattgttgattgtaatttgaatttggttttgatttttattaatgagatttgagt

SEQ ID NO: 60713 - DNA, 75 bp, Artificial Sequence
  Synthetic
gcccccaaccaatacagagacaagccaatgccacaagtacagagcagatccgaaaatcatgaccaaacccttcaa

SEQ ID NO: 60714 - DNA, 75 bp, Artificial Sequence
  Synthetic
atatgagatattagtttataatttttgttgaagttttttaatattgttaaggtggtttttataagtatttggttt

SEQ ID NO: 60715 - DNA, 75 bp, Artificial Sequence
  Synthetic
acacagcccagggttttgactcctatcagcgaggaagcagaccccagcgaccacaacgatggcgacaatgaaagc

SEQ ID NO: 60716 - DNA, 75 bp, Artificial Sequence
  Synthetic
tttggggggatattttttattttttaaggttatattatgtggtgggttataataattattaatatgtatgtaata

SEQ ID NO: 60717 - DNA, 75 bp, Artificial Sequence
  Synthetic
attcctcccctggaatcagacgacgagggtagcactgatactactgcagcagaaacaaagcctgccactgcacct

SEQ ID NO: 60718 - DNA, 75 bp, Artificial Sequence
  Synthetic
ttgtggaattaggaagtgtatttaattaaagatattgtgaattttatagtattggttgtaatatttgatgaaggg

SEQ ID NO: 60719 - DNA, 75 bp, Artificial Sequence
  Synthetic
cccgctcccgtctaccgaagtatctccgtagatgattctgtccccttagagaacattcccgcacagtccaatcaa

SEQ ID NO: 60720 - DNA, 75 bp, Artificial Sequence
  Synthetic
agttgtgaatttatatttgaaggttagattgtatttttttaggtttgtgataaaattatttttatgaattgtggt

SEQ ID NO: 60721 - DNA, 75 bp, Artificial Sequence
  Synthetic
acgaacaatgaggacaatgtcaggaacaatgcccagtcggagcaatccattgcagaaatgtatcaacatatcttg

SEQ ID NO: 60722 - DNA, 75 bp, Artificial Sequence
  Synthetic
atgttttttgaaattattatttgtatggtgttaggatgtttggtgaaggaggttttttttttgttttttttttgt

SEQ ID NO: 60723 - DNA, 75 bp, Artificial Sequence
  Synthetic
aaaacacaaggaccttttgatgccatcctttactaccatatgatgaaagaagagcccatcattttcagcactagt

SEQ ID NO: 60724 - DNA, 75 bp, Artificial Sequence
  Synthetic
gataattattatattgtttggaaaggttttagttaaattatttgtaagtaatgttttgtagagggtttggatatt

SEQ ID NO: 60725 - DNA, 75 bp, Artificial Sequence
  Synthetic
gatgggaaggagtatacatatccagactctcttgaagatgaatatccaccctggctcagcgagaaggaagccatg

SEQ ID NO: 60726 - DNA, 75 bp, Artificial Sequence
  Synthetic
tttggttaaataaggtaattttttaaatgttttattaatatttaatttttttttttttaatgaaaaagaaaaatt

SEQ ID NO: 60727 - DNA, 75 bp, Artificial Sequence
  Synthetic
aatgaagacaatagattcataaccatggatggtcagcagttttactggcctgtgatgaatcatagaaataaattc

SEQ ID NO: 60728 - DNA, 75 bp, Artificial Sequence
  Synthetic
tggatggtcagcagttttactggcctgtgatgaatcatagaaataaattcatggcaatcctccaacatcacaggt

SEQ ID NO: 60729 - DNA, 75 bp, Artificial Sequence
  Synthetic
ttgattttggggtaataagtatttaagtttttgggtgtattgtaagatatttttaatagaaaaatttttttgttt

SEQ ID NO: 60730 - DNA, 75 bp, Artificial Sequence
  Synthetic
gacccgacctctaaaactgagctcttaactacaagctaccccatcactctgccggaatgccagaacctccctcca

SEQ ID NO: 60731 - DNA, 75 bp, Artificial Sequence
  Synthetic
taggaattgtttaggtatatgtttggtattgaattgataaggtggattgtagtttaaaatgttaggtttaaaaat

SEQ ID NO: 60732 - DNA, 75 bp, Artificial Sequence
  Synthetic
gccggaatgccagaacctccctccaaaacagctccacatcgagaacctccgacgtggtacacaggcaagacaggc

SEQ ID NO: 60733 - DNA, 75 bp, Artificial Sequence
  Synthetic
tgtattttaataggtttgtttaattgttgttgtgtggtttttaatgaaaatgttgaggttattaatgatttttgt

SEQ ID NO: 60734 - DNA, 75 bp, Artificial Sequence
  Synthetic
aacccaatgatgttcctgttcacctacaaccgcaaccaacacttgatcgacttccaagacaactacaaccccctt

SEQ ID NO: 60735 - DNA, 75 bp, Artificial Sequence
  Synthetic
ggagaataatggaggatgatttaaatggtaaaatttttataaaagatttttgattattggaagtggagggaattg

SEQ ID NO: 60736 - DNA, 75 bp, Artificial Sequence
  Synthetic
cttccaagacaactacaacccccttagccaactccaccacagaagcactaccccataacaacaaccccaaatcaa

SEQ ID NO: 60737 - DNA, 75 bp, Artificial Sequence
  Synthetic
attttgtttaatgtaggaatttaattttggtgttaaatattggtttgatattatattgtattaagtgttttgatt

SEQ ID NO: 60738 - DNA, 75 bp, Artificial Sequence
  Synthetic
cgacactgcatgtaagtattgtctcaccccaagatgctccctggacaccaacaaccccctaacctccccaagttg

SEQ ID NO: 60739 - DNA, 75 bp, Artificial Sequence
  Synthetic
attaaagaaatgttttgtaatattatatttgaatatataatatgttttaaagatgataattggttgtaatgtttt

SEQ ID NO: 60740 - DNA, 75 bp, Artificial Sequence
  Synthetic
tcattaagaaaaaatatatgatgaagattaaaaccttcatcggagctatttcttctacgcttggttaggaccagt

SEQ ID NO: 60741 - DNA, 75 bp, Artificial Sequence
  Synthetic
tagaattgttgtatgatttttaattttttggatggtttttttattatgtagaattgggtggttttagtgtttttg

SEQ ID NO: 60742 - DNA, 75 bp, Artificial Sequence
  Synthetic
attcacaaactattttacaatccctacccaatatgacctctaacagagcaagggtgacttacaacccaccaccaa

SEQ ID NO: 60743 - DNA, 75 bp, Artificial Sequence
  Synthetic
gattgaaaataatttatataattgttgtggtgtagattggagtttgagtaatagttggtgaaatttgtggatttt

SEQ ID NO: 60744 - DNA, 75 bp, Artificial Sequence
  Synthetic
caaccacaggcacacgatcgtgtgggccggaactttccgggtggatctctgagcaattgatgacaggcaagattc

SEQ ID NO: 60745 - DNA, 75 bp, Artificial Sequence
  Synthetic
agataattgtgatttttttaattttttattaaggaggagtttatgtaatgtttgaataattgtaagatgtatttg

SEQ ID NO: 60746 - DNA, 75 bp, Artificial Sequence
  Synthetic
cgattaccgatatcttcaatgaaattgaaaccttacctagtataagtccctcgatccactccaaaatcaaaaccc

SEQ ID NO: 60747 - DNA, 75 bp, Artificial Sequence
  Synthetic
ggttaaaaattgttttttttgttttgtatattgggaatatagttgaattttagttaaatatagaggtttgagata

SEQ ID NO: 60748 - DNA, 75 bp, Artificial Sequence
  Synthetic
caagtgttcaaacacgcagtgtccagacccaaactgacccaaattgtaatcatgattttgcagaggttgtgaaaa

SEQ ID NO: 60749 - DNA, 75 bp, Artificial Sequence
  Synthetic
tttgattattttgtatttttttgattttaatatggataataggtagttttttgtgttatatagagattgaatatt

SEQ ID NO: 60750 - DNA, 75 bp, Artificial Sequence
  Synthetic
tgctaacatctctaacccttgtcgtacaaaaacaaacccttgcaactgaatcacttgagcaacgcattaccgacc

SEQ ID NO: 60751 - DNA, 75 bp, Artificial Sequence
  Synthetic
atttattagtggataattagtagatattggattttttaatttggttaatttagtaattagaagggtattaaaatg

SEQ ID NO: 60752 - DNA, 75 bp, Artificial Sequence
  Synthetic
tggaaggtagcctgaaaccagtgtctgagatcaccaagattgtttctgcactaaatagatcctgtgcagagatgg

SEQ ID NO: 60753 - DNA, 75 bp, Artificial Sequence
  Synthetic
atttgtgataagatttttatatataataaggattttggttgtagagattgaaataatatgtgtgtgtttttgaat

SEQ ID NO: 60754 - DNA, 75 bp, Artificial Sequence
  Synthetic
tggccaaatatgatcttctagtaatgacaactggtcgtgcaactgccactgctgcagctactgaagcatactggg

SEQ ID NO: 60755 - DNA, 75 bp, Artificial Sequence
  Synthetic
agtttttttgaagatattaggttggtattagttagttgatgtatgtggaatattagttgtgtttattggtaatag

SEQ ID NO: 60756 - DNA, 75 bp, Artificial Sequence
  Synthetic
cagaacatggacgtcctccaccggggccctcattgtacgaagaggatgcaatcaggactaaaattgaaaaacaag

SEQ ID NO: 60757 - DNA, 75 bp, Artificial Sequence
  Synthetic
agtaatagggattttttagaagatataattattatattttagaatgttaataattttatttgttataaattaagt

SEQ ID NO: 60758 - DNA, 75 bp, Artificial Sequence
  Synthetic
gggatatagtacccaaggaagtgcaagaggccttccgtaatctggatagtactgcccttctaacggaagagaatt

SEQ ID NO: 60759 - DNA, 75 bp, Artificial Sequence
  Synthetic
ggagtgtatatttttttggtttatttttttttgatgggtgaggatggtaagattatgttagaagaatagagtaga

SEQ ID NO: 60760 - DNA, 75 bp, Artificial Sequence
  Synthetic
ttgggaaaccagacatatccgcaaaagacttgcgcaatatcatgtatgatcacctcccaggttttggcacagcat

SEQ ID NO: 60761 - DNA, 75 bp, Artificial Sequence
  Synthetic
tagatatttgtttttgtgaatgattttatgaatgttttgttttaattgatttgtaattatttttttttgtgtttt

SEQ ID NO: 60762 - DNA, 75 bp, Artificial Sequence
  Synthetic
ttcatcaactagtgcaagttatctgcaagttagggaaggacaattcctcacttgatgtaattcatgcagaatttc

SEQ ID NO: 60763 - DNA, 75 bp, Artificial Sequence
  Synthetic
aatttgatttatgtaataattaaggaaggttgtattttgtatggtataattgattattttatttaagaaatttaa

SEQ ID NO: 60764 - DNA, 75 bp, Artificial Sequence
  Synthetic
aggccagccttgctgaaggagactctcctcagtgtgccctgattcagataaccaaacggattcctattttccaag

SEQ ID NO: 60765 - DNA, 75 bp, Artificial Sequence
  Synthetic
accaaacggattcctattttccaagatgcagcaccacccgtaatccatattcgttcacgcggtgatataccaaag

SEQ ID NO: 60766 - DNA, 75 bp, Artificial Sequence
  Synthetic
gtagggaggttttaatggtatatttttattatttgttagaatatttattaatattggagtaatgtagtttattgg

SEQ ID NO: 60767 - DNA, 75 bp, Artificial Sequence
  Synthetic
gcgtgtcaaaagagcctccgcccagttccaccatcaccaaagattgataggggttgggtatgcatattccagcta

SEQ ID NO: 60768 - DNA, 75 bp, Artificial Sequence
  Synthetic
gattgtagttatagggatattattaataaattgtaaaataatagtgttatattttaatttatagatatgttttgg

SEQ ID NO: 60769 - DNA, 75 bp, Artificial Sequence
  Synthetic
caagacggaaaaacactcggactcaaaatctaaggtgaacaattgcacaacctccacagtcgcctatattgcttc

SEQ ID NO: 60770 - DNA, 75 bp, Artificial Sequence
  Synthetic
aaatctaaggtgaacaattgcacaacctccacagtcgcctatattgcttccttccggaattagggtatgatcgcg

SEQ ID NO: 60771 - DNA, 75 bp, Artificial Sequence
  Synthetic
taaatggtatgtttttagtttagggtttagtgaatatttagagtaaagtttatatgtttttgttattaggttata

SEQ ID NO: 60772 - DNA, 75 bp, Artificial Sequence
  Synthetic
ttggtttaagataattggggaagataattttgtattaggatattgtgtatgttgggtagttattataaaatagag

SEQ ID NO: 60773 - DNA, 75 bp, Artificial Sequence
  Synthetic
taaaaaataagcttccaacatattgatatacgatccatacccataatgccatctccaggaatatgagaacgcaag

SEQ ID NO: 60774 - DNA, 75 bp, Artificial Sequence
  Synthetic
gaattgaaaaagttttatggtggtaaggattgtttttttagtattatggatttttttttaattttttttgtttta

SEQ ID NO: 60775 - DNA, 75 bp, Artificial Sequence
  Synthetic
gccatatcaggacccgatctcaattccaatgcaacctactgttaagaataaaataaccaatgtcctctagcctca

SEQ ID NO: 60776 - DNA, 75 bp, Artificial Sequence
  Synthetic
ttaataaatttagatttttattgtgttaatttgggtttattatattgtaaatagtgaatagatgttgtgagtgaa

SEQ ID NO: 60777 - DNA, 75 bp, Artificial Sequence
  Synthetic
tatgttctcaaaaatacaagtgatgaagattaagaaaaagcatcctttacttgagaggagctaattctttatact

SEQ ID NO: 60778 - DNA, 75 bp, Artificial Sequence
  Synthetic
attggattttatattgttttgattattttttgaatatggaaagttatatattatattaattgttagattaagtat

SEQ ID NO: 60779 - DNA, 75 bp, Artificial Sequence
  Synthetic
tcatctaatctttaagtaagttgatcattaccaccatgaggagggcaattctacctactgcaccgccagaataca

SEQ ID NO: 60780 - DNA, 75 bp, Artificial Sequence
  Synthetic
cattaccaccatgaggagggcaattctacctactgcaccgccagaatacatggaggctgtctacccaatgagaac

SEQ ID NO: 60781 - DNA, 75 bp, Artificial Sequence
  Synthetic
taattaaaggtatgattagggttatgttatataggtgattatatatgtaaaagtaaaaaattgaatgaggatatt

SEQ ID NO: 60782 - DNA, 75 bp, Artificial Sequence
  Synthetic
ctacctactgcaccgccagaatacatggaggctgtctacccaatgagaacggttagtactaatatcagcagtacc

SEQ ID NO: 60783 - DNA, 75 bp, Artificial Sequence
  Synthetic
tccagtggtccgaactttccagcaccggatgtaatgatgagtgatacaccctccaactcactcagaccaattgct

SEQ ID NO: 60784 - DNA, 75 bp, Artificial Sequence
  Synthetic
tatagggatattaggggtttaaatagtatatttttgtaatattttaaataggttttttattaattattgtataaa

SEQ ID NO: 60785 - DNA, 75 bp, Artificial Sequence
  Synthetic
gatgataatatcgatcatccaagtcatacaccaaccagtgtttcatcagcctttatactcgaggcaatggtgaat

SEQ ID NO: 60786 - DNA, 75 bp, Artificial Sequence
  Synthetic
gagagattaaattaagattatataggaaaatgattttgttttatgatggattatggaattaatgttagttttatt

SEQ ID NO: 60787 - DNA, 75 bp, Artificial Sequence
  Synthetic
gtgatatcggggccgaaggtactaatgaagcaaattcctatatggctccccttgggtgttgctgatcaaaaaaca

SEQ ID NO: 60788 - DNA, 75 bp, Artificial Sequence
  Synthetic
gtataatttttattatggtaattaaattgttaaagaattgttgaattttatgattaatgaagtaatgtttgatgg

SEQ ID NO: 60789 - DNA, 75 bp, Artificial Sequence
  Synthetic
tatagttttgactcaactacagctgcaattatgctcgcatcgtacaccatcactcactttggcaaaacctccaat

SEQ ID NO: 60790 - DNA, 75 bp, Artificial Sequence
  Synthetic
tttaggagtggtaataggtttaagtgttgatttatgtagtaaggagaatttgataggattagggtgttgtatatt

SEQ ID NO: 60791 - DNA, 75 bp, Artificial Sequence
  Synthetic
ccgcttgtgagaatcaatcgacttggtcctgggatccctgatcacccgttgcggcttctaagaataggaaatcaa

SEQ ID NO: 60792 - DNA, 75 bp, Artificial Sequence
  Synthetic
tattgtagatttatttggtttttgaattttgataagataatttatattagttttggtaatgatgattgtatagtt

SEQ ID NO: 60793 - DNA, 75 bp, Artificial Sequence
  Synthetic
gccttcttgcaagagtttgtgctgcctccagtgcaattgccgcagtatttcacttttgacctgacggctctaaag

SEQ ID NO: 60794 - DNA, 75 bp, Artificial Sequence
  Synthetic
tggtgtttttattttaatattgtttagaagttttttgtaattaatgatatgaagagttttgagtttatttataaa

SEQ ID NO: 60795 - DNA, 75 bp, Artificial Sequence
  Synthetic
ctgatcactcaacctctcccggcagcaacctggacagatgatactccgaccggtcctacaggaatacttcgtcct

SEQ ID NO: 60796 - DNA, 75 bp, Artificial Sequence
  Synthetic
gttaataatatttgattttataagagataatatttttatgtttagttggttttttatttgttgagtttttatgtt

SEQ ID NO: 60797 - DNA, 75 bp, Artificial Sequence
  Synthetic
ggaatttcctttcatcccaaactgagacctatcctattgccagggaagaccgggaaaagaggatccagctccgat

SEQ ID NO: 60798 - DNA, 75 bp, Artificial Sequence
  Synthetic
gaagtgattagtagatgttgttagtaattaattagtaattaggtttagggtttttgatagtggtttaatgaggga

SEQ ID NO: 60799 - DNA, 75 bp, Artificial Sequence
  Synthetic
cttacttctcctgataaaatacaagcaataatgaactttctccaagacctcaaactcgtgccgattgatccagcc

SEQ ID NO: 60800 - DNA, 75 bp, Artificial Sequence
  Synthetic
atgatttattaattggttaagaattttggtggtaagaattatttttaaggtttaaatgggagtttggattttaga

SEQ ID NO: 60801 - DNA, 75 bp, Artificial Sequence
  Synthetic
aagaacattatgggtattgaagtgccggaactcttggtccacagactaactggaaagaaaatcacaacaaaaaat

SEQ ID NO: 60802 - DNA, 75 bp, Artificial Sequence
  Synthetic
ttgttggtttttgaataagtgtgggaagaggttttgggttattgtttatgtaggagtaaaattatttattttaag

SEQ ID NO: 60803 - DNA, 75 bp, Artificial Sequence
  Synthetic
ggtcaaccaataattcctattcttctaccaaagtatattggcatggatcccatttctcagggagacctcacaatg

SEQ ID NO: 60804 - DNA, 75 bp, Artificial Sequence
  Synthetic
atgatttaatagggtaatatttttttggttgatattaaatttaagtttagtttagtaaattttttatttttgtat

SEQ ID NO: 60805 - DNA, 75 bp, Artificial Sequence
  Synthetic
gtcatcactcaagactgtgacacttgccattctcctgctagtcttcctccagtcagcgagaaataagcatgaagt

SEQ ID NO: 60806 - DNA, 75 bp, Artificial Sequence
  Synthetic
agttggagttattaggaagttgtataggttgttaaatataattttttgttttagtttttgttttggtgttattaa

SEQ ID NO: 60807 - DNA, 75 bp, Artificial Sequence
  Synthetic
agtcagcgagaaataagcatgaagtccgaggctgcctggcccacacggcccccagggccttcgtccgaccaccga

SEQ ID NO: 60808 - DNA, 75 bp, Artificial Sequence
  Synthetic
gttgtattggtttgtggttttagttattttggttatttttaatggaattttaggtttgtaaaaggagtttttttt

SEQ ID NO: 60809 - DNA, 75 bp, Artificial Sequence
  Synthetic
accaaccatctgaccttcatcaaaaccaaaaaataccaccacgcgaaagctaaaatgcaggaccacaatccaacc

SEQ ID NO: 60810 - DNA, 75 bp, Artificial Sequence
  Synthetic
ataaaattaatggatttgtataataaaggttttttttgttatttttatttttgttataagatttgatttttaaat

SEQ ID NO: 60811 - DNA, 75 bp, Artificial Sequence
  Synthetic
agcaacaccatccatacacaggcatcaattgggctaccgcagcatatagacccaatagcaagctgctgtccagaa

SEQ ID NO: 60812 - DNA, 75 bp, Artificial Sequence
  Synthetic
tataatgttgttgttatgatgttaaataattatttgtagaataagttggaagaataatttgattttaggtagtgt

SEQ ID NO: 60813 - DNA, 75 bp, Artificial Sequence
  Synthetic
aacagttccagaaagtaactcaaccatcgcaagcccaatgcagctttcagaaatccgccagcaacccaactccac

SEQ ID NO: 60814 - DNA, 75 bp, Artificial Sequence
  Synthetic
atcgcaagcccaatgcagctttcagaaatccgccagcaacccaactccactgtaccaccaatattaacctgaatc

SEQ ID NO: 60815 - DNA, 75 bp, Artificial Sequence
  Synthetic
tgaaaattattttttatagttaaagtattataaatgttttaatttttatttttggtaggattttgtgagtagatt

SEQ ID NO: 60816 - DNA, 75 bp, Artificial Sequence
  Synthetic
gactaaccgcactttaatttgaagcacatttgttcaatgggttcattattaacagtgttgcttttagattgtacc

SEQ ID NO: 60817 - DNA, 75 bp, Artificial Sequence
  Synthetic
agtttaataaaaaatgtgatgagttttttttaattataaattttagtttagtgggagtttaaatatgtaaaagag

SEQ ID NO: 60818 - DNA, 75 bp, Artificial Sequence
  Synthetic
tttgctcacagatagtaaattgttatggtatctaatcttattaagaaaaagaacacgatgaagattaacgcgacc

SEQ ID NO: 60819 - DNA, 75 bp, Artificial Sequence
  Synthetic
atatatattttatttgataattttattttgtaggaataaaattatatattttaaggagatgaaaattggtagagt

SEQ ID NO: 60820 - DNA, 75 bp, Artificial Sequence
  Synthetic
tagagcgctgccttcatctcatcaatttaacttgtcaatagcgcaacctagtttgtgattactcatctttcgtag

SEQ ID NO: 60821 - DNA, 75 bp, Artificial Sequence
  Synthetic
aaggtgtttggattgaagttaattttggaatttttttattaatttttattatgtttttgtagtttaattttataa

SEQ ID NO: 60822 - DNA, 75 bp, Artificial Sequence
  Synthetic
tttaacttgtcaatagcgcaacctagtttgtgattactcatctttcgtagttggcaaacactttgctaattaatt

SEQ ID NO: 60823 - DNA, 75 bp, Artificial Sequence
  Synthetic
gtttagattgtataatatagtatgtgtaggattattttatatttaagattatattattattaagggaattttatt

SEQ ID NO: 60824 - DNA, 75 bp, Artificial Sequence
  Synthetic
gtagatataccacagtcatcatggttacatcaggaattctacaattgccccgtgaacgcttcagaaaaacatcat

SEQ ID NO: 60825 - DNA, 75 bp, Artificial Sequence
  Synthetic
tttaatgttagagtgtgtttatgggtttttttttttaattttaaattttttaaaattattttaaaaataagtaat

SEQ ID NO: 60826 - DNA, 75 bp, Artificial Sequence
  Synthetic
tttttgtttgggtaataatcctatttcacaaagttttccctatcccattgggcgtagttcacaacaacactctcc

SEQ ID NO: 60827 - DNA, 75 bp, Artificial Sequence
  Synthetic
atttttattatttattttaatttaatgttttgttgtttttgttttaggttatttgagatgatttaatgtttttag

SEQ ID NO: 60828 - DNA, 75 bp, Artificial Sequence
  Synthetic
aggtaagtgatatagataaattggtgtgccgggataaactttcctccacaagtcagctgaaatcggtcgggctta

SEQ ID NO: 60829 - DNA, 75 bp, Artificial Sequence
  Synthetic
ggaggatttttgtaatataatgattttaatatttttattgattttgtttatttttaataataaatgattgatatt

SEQ ID NO: 60830 - DNA, 75 bp, Artificial Sequence
  Synthetic
atctagaaggtaatggagttgccacagatgtaccaacagcaacgaagagatggggattccgagccggtgttccac

SEQ ID NO: 60831 - DNA, 75 bp, Artificial Sequence
  Synthetic
atgaaataaatatttattattatattttatattgaataaggggagattgttttgatttttattttaatttttatt

SEQ ID NO: 60832 - DNA, 75 bp, Artificial Sequence
  Synthetic
ccaaagtggtgaactacgaagctggggagtgggctgaaaactgctacaacctggacatcaagaaagcagatggta

SEQ ID NO: 60833 - DNA, 75 bp, Artificial Sequence
  Synthetic
tgtgtttgtatttttatattggttttagttattatttttatttttattttgtttttttttttaaaaatattattt

SEQ ID NO: 60834 - DNA, 75 bp, Artificial Sequence
  Synthetic
gcgaatgcctacctgaagcccctgagggtgtaagaggcttccctcgctgccgttatgtgcacaaggtttctggaa

SEQ ID NO: 60835 - DNA, 75 bp, Artificial Sequence
  Synthetic
atagaggataagggtattttgttttatttgttttttttataggttaagttgtattattttttgattaagtatatt

SEQ ID NO: 60836 - DNA, 75 bp, Artificial Sequence
  Synthetic
cagggccgtgtcctgaaggtttcgctttccacaaagaaggcgctttcttcctgtatgatcgactggcatcaacaa

SEQ ID NO: 60837 - DNA, 75 bp, Artificial Sequence
  Synthetic
tttttggtgtaggagggagttttttattaatgtttgggggggtaagtaagtgtaggtttgatattattatagtgg

SEQ ID NO: 60838 - DNA, 75 bp, Artificial Sequence
  Synthetic
tcatctatcgaagcaccacgttttcagaaggtgttgtggctttcttgatcctccccaagactaaaaaggactttt

SEQ ID NO: 60839 - DNA, 75 bp, Artificial Sequence
  Synthetic
agtttttataggaaagttgtaatgttatatggaggaaagtagatataaatatagttaatgattgtttattttatt

SEQ ID NO: 60840 - DNA, 75 bp, Artificial Sequence
  Synthetic
tccaatcaccaccactacatgaaccggccaatatgacaacagacccatccagctactaccacacagtcacactta

SEQ ID NO: 60841 - DNA, 75 bp, Artificial Sequence
  Synthetic
gttgttatagtgttgttttaaaagtattttttttgttattatgtaaatgttgataaattttgagaattgatttag

SEQ ID NO: 60842 - DNA, 75 bp, Artificial Sequence
  Synthetic
attatgtggctgacaattttgggaccaatatgactaactttctgtttcaagtggatcatctaacttatgtgcaac

SEQ ID NO: 60843 - DNA, 75 bp, Artificial Sequence
  Synthetic
tttggttttgttttaagtttttttttttaagatgatttttatataattgattaagttgtgatttagagaattttt

SEQ ID NO: 60844 - DNA, 75 bp, Artificial Sequence
  Synthetic
ttgaaccaagattcacaccacaatttcttgtccaactcaatgagaccatttatactaatgggcgtcgcagcaaca

SEQ ID NO: 60845 - DNA, 75 bp, Artificial Sequence
  Synthetic
gtattaagatagtatttaatgttaagagagtatggagttttgtattatttattttattaatattttgattggttt

SEQ ID NO: 60846 - DNA, 75 bp, Artificial Sequence
  Synthetic
ccacaggaacactaatttggaaagtaaatcctactgttgacaccggcgtaggtgaatgggccttctgggaaaata

SEQ ID NO: 60847 - DNA, 75 bp, Artificial Sequence
  Synthetic
aaaatttagtagttttgattagtaattttagggttaattttggattgttgttttgtttgaagttattagttgtag

SEQ ID NO: 60848 - DNA, 75 bp, Artificial Sequence
  Synthetic
aaaaaacttcacaaaaaccctttcaagtgaagagctgtctgtcatacttgtaccaagagcccaggatccaggcag

SEQ ID NO: 60849 - DNA, 75 bp, Artificial Sequence
  Synthetic
gatttgttagttttaggtttttaggagtagttatattaagtgatgaattagttgatttataggttttttgtgtta

SEQ ID NO: 60850 - DNA, 75 bp, Artificial Sequence
  Synthetic
caaccagaagacgaaggtcactcccaccagcttcgccaacaaccaaacctccaagaaccacgaagacttggttcc

SEQ ID NO: 60851 - DNA, 75 bp, Artificial Sequence
  Synthetic
ccaagaaccacgaagacttggttccaaaggatcccgcttcagtggttcaagtgcgagacctccagagggaaaaca

SEQ ID NO: 60852 - DNA, 75 bp, Artificial Sequence
  Synthetic
taagaagtaggagtttttggttggttaggtttttaagttgatggttttttttatagaaattattattatatagaa

SEQ ID NO: 60853 - DNA, 75 bp, Artificial Sequence
  Synthetic
aaaggatcccgcttcagtggttcaagtgcgagacctccagagggaaaacacagtgccgacctcacccttgaacac

SEQ ID NO: 60854 - DNA, 75 bp, Artificial Sequence
  Synthetic
atttttttttgagagtaggataaatatttttaggtgttggagggatagtaagggttttagtattttttttatgga

SEQ ID NO: 60855 - DNA, 75 bp, Artificial Sequence
  Synthetic
agtccccacaactctgatccccgacacaatggaggaacaaaccaccagccactacgaactaccaaacatttccgg

SEQ ID NO: 60856 - DNA, 75 bp, Artificial Sequence
  Synthetic
aaattgtagggattttaatttgtgaagtattttgattattatggtagtttgttgttgttttattttgggaaatgg

SEQ ID NO: 60857 - DNA, 75 bp, Artificial Sequence
  Synthetic
aaaccatcaagagaggaacaacaccgcacaccccgaaactctcgccaacaatcctccagacaacacaaccccgtc

SEQ ID NO: 60858 - DNA, 75 bp, Artificial Sequence
  Synthetic
attttgttttaaattgaggatttgttgaattttgttggttggtatgtgaattttttgattttttgtgtttatgat

SEQ ID NO: 60859 - DNA, 75 bp, Artificial Sequence
  Synthetic
gacaccacctcaagacggtgagcggacaagttcccacacaacaccctccccccgcccagtcccaaccagcacaat

SEQ ID NO: 60860 - DNA, 75 bp, Artificial Sequence
  Synthetic
cccgcccagtcccaaccagcacaatccatcccaccacacgagagactcaaattcccaccacaatgataacaagcc

SEQ ID NO: 60861 - DNA, 75 bp, Artificial Sequence
  Synthetic
ttttttttatatttgtggtaaagattaataatatagttatttgtggttttggaaatggatgttattttgatatga

SEQ ID NO: 60862 - DNA, 75 bp, Artificial Sequence
  Synthetic
atgatactgacagtaatcgacccaacccaattgacatcagcgagtctacagagccaggactactcaccaacacca

SEQ ID NO: 60863 - DNA, 75 bp, Artificial Sequence
  Synthetic
aattaattgaattgttgttttgggatttttgtagaggataggtttttttttaagtaagtgtgagggttaatttaa

SEQ ID NO: 60864 - DNA, 75 bp, Artificial Sequence
  Synthetic
taagaggggttgcaaatttgctgacaggttcaagaagaacccggagggaaatcaccttgagaacacaagccaaat

SEQ ID NO: 60865 - DNA, 75 bp, Artificial Sequence
  Synthetic
agatttttgaatatgaatgtgtaggtggatgaagattataaaagtgggtataatgttatttttttttaattttta

SEQ ID NO: 60866 - DNA, 75 bp, Artificial Sequence
  Synthetic
aggttcaagaagaacccggagggaaatcaccttgagaacacaagccaaatgtaatccgaacctacactattggac

SEQ ID NO: 60867 - DNA, 75 bp, Artificial Sequence
  Synthetic
ttaatattatttttgggaaggaatttatatagtattgagaaagagtattaaagtattttagtttaaaggattttt

SEQ ID NO: 60868 - DNA, 75 bp, Artificial Sequence
  Synthetic
aacccaagatgaaggggctgccattggtctagcctggataccttacttcgggcccgcagcagagggaatttatac

SEQ ID NO: 60869 - DNA, 75 bp, Artificial Sequence
  Synthetic
gtaaatttatttttaagttttgtatagaatttggtattagtttgatttttaagtattagtattggtttataattt

SEQ ID NO: 60870 - DNA, 75 bp, Artificial Sequence
  Synthetic
ggaaggaataatgcacaatcaaaatgggctaatttgcgggttgaggcagctagcaaatgagacgactcaagccct

SEQ ID NO: 60871 - DNA, 75 bp, Artificial Sequence
  Synthetic
aaaatgttagaaatgtattaagtttaaattgatgatttaaattgatatttagtaaagtagtttgtaaatgtaaag

SEQ ID NO: 60872 - DNA, 75 bp, Artificial Sequence
  Synthetic
acagttattcttgcgtgctaccacggaattgcgcactttctccatattgaatcgaaaagccatcgactttttact

SEQ ID NO: 60873 - DNA, 75 bp, Artificial Sequence
  Synthetic
aagagtaataattgtaataataattttagtaatgtttatttttgtagggatttattgtttttagtttgtttatta

SEQ ID NO: 60874 - DNA, 75 bp, Artificial Sequence
  Synthetic
tcaaagatggggaggaacgtgccacatcttaggcccagattgctgtattgagccccatgattggactaagaacat

SEQ ID NO: 60875 - DNA, 75 bp, Artificial Sequence
  Synthetic
attattattattattttgattaggtaaggggttgttgatgaaattatggatgatttggttgattttattagtgat

SEQ ID NO: 60876 - DNA, 75 bp, Artificial Sequence
  Synthetic
tactgacaaaatagatcaaatcattcatgatttcattgataaacctctaccagatcaaacagataatgacaattg

SEQ ID NO: 60877 - DNA, 75 bp, Artificial Sequence
  Synthetic
gttttttgtttaattatgtggtttaatgtaataatttggttttaggattttgtatgttttgttttattgttgtag

SEQ ID NO: 60878 - DNA, 75 bp, Artificial Sequence
  Synthetic
gtggacagggtggaggcaatgggttcctgccgggattgggatcacgggggtaataatcgcagttatagcactgct

SEQ ID NO: 60879 - DNA, 75 bp, Artificial Sequence
  Synthetic
aaggaaatttatggtttttttattgagtatggtatatgtttgtagttttgttgtggtttttaagaaaagttgtag

SEQ ID NO: 60880 - DNA, 75 bp, Artificial Sequence
  Synthetic
gtgtatttgcaaatttctactctaatctagtccgactctgtaccagcataatggcctctaaaataagcttctgct

SEQ ID NO: 60881 - DNA, 75 bp, Artificial Sequence
  Synthetic
tctagtccgactctgtaccagcataatggcctctaaaataagcttctgcttctgcttcctatagttaatacatct

SEQ ID NO: 60882 - DNA, 75 bp, Artificial Sequence
  Synthetic
agtttgagttgttttatttgtaagttgtttaagtttatagattaaggtattttggttatgtattaggtttttagt

SEQ ID NO: 60883 - DNA, 75 bp, Artificial Sequence
  Synthetic
cagcaaaaatcaactattaagttaaaagaagatccctctaataatcctaattaccttcaaaaatctagaacttta

SEQ ID NO: 60884 - DNA, 75 bp, Artificial Sequence
  Synthetic
gtatatgttttttgtatttggtttaaagtatgggatttaggtaattttagtagtattatgttgtttttgtgtagt

SEQ ID NO: 60885 - DNA, 75 bp, Artificial Sequence
  Synthetic
ttaattctcagggtatttagaacagccagatgacttgactaagtttgtactgtaataaaaagatacttgatgaag

SEQ ID NO: 60886 - DNA, 75 bp, Artificial Sequence
  Synthetic
ttagtagtgtaagttgggattgtatttatttgtggttttggtgttagtttgttttttgttgtgtttttgaagttt

SEQ ID NO: 60887 - DNA, 75 bp, Artificial Sequence
  Synthetic
attaagaaaaagacagtcttgtgattgtcactaatcttcatctcaaaacatattattttaccagaagctaccata

SEQ ID NO: 60888 - DNA, 75 bp, Artificial Sequence
  Synthetic
aagatttttaagaatttttgttattgttgaagttattagattgttgtttgtggatttttgtggtaggatagtttt

SEQ ID NO: 60889 - DNA, 75 bp, Artificial Sequence
  Synthetic
gcctacctccttgacacatagcaaaccttactcatgttgataattgtttgcctgctatttacatatttactaact

SEQ ID NO: 60890 - DNA, 75 bp, Artificial Sequence
  Synthetic
aattgttgttgttatattttttggggtggtgagagtgggtgtttttgttgttgggttgggggagttttttggtgg

SEQ ID NO: 60891 - DNA, 75 bp, Artificial Sequence
  Synthetic
tacaaaattatcttggggatttctctgaacatataatcaggattggcatttaaaacacaagttagtcctaatgga

SEQ ID NO: 60892 - DNA, 75 bp, Artificial Sequence
  Synthetic
tgttgttggttttttggtggttattattgatggatttgatgtgtgggttgtgggggtttgagttttagggtttgg

SEQ ID NO: 60893 - DNA, 75 bp, Artificial Sequence
  Synthetic
ctcatttcatgaaagagggcgtagcagaactattcgacagagtgcaagagatgggccgagtcatcaagtaagaac

SEQ ID NO: 60894 - DNA, 75 bp, Artificial Sequence
  Synthetic
tgttgtggttggtgaggaatttgggatttggttggagtttggttttattttgatggtggagatttgtatatggtt

SEQ ID NO: 60895 - DNA, 75 bp, Artificial Sequence
  Synthetic
aagatcatcctccagagacagccaccgcagcgaatatcatacacctaggagctcttcccaagttcgagtcccgac

SEQ ID NO: 60896 - DNA, 75 bp, Artificial Sequence
  Synthetic
gttgttagtgtttataattgttgtagttgtttttgtaatggttttttgagtgtttatatttattttttgattttt

SEQ ID NO: 60897 - DNA, 75 bp, Artificial Sequence
  Synthetic
tgtgtttcatcggaagcgtactgattttttgacagttccaccagcaccaaaggacatatgtcctaccttaaggaa

SEQ ID NO: 60898 - DNA, 75 bp, Artificial Sequence
  Synthetic
tgttgaattttgagatggtaatgttgtttttttttttggtatgtgtaatggaattattttaggggaattttttgg

SEQ ID NO: 60899 - DNA, 75 bp, Artificial Sequence
  Synthetic
aggatttttgtgtgacagcaatttttgtaaaaaagaccatcaactagaaagtttaacagatagggagctgctttt

SEQ ID NO: 60900 - DNA, 75 bp, Artificial Sequence
  Synthetic
aattaggtttgaatattttttggtggtttggttggagatttttttttttgtaatttttgatgatgttgtattatt

SEQ ID NO: 60901 - DNA, 75 bp, Artificial Sequence
  Synthetic
gctgattgcacggaaaacctgcggctcccttgaacaacaattgaacatcactgctcctaaagatacacgattagc

SEQ ID NO: 60902 - DNA, 75 bp, Artificial Sequence
  Synthetic
gttttttgttttgttgagtgataaagttttgaaagatagtttttttttatgtagttgtttggagagattttttta

SEQ ID NO: 60903 - DNA, 75 bp, Artificial Sequence
  Synthetic
aaatccaattgcagatgatttccaacaaaaagacggcccaaaaattacactattgacacttttggagactgcgga

SEQ ID NO: 60904 - DNA, 75 bp, Artificial Sequence
  Synthetic
tttttttaaaaagtttatttattaatattagtattgatattagtatttagtgtttaaattagttttttagttgta

SEQ ID NO: 60905 - DNA, 75 bp, Artificial Sequence
  Synthetic
gtattggtcaaaacaagatatcaagggcattgatgattcaagactaagagcattactaaccctttgtgccgtcat

SEQ ID NO: 60906 - DNA, 75 bp, Artificial Sequence
  Synthetic
ttatttaattgttggtgaaggtgaatggtattatttagttggaaaaggaattgaggtgtgtggggtttgtttaga

SEQ ID NO: 60907 - DNA, 75 bp, Artificial Sequence
  Synthetic
gacgaggaaattctcaaaatcccagctgagtctattgtgtgagagtcatctacgacgagaagggctaggacagga

SEQ ID NO: 60908 - DNA, 75 bp, Artificial Sequence
  Synthetic
tgaataaaagtattattgttaattttgaaaagggttgtggagtgttgagtattaaaatttttgattttatatttt

SEQ ID NO: 60909 - DNA, 75 bp, Artificial Sequence
  Synthetic
tcaatcagaatctgttcttgaagtgtaccagcgcttgcatagcgacaaaggcggaaattttgaggcagccctatg

SEQ ID NO: 60910 - DNA, 75 bp, Artificial Sequence
  Synthetic
aagtaggatgtggtataataatttgatgtatttttagtgtagtttattgttttttgaatggggggtgattgaagg

SEQ ID NO: 60911 - DNA, 75 bp, Artificial Sequence
  Synthetic
gcaacaatgggaccgacagtccttgatcatgtttataacagcatttcttaatattgctttacaattaccctgtga

SEQ ID NO: 60912 - DNA, 75 bp, Artificial Sequence
  Synthetic
aatgttttttttggtttagttaatattaagaatgtaattatttttttagtaaaattgatttttttgtaaattata

SEQ ID NO: 60913 - DNA, 75 bp, Artificial Sequence
  Synthetic
aagttcatctgttgttatttcaggattaaggctgctagtgcctcaatcagaagataccgagacctcaacctacac

SEQ ID NO: 60914 - DNA, 75 bp, Artificial Sequence
  Synthetic
gttgaagttagtttgttatagaggaagaaagttttatttttgtgaaaggtgtagttatttgggtagggtttggtt

SEQ ID NO: 60915 - DNA, 75 bp, Artificial Sequence
  Synthetic
cgagacacgtgcatggtcagaggaaggtggcccccattaacatcttccacagttgaatctaccataacttcccta

SEQ ID NO: 60916 - DNA, 75 bp, Artificial Sequence
  Synthetic
ttttgggttttgtgaatatagtggtattttggaaagtttttgatattatttggtggtgggggtaagtatttgttt

SEQ ID NO: 60917 - DNA, 75 bp, Artificial Sequence
  Synthetic
ttcaacgcaggtaagaatcagtactaaaccacaagtgcaaaaattaacaaaacaccagcataagtgaaatcttgt

SEQ ID NO: 60918 - DNA, 75 bp, Artificial Sequence
  Synthetic
ttgtttggtttttttattttaagattgtagtaatttttagtttatttttttgttttatagttgattattttggga

SEQ ID NO: 60919 - DNA, 75 bp, Artificial Sequence
  Synthetic
ctgtgattagcaagacgaatgatcttcaatcctgttgcaattcgccagtgataattgtattcacattgtggccac

SEQ ID NO: 60920 - DNA, 75 bp, Artificial Sequence
  Synthetic
ggaatattagatttgaagttttaatgttttgttgtagatgggatattagtagatattttgttttttttgaggttg

SEQ ID NO: 60921 - DNA, 75 bp, Artificial Sequence
  Synthetic
tcaatcctgttgcaattcgccagtgataattgtattcacattgtggccacaatatactgttttttccattgaaaa

SEQ ID NO: 60922 - DNA, 75 bp, Artificial Sequence
  Synthetic
acaaggctgaatctattgcgctacacaaacttacaggattagcaccacgacggctcaatactatacctattggtc

SEQ ID NO: 60923 - DNA, 75 bp, Artificial Sequence
  Synthetic
agattaattgattttagttggttagtagatgtaagatgatttttgtagattagttggttaatttttgttattttt

SEQ ID NO: 60924 - DNA, 75 bp, Artificial Sequence
  Synthetic
acggctcgatgtgttaatcacttatattgtattcatttgaaattattcattaggcaaatattttgattaagaaaa

SEQ ID NO: 60925 - DNA, 75 bp, Artificial Sequence
  Synthetic
aaagtgttgttagttataatatttaaaggtatggaaaaggttttttggaataagatgatgatttaaataaagaaa

SEQ ID NO: 60926 - DNA, 75 bp, Artificial Sequence
  Synthetic
aataattggaaaaccagaaaatccctaggtatttaaattcctatctccggagatccgagataattaatcaagcaa

SEQ ID NO: 60927 - DNA, 75 bp, Artificial Sequence
  Synthetic
gagtttttttgaaatttgtttttgggtaattggagtaggttaagattttttattgtgagatttttaggatggggg

SEQ ID NO: 60928 - DNA, 75 bp, Artificial Sequence
  Synthetic
tgaaggaacaatggtgaacaacaacatattgttgccccctttagattggtcagttccaaaaacaagtgatgaaga

SEQ ID NO: 60929 - DNA, 75 bp, Artificial Sequence
  Synthetic
tgtattggtaagtgtatttttattaaatggtattgagaataagattatggtaaaaagatgaaggttgggttttta

SEQ ID NO: 60930 - DNA, 75 bp, Artificial Sequence
  Synthetic
ttaatgcagatgtccaaggaacacatatttgtgatttaaacgttccagttagactctgttcaaggatcttcatct

SEQ ID NO: 60931 - DNA, 75 bp, Artificial Sequence
  Synthetic
ttaggtttaatttttattagatttgttttttttaatggtgtaattatgttaagatattttattttatgtttgggt

SEQ ID NO: 60932 - DNA, 75 bp, Artificial Sequence
  Synthetic
tttgtagctccactctgagtcacaacataattgagtttttgctcagaacagttatcaggattaaattctctcaaa

SEQ ID NO: 60933 - DNA, 75 bp, Artificial Sequence
  Synthetic
gaaatgagtatagagtggtgaaggtgtaatttttgaggattaggttatttgagaaggaggttgagggaatttttt

SEQ ID NO: 60934 - DNA, 75 bp, Artificial Sequence
  Synthetic
taactgaaactactagcatcactctcaatttcattacttacgacaatcattatcttaataatatttccctaaatt

SEQ ID NO: 60935 - DNA, 75 bp, Artificial Sequence
  Synthetic
ggtatagttaggttaatttgttaggaaggaggtttgaaggggtgaatattggatattgattgggtgaagtatgga

SEQ ID NO: 60936 - DNA, 75 bp, Artificial Sequence
  Synthetic
actgacttaatcagcttgtaatcagataatatcgaaaccaatttatcataaggtataatttgtataagtgattta

SEQ ID NO: 60937 - DNA, 75 bp, Artificial Sequence
  Synthetic
ttgtttatgtatgttaattgattggttaagtttgtaagagattttggggaggttttttgggttggttttattttg

SEQ ID NO: 60938 - DNA, 75 bp, Artificial Sequence
  Synthetic
ggatttaccccagaagtgaaataattcttagaataaaagaccgactagaatatccttaaggctgtctgacgtgcc

SEQ ID NO: 60939 - DNA, 75 bp, Artificial Sequence
  Synthetic
gatttaggtttgattagtgagagttttttgatttgattagtatattttaataagagggttgagttgttttatagt

SEQ ID NO: 60940 - DNA, 75 bp, Artificial Sequence
  Synthetic
acacagctagggttagcctgacatctggaacaagatcgatactaatatagggatttgtttcatactaactctctg

SEQ ID NO: 60941 - DNA, 75 bp, Artificial Sequence
  Synthetic
atatggattgttagttttttaaaagttgattgagttgttatagataagatttgatttttttattggaggtgtttt

SEQ ID NO: 60942 - DNA, 75 bp, Artificial Sequence
  Synthetic
caaacacaatggctaaggcaacaggtaggtacaacttggtttcacctaaaaaggacctcgagagggggctagttt

SEQ ID NO: 60943 - DNA, 75 bp, Artificial Sequence
  Synthetic
ttttattttgtgagaattattttttattgagataagagtaattggtaggtgaatgataattattataatttggtg

SEQ ID NO: 60944 - DNA, 75 bp, Artificial Sequence
  Synthetic
tgaatgatttgtgcacgtttttagttgatcagactatccaggggtggcgggtgacttgggttgggattgaatttg

SEQ ID NO: 60945 - DNA, 75 bp, Artificial Sequence
  Synthetic
ttatgattatagttaggtttttaggtgagattggatttagtttaatgtattttgggagtaagataggaattatag

SEQ ID NO: 60946 - DNA, 75 bp, Artificial Sequence
  Synthetic
atatcgcccagaaagggatggctctactgcatcggttaaaaactgctgacttcgctcctgcatggtcgatgacaa

SEQ ID NO: 60947 - DNA, 75 bp, Artificial Sequence
  Synthetic
gttgtttatttttttgatttattttttttttagtgagtttgtggattagtaattttggaattttgattttaatga

SEQ ID NO: 60948 - DNA, 75 bp, Artificial Sequence
  Synthetic
ggaatttatttcctcatttattccaaaattcaaattctactattgagtctcccctctgggcattacgagtgattc

SEQ ID NO: 60949 - DNA, 75 bp, Artificial Sequence
  Synthetic
tatttttagttggattaattggtatgattttgaaattttgtattaggtttataattgtttgaattttgtttgggg

SEQ ID NO: 60950 - DNA, 75 bp, Artificial Sequence
  Synthetic
tggcagctggtattcaagaccagttaattgaccaatccttggtagaaccgttggccggagccctgagtttagtct

SEQ ID NO: 60951 - DNA, 75 bp, Artificial Sequence
  Synthetic
tagttagattagaaatatgtttttttttttttgttttgtttggaagtagaatgggttttagttttgggtgaaatg

SEQ ID NO: 60952 - DNA, 75 bp, Artificial Sequence
  Synthetic
ccgattggcttctcacaacaaacacaaaccattttcaaatgcgcacgcagcacgctaaagagcaactgagcttga

SEQ ID NO: 60953 - DNA, 75 bp, Artificial Sequence
  Synthetic
aaagtttgggatgaagggtttttgaaaggttgtttggagttttatttgtttatgttgtagtagggagaggttgtg

SEQ ID NO: 60954 - DNA, 75 bp, Artificial Sequence
  Synthetic
agatgctatcattagtgcgctccaatatcctgaaattcatcagtcaattggacgcactacatgtcgtgaactaca

SEQ ID NO: 60955 - DNA, 75 bp, Artificial Sequence
  Synthetic
ttattagtttgagtgtagttagattaaaagtgaaatattgtggtagttgaattggtggtagtataaatttttgaa

SEQ ID NO: 60956 - DNA, 75 bp, Artificial Sequence
  Synthetic
atggactcttgagcagtatcgaaattggcactagaaatcataccattatcatcacaagaaccaacatgggtttcc

SEQ ID NO: 60957 - DNA, 75 bp, Artificial Sequence
  Synthetic
ggaaagtttggttttttattttgagtaatttgagtgggtgatttggtattttttgattaagttgatttattttaa

SEQ ID NO: 60958 - DNA, 75 bp, Artificial Sequence
  Synthetic
tggtagaattacaggagcctgataaatctgccatgaatcaaaagaaaccaggaccagtcaagttctccctcctgc

SEQ ID NO: 60959 - DNA, 75 bp, Artificial Sequence
  Synthetic
tgagggggttgttggtttttttaaaatgggtgattgtataagatgtgagtataattgttgttgttgttgagttaa

SEQ ID NO: 60960 - DNA, 75 bp, Artificial Sequence
  Synthetic
atgaatcaaccttcaaggctctaatcaaaaaacccgcaactaagatgcaggccttgattctggaatttaacagct

SEQ ID NO: 60961 - DNA, 75 bp, Artificial Sequence
  Synthetic
aattgtatgttttttggttagtaattttgagtggtaattaaatagggatttgttttatgaggattttgggttttg

SEQ ID NO: 60962 - DNA, 75 bp, Artificial Sequence
  Synthetic
ccctggcaatatagtccaacgataccaaccatcattttttgtaactgcatctcttttatttcttttctaacttga

SEQ ID NO: 60963 - DNA, 75 bp, Artificial Sequence
  Synthetic
agattatattgatagttgtttttaagatgaatgttgaggttattttgtttggggtatgatttgtatgattaatgt

SEQ ID NO: 60964 - DNA, 75 bp, Artificial Sequence
  Synthetic
tacaattataatcaagatccctaatcccttttgacgaagtgggctaatttttgctcattctaataataaatcata

SEQ ID NO: 60965 - DNA, 75 bp, Artificial Sequence
  Synthetic
tattattagtaataggttttatagaatttgatggtgtatttattttaggaaggattttttgtttttgttgaattt

SEQ ID NO: 60966 - DNA, 75 bp, Artificial Sequence
  Synthetic
tatttatagttttgtttgatttgatgggaagtatgtttataggatagttaatgttagtataggtaggtggtgtag

SEQ ID NO: 60967 - DNA, 75 bp, Artificial Sequence
  Synthetic
tcgcactaagggacaagttaatcaatctttacttaataatatactaaatgctagatagctctggctaattaacct

SEQ ID NO: 60968 - DNA, 75 bp, Artificial Sequence
  Synthetic
ttggtatagtgattttttttattttttttgagttttaaatttgtttaaatgagatgaaggtaagaaaaaagattt

SEQ ID NO: 60969 - DNA, 75 bp, Artificial Sequence
  Synthetic
gagttgtggattactccttttaaaagtctatcaatttaagcttatcactaatattaaggaggactttttaaataa

SEQ ID NO: 60970 - DNA, 75 bp, Artificial Sequence
  Synthetic
tttttgagaaaattttttttttttttaatttttattaattttaatttgtttgggggtttttgtatagtattaagt

SEQ ID NO: 60971 - DNA, 75 bp, Artificial Sequence
  Synthetic
gagcaagtgttatgtagtcttactaagaatgatttgaggaagattaagaaaaagtgcttgtggggtctttccgtt

SEQ ID NO: 60972 - DNA, 75 bp, Artificial Sequence
  Synthetic
aggggaaatatgttaatgaggttttattataatataggggaatttttttattgatagtattattaattgattagg

SEQ ID NO: 60973 - DNA, 75 bp, Artificial Sequence
  Synthetic
gtggaggacacacgagcaaacttcttcctctaattttaatatggcaactcaacatacacaatatccagatgcaag

SEQ ID NO: 60974 - DNA, 75 bp, Artificial Sequence
  Synthetic
atagaggggaaatttaaaattgatttataagtttatgatataatagattattagtttaatttgattttaaatagt

SEQ ID NO: 60975 - DNA, 75 bp, Artificial Sequence
  Synthetic
attatcttcacccattgtcttagatcaatgtgatcttgtcactcgtgcttgcggtctgtattcttcatattcatt

SEQ ID NO: 60976 - DNA, 75 bp, Artificial Sequence
  Synthetic
tataagtattatttggttattgtaaaatgagtttattttgtttttgtattatatttttagtttaagggttttttt

SEQ ID NO: 60977 - DNA, 75 bp, Artificial Sequence
  Synthetic
aaatcctcagttgaaaaattgtagactaccaaaacatatttaccgcctcaaatttgatgctacggttacaaaatt

SEQ ID NO: 60978 - DNA, 75 bp, Artificial Sequence
  Synthetic
gttttggaattgaaaaatatagatttaatttttattgatttttggtgatggtgggattggttggaggtttttttg

SEQ ID NO: 60979 - DNA, 75 bp, Artificial Sequence
  Synthetic
tttaagcgatgttccaatagttacattgccaatagattacttgacccctttacttttacgaactttatccgggga

SEQ ID NO: 60980 - DNA, 75 bp, Artificial Sequence
  Synthetic
ataggttttgggtatatttttttgagatttgatatgtataattggaggagaggtattttggaaagtagggatttg

SEQ ID NO: 60981 - DNA, 75 bp, Artificial Sequence
  Synthetic
gggcttatgccctgtcgaaccaaagtgcagccaattcttagatgaaatagtaagttatgttttgcaggatgcacg

SEQ ID NO: 60982 - DNA, 75 bp, Artificial Sequence
  Synthetic
tgcagccaattcttagatgaaatagtaagttatgttttgcaggatgcacgttttttaagacactattttaggcat

SEQ ID NO: 60983 - DNA, 75 bp, Artificial Sequence
  Synthetic
ttttgttatttggattaatgtatattggggggagttttttttagttaagtttgtttggaattttgtatgaattat

SEQ ID NO: 60984 - DNA, 75 bp, Artificial Sequence
  Synthetic
gtttaggatattattatttttattaattttgtagataatttgtattaattgatgaaaagttgttttaaattttgg

SEQ ID NO: 60985 - DNA, 75 bp, Artificial Sequence
  Synthetic
gttggagtacacgatgacaatgtggggaaaaattttgagccaaagattaaggctttgatttatgataatgaattt

SEQ ID NO: 60986 - DNA, 75 bp, Artificial Sequence
  Synthetic
gagatggttatagatgatttttttgagattttttgttgaaatgtaaggttgtttgaaattttttttattgagggt

SEQ ID NO: 60987 - DNA, 75 bp, Artificial Sequence
  Synthetic
ctgcaacaattgttttattggtacgatttagcaatcctaacgcgtagagggcgcctgaatcgagggaataaccgt

SEQ ID NO: 60988 - DNA, 75 bp, Artificial Sequence
  Synthetic
atttgtgttatttagatttatgtaggtttgtttgatattttttggaatttttttgtttggattttttaatttagt

SEQ ID NO: 60989 - DNA, 75 bp, Artificial Sequence
  Synthetic
tcaacatggtttgcaaatgacgatttaatagacattctcgggtacggtgattatattttctggaaaataccgttg

SEQ ID NO: 60990 - DNA, 75 bp, Artificial Sequence
  Synthetic
tttaatagtattatttttgtataatgatgggtttggaggtgtttgtttatgtttattttaatatgtttttgttgt

SEQ ID NO: 60991 - DNA, 75 bp, Artificial Sequence
  Synthetic
tcattgttgtcactcaacacagaggggattcctcatgcagctaaggactggtatcacgcatcaatcttcaaagaa

SEQ ID NO: 60992 - DNA, 75 bp, Artificial Sequence
  Synthetic
tgtagtagtggtagttgtttgtttagtggttattattagtaggttgtattttgtaattattttggtatagttgtg

SEQ ID NO: 60993 - DNA, 75 bp, Artificial Sequence
  Synthetic
gcggttcaaggtcacacacatatcgtgtcagtttccactgcagatgttttaattatgtgtaaggacatcataacc

SEQ ID NO: 60994 - DNA, 75 bp, Artificial Sequence
  Synthetic
atttagggatgatatggtttttgttatgttttgaatgggttttaagttggttttaagagttgttatttgattttt

SEQ ID NO: 60995 - DNA, 75 bp, Artificial Sequence
  Synthetic
tgtcgtttcaataccacactcattgcagcattggcaaatttagaagattctatctgttctgactatccacaacct

SEQ ID NO: 60996 - DNA, 75 bp, Artificial Sequence
  Synthetic
cagcattggcaaatttagaagattctatctgttctgactatccacaacctgaaacaatctctaatctgtataaag

SEQ ID NO: 60997 - DNA, 75 bp, Artificial Sequence
  Synthetic
tagtgatttaatagtattggtttgttgatgtatagttgatattattgaatttatggtagttttgattttttttgt

SEQ ID NO: 60998 - DNA, 75 bp, Artificial Sequence
  Synthetic
caggggattacttaatttcgatattgggttcagaaggttataaggtcataaagtttttagaaccactatgtttag

SEQ ID NO: 60999 - DNA, 75 bp, Artificial Sequence
  Synthetic
taataagttattggtattatttgtttggatttgtttattatttttatgtgttgttttgggatttttattaataat

SEQ ID NO: 61000 - DNA, 75 bp, Artificial Sequence
  Synthetic
ctaagatccaattgtgctcaaattacactgagaggaaagggagattccttactcaaatgcatttggccgttaatc

SEQ ID NO: 61001 - DNA, 75 bp, Artificial Sequence
  Synthetic
ggttattggggtaggatttggtttgtttttaatattaataaatatttttgttagtggtattttgttggttattaa

SEQ ID NO: 61002 - DNA, 75 bp, Artificial Sequence
  Synthetic
acacacttgaagaacttattgagggccggggattgaagtcacaacaagactggaagatgagggaatttcaccgaa

SEQ ID NO: 61003 - DNA, 75 bp, Artificial Sequence
  Synthetic
ttgtttagaaaattagttagatattttgggtttatgatgtttataagttttattttgttgtatggtttatatgtt

SEQ ID NO: 61004 - DNA, 75 bp, Artificial Sequence
  Synthetic
tcttagtaaatttaaagtcaacaccacaacaactctgtgaattgttttcagtgcaaaagcattgggggcatcctg

SEQ ID NO: 61005 - DNA, 75 bp, Artificial Sequence
  Synthetic
gggtagtgtttaggttaagagggtataaaataatagtttttagatattaataaggatatttagataaagaatagt

SEQ ID NO: 61006 - DNA, 75 bp, Artificial Sequence
  Synthetic
gtgcaaaagcattgggggcatcctgtgctacatagtgagaaggctattcagaaagtaaagaaacatgcaaccata

SEQ ID NO: 61007 - DNA, 75 bp, Artificial Sequence
  Synthetic
tttttttttaaaggatgatgaaggttttaatttttattatgaatttttttttaattttaagttttatagaattta

SEQ ID NO: 61008 - DNA, 75 bp, Artificial Sequence
  Synthetic
ataaaagcattgcgtcctataatcatctttgagacatattgtgtgttcaagtacagcattgccaaacattatttt

SEQ ID NO: 61009 - DNA, 75 bp, Artificial Sequence
  Synthetic
ttaggatattatttttttaagtttattgaaggatattttatgttttaatgttataatgtttttttattggtatat

SEQ ID NO: 61010 - DNA, 75 bp, Artificial Sequence
  Synthetic
gatagccaagggtcatggtatagtgtaatctcagataaacatctaacaccaggtttacattcttacattaagagg

SEQ ID NO: 61011 - DNA, 75 bp, Artificial Sequence
  Synthetic
attataagttgattaaaattattaaataattatttttgtggtatgggtattagtttgtgataaattgatataagt

SEQ ID NO: 61012 - DNA, 75 bp, Artificial Sequence
  Synthetic
aaccaatttccgccactgcctatgattaaagacttattgtgggaattctatcaccttgatcatcctcccttattt

SEQ ID NO: 61013 - DNA, 75 bp, Artificial Sequence
  Synthetic
agttttttatagttttataatttatagattatttatttaatttttttataattaaaatagggtttatattttggg

SEQ ID NO: 61014 - DNA, 75 bp, Artificial Sequence
  Synthetic
tccaccaagattattagtgacttgagtattttcattaaggatcgcgctaccgcagtggaaaaaacatgttgggat

SEQ ID NO: 61015 - DNA, 75 bp, Artificial Sequence
  Synthetic
ttggttgtttatatttgaattattaaaataattataattaagtttagaataaataaaatttattaattatgggtt

SEQ ID NO: 61016 - DNA, 75 bp, Artificial Sequence
  Synthetic
gcagttttcgaacctaatgttcttggatatagtcctccaaacaagttctcaactaagagggttcctgaacagttt

SEQ ID NO: 61017 - DNA, 75 bp, Artificial Sequence
  Synthetic
tttagttatgttgaagaatagtaaggaatttgttttgtaggtttattattggttagaggaattgttggttattaa

SEQ ID NO: 61018 - DNA, 75 bp, Artificial Sequence
  Synthetic
cttgaacaagaaaatttctcgattgatagtgttctcacttatgcccagcgcctggattatctacttccacaatac

SEQ ID NO: 61019 - DNA, 75 bp, Artificial Sequence
  Synthetic
tgattagataatgattttttttttttaaggttttttttttatttaattaaggtgggtaggtttttttaagagaat

SEQ ID NO: 61020 - DNA, 75 bp, Artificial Sequence
  Synthetic
cggaatttttctttctcacttaaggaaaaggaattaaatgtaggacgagcttttggtaagctaccttatcctaca

SEQ ID NO: 61021 - DNA, 75 bp, Artificial Sequence
  Synthetic
ttgggaagatatattttttgttatttttagtgttaaaagtaatgggtttattatttattaggtgataataattga

SEQ ID NO: 61022 - DNA, 75 bp, Artificial Sequence
  Synthetic
cgtaatgttcaaactttatgtgaagccttattggcagatggattagctaaagcctttcctagtaacatgatggtt

SEQ ID NO: 61023 - DNA, 75 bp, Artificial Sequence
  Synthetic
ttgttttaaatggattttgtgtttttaggagatgataatatgttttttttagtgtagatttttttttggggttga

SEQ ID NO: 61024 - DNA, 75 bp, Artificial Sequence
  Synthetic
gtaacagagcgtgaacagaaggaaagcctcttgcaccaggcgtcgtggcaccacacaagtgacgatttcggtgag

SEQ ID NO: 61025 - DNA, 75 bp, Artificial Sequence
  Synthetic
ttgggagagttttatttttagaattttgattatttatagtattgtttggtttattttgttgattagtgtttattt

SEQ ID NO: 61026 - DNA, 75 bp, Artificial Sequence
  Synthetic
aatgccactgttagaggcagcagttttgttaccgacctagaaaaatacaacttggcatttagatatgagtttaca

SEQ ID NO: 61027 - DNA, 75 bp, Artificial Sequence
  Synthetic
tagtatttttgtagattggtgttggtggagttatagttgggttgtttttttttgatatgtttttaatatttttgt

SEQ ID NO: 61028 - DNA, 75 bp, Artificial Sequence
  Synthetic
gctccatttattgaatactgtaatcgatgttatggtgtaaaaaatttattcaattggatgcattatacgataccg

SEQ ID NO: 61029 - DNA, 75 bp, Artificial Sequence
  Synthetic
tatttttagagttaagggatgtgagatttttgttattattatttttttgattattgggttttgattttttttgta

SEQ ID NO: 61030 - DNA, 75 bp, Artificial Sequence
  Synthetic
caatgttatatacatgtaagtgattattataatccccctcatggagtttcgctagaaaatcgggaagatcctccg

SEQ ID NO: 61031 - DNA, 75 bp, Artificial Sequence
  Synthetic
taggggttatattttggagagtagatgatatattgttttgtggttggttggtgtttgaatttggtttggtgatgt

SEQ ID NO: 61032 - DNA, 75 bp, Artificial Sequence
  Synthetic
gaaggccctagctcttaccggggtcatcttgggggaattgagggactccaacagaaactctggaccagcatttca

SEQ ID NO: 61033 - DNA, 75 bp, Artificial Sequence
  Synthetic
ggaggttgtttggttggtgggaatttggggttaattttggtattttttttgttttgtttaaggttggattttgga

SEQ ID NO: 61034 - DNA, 75 bp, Artificial Sequence
  Synthetic
tgtgcgcaaatctcattagttgagatcaagactggtttcaagttgagatctgcggtaatgggtgataatcaatgc

SEQ ID NO: 61035 - DNA, 75 bp, Artificial Sequence
  Synthetic
ggttatgtgtttgagttgttttttttttgttttgttttttgtttggtggttttggttggttgttgttattgttgt

SEQ ID NO: 61036 - DNA, 75 bp, Artificial Sequence
  Synthetic
atcacagttctttccgtattccctctagagacagattccaatgagcaagagcatagctccgaggacaatgctgct

SEQ ID NO: 61037 - DNA, 75 bp, Artificial Sequence
  Synthetic
tgtttaaattgaagagattaagattttttgtggtgtttttagttgaatttttgtagttaggataattattatttt

SEQ ID NO: 61038 - DNA, 75 bp, Artificial Sequence
  Synthetic
cgcgtagcagccagtttagccaaagtcacgagtgcctgtggcatcttcctaaaaccagatgagacttttgtgcat

SEQ ID NO: 61039 - DNA, 75 bp, Artificial Sequence
  Synthetic
tattattatatgggttaataatattatttgggatagttgtattatgtgaattattaggattattattagaagggt

SEQ ID NO: 61040 - DNA, 75 bp, Artificial Sequence
  Synthetic
tcaggctttatttatttcggtaagaagcaatatttaaatggcgttcaattgccacaatcactcaagactgctacc

SEQ ID NO: 61041 - DNA, 75 bp, Artificial Sequence
  Synthetic
tggggtgggttttattatagattggtttgggaaatggaatattattgttattaggataatgatttttaattttga

SEQ ID NO: 61042 - DNA, 75 bp, Artificial Sequence
  Synthetic
aggattgctcccttgtcagatgcaatctttgatgaccttcagggaactctggctagtataggaacggcatttgag

SEQ ID NO: 61043 - DNA, 75 bp, Artificial Sequence
  Synthetic
tttttgatgtagttgtgatggttttggttagtttggttagttgttttttttttagggttattattgtgttagttt

SEQ ID NO: 61044 - DNA, 75 bp, Artificial Sequence
  Synthetic
agatctatatccgagactagacatgtatacccttgccgggtggttgccgcattccatacattcttctccgttagg

SEQ ID NO: 61045 - DNA, 75 bp, Artificial Sequence
  Synthetic
gttggaagttgattttattttttttttggtggaagtttatgagaattttttttttttgtttattaagtttaaggt

SEQ ID NO: 61046 - DNA, 75 bp, Artificial Sequence
  Synthetic
atcctccaataccaccaccttggtttcaacaaaggaactgatctaggtcaactatcactaagcaaaccgttggat

SEQ ID NO: 61047 - DNA, 75 bp, Artificial Sequence
  Synthetic
tgtttaatttatgtgttttagtatattgttggagttgttttttagttttagtagtagttttatgtagttgttgat

SEQ ID NO: 61048 - DNA, 75 bp, Artificial Sequence
  Synthetic
ttcggaactatcactcttgctttagcggtacctcaagttctaggaggtttatcgtttttgaacccagaaaaatgt

SEQ ID NO: 61049 - DNA, 75 bp, Artificial Sequence
  Synthetic
attgtttttttatattaatattagttagtgtgtttttgtgggtagttgtaatatttaaagtaatggttgagagtt

SEQ ID NO: 61050 - DNA, 75 bp, Artificial Sequence
  Synthetic
ttttatcgcaaccttggagaccccgtgacctctggcctattccaacttaggacttacctgcaaatgatcaacatg

SEQ ID NO: 61051 - DNA, 75 bp, Artificial Sequence
  Synthetic
gtggataaagtttatgttttaagttgttgattttagaaagattgaggagatgtgtaaatggagtatattttttat

SEQ ID NO: 61052 - DNA, 75 bp, Artificial Sequence
  Synthetic
gacgacttatttctacctttaattgccaagaaccccgggaactgtagtgcaattgactttgtactcaacccaagc

SEQ ID NO: 61053 - DNA, 75 bp, Artificial Sequence
  Synthetic
gtttggtaagtgagttaagagttgttttgaatgaattgattttatttttgatttttgttgttttggttagtggat

SEQ ID NO: 61054 - DNA, 75 bp, Artificial Sequence
  Synthetic
ggattgaatgtccctgggtcacaagacctaacatcttttttacgtcagatagtgcgtagaacaatcacattgagt

SEQ ID NO: 61055 - DNA, 75 bp, Artificial Sequence
  Synthetic
gaagttgtattttaagatttgttttttgtaggatgtggtttagaatagtttttataattagaagattagagaatt

SEQ ID NO: 61056 - DNA, 75 bp, Artificial Sequence
  Synthetic
gcaaaaaataagctaataaacacattgtttcattcctcagccgatttagaagatgagatggtatgtaaatggcta

SEQ ID NO: 61057 - DNA, 75 bp, Artificial Sequence
  Synthetic
ttgtttgggtaatagaattagatattattgtgttatttgtattatggtttgtgattatgtgtattttttgatgta

SEQ ID NO: 61058 - DNA, 75 bp, Artificial Sequence
  Synthetic
ctttcttcaacacctgtaatgagtcggtttgctgctgatatattctctcgtactccgagtgggaagcgcctgcag

SEQ ID NO: 61059 - DNA, 75 bp, Artificial Sequence
  Synthetic
ttagtaggaatttgattaaaaagtttgtttttattaaatggaagattattattatgtgtttaattgattgttagg

SEQ ID NO: 61060 - DNA, 75 bp, Artificial Sequence
  Synthetic
atcctaggttatttagaagggactagaaccttgctagcctccaaagtcatcaataacaatgcagagactcctatt

SEQ ID NO: 61061 - DNA, 75 bp, Artificial Sequence
  Synthetic
aagttggatattgaatgagtttttgttttgtatggatttgaatttgtttttgtattttttttagatatgtttttt

SEQ ID NO: 61062 - DNA, 75 bp, Artificial Sequence
  Synthetic
ttagataggttgaggaaaatcacactgcagagatggagtttatggtttagctacctagaccactgtgatcaggtt

SEQ ID NO: 61063 - DNA, 75 bp, Artificial Sequence
  Synthetic
ttttaatgataagtttgggtagaaataaattggtaaaggataaaaattgattagtattagtttttgttgtttttt

SEQ ID NO: 61064 - DNA, 75 bp, Artificial Sequence
  Synthetic
ctagcagatgctttaataaaagtttcttgtacagttgatttggcgcaaattttacgtgaatatacctgggcacac

SEQ ID NO: 61065 - DNA, 75 bp, Artificial Sequence
  Synthetic
ttttaggtattgtagttaatgtttttttaagattttttttattggtgatattgggtaataatttatttagatggt

SEQ ID NO: 61066 - DNA, 75 bp, Artificial Sequence
  Synthetic
atactagagggaagacagctcattggtgcaacacttccttgcatgttagaacaatttaatgtgttttggctcaaa

SEQ ID NO: 61067 - DNA, 75 bp, Artificial Sequence
  Synthetic
gtatatttttttttttttggattttaaatttgaaattatggttttttaagtattgaattgtattatttttgagga

SEQ ID NO: 61068 - DNA, 75 bp, Artificial Sequence
  Synthetic
tcgtacgaacaatgcccaaaatgtgcaagatctagaaatccaaaaggagagccatttgtgtcaattgcaattaag

SEQ ID NO: 61069 - DNA, 75 bp, Artificial Sequence
  Synthetic
agagtttatgatttttttggtaagtatgatgtaaatataaaagtaaaaggaagttgttagtattattttggaaat

SEQ ID NO: 61070 - DNA, 75 bp, Artificial Sequence
  Synthetic
aaacaagttgtgagtgcatggccgaatcagtcacggttaaattggaccattggggacggtgtaccttacatcggg

SEQ ID NO: 61071 - DNA, 75 bp, Artificial Sequence
  Synthetic
ttatgtttgttttaaaggtttgaatgatatgttgataaatatttttaagattatttataatatatattgggatga

SEQ ID NO: 61072 - DNA, 75 bp, Artificial Sequence
  Synthetic
tctcgaacagaggacaagattgggcagccagcaatcaagcctaagtgtccctctgctgccttacgtgaagcaata

SEQ ID NO: 61073 - DNA, 75 bp, Artificial Sequence
  Synthetic
ttttttgttgtataattttttgttggattgaaagtttggttgttaatattttgtggtagttaagattaattttag

SEQ ID NO: 61074 - DNA, 75 bp, Artificial Sequence
  Synthetic
gagttgacatctagactaacatgggttacccaaggtggtgccaatagtgatttgctagtcaaaccttttgtagaa

SEQ ID NO: 61075 - DNA, 75 bp, Artificial Sequence
  Synthetic
attgtttttttagggtttatgaattttttatttgtttatttatgttgtaggtttttaggtaaatttttagtagtt

SEQ ID NO: 61076 - DNA, 75 bp, Artificial Sequence
  Synthetic
gcacgagtaaacctgagtgtgcaggagatccttcaaatgacgccttctcattattcagggaacatcgtacatcgg

SEQ ID NO: 61077 - DNA, 75 bp, Artificial Sequence
  Synthetic
agtgtgtgatgagagtaattagtttatttagttaaaattagttagattttgtggattggagggatattttgggat

SEQ ID NO: 61078 - DNA, 75 bp, Artificial Sequence
  Synthetic
tataatgaccaatacagccctcattctttcatggcaaatagaatgagtaattccgcgacgagattggtggtgtcg

SEQ ID NO: 61079 - DNA, 75 bp, Artificial Sequence
  Synthetic
tttttttttatttttttttaggatttgagatagtattggttttattagaaaatgttaattattaggatgaaatta

SEQ ID NO: 61080 - DNA, 75 bp, Artificial Sequence
  Synthetic
acaaatactctcggggagttctcaggtggggggcaatcagcaagggacagcaatatcatctttcaaaatgtaatc

SEQ ID NO: 61081 - DNA, 75 bp, Artificial Sequence
  Synthetic
gtttattatttaggtaattatatttattaagtaggttagaattgtaggaggagttaggttaggaaaaggtaaagt

SEQ ID NO: 61082 - DNA, 75 bp, Artificial Sequence
  Synthetic
aattttgcggttgccctatttgatttacgatttcggaacaccgaaacatcctccattcagcataaccgtgcccat

SEQ ID NO: 61083 - DNA, 75 bp, Artificial Sequence
  Synthetic
aatatgatttatatatttttgtaatattttaggaatgtttttaaatgggggattgattagttaaattgtttttaa

SEQ ID NO: 61084 - DNA, 75 bp, Artificial Sequence
  Synthetic
ctccatctttcacagtgttgcacacgggaagtcccagctcaatacctaacctacacgtctacgctttccttggat

SEQ ID NO: 61085 - DNA, 75 bp, Artificial Sequence
  Synthetic
ttggtaaatgatgagattaattttaatgttaatattagtttgagtttgaggaaaatgattaattttttttatagt

SEQ ID NO: 61086 - DNA, 75 bp, Artificial Sequence
  Synthetic
ctcacaaggtaccgagagaatgagttaatttatgataacaatccattaaaaggtggacttaattgcaacctatcc

SEQ ID NO: 61087 - DNA, 75 bp, Artificial Sequence
  Synthetic
gaaaatgattaattttttttatagttatttgtatataaaaagtataaaaaatttttttttttttttgtgtgtttg

SEQ ID NO: 61088 - DNA, 75 bp, Artificial Sequence
  Synthetic
tggatatataaaaagaaaaaaggttttttaagattttttgtgtgtgagtaattatgaggaagattaatagttttt

SEQ ID NO: 61089 - DNA, 75 bp, Artificial Sequence
  Synthetic
tttgataatccacttttcaagggccaaaggctcaatatcatagaggaggatttgattagatttccacatttatct

SEQ ID NO: 61090 - DNA, 75 bp, Artificial Sequence
  Synthetic
tttagtttaagatatatattgaaattgagattgagatttttttttttgttattttgtaattttttttggttgtga

SEQ ID NO: 61091 - DNA, 75 bp, Artificial Sequence
  Synthetic
gggtgggaacttgcgaaaaccatcattcagtccattatctcagacagcaataactcatccacagaccccattagc

SEQ ID NO: 61092 - DNA, 75 bp, Artificial Sequence
  Synthetic
taattgaattagttttatttattattaattattattaatatggtatgtttagtgattttgggatttttttttatt

SEQ ID NO: 61093 - DNA, 75 bp, Artificial Sequence
  Synthetic
agtggagaaacacgatcattcacaactcactttctcacatatcctaaggttgggctcctctatagtttcggcgcc

SEQ ID NO: 61094 - DNA, 75 bp, Artificial Sequence
  Synthetic
tggttttttttagagttttgaatttattttgtgagaagtttatttaaatgatttagtgtttgaaaatataaaagg

SEQ ID NO: 61095 - DNA, 75 bp, Artificial Sequence
  Synthetic
atcgtgagttattacttagggaataccattattaggaccaaaaagctagacctcagtcatttcatgtattactta

SEQ ID NO: 61096 - DNA, 75 bp, Artificial Sequence
  Synthetic
tttttttttttgttaagtttaaggggttgttttgattgtgtgtagattttataattttagagtgttaaggagttg

SEQ ID NO: 61097 - DNA, 75 bp, Artificial Sequence
  Synthetic
acaactcaaatccataatttgccacatcgctcgttgaggatacttaagcccacttttaaacatgttagtgtgata

SEQ ID NO: 61098 - DNA, 75 bp, Artificial Sequence
  Synthetic
tgtgttattattgattgggaagattaaggaaataatttgttttaataatattgtatattttgattaagttgaata

SEQ ID NO: 61099 - DNA, 75 bp, Artificial Sequence
  Synthetic
tcaagactaatgagtattgatcctcatttttcaatctacatcgggggtacagcaggtgatcgagggctttcggat

SEQ ID NO: 61100 - DNA, 75 bp, Artificial Sequence
  Synthetic
agcaggtgatcgagggctttcggatgctaccagactattccttcgagtggccatttcttccttccttcaatttgt

SEQ ID NO: 61101 - DNA, 75 bp, Artificial Sequence
  Synthetic
aggggaagttgatatggattgtgggattagaagaatttgggtgttgtaaaattaaggtgatattgatttagatta

SEQ ID NO: 61102 - DNA, 75 bp, Artificial Sequence
  Synthetic
gctaccagactattccttcgagtggccatttcttccttccttcaatttgtcaaaaagtggatcgtggaatacagg

SEQ ID NO: 61103 - DNA, 75 bp, Artificial Sequence
  Synthetic
ttataaaattttgatagttggttttattgtttaatagggaattgttaggtagaaaataatttttgtatattttgt

SEQ ID NO: 61104 - DNA, 75 bp, Artificial Sequence
  Synthetic
acagctattcctctgtgggttgtataccctttggagggacaaaatccagatccaattaatagctttctacatcag

SEQ ID NO: 61105 - DNA, 75 bp, Artificial Sequence
  Synthetic
tgataatttggaggttatgtgttaattggtaatataagtttttgaggttggaattgatttttaagaaaatgttga

SEQ ID NO: 61106 - DNA, 75 bp, Artificial Sequence
  Synthetic
attatagccttactgcaaaatgaatcccctcaaaacaacatccaattccaagaaggcagaaataatcaacagttg

SEQ ID NO: 61107 - DNA, 75 bp, Artificial Sequence
  Synthetic
tagtttttttttgatgttttgtttatattatgtttattaaggtgattataaattgtttttggagagtaatgttgt

SEQ ID NO: 61108 - DNA, 75 bp, Artificial Sequence
  Synthetic
tccgataatctagtttacatgtgcaagagcactgccagtaatttcttccatgcatcacttgcctattggaggagc

SEQ ID NO: 61109 - DNA, 75 bp, Artificial Sequence
  Synthetic
atagtatttggaaggttatggatttaaatttgagttttggaagaaggatggtgttaattggtttgaggaattgtt

SEQ ID NO: 61110 - DNA, 75 bp, Artificial Sequence
  Synthetic
cggcacaaaggacggcccaaaaatcgatcgaccgaagaacagacagttaaacccagaccatataataattttcat

SEQ ID NO: 61111 - DNA, 75 bp, Artificial Sequence
  Synthetic
ttttgttgtaatgagtggaaaaaatattaggtgtatgttggttgtattgtttgaagaggagattatagaagtaaa

SEQ ID NO: 61112 - DNA, 75 bp, Artificial Sequence
  Synthetic
tctgttaaatgtgcctcaaacccaccaagcatccccaaatctaagtcaggaactcaaggctcaagcgcatttttt

SEQ ID NO: 61113 - DNA, 75 bp, Artificial Sequence
  Synthetic
aactcaaggctcaagcgcattttttgagaaacttgaatatgataaagaaatagaattgccaacagcttccacacc

SEQ ID NO: 61114 - DNA, 75 bp, Artificial Sequence
  Synthetic
tgtagggtaattttttttatttgtgagtttgtttttttttaaattggttgtgggagagaaggtttgtttggaaaa

SEQ ID NO: 61115 - DNA, 75 bp, Artificial Sequence
  Synthetic
gagaaacttgaatatgataaagaaatagaattgccaacagcttccacaccagccgaaaaacccaagacctatacc

SEQ ID NO: 61116 - DNA, 75 bp, Artificial Sequence
  Synthetic
agtttagtgataaatttaggtttatgtagaatagggtttaatttaatattttattgtatggtaattagttggata

SEQ ID NO: 61117 - DNA, 75 bp, Artificial Sequence
  Synthetic
aaggccctatccagccgaatttaccatggtaaaacaccatccaatgccgcaaaagatgattcaacaacctccaag

SEQ ID NO: 61118 - DNA, 75 bp, Artificial Sequence
  Synthetic
tatgatggtaatttttagattgatgaggattaattttttgattaaatatttattgatttattagggtatgtatat

SEQ ID NO: 61119 - DNA, 75 bp, Artificial Sequence
  Synthetic
ggctgcgattccaaagaagaaaatgccgttcaagcttcacaccgaattgtcctaccattttttacattgtcacag

SEQ ID NO: 61120 - DNA, 75 bp, Artificial Sequence
  Synthetic
ccgttcaagcttcacaccgaattgtcctaccattttttacattgtcacagaacggctacagaactccctcagtta

SEQ ID NO: 61121 - DNA, 75 bp, Artificial Sequence
  Synthetic
ggtagttggttatgatgttaatgatgttgttattgttaatttagttgtttaggtttgttttttaggatttttaat

SEQ ID NO: 61122 - DNA, 75 bp, Artificial Sequence
  Synthetic
aaaagtcagagtatgtaactgaaatcaccaaactaattcgacaattaaaggcaattccagataccactgtatact

SEQ ID NO: 61123 - DNA, 75 bp, Artificial Sequence
  Synthetic
tgttaaaattgtttttgattatattttgtaaaaaattgattaaggagtaagattttattttttggtttgaatagt

SEQ ID NO: 61124 - DNA, 75 bp, Artificial Sequence
  Synthetic
gtcgctttacaggggttgtgtcttcaatgcattataagcttgatgaggttctctgggaattcgatagtttcaaaa

SEQ ID NO: 61125 - DNA, 75 bp, Artificial Sequence
  Synthetic
taaagtgtgtaatgaggttaatgtatttaaggttgttttaagtttatttgttaagtatggggaatatgttttttt

SEQ ID NO: 61126 - DNA, 75 bp, Artificial Sequence
  Synthetic
ctgctgtgactctagctgaaggagaagggtcaggtgccttattactactacaaaaatataaggttagaacaatct

SEQ ID NO: 61127 - DNA, 75 bp, Artificial Sequence
  Synthetic
tgtttgtttttttaattttttgggagttaataatttagaatatggtttttatttatagttattagtaattgtttt

SEQ ID NO: 61128 - DNA, 75 bp, Artificial Sequence
  Synthetic
tttttaacactttagctacagagcatagcatcgaggcagaaatagtttctgggacaaccacacctcgaatgctcc

SEQ ID NO: 61129 - DNA, 75 bp, Artificial Sequence
  Synthetic
tggagttgttatagtatatggtagtatttttgtaggagttaatgttggtgagtagtattagtagtttagagaggt

SEQ ID NO: 61130 - DNA, 75 bp, Artificial Sequence
  Synthetic
ttcctgtaatggccaaacttcatgatgatcaaataaatgtaatattaaacaattctgctagccaggttactgata

SEQ ID NO: 61131 - DNA, 75 bp, Artificial Sequence
  Synthetic
tgttattgaagttgagaagtaattttaataatatgttgagtttagagaatttgatagtttaggtttggatgatta

SEQ ID NO: 61132 - DNA, 75 bp, Artificial Sequence
  Synthetic
tcactaaccctgcatggttcactgaccagaaatctagaatccccacacaagttgagattatgactatggatgctg

SEQ ID NO: 61133 - DNA, 75 bp, Artificial Sequence
  Synthetic
ccagaaatctagaatccccacacaagttgagattatgactatggatgctgaaacgacagaaaatattaatcggtc

SEQ ID NO: 61134 - DNA, 75 bp, Artificial Sequence
  Synthetic
ggaaagaagaatattaatgaatttttattagaagaaaaatgaaattagtttttagtagattaatgtaatggtaat

SEQ ID NO: 61135 - DNA, 75 bp, Artificial Sequence
  Synthetic
gttgagattatgactatggatgctgaaacgacagaaaatattaatcggtcaaaattatacgaagctatccagcaa

SEQ ID NO: 61136 - DNA, 75 bp, Artificial Sequence
  Synthetic
ttttaggaaagagtgattggttaaattaatagaagttataatgttggttttaagatttaattttgggtttagata

SEQ ID NO: 61137 - DNA, 75 bp, Artificial Sequence
  Synthetic
ttaattgtttcacacattgatacaagggtgctaaagattgttattataaaggtttttttaagtgatattgatggt

SEQ ID NO: 61138 - DNA, 75 bp, Artificial Sequence
  Synthetic
gggtgctaaagattgttattataaaggtttttttaagtgatattgatggtctactgtggcttaatgaccatcttg

SEQ ID NO: 61139 - DNA, 75 bp, Artificial Sequence
  Synthetic
agatgatggtaatgaaatattgttttttgggtttataagtaataatttagattaagattatttggaggatgattt

SEQ ID NO: 61140 - DNA, 75 bp, Artificial Sequence
  Synthetic
cccctttattcggatccggctatttaattaagccgattacttcgagtccaaagtcaagcgaatggtacttatgtc

SEQ ID NO: 61141 - DNA, 75 bp, Artificial Sequence
  Synthetic
tagagattttagagatattattatttttaatggtgtaattgattttgaggatggtgattttgaaaattataatgg

SEQ ID NO: 61142 - DNA, 75 bp, Artificial Sequence
  Synthetic
tttcaaatttcctttcagcttctcgacgacggcctcatcagggtcatgctacctgtatgcaagtcatccaaacag

SEQ ID NO: 61143 - DNA, 75 bp, Artificial Sequence
  Synthetic
ttattatgatgatgaagttgggatggtaggtgatttggttttgtttgattttgatgattatgaggatgataataa

SEQ ID NO: 61144 - DNA, 75 bp, Artificial Sequence
  Synthetic
cgctacgactccaagttcaaaggagttcatactggcttagccatttagtgcaatatgctgatattaatttgcact

SEQ ID NO: 61145 - DNA, 75 bp, Artificial Sequence
  Synthetic
agtttttgagttataggatagtttgttataattttaaagggaaatagagagagaaagattaatttatttattttt

SEQ ID NO: 61146 - DNA, 75 bp, Artificial Sequence
  Synthetic
tgagttatgttaatttgggtttcccttcattggaaaaggttctttaccatcgatataacctagttgattcacgga

SEQ ID NO: 61147 - DNA, 75 bp, Artificial Sequence
  Synthetic
aggtaataataaggatgataattgagttttagataataattaataattagtagattttgaggaataaggaggtta

SEQ ID NO: 61148 - DNA, 75 bp, Artificial Sequence
  Synthetic
agggtccactggtctcgatcctttaccatttaacacacttgcaagcagaaattagagaattggtgtgtgactata

SEQ ID NO: 61149 - DNA, 75 bp, Artificial Sequence
  Synthetic
atataattggtattgaggtttagaatgtatgattgttaattgaagatttttattagtgtatgaagaggatatttt

SEQ ID NO: 61150 - DNA, 75 bp, Artificial Sequence
  Synthetic
atcagcaacgacaaagtcgaacccaaacataccacttcatcaaaacgacaaagggccggattacaaaattagtca

SEQ ID NO: 61151 - DNA, 75 bp, Artificial Sequence
  Synthetic
tatggattaaggtgatgatgattttttaagtttatttttgttggaatttgatgatgatgatgtattaagtagtta

SEQ ID NO: 61152 - DNA, 75 bp, Artificial Sequence
  Synthetic
atgactaccttaaattttatctcgtagtgcaagcactgaagcataattgtctttggcaggaagaactcagaacac

SEQ ID NO: 61153 - DNA, 75 bp, Artificial Sequence
  Synthetic
ataagattttgattatatagttgttgttttttttgtttttgtatattgtagtgtagaagtttatgagttttttta

SEQ ID NO: 61154 - DNA, 75 bp, Artificial Sequence
  Synthetic
ttcctgacttaatcaatgtttgcaatcgattttaccatataagggactgctcatgtgaagatcgatttttaattc

SEQ ID NO: 61155 - DNA, 75 bp, Artificial Sequence
  Synthetic
taaatttttgaatgagttagttgaaatattataattgaatgaagattttgatattggttaattaaagtttatgta

SEQ ID NO: 61156 - DNA, 75 bp, Artificial Sequence
  Synthetic
aaactctttacttaacccgtatgcaagactcagaagtaaaattaatggagagattaaccgggtttctaggattgt

SEQ ID NO: 61157 - DNA, 75 bp, Artificial Sequence
  Synthetic
aaaattagaagagatatattattatttgttgagaatttaaggtttatttgaagttattaattattattatatgat

SEQ ID NO: 61158 - DNA, 75 bp, Artificial Sequence
  Synthetic
atcctaatggtattaacacttaagatccccttagaggcatcgcaatatgactccaaacattaaatgatattgctg

SEQ ID NO: 61159 - DNA, 75 bp, Artificial Sequence
  Synthetic
tccccttagaggcatcgcaatatgactccaaacattaaatgatattgctgtcaatatatctacctgaccgagagt

SEQ ID NO: 61160 - DNA, 75 bp, Artificial Sequence
  Synthetic
gaaggatgagttggtaatatttagtattgatgatgggaaggaatatatttatttggatttatttgaggaagttta

SEQ ID NO: 61161 - DNA, 75 bp, Artificial Sequence
  Synthetic
aaggtttattataaaaaatctatacacatgactgcaatgcgtgatttataccgaaacacagtgagggctgcacat

SEQ ID NO: 61162 - DNA, 75 bp, Artificial Sequence
  Synthetic
ttttttatggtttattgagaaagaatgattggataaagagaattgttatatttatataaataattaatagttttt

SEQ ID NO: 61163 - DNA, 75 bp, Artificial Sequence
  Synthetic
ccgaaacacagtgagggctgcacatgcaggttcctgttgagcttaaaaagatcatgcaatacaaaatgatatttg

SEQ ID NO: 61164 - DNA, 75 bp, Artificial Sequence
  Synthetic
ttggtttgttatgagttttagagataaattttttgtaattttgtagtattattagtaattatagtataaagtgtg

SEQ ID NO: 61165 - DNA, 75 bp, Artificial Sequence
  Synthetic
atcatgcaatacaaaatgatatttgtatactaatcatgttaatactaactaacagtactcactgcatataccata

SEQ ID NO: 61166 - DNA, 75 bp, Artificial Sequence
  Synthetic
gtttattttgtaaagttaaatatatttaagatttgattgatttatttataaaaattaatttattataatttatta

SEQ ID NO: 61167 - DNA, 75 bp, Artificial Sequence
  Synthetic
tcaattaagaaaaattactgtggtttatgcatttaaatgacatcacggatggatataatatagttaattcttacc

SEQ ID NO: 61168 - DNA, 75 bp, Artificial Sequence
  Synthetic
gtgttatttttttataagtgatttttaatttaaggttattaagagtttaagtaatatatatatatatttatattg

SEQ ID NO: 61169 - DNA, 75 bp, Artificial Sequence
  Synthetic
taaatgttgagttatagtaatttgaagttgtaattatgattagtgcttatactataaataatagctataccaagt

SEQ ID NO: 61170 - DNA, 75 bp, Artificial Sequence
  Synthetic
actataaataatagctataccaagtatacacaagaagttatgattttgtatttaagttatattcacaggaacttg

SEQ ID NO: 61171 - DNA, 75 bp, Artificial Sequence
  Synthetic
gtttatttaagatgtggtttaatgtttttgatttgaatatagttataaggggataaataatattttatatttttg

SEQ ID NO: 61172 - DNA, 75 bp, Artificial Sequence
  Synthetic
atacacaagaagttatgattttgtatttaagttatattcacaggaacttgtgattaataacaaaagtctcagttg

SEQ ID NO: 61173 - DNA, 75 bp, Artificial Sequence
  Synthetic
attgtggattgatttattttgtttaaaatgttttgtttattgaaaatgtgatttaatagatagttttgattagat

SEQ ID NO: 61174 - DNA, 75 bp, Artificial Sequence
  Synthetic
ttggttgttgagttgcaaaacccccgttaaaaatttattttccacttataactaataataatcatagatcagtat

SEQ ID NO: 61175 - DNA, 75 bp, Artificial Sequence
  Synthetic
actaataataatcatagatcagtatgagttgaggctatttagaccttagaaaaattgtgcgatgttttttaccat

SEQ ID NO: 61176 - DNA, 75 bp, Artificial Sequence
  Synthetic
aaattaagaaaaatatttgatgaagattaaaatttttattgttagtaaatgattatattgtttgtaggtaggtgt

SEQ ID NO: 61177 - DNA, 75 bp, Artificial Sequence
  Synthetic
atcaatcttgatttcaatgatattggagggcttgtcgataaatttagtaattaacattaagtcagtgtggaacct

SEQ ID NO: 61178 - DNA, 75 bp, Artificial Sequence
  Synthetic
ttattttattttaaatttggaaatattttattttaggattattgttaagaggtgtataggtattattatttttga

SEQ ID NO: 61179 - DNA, 75 bp, Artificial Sequence
  Synthetic
gtgtggaacctcattggatatttgatcgtacacaaaaatatctttacaaaattgttttctcttttttgtgtgtcc

SEQ ID NO: 61180 - DNA, 75 bp, Artificial Sequence
  Synthetic
cggacacacaaaaagaaagaaaagtttttaagactttttgtgtgcgaataactatgaggaagattaatcattttc

SEQ ID NO: 61181 - DNA, 75 bp, Artificial Sequence
  Synthetic
gaatatgtataataataaattgaaggtatgtttaggtttagaaatgattggatggatttttgagtaatttatgat

SEQ ID NO: 61182 - DNA, 75 bp, Artificial Sequence
  Synthetic
aggtaagattttagtaattgatatatttattgatattgataataagttagattaaatggaagtttgatttaaatt

SEQ ID NO: 61183 - DNA, 75 bp, Artificial Sequence
  Synthetic
attattaaggagtttaataagaatttgtataagtagtagttagatggaggttaattatgtatttttttttaaaaa

SEQ ID NO: 61184 - DNA, 75 bp, Artificial Sequence
  Synthetic
ggttgaggatatattaattatgttagtgaatgttattagttgttagaatgttgtaattgaggtttttgaaaattg

SEQ ID NO: 61185 - DNA, 75 bp, Artificial Sequence
  Synthetic
ctcctacaattctaaccttcttgataagtgtggttaccagagtaatagactaaatttgtcctggtagttagcatt

SEQ ID NO: 61186 - DNA, 75 bp, Artificial Sequence
  Synthetic
ttttagtatatttgagagtagtttaaagttaatttaagatatgggtaaagtgattttattattgaattgtagttg

SEQ ID NO: 61187 - DNA, 75 bp, Artificial Sequence
  Synthetic
ttctagtaagaccgatactatcccaagtctcaagagagggtgagaggagggccccgaggtatccctttagtccac

SEQ ID NO: 61188 - DNA, 75 bp, Artificial Sequence
  Synthetic
gccccgaggtatccctttagtccacaaaatctagccaattttagctaagtggactgattaccttcatcacacgct

SEQ ID NO: 61189 - DNA, 75 bp, Artificial Sequence
  Synthetic
tgttgaaatggttgtaaaatatgattttttagttatgataattggatgggttattttaattgtagttgtagtaga

SEQ ID NO: 61190 - DNA, 75 bp, Artificial Sequence
  Synthetic
atctactaagggtttacctgagagcctacaacatggataaacgggtgagaggttcatgggccctgggaggacaat

SEQ ID NO: 61191 - DNA, 75 bp, Artificial Sequence
  Synthetic
tgtgtattggaaagagtataaatagttattattagggttagtgttgtatgaagagaatgtgtttaaaggaaaaat

SEQ ID NO: 61192 - DNA, 75 bp, Artificial Sequence
  Synthetic
ctgaggttgatcttgactaccacaagatattaacagccgggctttcagtccaacaggggattgtgcgacagagag

SEQ ID NO: 61193 - DNA, 75 bp, Artificial Sequence
  Synthetic
tgatgatttaaatagttatgtattagatgttgtgtaagaggtttataagaattttgatagtatattgattttgat

SEQ ID NO: 61194 - DNA, 75 bp, Artificial Sequence
  Synthetic
tcatcccggtatatgtcgtgaatgatcttgagggtatttgtcaacatatcattcaggcttttgaagcaggtgtag

SEQ ID NO: 61195 - DNA, 75 bp, Artificial Sequence
  Synthetic
tgaggaaaattttgggaaattttatatatttgttaaagatttgaaggagattatgtatgattatttatttggttt

SEQ ID NO: 61196 - DNA, 75 bp, Artificial Sequence
  Synthetic
tcttgagggtatttgtcaacatatcattcaggcttttgaagcaggtgtagatttccaggataatgctgatagctt

SEQ ID NO: 61197 - DNA, 75 bp, Artificial Sequence
  Synthetic
tgggattgttttttattaatttgtttaagtgatttgtaaaataggaaaggataataattttttggatataattta

SEQ ID NO: 61198 - DNA, 75 bp, Artificial Sequence
  Synthetic
ccttttacttttatgtttacatcatgcctaccaaggagatcataggctcttcctcaaaagtgatgcagttcaata

SEQ ID NO: 61199 - DNA, 75 bp, Artificial Sequence
  Synthetic
tgttgagttttaggtaagtttagtagatggtgattttttttaatgtgtatttatatagataattaaaagggtttt

SEQ ID NO: 61200 - DNA, 75 bp, Artificial Sequence
  Synthetic
tttagagggccatggcttcaggtttgaggtccgagaaaaggagaatgtgcaccgtctggatgaattgttgcccaa

SEQ ID NO: 61201 - DNA, 75 bp, Artificial Sequence
  Synthetic
accgtctggatgaattgttgcccaatgttaccggtggaaaaaatctcaggagaacattggctgctatgcccgaag

SEQ ID NO: 61202 - DNA, 75 bp, Artificial Sequence
  Synthetic
aattttttaggatgtgttgtttttgataatttatattagattttgtggtgatattttatgagtatgttaaaagag

SEQ ID NO: 61203 - DNA, 75 bp, Artificial Sequence
  Synthetic
tttttgattagtattattattatttaaaattgattgtggttgggtttgtttgtttaagatgtaagatggtaaaat

SEQ ID NO: 61204 - DNA, 75 bp, Artificial Sequence
  Synthetic
tttctacccaaacttgtcgttggggagaaagcgtgcctggaaaaagtacaaaggcaaattcaggtccatgcagaa

SEQ ID NO: 61205 - DNA, 75 bp, Artificial Sequence
  Synthetic
gtttggatttaagatttaagaattaagatttatttaataaggtaagttataattttagatggaattttagttaga

SEQ ID NO: 61206 - DNA, 75 bp, Artificial Sequence
  Synthetic
caagggctcattcaatatccaacttcctggcaatcagttggacacatgatggtgatcttccgtttgatgaggaca

SEQ ID NO: 61207 - DNA, 75 bp, Artificial Sequence
  Synthetic
ttattgaattattgatgttgttgatgataatatataattaatggttttatttgaatatgataatattttgttttt

SEQ ID NO: 61208 - DNA, 75 bp, Artificial Sequence
  Synthetic
aactttttaatcaagtttctactaatacatcaagggatgcacatggttgcaggtcatgatgcgaatgacacagta

SEQ ID NO: 61209 - DNA, 75 bp, Artificial Sequence
  Synthetic
tgttttgttttgtagttttttgaattggaagattattttaaatttataaatatgtataagatgttatggtttagt

SEQ ID NO: 61210 - DNA, 75 bp, Artificial Sequence
  Synthetic
atatctaattctgttgcccaggcaaggttctctggtcttctgattgtaaagactgttctggatcacatcctacaa

SEQ ID NO: 61211 - DNA, 75 bp, Artificial Sequence
  Synthetic
aaagaattgataggagtattggtatataatgtaaatataataagtgatgaagattaagaaaaattagttggtatt

SEQ ID NO: 61212 - DNA, 75 bp, Artificial Sequence
  Synthetic
ggttctctggtcttctgattgtaaagactgttctggatcacatcctacaaaaaacagatctcggagtacgacttc

SEQ ID NO: 61213 - DNA, 75 bp, Artificial Sequence
  Synthetic
ttttagatttggtattttttatttttattttttaaagtgagatattttattattaaaaaatgaggtgtggagtgt

SEQ ID NO: 61214 - DNA, 75 bp, Artificial Sequence
  Synthetic
atccactggccaggacagcaaaagtgaagaatgaggtcagttcattcaaggcggctcttggttcacttgccaagc

SEQ ID NO: 61215 - DNA, 75 bp, Artificial Sequence
  Synthetic
atggagaatatgctccgtttgcacgtctccttaatctttctggagtcaacaacttggaacatgggctttatccac

SEQ ID NO: 61216 - DNA, 75 bp, Artificial Sequence
  Synthetic
tattaatggtttttttagtatataatgatattgtatattttatgagtatatttttaatttgattaagtgttatag

SEQ ID NO: 61217 - DNA, 75 bp, Artificial Sequence
  Synthetic
aacttggaacatgggctttatccacaactttcagccatcgctttgggtgttgcaactgcccacgggagtacgctt

SEQ ID NO: 61218 - DNA, 75 bp, Artificial Sequence
  Synthetic
ttaatgagattaaattagatgtattggtagtgttaggggtagatgttttattaaattttatgagattagtggttg

SEQ ID NO: 61219 - DNA, 75 bp, Artificial Sequence
  Synthetic
gctggtgtgaatgtaggggagcaatatcagcaactgcgtgaggctgctactgaggctgaaaagcaactccaacaa

SEQ ID NO: 61220 - DNA, 75 bp, Artificial Sequence
  Synthetic
atgataatattgattatttaagttatattttaagtggagtagtttttgtttttatattggaagttatagtgaatg

SEQ ID NO: 61221 - DNA, 75 bp, Artificial Sequence
  Synthetic
atcagcaactgcgtgaggctgctactgaggctgaaaagcaactccaacaatatgctgaaacacgtgagttggata

SEQ ID NO: 61222 - DNA, 75 bp, Artificial Sequence
  Synthetic
accttgggcttgatgaacaggagaagaagattctcatgagcttccaccagaagaagaatgagatcagcttccagc

SEQ ID NO: 61223 - DNA, 75 bp, Artificial Sequence
  Synthetic
taattttgggaataaaagttttgatgaagtaaatatttatttggtttttattgggtgtagttgattagaagatat

SEQ ID NO: 61224 - DNA, 75 bp, Artificial Sequence
  Synthetic
agaccaatgcaatggtaaccttgaggaaagaacggctggctaaattgaccgaagccatcacgactgcatcgaaga

SEQ ID NO: 61225 - DNA, 75 bp, Artificial Sequence
  Synthetic
atagttttgatttaataatagttgtaattatgttggttttttatatagtgatatattttgggaagatatttaatt

SEQ ID NO: 61226 - DNA, 75 bp, Artificial Sequence
  Synthetic
gaagccatcacgactgcatcgaagatcaaggttggagaccgttatcctgatgacaatgatattccatttcccggg

SEQ ID NO: 61227 - DNA, 75 bp, Artificial Sequence
  Synthetic
tgttggtatgtgttaataggttaggtttaggaatatttgattatttgttatgatttttaaggttgggtaattagg

SEQ ID NO: 61228 - DNA, 75 bp, Artificial Sequence
  Synthetic
tgacaatgatattccatttcccgggccgatctatgatgacactcaccccaatccctctgatgataatcctgatga

SEQ ID NO: 61229 - DNA, 75 bp, Artificial Sequence
  Synthetic
tatttttttaagagtttgtttttttattagtttagtttttttagtattttatatttgatttaatagttttaaagt

SEQ ID NO: 61230 - DNA, 75 bp, Artificial Sequence
  Synthetic
ttcacgtgatacaactattccaggtggtgttgttgacccgtatgatgatgagagtaataattatcctgactacga

SEQ ID NO: 61231 - DNA, 75 bp, Artificial Sequence
  Synthetic
ttattatttaattattgttagttgtaatttggatagatgaaattttagtaggagtagttaatgttttttgttttg

SEQ ID NO: 61232 - DNA, 75 bp, Artificial Sequence
  Synthetic
ggattcggctgaaggcaccacaggagatcttgatctcttcaatttggacgacgacgatgatgacagccgaccagg

SEQ ID NO: 61233 - DNA, 75 bp, Artificial Sequence
  Synthetic
acgacgatgatgacagccgaccaggaccaccagacagggggcagaacaaggagagggcggcccggacatatggcc

SEQ ID NO: 61234 - DNA, 75 bp, Artificial Sequence
  Synthetic
ggtttttattttattttaagttttgtttaatttttttgttggggaagataggaaagaaaggatatgttttagatt

SEQ ID NO: 61235 - DNA, 75 bp, Artificial Sequence
  Synthetic
tccaagatccgaccttggacggagcgaaaaaggtgccggagttgaccccaggttcccatcaaccaggcaacctcc

SEQ ID NO: 61236 - DNA, 75 bp, Artificial Sequence
  Synthetic
taatattatttgataagatttaaataattatgaatgtaatattggattttaaaattgttttgattgatttaatta

SEQ ID NO: 61237 - DNA, 75 bp, Artificial Sequence
  Synthetic
gaaaaaggtgccggagttgaccccaggttcccatcaaccaggcaacctccaaatcaccaagtcgggttcaaacac

SEQ ID NO: 61238 - DNA, 75 bp, Artificial Sequence
  Synthetic
agaatatagttggaattgaggttttagaattattagtttaaaggttgattggtaaaaaattataatttaaaaatg

SEQ ID NO: 61239 - DNA, 75 bp, Artificial Sequence
  Synthetic
caaccaaccacaaggcaatatgtcatctactctccatagtatgacccctatacaggaagaatcagagcccgatga

SEQ ID NO: 61240 - DNA, 75 bp, Artificial Sequence
  Synthetic
gttaattaattattttagttttttttttgaaatatgttggatttgattttatattgttaggggatttaattatgg

SEQ ID NO: 61241 - DNA, 75 bp, Artificial Sequence
  Synthetic
tcaaaaagataatgatgacgagagtctcacatcccttgactctgaaggtgacgaagatggtgagagcatctctga

SEQ ID NO: 61242 - DNA, 75 bp, Artificial Sequence
  Synthetic
ttattatttaggattgtgatttatgttattttttagttagttatttgtattatatggataagtagaatagttatt

SEQ ID NO: 61243 - DNA, 75 bp, Artificial Sequence
  Synthetic
ggagaacaccccaactgtagctccaccagcaccagtctacaaagacactggagtagacactaatcagcagaatgg

SEQ ID NO: 61244 - DNA, 75 bp, Artificial Sequence
  Synthetic
aataatttaaattttatttgagttattattttgttagtaattttgatgggattaatagattaaaaatttgattgt

SEQ ID NO: 61245 - DNA, 75 bp, Artificial Sequence
  Synthetic
accaagcagtactgtagatagtcaaggttctgaaagtgaagctctcccaatcaactctaaaaagagttccgcact

SEQ ID NO: 61246 - DNA, 75 bp, Artificial Sequence
  Synthetic
atagaattataaaagaattaagtagaggtaatagatttatagtttatgtttagataattaatattaaggagtttt

SEQ ID NO: 61247 - DNA, 75 bp, Artificial Sequence
  Synthetic
agaagaaacatattatcatctcctaaaaacacagggtccatttgaggcaatcaattattattacctaatgagtga

SEQ ID NO: 61248 - DNA, 75 bp, Artificial Sequence
  Synthetic
ttaatttaattttttagttttgagtaataattattttttttgtaattaattatgtatttgttaatttattggtgt

SEQ ID NO: 61249 - DNA, 75 bp, Artificial Sequence
  Synthetic
tgaacccattgcttttagcactgaaagtggcaaggaatatatctttccagactcccttgaagaagcctacccgcc

SEQ ID NO: 61250 - DNA, 75 bp, Artificial Sequence
  Synthetic
gagatttttttgagaatttggtggagtttttattatttgtagtaattagaagagaagtttaatttagttaaaatt

SEQ ID NO: 61251 - DNA, 75 bp, Artificial Sequence
  Synthetic
gtggttgagtgagaaggaggccttagagaaggaaaatcgttatctggtcattgatggccagcaattcctctggcc

SEQ ID NO: 61252 - DNA, 75 bp, Artificial Sequence
  Synthetic
aaattaagtaatattttgaatgttttatagtttattttaattagaggtataataatggttaagattttaatgatt

SEQ ID NO: 61253 - DNA, 75 bp, Artificial Sequence
  Synthetic
ggtaatgagcctacaggacaagttccttgccgttcttcaacatgactgaggacctatgattggtggatcttgttt

SEQ ID NO: 61254 - DNA, 75 bp, Artificial Sequence
  Synthetic
tgttaataattgttagtaattttaatttttagattaagaaaaagatatatgatgaagattaaggtgataatgagt

SEQ ID NO: 61255 - DNA, 75 bp, Artificial Sequence
  Synthetic
attccgagcctgattataattgttctgataattcaagtataagcacctactccgaaatataaaccctatcttagt

SEQ ID NO: 61256 - DNA, 75 bp, Artificial Sequence
  Synthetic
tgaaattttattttttttaaagatttaatattatttgttttaaagttatataaggatatatttaaattagggatt

SEQ ID NO: 61257 - DNA, 75 bp, Artificial Sequence
  Synthetic
tataaggaaattaaataaataacctgtaagttataggactacgaagagctgcttgtgtcaatttatcatgggttg

SEQ ID NO: 61258 - DNA, 75 bp, Artificial Sequence
  Synthetic
gtaagttgttattttttatttttttaaattatttatataatatggggttaggatattaatttttttaattgtttt

SEQ ID NO: 61259 - DNA, 75 bp, Artificial Sequence
  Synthetic
atacccgtaccgcaagaatcattatttagtagttttggtcagcttctgatatgtaccaataagaaaacattatag

SEQ ID NO: 61260 - DNA, 75 bp, Artificial Sequence
  Synthetic
ttagtagttttggtcagcttctgatatgtaccaataagaaaacattatagcattaaaacataaggtatctttcaa

SEQ ID NO: 61261 - DNA, 75 bp, Artificial Sequence
  Synthetic
gggaatgtttttgtaaaattttgtttttagtatgggtaattatttttttttagtgagtaatttttatgttgtttg

SEQ ID NO: 61262 - DNA, 75 bp, Artificial Sequence
  Synthetic
gtatagtgataaatagtatttttaaagtaatagaaattgattaattggtttgttgggataaattgttattaatta

SEQ ID NO: 61263 - DNA, 75 bp, Artificial Sequence
  Synthetic
accttcatcatcttttaaaaagagagctatttctgatctaaatgttcttattaatgtcaaagagctattagtttg

SEQ ID NO: 61264 - DNA, 75 bp, Artificial Sequence
  Synthetic
gttagtttaagtttgtggggttgaatttggaaggaaatggaattgtaattgatgttttattagtaataaaatgtt

SEQ ID NO: 61265 - DNA, 75 bp, Artificial Sequence
  Synthetic
ttaatgtcaaagagctattagtttgtatcctcttagcctagacgctgcctaacatataagccatgcagcaggata

SEQ ID NO: 61266 - DNA, 75 bp, Artificial Sequence
  Synthetic
ggggattttgtttaggtgtgttttttaaggtggttagttatgaagttggagaatgggtagaaaattgttataatt

SEQ ID NO: 61267 - DNA, 75 bp, Artificial Sequence
  Synthetic
tggagattaaaaagttagatggaagtgaatgttttttttttttttttgatggtgtatgaggattttttagatgtt

SEQ ID NO: 61268 - DNA, 75 bp, Artificial Sequence
  Synthetic
cagaggtgtttgttgacgttgaaaccaagccaagtcctaccccgataaccattattagtaagaatcctaaaacaa

SEQ ID NO: 61269 - DNA, 75 bp, Artificial Sequence
  Synthetic
attattagtaagaatcctaaaacaacgcgtaaaagtgataagcaagtccaaacagatgatgctagtagcttattg

SEQ ID NO: 61270 - DNA, 75 bp, Artificial Sequence
  Synthetic
gttatgtttataaagtttaaggaataggtttttgttttggtgatttagttttttataaaaatggggttttttttt

SEQ ID NO: 61271 - DNA, 75 bp, Artificial Sequence
  Synthetic
acagaagaggtcaagactgccataaattcggtgatatcagctgtgcgtcggcaaaccaatgctattgaatcacta

SEQ ID NO: 61272 - DNA, 75 bp, Artificial Sequence
  Synthetic
tgtatgatagattggttttaattgttatttattgagggataatttttgttgaaggtgttgtagtttttttaattt

SEQ ID NO: 61273 - DNA, 75 bp, Artificial Sequence
  Synthetic
gaaagtcgaatagcaaaccttgaggccagcttaaaaccagttcaagatatggcaaagaccatttcatccctgaat

SEQ ID NO: 61274 - DNA, 75 bp, Artificial Sequence
  Synthetic
tgttagagtttaagaagtatttttggaaggttatattagtttatgaattggtgaatataatagatgattttataa

SEQ ID NO: 61275 - DNA, 75 bp, Artificial Sequence
  Synthetic
ccagcttaaaaccagttcaagatatggcaaagaccatttcatccctgaatcgcagttgtgctgaaatggttgcaa

SEQ ID NO: 61276 - DNA, 75 bp, Artificial Sequence
  Synthetic
gttattatatgattttgatatttagttatgagatgttaaattttgggggtaatgaaagtaatattttttttaagg

SEQ ID NO: 61277 - DNA, 75 bp, Artificial Sequence
  Synthetic
tagataattatatatatgtgtaattagattgtttatatattttgtagttttttgtttagtttaatgaaatatttt

SEQ ID NO: 61278 - DNA, 75 bp, Artificial Sequence
  Synthetic
atggacaagcacctccaggcccatcattgtacgaagatgatgctatcaaggctaaattgaaagatccgaacggga

SEQ ID NO: 61279 - DNA, 75 bp, Artificial Sequence
  Synthetic
gaagaaataattgttttagtaatagtatagggagattgatttggatattggattttaaaattgaattagatgttg

SEQ ID NO: 61280 - DNA, 75 bp, Artificial Sequence
  Synthetic
aagttccagagagtgtcaaacaggcctacacaaatctggatagcacaagtgccctcaatgaggaaaattttgggc

SEQ ID NO: 61281 - DNA, 75 bp, Artificial Sequence
  Synthetic
gccctcaatgaggaaaattttgggcgaccttacatctcagcaaaagatctcaaggaaatcatctatgatcatctc

SEQ ID NO: 61282 - DNA, 75 bp, Artificial Sequence
  Synthetic
gtgagtgggttttttgggaaattaaaaaaattttttttaataattttatggagaaaatttgtatttttaaatttt

SEQ ID NO: 61283 - DNA, 75 bp, Artificial Sequence
  Synthetic
ccaggatttgggacagcctttcatcagctggtgcaggttatctgcaaaattggtaaggataataatatcctagac

SEQ ID NO: 61284 - DNA, 75 bp, Artificial Sequence
  Synthetic
attaatttatattaataattttttagattagagtttggtgggaattgtttaaggaaaaattagttattatttatt

SEQ ID NO: 61285 - DNA, 75 bp, Artificial Sequence
  Synthetic
ataatccatgcagaattccaagcaagcttggctgagggagactccccccagtgtgcattaatccagataacaaaa

SEQ ID NO: 61286 - DNA, 75 bp, Artificial Sequence
  Synthetic
tgttaataattttgagttggttttaatggatttttttttagtggttttagtgtttattgtaggatggatagagga

SEQ ID NO: 61287 - DNA, 75 bp, Artificial Sequence
  Synthetic
gtgtgcattaatccagataacaaaacggatccctactttccaagatgcctctcctccaatcgtgcatataaagtc

SEQ ID NO: 61288 - DNA, 75 bp, Artificial Sequence
  Synthetic
aatgttgatttaaggtttaattaatggagagataattataggttttattgtgaatttaatgataattattattgt

SEQ ID NO: 61289 - DNA, 75 bp, Artificial Sequence
  Synthetic
tcgaggagatatacccaaagcctgtcagaaaagcctccggccggtcccaccgtcaccaaagatcgatagaggttg

SEQ ID NO: 61290 - DNA, 75 bp, Artificial Sequence
  Synthetic
tttaagtttaattatgataagtgaggttgataataatgtattaagtgaatagttgaataatatagtatttattga

SEQ ID NO: 61291 - DNA, 75 bp, Artificial Sequence
  Synthetic
agatttttttttattggtaagtaatgagataatttattattttgagatggatttgatttaaggtttgaataattt

SEQ ID NO: 61292 - DNA, 75 bp, Artificial Sequence
  Synthetic
ttgcgatggcaaagtgatacttatgactgtttggaatcaagttagactcatagtctatcacgtcataagcttata

SEQ ID NO: 61293 - DNA, 75 bp, Artificial Sequence
  Synthetic
tgtttagagtttatagattaagattatgttagtatttataatatttttgatgatttaggatttgtaagagatggt

SEQ ID NO: 61294 - DNA, 75 bp, Artificial Sequence
  Synthetic
agtcagttaaaaatttatcctctatcctaatcaattgatgatgctgtcaatagggagattcccctgtattgtaat

SEQ ID NO: 61295 - DNA, 75 bp, Artificial Sequence
  Synthetic
taatagtagtaaattaggaattagtttaggaagtgtagttggattaagttagtttggatttattataaatatagt

SEQ ID NO: 61296 - DNA, 75 bp, Artificial Sequence
  Synthetic
aaaacctcattaacatatctcccctgcttggtactatgtagaaacccttgaataaatcaaaattgatgaagatta

SEQ ID NO: 61297 - DNA, 75 bp, Artificial Sequence
  Synthetic
aagtaaggtagttgatttattgagttttattaggaaataaaagtgattggtttgataaaatattgttaataaatg

SEQ ID NO: 61298 - DNA, 75 bp, Artificial Sequence
  Synthetic
agaaaaagagggattttctcaggaaaaatcttctttcttaccttcatcttatttagataaatctaggatttaggg

SEQ ID NO: 61299 - DNA, 75 bp, Artificial Sequence
  Synthetic
taatttagatttttattattggatagttgttgatgagggggtagtagtaggattggtatggattttatattttgg

SEQ ID NO: 61300 - DNA, 75 bp, Artificial Sequence
  Synthetic
aaaatgagaagggttactgtgccgactgcaccacctgcatatgctgacattggctatcctatgagcatgcttcca

SEQ ID NO: 61301 - DNA, 75 bp, Artificial Sequence
  Synthetic
atttgtagtagaaggtatttatattgagggtgtaatgtataattagaatgggtttatttgtgggttatgttagtt

SEQ ID NO: 61302 - DNA, 75 bp, Artificial Sequence
  Synthetic
ctgcaccacctgcatatgctgacattggctatcctatgagcatgcttccaatcaagtcaagcagggctgtaagtg

SEQ ID NO: 61303 - DNA, 75 bp, Artificial Sequence
  Synthetic
agttaatgaaattatttaggttttttaattatttttgtgggttataatagaattgaggatttatttattttttaa

SEQ ID NO: 61304 - DNA, 75 bp, Artificial Sequence
  Synthetic
tagaaaagttattgatttttttttttaatgatggggaggtatttgttgaattttaggattattttgttgtattga

SEQ ID NO: 61305 - DNA, 75 bp, Artificial Sequence
  Synthetic
aaacggagtggcctcagcattcatcttggaggcaactgtcaatgtgatctcggggcccaaagtcctcatgaaaca

SEQ ID NO: 61306 - DNA, 75 bp, Artificial Sequence
  Synthetic
gttatatgattggataaaaaatattattgatgaaattaattaaattaaatatgattttattgataattttttatt

SEQ ID NO: 61307 - DNA, 75 bp, Artificial Sequence
  Synthetic
ttgactcaacaacagcagcaattatgctcgcatcctacacgatcactcattttggaaaggccaacaaccccctcg

SEQ ID NO: 61308 - DNA, 75 bp, Artificial Sequence
  Synthetic
agattatggagatgattttaatttatggataggttggagataatggattttggttggaattgggattattggagt

SEQ ID NO: 61309 - DNA, 75 bp, Artificial Sequence
  Synthetic
tcagagtgaatcgacttggtcaaggaataccggatcacccactcagattgctcaggatggggaaccaggctttcc

SEQ ID NO: 61310 - DNA, 75 bp, Artificial Sequence
  Synthetic
tataattgttataatagttttattttgtatatgtaagattttgtgttgatttattttgagatttgagagagaaaa

SEQ ID NO: 61311 - DNA, 75 bp, Artificial Sequence
  Synthetic
ttcaagagtttgtgctaccaccagttcaactgccgcaatatttcacttttgatctgactgcactcaaattagtga

SEQ ID NO: 61312 - DNA, 75 bp, Artificial Sequence
  Synthetic
attttagggttattttaaggagaaatattatttttaaaatttatttgaatgttgattatttattttaaatgagta

SEQ ID NO: 61313 - DNA, 75 bp, Artificial Sequence
  Synthetic
cacagcctctccctgctgcaacatggacagatgagactccgagcaacctttcaggagcactccgtccagggctct

SEQ ID NO: 61314 - DNA, 75 bp, Artificial Sequence
  Synthetic
attaataatatgtttttttgtttttttgtttgatttataatatgatattttttttaataatgattaatatattaa

SEQ ID NO: 61315 - DNA, 75 bp, Artificial Sequence
  Synthetic
gacagatgagactccgagcaacctttcaggagcactccgtccagggctctcatttcacccgaaactgagacccgt

SEQ ID NO: 61316 - DNA, 75 bp, Artificial Sequence
  Synthetic
gaaaaatttatgatgaagattaaaggagaggattgttaatgggaaaattttttattttgtttgttgaagttatgt

SEQ ID NO: 61317 - DNA, 75 bp, Artificial Sequence
  Synthetic
ccccagacaaaatccagacaattgtgaacctgatgcaagatttcaagattgtgccaatcgacccagccaagagca

SEQ ID NO: 61318 - DNA, 75 bp, Artificial Sequence
  Synthetic
tggtggtgtttgtagttgagaataattttagagattgtaggtagaaaggattaatatttataggtaggggttaga

SEQ ID NO: 61319 - DNA, 75 bp, Artificial Sequence
  Synthetic
tcattgggatcgaggttccagaattgctggtccacaagctcaccgggaagaaaatgagtcagaagaacggacagc

SEQ ID NO: 61320 - DNA, 75 bp, Artificial Sequence
  Synthetic
aagtaataataattataaaaggagagtttgatattgttatttaatattttagaatttgatttttaggttttagtt

SEQ ID NO: 61321 - DNA, 75 bp, Artificial Sequence
  Synthetic
ctataattcctgtcttactcccaaaatacattgggctagatccaatctcgcccggagacctaactatggtcataa

SEQ ID NO: 61322 - DNA, 75 bp, Artificial Sequence
  Synthetic
ttaaaatttggatgatggagtatttaagagaatggggtagatttagtaatatgtgatataatagttgggaattat

SEQ ID NO: 61323 - DNA, 75 bp, Artificial Sequence
  Synthetic
caccagattatgatgattgtcattcacccgccagttgctcttatctcagtgaaaagtgattctcacaaagtgaga

SEQ ID NO: 61324 - DNA, 75 bp, Artificial Sequence
  Synthetic
atgaaaatttattaaggttttgtttattattttgggattttaattaggttgattgtagatagttttgaagtgtat

SEQ ID NO: 61325 - DNA, 75 bp, Artificial Sequence
  Synthetic
gagacacctccagtaaagaaatcaaatcttatctatagcaactcaatcgacttttggaaggctagcagtacatat

SEQ ID NO: 61326 - DNA, 75 bp, Artificial Sequence
  Synthetic
tttaaatttgtgttttgaatttgttttattggaaaaagattgatgtatttatagtttttttggtttttaaagata

SEQ ID NO: 61327 - DNA, 75 bp, Artificial Sequence
  Synthetic
cttttggaaggctagcagtacatatactatgggacaactcaaccctcctgttaaaatgtactaatcgggtcaagg

SEQ ID NO: 61328 - DNA, 75 bp, Artificial Sequence
  Synthetic
tatgtttaatatttaaaaaaggatttttttgtgatagtaaattttgtaaaaaagattattaattggatagtttaa

SEQ ID NO: 61329 - DNA, 75 bp, Artificial Sequence
  Synthetic
aactctcactgatcaagtctaaatccaggatagaaccagcccaaagggtctcctccaagtctcccacaagcttag

SEQ ID NO: 61330 - DNA, 75 bp, Artificial Sequence
  Synthetic
atgattatgaattattattgttaattgtaagaagaatatgtggaattattgagagtaatttgtagattatatttt

SEQ ID NO: 61331 - DNA, 75 bp, Artificial Sequence
  Synthetic
ccaatcaatttacatgcgtaagcgatccatacttaatccaattagtgttcgatgctcacccctccaagcctcctt

SEQ ID NO: 61332 - DNA, 75 bp, Artificial Sequence
  Synthetic
taaaagatatgtggttagtgaatttaatagttgaagattttttataaggtaatagttttaaattaatatttgtag

SEQ ID NO: 61333 - DNA, 75 bp, Artificial Sequence
  Synthetic
cctggcaaatcaacctagctgtaccaggagattccctaagtctccttctcaaatgacctgatacttgagggttac

SEQ ID NO: 61334 - DNA, 75 bp, Artificial Sequence
  Synthetic
tttttttttaaattgttgaatattgggtaattagagatttaaggtaaattgaggattttaaatttagagtttttt

SEQ ID NO: 61335 - DNA, 75 bp, Artificial Sequence
  Synthetic
atcctcaccaatctatgcttatttaacccaaacataaaaagcaatgcctttacatgattgcactattaagaaaaa

SEQ ID NO: 61336 - DNA, 75 bp, Artificial Sequence
  Synthetic
taattttttgtgttgtattaataaggaaattttttaaattttaattgggttttttatgtgagatttatttatggt

SEQ ID NO: 61337 - DNA, 75 bp, Artificial Sequence
  Synthetic
atgagggttttggataggattaagttgattttgtattagaggtttattaaagattttatagtgataaaggaggga

SEQ ID NO: 61338 - DNA, 75 bp, Artificial Sequence
  Synthetic
taataggggtatacttgccaaagcgcccccatcttcaggatctcgcaatggagggtcttagcctactccaattgc

SEQ ID NO: 61339 - DNA, 75 bp, Artificial Sequence
  Synthetic
attttgaggttgttttgtggtaataatgggattgatagttattaataatgtttatttttgttttttttaatattg

SEQ ID NO: 61340 - DNA, 75 bp, Artificial Sequence
  Synthetic
gagggtcttagcctactccaattgcccagagataaatttcgaaaaagctctttctttgtttgggtcatcatctta

SEQ ID NO: 61341 - DNA, 75 bp, Artificial Sequence
  Synthetic
ttttttagatattttgtgaaagttttagtgttgtagttttaggttttgttatattgtatttagtataagataatt

SEQ ID NO: 61342 - DNA, 75 bp, Artificial Sequence
  Synthetic
tttcaaaaggccttttccatgcctttgggtgttgtgaccaacagcactttagaagtaacagagattgaccagcta

SEQ ID NO: 61343 - DNA, 75 bp, Artificial Sequence
  Synthetic
ttatattatttgaggtaattaatgatattatttggttaagtatagttgaatagaaaattattggagttatttttt

SEQ ID NO: 61344 - DNA, 75 bp, Artificial Sequence
  Synthetic
gtctgcaaggatcatcttgcatccactgaccagctgaaatcagttggtctcaacctcgaggggagcggagtatct

SEQ ID NO: 61345 - DNA, 75 bp, Artificial Sequence
  Synthetic
tatgattgtttttagttaataaattaatatagatataatatgattttggtgtgtaattgttaagagttttattta

SEQ ID NO: 61346 - DNA, 75 bp, Artificial Sequence
  Synthetic
actgatatcccatctgcgacaaagcgttggggcttcagatctggtgtgcctcccaaagtggtcagctatgaagca

SEQ ID NO: 61347 - DNA, 75 bp, Artificial Sequence
  Synthetic
gtaataatgatttttaaaataatttattattgtaattattgatggatttattttatttgatggtatatgatttga

SEQ ID NO: 61348 - DNA, 75 bp, Artificial Sequence
  Synthetic
ggagaatgggctgaaaattgctacaatcttgaaataaagaagccggacgggagcgaatgcttacccccaccgccg

SEQ ID NO: 61349 - DNA, 75 bp, Artificial Sequence
  Synthetic
atgtaataaggtaagttggtatttgaggtattttgtttagagtatatttaaaattgtatgtttagtaaattatta

SEQ ID NO: 61350 - DNA, 75 bp, Artificial Sequence
  Synthetic
atagtaaagttaaatttttttaattttatattttgattaagtaattatgattttatgataattttttttagatta

SEQ ID NO: 61351 - DNA, 75 bp, Artificial Sequence
  Synthetic
gcctttcacaaggatggagctttcttcctctatgacaggctggcttcaactgtaatttacagaggagtcaatttt

SEQ ID NO: 61352 - DNA, 75 bp, Artificial Sequence
  Synthetic
tcctctatgacaggctggcttcaactgtaatttacagaggagtcaattttgctgagggggtaattgcattcttga

SEQ ID NO: 61353 - DNA, 75 bp, Artificial Sequence
  Synthetic
ttggtttaatttttattaagaaaaaattatgattgtagataatttattggtagtttttgggtatttaagtttatg

SEQ ID NO: 61354 - DNA, 75 bp, Artificial Sequence
  Synthetic
tattggctaaaccaaaggaaacgttccttcaatcaccccccattcgagaggcagtaaactacactgaaaatacat

SEQ ID NO: 61355 - DNA, 75 bp, Artificial Sequence
  Synthetic
aatagagttagagagaatttgttatttttgaggtataattttattatttgttattttgaatgtttaaaattagta

SEQ ID NO: 61356 - DNA, 75 bp, Artificial Sequence
  Synthetic
caagttactatgccacatcctacttggagtacgaaatcgaaaattttggtgctcaacactccacgacccttttca

SEQ ID NO: 61357 - DNA, 75 bp, Artificial Sequence
  Synthetic
atgtaggatgaagattaattgtggaggaattaggaatttaattttagttttttaaggttttgtttgaatttttat

SEQ ID NO: 61358 - DNA, 75 bp, Artificial Sequence
  Synthetic
tagtttgtaagtttttttatagaagttattagtttttaaggtgattatattttagtattaaattttgttaattgt

SEQ ID NO: 61359 - DNA, 75 bp, Artificial Sequence
  Synthetic
ttccttttccagctgaatgataccattcaccttcaccaacagttgagcaacacaactgggaaactaatttggaca

SEQ ID NO: 61360 - DNA, 75 bp, Artificial Sequence
  Synthetic
ttgttataaagttgaaatgtttaatgtttaaatgaatatttttttgaagttgatatatgaatatattatattata

SEQ ID NO: 61361 - DNA, 75 bp, Artificial Sequence
  Synthetic
ctagatgctaatatcaatgctgatattggtgaatgggctttttgggaaaataaaaaaatctctccgaacaactac

SEQ ID NO: 61362 - DNA, 75 bp, Artificial Sequence
  Synthetic
ttggtgaatgggctttttgggaaaataaaaaaatctctccgaacaactacgtggagaagagctgtctttcgaaac

SEQ ID NO: 61363 - DNA, 75 bp, Artificial Sequence
  Synthetic
tgaaaatattgtaattagagtgtttttgaagtttggtattgatagttattaggttgtttttagtagtttgttttt

SEQ ID NO: 61364 - DNA, 75 bp, Artificial Sequence
  Synthetic
tttatcgctcaacgagacagaagacgatgatgcgacatcgtcgagaactacaaagggaagaatctccgaccgggc

SEQ ID NO: 61365 - DNA, 75 bp, Artificial Sequence
  Synthetic
ggaagtttttggggagataaaaagaggttttagagagttttaataggttggtataaggttattaatattagtata

SEQ ID NO: 61366 - DNA, 75 bp, Artificial Sequence
  Synthetic
gttggtttgattaagattgtaagtgagttgattttaattaaaaagattattttttgttgtttaaataaatttttt

SEQ ID NO: 61367 - DNA, 75 bp, Artificial Sequence
  Synthetic
ttgtgtgagatatttttaaggtataagatggttaaagttataggttgatataattttgtgtttttaaagaaagat

SEQ ID NO: 61368 - DNA, 75 bp, Artificial Sequence
  Synthetic
ctcaggaaactatcacagagacaactgcaacaatcataggcactaacggtaacaacatgcagatctccaccatcg

SEQ ID NO: 61369 - DNA, 75 bp, Artificial Sequence
  Synthetic
atggaaaagggagtgatttttagtgatttttgtaattttttgattatttaaattttgtaaggttggaaggtttat

SEQ ID NO: 61370 - DNA, 75 bp, Artificial Sequence
  Synthetic
ggacaggactgagctccagccaaatcctgagttcctcaccgaccatggcaccaagccctgagactcagacctcca

SEQ ID NO: 61371 - DNA, 75 bp, Artificial Sequence
  Synthetic
tgggtaggaattgagtttgatgtaagttaaaaaggtatggtttttttgataagatttaaaataaatgattttgtt

SEQ ID NO: 61372 - DNA, 75 bp, Artificial Sequence
  Synthetic
caacctacacaccaaaactaccagtgatgaccaccgaggaaccaacaacaccaccgagaaactctcctggctcaa

SEQ ID NO: 61373 - DNA, 75 bp, Artificial Sequence
  Synthetic
tttgtttgggtgatgataagaaatttttttttatatttgttttagaatttaaatttggttatttaattttttatt

SEQ ID NO: 61374 - DNA, 75 bp, Artificial Sequence
  Synthetic
caacagaagcacccactctcaccaccccagagaatataacaacagcggttaaaactgttttgccacaagagtcca

SEQ ID NO: 61375 - DNA, 75 bp, Artificial Sequence
  Synthetic
cccagagaatataacaacagcggttaaaactgttttgccacaagagtccacaagcaacggtctaataacttcaac

SEQ ID NO: 61376 - DNA, 75 bp, Artificial Sequence
  Synthetic
tgggttttgagggtaattttggtagttggattgtaggattagttgttagattatttattggttgagttattgata

SEQ ID NO: 61377 - DNA, 75 bp, Artificial Sequence
  Synthetic
agtaacaggtattcttgggagccttggacttcgaaaacgcagcagaagacaagttaacaccagggccacgggtaa

SEQ ID NO: 61378 - DNA, 75 bp, Artificial Sequence
  Synthetic
ggggtttttggtttaatttttgattggtttttaattataatgttaatatattttaatttttgtattagaagtgta

SEQ ID NO: 61379 - DNA, 75 bp, Artificial Sequence
  Synthetic
atgcaatcccaacttacactactggactgcacaagaacaacataatgctgctgggattgcctggatcccgtactt

SEQ ID NO: 61380 - DNA, 75 bp, Artificial Sequence
  Synthetic
aaggattagtttagtttttgtatgttatttttgattaggttaaatattttgtagtttattaataagtttgatgtt

SEQ ID NO: 61381 - DNA, 75 bp, Artificial Sequence
  Synthetic
tggaccgggtgcagaaggcatatacactgaaggccttatgcacaaccaaaatgccttagtctgtggactcagaca

SEQ ID NO: 61382 - DNA, 75 bp, Artificial Sequence
  Synthetic
ttgtatgttgttaattataatggtttatttagtagtattgagattgggatttttatatatataattattataatt

SEQ ID NO: 61383 - DNA, 75 bp, Artificial Sequence
  Synthetic
acttgcaaatgaaacaactcaagctctgcagcttttcttaagggccacgacggagctgcggacatataccatact

SEQ ID NO: 61384 - DNA, 75 bp, Artificial Sequence
  Synthetic
tgtataaatatgggtttttttgtggaagtttaagagtttgataaattagttatgaattttaagtgtttaggatta

SEQ ID NO: 61385 - DNA, 75 bp, Artificial Sequence
  Synthetic
ctgcgacgatggggcgggacatgtaggatcctgggaccagattgttgcattgagccacatgattggaccaaaaac

SEQ ID NO: 61386 - DNA, 75 bp, Artificial Sequence
  Synthetic
gttaagtttttattattttatgagtttgtttttaaattttttatttgtgttttataatttgggatgtaattatta

SEQ ID NO: 61387 - DNA, 75 bp, Artificial Sequence
  Synthetic
atcactgataaaatcaaccaaatcatccatgatttcatcgacaaccctttacccaatcaggataatgatgataat

SEQ ID NO: 61388 - DNA, 75 bp, Artificial Sequence
  Synthetic
ataatggagtttaatagtttgttggtaatttaataaggtaattttaaaataagtatatgaatgagaattagttgt

SEQ ID NO: 61389 - DNA, 75 bp, Artificial Sequence
  Synthetic
tggtggacgggctggagacagtggatccctgcaggaataggcattactggaattattattgcaatcattgctctt

SEQ ID NO: 61390 - DNA, 75 bp, Artificial Sequence
  Synthetic
gggttttatttagtattgttgagttaattatttaatttatttttgttaattgtattgagtattgttaataggttt

SEQ ID NO: 61391 - DNA, 75 bp, Artificial Sequence
  Synthetic
ctttgcgtctgcaagctgctttgttgaatatcaacttgaatcattaatttaaagttgatacatttctaacattat

SEQ ID NO: 61392 - DNA, 75 bp, Artificial Sequence
  Synthetic
gtattatgttaaagatttagagtgtatgaattgtgtagatttaaatttgggttttgttttatgttttataggtgg

SEQ ID NO: 61393 - DNA, 75 bp, Artificial Sequence
  Synthetic
gaatatcaacttgaatcattaatttaaagttgatacatttctaacattataaattataatctgatattaatactt

SEQ ID NO: 61394 - DNA, 75 bp, Artificial Sequence
  Synthetic
tttttttgaaatggagattattagtattttttaaatgggaggagttagtaattagaaattggagataaatggata

SEQ ID NO: 61395 - DNA, 75 bp, Artificial Sequence
  Synthetic
ttgggatagaataatgtttaattattgggtggtttttatttttatatgtgtatataattaatttttttttatttt

SEQ ID NO: 61396 - DNA, 75 bp, Artificial Sequence
  Synthetic
agttccttcccaaaaataatattgatgaagattaagaaaaagtgacattgtgtccacttttgtaatcttcatcca

SEQ ID NO: 61397 - DNA, 75 bp, Artificial Sequence
  Synthetic
tgtttatattggtgtaattttattttaataatatgttaatgttatattgttaagagaaggtttgaggaagattaa

SEQ ID NO: 61398 - DNA, 75 bp, Artificial Sequence
  Synthetic
cctaaacatccgttgtcaggaatctttgaatcaacccttacacttgcttaggaaagagcctgtcctcgacaagaa

SEQ ID NO: 61399 - DNA, 75 bp, Artificial Sequence
  Synthetic
gaaaaaggttttgtgtttatttggttgttgttaagtattttgtggtttttttttatttaatttttttatgttata

SEQ ID NO: 61400 - DNA, 75 bp, Artificial Sequence
  Synthetic
ttccgaggcggcaattcagttaatttaatatcaagataacatccatttccaaggccacagctagttatattatta

SEQ ID NO: 61401 - DNA, 75 bp, Artificial Sequence
  Synthetic
tggttatttagtatatttagtatttggatgtatgtttatttttatttatagttttggattaatgtgatttggtaa

SEQ ID NO: 61402 - DNA, 75 bp, Artificial Sequence
  Synthetic
aaggccacagctagttatattattaacttttatcacaaatatggagaggggtcgtgagcgcgggagatcaagaag

SEQ ID NO: 61403 - DNA, 75 bp, Artificial Sequence
  Synthetic
tttgagtatgtgggttatatttattttattttttaaatttttaattaaggtaatgtaaattattaaaatatatat

SEQ ID NO: 61404 - DNA, 75 bp, Artificial Sequence
  Synthetic
attgatttaagtttgatataatagtatttaaatttttaagtgatatatttgtagtaatattgttgatagattatt

SEQ ID NO: 61405 - DNA, 75 bp, Artificial Sequence
  Synthetic
agactaccgtggtagtcgaagcacttcgcaagttagagtccctacagtcttccataagaaaggtaccgggaccct

SEQ ID NO: 61406 - DNA, 75 bp, Artificial Sequence
  Synthetic
tagtattaatttttttgtgttttttaatggggtatggtgataggttattgattttgatttgtaattaattttttg

SEQ ID NO: 61407 - DNA, 75 bp, Artificial Sequence
  Synthetic
tactgtccctccagcacctaaggatatctgtcctactcttagaaaaggatttctgtgtgatagcaatttctgtaa

SEQ ID NO: 61408 - DNA, 75 bp, Artificial Sequence
  Synthetic
atgaaattattaattatattttttatgatgtagttttttttgattattattttaaggtaataggtgtataggatt

SEQ ID NO: 61409 - DNA, 75 bp, Artificial Sequence
  Synthetic
tagcacggaaaacctgtggatcaactgattcatcacttaatatagctgctcctaaagacttaagactggcaaatc

SEQ ID NO: 61410 - DNA, 75 bp, Artificial Sequence
  Synthetic
atttgataaatattgtaattagagagaagtttaaaaatgaaattttaaataatgattatgtttattaattgtttt

SEQ ID NO: 61411 - DNA, 75 bp, Artificial Sequence
  Synthetic
ctacggctgatgacttcaagcaggacggcagtccaaaattaaccctaaaattactagtagagactgctgagtttt

SEQ ID NO: 61412 - DNA, 75 bp, Artificial Sequence
  Synthetic
tttggtatgatttttttattttggtttgatgtgggtgtttgaattgtgggaataattgtttaatttggtttgttt

SEQ ID NO: 61413 - DNA, 75 bp, Artificial Sequence
  Synthetic
gggctaatcagaatattaatgaggtagatgatgcaaaactccgtgctcttttgacgttgagtgctgttctagtgc

SEQ ID NO: 61414 - DNA, 75 bp, Artificial Sequence
  Synthetic
atgatgaatttattgatattttaggatatggtgattatattttttggaaaatatttttattattattattagtta

SEQ ID NO: 61415 - DNA, 75 bp, Artificial Sequence
  Synthetic
agatgatgcaaaactccgtgctcttttgacgttgagtgctgttctagtgcggaaattctctaagtcacaacttag

SEQ ID NO: 61416 - DNA, 75 bp, Artificial Sequence
  Synthetic
ttatagatggggttttatatgtagtaattgattggtattaattgattttttttaaagaatttattttagggtata

SEQ ID NO: 61417 - DNA, 75 bp, Artificial Sequence
  Synthetic
tcaattatgtgagagtcatcttaggagggaaaacttggggcaagaccaagctgaatcagttctcgaggtttatca

SEQ ID NO: 61418 - DNA, 75 bp, Artificial Sequence
  Synthetic
gttaaattttatttgtgttaatagttgaaatattaattatgtgtaaagatattattatttgtaggtttaatatat

SEQ ID NO: 61419 - DNA, 75 bp, Artificial Sequence
  Synthetic
acgtttacatagtgataaaggtggtgctttcgaggcagcactatggcaacagtgggatagacaatcattgactat

SEQ ID NO: 61420 - DNA, 75 bp, Artificial Sequence
  Synthetic
tattgattgtatttattgtaaaattagaggatgtagatgtgtttgattattttgatttgagtgatatttttaaga

SEQ ID NO: 61421 - DNA, 75 bp, Artificial Sequence
  Synthetic
gtttatatctgcttttctccatgtagcattgcaactttcctgtgagagctccaccgtagtgatatcaggcctacg

SEQ ID NO: 61422 - DNA, 75 bp, Artificial Sequence
  Synthetic
tatataatgttggagattatgtaatatttatttttggtttagagggttataagataataaagtattttgaattat

SEQ ID NO: 61423 - DNA, 75 bp, Artificial Sequence
  Synthetic
cttacttgcccctccaagcgtgaatgaagggctccctcctgcaccaggagaatatacttggtcagaagatagtac

SEQ ID NO: 61424 - DNA, 75 bp, Artificial Sequence
  Synthetic
tttgtttggttaaaatttaattttgttttaaatttatagaaagaaaaggttgtttttttatatagatgtatttat

SEQ ID NO: 61425 - DNA, 75 bp, Artificial Sequence
  Synthetic
aacttagtccgtagggaggacaagtcaaataagatatccttatcctctataggaggtattttttaagagggggac

SEQ ID NO: 61426 - DNA, 75 bp, Artificial Sequence
  Synthetic
tagtaataaatgatttttgggagttgatttttaattgtaggttaaaggattattagtaagagaagattagagatt

SEQ ID NO: 61427 - DNA, 75 bp, Artificial Sequence
  Synthetic
aggatatgaataaggataacgactaaagccaatataaagataagaacacaaataggaattaaaatagaaatcaaa

SEQ ID NO: 61428 - DNA, 75 bp, Artificial Sequence
  Synthetic
tttataaaatattattataattgtaattatttttttaatagttttgtgaattattttttgtttaaaaatattggg

SEQ ID NO: 61429 - DNA, 75 bp, Artificial Sequence
  Synthetic
acaatctccccttattaaatatgaaacacaatggtgagtatttgtttcctgatattaatcatttattgttaaaaa

SEQ ID NO: 61430 - DNA, 75 bp, Artificial Sequence
  Synthetic
ggtatttaattttatatagtgagaaagttatataaaaagtaaaatggtatgtaattatttttaaggtttttagat

SEQ ID NO: 61431 - DNA, 75 bp, Artificial Sequence
  Synthetic
taaacaaagtcagtaagagtgttaggatcattatattgtaaggatcttcccttgaagcgttgaatcatctcaagt

SEQ ID NO: 61432 - DNA, 75 bp, Artificial Sequence
  Synthetic
ttaatgttatttttgagatatattgtgtatttaagtataatattgttaagtattattttgatagttaaggaattt

SEQ ID NO: 61433 - DNA, 75 bp, Artificial Sequence
  Synthetic
agcctagaaccaaaacagtagagcattaaattgtaatagataatagggacattacttgtttttaagataattttg

SEQ ID NO: 61434 - DNA, 75 bp, Artificial Sequence
  Synthetic
ggtatagtgtaattttagataggaatttaattttaggatttaatttttttataaaatgtaattatttttttttat

SEQ ID NO: 61435 - DNA, 75 bp, Artificial Sequence
  Synthetic
ggaagtttaaaattaagaaaaagaacccatggacacactctaacattgaggatagggtttccttgatgatagtct

SEQ ID NO: 61436 - DNA, 75 bp, Artificial Sequence
  Synthetic
tatttatgattaaggattttttatgggaattttattattttaattattttttgttattttttataaaggtgatta

SEQ ID NO: 61437 - DNA, 75 bp, Artificial Sequence
  Synthetic
agtcttaggtacagggtagtcctacacgccctatattatacaatctaaacttgtaaaattgaattacaaaaacat

SEQ ID NO: 61438 - DNA, 75 bp, Artificial Sequence
  Synthetic
gtgatttaagtatttttattaaagatagggttatagttgttgaatagatatgttgggatgtagtttttgaattta

SEQ ID NO: 61439 - DNA, 75 bp, Artificial Sequence
  Synthetic
gatgaaaattaatgagaaggttccaagattgacttcaatccaaacaccttgctctgccaattttcatctccttaa

SEQ ID NO: 61440 - DNA, 75 bp, Artificial Sequence
  Synthetic
gctctgccaattttcatctccttaagatatatgattttgttcctgcaagataaggttatcaaacagggtgtgtag

SEQ ID NO: 61441 - DNA, 75 bp, Artificial Sequence
  Synthetic
atgtgttaggttataattttttaaataaattttttattaaaagggtgttggaataatttttagaataagaggatt

SEQ ID NO: 61442 - DNA, 75 bp, Artificial Sequence
  Synthetic
ctctttcacatatttgggcccctactgggctagggtttatagttaaggaagactcatctcatttctcattgaact

SEQ ID NO: 61443 - DNA, 75 bp, Artificial Sequence
  Synthetic
ttttaattgaaagtgttttgaattatgtataggaattatattatttattattatagaataggaattttttttttt

SEQ ID NO: 61444 - DNA, 75 bp, Artificial Sequence
  Synthetic
attctactcgtaggatcctactgggaatataaatcagaacatctgtgacactttgactataggaaataattttca

SEQ ID NO: 61445 - DNA, 75 bp, Artificial Sequence
  Synthetic
tttttaaagaaaaggaattaaatattggatgaatatttgggaagttattatattttatatggaatgtttaaattt

SEQ ID NO: 61446 - DNA, 75 bp, Artificial Sequence
  Synthetic
aaactacctgagatcgggtcatttctccaactcattctgcaagtaattgtttagcatcataacaacagcgttata

SEQ ID NO: 61447 - DNA, 75 bp, Artificial Sequence
  Synthetic
tatgtgaggttttgttagtagatggattggttaaggttttttttagtaatatgatggtagtaattgaatgtgaat

SEQ ID NO: 61448 - DNA, 75 bp, Artificial Sequence
  Synthetic
atttaaaaatcaagtcttgtaacaaaaataaggataacagaaagaacccttcttatacgggttcactaattttat

SEQ ID NO: 61449 - DNA, 75 bp, Artificial Sequence
  Synthetic
aaaaagagagttttttttattaggtattatggtattatattagtgatgattttggagagaatgttattgtttgag

SEQ ID NO: 61450 - DNA, 75 bp, Artificial Sequence
  Synthetic
aggagaagctccttttgcaagcctaagattccattaaagataaccagaatggctaaagccacaggccggtacaac

SEQ ID NO: 61451 - DNA, 75 bp, Artificial Sequence
  Synthetic
ggagtagttttgtaattgatttagagaagtataattttgtattttgttatgagtttattgtattatttattgagt

SEQ ID NO: 61452 - DNA, 75 bp, Artificial Sequence
  Synthetic
ttggtaacaccaaaacgggagctagagcaaggagttgtatttagcgacctatgcaacttcctagtgactccaact

SEQ ID NO: 61453 - DNA, 75 bp, Artificial Sequence
  Synthetic
attgtaattattgttatggtgtgtgtaatgtttttaattggatgtattatttaattttgtagtgttatatgtatg

SEQ ID NO: 61454 - DNA, 75 bp, Artificial Sequence
  Synthetic
gtgcaaggatggaaggtttactgggctggacttgagtttgatgtcaaccaaaagggtattaccctgttaaatcgt

SEQ ID NO: 61455 - DNA, 75 bp, Artificial Sequence
  Synthetic
taagtgattattataatttgttttataatgttaattttagtaattgagaatatttttttgaaggtttgagtttgt

SEQ ID NO: 61456 - DNA, 75 bp, Artificial Sequence
  Synthetic
cttaaagtgaatgattttgctcctgcatgggcgatgacccggaaccttttcccacacttgttcaaaaaccaacag

SEQ ID NO: 61457 - DNA, 75 bp, Artificial Sequence
  Synthetic
attgagggtatttaggaggtatagagggattataataaaaattgtggatgagtatattttgtgtataaatttttt

SEQ ID NO: 61458 - DNA, 75 bp, Artificial Sequence
  Synthetic
tctgaagtccaaactcccatttgggccttgagggtaattcttgccgccgggattcttgaccaattaatggatcat

SEQ ID NO: 61459 - DNA, 75 bp, Artificial Sequence
  Synthetic
tagtggaaattaaaattggttttaagttatgattagtggttatgggagataattagtgtataattgtattgtttg

SEQ ID NO: 61460 - DNA, 75 bp, Artificial Sequence
  Synthetic
tttttttatttaaaatagattttgaagagtaggagtaaagtgttgaagataatgttgtaagagtagtagtaagtt

SEQ ID NO: 61461 - DNA, 75 bp, Artificial Sequence
  Synthetic
ttgtaaaagtaattagtgtatgtgggattttttttaaattagatgagatatttgtatatttaggttttatttatt

SEQ ID NO: 61462 - DNA, 75 bp, Artificial Sequence
  Synthetic
accaactgagcatgaggatgttatctcttataaggtcaaatattattaactttataaataagctcgaaactcttc

SEQ ID NO: 61463 - DNA, 75 bp, Artificial Sequence
  Synthetic
tcttataaggtcaaatattattaactttataaataagctcgaaactcttcatgttgttaattacaagggacttct

SEQ ID NO: 61464 - DNA, 75 bp, Artificial Sequence
  Synthetic
ttggaaaaaaataatattttaatggtgtataattattgtaattatttaaaatagtagtaagaatggtattatttt

SEQ ID NO: 61465 - DNA, 75 bp, Artificial Sequence
  Synthetic
atgttgttaattacaagggacttctaagcagtgttgagataggaacaccaagctatgcaatcatcattaccagaa

SEQ ID NO: 61466 - DNA, 75 bp, Artificial Sequence
  Synthetic
ttgatgttatatttgatgatttataaggaatatttgttagtattggaattgtttttgaatgtgttatattggaaa

SEQ ID NO: 61467 - DNA, 75 bp, Artificial Sequence
  Synthetic
ctaatatgggctatcttgtcgaagttcaggaaccagataaatctgcgatggatatacgacaccctggtcctgtca

SEQ ID NO: 61468 - DNA, 75 bp, Artificial Sequence
  Synthetic
tgtgatatatttttttatgttgtattgtagtagttttttatatgtattttgttgtttggattttataatattatt

SEQ ID NO: 61469 - DNA, 75 bp, Artificial Sequence
  Synthetic
agttctctctactgcatgaatcgaccctcaaacctgttgccacttctaaaccgtcaagcattacttcattgatca

SEQ ID NO: 61470 - DNA, 75 bp, Artificial Sequence
  Synthetic
attttggatttaataaaggtattgatttaggatagttgttatttagtaaattattagattatgggattattattt

SEQ ID NO: 61471 - DNA, 75 bp, Artificial Sequence
  Synthetic
tggagttcaatagttctttggcaatttaattgccataacaaagattgtatgatagggctaatattgattcaataa

SEQ ID NO: 61472 - DNA, 75 bp, Artificial Sequence
  Synthetic
taatattggtggttttataagtttttgggggattgttttttttaaatttagaaaagtgtttttattgaaattttg

SEQ ID NO: 61473 - DNA, 75 bp, Artificial Sequence
  Synthetic
tctatcgtaggacagaatcattttcctgtatgatctcagtttaatctctctttatgcaataattaataaggagct

SEQ ID NO: 61474 - DNA, 75 bp, Artificial Sequence
  Synthetic
gagattttgtgatttttggatttttttagttatgggtgtatttagaaatggttaatatgaaagatttattttgtt

SEQ ID NO: 61475 - DNA, 75 bp, Artificial Sequence
  Synthetic
tgtttaaaatgttacaaaagtataatgtttgaacctctagtatccctgtaaatattttcattcaattgtcagccc

SEQ ID NO: 61476 - DNA, 75 bp, Artificial Sequence
  Synthetic
tattaatattgaaaaatttaggaaattgtagtgttattgattttgttttaaatttatttggattaaatgttttag

SEQ ID NO: 61477 - DNA, 75 bp, Artificial Sequence
  Synthetic
ttacatgtgtagtcacttgtgtagcatgacactagttttgccttcaattaatatctaacctagcagtcaatataa

SEQ ID NO: 61478 - DNA, 75 bp, Artificial Sequence
  Synthetic
gattataagatttgatattttttttgtgataaattgttaggtgtagtattattttaattgttagaaataagttaa

SEQ ID NO: 61479 - DNA, 75 bp, Artificial Sequence
  Synthetic
tgtataactttctatgttcaaagagtagtcaaaacaatgtgagatccagtttcactcacagcatctattcaatat

SEQ ID NO: 61480 - DNA, 75 bp, Artificial Sequence
  Synthetic
ttaatatttttttttatgtttttgttgatttggaagatgagatggtttgtaagtggttttttttattaaattttg

SEQ ID NO: 61481 - DNA, 75 bp, Artificial Sequence
  Synthetic
ttacagtatgatgagtccgaattaacacagtagaggtctaggtgtattaacagaacgaggaagattaagaaaaag

SEQ ID NO: 61482 - DNA, 75 bp, Artificial Sequence
  Synthetic
cacagtagaggtctaggtgtattaacagaacgaggaagattaagaaaaagtccataatgctgggtggacaatcct

SEQ ID NO: 61483 - DNA, 75 bp, Artificial Sequence
  Synthetic
ttatgagttgttttgtagtggatattttttttaggatattgagtggtaaatgtttttaaatattaggttattttg

SEQ ID NO: 61484 - DNA, 75 bp, Artificial Sequence
  Synthetic
tgccaccataggactttttcaattcctctactttatgatggctacccaacatacacaatatcctgatgcaagatt

SEQ ID NO: 61485 - DNA, 75 bp, Artificial Sequence
  Synthetic
aagggattaggattttattggtttttaaaattataaataataatagtgagatatttgtatttgataagttgagga

SEQ ID NO: 61486 - DNA, 75 bp, Artificial Sequence
  Synthetic
gtcttccccaatcgttttagaccaatgtgacctagtgacaagagcatgcggactgtactctgagtattcgctgaa

SEQ ID NO: 61487 - DNA, 75 bp, Artificial Sequence
  Synthetic
agattattttataaagatggaatttgtggtttagttatttggattattgtgattaattattagtagatgttttat

SEQ ID NO: 61488 - DNA, 75 bp, Artificial Sequence
  Synthetic
ccctaaactaagaacatgccgcttgccgaaacatatctatagattaaaatatgacgccattgttttacgatttat

SEQ ID NO: 61489 - DNA, 75 bp, Artificial Sequence
  Synthetic
agaaaattagttgtatggtggatttggtttagattttgtgtgagtatatatggttatatattttagagggtagat

SEQ ID NO: 61490 - DNA, 75 bp, Artificial Sequence
  Synthetic
tattgattggagtgatattattatgtatggtggagtaatttaaagttaagtggttaggataatatgaattttgtt

SEQ ID NO: 61491 - DNA, 75 bp, Artificial Sequence
  Synthetic
aaatgcaccattagaacctccctgtttgagcttcctagatgagatagtcaattatactgtgcaggatgcggcatt

SEQ ID NO: 61492 - DNA, 75 bp, Artificial Sequence
  Synthetic
tagaatgttttaataaaaaaggtttaaatgtttatgttttagttgtagttaaagattaagtggttagtgtttggt

SEQ ID NO: 61493 - DNA, 75 bp, Artificial Sequence
  Synthetic
ccttaattattacatgaatcagattaaaacacaggaaggagtaattacagatcaattaaaacagaacattcgtag

SEQ ID NO: 61494 - DNA, 75 bp, Artificial Sequence
  Synthetic
ttaatattttttgaataagttggataatagggagtggtgttttttatatagggttaagaattgaggataaaattg

SEQ ID NO: 61495 - DNA, 75 bp, Artificial Sequence
  Synthetic
gatagtttgttattaagttgtgatgttttttatttgtttttaaggaggttatagaattagtattaaggtttattt

SEQ ID NO: 61496 - DNA, 75 bp, Artificial Sequence
  Synthetic
acttggtttgtaacgaatgaggttgttgatatcctaggatatggtgattatattttctggaagatccctattgct

SEQ ID NO: 61497 - DNA, 75 bp, Artificial Sequence
  Synthetic
gggttatataaggaggttttaatagtgaataattaatttggttttttttggaagtgagagttaattttagtgtta

SEQ ID NO: 61498 - DNA, 75 bp, Artificial Sequence
  Synthetic
ctattaccaatgaacacagctaatgttcctcatgcatcgactgactggtaccaacctaatatcttcaaggaggct

SEQ ID NO: 61499 - DNA, 75 bp, Artificial Sequence
  Synthetic
gtgaagttttgtaaatgatattattatattatttaggaaatattgtttattgatataatgattaatatagtttgt

SEQ ID NO: 61500 - DNA, 75 bp, Artificial Sequence
  Synthetic
atttatttatggtgaattgtatgagtaatattgtgatttgttttatagtgttaattaatatatttggagaatttt

SEQ ID NO: 61501 - DNA, 75 bp, Artificial Sequence
  Synthetic
tatgtgtaaggatcttgtcacaagtcgttttaacacccttctgattgctgagttagccaggttggaagatccagt

SEQ ID NO: 61502 - DNA, 75 bp, Artificial Sequence
  Synthetic
taggtggagggtaggttgttagggatagtaatataattttttagaatgttataaatttagtagttgttttttatg

SEQ ID NO: 61503 - DNA, 75 bp, Artificial Sequence
  Synthetic
gtccgctgattatccactggtagatgatattcaatctctgtataatgcaggagactacttgttgtccatattggg

SEQ ID NO: 61504 - DNA, 75 bp, Artificial Sequence
  Synthetic
atattagattttggaatataaatatttttgatataaggtataatagggtttatttttatttgatagagtgttgta

SEQ ID NO: 61505 - DNA, 75 bp, Artificial Sequence
  Synthetic
gatattcaatctctgtataatgcaggagactacttgttgtccatattgggatcggaggggtacaaaataatcaag

SEQ ID NO: 61506 - DNA, 75 bp, Artificial Sequence
  Synthetic
tatctcgagcctctgtgtttggctaagattcaactatgttcccaatatacagaacgaaaagggcggtttttaacc

SEQ ID NO: 61507 - DNA, 75 bp, Artificial Sequence
  Synthetic
ttaaagaggttttggtttagtatttgatatatataagtgtatttaatttggatttaagttgttattgtgataatg

SEQ ID NO: 61508 - DNA, 75 bp, Artificial Sequence
  Synthetic
cagatgcatcttgcagttattcaaacattgcgtgaacttctccttaatagagggttgaaaaaatcacagctttct

SEQ ID NO: 61509 - DNA, 75 bp, Artificial Sequence
  Synthetic
aattaatatatgatttaaatttattgaagggaggattgaattgtaatttaataatagatagttttttagtgaagg

SEQ ID NO: 61510 - DNA, 75 bp, Artificial Sequence
  Synthetic
aaaatccgtgagttccaccaactgttgctcagacttcgatctacaccacaacaattatgtgaattattttcaatc

SEQ ID NO: 61511 - DNA, 75 bp, Artificial Sequence
  Synthetic
gttttaggtttaatatgattgaagatgattttttttgttttttatatttttttggatgggagttagtgaaaatgg

SEQ ID NO: 61512 - DNA, 75 bp, Artificial Sequence
  Synthetic
tgctcagacttcgatctacaccacaacaattatgtgaattattttcaatccaaaagcactggggccatccagttc

SEQ ID NO: 61513 - DNA, 75 bp, Artificial Sequence
  Synthetic
tggtataatttattattttagataatagtaatttattaatagatttaattagtagtggagaaatatgttttttta

SEQ ID NO: 61514 - DNA, 75 bp, Artificial Sequence
  Synthetic
tgcatagtgaaaaggccatacaaaaggttaaaaatcatgcaacagttctaaaggcattgcgtccgattatcatct

SEQ ID NO: 61515 - DNA, 75 bp, Artificial Sequence
  Synthetic
taatttatttttttatttatttttagattggttttttttatagttttggagtagtattatgtttttatttaggta

SEQ ID NO: 61516 - DNA, 75 bp, Artificial Sequence
  Synthetic
ttgaaacgtactgtgtattcaagtacagtgttgcaaaacatttctttgatagccaaggcacttggtacagtgtga

SEQ ID NO: 61517 - DNA, 75 bp, Artificial Sequence
  Synthetic
atattattttatggattaaaaaatttgattatgaatagtttttatattatttgtataattagttgtataatttat

SEQ ID NO: 61518 - DNA, 75 bp, Artificial Sequence
  Synthetic
tatcagaccgatgtttaacgccgggattgaattcctacattaggcgaaatcaattcccaccacttccaatgatca

SEQ ID NO: 61519 - DNA, 75 bp, Artificial Sequence
  Synthetic
tttattgagtattttgtgtttttaaattaatatttaagtatgttagtgtgatgttttgattaatggaaattgatt

SEQ ID NO: 61520 - DNA, 75 bp, Artificial Sequence
  Synthetic
aagatcttctatgggaattttaccatttggatcatcctccattattctccacgaagatcattagtgatctcagca

SEQ ID NO: 61521 - DNA, 75 bp, Artificial Sequence
  Synthetic
ttaattttttaatttatattggtgggatatttggagattgagggttgtttgatgttgtttgattgtttttttgga

SEQ ID NO: 61522 - DNA, 75 bp, Artificial Sequence
  Synthetic
tagtaattgtgagttttttataattttttaaaagttggattattgattgttaaaagataatttttttatggatag

SEQ ID NO: 61523 - DNA, 75 bp, Artificial Sequence
  Synthetic
caagcgtgtacccgaacaattcctggagcaagaggatttttctattgagagtgtcttacaatacgcccaagaact

SEQ ID NO: 61524 - DNA, 75 bp, Artificial Sequence
  Synthetic
gagcaagaggatttttctattgagagtgtcttacaatacgcccaagaacttaggtacctattgccccagaatcga

SEQ ID NO: 61525 - DNA, 75 bp, Artificial Sequence
  Synthetic
tatatttgtttgaaggttaatagttggaatttattaatgaatttttatataaaattttgggtttgtttaaataag

SEQ ID NO: 61526 - DNA, 75 bp, Artificial Sequence
  Synthetic
aatttttctttttcattgaaagaaaaagaattaaatgttggtaggacatttggaaaattgccttatttaactagg

SEQ ID NO: 61527 - DNA, 75 bp, Artificial Sequence
  Synthetic
gttttaaaagtattttaaaggaggttagtatttaaaatgatggatatttggatttggtagaaaataattatgttt

SEQ ID NO: 61528 - DNA, 75 bp, Artificial Sequence
  Synthetic
aatgtccaaaccctctgcgaagcattacttgcagatggtttggctaaagcctttccaagcaacatgatggttgtc

SEQ ID NO: 61529 - DNA, 75 bp, Artificial Sequence
  Synthetic
ataatagtaagagtattgttagtaattttttttatgtatttttagtttattggagaagtaggaaattttggaaaa

SEQ ID NO: 61530 - DNA, 75 bp, Artificial Sequence
  Synthetic
tttaagattataatgattttttaagaggggatggaatatttatagaatttgtgtgtaagtttttaagtaattatt

SEQ ID NO: 61531 - DNA, 75 bp, Artificial Sequence
  Synthetic
tacgagtgatgatttcggagagcatgccacagttcgcgggagtagttttgtcacagacctagagaaatataatct

SEQ ID NO: 61532 - DNA, 75 bp, Artificial Sequence
  Synthetic
agttagatgaaaagtattataatgtgatatgtggaaagttattgaagttgtaagaatgtaaagattttttgtaat

SEQ ID NO: 61533 - DNA, 75 bp, Artificial Sequence
  Synthetic
ggctttcaggtatgaattcacagctcccttcatcaaatattgcaaccaatgctatggggttcgcaatgtctttga

SEQ ID NO: 61534 - DNA, 75 bp, Artificial Sequence
  Synthetic
cccttcatcaaatattgcaaccaatgctatggggttcgcaatgtctttgattggatgcacttcctaattccgcaa

SEQ ID NO: 61535 - DNA, 75 bp, Artificial Sequence
  Synthetic
atagatttagtaataatgggtaaataatgagtaattattgtaagaaagggaagttttataagtggaatttttgta

SEQ ID NO: 61536 - DNA, 75 bp, Artificial Sequence
  Synthetic
tgttacatgcatgttagtgattattataacccaccacataatgtaactttagagaatagggaatatcctcccgaa

SEQ ID NO: 61537 - DNA, 75 bp, Artificial Sequence
  Synthetic
aaatgttaatggagagttaaaggggaattgttttaatagagggtgattatttttaaaataatattttattaatag

SEQ ID NO: 61538 - DNA, 75 bp, Artificial Sequence
  Synthetic
ggaccaagtgcttatcgaggccaccttggtggtattgaggggcttcaacaaaagttatggactagcatctcatgt

SEQ ID NO: 61539 - DNA, 75 bp, Artificial Sequence
  Synthetic
atgatgtattaagtttttattgatttattttattattttttaaattgggaaattataattatgtatatgattaag

SEQ ID NO: 61540 - DNA, 75 bp, Artificial Sequence
  Synthetic
gctcaaatttcattggtagagatcaagaccggattcaaattgcgatcagcagtcatgggggataatcaatgtatc

SEQ ID NO: 61541 - DNA, 75 bp, Artificial Sequence
  Synthetic
atgtttaagaattgatgaattaaaatattaaatagtatttatattagttaaggtttatgttggatattattatat

SEQ ID NO: 61542 - DNA, 75 bp, Artificial Sequence
  Synthetic
agtcatgggggataatcaatgtatcacagtattatcagtctttccactagaatccagtccgaatgagcaagagag

SEQ ID NO: 61543 - DNA, 75 bp, Artificial Sequence
  Synthetic
attgtagatttatagggattgttttatttatgtattataaattggatgaagtttttttagaatataatagttttg

SEQ ID NO: 61544 - DNA, 75 bp, Artificial Sequence
  Synthetic
atgtgcagaagacaatgcagccagagtagctgctagcttggccaaagtcacaagtgcctgtgggatattcctcaa

SEQ ID NO: 61545 - DNA, 75 bp, Artificial Sequence
  Synthetic
atttagttattatattagttgaaggtgaggggttaggggttttattatttttgtaaaaatatagtataaggttat

SEQ ID NO: 61546 - DNA, 75 bp, Artificial Sequence
  Synthetic
tatttttgaatatattggtaatagaatatagtatagaattagaagttgtattaggtttttttattttgagaatgt

SEQ ID NO: 61547 - DNA, 75 bp, Artificial Sequence
  Synthetic
tcaatcactcaagacagcagctaggatggcccctctctcagatgcaatttttgatgacttgcagggtacacttgc

SEQ ID NO: 61548 - DNA, 75 bp, Artificial Sequence
  Synthetic
tgttattaataatgtaaaaggtttatgaaggataagttattgttattttaaataatttagtaagttagataattg

SEQ ID NO: 61549 - DNA, 75 bp, Artificial Sequence
  Synthetic
cagtataggaactgcctttgagcgatcaatctccgaaactagacatattttaccatgtcgtgttgcagctgcctt

SEQ ID NO: 61550 - DNA, 75 bp, Artificial Sequence
  Synthetic
atataattagtttaatgtggttaagtaattaaaaatataatttattttgttaagttgaaattattatgatggatg

SEQ ID NO: 61551 - DNA, 75 bp, Artificial Sequence
  Synthetic
tcatacatatttctctgttcggatcttacaacatcatcaccttggcttccataaaggttcagaccttggacaatt

SEQ ID NO: 61552 - DNA, 75 bp, Artificial Sequence
  Synthetic
ttgaaataatagagaatttaaataggttttaattttattgagtagtatataatttaatatttgattatattgatt

SEQ ID NO: 61553 - DNA, 75 bp, Artificial Sequence
  Synthetic
ggcaatcaataaacctcttgattttgggaccattgcactatccttagcagttccccaggtactgggtggattatc

SEQ ID NO: 61554 - DNA, 75 bp, Artificial Sequence
  Synthetic
tgtagtattttaaggtggtggtatttaaagtatttttgagtgatatagaaggaatattatggattaatgattatt

SEQ ID NO: 61555 - DNA, 75 bp, Artificial Sequence
  Synthetic
cttcctaaatccagaaaaatgtctttatcgcaacctgggtgaccctgtgacttcaggcctattccagttgaagca

SEQ ID NO: 61556 - DNA, 75 bp, Artificial Sequence
  Synthetic
tggttttattatttggggttggttatttgattaaattgattatattaagtgtttggttaagtgaatggtattttt

SEQ ID NO: 61557 - DNA, 75 bp, Artificial Sequence
  Synthetic
ttatctatcaatggtaggtatgagtgatatctttcacgcacttgttgcaaaaagtccagggaattgtagcgcaat

SEQ ID NO: 61558 - DNA, 75 bp, Artificial Sequence
  Synthetic
gtttattaaatttgatatttattaataggagattggtttattagatttataaggtatgttttggtgttattagag

SEQ ID NO: 61559 - DNA, 75 bp, Artificial Sequence
  Synthetic
gatatctttcacgcacttgttgcaaaaagtccagggaattgtagcgcaattgactttgttctaaacccaggaggg

SEQ ID NO: 61560 - DNA, 75 bp, Artificial Sequence
  Synthetic
ttaaatgtccctggatcacaggatctaacatctttccttcgtcagattgtcagaaggagtatcacactttcggca

SEQ ID NO: 61561 - DNA, 75 bp, Artificial Sequence
  Synthetic
atgttttgtaagtataagtttagtgaggtgtgtattggttgagttatattgtatagtatgttataaagaattttt

SEQ ID NO: 61562 - DNA, 75 bp, Artificial Sequence
  Synthetic
aggaataagttaatcaacacgctgtttcatgcctctgcagatcttgaagatgaattagtttgtaaatggttactt

SEQ ID NO: 61563 - DNA, 75 bp, Artificial Sequence
  Synthetic
attgtgaatatataggttttggttttttatttttagaaaaggttttatattataggtataatttagttgatattg

SEQ ID NO: 61564 - DNA, 75 bp, Artificial Sequence
  Synthetic
tcttcaacgcccgtcatgagccgtttcgcagccgatattttctcacgaacaccaagcgggaaaagattacaaatc

SEQ ID NO: 61565 - DNA, 75 bp, Artificial Sequence
  Synthetic
gatttggtttattgttgttagttattagatatttaattaatttttaggtagagatatgagatttagtattagatt

SEQ ID NO: 61566 - DNA, 75 bp, Artificial Sequence
  Synthetic
ataatttgatgagggagagttgtatttaaatgtattattttattaagattgtaaaaggtagaattataaagttag

SEQ ID NO: 61567 - DNA, 75 bp, Artificial Sequence
  Synthetic
ttgggatatctcgagggaaccagaactttattagcatctaaaatgataagcaataatgcagagacaccaatctta

SEQ ID NO: 61568 - DNA, 75 bp, Artificial Sequence
  Synthetic
gagagactcagaaagataacacttcaaagatggaatttatggtttagttacctagatcattgtgactcagcctta

SEQ ID NO: 61569 - DNA, 75 bp, Artificial Sequence
  Synthetic
ttaatgattttttgaagttttttttaattgtttaggtatttaaaaataattttttttggtatattgagtttaaaa

SEQ ID NO: 61570 - DNA, 75 bp, Artificial Sequence
  Synthetic
atggaagcaattcaaccaattaggtgtactgttgatattgctcaaattcttagagaatactcctgggctcatatt

SEQ ID NO: 61571 - DNA, 75 bp, Artificial Sequence
  Synthetic
aattatttgaggttattaatgtgtgtaattgattttattatatttataattgtgaatgttaggaaaaattttttg

SEQ ID NO: 61572 - DNA, 75 bp, Artificial Sequence
  Synthetic
tttagatgttttatttataatgtttatgtgatgtagaaattaagttaattgaatgttttattgggttaatgtgat

SEQ ID NO: 61573 - DNA, 75 bp, Artificial Sequence
  Synthetic
caacattgccatgtatacctgagcagttccaaaccacatggttaaaaccttacgagcaatgtgtggaatgttcat

SEQ ID NO: 61574 - DNA, 75 bp, Artificial Sequence
  Synthetic
tttatttagaagggttaatatattttaattatatataggtattaaattattatagtatgaggaataagataatga

SEQ ID NO: 61575 - DNA, 75 bp, Artificial Sequence
  Synthetic
ccacaaacaattctagtccatatgtatcagttgcattaaaaaggaacgtggtcagcgcttggcctgacgcatcta

SEQ ID NO: 61576 - DNA, 75 bp, Artificial Sequence
  Synthetic
taatttttgatgatagttttagttttgattttaagtatattggaagagagtatgttaattttaattgttagaggt

SEQ ID NO: 61577 - DNA, 75 bp, Artificial Sequence
  Synthetic
gattggggtggacgattggtgatgggattccctatataggctcaagaactgaggacaagataggtcagcccgcta

SEQ ID NO: 61578 - DNA, 75 bp, Artificial Sequence
  Synthetic
aataagttattagttattatttattgataagaatatattttattatagtgtaatatattataattttataatgat

SEQ ID NO: 61579 - DNA, 75 bp, Artificial Sequence
  Synthetic
ttaagccgaggtgcccatcagctgcattgagggaagctattgaattgacctctaggttaacctgggtcactcaag

SEQ ID NO: 61580 - DNA, 75 bp, Artificial Sequence
  Synthetic
tttgtatttttaattttagtatttattagaatgtattattagagaaatgattttagtttttatttttaaataatg

SEQ ID NO: 61581 - DNA, 75 bp, Artificial Sequence
  Synthetic
gtagtgcaaatagcgatcagttaattcgtccttttcttgaggcaagagtgaacttgagtgtacaagaaattcttc

SEQ ID NO: 61582 - DNA, 75 bp, Artificial Sequence
  Synthetic
aaatgacaccctcacattattccggtaatattgtgcatcggtataatgatcagtatagccctcactcctttatgg

SEQ ID NO: 61583 - DNA, 75 bp, Artificial Sequence
  Synthetic
attaggtttatgagttggttatatagtgagtattagtaattgaggattatgtagataggtaatttaatattgaat

SEQ ID NO: 61584 - DNA, 75 bp, Artificial Sequence
  Synthetic
ccaaccgcatgagtaacacagcaacgcgcttgatggtatctacaaacacactaggagagttctccggagggggcc

SEQ ID NO: 61585 - DNA, 75 bp, Artificial Sequence
  Synthetic
tatttatttgatgttattatatttaaatgttgtgttagttgtatttaaatatgttatttttagttaagtaatata

SEQ ID NO: 61586 - DNA, 75 bp, Artificial Sequence
  Synthetic
aagctgcacgtgatagcaacattatattccaaaatgtgattaattttgcagtagccttgtatgacattaggtttc

SEQ ID NO: 61587 - DNA, 75 bp, Artificial Sequence
  Synthetic
gattgaaaatgttaagaagagattggagtaaaagtataaaataaatttaattaaattttaaagtgattaaatgat

SEQ ID NO: 61588 - DNA, 75 bp, Artificial Sequence
  Synthetic
ggaacacctgtacatcctctattcaatatcacagggctcatattcacctgacagattgttgtacgagggaagtac

SEQ ID NO: 61589 - DNA, 75 bp, Artificial Sequence
  Synthetic
aatgattttgggaatttgatatgattttaagttaaaaataatgttaatataattgtttagtaatatgagtgataa

SEQ ID NO: 61590 - DNA, 75 bp, Artificial Sequence
  Synthetic
cagcccaatacttaacatacacaaccacgctaaatctagatttgagtaagtatcgtaataatgaactgatttatg

SEQ ID NO: 61591 - DNA, 75 bp, Artificial Sequence
  Synthetic
tgtaaattttgataattaattagttttagtagttaagattaaatgtaaatattataagaatgttaagtgtatata

SEQ ID NO: 61592 - DNA, 75 bp, Artificial Sequence
  Synthetic
aatgtaaatattataagaatgttaagtgtatataaaaatattataaaaaattaatttttttttttttgtgtgttt

SEQ ID NO: 61593 - DNA, 75 bp, Artificial Sequence
  Synthetic
attcagagccactaagaggaggtctaaactgcaacttatcgattgacagtcctttgatgaagggcccacgtttaa

SEQ ID NO: 61594 - DNA, 75 bp, Artificial Sequence
  Synthetic
ggatatataaaaaggaaaaaattggttttttataatgtttttgtgtgtgtttaatatttttataatgtttgtatt

SEQ ID NO: 61595 - DNA, 75 bp, Artificial Sequence
  Synthetic
atattattgaggatgacttaatacggttgccacatttatccggttgggaattagcaaaaacagttttgcaatcca

SEQ ID NO: 61596 - DNA, 75 bp, Artificial Sequence
  Synthetic
tgattttaattattaaagttagttagttattaaaatttatattattatttatattattaaataattatattgata

SEQ ID NO: 61597 - DNA, 75 bp, Artificial Sequence
  Synthetic
taatttctgatagtagcaattcatcaacagatcccattagcagcggtgaaacaagatcctttacaacccacttct

SEQ ID NO: 61598 - DNA, 75 bp, Artificial Sequence
  Synthetic
ttatttttgatttgaggttatattgagtttttaagattattattatttaattattttgaagtttaattaaattta

SEQ ID NO: 61599 - DNA, 75 bp, Artificial Sequence
  Synthetic
ttttatatttttattttaatttttttttagtatttttagtttatgttatttaattgaagatagtatgtttaaatg

SEQ ID NO: 61600 - DNA, 75 bp, Artificial Sequence
  Synthetic
atacagttttggagccctcataagtttttatttgggtaatactatcttgtgcacgaaaaagatcggacttacaga

SEQ ID NO: 61601 - DNA, 75 bp, Artificial Sequence
  Synthetic
tgattagtataatatttggatatggtgatattagatgggtgatttagtgttagattatttatttatataattttt

SEQ ID NO: 61602 - DNA, 75 bp, Artificial Sequence
  Synthetic
ttcgaatcttcaaaccgacattcagacactcaagtgtcatgtctaggttgatggatatagaccccaacttctcaa

SEQ ID NO: 61603 - DNA, 75 bp, Artificial Sequence
  Synthetic
aattattaatatttattgtgtaattaatttataaatttaataaattaataatttaatatatataattattattta

SEQ ID NO: 61604 - DNA, 75 bp, Artificial Sequence
  Synthetic
atggatatagaccccaacttctcaatatatattggtgggactgcaggtgatcgtggattatcggatgctgcaaga

SEQ ID NO: 61605 - DNA, 75 bp, Artificial Sequence
  Synthetic
aagataggaattggggttatttttttggtagtatattttaataaatattaggattagaaatgtaaaattgttata

SEQ ID NO: 61606 - DNA, 75 bp, Artificial Sequence
  Synthetic
aagttatgatgtgttatgttatgataaagtgtatttttattaataagtaataattaatagtttgttatttttaat

SEQ ID NO: 61607 - DNA, 75 bp, Artificial Sequence
  Synthetic
ccactatgggttgtctatcctctcgaaggccaacgccctgatcctcctggtgaatttttaaaccgagtaaaatct

SEQ ID NO: 61608 - DNA, 75 bp, Artificial Sequence
  Synthetic
aattaagattggtatatttttttttgatatatttagaattggaattaaaattgttgttaggaattattattattt

SEQ ID NO: 61609 - DNA, 75 bp, Artificial Sequence
  Synthetic
ttaattgttgggattgaggatgataaaaataaaggctctatactttcaagatctgaagagaagtgctcttcaaat

SEQ ID NO: 61610 - DNA, 75 bp, Artificial Sequence
  Synthetic
tattttttatattatgatgatttagtatttatgtgtgattggaatatattaatttttttggataaaattgtatta

SEQ ID NO: 61611 - DNA, 75 bp, Artificial Sequence
  Synthetic
atttggtaaggtgtttaattagtttgatttttgtattgtgtaggtgttgtaaataaagtgtttggataaagaatt

SEQ ID NO: 61612 - DNA, 75 bp, Artificial Sequence
  Synthetic
aagcgacaacagctccacacatcattttgccgctaggaaattctgatcgaccgcctggtctagatcttaatcaga

SEQ ID NO: 61613 - DNA, 75 bp, Artificial Sequence
  Synthetic
ttttttgatatttgtaattgtgagtatgataaaattgattatatatattaataattttaggtaattttttaagtt

SEQ ID NO: 61614 - DNA, 75 bp, Artificial Sequence
  Synthetic
gcaatgatacttttattcctaccagaattaaacagatagtccaaggagactctagaaatgacagaacaaccacca

SEQ ID NO: 61615 - DNA, 75 bp, Artificial Sequence
  Synthetic
tagtatattaagaagaattatttttgagtgtttggataattaaagaaaattttagaaagttattgattaattttg

SEQ ID NO: 61616 - DNA, 75 bp, Artificial Sequence
  Synthetic
cgagacttccacccaaaagtaggtccaccccaacatcagcaaccgagcctcctacaaaaatatatgagggttcga

SEQ ID NO: 61617 - DNA, 75 bp, Artificial Sequence
  Synthetic
tgattttgttttttgtagttttaataaaatggtatgtttgagtgtgatttttttttattaggttataatttaata

SEQ ID NO: 61618 - DNA, 75 bp, Artificial Sequence
  Synthetic
caacctatcgaggaaaatcaacagatacacatttggatgagggtcataatgccaaagagttcccattcaatccgc

SEQ ID NO: 61619 - DNA, 75 bp, Artificial Sequence
  Synthetic
ttaagttttgtatttttgtttggaggttagttaaatgtttaataattgatgataatggattgagtttagtattaa

SEQ ID NO: 61620 - DNA, 75 bp, Artificial Sequence
  Synthetic
tacacatttggatgagggtcataatgccaaagagttcccattcaatccgcatcgtttagtagtaccattttttaa

SEQ ID NO: 61621 - DNA, 75 bp, Artificial Sequence
  Synthetic
ttagattatatttgtgatataggattttttttagagatgggaaattaaggtttatgtatttataatggagatttt

SEQ ID NO: 61622 - DNA, 75 bp, Artificial Sequence
  Synthetic
attaacaaaagatggggaatacagtatcgaaccttcccctgaagaaagccgcagtaatataaaagggttacttca

SEQ ID NO: 61623 - DNA, 75 bp, Artificial Sequence
  Synthetic
ttgtagtatattgtgtgatgtgatttaattagtatatgttttgttggatttgtgtttgtaaagtatttttgataa

SEQ ID NO: 61624 - DNA, 75 bp, Artificial Sequence
  Synthetic
acatttaagaaccatggttgatactaccatatattgtcgcttcactgggattgtttcatcaatgcattataaatt

SEQ ID NO: 61625 - DNA, 75 bp, Artificial Sequence
  Synthetic
tattaagatatgttttgtgagtttgatgggttgattttttgttagtagatattaaatttgataagtaaaggtatt

SEQ ID NO: 61626 - DNA, 75 bp, Artificial Sequence
  Synthetic
agatgaagtactatgggaatataataaatttgaatcagctgtaaccctagcagagggggagggttcaggtgcttt

SEQ ID NO: 61627 - DNA, 75 bp, Artificial Sequence
  Synthetic
atttatttgattgggtatttgatgtaattggtttaattaagtaattagttttgaataatggagttaagtaattat

SEQ ID NO: 61628 - DNA, 75 bp, Artificial Sequence
  Synthetic
actactgatccaaaaatacggcgttaagaagttatttttgaatacacttgctactgaacatagtattgagagtga

SEQ ID NO: 61629 - DNA, 75 bp, Artificial Sequence
  Synthetic
ctactgaacatagtattgagagtgaagtgatatcaggttacaccaccccaagaatgctactctcagttatgccta

SEQ ID NO: 61630 - DNA, 75 bp, Artificial Sequence
  Synthetic
taatttataatattttttttatattatttagaaatattttgagtattattattttgagatattgtggattaatgt

SEQ ID NO: 61631 - DNA, 75 bp, Artificial Sequence
  Synthetic
gaacacatcgtggtgagctagaggtcatattaaataactcagctagtcaaataactgatattacacaccgagatt

SEQ ID NO: 61632 - DNA, 75 bp, Artificial Sequence
  Synthetic
gattaagtattaagttatatattgtttggtagagttgggatttgtttaagttttttgttgttttagtatttatta

SEQ ID NO: 61633 - DNA, 75 bp, Artificial Sequence
  Synthetic
taatgattttaatttgataaggtagattatatttttgattatttaattatattgagttagttatgttagttattt

SEQ ID NO: 61634 - DNA, 75 bp, Artificial Sequence
  Synthetic
tagatcgttcaagattatatgaagcagtatatacgattatttgtaatcatatcaatcctaaaactttaaaagtgg

SEQ ID NO: 61635 - DNA, 75 bp, Artificial Sequence
  Synthetic
gatttgttgaattatttaagataatagtgatttgttttttatgaattttttgtattattggtaataatatttttg

SEQ ID NO: 61636 - DNA, 75 bp, Artificial Sequence
  Synthetic
tcatcttaaaagtcttcctcagcgatttggatgggatgtgctggattaacaattatcttgctcctatgtttggat

SEQ ID NO: 61637 - DNA, 75 bp, Artificial Sequence
  Synthetic
gagtagaaaaatttgatataatttttgattttatattgtgttttgttgttaatgtgtttaaaaataataattttg

SEQ ID NO: 61638 - DNA, 75 bp, Artificial Sequence
  Synthetic
tattatatttttgtaaaagtaatagagtttttgattttttatttttagttaatgtgatagttgaattgaaattat

SEQ ID NO: 61639 - DNA, 75 bp, Artificial Sequence
  Synthetic
atcaagtgcaaggtcaagtgagtggtatttatgcttatctaatctactttcaactttgagaactactcagcatca

SEQ ID NO: 61640 - DNA, 75 bp, Artificial Sequence
  Synthetic
tgtattttagaagaattttgtttaatttgtaatgtatggatgagataatttttgtgaatttataatatatagtgg

SEQ ID NO: 61641 - DNA, 75 bp, Artificial Sequence
  Synthetic
aacccaagcaaactgtcttcatgtcgtacaatgtgctcttcaacagcaagttcaaagagggtcatattggctaag

SEQ ID NO: 61642 - DNA, 75 bp, Artificial Sequence
  Synthetic
tgtttaatatagattttagttgatgtaggtattgtttaatattttgatttattaatttttgggtattttgattat

SEQ ID NO: 61643 - DNA, 75 bp, Artificial Sequence
  Synthetic
ttggttttccttcgttagagaaggtcctatatcatagatataatcttgttgattcgagaaatggaccattggttt

SEQ ID NO: 61644 - DNA, 75 bp, Artificial Sequence
  Synthetic
gtgtatggttgtgattttttaatttaaaaaatggtagaatgagttggtgaggatttgatatattatttgttggtg

SEQ ID NO: 61645 - DNA, 75 bp, Artificial Sequence
  Synthetic
ctatcacaagacaccttgccctcctccaaactgagatccgggagttggtaactgattataatcagctgcgacaaa

SEQ ID NO: 61646 - DNA, 75 bp, Artificial Sequence
  Synthetic
gagtattgttttgaaagtagttattttttgttagaatagtttttttttgattttttattaatattttgtagggat

SEQ ID NO: 61647 - DNA, 75 bp, Artificial Sequence
  Synthetic
gtcgaacccagacttatcatttcataaaaacatccaagggacggataactaaactagtgaatgattatctaagat

SEQ ID NO: 61648 - DNA, 75 bp, Artificial Sequence
  Synthetic
tttatttgtggaattttttttttttatgatgattatttattgtttgtttgttattgttgagtttgtattgtgaga

SEQ ID NO: 61649 - DNA, 75 bp, Artificial Sequence
  Synthetic
agtttttgtgtttttgtggttttggtgattttttatatgttatattgtagtattttttatttgattgatgattgt

SEQ ID NO: 61650 - DNA, 75 bp, Artificial Sequence
  Synthetic
gtgtttgccatcgatttaatcatacacgcaactgtacatgcagtgaaaggttcctggttcaaaccttatatctac

SEQ ID NO: 61651 - DNA, 75 bp, Artificial Sequence
  Synthetic
ttgaaaatttatgtatgggttttgtaagtgttttatttttttttgagaaattattatggttttgagttttttgag

SEQ ID NO: 61652 - DNA, 75 bp, Artificial Sequence
  Synthetic
accggatgagtgatgctgagataaaacttatggaccggctcaccagcctagtcaatatgtttcccgaaggtttca

SEQ ID NO: 61653 - DNA, 75 bp, Artificial Sequence
  Synthetic
attttttatttttttagtaagttaaggatgtatggaagaaattattagtagtgtttttattattgtaaatataat

SEQ ID NO: 61654 - DNA, 75 bp, Artificial Sequence
  Synthetic
ggtctagttcagtctaattctaactgcatctcaggttctagaagtattttaaataaccaggtatatatcaaagtc

SEQ ID NO: 61655 - DNA, 75 bp, Artificial Sequence
  Synthetic
tattttttgttaaatttaaatgtttattattttggatgttgattttttttggaatatttttggggttttgtttga

SEQ ID NO: 61656 - DNA, 75 bp, Artificial Sequence
  Synthetic
aatacaagtgtaagaacaatatgcaagggaccacatttggcattagtttattgactcttccaatatacagcgttg

SEQ ID NO: 61657 - DNA, 75 bp, Artificial Sequence
  Synthetic
gtagatttaaaattttatgtagaaatttattgatggattttggttgttgatttttaagtggatatattatttata

SEQ ID NO: 61658 - DNA, 75 bp, Artificial Sequence
  Synthetic
gaagcatcgattcaaggtttcgaagacactctattgattatgttgataatgtaaataataatttttcctagctat

SEQ ID NO: 61659 - DNA, 75 bp, Artificial Sequence
  Synthetic
aaggaattgttttttggtgattgatgatttagtttttaagaaattgtaaaaaatttgtgattgttgtttgaagaa

SEQ ID NO: 61660 - DNA, 75 bp, Artificial Sequence
  Synthetic
tatgactaaaataaacaaatctataacgaacatcacaaccaaattgttgccctagttcatatattaaattcaaat

SEQ ID NO: 61661 - DNA, 75 bp, Artificial Sequence
  Synthetic
atagttgagtagtattagatagtttttgatttttagatgttttgttaatataaattgagaagttagaattaattt

SEQ ID NO: 61662 - DNA, 75 bp, Artificial Sequence
  Synthetic
ttagaagctaggttgactccagttacataagtattaagaaaaaattactaagactaatactcttatgctaagaac

SEQ ID NO: 61663 - DNA, 75 bp, Artificial Sequence
  Synthetic
ttattaattgggatattatattggtatgtttaaatgttggtttaaaaatatggagtgtttgatgaggtaagttgt

SEQ ID NO: 61664 - DNA, 75 bp, Artificial Sequence
  Synthetic
tagtaatatgtttcacatgacaggttatttctgatactaaattgcaatttcacttttaaagctaagtttaatact

SEQ ID NO: 61665 - DNA, 75 bp, Artificial Sequence
  Synthetic
gtagttggttatgtaaataatatagaaattgtttgtaattaagttttttagtttataggatagtattgtttagat

SEQ ID NO: 61666 - DNA, 75 bp, Artificial Sequence
  Synthetic
tatacagccaaaatatttcctagggccggtaggaataacataagaagaacacggtcaatgaaccttttattccaa

SEQ ID NO: 61667 - DNA, 75 bp, Artificial Sequence
  Synthetic
aaaagtataatattgttttgaaattgtaaagaaggttaatttgagggtaagtgagaaaatgagttgtgaaagagt

SEQ ID NO: 61668 - DNA, 75 bp, Artificial Sequence
  Synthetic
ccaggtagttgattgataatctacaaattccataagatgttcttacgacatttttttgtttttaatctcaatgtc

SEQ ID NO: 61669 - DNA, 75 bp, Artificial Sequence
  Synthetic
gtgtttttttgttattgattggatttgttgatgagttgttattgtttgagatgatggattgtattattgtttttg

SEQ ID NO: 61670 - DNA, 75 bp, Artificial Sequence
  Synthetic
tttttttgtttttaatctcaatgtcaatgatttaattagtagtaagaaaaaagttacattagaggtgcaggaaga

SEQ ID NO: 61671 - DNA, 75 bp, Artificial Sequence
  Synthetic
ttaatttttatttagaaaggtgtggaaagtggagaagattatttttaattatgttaagtttaggattttttatta

SEQ ID NO: 61672 - DNA, 75 bp, Artificial Sequence
  Synthetic
aaggattatttattgttaaattgtagtttaattttttttttagtggatttgagttatatattagtttattattat

SEQ ID NO: 61673 - DNA, 75 bp, Artificial Sequence
  Synthetic
gataatggtttaaatttagattaagtgtatttgtatatgttaaatattgggttgggatttttttagtatagtatt

SEQ ID NO: 61674 - DNA, 75 bp, Artificial Sequence
  Synthetic
ttgttaggtgaagatgagttttattatgttttatattagaggtgtttgtattttggaatttaatattataaaggg

SEQ ID NO: 61675 - DNA, 75 bp, Artificial Sequence
  Synthetic
taattgttaaatttataatattttggaaaattatattgttatttttggtggtttgttttttatttgaaaattttt

SEQ ID NO: 61676 - DNA, 75 bp, Artificial Sequence
  Synthetic
acctgaataaaagacaccacaatattataacccaataacacctagagaattgctaaattgctaaagattatatac

SEQ ID NO: 61677 - DNA, 75 bp, Artificial Sequence
  Synthetic
taagtgtattagttgatattatgagatgggttgtagtattgtttatgtgatttgttataaatgagtgtgggttgt

SEQ ID NO: 61678 - DNA, 75 bp, Artificial Sequence
  Synthetic
attggttgttatattgatggataatattttttgaataatgtgatggtgttatttgtaggattttattgatattaa

SEQ ID NO: 61679 - DNA, 75 bp, Artificial Sequence
  Synthetic
ctcaaactcaaactaatattaacattgagattgatctcatcatttaccaattggagacaatttaactagtcaatc

SEQ ID NO: 61680 - DNA, 75 bp, Artificial Sequence
  Synthetic
ggttgatttttgtttttaagaaaggttggattaattgtttattattagaatttttttgtgtaatttaagtgagtt

SEQ ID NO: 61681 - DNA, 75 bp, Artificial Sequence
  Synthetic
ccccatttgggggcattcctaaagtgttgcaaaggtatgtgggtcgtattgctttgccttttcctaacctggctc

SEQ ID NO: 61682 - DNA, 75 bp, Artificial Sequence
  Synthetic
ttgatgttaattttatagtttttttgagggtagatgaagggtattgtggtttgatagtaggttgtttgattttat

SEQ ID NO: 61683 - DNA, 75 bp, Artificial Sequence
  Synthetic
ctcctacaattctaacctgcttgataagtgtgattacctgagtaatagactaatttcgtcctggtaattagcatt

SEQ ID NO: 61684 - DNA, 75 bp, Artificial Sequence
  Synthetic
ttttggtttttgattttatataggggatattattttttattgtttaatttatttgagaagtattaggttaagtat

SEQ ID NO: 61685 - DNA, 75 bp, Artificial Sequence
  Synthetic
ttctagtaaaaccaatactatctcaagtcctaagagaaggtgagaagagggtcccgaggtatccctccagtccac

SEQ ID NO: 61686 - DNA, 75 bp, Artificial Sequence
  Synthetic
tgattatttgatttttgattgtaattgagatataagtatttgagttttttttgttgagatattttggataaggtt

SEQ ID NO: 61687 - DNA, 75 bp, Artificial Sequence
  Synthetic
gtcccgaggtatccctccagtccacaaaatctagctaattttagctgagtggactgattactctcatcacacgct

SEQ ID NO: 61688 - DNA, 75 bp, Artificial Sequence
  Synthetic
tatattgttttagttatttaattttgaattgttttattatatatggtaatgttgttttgattaatgatttatttt

SEQ ID NO: 61689 - DNA, 75 bp, Artificial Sequence
  Synthetic
ttaagatgtgtgattatgtatatttatgtaaaatttgggttaaatttattgtgtaattaattttttgtagagtat

SEQ ID NO: 61690 - DNA, 75 bp, Artificial Sequence
  Synthetic
ctgaagttgatcttgactaccacaaaatattaacagccgggctttcggtccaacaagggattgtgcgacaaagag

SEQ ID NO: 61691 - DNA, 75 bp, Artificial Sequence
  Synthetic
ttgttagtaattggttataatggtttaaataattgaattatagattttatttttgtagggtgattttttttagtt

SEQ ID NO: 61692 - DNA, 75 bp, Artificial Sequence
  Synthetic
tcatcccggtatatgttgtgagtgatcttgagggtatttgtcaacatatcattcaggcctttgaagcaggcgtag

SEQ ID NO: 61693 - DNA, 75 bp, Artificial Sequence
  Synthetic
tcttgagggtatttgtcaacatatcattcaggcctttgaagcaggcgtagatttccaagataatgctgacagctt

SEQ ID NO: 61694 - DNA, 75 bp, Artificial Sequence
  Synthetic
tattaagtataggtgttttattgttgttgtttatgattttggaggttaatagagttttggtttttttaagataat

SEQ ID NO: 61695 - DNA, 75 bp, Artificial Sequence
  Synthetic
ttaatatttggagatgtttattatttggtgttttggaaaaaatatttgttgtaaagtgatttatgatagggtttg

SEQ ID NO: 61696 - DNA, 75 bp, Artificial Sequence
  Synthetic
atgaaaggagttatttataaattattttattttttaaattagtagaggtatggaagagagtgttaattaatttat

SEQ ID NO: 61697 - DNA, 75 bp, Artificial Sequence
  Synthetic
tgtcaccggtggaaaaaatcttaggagaacattggctgcaatgcctgaagaggagacaacagaagctaatgctgg

SEQ ID NO: 61698 - DNA, 75 bp, Artificial Sequence
  Synthetic
ttttagtagttagggtaatattatgtttaatgatttgttgtaaaaaggatgttaagttttgtgattttggaatat

SEQ ID NO: 61699 - DNA, 75 bp, Artificial Sequence
  Synthetic
aggagacaacagaagctaatgctggtcagtttttatcctttgccagtttgtttctacccaaacttgtcgttgggg

SEQ ID NO: 61700 - DNA, 75 bp, Artificial Sequence
  Synthetic
ttaatttggatggatttaagataaaattaatggtattataattttttggattttttgatattaatggataaaata

SEQ ID NO: 61701 - DNA, 75 bp, Artificial Sequence
  Synthetic
ggttttttatgttaattatttttaggtatatttgtagttggaaaagtttagaagttataggatttttgaagtttt

SEQ ID NO: 61702 - DNA, 75 bp, Artificial Sequence
  Synthetic
gataaaaatatttttttggatttagaaaagataattttttaaggatttgtggaattgttaatgttagagtaatag

SEQ ID NO: 61703 - DNA, 75 bp, Artificial Sequence
  Synthetic
aactttttaatcaagttcctactaatacatcaggggatgcacatggtcgcaggccatgatgcgaatgacacagta

SEQ ID NO: 61704 - DNA, 75 bp, Artificial Sequence
  Synthetic
ttttatagtttaatggtttattaagtgataattgttttaaattgatgtttttattaaatttaagatggtgatatt

SEQ ID NO: 61705 - DNA, 75 bp, Artificial Sequence
  Synthetic
gtaaaatttgaatggtgaaatatgtatggaaagttgttataatatgatatgggaggatatgttgtgtttttgata

SEQ ID NO: 61706 - DNA, 75 bp, Artificial Sequence
  Synthetic
aaaacagatcttggagtacgacttcatccactggccaggacagcaaaagtcaagaatgaggtcagttcattcaag

SEQ ID NO: 61707 - DNA, 75 bp, Artificial Sequence
  Synthetic
atccactggccaggacagcaaaagtcaagaatgaggtcagttcattcaaggcagctcttggctcacttgccaagc

SEQ ID NO: 61708 - DNA, 75 bp, Artificial Sequence
  Synthetic
tagtatgtttgaaggtagttttaatattggtaagtgttttttgtagattattgaatatagtattagagagtggtg

SEQ ID NO: 61709 - DNA, 75 bp, Artificial Sequence
  Synthetic
ttatttttgttgttgttttgagtgattgtggtaattgtatattattgagatattgtttttttttgaaataaatga

SEQ ID NO: 61710 - DNA, 75 bp, Artificial Sequence
  Synthetic
aacttggaacatgggctttatccacaactctcagccattgctttgggtgttgcaactgcccacgggagcacgctg

SEQ ID NO: 61711 - DNA, 75 bp, Artificial Sequence
  Synthetic
aatttgagtgtataaatgttttatttggtttaagaaagattttatatgtattggttatttttgtaagatttgttg

SEQ ID NO: 61712 - DNA, 75 bp, Artificial Sequence
  Synthetic
atcagcaactgcgtgaggctgctactgaagctgaaaagcaactccaacaatatgctgaaacacgtgagttggaca

SEQ ID NO: 61713 - DNA, 75 bp, Artificial Sequence
  Synthetic
ttatttttgtagtattgtttttggtgttttgtttttgttttttagggtttgttttaagtggaaaaatagataata

SEQ ID NO: 61714 - DNA, 75 bp, Artificial Sequence
  Synthetic
tggttatatattgattgttttttatgattgttgattgtaatttaaaattagttttaatttttattaaggagattt

SEQ ID NO: 61715 - DNA, 75 bp, Artificial Sequence
  Synthetic
aagaagaatgagatcagcttccagcaaactaacgcaatggtaaccctgaggaaagagcggctggccaaactgacc

SEQ ID NO: 61716 - DNA, 75 bp, Artificial Sequence
  Synthetic
gtgtataggatatatttgtttatagtttttgttgtaatttttttatgttttttaagtgtttttggtatgaatttg

SEQ ID NO: 61717 - DNA, 75 bp, Artificial Sequence
  Synthetic
tgacaatgatattccatttcccgggccgatctatgatgaaacccaccccaacccttctgatgataatcctgatga

SEQ ID NO: 61718 - DNA, 75 bp, Artificial Sequence
  Synthetic
ggtttttaggaggatatttttgattgttaagattaatattgtgaggtggattataataattatttatatgtatgt

SEQ ID NO: 61719 - DNA, 75 bp, Artificial Sequence
  Synthetic
aatattgtgggattaaataatgtatttaattaaagatattatgtatattatagtaatggttgtagtatttaataa

SEQ ID NO: 61720 - DNA, 75 bp, Artificial Sequence
  Synthetic
acgacgatgacgacagccaaccaggaccaccagacagggggcagagcaaggaaagagcggctcggacacatggcc

SEQ ID NO: 61721 - DNA, 75 bp, Artificial Sequence
  Synthetic
atggtgtagtgaatttatagtgaaatgtaagattgtatttttttaaattagttataaaattatttttttgaatgg

SEQ ID NO: 61722 - DNA, 75 bp, Artificial Sequence
  Synthetic
tagtattttttttaaaattattattggtgtggtgttatgatgtttgatgaagaaggttttttttttgtttatgtt

SEQ ID NO: 61723 - DNA, 75 bp, Artificial Sequence
  Synthetic
ggttcccaccaaccaggcaacctccacatcaccaagccgggttcaaacaccaaccaaccacaaggcaatatgtca

SEQ ID NO: 61724 - DNA, 75 bp, Artificial Sequence
  Synthetic
tagttattattattatgttattggggaaggttttggttagtttatttgttaatagagttttatataaagtttgga

SEQ ID NO: 61725 - DNA, 75 bp, Artificial Sequence
  Synthetic
tattttgtgtgagatatggtagttttttaaatgtttgtttaatatttaattttttttttttgagagaaaaggaaa

SEQ ID NO: 61726 - DNA, 75 bp, Artificial Sequence
  Synthetic
tcagaaagatgatgatgacgagagtctcacatcccttgactctgaaggtgacgaagatgttgagagcgtatcagg

SEQ ID NO: 61727 - DNA, 75 bp, Artificial Sequence
  Synthetic
aatttttattttgtggtaataaataatgtaatttttgtgtataatttaggatatttttgattgaaaaattttttt

SEQ ID NO: 61728 - DNA, 75 bp, Artificial Sequence
  Synthetic
ggagaacaacccaactgtagctccaccagcaccagtctacaaagatactggagtagacactaatcagcaaaatgg

SEQ ID NO: 61729 - DNA, 75 bp, Artificial Sequence
  Synthetic
gttttagaaattgttttggtatttttttagtggagaatttgtttggaggattgtaatttagtatattgggtttaa

SEQ ID NO: 61730 - DNA, 75 bp, Artificial Sequence
  Synthetic
accaagcaatgctgtagatggtcaaggttctgaaagtgaagctctcccaatcaaccccgaaaagggatctgcact

SEQ ID NO: 61731 - DNA, 75 bp, Artificial Sequence
  Synthetic
agattgtattttaatatgtttgtttaatagttgtggttttatttttgatgaaaatatttaagttattaattattt

SEQ ID NO: 61732 - DNA, 75 bp, Artificial Sequence
  Synthetic
ttgtagagaataatggagggtgattaagatgatagaatttttatagaagatttttaattatgggtagtgaaggaa

SEQ ID NO: 61733 - DNA, 75 bp, Artificial Sequence
  Synthetic
tgagcccattgcttttagcactgaaagtggcaaggaatatatcttcccagattctcttgaagaagcctacccgcc

SEQ ID NO: 61734 - DNA, 75 bp, Artificial Sequence
  Synthetic
agtgattatgttttatgaaggagttgagttttggagttaaatttttgtttgagattatattgtattaagtttttt

SEQ ID NO: 61735 - DNA, 75 bp, Artificial Sequence
  Synthetic
ggttgttgaaatagtgtttggtaatattgtatttgaatatataatatgttttaaagatgatattaggtttgagag

SEQ ID NO: 61736 - DNA, 75 bp, Artificial Sequence
  Synthetic
agtaatgagcctacaggacaagttccttgctgttcttcaacatgactgaggacccatgattagtagattttgttt

SEQ ID NO: 61737 - DNA, 75 bp, Artificial Sequence
  Synthetic
gacccatgattagtagattttgtttattctgagcttgattataattgttttgataattcaagtatgagcaaccaa

SEQ ID NO: 61738 - DNA, 75 bp, Artificial Sequence
  Synthetic
ttttaaggatggttgtatgttgttttattttttgtatagtttttttattatgtaaaattggatgtttttaatgtt

SEQ ID NO: 61739 - DNA, 75 bp, Artificial Sequence
  Synthetic
cccgaaatataaaccctattttagttatgaggaaattaaataaataatctgtaagttgtaggactatgaagagct

SEQ ID NO: 61740 - DNA, 75 bp, Artificial Sequence
  Synthetic
tttgaatagagaataatttataaaattgttgaggagataattgtaattgtaataatattttgtgaaaatttttaa

SEQ ID NO: 61741 - DNA, 75 bp, Artificial Sequence
  Synthetic
gcttgtgtcaatttatcacgggctaatacccataccgcaagaataattatttagtaattttgatcagcttatgat

SEQ ID NO: 61742 - DNA, 75 bp, Artificial Sequence
  Synthetic
tttttttttgttgatagttttttaatttgtggttagaaattaatttttgaagattatttattattgataaatgta

SEQ ID NO: 61743 - DNA, 75 bp, Artificial Sequence
  Synthetic
ttagtaattttgatcagcttatgatatgtaccaataggaaaacattatagcattaaaacataaagtatccttcga

SEQ ID NO: 61744 - DNA, 75 bp, Artificial Sequence
  Synthetic
tttgtgtgaggaaatgattttttttttttgtgaatttagagtaaagttggattttggttaaataaagtggtttaa

SEQ ID NO: 61745 - DNA, 75 bp, Artificial Sequence
  Synthetic
ggtattttattattttataattttttgagttaagaatagatattatatagtttttagtattgtatattttaagaa

SEQ ID NO: 61746 - DNA, 75 bp, Artificial Sequence
  Synthetic
accttcatcatcctttaaaaagagagctattctttatctgaatgtccttattaatgtctaagagctattattttg

SEQ ID NO: 61747 - DNA, 75 bp, Artificial Sequence
  Synthetic
tattatttgggttaggataattagatatatttatattttttaattttgtaatggatgtaattagtgatgtattaa

SEQ ID NO: 61748 - DNA, 75 bp, Artificial Sequence
  Synthetic
atttataggtgataatatttttatatataattagtattttagttgttgatatagataggatttggttatgtttta

SEQ ID NO: 61749 - DNA, 75 bp, Artificial Sequence
  Synthetic
ggacttatagacatcatggacccgaagtgtctggctggttttctgagcaattaatgaccggcaaaataccgctaa

SEQ ID NO: 61750 - DNA, 75 bp, Artificial Sequence
  Synthetic
ggatggattttttaaaaagagttggttgatattagttagttgttgtgtgtgggattttgtttatagtaattggta

SEQ ID NO: 61751 - DNA, 75 bp, Artificial Sequence
  Synthetic
cagaggtgtttgttgatgttgaaaacaaaccaagtcctgccccgataaccattattagtaagaatcccaagacaa

SEQ ID NO: 61752 - DNA, 75 bp, Artificial Sequence
  Synthetic
ataatgataaaggtattttttaaaaaatataattgttatattttaaaatattaatgaatttattatgaataaatt

SEQ ID NO: 61753 - DNA, 75 bp, Artificial Sequence
  Synthetic
cacgtaaaagtgataagcaagtccaaacagatgatgccagtagcttattgacagaagaagtcaaggctgccataa

SEQ ID NO: 61754 - DNA, 75 bp, Artificial Sequence
  Synthetic
aggttgaatggttgtttttgtgatttagatgtttatgttgagttaaaatagaaaggttatgttagaagaataatt

SEQ ID NO: 61755 - DNA, 75 bp, Artificial Sequence
  Synthetic
acagaagaagtcaaggctgccataaattcggtgatatcagctgtgcgtcggcaaaccaatgctattgaatcacta

SEQ ID NO: 61756 - DNA, 75 bp, Artificial Sequence
  Synthetic
gaaggtcgagtaacaactcttgaggccagcttaaaacccgttcaagacatggcaaagaccatatcatccctgaat

SEQ ID NO: 61757 - DNA, 75 bp, Artificial Sequence
  Synthetic
ccagcttaaaacccgttcaagacatggcaaagaccatatcatccctgaatcgcagctgtgccgaaatggttgcaa

SEQ ID NO: 61758 - DNA, 75 bp, Artificial Sequence
  Synthetic
gatggatataattattgtttagaattttgtttttaagtttttttttagttgtaatgtttgttaaatggttttgtg

SEQ ID NO: 61759 - DNA, 75 bp, Artificial Sequence
  Synthetic
tatttgttgttttgagatagtaattaagaaaggttgtattatgaagagtgtaattaataattttattaaggaatt

SEQ ID NO: 61760 - DNA, 75 bp, Artificial Sequence
  Synthetic
aatacgacctactggtgatgaccactgggcgagcaactgccactgctgcagcaacagaagcatattggaatgaac

SEQ ID NO: 61761 - DNA, 75 bp, Artificial Sequence
  Synthetic
gattgtaagttggggttaatggtttattattgtgttttgttagggaatgtaggagaattggtattaaatagttta

SEQ ID NO: 61762 - DNA, 75 bp, Artificial Sequence
  Synthetic
ttggtagtgttgttataggtgtattatttaggaatttggatattattgtgttgaatttaagttgatatatatgtt

SEQ ID NO: 61763 - DNA, 75 bp, Artificial Sequence
  Synthetic
aggttccagaaagtgtcaaacaggcctacataaatctagatagcacaagtgccctcaatgaggaaaatttcgggc

SEQ ID NO: 61764 - DNA, 75 bp, Artificial Sequence
  Synthetic
gccctcaatgaggaaaatttcgggcgaccttacatttcagcaaaagatctcaaggaaatcatctatgaccatctc

SEQ ID NO: 61765 - DNA, 75 bp, Artificial Sequence
  Synthetic
ttggtaatttatattgttttagttgaggatttagagaataagatgaatataatttatatgtttgagttattaaat

SEQ ID NO: 61766 - DNA, 75 bp, Artificial Sequence
  Synthetic
tatattgatttaggattataggtgaggataaatgtgtatttgggtattgggtatgttgggtagttatatggtatg

SEQ ID NO: 61767 - DNA, 75 bp, Artificial Sequence
  Synthetic
aggaagttaggtagaaaaaaattataggatatttgatggtaattaagtgaatatgaggttttttttttaattttt

SEQ ID NO: 61768 - DNA, 75 bp, Artificial Sequence
  Synthetic
gtgtgcattaatccagataacaaaacggatccctgctttccaagatgcctctcctccaattgtgcatatcaagtc

SEQ ID NO: 61769 - DNA, 75 bp, Artificial Sequence
  Synthetic
tttagatttttttttaatagtatagtattgatatgttattaaaataaagttatattaatataagtaaagatagga

SEQ ID NO: 61770 - DNA, 75 bp, Artificial Sequence
  Synthetic
aaagattggttatatatatatgtaaaaatggaagttgtttaatagttaggtattgttttattttgatgtttattt

SEQ ID NO: 61771 - DNA, 75 bp, Artificial Sequence
  Synthetic
atttttaatttttgattgttaattttttttatttaagaaatgttgataatttttattttaaaaagattatttatg

SEQ ID NO: 61772 - DNA, 75 bp, Artificial Sequence
  Synthetic
aagtataaggtaaaatttaagtttaaatttgtataatttatatattttaaatttttaatgtgatataaatttatt

SEQ ID NO: 61773 - DNA, 75 bp, Artificial Sequence
  Synthetic
agtcagttttaaatttcccctctatcctaatcaattgataatgctgtcaatagggaaattcccctgtattgtaat

SEQ ID NO: 61774 - DNA, 75 bp, Artificial Sequence
  Synthetic
agtagtgtttaatgtaattagtgaaaatagattagatagttaatttaataatgttagataagatttataattaat

SEQ ID NO: 61775 - DNA, 75 bp, Artificial Sequence
  Synthetic
aagacctcattaacatatttcccctgcttagtactatgcagaaacccccgagcaaattaaaattgatgaagatta

SEQ ID NO: 61776 - DNA, 75 bp, Artificial Sequence
  Synthetic
gcttagtactatgcagaaacccccgagcaaattaaaattgatgaagattaagaaaaagagggattttctcaggaa

SEQ ID NO: 61777 - DNA, 75 bp, Artificial Sequence
  Synthetic
ttttatttatgtatttattttaagattattttgttaaattgttaataaattgttgaattttattattaatgattg

SEQ ID NO: 61778 - DNA, 75 bp, Artificial Sequence
  Synthetic
aaatcttttttcttaccttcatctcatttaaacaaatttaggactcaggaaaaatgagaagggtcactgtgccga

SEQ ID NO: 61779 - DNA, 75 bp, Artificial Sequence
  Synthetic
tattttagattgtggaatatgagtgaaaggtttgaaggtagatttatgaagtaatgagaatttgattggttttgg

SEQ ID NO: 61780 - DNA, 75 bp, Artificial Sequence
  Synthetic
ctgcaccacctgcctatgctgacattggctatcctatgagcatgcttcccatcaagtcaagcagggctgtgagtg

SEQ ID NO: 61781 - DNA, 75 bp, Artificial Sequence
  Synthetic
gtgtttagaatttatagttgatttgttaggtttttgaatttttatgagaaaatttatatttgtatgagttataat

SEQ ID NO: 61782 - DNA, 75 bp, Artificial Sequence
  Synthetic
gaattcaacagaaacaagaggtccttcctggaatggatacaccatcaaattctatgagacctgttgctgatgata

SEQ ID NO: 61783 - DNA, 75 bp, Artificial Sequence
  Synthetic
gattgtgtgtgtagaagttttgattttaatattattgagtaaattattgtaattgataatatgtagggtgttaag

SEQ ID NO: 61784 - DNA, 75 bp, Artificial Sequence
  Synthetic
tctatgagacctgttgctgatgataacattgatcatacaagtcataccccgaacggagtggcctcagcattcatc

SEQ ID NO: 61785 - DNA, 75 bp, Artificial Sequence
  Synthetic
tttgttgatgaattgtaagatgtttgatttgattaaagataatatatgaagattaagttggttttttatgttttt

SEQ ID NO: 61786 - DNA, 75 bp, Artificial Sequence
  Synthetic
aatccctatttggttgccactcggaattgctgaccaaaaaacgtacagttttgactcaacaacagcagcaattat

SEQ ID NO: 61787 - DNA, 75 bp, Artificial Sequence
  Synthetic
agtatgaagattgaaatgtgttgatgttgtagttaggagttaattagaaattagattgagagtttttgttaatgg

SEQ ID NO: 61788 - DNA, 75 bp, Artificial Sequence
  Synthetic
ttgactcaacaacagcagcaattatgctcgcatcttatacgatcacccattttggaaaggccaacaaccccctcg

SEQ ID NO: 61789 - DNA, 75 bp, Artificial Sequence
  Synthetic
tttaattaatgaatggtttaataattgattttgtaatttggttgttaaaattatttttaaagtttagatgggaga

SEQ ID NO: 61790 - DNA, 75 bp, Artificial Sequence
  Synthetic
ttgaataattgaatttgggttttggaatagatgtgggaaaagattttttgttattgtttaggtaggagtaaagtt

SEQ ID NO: 61791 - DNA, 75 bp, Artificial Sequence
  Synthetic
cacagcctctccctgctgcaacatggacagatgagactccgagcaacctttcaggagcccttcgtcccgggcttt

SEQ ID NO: 61792 - DNA, 75 bp, Artificial Sequence
  Synthetic
gacagatgagactccgagcaacctttcaggagcccttcgtcccgggctttcatttcacccaaagctgagacccgt

SEQ ID NO: 61793 - DNA, 75 bp, Artificial Sequence
  Synthetic
atttgttttgagttttgttagaagagttatgtttttttgatttatattaaatttaatttttgtttaataaatttt

SEQ ID NO: 61794 - DNA, 75 bp, Artificial Sequence
  Synthetic
tctacttccaggcaagacgggaaagaaagggcatgtttctgatctgactgccccagacaaaattcagacaattgt

SEQ ID NO: 61795 - DNA, 75 bp, Artificial Sequence
  Synthetic
ttaattttgtagggtttgagtaattaagaaattataaagattattaaaaattatttttttttttatatttttttt

SEQ ID NO: 61796 - DNA, 75 bp, Artificial Sequence
  Synthetic
ccccagacaaaattcagacaattgtgaacctgatgcaagatttcaaaatcgtgccaattgatccagctaagagta

SEQ ID NO: 61797 - DNA, 75 bp, Artificial Sequence
  Synthetic
tgggggtatgagattgtattggtttgtggttttagttattttgtgttttgaggatgttttatataaaaggaattt

SEQ ID NO: 61798 - DNA, 75 bp, Artificial Sequence
  Synthetic
gtttaaataataagaaataatttttttagttgaaattgatttgtttatagttttggttgagttgattatgttggt

SEQ ID NO: 61799 - DNA, 75 bp, Artificial Sequence
  Synthetic
ctataattcctgtcttacttccaaaatacattgggctagatccaatctcacctggagacctgactatggtcataa

SEQ ID NO: 61800 - DNA, 75 bp, Artificial Sequence
  Synthetic
gttaatgattttatgttaatttgttgggattttttgggatttttttttgtttttttaagagtttttaaggataga

SEQ ID NO: 61801 - DNA, 75 bp, Artificial Sequence
  Synthetic
ttattgagaatagtttggtgattgttaatgttagattttaaggatgttttaattgtgatgtttttatatgatatg

SEQ ID NO: 61802 - DNA, 75 bp, Artificial Sequence
  Synthetic
atgtatttgtatgttagttttaaaaaagtgtttatttaagtattagatattttaattttatagtaagtaattagt

SEQ ID NO: 61803 - DNA, 75 bp, Artificial Sequence
  Synthetic
actatgggacaactcaaccctcttgttaaaatgtactaatcgggtcaaggaactctcactgatcaagcctgaatc

SEQ ID NO: 61804 - DNA, 75 bp, Artificial Sequence
  Synthetic
aaaatttaatattaaaatataattattttagaagttaatgatttttataaaagaatttatgaattgatgaagatt

SEQ ID NO: 61805 - DNA, 75 bp, Artificial Sequence
  Synthetic
caagatagaaccagcccaaagggcctccccagagtctcttacaagcttagccaatcaattaacatgcataagcga

SEQ ID NO: 61806 - DNA, 75 bp, Artificial Sequence
  Synthetic
tggatgaggttttaaggaattaaagttgaatttttgatttttttgtaattaatttttattttgtattattggttt

SEQ ID NO: 61807 - DNA, 75 bp, Artificial Sequence
  Synthetic
tccatacttcgcccaatcagtgtccgatgttcaccccttcaagcctccttcctagcaaattgacctagctgtacc

SEQ ID NO: 61808 - DNA, 75 bp, Artificial Sequence
  Synthetic
taggtatttgaagtagtaaataataaagttatattttggaagtagtaaattttttttagttttatttataaattt

SEQ ID NO: 61809 - DNA, 75 bp, Artificial Sequence
  Synthetic
aagagattccctcagcctccttctcaaataacctgatcctcgagggttacaccttcaccactctatgctcatttc

SEQ ID NO: 61810 - DNA, 75 bp, Artificial Sequence
  Synthetic
ggatatttaaggattattagtaaattgtttataattatgatttttttttaataaagattaaattgataatttgaa

SEQ ID NO: 61811 - DNA, 75 bp, Artificial Sequence
  Synthetic
accttcaccactctatgctcatttcacccaaacataaaatgaaatgtcttaacatgattgcaccattaagaaaaa

SEQ ID NO: 61812 - DNA, 75 bp, Artificial Sequence
  Synthetic
aagaattattataaaattatgattatttgattaaaatatgaggttaggagaatttaattttgttattgataattt

SEQ ID NO: 61813 - DNA, 75 bp, Artificial Sequence
  Synthetic
caaatctgatgaagattaagcctgattaaggcccaaccttcatctttttaccataatcttgttctcagtaccatt

SEQ ID NO: 61814 - DNA, 75 bp, Artificial Sequence
  Synthetic
gttagatatatgattttgagtatattttagataaaatattttagatattaatttattttattatatttaagttat

SEQ ID NO: 61815 - DNA, 75 bp, Artificial Sequence
  Synthetic
tgataagggtacacttgccaatacgcccccatcctaagggtctcgcaatggggggtcttagcctactccaattgc

SEQ ID NO: 61816 - DNA, 75 bp, Artificial Sequence
  Synthetic
gggggtcttagcctactccaattgcccagggacaaatttcggaaaagctctttctttgtttgggtcatcatctta

SEQ ID NO: 61817 - DNA, 75 bp, Artificial Sequence
  Synthetic
gtattgttaaatagggtagatttattgataattgtgatagtagattgttttaagaattattattattaaatggaa

SEQ ID NO: 61818 - DNA, 75 bp, Artificial Sequence
  Synthetic
tttttgataattgtatattgaagttgtattatatttatattaatttattgattgagagtaattgtggaaaaatag

SEQ ID NO: 61819 - DNA, 75 bp, Artificial Sequence
  Synthetic
ttttagtggttttttatttaattgtatttgattaggtggtattattagttgttttggatggtgtagaattgtttt

SEQ ID NO: 61820 - DNA, 75 bp, Artificial Sequence
  Synthetic
actgatatcccatctgcaacaaagcgttggggcttcagatctggtgttcctcccaaggtggtcagctatgaagcg

SEQ ID NO: 61821 - DNA, 75 bp, Artificial Sequence
  Synthetic
gtgttgggtataatgtggtaagatttgagattatgatattagaatttttataaggtatttggagagtaatgttga

SEQ ID NO: 61822 - DNA, 75 bp, Artificial Sequence
  Synthetic
gaaaagtagagatgaatattattaatgattgttggttttattgttgttatagggtagttttaaaatttttttttt

SEQ ID NO: 61823 - DNA, 75 bp, Artificial Sequence
  Synthetic
gatggtgtcagaggctttccaaggtgccgctatgttcacaaagcccaaggaaccgggccctgcccaggtgactac

SEQ ID NO: 61824 - DNA, 75 bp, Artificial Sequence
  Synthetic
tattattgtggagtttttggtagatttttaatatagaattagtttggttttgtttgaggtttttatgttgtaggt

SEQ ID NO: 61825 - DNA, 75 bp, Artificial Sequence
  Synthetic
gggttttatatagaagatttagttgggatttagaaaatttttttgttaatatggtataaagggttaaaagagttt

SEQ ID NO: 61826 - DNA, 75 bp, Artificial Sequence
  Synthetic
taagtttagagtttttaatttgttttaggtttttggttgtttaatgtttagtaatttgaagaaggattgtaagtg

SEQ ID NO: 61827 - DNA, 75 bp, Artificial Sequence
  Synthetic
caagttattatgccacatcctacttggagtatgaaatcgaaaattttggtgctcaacactccacgacccttttca

SEQ ID NO: 61828 - DNA, 75 bp, Artificial Sequence
  Synthetic
ttaatttaggattattattttgtgagaagtttttagttgttggatttgttaattgtatattttttggggatgtaa

SEQ ID NO: 61829 - DNA, 75 bp, Artificial Sequence
  Synthetic
aaattgacaataatacttttgttcgtctggacaggccccacacgcctcagttccttttccagctgaatgatacca

SEQ ID NO: 61830 - DNA, 75 bp, Artificial Sequence
  Synthetic
tttgtgaattgtttttgataattttatatgttttttttgtaattagtagtagtaatttatgattatttaagttat

SEQ ID NO: 61831 - DNA, 75 bp, Artificial Sequence
  Synthetic
ttccttttccagctgaatgataccattcaccttcaccaacagttgagtaatacaactgggagactaatttggaca

SEQ ID NO: 61832 - DNA, 75 bp, Artificial Sequence
  Synthetic
ttaattggtgattttttttgtaaaatttgttattgtagaggaatttttttttgagtgttgggtatatatttttag

SEQ ID NO: 61833 - DNA, 75 bp, Artificial Sequence
  Synthetic
gagttggaggaattatgagtgtattagtttttttttgatggaatagatttggaatatgaatttgggatgtatttt

SEQ ID NO: 61834 - DNA, 75 bp, Artificial Sequence
  Synthetic
caaagggaagaatctccgaccgggccaccaggaagtattcggacctggttccaaagaattcccctgggatggttc

SEQ ID NO: 61835 - DNA, 75 bp, Artificial Sequence
  Synthetic
gaggttgtttatgattaatttgattagggttttgagataatgagtgagattttgatggatttttgtatggttttt

SEQ ID NO: 61836 - DNA, 75 bp, Artificial Sequence
  Synthetic
ggttattatgttgtatgttgttagatttattttgtttttttgaatgttttattatttggattttaaagttagaat

SEQ ID NO: 61837 - DNA, 75 bp, Artificial Sequence
  Synthetic
ctcaggagaccattacagagacagctgcaacaattataggcactaacggcaaccatatgcagatctccaccatcg

SEQ ID NO: 61838 - DNA, 75 bp, Artificial Sequence
  Synthetic
ttagaaattaggttttaggatattaaatagtaatgttaggttttttttttatggttattgttgttttttgatttt

SEQ ID NO: 61839 - DNA, 75 bp, Artificial Sequence
  Synthetic
ggataagaccgagctccagccaaatcccgagttcctcaccgaccacggcaccaagccctgaggctcagaccccca

SEQ ID NO: 61840 - DNA, 75 bp, Artificial Sequence
  Synthetic
tatttataaatgttggttttttttatttataatttttggagttgtttttagttgtaagtattattaatgtggttt

SEQ ID NO: 61841 - DNA, 75 bp, Artificial Sequence
  Synthetic
caacccacacatcaggtccatcagtgatggccaccgaggaaccaacaacaccaccgggaagctcccccggcccaa

SEQ ID NO: 61842 - DNA, 75 bp, Artificial Sequence
  Synthetic
tgatgaatgagatgggaggtttttttgttaatgatttttttttttaatttttgttataagttttttttaatatat

SEQ ID NO: 61843 - DNA, 75 bp, Artificial Sequence
  Synthetic
caacagaagcacccactctcaccaccccagaaaatataacaacagcggttaaaactgtcctgccacaggagtcca

SEQ ID NO: 61844 - DNA, 75 bp, Artificial Sequence
  Synthetic
taattattattaagagaaatattatattgtaaattaagtaaagaagtagaaaaatatattattaattgtttattt

SEQ ID NO: 61845 - DNA, 75 bp, Artificial Sequence
  Synthetic
caagcaacggtctaataacttcaacagtaacagggattcttgggagtcttgggcttcgaaaacgcagcagaagac

SEQ ID NO: 61846 - DNA, 75 bp, Artificial Sequence
  Synthetic
agtaacagggattcttgggagtcttgggcttcgaaaacgcagcagaagacaaactaacaccaaagccacgggtaa

SEQ ID NO: 61847 - DNA, 75 bp, Artificial Sequence
  Synthetic
aagataagtggttagtatttaagtaaattttaaaaataatatttttttttagagtaattttgagatttttttttt

SEQ ID NO: 61848 - DNA, 75 bp, Artificial Sequence
  Synthetic
ttagattttagaataaattaatataaaattttatatatataaagtagggttattatagtaattataattttaata

SEQ ID NO: 61849 - DNA, 75 bp, Artificial Sequence
  Synthetic
attttaattttagttgggatttattgtttttaatttgtttatagattaagattatttttgtggtttggtagggga

SEQ ID NO: 61850 - DNA, 75 bp, Artificial Sequence
  Synthetic
tggaccgggtgcggaaggcatatacactgaaggcctgatgcataaccaaaatgccttagtctgtggacttaggca

SEQ ID NO: 61851 - DNA, 75 bp, Artificial Sequence
  Synthetic
ttgttaataaagttatgtttaatttggttaattttattagtaatattttttgtttaattatgtggtttaatgtaa

SEQ ID NO: 61852 - DNA, 75 bp, Artificial Sequence
  Synthetic
ctgcagcttttcttaagagccacaacggagctgcggacatataccatactcaataggaaggccatagatttcctt

SEQ ID NO: 61853 - DNA, 75 bp, Artificial Sequence
  Synthetic
taagatggttttaggatttgataggtatttttttattgttgaagaagaaaattaatagtttttttgttaagaagt

SEQ ID NO: 61854 - DNA, 75 bp, Artificial Sequence
  Synthetic
gagtaagtttttagttttgttgtggtttgtagaaataattgaagagtttgggtagttttattggttagttgatgt

SEQ ID NO: 61855 - DNA, 75 bp, Artificial Sequence
  Synthetic
agtttgtaaataagtttattttgattatgtattatatttttaatgtagatgttttttgttgtaggtttgaaatat

SEQ ID NO: 61856 - DNA, 75 bp, Artificial Sequence
  Synthetic
ggaatttatgttaattttattgttgtttttttattaatagttgtttaatagtaaagatttgggttatatttatta

SEQ ID NO: 61857 - DNA, 75 bp, Artificial Sequence
  Synthetic
ctttgcgtttgcaagctgctttgctgaatatcaatttgaatcatcaatttaagcttgatacatttctagcatttt

SEQ ID NO: 61858 - DNA, 75 bp, Artificial Sequence
  Synthetic
gaatatcaatttgaatcatcaatttaagcttgatacatttctagcattttaaattataaaccgatactgatactt

SEQ ID NO: 61859 - DNA, 75 bp, Artificial Sequence
  Synthetic
gtggtgttttgttgaattgattgtttttgttttttggtgggatttagtgaattagttattttatttattgtattt

SEQ ID NO: 61860 - DNA, 75 bp, Artificial Sequence
  Synthetic
atagtgagtttgggttgatttggtttggttgtgttttttgggttggtttttggtttgttgttgttggttgttttt

SEQ ID NO: 61861 - DNA, 75 bp, Artificial Sequence
  Synthetic
tgtgggttttgggttattggggatgttgtgggtgttggtgtggttttggtttgtgggttttgggtggagttgttt

SEQ ID NO: 61862 - DNA, 75 bp, Artificial Sequence
  Synthetic
gagttttggattggatttattttggagtggtaaattgttttgttgtttgttgatgggggggagtttttaatggat

SEQ ID NO: 61863 - DNA, 75 bp, Artificial Sequence
  Synthetic
cctacacattcatattcaggaatctttgaattaaccctcacacttgcttaggaaagagcctatcctctacaagaa

SEQ ID NO: 61864 - DNA, 75 bp, Artificial Sequence
  Synthetic
gttgtgttgtttggttgtttatttggtatattgttattaattttgtttgttatggttggatttggggtaatggtg

SEQ ID NO: 61865 - DNA, 75 bp, Artificial Sequence
  Synthetic
tcccgaggcggcaattcagttaatttcatatcaagataacatccatttccaagaccacagataactatattatta

SEQ ID NO: 61866 - DNA, 75 bp, Artificial Sequence
  Synthetic
aagaccacagataactatattattaatctttaccacaaatatggagaggggtcgtgagcgcgggagatcaaggaa

SEQ ID NO: 61867 - DNA, 75 bp, Artificial Sequence
  Synthetic
gttgttattgggtttgtggtgaaatttgtgattgtttttttgttggttagattttgggttgatattttttttgtt

SEQ ID NO: 61868 - DNA, 75 bp, Artificial Sequence
  Synthetic
ttcacgtgccgaccagcaaaattcaacaggtcctcaatttaggacaagatccatttcccgggataagacaacaac

SEQ ID NO: 61869 - DNA, 75 bp, Artificial Sequence
  Synthetic
tgttttgtagtgagtattgaaattattggaggggaatttgttggaattagtttggagttgttggtgggtgggtgg

SEQ ID NO: 61870 - DNA, 75 bp, Artificial Sequence
  Synthetic
agactaccgtagtagtcgaagtacttcgcaagttagagtccctacggttttccataagaaaggtactgggaccct

SEQ ID NO: 61871 - DNA, 75 bp, Artificial Sequence
  Synthetic
tagttaatttttttttggatagtttttgttgggttttgatttgaggagttgttggtgtgggttgatggaatttgg

SEQ ID NO: 61872 - DNA, 75 bp, Artificial Sequence
  Synthetic
aaatgtaagttttttttatgaagttgttgggaaaagtttttttagttttttagaaggtttatttattaatatttg

SEQ ID NO: 61873 - DNA, 75 bp, Artificial Sequence
  Synthetic
gtttaattttaggatttaatgtttaagttaatttttttgtattgttgttaaggtgattatttttttgaagtgttt

SEQ ID NO: 61874 - DNA, 75 bp, Artificial Sequence
  Synthetic
tagcacggaagacctgtggatcaactgattcatcgcttaatatagctgctcctaaagacctaagactagcaaatc

SEQ ID NO: 61875 - DNA, 75 bp, Artificial Sequence
  Synthetic
tattgagttgaataaggaattgtggagtgtgtggatgatttagttgtatatatgtgtggttgtttattttaaaaa

SEQ ID NO: 61876 - DNA, 75 bp, Artificial Sequence
  Synthetic
gggtgttgtttttattgtttttaaaatttgatattttgtagttgagtgttagggttatgtagtagtttgtggaat

SEQ ID NO: 61877 - DNA, 75 bp, Artificial Sequence
  Synthetic
gggccaatcagaatattaatgaagtagatgatgcaaaactccgtgctctcttgacgttgagtgctgtcttagtgc

SEQ ID NO: 61878 - DNA, 75 bp, Artificial Sequence
  Synthetic
agatgatgcaaaactccgtgctctcttgacgttgagtgctgtcttagtgcggaaattctctaagtcacagcttag

SEQ ID NO: 61879 - DNA, 75 bp, Artificial Sequence
  Synthetic
tatttgttgtgtttattggtttatgagttggtgtagttttttaaaaatgttttttgggttttgatagaattaaaa

SEQ ID NO: 61880 - DNA, 75 bp, Artificial Sequence
  Synthetic
aagttatgatatttttagtaaaagttgttttttggtagatgatagttgaggttaatttattatataagaaaaaag

SEQ ID NO: 61881 - DNA, 75 bp, Artificial Sequence
  Synthetic
acgtttacatagtgacaaaggaggtgcttttgaggcagcactatggcaacagtgggatagacaatcattaactat

SEQ ID NO: 61882 - DNA, 75 bp, Artificial Sequence
  Synthetic
ttttatttttatggaaagttaagttattaggataaggatttgttttttgaattttgtggatatagtgatatttag

SEQ ID NO: 61883 - DNA, 75 bp, Artificial Sequence
  Synthetic
ggaatttttgtatattgttgggagggagagggaggtatttatttttgtttgattttttgatttttagattgtagt

SEQ ID NO: 61884 - DNA, 75 bp, Artificial Sequence
  Synthetic
cttacttgcccccccaagcgttaatgaagggctccctcctgcaccaggggaatatacttggtcagaagatagtac

SEQ ID NO: 61885 - DNA, 75 bp, Artificial Sequence
  Synthetic
aattttttgtttattttttggttttatagttgattattttgggaggtatatttgaatgaaatttttagtgttttg

SEQ ID NO: 61886 - DNA, 75 bp, Artificial Sequence
  Synthetic
aacttagcctgtagggaggacaagtaaaacaagatgcccttatcctctatagatggtatttttagagagggggac

SEQ ID NO: 61887 - DNA, 75 bp, Artificial Sequence
  Synthetic
ttgttgatgggatattggttgtaattttatttttttttagatttagttttatagatttgagttgattggttgatg

SEQ ID NO: 61888 - DNA, 75 bp, Artificial Sequence
  Synthetic
aggataggaataaagataatgactaaagccaatataaagatacgaacacaagtagaaattaaaatagaaatcaaa

SEQ ID NO: 61889 - DNA, 75 bp, Artificial Sequence
  Synthetic
atagtttgttttgataaattaattgattaatttttgttgttttgagagtgttatttgttattatattaagtggta

SEQ ID NO: 61890 - DNA, 75 bp, Artificial Sequence
  Synthetic
acaatctccccttattcaatatgaaatataatagtgagtatttgtttcatgatgtcaatcatttattgttaaaaa

SEQ ID NO: 61891 - DNA, 75 bp, Artificial Sequence
  Synthetic
tggagattgtttgttggaagaggatgattatttatattaagaatgaagttttatgaaaatgtttttgaggtaatt

SEQ ID NO: 61892 - DNA, 75 bp, Artificial Sequence
  Synthetic
taaacaaagtcagtaagagtgttaggatcgttatattgcaaggatcctccctagaagcgttgaatcatctcaagt

SEQ ID NO: 61893 - DNA, 75 bp, Artificial Sequence
  Synthetic
gatcgttatattgcaaggatcctccctagaagcgttgaatcatctcaagtagcctagaacaagaacagcagagca

SEQ ID NO: 61894 - DNA, 75 bp, Artificial Sequence
  Synthetic
ggagaagttgatattttgattttatgttgtataggtaatttggggaggtaagaaatagtagtttataatttttga

SEQ ID NO: 61895 - DNA, 75 bp, Artificial Sequence
  Synthetic
tttgaatgtgtttttgtatgattttggaatagataatgttagatttttaaaagagatgaagttttggtttgttgt

SEQ ID NO: 61896 - DNA, 75 bp, Artificial Sequence
  Synthetic
ttaaattgaaatagataataaggatattgcttgtttttaagatagttttaggaagtttaaaattaagaaaaagaa

SEQ ID NO: 61897 - DNA, 75 bp, Artificial Sequence
  Synthetic
tgttttaatttttattgtatattttttttttaatttggagattaaaattattagtgattgttaatgagttattga

SEQ ID NO: 61898 - DNA, 75 bp, Artificial Sequence
  Synthetic
cccatggacacactctagcattgaggatggggttcccttgatgatagtatagtcttaggtatagggtagtcctac

SEQ ID NO: 61899 - DNA, 75 bp, Artificial Sequence
  Synthetic
agtcttaggtatagggtagtcctacacgtactatattatacagtctaaacttgtaaaattaaactacaagaacat

SEQ ID NO: 61900 - DNA, 75 bp, Artificial Sequence
  Synthetic
aattttagttattgttatatttttgattagaatagattatagagtatttagaatattgtttggtttagttttgat

SEQ ID NO: 61901 - DNA, 75 bp, Artificial Sequence
  Synthetic
tgggttgaattttttttttggttattgtagatagtagaagttttgttgggtttttaaggaaattttgtattgata

SEQ ID NO: 61902 - DNA, 75 bp, Artificial Sequence
  Synthetic
gatatatgattttgttcctgcgagataaggttatcaaatagggtgtgtatctcttttacatatttgggctcccac

SEQ ID NO: 61903 - DNA, 75 bp, Artificial Sequence
  Synthetic
agttaataaatgtataattaattataaaagaaatgattattatttaagattggaaaattagattaaaaaattttt

SEQ ID NO: 61904 - DNA, 75 bp, Artificial Sequence
  Synthetic
taggctagggtttatagttaaggaagactcatcacattttttattgaactagtctactcgcagaatcctaccggg

SEQ ID NO: 61905 - DNA, 75 bp, Artificial Sequence
  Synthetic
taatattagttatttaggtgtaagttgtgagtttgttgtttttgtttgatttttttataattttatataattaga

SEQ ID NO: 61906 - DNA, 75 bp, Artificial Sequence
  Synthetic
aatagaaattagaacatttgtgatactttgactataggaaataattttcaacactacctgagatcaggttattct

SEQ ID NO: 61907 - DNA, 75 bp, Artificial Sequence
  Synthetic
tttttagtttattgattttgttggaattattagtagaataatagtttgaatggaatttaaattattggtaattat

SEQ ID NO: 61908 - DNA, 75 bp, Artificial Sequence
  Synthetic
tccaacttattctgcaagtaattgtttagcatcataacaacaacgttataatttaagaatcaagtcttgtaacag

SEQ ID NO: 61909 - DNA, 75 bp, Artificial Sequence
  Synthetic
tttgtttgtttatgtgatatggatggttggttggagagtggtatgaattataattttgggtgataattatagtta

SEQ ID NO: 61910 - DNA, 75 bp, Artificial Sequence
  Synthetic
atttaagaatcaagtcttgtaacagaaataaagataacagaaagaacctttattatacgggtccattaattttat

SEQ ID NO: 61911 - DNA, 75 bp, Artificial Sequence
  Synthetic
agttttttggtgatataggattaagtttaatatattttggaagaagaattggaataattggttggttatttttgg

SEQ ID NO: 61912 - DNA, 75 bp, Artificial Sequence
  Synthetic
gttgtggttttttgttggttagtttttgaattagtaattttggaattttaattttaattatgtttttggttggat

SEQ ID NO: 61913 - DNA, 75 bp, Artificial Sequence
  Synthetic
taattgggataattttgaggtttggtattgtatttatgattgtttgaattttgttaggtgatgttaagtttgaag

SEQ ID NO: 61914 - DNA, 75 bp, Artificial Sequence
  Synthetic
ccttgagggtaattcttgccgccgggattcttgaccaattaatggatcattccctcattgagccgctatcagggg

SEQ ID NO: 61915 - DNA, 75 bp, Artificial Sequence
  Synthetic
tatgtttttttttttttgttttttttggtaggagaattggatgaagtttgggatggagtgagagtttaggatgaa

SEQ ID NO: 61916 - DNA, 75 bp, Artificial Sequence
  Synthetic
gagtattgattgtttttgttggagttttgtttgtttaggttgtagttggtaatggttgagtgatgagttttagag

SEQ ID NO: 61917 - DNA, 75 bp, Artificial Sequence
  Synthetic
ttgttagattaaatgtgaaatattggggaagttggattggtggaagaataaatttttgaaggaatgtttgattgt

SEQ ID NO: 61918 - DNA, 75 bp, Artificial Sequence
  Synthetic
ttaattttaggagttgtagtggatgattgggtatttttgggtttagtttgttgatatgtattagtgggttagata

SEQ ID NO: 61919 - DNA, 75 bp, Artificial Sequence
  Synthetic
aagcagtgttgagataggaacaccaagctatgcaatcatcattaccaggactaatatgggttatcttgtcgaggt

SEQ ID NO: 61920 - DNA, 75 bp, Artificial Sequence
  Synthetic
tttttttgaagtgtgttattgtgtaggaagttaatataattgtggttgttgttgaattaaagttgtatatttttt

SEQ ID NO: 61921 - DNA, 75 bp, Artificial Sequence
  Synthetic
tcaggaaccagataaatctgcgatggatatacgacaccctggtcctgtcaaattctccttactacatgaatcgac

SEQ ID NO: 61922 - DNA, 75 bp, Artificial Sequence
  Synthetic
gattagttatatttagtggaagttaaataggtatttgttttattaggatttttgtttttgaaattatatttattg

SEQ ID NO: 61923 - DNA, 75 bp, Artificial Sequence
  Synthetic
acttaaacctgttgccactcctaaaccatcaagcattacttcattgatcatggagttcaacagttctttggcaat

SEQ ID NO: 61924 - DNA, 75 bp, Artificial Sequence
  Synthetic
tagtttttaatataaaggtagaagttattttgtttggagtatggtttgagtgattaatgttattattagttattg

SEQ ID NO: 61925 - DNA, 75 bp, Artificial Sequence
  Synthetic
ttaattgccgtaataaaaattgtacgatagggctaacattgattccataatccatcgtaggacagaatcattttc

SEQ ID NO: 61926 - DNA, 75 bp, Artificial Sequence
  Synthetic
gttttatggagtttgatggaatatttgtttttggtattgttagtatatttgatttggttttattgattatgatat

SEQ ID NO: 61927 - DNA, 75 bp, Artificial Sequence
  Synthetic
ctgtatgatcttagtttaatctctctttatacaatgattaataaggagcctgtttaaaatgttacaaaagtatac

SEQ ID NO: 61928 - DNA, 75 bp, Artificial Sequence
  Synthetic
ttggttgggttgggagtatgtttatagggtatgtaatattattatatgttggaggagttgttggtaatattttgt

SEQ ID NO: 61929 - DNA, 75 bp, Artificial Sequence
  Synthetic
tgtttgaacccctagtatccctgtaaatatcctcattcaattttttgcttttacatgtgtagtcacctgtatagc

SEQ ID NO: 61930 - DNA, 75 bp, Artificial Sequence
  Synthetic
gttttattttttgatgataaaatattttattttagaagatgaagataagaaatgttaagtttggaaaatattgat

SEQ ID NO: 61931 - DNA, 75 bp, Artificial Sequence
  Synthetic
atgaccctagtcatgcctttaattaatacttaatctaacagttaatataatgtataactttccatgttcaaagag

SEQ ID NO: 61932 - DNA, 75 bp, Artificial Sequence
  Synthetic
tggttttttttaatttttattatttgttatatttatattatatattagtatttttattaattttttgttaaatta

SEQ ID NO: 61933 - DNA, 75 bp, Artificial Sequence
  Synthetic
tagtcaaaacaatgtgagatccagtttcactcacagcatctattcactatttacagtatgatgagcccaaattaa

SEQ ID NO: 61934 - DNA, 75 bp, Artificial Sequence
  Synthetic
taatattttgtgtatgtttgtaagtttggaatgattttttaatttaaagagttataaggtagaataagaagtaag

SEQ ID NO: 61935 - DNA, 75 bp, Artificial Sequence
  Synthetic
cacggtagaggtctagatttattaatagaacgaggaagattaagaaaaagtccataatgctggggaggcaatcct

SEQ ID NO: 61936 - DNA, 75 bp, Artificial Sequence
  Synthetic
atgttgttatatttaaataagattattaattatatattattattaatagtgttaatagtttaatagtttggttga

SEQ ID NO: 61937 - DNA, 75 bp, Artificial Sequence
  Synthetic
ggttttatttaaggttgtggtttgttttgttaaataaattttgatttttagattttaagtttaagtgttttatta

SEQ ID NO: 61938 - DNA, 75 bp, Artificial Sequence
  Synthetic
gtcttccccaattgtcttagaccaatgtgacctagtgacaagagcatgtggactttactctgagtattcgctgaa

SEQ ID NO: 61939 - DNA, 75 bp, Artificial Sequence
  Synthetic
ttttgtattttaaataaataaatttaattatgattaattttgggtgatggtggtgttggttggagatttttttgg

SEQ ID NO: 61940 - DNA, 75 bp, Artificial Sequence
  Synthetic
tatgtttgtgggatgttattatgggatttaatatggattattgggggtggtatattttgaaagattgggattttt

SEQ ID NO: 61941 - DNA, 75 bp, Artificial Sequence
  Synthetic
ttggttatttgtatgagtgtatattggggagagttattatttgttagatttgtttggaatttagtatggattgtg

SEQ ID NO: 61942 - DNA, 75 bp, Artificial Sequence
  Synthetic
aaatgtaccattggaacctccctgcttgagtttcttggatgaaatagtcaattataccgtgcaggatgcagcctt

SEQ ID NO: 61943 - DNA, 75 bp, Artificial Sequence
  Synthetic
tttaaaaggttgttatttttttttattttataaattatttgaataagttggtgaaaggtagttttaaaattaggt

SEQ ID NO: 61944 - DNA, 75 bp, Artificial Sequence
  Synthetic
atcaattaaaacagaacattcgtagggtcattcacaaaaacagatatctatctgctctattcttctggcatgatc

SEQ ID NO: 61945 - DNA, 75 bp, Artificial Sequence
  Synthetic
agatgattatatatgattttttttaggtttttagtagatatataaggttttttaaaattttttttggttagggtt

SEQ ID NO: 61946 - DNA, 75 bp, Artificial Sequence
  Synthetic
ttgccatcctcacccgtcgagggagaatgaaccgaggaaatgtgcgctccacttggtttgtaacgaatgaggttg

SEQ ID NO: 61947 - DNA, 75 bp, Artificial Sequence
  Synthetic
gatgtattgttaaggtttttgtaagttttttgtatagtatttggtatatagttgtttggattattgatttttttt

SEQ ID NO: 61948 - DNA, 75 bp, Artificial Sequence
  Synthetic
acttggtttgtaacgaatgaggttgttgacattctaggatatggtgattatatcttctggaagatccctattgct

SEQ ID NO: 61949 - DNA, 75 bp, Artificial Sequence
  Synthetic
ttaagtgtattttttttatataatgttggttttggtggtggttgtttgtgttttttttaatatgtatttattgta

SEQ ID NO: 61950 - DNA, 75 bp, Artificial Sequence
  Synthetic
ccaacctaatatcttcaaggaggctattcaaggacacacacatattatttcagtctctacagccgaggtccttat

SEQ ID NO: 61951 - DNA, 75 bp, Artificial Sequence
  Synthetic
gttgtagttgaagtagtttgtttagttgttataattagaagattatattttgtaattattttggtataattgtga

SEQ ID NO: 61952 - DNA, 75 bp, Artificial Sequence
  Synthetic
tttaatgatgaaattattttatttatgttttggattggttttaagttatttttaagtgtgttgaggtggttttta

SEQ ID NO: 61953 - DNA, 75 bp, Artificial Sequence
  Synthetic
gtctgctgattatccactagtagataatattcaatctctgtataacgcaggagactacctgttgtccatattggg

SEQ ID NO: 61954 - DNA, 75 bp, Artificial Sequence
  Synthetic
aatattcaatctctgtataacgcaggagactacctgttgtccatattgggatcagaggggtacaaaataatcaaa

SEQ ID NO: 61955 - DNA, 75 bp, Artificial Sequence
  Synthetic
agggttttgattgtagtattttgatgattggtggtatttattagtatagttaatgtatttttaatttttttaagg

SEQ ID NO: 61956 - DNA, 75 bp, Artificial Sequence
  Synthetic
agaggtatatagttgatttttgtttgattgttatttgtataagtttttgttgagttttttgatgatggtttgagt

SEQ ID NO: 61957 - DNA, 75 bp, Artificial Sequence
  Synthetic
tggatttttatttgatttggtttgttattaatattaatgaatatattagttattggaattttatttgttataagt

SEQ ID NO: 61958 - DNA, 75 bp, Artificial Sequence
  Synthetic
cagatgcatcttgcagttattcagacattgcgtgaactcctccttaatagagggttgaaaaaatcacaattgtct

SEQ ID NO: 61959 - DNA, 75 bp, Artificial Sequence
  Synthetic
tgtttagaaatttatttagttgtttttgggtttgaatatatttttaatttattattgtatatgtttttaagggtg

SEQ ID NO: 61960 - DNA, 75 bp, Artificial Sequence
  Synthetic
aaaatccgcgagtttcaccaactgttgctcagactccgatctacaccacaacaattatgtgaattattttcaatc

SEQ ID NO: 61961 - DNA, 75 bp, Artificial Sequence
  Synthetic
tgctcagactccgatctacaccacaacaattatgtgaattattttcaatccaaaaacactggggccacccagttc

SEQ ID NO: 61962 - DNA, 75 bp, Artificial Sequence
  Synthetic
gtaatgtttatgtattttttgataatggttttaaggtaggatatttttaaatttaaggtggagtaaatatttgtt

SEQ ID NO: 61963 - DNA, 75 bp, Artificial Sequence
  Synthetic
tatagataatataattatttattggtgatgaaggttttaatttttattaaatgttttttttaatttgtttagtta

SEQ ID NO: 61964 - DNA, 75 bp, Artificial Sequence
  Synthetic
ttgaaacgtattgtgtattcaagtatagtgttgcaaaacatttctttgatagtcaaggcacttggtacagtgtga

SEQ ID NO: 61965 - DNA, 75 bp, Artificial Sequence
  Synthetic
gggttatttattagattatatttttaatgggtgaagtattttaagtagaatgggttaatttataattagaaatat

SEQ ID NO: 61966 - DNA, 75 bp, Artificial Sequence
  Synthetic
aaagtattatttatttttttatgattatgtttaaattaagaatattgagttatattttggatagattggtgtaag

SEQ ID NO: 61967 - DNA, 75 bp, Artificial Sequence
  Synthetic
tgtatatgtatattatttaaatttttaatggttttagattaagaattatttatagaaaagtagtattaataagtt

SEQ ID NO: 61968 - DNA, 75 bp, Artificial Sequence
  Synthetic
ttttcattaaagaccgcgcaacagcagttgaacaaacctgttgggatgcagtttttgagcctaacgttttgggct

SEQ ID NO: 61969 - DNA, 75 bp, Artificial Sequence
  Synthetic
agttgaacaaacctgttgggatgcagtttttgagcctaacgttttgggctacagtccaccttatcgattcaatac

SEQ ID NO: 61970 - DNA, 75 bp, Artificial Sequence
  Synthetic
ataatggattagtttttgtagatgaattggttaagttttaagtgtatttagttttatgaagtggattgtgttttg

SEQ ID NO: 61971 - DNA, 75 bp, Artificial Sequence
  Synthetic
tgttgtggttattgatggtgttgtaagattgtaagaaatttgtttttgggatttatgataggttagaagaattgt

SEQ ID NO: 61972 - DNA, 75 bp, Artificial Sequence
  Synthetic
tgattatttatgtaaatgtagtgattttttttgtttagttgtttttttttggtgagttatggaggataggttttt

SEQ ID NO: 61973 - DNA, 75 bp, Artificial Sequence
  Synthetic
ttaagtgaatttgggtaggtgtatttttttttattattagtgttaaatattattggtttattttttattatgtga

SEQ ID NO: 61974 - DNA, 75 bp, Artificial Sequence
  Synthetic
taataattgatggttttaaatggattttgagtttttagtagatggtgatatgttttttttaatttttgtatagat

SEQ ID NO: 61975 - DNA, 75 bp, Artificial Sequence
  Synthetic
tacaagtgatgatttcggagagcatgccacagttcgtggaagtagttttgtcacagacctggaaaaatacaatct

SEQ ID NO: 61976 - DNA, 75 bp, Artificial Sequence
  Synthetic
tttgattgattgatattagggtttttatttaattgtgatgttttagttggtttgtttgaggatttgtggggaggt

SEQ ID NO: 61977 - DNA, 75 bp, Artificial Sequence
  Synthetic
ttgtgggtttttgtattgtggtatataggagtaggaggggtaatagttgtataattgggattttgttggttattt

SEQ ID NO: 61978 - DNA, 75 bp, Artificial Sequence
  Synthetic
gatgtattgttattattagattttagtggaggtaagtttgagggattattattattttgatttataagggtgttt

SEQ ID NO: 61979 - DNA, 75 bp, Artificial Sequence
  Synthetic
ggaccaagtgcttatagaggccaccttggcggtattgaggggcttcaacaaaagttatggactagtatctcatgt

SEQ ID NO: 61980 - DNA, 75 bp, Artificial Sequence
  Synthetic
tttttgtgtattggtgagagtttttgattggtggttgtatgttttgggttttggtgttagttgtattgatttttt

SEQ ID NO: 61981 - DNA, 75 bp, Artificial Sequence
  Synthetic
gctcaaatctcattggtagagatcaagaccgggttcaaattgcgatcagcagtcatgggggataatcaatgtatt

SEQ ID NO: 61982 - DNA, 75 bp, Artificial Sequence
  Synthetic
tgttttttagaatttgttgattgttgattgttgtttgaggtttgattgttgtttttgttgttgtttgggggtgga

SEQ ID NO: 61983 - DNA, 75 bp, Artificial Sequence
  Synthetic
agtcatgggggataatcaatgtattacagtattatcagtctttccactagaatctagtccgaatgagcaggagag

SEQ ID NO: 61984 - DNA, 75 bp, Artificial Sequence
  Synthetic
tgaattaatttttttttttttatttttttttgggattgtggtgagttgttttgtggtttaaaagttttattgtta

SEQ ID NO: 61985 - DNA, 75 bp, Artificial Sequence
  Synthetic
gcctgatgagactttcgtacactcaggctttatctattttggcaaaaagcaatacttgaacggaattcaattacc

SEQ ID NO: 61986 - DNA, 75 bp, Artificial Sequence
  Synthetic
tttttatgattgttaagattgaataggattaagttatttgttgttttaattttattattatgatagttattgtaa

SEQ ID NO: 61987 - DNA, 75 bp, Artificial Sequence
  Synthetic
tttttaaaattattatttttggggttaattgtattattaggaatgatggtgtttttggagtttttaggattattt

SEQ ID NO: 61988 - DNA, 75 bp, Artificial Sequence
  Synthetic
tttagatgattttggtttgggttgttgtttataggtttagggaatggtattttattgttgttgttttgtttagat

SEQ ID NO: 61989 - DNA, 75 bp, Artificial Sequence
  Synthetic
ttgaggttaggttttgaggttagtgttatagtttttgttaatttagttagttgtttttttttaagggttattatt

SEQ ID NO: 61990 - DNA, 75 bp, Artificial Sequence
  Synthetic
ggcaatcaataaacctcttgatttcgggaccattgcactatccttagcagttcctcaggtattgggtggattatc

SEQ ID NO: 61991 - DNA, 75 bp, Artificial Sequence
  Synthetic
gtattggtttgttggaaattaattttgttttttttttgatggaagtttattagtattttttttttttgattgttt

SEQ ID NO: 61992 - DNA, 75 bp, Artificial Sequence
  Synthetic
cttcctaaatccagaaaagtgcctttatcgcaacttgggtgatcctgtaacttcaggcctatttcagttgaagca

SEQ ID NO: 61993 - DNA, 75 bp, Artificial Sequence
  Synthetic
aggtttaggttgttgagttttttggatttagtatattgttggagttgttttttagttttagtggtagttttttta

SEQ ID NO: 61994 - DNA, 75 bp, Artificial Sequence
  Synthetic
ttatctgtcaatggtgggtatgagtgatatctttcatgcacttattgcaaaaagcccagggaattgtagcgcaat

SEQ ID NO: 61995 - DNA, 75 bp, Artificial Sequence
  Synthetic
agttgttgatattgtttattaatattaatttttgtaagggtgttattatgtgttgtggtaattttaagagtaatt

SEQ ID NO: 61996 - DNA, 75 bp, Artificial Sequence
  Synthetic
aaagcccagggaattgtagcgcaattgactttgttctaaacccaggcgggttaaatgtccctggatcacaggatt

SEQ ID NO: 61997 - DNA, 75 bp, Artificial Sequence
  Synthetic
gttgataattgtgggtagagattatgttttaggttgttaatttttgagagattgagaaggtgagtaaaaggggta

SEQ ID NO: 61998 - DNA, 75 bp, Artificial Sequence
  Synthetic
tattttttatgtttagtaagtgagtttagggtggttttaaatgtattaattttattatgtattttggttgtttgg

SEQ ID NO: 61999 - DNA, 75 bp, Artificial Sequence
  Synthetic
aggaacaagttaatcaacacgttatttcacgcttctgcagatcttgaagacgaattagtatgtaaatggttactt

SEQ ID NO: 62000 - DNA, 75 bp, Artificial Sequence
  Synthetic
gttaaagggtgaagttttattttttggttggttttttgtagaatatgattaagaatggttttgataattaggagt

SEQ ID NO: 62001 - DNA, 75 bp, Artificial Sequence
  Synthetic
tttgaaaagtgagtttgagtaattgaattagtaatgatagtattattggtattgtggttagttattatatgtata

SEQ ID NO: 62002 - DNA, 75 bp, Artificial Sequence
  Synthetic
ttttggtggattagtaaatatttaattaagaaattagtttttattaatttgaagattattattatgtgtttaatt

SEQ ID NO: 62003 - DNA, 75 bp, Artificial Sequence
  Synthetic
gagaggctcagaaaaataacacttcaaagatggaatctatggtttagttacctagaccattgtgacccagcttta

SEQ ID NO: 62004 - DNA, 75 bp, Artificial Sequence
  Synthetic
gattgttatgtagtgggatattgaattaaattttgttttgtatgaatttgaatttgttgttggattttttttaag

SEQ ID NO: 62005 - DNA, 75 bp, Artificial Sequence
  Synthetic
taagtttttttttttataattagtttgggaagaaataaatttgtaaatgagagaaattgttttgtatttgttttt

SEQ ID NO: 62006 - DNA, 75 bp, Artificial Sequence
  Synthetic
ccacaaacaattctagtccatatgtatcagttgcattaaaaaggaacgtggttagtgcttggcctgatgcatcta

SEQ ID NO: 62007 - DNA, 75 bp, Artificial Sequence
  Synthetic
gtagttttttttttaggtagtgtggttaatgtatgtttgatgttttttttatttgttgtagtaggaagtaatttt

SEQ ID NO: 62008 - DNA, 75 bp, Artificial Sequence
  Synthetic
ttgagttgattgatattgttttttttttggagtttaaatttgaatttatgattttttaaatattgtatagtattg

SEQ ID NO: 62009 - DNA, 75 bp, Artificial Sequence
  Synthetic
ttaagccgaggtgcccatcagctgcattaagagaagctattgaattgacctctaggttgacctgggtcactcaag

SEQ ID NO: 62010 - DNA, 75 bp, Artificial Sequence
  Synthetic
ttttttaagaataatttatagttattttggtaagtatgatgtaggtaaagtattagaaggaagttgttggtattt

SEQ ID NO: 62011 - DNA, 75 bp, Artificial Sequence
  Synthetic
gtagtgcaaacagcgatcagttaattcgcccttttcttgaggcaagagtaaacttgagtgtacaagagattcttc

SEQ ID NO: 62012 - DNA, 75 bp, Artificial Sequence
  Synthetic
ttttggaaattaattttggttttaaaggtttgtattattaattgatatatagtttttaagttattaataagatat

SEQ ID NO: 62013 - DNA, 75 bp, Artificial Sequence
  Synthetic
atagaaattattttttgtttgataattttttgttgaatagtaaggttagttgttaaaattttatgataatttaaa

SEQ ID NO: 62014 - DNA, 75 bp, Artificial Sequence
  Synthetic
ctaaccgcatgagtaacacagcaacgcgcttgatggtatctaccaacacactaggagagttttccggagggggtc

SEQ ID NO: 62015 - DNA, 75 bp, Artificial Sequence
  Synthetic
ttagtattattttgattttgtgatatttagatttttttggttttatgatttatattgatttttttttgtttgatt

SEQ ID NO: 62016 - DNA, 75 bp, Artificial Sequence
  Synthetic
aggctgcacgtgatagcaacattatatttcaaaatgtgattaactttgcagtggccttgtatgacattaggtttc

SEQ ID NO: 62017 - DNA, 75 bp, Artificial Sequence
  Synthetic
tagttaagatgtatgatattattggaataaattgtttttttgatttttttaattaatgatgatatgtaatttttt

SEQ ID NO: 62018 - DNA, 75 bp, Artificial Sequence
  Synthetic
ggaacacttgtacatcttctattcaatatcacagggcccatattcacctgacgaattgttgtacgagggaagtac

SEQ ID NO: 62019 - DNA, 75 bp, Artificial Sequence
  Synthetic
ggtattttaggattataaaatttatatataattaaaataattttttaaatttgatggaaaggggaattttttgta

SEQ ID NO: 62020 - DNA, 75 bp, Artificial Sequence
  Synthetic
tttttagatattgggttgtttggatgaattttttgtaaaatggatttagagttttaggaaaaattagatgaagaa

SEQ ID NO: 62021 - DNA, 75 bp, Artificial Sequence
  Synthetic
gagttttaagattattagatatattatgttgatggtaattggtaatagataaaattgatttaattgttataatta

SEQ ID NO: 62022 - DNA, 75 bp, Artificial Sequence
  Synthetic
atattattgaggatgacttaatacggttgccacatttatccggctgggaattagcaaaaacagtcttgcaatcaa

SEQ ID NO: 62023 - DNA, 75 bp, Artificial Sequence
  Synthetic
gggaaagttatagaatagtaaagaggagaattttaattttaattttagtgtatattttaaattgaggaaaattgt

SEQ ID NO: 62024 - DNA, 75 bp, Artificial Sequence
  Synthetic
gaaaattgttaattttttttatagttatttgtatataaaaagttttaaaaaattttttttttttttgtgtgtttg

SEQ ID NO: 62025 - DNA, 75 bp, Artificial Sequence
  Synthetic
tggatatataaaaagaaagaagaatttttaggattttttgtgtgtgaataattatgaggaagattaataattttt

SEQ ID NO: 62026 - DNA, 75 bp, Artificial Sequence
  Synthetic
aacagatcccattagcagcggtgaaacaagatccttcacaacccacttcttaacgtatcccaaaatagggcttct

SEQ ID NO: 62027 - DNA, 75 bp, Artificial Sequence
  Synthetic
atacagttttggagccctcataagtttttatttgggtaatactattctatgcacgaaaaagatcggactcacaga

SEQ ID NO: 62028 - DNA, 75 bp, Artificial Sequence
  Synthetic
tttttattgaaatttatattggaatttaaattgaaattgttattgtaattatatttggtttgttttagagttata

SEQ ID NO: 62029 - DNA, 75 bp, Artificial Sequence
  Synthetic
atttctatactatctccagaatcagatccacaacttatcacatagatcccttcgaatcttcaaaccgacatttag

SEQ ID NO: 62030 - DNA, 75 bp, Artificial Sequence
  Synthetic
ttataaagatagagaataatttaggtttttgaagggagtaagggtattagtgtgtttagttgaaaattttttgtt

SEQ ID NO: 62031 - DNA, 75 bp, Artificial Sequence
  Synthetic
aatatttaggttttattatattataagttttattttagattttgtagggtgatttaataattttaatagaaatat

SEQ ID NO: 62032 - DNA, 75 bp, Artificial Sequence
  Synthetic
tattgttaaaggatagtattagtttatagttaaataagtaagattgagaattaattttggttttgaatttgaata

SEQ ID NO: 62033 - DNA, 75 bp, Artificial Sequence
  Synthetic
ttatttctccgaattgcaatttcaactttcttgagctttgttgaggagtgggttatctttaggaaggcaaacatc

SEQ ID NO: 62034 - DNA, 75 bp, Artificial Sequence
  Synthetic
tttaggggattgaagatttaataattttaaagtttggggtaaaatattggaaatagttaaaagataaattgtttg

SEQ ID NO: 62035 - DNA, 75 bp, Artificial Sequence
  Synthetic
ccactatgggttatctatcctctcgaaggccaacgctctgatcctcctggcgaatttttgaaccgagtaaaatct

SEQ ID NO: 62036 - DNA, 75 bp, Artificial Sequence
  Synthetic
gaattataaaattttgagtatggatttttgtttttagaaaatttggatggtgttgagttttattgaatttgatat

SEQ ID NO: 62037 - DNA, 75 bp, Artificial Sequence
  Synthetic
ctaattgttgggactgaagatgataaaaataaaggctctatactttcaagatctggagagaaatgctcttcaaat

SEQ ID NO: 62038 - DNA, 75 bp, Artificial Sequence
  Synthetic
ggattattataagattttgatagtaggtttgtttgtttaataggggattgtttggtaaagagttattttagtgta

SEQ ID NO: 62039 - DNA, 75 bp, Artificial Sequence
  Synthetic
ttaagtaaataattttgaagaaatttgttaatttattatataggtttttgaagtaggtgttgatttttaagagag

SEQ ID NO: 62040 - DNA, 75 bp, Artificial Sequence
  Synthetic
cctaagaagactataggtgcaactaacgcgacaacagctccacatatcattttgccactgggaaattctgatcga

SEQ ID NO: 62041 - DNA, 75 bp, Artificial Sequence
  Synthetic
tgtggatagttttttttttatgttttgtttttattatgtgtattagggagattataaattttttttggaaagtgg

SEQ ID NO: 62042 - DNA, 75 bp, Artificial Sequence
  Synthetic
ccgcctggcctagaccttaataggaacaatgatactttcattcctaccagaattaaacagatagtccaaggagac

SEQ ID NO: 62043 - DNA, 75 bp, Artificial Sequence
  Synthetic
tgtagttaagtatttggaagggtatgggttttgttttgaagttaagaagtgtgatggagtgaagtgttttgagga

SEQ ID NO: 62044 - DNA, 75 bp, Artificial Sequence
  Synthetic
tctagaaacgacagaacgaccaccacgagatttccacccaaaagtaggtccactccaacatcagcaaccgagcct

SEQ ID NO: 62045 - DNA, 75 bp, Artificial Sequence
  Synthetic
attgttgttagtagtatttagtggaaaaaatattaagagaatatttgttgttatgttggaagaggagataattga

SEQ ID NO: 62046 - DNA, 75 bp, Artificial Sequence
  Synthetic
cctacaaaaatgtatgagggttcgacaacccaccaagggaaattaacagatacacatttggatgaggatcacaat

SEQ ID NO: 62047 - DNA, 75 bp, Artificial Sequence
  Synthetic
agttaatgttggttagttttttttttttgtaagtttattttttttgaaattggtagtaggagaaaaggtttgttt

SEQ ID NO: 62048 - DNA, 75 bp, Artificial Sequence
  Synthetic
tgagaaggtttaaaggtaaatttaagtatatgtagagtaaggattgatataatatttaatagtttggtaattagt

SEQ ID NO: 62049 - DNA, 75 bp, Artificial Sequence
  Synthetic
aggatatatgatggtgattttttgtttgatgtgaataaattttttgattaaattttttttaatatattaagggat

SEQ ID NO: 62050 - DNA, 75 bp, Artificial Sequence
  Synthetic
gtatatggttgttgggtatgatgttaatgatgttgtgattttaaatttagtggtttaagtttgttttttaggttt

SEQ ID NO: 62051 - DNA, 75 bp, Artificial Sequence
  Synthetic
attgattgttaaaatagtatttgattatattttataaaagatagaatgaggagtttgtttttatttttttgtaag

SEQ ID NO: 62052 - DNA, 75 bp, Artificial Sequence
  Synthetic
agtgatatcaggttacaccactccaaggatgctactcccaattatgcctaaaacacatcgtggtgagctagaggt

SEQ ID NO: 62053 - DNA, 75 bp, Artificial Sequence
  Synthetic
gattgttaaggtaaaaaatgaggtgaatttttttaaggttgtatttagttttttggttaagtatggagagtatgt

SEQ ID NO: 62054 - DNA, 75 bp, Artificial Sequence
  Synthetic
tttttttgtttgatttttgaatttttttggagtaaataattttgagtatggtttttttttttaattattggtaat

SEQ ID NO: 62055 - DNA, 75 bp, Artificial Sequence
  Synthetic
ggttttcaaatcaaaaaaataggattccaaatgatgctgatattattaccatggatgctgaaactacagaaaact

SEQ ID NO: 62056 - DNA, 75 bp, Artificial Sequence
  Synthetic
tgtatttggagttgttatagtatatgggagtatttttgtaggagtaaatgttggagaatagtattaataatttag

SEQ ID NO: 62057 - DNA, 75 bp, Artificial Sequence
  Synthetic
agaggttgttattgaggttgagaagtaattttaataatatgtagagttttgtgaatttgattattttggatttga

SEQ ID NO: 62058 - DNA, 75 bp, Artificial Sequence
  Synthetic
tttggatgggatgtgctggattaacaattatcttgctcctatgtttggatcaggatatttaatcaaacctataac

SEQ ID NO: 62059 - DNA, 75 bp, Artificial Sequence
  Synthetic
tgattaggaaaagaaaatttttatgaatttttattagaaaaagaatgaaattagtttttagtaaataaatgttat

SEQ ID NO: 62060 - DNA, 75 bp, Artificial Sequence
  Synthetic
ggtaattttaagaaaagagtgtttggttaagttgatagaagttattattgttgtgttattgtttaaaataagtgg

SEQ ID NO: 62061 - DNA, 75 bp, Artificial Sequence
  Synthetic
aacccaggcaaactgtctccatgtcgtacaatgtgctcttcaacagcaagtacaaagagggtcatattggctaag

SEQ ID NO: 62062 - DNA, 75 bp, Artificial Sequence
  Synthetic
atattatgatgatgatgatgatattttttttttaggatttattaatgatgatgataattttggttattaagatga

SEQ ID NO: 62063 - DNA, 75 bp, Artificial Sequence
  Synthetic
tcatcttaccaaatacaccacaagtagattgcacaatagttatattgcatttggttttccttcattagagaaggt

SEQ ID NO: 62064 - DNA, 75 bp, Artificial Sequence
  Synthetic
ttggttttccttcattagagaaggtcctatatcataggtataaccttgttgattcgagaaatggaccattagttt

SEQ ID NO: 62065 - DNA, 75 bp, Artificial Sequence
  Synthetic
tgatttgattgatttataggatatgattatttttgatgtggtggttgattttgatgatggaagttatggtgaata

SEQ ID NO: 62066 - DNA, 75 bp, Artificial Sequence
  Synthetic
ttagagttatttggaaaatggtatgaatgtattagatgatttggttttatttgatttagatgaggatgatgagga

SEQ ID NO: 62067 - DNA, 75 bp, Artificial Sequence
  Synthetic
tattaagttagtgtttaatagattgattaagggtggataatagaagaatagttaaaagggttagtatatagaggg

SEQ ID NO: 62068 - DNA, 75 bp, Artificial Sequence
  Synthetic
gtgtttgccatcgatttaatcatacacgtaactgtacatgcagtgaaaggttcctggttcaaactttatatctac

SEQ ID NO: 62069 - DNA, 75 bp, Artificial Sequence
  Synthetic
tagatagatataatttaggttaatttaaaatgttttaggtttttatagaataatttattatgttagtgtgttatt

SEQ ID NO: 62070 - DNA, 75 bp, Artificial Sequence
  Synthetic
tatggataatgatagaagaaatgaattttttggtttaattagtttttgtatgttgatattaattaatgaagaggt

SEQ ID NO: 62071 - DNA, 75 bp, Artificial Sequence
  Synthetic
ggtctagttcagtctaattctaactgcaccaaaggctctaaaaatattttaaataaccaggtgtatatcaaagtc

SEQ ID NO: 62072 - DNA, 75 bp, Artificial Sequence
  Synthetic
agatttattggatgatgttgatgatgagatgtttagttttttgtttttggagttagatgatgaagagtaggatag

SEQ ID NO: 62073 - DNA, 75 bp, Artificial Sequence
  Synthetic
aatacaagtgtaaaaacaatatgcaagggaccacatttaggatcagtttattgactcttccaatacacagagttg

SEQ ID NO: 62074 - DNA, 75 bp, Artificial Sequence
  Synthetic
ggatggaatttttaattgtatatttattgttgttttattggtttttgtatatagagattattttgaaaagaaaga

SEQ ID NO: 62075 - DNA, 75 bp, Artificial Sequence
  Synthetic
gaagcaccgattcaaggtttctaagacgccctatcgattatgttgataatgtaaataatagcttttcctgtctat

SEQ ID NO: 62076 - DNA, 75 bp, Artificial Sequence
  Synthetic
atttttgtaagatgagtaataagattaggattatatttaagaggttaggaattaggatagtgataatatttagtt

SEQ ID NO: 62077 - DNA, 75 bp, Artificial Sequence
  Synthetic
tatgacttaaataatcatatctataacgaccatcacagctaagtcgttgccctagttcatatattaaattaaaat

SEQ ID NO: 62078 - DNA, 75 bp, Artificial Sequence
  Synthetic
agaatatttttttgaggagatgtattgttatattttaagattataggggttatttgatgttgttttgtattatta

SEQ ID NO: 62079 - DNA, 75 bp, Artificial Sequence
  Synthetic
ttagaagctaggttgactctaattacataagtattaagaaaaaattactaagactaatactctcatgccaagaac

SEQ ID NO: 62080 - DNA, 75 bp, Artificial Sequence
  Synthetic
tatgatgaaggatgagtttgtagtttttagtattagtgatggtaaagagtatatgtatttagatttttttgaaga

SEQ ID NO: 62081 - DNA, 75 bp, Artificial Sequence
  Synthetic
tagtaatgtgtttcacatgacagattatttctaacactaaattgcaatttcaattttaaagctaagtttaacacc

SEQ ID NO: 62082 - DNA, 75 bp, Artificial Sequence
  Synthetic
ggaatatttattatggtttattgaaaaagaggttatgaatgaagagaatagatttgttatattggatggttaata

SEQ ID NO: 62083 - DNA, 75 bp, Artificial Sequence
  Synthetic
tatacagccaaaatatttcatagggccgatgggaataacataagaggaacatgatcaatgaaccctttattccaa

SEQ ID NO: 62084 - DNA, 75 bp, Artificial Sequence
  Synthetic
attttattggttggtgatgaattataagaataaatttatggtaattttgtaatattattagtgaatgagtatgga

SEQ ID NO: 62085 - DNA, 75 bp, Artificial Sequence
  Synthetic
ctaggcagttgattgataatctacaaattccataagatgttcttacgatattcttttgtttttaatctcaatgtc

SEQ ID NO: 62086 - DNA, 75 bp, Artificial Sequence
  Synthetic
ataatgggatgatttaattgataaatagttaatattaagtagttaaggaatgaaaataggaagaatttttgatgt

SEQ ID NO: 62087 - DNA, 75 bp, Artificial Sequence
  Synthetic
ttcttttgtttttaatctcaatgtcaatgatttaataagtaataataaaaaaatcacattaaagatgcaggaaga

SEQ ID NO: 62088 - DNA, 75 bp, Artificial Sequence
  Synthetic
ttaaggtgtgaattattattataataaaagtgatttttatttttgaatttaaagttagtttattattattagttg

SEQ ID NO: 62089 - DNA, 75 bp, Artificial Sequence
  Synthetic
ttttttaaagtttaatttgagttttaatgtaaataggtgttaagttatagttatagttataattgtaatttaata

SEQ ID NO: 62090 - DNA, 75 bp, Artificial Sequence
  Synthetic
ttttaattagtgatttatttaaattaaattatattatgtttttataatttatttattagtttgtttaatatttat

SEQ ID NO: 62091 - DNA, 75 bp, Artificial Sequence
  Synthetic
atgattgttttataattaagaaaaaattaatgatgaagattaaaatttttattatttttatgttaattgaatttt

SEQ ID NO: 62092 - DNA, 75 bp, Artificial Sequence
  Synthetic
ttagtatttgaagtttattgtttttaatgtaaaagaaaagttggtttaataagatgataattagaataaagggta

SEQ ID NO: 62093 - DNA, 75 bp, Artificial Sequence
  Synthetic
ggggttatattgtggttatgatttaaaatgatagaatgttaggttttgagtttttgggttggatttttgagtagt

SEQ ID NO: 62094 - DNA, 75 bp, Artificial Sequence
  Synthetic
taatgattggaagaatttttgtaagtgatattttttgtgatattgagaataatttaggattatgttatgtatttt

SEQ ID NO: 62095 - DNA, 75 bp, Artificial Sequence
  Synthetic
aaatgtaataaatgaagttaaatttgaagatgtgtaatagttaaatttaaatggatttaatttgtaattatagtt

SEQ ID NO: 62096 - DNA, 75 bp, Artificial Sequence
  Synthetic
ttgaggaggtagtataaatattggttttattggttattgttgtgtaataataaattattgtattagaattattag

SEQ ID NO: 62097 - DNA, 75 bp, Artificial Sequence
  Synthetic
ggtctgtatttttcaatttcaagacgggaagacccttgggctaaaaatatgatacagaagcaaggtaagctcatt

SEQ ID NO: 62098 - DNA, 75 bp, Artificial Sequence
  Synthetic
aataatgtattatgagttttgagaatggtttaaagttagtttatgatatggtaaaaataatttttttattgaata

SEQ ID NO: 62099 - DNA, 75 bp, Artificial Sequence
  Synthetic
cttttggaaggctagcagtacatatactatgggacaactcaaccctcctgccaaaatgcactaatcgggtcaagg

SEQ ID NO: 62100 - DNA, 75 bp, Artificial Sequence
  Synthetic
gggtttgtgttgagatggttgtaaaatatgattttttggtgatgataattggttgggtaatagtaattgttgtgg

SEQ ID NO: 62101 - DNA, 75 bp, Artificial Sequence
  Synthetic
taattgaggtttattgggttgaatatggttaattattatttggattattattttatgaagaaagtgtgatttggg

SEQ ID NO: 62102 - DNA, 75 bp, Artificial Sequence
  Synthetic
gtaagattgaatttagagatgagattgttttttaaagtgttagggaggtatttaataatttaaatagtattattt

SEQ ID NO: 62103 - DNA, 75 bp, Artificial Sequence
  Synthetic
tattaattgaggaaaattttgggaaatttgatattttggtaaaggatttgagaaatattatgtatgattatttgt

SEQ ID NO: 62104 - DNA, 75 bp, Artificial Sequence
  Synthetic
ttggttttggaattgttttttattaattagtataagtgatttgtaaattgggaaaagatagtaatttattggata

SEQ ID NO: 62105 - DNA, 75 bp, Artificial Sequence
  Synthetic
ttatttatgttgagttttaggttagtttggttgaaggagattttttttaatgtgttttaatttaaattataaaaa

SEQ ID NO: 62106 - DNA, 75 bp, Artificial Sequence
  Synthetic
gagttttaattttttaagatgttgttttatttgttatttatatttgtttttgaggtgatattttttgagtttgtt

SEQ ID NO: 62107 - DNA, 75 bp, Artificial Sequence
  Synthetic
aaaggaccaccaacttgaaagcctaaccgaccgggagctcctgcttcttatagcacggaagacctgtggatcaac

SEQ ID NO: 62108 - DNA, 75 bp, Artificial Sequence
  Synthetic
agaaaagtttgtgtttagttttattattgtttaagattgattgaggttgggtatgtgttttttagttttaagatg

SEQ ID NO: 62109 - DNA, 75 bp, Artificial Sequence
  Synthetic
gtaaaatatttggatttaaaatttgagttaattttttttttttttgaaagaggtgaataatagtagaggttttaa

SEQ ID NO: 62110 - DNA, 75 bp, Artificial Sequence
  Synthetic
ttgttgaattatagggtatgttatattaatgatatatttgtgagtattagttttggataatataagttaattaaa

SEQ ID NO: 62111 - DNA, 75 bp, Artificial Sequence
  Synthetic
tgattaagataaaattgtttatattttgttagtagtttaaaatataaatgtaataggagttatatttttgatagt

SEQ ID NO: 62112 - DNA, 75 bp, Artificial Sequence
  Synthetic
attataattaattgttattaagtaatttaaattaaaagtgatgaagattaagaaaaatttattttggttgagaga

SEQ ID NO: 62113 - DNA, 75 bp, Artificial Sequence
  Synthetic
gtgtttttttattaatttttattttgtaaatgttgagtaaaattgttaaaaatatgaggtgggttatattgttta

SEQ ID NO: 62114 - DNA, 75 bp, Artificial Sequence
  Synthetic
ttgttttttttgaatatatggaggttatatattttgttaggttaaatttaataattgttagaggtggtaatagta

SEQ ID NO: 62115 - DNA, 75 bp, Artificial Sequence
  Synthetic
atataggttttttgatattggagttagttaatggggatattttattgaatttatttaggttaattgttgatgata

SEQ ID NO: 62116 - DNA, 75 bp, Artificial Sequence
  Synthetic
ttattgattatgttagttatatattaggtagtgtgttattagtatttatttttgaagttatggtgaatgttatat

SEQ ID NO: 62117 - DNA, 75 bp, Artificial Sequence
  Synthetic
tgggttttaaagtgttaatgaagtaaattttaatttggttttttttaggtgttgttgattaaaagatttatagtt

SEQ ID NO: 62118 - DNA, 75 bp, Artificial Sequence
  Synthetic
ttgatttaattatggttgttattatgtttgttttatatattattatttattttggtaaggtaattaatttatttg

SEQ ID NO: 62119 - DNA, 75 bp, Artificial Sequence
  Synthetic
ttagagttaattggttgggttttggaattttggattatttttttaggtttttgtgaattggaaattaggtttttt

SEQ ID NO: 62120 - DNA, 75 bp, Artificial Sequence
  Synthetic
tttaggagtttgtttttttgttagtttaattattttagtattttatttttgatttgatagtatttaaattgatta

SEQ ID NO: 62121 - DNA, 75 bp, Artificial Sequence
  Synthetic
tttaattattgtttgttgtaatatggattgatgatattttaataggattaaatggagtgttgtgtttaggaattt

SEQ ID NO: 62122 - DNA, 75 bp, Artificial Sequence
  Synthetic
tattttatttaaaattttgttttatttttttatttaataaaagtgggaagaaggggaatagtgttgatttaatat

SEQ ID NO: 62123 - DNA, 75 bp, Artificial Sequence
  Synthetic
gtactgttgatattgctcaaattcttagagaatactcctgggctcatattcttgacggtagacagttaatagggg

SEQ ID NO: 62124 - DNA, 75 bp, Artificial Sequence
  Synthetic
ttttggagaaaatttaagtaataatgattttattttaggattttaagattgttttaattgatttaattaaaaata

SEQ ID NO: 62125 - DNA, 75 bp, Artificial Sequence
  Synthetic
ttatgggaattgaagtgttagaaattttggtttataagttgattggtaagaaggtgatttttaaaaatggataat

SEQ ID NO: 62126 - DNA, 75 bp, Artificial Sequence
  Synthetic
taattatttttgtttttttgttaaagtatattgggttggatttggtggttttaggagattttattatggtaatta

SEQ ID NO: 62127 - DNA, 75 bp, Artificial Sequence
  Synthetic
tataggattgtgatatgtgttatttttttgtaagttttttagttgtgattgagaagtaattgtaataattgattt

SEQ ID NO: 62128 - DNA, 75 bp, Artificial Sequence
  Synthetic
ttgagttggttatacgggctcttaaaaataattctacatggcaccatgagttgtacttactaccagaacttatag

SEQ ID NO: 62129 - DNA, 75 bp, Artificial Sequence
  Synthetic
agatttagttttatagaatttttttagggatagtgataatatttatttagtaatttgtttattagaggagatatt

SEQ ID NO: 62130 - DNA, 75 bp, Artificial Sequence
  Synthetic
tttaattgattaatatattaaaggtgttttatattattgtttttttttttttttaaatgtagaatttaataaaag

SEQ ID NO: 62131 - DNA, 75 bp, Artificial Sequence
  Synthetic
atttataatatatttgtttttaaaggattgattgatgaaagattataattaataatattataaataattttatta

SEQ ID NO: 62132 - DNA, 75 bp, Artificial Sequence
  Synthetic
taattaatatggtgatttaaatgttaattttttttattgtatatattttttgtttttatttttaaattgtttgta

SEQ ID NO: 62133 - DNA, 75 bp, Artificial Sequence
  Synthetic
tgtttatatttgaggatagttagtgtgatttggattggaaatgtggagaaaaaattgggatttatttttaggttg

SEQ ID NO: 62134 - DNA, 75 bp, Artificial Sequence
  Synthetic
tttataatttaagtatagatattgtttttttaattaagaaaaaattggtgatgaagattaagttgatagtgagtg

SEQ ID NO: 62135 - DNA, 75 bp, Artificial Sequence
  Synthetic
taatttttattttttttagattatttgttttttagagtaggggttgttaggttttttttaattgtgtaattaaaa

SEQ ID NO: 62136 - DNA, 75 bp, Artificial Sequence
  Synthetic
taaattttattagaaggatattgtggggtaataatataatgggtgttataggaatattgtagttattttgtgatt

SEQ ID NO: 62137 - DNA, 75 bp, Artificial Sequence
  Synthetic
gatttaagaggatattattttttttttgggtaattatttttttttaaagaatattttttattttatttggagtta

SEQ ID NO: 62138 - DNA, 75 bp, Artificial Sequence
  Synthetic
tttataatagtatattataggttagtgatgttgataaattagtttgttgtgataaattgttatttataaattaat

SEQ ID NO: 62139 - DNA, 75 bp, Artificial Sequence
  Synthetic
tgagattagttggattgaattttgaagggaatggagtggtaattgatgtgttatttgtaattaaaagatggggtt

SEQ ID NO: 62140 - DNA, 75 bp, Artificial Sequence
  Synthetic
ttaggtttggtgttttattaaaggtggttaattatgaagttggtgaatgggttgaaaattgttataattttgaaa

SEQ ID NO: 62141 - DNA, 75 bp, Artificial Sequence
  Synthetic
ttaaaaaatttgatgggagtgagtgtttattagtagtgttagatgggatttggggttttttttggtgttggtatg

SEQ ID NO: 62142 - DNA, 75 bp, Artificial Sequence
  Synthetic
tgtataaagtattaggaatgggattgtgtgttggagattttgttttttataaagagggtgttttttttttgtatg

SEQ ID NO: 62143 - DNA, 75 bp, Artificial Sequence
  Synthetic
attgatttgtttttatagttatttattgaggaatgatttttgttgaaggtgttgttgtatttttgatattgtttt

SEQ ID NO: 62144 - DNA, 75 bp, Artificial Sequence
  Synthetic
agaccagcaacaacaaagctgagaaatggacaggaccaggatggaaaccaaggcgaaactgcatccccacgggta

SEQ ID NO: 62145 - DNA, 75 bp, Artificial Sequence
  Synthetic
aagttaagaaggatttttttagtttatattttttgagagagttggttaatgtaatggaggatttgtttagtggtt

SEQ ID NO: 62146 - DNA, 75 bp, Artificial Sequence
  Synthetic
attattttattataattagatattaggttattggttttggaattaatgagatagagtatttgtttgaggttgata

SEQ ID NO: 62147 - DNA, 75 bp, Artificial Sequence
  Synthetic
atttgatttatgtttaatttgaattaagatttatattatagtttttgttttagttgaatgagataatatatataa

SEQ ID NO: 62148 - DNA, 75 bp, Artificial Sequence
  Synthetic
gtgggaaaaggagtaatattatgggaaaattaatttggaaggttaattttgaaattgatataataattggggagt

SEQ ID NO: 62149 - DNA, 75 bp, Artificial Sequence
  Synthetic
gggttttttgggaaattaaaaaaattttattagaaaaatttgtagtgaagagttgttttttatagttgtattaaa

SEQ ID NO: 62150 - DNA, 75 bp, Artificial Sequence
  Synthetic
tggagttaaaaatattagtggttagagtttggtgtgaattttttttgatttagggattaatataataattgaaga

SEQ ID NO: 62151 - DNA, 75 bp, Artificial Sequence
  Synthetic
ttataaaattatggttttagaaaatttttttgtaatggtttaagtgtatagttaaggaagggaagttgtagtgtt

SEQ ID NO: 62152 - DNA, 75 bp, Artificial Sequence
  Synthetic
gtatttaataatttttgttataatttttatgagtttttaattttttataattaaattaggtttggataatagtat

SEQ ID NO: 62153 - DNA, 75 bp, Artificial Sequence
  Synthetic
ttataatatatttgtgtataaatttgatatttttgaggtaatttaagttgaataatattattgtagaatagataa

SEQ ID NO: 62154 - DNA, 75 bp, Artificial Sequence
  Synthetic
tgatagtatagtttttgatattttttttgttatgattgtagttggatttttaaaagtagagaatattaatatgag

SEQ ID NO: 62155 - DNA, 75 bp, Artificial Sequence
  Synthetic
taagagtattgattttttggattttgttattataataagtttttaaaattatagtgagattgttggtaataataa

SEQ ID NO: 62156 - DNA, 75 bp, Artificial Sequence
  Synthetic
tatttattattaagatattggagaagagagtgttagtagtgggaagttaggtttaattattaatattattgttgg

SEQ ID NO: 62157 - DNA, 75 bp, Artificial Sequence
  Synthetic
agttgtaggattgattataggtgggagaagaatttgaagagaagtaattgttaatgtttaatttaaatgtaattt

SEQ ID NO: 62158 - DNA, 75 bp, Artificial Sequence
  Synthetic
taatttatattattggattatttaggatgaaggtgttgtaattggattggtttggatattatattttgggttagt

SEQ ID NO: 62159 - DNA, 75 bp, Artificial Sequence
  Synthetic
agttgagggaatttatatagaggggttaatgtataattaagatggtttaatttgtgggttgagatagttggttaa

SEQ ID NO: 62160 - DNA, 75 bp, Artificial Sequence
  Synthetic
tgagatgatttaagttttttaattgtttttgagagttataattgagttatgtatttttttaatttttaattgtaa

SEQ ID NO: 62161 - DNA, 75 bp, Artificial Sequence
  Synthetic
ggtaattgattttttgttgtagtgatggggtggtatatgttatattttgggattggattgttgtattgaattata

SEQ ID NO: 62162 - DNA, 75 bp, Artificial Sequence
  Synthetic
tgattggattaagaatataatagataaaattgattagattatttatgattttgttgataaaatttttttggatta

SEQ ID NO: 62163 - DNA, 75 bp, Artificial Sequence
  Synthetic
gggggataatgataattggtggataggatggagataatggatattggtaggtattggagttataggtgttataat

SEQ ID NO: 62164 - DNA, 75 bp, Artificial Sequence
  Synthetic
tgtagttattgttttattttgtatatgtaaatttgttttttagtttttttttagattgttttatggaaaagttta

SEQ ID NO: 62165 - DNA, 75 bp, Artificial Sequence
  Synthetic
gttttaaattaatgaaattaggatttaattatatggattatttgaatttaagattatttgataaatgataatata

SEQ ID NO: 62166 - DNA, 75 bp, Artificial Sequence
  Synthetic
atatattggagttttaaatatagttaatgtgattttaatttttttaaatttatagttaattataaataaggtttg

SEQ ID NO: 62167 - DNA, 75 bp, Artificial Sequence
  Synthetic
ctacctactgcaccgccagaatacatagaggctgtctacccaatgagaacggttagtactagtatcaacagtact

SEQ ID NO: 62168 - DNA, 75 bp, Artificial Sequence
  Synthetic
atattaatttagttatttttttgagaatgataaatttgatgaagattaagaaaaaggtaattttttgattatttt

SEQ ID NO: 62169 - DNA, 75 bp, Artificial Sequence
  Synthetic
taatttttatttttgattttataattatgatagttgtttttagtgataagggaaagaagtttttttattaagttg

SEQ ID NO: 62170 - DNA, 75 bp, Artificial Sequence
  Synthetic
taataattagatttgtgaattggtagagtttagttgtaatttaatatatataaagtattggttaaaaagttaata

SEQ ID NO: 62171 - DNA, 75 bp, Artificial Sequence
  Synthetic
gaaatttaaatagtgagtggagataatttttaaatggaagttttatatgagagaggatgtttatgagttgttaga

SEQ ID NO: 62172 - DNA, 75 bp, Artificial Sequence
  Synthetic
tagtatttaagggatggatatgattattatgtttgagtatgattattatttagagagaattattgaggtgagtat

SEQ ID NO: 62173 - DNA, 75 bp, Artificial Sequence
  Synthetic
agtcagcgagaaatgagcatgaagtccgaggctgcccggcccacacgacccccagggccttcgtccggctaccga

SEQ ID NO: 62174 - DNA, 75 bp, Artificial Sequence
  Synthetic
tgttaattaaggagtgttttataagtgtgtgtttttattgtattttataagaagagagttgaattattaatagtt

SEQ ID NO: 62175 - DNA, 75 bp, Artificial Sequence
  Synthetic
tttttagtatttaaagatatatgtttgattttgaaaaaaggatttttgtgtgatagtagtttttgtaaaaaagat

SEQ ID NO: 62176 - DNA, 75 bp, Artificial Sequence
  Synthetic
tattagttggagagtttaattgatagggaattatttttattaattgtttgtaagatttgtggattagtagaataa

SEQ ID NO: 62177 - DNA, 75 bp, Artificial Sequence
  Synthetic
taattaaatataattgtatttaaggatttgtgtttagtaaatttaatggttgatgatttttagtaagaggaaggt

SEQ ID NO: 62178 - DNA, 75 bp, Artificial Sequence
  Synthetic
ttaaaaattattttgttgatattgattaagatggtagaatattgggtgagataagatattagaattatagaggat

SEQ ID NO: 62179 - DNA, 75 bp, Artificial Sequence
  Synthetic
ttaaaattaagagtattgttgattttatgtgttgtgatgatgaggaaatttttaaaattttagttgagtttttta

SEQ ID NO: 62180 - DNA, 75 bp, Artificial Sequence
  Synthetic
tgtgagatatatttaaggtgtgaggggtttgggtaagattaggtagaatttgtttttgaagtatattaatgatta

SEQ ID NO: 62181 - DNA, 75 bp, Artificial Sequence
  Synthetic
tttaacttgtcaatagagcaacctagtttgtgattactcatcttccgtagttgacaaacactttgctggttaatt

SEQ ID NO: 62182 - DNA, 75 bp, Artificial Sequence
  Synthetic
tatagtgataaaggaggtagttttgaagttgtattatggtaataatgggattgataatttttaattatgtttatt

SEQ ID NO: 62183 - DNA, 75 bp, Artificial Sequence
  Synthetic
attgtatttttgaatattgttttttagttattgtgtgaaagttttgttgttgttgttttagggttaagaatattg

SEQ ID NO: 62184 - DNA, 75 bp, Artificial Sequence
  Synthetic
gttttttaattagataatgaggaagttttaattaatttggggatatgtttatggtttgatgagggtattttttaa

SEQ ID NO: 62185 - DNA, 75 bp, Artificial Sequence
  Synthetic
taaggttgattaaaatattatataattttttatttgattataatattttgtatatttattattatatatttaatt

SEQ ID NO: 62186 - DNA, 75 bp, Artificial Sequence
  Synthetic
aagatgatattttttaaaatttatttagtattataattatttttgttttaaattaataagatgtgtatgattgtt

SEQ ID NO: 62187 - DNA, 75 bp, Artificial Sequence
  Synthetic
ttaatatatgaagaggtatgatataattttaatagtgattaaagaaaattataattttgtattgtttgtaatata

SEQ ID NO: 62188 - DNA, 75 bp, Artificial Sequence
  Synthetic
agaggatcccgcttcagtggttcaagtgcgagacctccagagggaaaacacagtgccgaccccacccccagacac

SEQ ID NO: 62189 - DNA, 75 bp, Artificial Sequence
  Synthetic
atttgttaagtatattttttgtataaagtgatttttgtatataaataatgttttattttataggaggtagtaatg

SEQ ID NO: 62190 - DNA, 75 bp, Artificial Sequence
  Synthetic
atttattttattaaaaaataagtattttatgatttattaatgattttttaaaatattaagaaaaattgatggaat

SEQ ID NO: 62191 - DNA, 75 bp, Artificial Sequence
  Synthetic
ataaattttttatgttttaagttgtggaggaggtgtttggtattggttattgttatattataattaataataagt

SEQ ID NO: 62192 - DNA, 75 bp, Artificial Sequence
  Synthetic
ttgtaaaaatattgtttttgttttaagaggtagattgtgattggaaatgttaaattaatgatgaagattaatgtg

SEQ ID NO: 62193 - DNA, 75 bp, Artificial Sequence
  Synthetic
atgacaccgacagcaatcgacccaacccaattgacatcagcgagtctacagagccaggaccactcaccaacacca

SEQ ID NO: 62194 - DNA, 75 bp, Artificial Sequence
  Synthetic
gaggtttgataagaataaattttattatttagattaggttttaagaggtattttttatttttttttagtaaagta

SEQ ID NO: 62195 - DNA, 75 bp, Artificial Sequence
  Synthetic
caagaggggctgcaaatctgctgacaggctcaagaagaacccgaagggaaatcaccctgagaacacaagccaaat

SEQ ID NO: 62196 - DNA, 75 bp, Artificial Sequence
  Synthetic
ttattttagggtagtttaattagtggtatgttttttagttgtatattagttgtttttgagatatgttataaaagt

SEQ ID NO: 62197 - DNA, 75 bp, Artificial Sequence
  Synthetic
aggctcaagaagaacccgaagggaaatcaccctgagaacacaagccaaatgcaacccaaacctacactattggac

SEQ ID NO: 62198 - DNA, 75 bp, Artificial Sequence
  Synthetic
gtttttaagttaaattggtttgtatatattttatatattgtattaggggtaataatatttaattgaatttagttg

SEQ ID NO: 62199 - DNA, 75 bp, Artificial Sequence
  Synthetic
tttaaaatttagtgtataaatttgggttaatattattaggttaattttattggttgaaaagaagtttatttataa

SEQ ID NO: 62200 - DNA, 75 bp, Artificial Sequence
  Synthetic
tgaatattattttgagtgtttttataattaaaaaataggaatgttgttttaataattgagtgtaaggttttaagg

SEQ ID NO: 62201 - DNA, 75 bp, Artificial Sequence
  Synthetic
ttgaattgagagtgtttagataataaaatattgatattttagatattaagtaagatttgagaaaaaattatggtt

SEQ ID NO: 62202 - DNA, 75 bp, Artificial Sequence
  Synthetic
aaagttatgggatgatataatttaatattgtttaaaaaggatttggagaaaggggttgttttaagtgatttttgt

SEQ ID NO: 62203 - DNA, 75 bp, Artificial Sequence
  Synthetic
aattttttagttagttaaattatttaggggtggaaggtttattgggttggtattgagtttgatgtgatttataaa

SEQ ID NO: 62204 - DNA, 75 bp, Artificial Sequence
  Synthetic
ggaatggttttattgtatagattgaaaattaatgattttgtttttgtatggttaatgataaggaatttttttttt

SEQ ID NO: 62205 - DNA, 75 bp, Artificial Sequence
  Synthetic
tatttattttaaaatttgaattttataattgaattattgttgtgggtattgagagttatttttgtagtagggata

SEQ ID NO: 62206 - DNA, 75 bp, Artificial Sequence
  Synthetic
taggattagttgattgattagtttttgattgaatttttagtaggagtttttggtttgatttttgattggttgtta

SEQ ID NO: 62207 - DNA, 75 bp, Artificial Sequence
  Synthetic
ataattaatattaattattttaatatgtgaatataatgtgttaaggaataattgagtttaaaaatgttgttgttg

SEQ ID NO: 62208 - DNA, 75 bp, Artificial Sequence
  Synthetic
atttgatttaatatttttaagtttattaataaattggatgttttatatgttgtgaattataatggattgttgagt

SEQ ID NO: 62209 - DNA, 75 bp, Artificial Sequence
  Synthetic
agtattgaaattggaatttaaaattatataattattataatttgaattaatatgggttttttggtggagttttaa

SEQ ID NO: 62210 - DNA, 75 bp, Artificial Sequence
  Synthetic
gaatttgataaattggtaatgaattgtatgaagtttgggttggtgaaatttttttttttttatgagtttatattg

SEQ ID NO: 62211 - DNA, 75 bp, Artificial Sequence
  Synthetic
aaagtatttatataaggatttttgatatgaatgtaaagtttgatttttgaatttaatagtttttttgttatttaa

SEQ ID NO: 62212 - DNA, 75 bp, Artificial Sequence
  Synthetic
ttaaggtagaatattttatattgagttaatttatatatgttgatttaatagttattttgatatttttgtttttat

SEQ ID NO: 62213 - DNA, 75 bp, Artificial Sequence
  Synthetic
aattagatatataagtataataaataaatatttatattttttgataatttgtttaattatagataaatttttatt

SEQ ID NO: 62214 - DNA, 75 bp, Artificial Sequence
  Synthetic
gtaagttagtttttaagttgatatttttataaaaattaggatttagaattttttaaataagagattttaagataa

SEQ ID NO: 62215 - DNA, 75 bp, Artificial Sequence
  Synthetic
ataattgtattcacattgtggccacaatatactgtcttttcccattgaaaaataaggctgaatctattacgctac

SEQ ID NO: 62216 - DNA, 75 bp, Artificial Sequence
  Synthetic
tattatagaattgttttattatatgaataagtattttattattagaaattttatatattaaatggttaattgtaa

SEQ ID NO: 62217 - DNA, 75 bp, Artificial Sequence
  Synthetic
ttgaatttgtaggttatatgtgttaggttttatagattttatatattattaattttatatttgtaattaatatta

SEQ ID NO: 62218 - DNA, 75 bp, Artificial Sequence
  Synthetic
gataagtagattaagaaaaaagtttgaggaagattaagaaaaattgtttattgggtttttttgtgttttagatga

SEQ ID NO: 62219 - DNA, 75 bp, Artificial Sequence
  Synthetic
agtagttgaaatttttttttttgatattaaatggttatataatatatttaatatttagatgttaggttattatta

SEQ ID NO: 62220 - DNA, 75 bp, Artificial Sequence
  Synthetic
ttaattgtattggattaatgtgatttagttattagagtttgtgggttatatttattatatttttttaatttgtaa

SEQ ID NO: 62221 - DNA, 75 bp, Artificial Sequence
  Synthetic
ttatgtaattgtaaatttttgaaatatatttattgtttgaaatatgatgtaattgttattaagtttttgagtgat

SEQ ID NO: 62222 - DNA, 75 bp, Artificial Sequence
  Synthetic
gtattagtggtgatattgtttatagattttatagttttagttttttttaaggtattgttaggtaatggattttgt

SEQ ID NO: 62223 - DNA, 75 bp, Artificial Sequence
  Synthetic
tttgttgagttgtggtgttaatagtttttagatgaaattattaagtatataatgtaagatgttttttttttgaaa

SEQ ID NO: 62224 - DNA, 75 bp, Artificial Sequence
  Synthetic
tattattttaaaaatgtgggtgtttaagaagattgtgttgatgaatatttttaagagaaaattttatttttaatt

SEQ ID NO: 62225 - DNA, 75 bp, Artificial Sequence
  Synthetic
tagggtaatgaatttttatattaaatgtttttttggtatgatttggttattttaatttgaaggggtagattaaat

SEQ ID NO: 62226 - DNA, 75 bp, Artificial Sequence
  Synthetic
tgaggaaattttagattaatatggtttgtttatgatgatttaatagatattttaggttatggggattatgttttt

SEQ ID NO: 62227 - DNA, 75 bp, Artificial Sequence
  Synthetic
tggaagattttaattttaatgttattattgaatatataaggaattttttatgttgttatggattggtattaggta

SEQ ID NO: 62228 - DNA, 75 bp, Artificial Sequence
  Synthetic
ttagtatttaaagaagtggtttaagggtatatatatattgtttttgtttttattgttgatgttttgataatgtgt

SEQ ID NO: 62229 - DNA, 75 bp, Artificial Sequence
  Synthetic
aaagatttaattatatgttgatttaatataattttaattttaaaaatagtagagattgaggatttagtttgtttt

SEQ ID NO: 62230 - DNA, 75 bp, Artificial Sequence
  Synthetic
gattattttaattttaagattgtgtttatgttttattagagtggagattatttattttttatattagggtttgat

SEQ ID NO: 62231 - DNA, 75 bp, Artificial Sequence
  Synthetic
gggtataaaattattaagttttttgaattattgtgtttggttaaaatttaattatgtttaaagtatattgagagg

SEQ ID NO: 62232 - DNA, 75 bp, Artificial Sequence
  Synthetic
aagggttgatttttaatataaatgtatttagttgtaaattatattttagaagaaattatagaaatgtgtgtatta

SEQ ID NO: 62233 - DNA, 75 bp, Artificial Sequence
  Synthetic
aagtttttataggtttaaaagatttgtgaattttatagaatattgataaggttggagatgatgttataataattt

SEQ ID NO: 62234 - DNA, 75 bp, Artificial Sequence
  Synthetic
tgtgagttattttttatttaaaaatattgggggtattttgtgttatatagtgaaatagtaatttaaaaagttaaa

SEQ ID NO: 62235 - DNA, 75 bp, Artificial Sequence
  Synthetic
aaatatgttatggtgttaaaagtattatgttttatagtgatttttgagatatattgtgtttttaaatatagtatt

SEQ ID NO: 62236 - DNA, 75 bp, Artificial Sequence
  Synthetic
gttaaatattattttgatagttaaggattttggtatagtgttattttagataggaatttaatattgggttttaat

SEQ ID NO: 62237 - DNA, 75 bp, Artificial Sequence
  Synthetic
ttttatattaaaagaaattaattttttttgttgttaatgattaaagaattattatgggaattttattattttgat

SEQ ID NO: 62238 - DNA, 75 bp, Artificial Sequence
  Synthetic
tattttttattttttttaattaaaattattagtgatttaagtatttttataaaagatagagttattgtagtagaa

SEQ ID NO: 62239 - DNA, 75 bp, Artificial Sequence
  Synthetic
aggatatgttgggatgtagtatttgagtttaatgttttaggatataatttattttataaatttagtattaaatgt

SEQ ID NO: 62240 - DNA, 75 bp, Artificial Sequence
  Synthetic
gtattggaataatttttagagtaagaaaatttttttattgagaatgtttttttttatgtataaaaatttgagtat

SEQ ID NO: 62241 - DNA, 75 bp, Artificial Sequence
  Synthetic
ttattattataatattggaattttttttttttattgaaagagaaagagttgaatgtaggtagaatttttggaaaa

SEQ ID NO: 62242 - DNA, 75 bp, Artificial Sequence
  Synthetic
ttgttttatttgatttgtaatgtttaaatattttgtgaagttttgttagttgatggttttgttaaagtatttttt

SEQ ID NO: 62243 - DNA, 75 bp, Artificial Sequence
  Synthetic
agtaatatgatggtagttatggaatgtgagtaaaaagaaagtttattgtattaagtattatggtattatataagt

SEQ ID NO: 62244 - DNA, 75 bp, Artificial Sequence
  Synthetic
gatgattttggtgaatatgttatagttagagggagtagttttgtaattgatttagagaaatataattttgtattt

SEQ ID NO: 62245 - DNA, 75 bp, Artificial Sequence
  Synthetic
agatatgagtttatagtattttttatagaatattgtaattgttgttatggtgttaagaatgtttttaattggatg

SEQ ID NO: 62246 - DNA, 75 bp, Artificial Sequence
  Synthetic
tattatataattttatagtgttatatgtatgttagtgattattataatttattatataattttatattggagaat

SEQ ID NO: 62247 - DNA, 75 bp, Artificial Sequence
  Synthetic
tgagataatttttttgaagggtttagtttatataggggttatatgggagggattgaaggattgtaataaaaattt

SEQ ID NO: 62248 - DNA, 75 bp, Artificial Sequence
  Synthetic
tggataagtattttatgtgtttaaatttttttagttgaaattaagattggttttaagttatgtttagttgtgatg

SEQ ID NO: 62249 - DNA, 75 bp, Artificial Sequence
  Synthetic
ggtgataattagtgtattattgttttattagttttttttttagagattgatgtagatgagtaggaatagagtgtt

SEQ ID NO: 62250 - DNA, 75 bp, Artificial Sequence
  Synthetic
gaagataatgtagtgagggtggttgttagtttagtaaaagttataagtgtttgtggaatttttttaaaatttgat

SEQ ID NO: 62251 - DNA, 75 bp, Artificial Sequence
  Synthetic
gaaatatttgtatatttaggttttatttattttggaaaaaaataatatttgaatggggtttaattgttttagttt

SEQ ID NO: 62252 - DNA, 75 bp, Artificial Sequence
  Synthetic
tttaaaatggttataagaatggtattattgtttgatgtaatttttgatgatttttaagggattttggttagtata

SEQ ID NO: 62253 - DNA, 75 bp, Artificial Sequence
  Synthetic
ggtattgtttttgagtgatttatttttgagatatgatatatttttttttgtaggataattgtagttttttatatg

SEQ ID NO: 62254 - DNA, 75 bp, Artificial Sequence
  Synthetic
ttttttttggtgagaattttgtaatattattattttgggtttaataaaggttttgattttggatagttaatattt

SEQ ID NO: 62255 - DNA, 75 bp, Artificial Sequence
  Synthetic
ggtaaatttttggattttggaataatattattggtattagtggtattgtaggtgtttggagggttattttttttg

SEQ ID NO: 62256 - DNA, 75 bp, Artificial Sequence
  Synthetic
aattttgagaaatgtttttattggaatttaggagatttagttattttaggtttattttagttaaaaatttatttt

SEQ ID NO: 62257 - DNA, 75 bp, Artificial Sequence
  Synthetic
tgaatgattgagatggatgatttatttttatttttaattgtgaagaattttgggaattgtattgttattgatttt

SEQ ID NO: 62258 - DNA, 75 bp, Artificial Sequence
  Synthetic
gtgttaaattttagtggattaaatgtttttgggttgtaagatttaattttatttttgtgttagattgtatgtagg

SEQ ID NO: 62259 - DNA, 75 bp, Artificial Sequence
  Synthetic
attattattttaagtgtgaaaaataaatttattaatattttattttatgtgttagttgattttgaagatgaaatg

SEQ ID NO: 62260 - DNA, 75 bp, Artificial Sequence
  Synthetic
gtttgtaaatggttattattattaatttttgttatgagttgttttgtggttgatatttttttatgtatgttgagt

SEQ ID NO: 62261 - DNA, 75 bp, Artificial Sequence
  Synthetic
gggaagtgattgtaaattttaggatatttggaaggaatatgtatattattagtttttaagattattaataataat

SEQ ID NO: 62262 - DNA, 75 bp, Artificial Sequence
  Synthetic
atagagatattggttttggatagattgaggaaaataatattgtaaaggtggagtttatggtttagttattttgat

SEQ ID NO: 62263 - DNA, 75 bp, Artificial Sequence
  Synthetic
tattgtgataatattttggtggaggttttaatttaaataatttgtatagttgatttagtatagattttgagggaa

SEQ ID NO: 62264 - DNA, 75 bp, Artificial Sequence
  Synthetic
tatttatgggtttatattttagagggaagattttttattggagttatatttttatgtatgattgagtaatttaaa

SEQ ID NO: 62265 - DNA, 75 bp, Artificial Sequence
  Synthetic
gtgttttggttgaaattttatgaataatgtttgtagtgtttaaatgtaaagtaattaggtgggaaattatttgtg

SEQ ID NO: 62266 - DNA, 75 bp, Artificial Sequence
  Synthetic
ttagtggtagttaagaaatatattgttagtgtatggttgaatgtattttgaataagttggattattggggatgga

SEQ ID NO: 62267 - DNA, 75 bp, Artificial Sequence
  Synthetic
attttatatattggattaaggatagaagataagataggataatttgttattaaattaaaatgtttttttgtagtt

SEQ ID NO: 62268 - DNA, 75 bp, Artificial Sequence
  Synthetic
ttaagagaggttattgaattggtgttttgtttaatatgggtaatttaaggtagtttgaatagtgatttgttaata

SEQ ID NO: 62269 - DNA, 75 bp, Artificial Sequence
  Synthetic
aaattatttttggaagtatgagtaaatttaagtgtttaagaaatattttaaatgatttttttatattatttagga

SEQ ID NO: 62270 - DNA, 75 bp, Artificial Sequence
  Synthetic
aatattgtttataggtataatgattaatatagtttttatttttttatggttaattgtatgagtaatttagtaatg

SEQ ID NO: 62271 - DNA, 75 bp, Artificial Sequence
  Synthetic
tgattgattgtttttataaatattttaggtgagtttttaggaggtggttagtttgtatgtgatagtaatattatt

SEQ ID NO: 62272 - DNA, 75 bp, Artificial Sequence
  Synthetic
ttttagaatgttataaattatgtagttgtattgtttgatattaaatttagaaatattgaggttatagatatttaa

SEQ ID NO: 62273 - DNA, 75 bp, Artificial Sequence
  Synthetic
tataattgtgtttatttttatttaattaagtgttgtatttgggaagtattagtttagtatttaatatatatattt

SEQ ID NO: 62274 - DNA, 75 bp, Artificial Sequence
  Synthetic
atattggatttagatttaataagatattgagaaaatgaattgatttatgatagtaattttttaaaaggaggattt

SEQ ID NO: 62275 - DNA, 75 bp, Artificial Sequence
  Synthetic
aattgtaatattttatttgataatttatttttttaaggtaaatggttgaatattatagaagatgattttatttga

SEQ ID NO: 62276 - DNA, 75 bp, Artificial Sequence
  Synthetic
ttgttttatttatttggatgggagttagttaagattattatgtaattaattattttagatagtaataatttattt

SEQ ID NO: 62277 - DNA, 75 bp, Artificial Sequence
  Synthetic
atagatttaattagtagtggagaaataagattatttattatttattttttaatttattttaagataggatttttg

SEQ ID NO: 62278 - DNA, 75 bp, Artificial Sequence
  Synthetic
tatagttttggggtttttgtaagttattattttggtaatataattttttggattaagaaattaatatttgataat

SEQ ID NO: 62279 - DNA, 75 bp, Artificial Sequence
  Synthetic
tttttatattatttaattatttaaatttataatttattatattgtttattgtgaatatttaagttaatatttaaa

SEQ ID NO: 62280 - DNA, 75 bp, Artificial Sequence
  Synthetic
tatgtaagtgttatgttatggttaatgagtattgatttttatttttttatttatataggtggtgttgtaggtgat

SEQ ID NO: 62281 - DNA, 75 bp, Artificial Sequence
  Synthetic
agaggatttttagatgtggttaggttatttttgagaatgtttattttatttttttttatatttgtaaaagaatgg

SEQ ID NO: 62282 - DNA, 75 bp, Artificial Sequence
  Synthetic
ataattaattgtggaataattgtttttttatggatagtatatttgttagagggttaaaatttaatatttgtgaat

SEQ ID NO: 62283 - DNA, 75 bp, Artificial Sequence
  Synthetic
aattttttttattagattgtagaattgttggtgtatgatttattaagataataggtttttaaaattattataagt

SEQ ID NO: 62284 - DNA, 75 bp, Artificial Sequence
  Synthetic
gattatgtatatttttatgataattttgtttatatatgtaagagtatagttagtaattttttttatgtattattg

SEQ ID NO: 62285 - DNA, 75 bp, Artificial Sequence
  Synthetic
gtgtattggaggagtagatatagaaatagtaattgaaaatatttggtaagagattttttaattggattaagtata

SEQ ID NO: 62286 - DNA, 75 bp, Artificial Sequence
  Synthetic
aataatagtgatggttatattgagagaagttaagaataaattattagagatttatatgatggtattgaatggaat

SEQ ID NO: 62287 - DNA, 75 bp, Artificial Sequence
  Synthetic
ttagttttataaatgagttatgaaataaaaagaatgataattttataagaaaatatgtattagggtttgttgttt

SEQ ID NO: 62288 - DNA, 75 bp, Artificial Sequence
  Synthetic
tagttttttttaagtgattttgtttgtggtatagtaaatttaaaattaaattttgattgattgagatataatgtg

SEQ ID NO: 62289 - DNA, 75 bp, Artificial Sequence
  Synthetic
aaattttaggattataatttggtatttaagagggaaggttattaaataattttatattgtttagttttatttttt

SEQ ID NO: 62290 - DNA, 75 bp, Artificial Sequence
  Synthetic
tttatattattttaagggatatgttaattaatgttatttaatgagttataaatttaagatgagatattaaagtat

SEQ ID NO: 62291 - DNA, 75 bp, Artificial Sequence
  Synthetic
ttatggtaattgagatttgttattgatattatagtttattgtagatttattggtatagttttgtttatgtattat

SEQ ID NO: 62292 - DNA, 75 bp, Artificial Sequence
  Synthetic
aaatttgatgaggttttttgggaaatagagagttttaagttggttgtgatgttagtagagggagaaggtgttggt

SEQ ID NO: 62293 - DNA, 75 bp, Artificial Sequence
  Synthetic
gttttattattgatttagaaatattaagttaagattttattttttaatatgttagttattgagtttagtatagag

SEQ ID NO: 62294 - DNA, 75 bp, Artificial Sequence
  Synthetic
ttagaaatagtattaggaatgattatttttaggatgtttttatttgttatgttaaaattttataatgattaaatt

SEQ ID NO: 62295 - DNA, 75 bp, Artificial Sequence
  Synthetic
gagattatttttaataatttagtaagttaaataatagatataataaattttatttggtttaaagattaaagagta

SEQ ID NO: 62296 - DNA, 75 bp, Artificial Sequence
  Synthetic
aggttatttaagtaagttgaggttataattatggatgtagagataatagagaatataaatagattgaaattgtat

SEQ ID NO: 62297 - DNA, 75 bp, Artificial Sequence
  Synthetic
gaagttgtatataaattgattttatattatattgattttagtgtattgaaagtagtggtttttaaagttttttta

SEQ ID NO: 62298 - DNA, 75 bp, Artificial Sequence
  Synthetic
agtgatattgagggtatgttatggttaaatgataatttagttttgttttttgttattggttatttaattaagtta

SEQ ID NO: 62299 - DNA, 75 bp, Artificial Sequence
  Synthetic
ataatgttaagtgttagatttagtgagtggtatttttgtttgatgaattttttattaattatatgtaagatgtta

SEQ ID NO: 62300 - DNA, 75 bp, Artificial Sequence
  Synthetic
tattaaaattattttagttgtaaataggtaatatttatggtattgtaattgtaaatttaatgaagtttatattgg

SEQ ID NO: 62301 - DNA, 75 bp, Artificial Sequence
  Synthetic
ttaagttatttaatttagtatgttgattgtgagttatatttaagttatatttgttttggttttttattattagag

SEQ ID NO: 62302 - DNA, 75 bp, Artificial Sequence
  Synthetic
aaagtattatattataggtataattttgttgatttaaaaagaggtttattagtttttattatttagtatttagta

SEQ ID NO: 62303 - DNA, 75 bp, Artificial Sequence
  Synthetic
tattttagagtagagatttgagaattaattaatgattataattaatagtgataaagttggatttaaatatattat

SEQ ID NO: 62304 - DNA, 75 bp, Artificial Sequence
  Synthetic
tttatttgtattgtaaaaggatgaattataaaattagttaatgattatttaaaatttttttttattgtgtaagta

SEQ ID NO: 62305 - DNA, 75 bp, Artificial Sequence
  Synthetic
gccatttcttccttccttcaatttatcaaaaaatggatcgtggaatacaagacagctattcctctgtgggttata

SEQ ID NO: 62306 - DNA, 75 bp, Artificial Sequence
  Synthetic
ttaaaatataatgggatatggtaagttgagtttaagaaattattagagttgattagtgtgtgtaataggttttat

SEQ ID NO: 62307 - DNA, 75 bp, Artificial Sequence
  Synthetic
tatattagagattgtaattgtgaagaatgttttttagtttaaattttatatttatatagaatgtaggattttgaa

SEQ ID NO: 62308 - DNA, 75 bp, Artificial Sequence
  Synthetic
gttaagtttattgaaaggttgatagggtttttgagtttatttttggatggtttttataggtttgattgaattatt

SEQ ID NO: 62309 - DNA, 75 bp, Artificial Sequence
  Synthetic
gtgtatagtattttgatatttgtaaaggttggttattaatatatagattataaaaaatttataaattgtttttat

SEQ ID NO: 62310 - DNA, 75 bp, Artificial Sequence
  Synthetic
atattatattgatttaattttaataaataattatttaaataatgaaaggagtttttatattatatattatattta

SEQ ID NO: 62311 - DNA, 75 bp, Artificial Sequence
  Synthetic
gtttttttttttgtgtgataattaaaaaatttataatgtagtatgtgtgatatattattgttgtaatgaatttaa

SEQ ID NO: 62312 - DNA, 75 bp, Artificial Sequence
  Synthetic
agagaattgccaacagcttccacaccagccgaacaatccaagacctatatcaaggccctatccagccgaatttat

SEQ ID NO: 62313 - DNA, 75 bp, Artificial Sequence
  Synthetic
tgtaatataataaattttgtattttttataattaagttttaatgaaaggtttgggtttatattgttattgatata

SEQ ID NO: 62314 - DNA, 75 bp, Artificial Sequence
  Synthetic
ataatgttgtattaatattttgttagatggaatagtgttttggttgataatataattttttaaaataaaattgat

SEQ ID NO: 62315 - DNA, 75 bp, Artificial Sequence
  Synthetic
ttttaagattaagttttttataattattattattttaatttgttgttttaaaaatggtgatagttttaatttttg

SEQ ID NO: 62316 - DNA, 75 bp, Artificial Sequence
  Synthetic
tgtaaaataagagattaggtgtaataattttaatatttttgtttagtaagttattattttatatagaatgataaa

SEQ ID NO: 62317 - DNA, 75 bp, Artificial Sequence
  Synthetic
attaaaagaaaaggtaggattgtaaaattagaaatattttttttataatatagtagattagataataatttttgt

SEQ ID NO: 62318 - DNA, 75 bp, Artificial Sequence
  Synthetic
gttaatgataattaagatattgattatgtttattagaaggtttgttagaataaatgttgtaaaaaggatttttgg

SEQ ID NO: 62319 - DNA, 75 bp, Artificial Sequence
  Synthetic
taaaaaggatttttggaaaaatggttgtatataaaaatttaaaaataaatttatttttttttttttgtgtgttta

SEQ ID NO: 62320 - DNA, 75 bp, Artificial Sequence
  Synthetic
tggatatataaaaaagaagaaatagatttatttttaaatttttgtgtgtgattatttttttaggaattttttttg

SEQ ID NO: 62321 - DNA, 75 bp, Artificial Sequence
  Synthetic
taatgtttattttggtgagttttttgatgagtgtggttaatgttttaattattattaatatgaagattattattt

SEQ ID NO: 62322 - DNA, 75 bp, Artificial Sequence
  Synthetic
agtttgttatattgtaaagaaggtatttttgattttatagttttgtttttttttttaattttattattttgtatg

SEQ ID NO: 62323 - DNA, 75 bp, Artificial Sequence
  Synthetic
gaaacgacagaaaatattaatcggtcaaaattatatgaggctattcagcaattaattgtttcacacattgataca

SEQ ID NO: 62324 - DNA, 75 bp, Artificial Sequence
  Synthetic
aaatagtagtttattagataaaaatgttaaggttattatatttaattttttattttatataaagattaaggttat

SEQ ID NO: 62325 - DNA, 75 bp, Artificial Sequence
  Synthetic
tattgtttttaaaatgataaattaaagtaatgataattataaaaaatttaattttaaagattaattttgttttaa

SEQ ID NO: 62326 - DNA, 75 bp, Artificial Sequence
  Synthetic
gaagttgtgttattaattaaaatattattttatttgataggatattgatataatattattatattaataataata

SEQ ID NO: 62327 - DNA, 75 bp, Artificial Sequence
  Synthetic
tgagtttagattttttgttaaagtttaattataaagagtgtagagtttattatgttgtgttaaatttattgtggt

SEQ ID NO: 62328 - DNA, 75 bp, Artificial Sequence
  Synthetic
agtaatatgttatatatgttgtattgtgaattttttgattattatgtagggagagaggttaaatatagtatataa

SEQ ID NO: 62329 - DNA, 75 bp, Artificial Sequence
  Synthetic
tatagggattttttttgttatttaaatagttgtttattgagattagattaatatgatgtatgagagtaatttatg

SEQ ID NO: 62330 - DNA, 75 bp, Artificial Sequence
  Synthetic
agttttttataatttgtatgttaataattaatttttgtaagtattaggatattatgtatggtaatttaattaaat

SEQ ID NO: 62331 - DNA, 75 bp, Artificial Sequence
  Synthetic
ttgtagagattatttggaaataaatttagaagttttgttagttttttgataagtttaattttagaattttgtatt

SEQ ID NO: 62332 - DNA, 75 bp, Artificial Sequence
  Synthetic
ttatgtaaatataaggtttgaattaagaaatgttttttataattgtaatttttaatatggtagaatttattgtat

SEQ ID NO: 62333 - DNA, 75 bp, Artificial Sequence
  Synthetic
atattaattaattttggtaattttttaaatttagtttgttatgttttattatgttttaatgtttgtataataaga

SEQ ID NO: 62334 - DNA, 75 bp, Artificial Sequence
  Synthetic
aagaattttaaataattattgattagttttgtgatttgtttttttgtagtatgaataaagtgatatgtttgagtt

SEQ ID NO: 62335 - DNA, 75 bp, Artificial Sequence
  Synthetic
tgattttgttgttgttgattataattattagttaatttttgaatttttgttttaagatgtgttaagtgttgagtg

SEQ ID NO: 62336 - DNA, 75 bp, Artificial Sequence
  Synthetic
atagagattagtggatttttttttgaattgatgaggttatatttgtggtatagtattttttttaatgatggaaaa

SEQ ID NO: 62337 - DNA, 75 bp, Artificial Sequence
  Synthetic
gtatactaatcatgttagtactaactaacagtactcactgcatatactctatcaattaagaaaaattactgtggt

SEQ ID NO: 62338 - DNA, 75 bp, Artificial Sequence
  Synthetic
ttaaggtggatataatttaaatgtaatttatagttagtatattgagttaaatgatttagttagtatgggttttgt

SEQ ID NO: 62339 - DNA, 75 bp, Artificial Sequence
  Synthetic
tgaatttgtagttgtaatgttgtaagtattatttgtttataattgagatggttttggtgtggtattttatgtgta

SEQ ID NO: 62340 - DNA, 75 bp, Artificial Sequence
  Synthetic
gttgataagaagtttgttagataaagatattatttattagatttagtatttgatgttattggtttaattaaataa

SEQ ID NO: 62341 - DNA, 75 bp, Artificial Sequence
  Synthetic
ttagtggtaaaaaatggggttaaattattatttagttataatatatttttagtattatttagaaagattttaagg

SEQ ID NO: 62342 - DNA, 75 bp, Artificial Sequence
  Synthetic
attcaaattatattcacaggaacttgtgattaataataaaagtctcagttgttggttgttgagttgtaaaactcc

SEQ ID NO: 62343 - DNA, 75 bp, Artificial Sequence
  Synthetic
attattgtttttaatatgttaggattaatatggtgtaagattaatttatatatagttttgtataattttgatttg

SEQ ID NO: 62344 - DNA, 75 bp, Artificial Sequence
  Synthetic
tttatattttttgttgtttttgtatttatggttataattttgatttgtttaggtagttttgttttttggttttta

SEQ ID NO: 62345 - DNA, 75 bp, Artificial Sequence
  Synthetic
aattaagtaggatttgttatgtttgttatttggtttgttgagttgttaagaataattttaatttggttattatgg

SEQ ID NO: 62346 - DNA, 75 bp, Artificial Sequence
  Synthetic
tgtggaacctcattggatatttgatcgtacacaaaaatatctttacaaaattgttttctcttttttgtgtgtcca

SEQ ID NO: 62347 - DNA, 75 bp, Artificial Sequence
  Synthetic
aattttgatataataggtagaagtattttaggagtagttatttttgatattatttttgattttatattggattta

SEQ ID NO: 62348 - DNA, 75 bp, Artificial Sequence
  Synthetic
gtagttagtgtgttgaaaaataaggttttaatttggtatttttgaattaatagtaaggtattagtattttttttt

SEQ ID NO: 62349 - DNA, 75 bp, Artificial Sequence
  Synthetic
tttgttagtgttatagttgatttgaaattttttattttttaaaggattttattaagtttgtaatgtatggatgag

SEQ ID NO: 62350 - DNA, 75 bp, Artificial Sequence
  Synthetic
attatattggtaaatttataataaattgtggtattaatgatggattttaattgttgtaagtattttgatattttg

SEQ ID NO: 62351 - DNA, 75 bp, Artificial Sequence
  Synthetic
ttttgggtttgtgatttattggatgatgttaattggtgtgttttttgagataatgtaaagaaaggtaggattaga

SEQ ID NO: 62352 - DNA, 75 bp, Artificial Sequence
  Synthetic
tggtgtgagattatttgatgatttttttttttggatgttgagttatgattttgaaattttatattgtgttttgat

SEQ ID NO: 62353 - DNA, 75 bp, Artificial Sequence
  Synthetic
tgattgaaatttagttttggatttgttgtattataagtagagttatttagaaaggattggaatgatggattttgg

SEQ ID NO: 62354 - DNA, 75 bp, Artificial Sequence
  Synthetic
tgtgtgtttttttgtggaattgttgttttttttattttatggtttatttgtaggattagattttgtttagtgtta

SEQ ID NO: 62355 - DNA, 75 bp, Artificial Sequence
  Synthetic
ttatgtggatttttggtggtttgtttttgattttttttaatatgattattattgttgtttgtgtttgatttagtt

SEQ ID NO: 62356 - DNA, 75 bp, Artificial Sequence
  Synthetic
gaagagttttttgttaagtatttttggttgttgtttttgtgtttgtttttttagtatgttaatgatgtatggaag

SEQ ID NO: 62357 - DNA, 75 bp, Artificial Sequence
  Synthetic
aaattgttggttgtatttttatatgtgtaaataagattgttgtgaggatgtatatgattatttatggtagtttta

SEQ ID NO: 62358 - DNA, 75 bp, Artificial Sequence
  Synthetic
aaagtttgttgttttgatgaattatgtattagtagttttatgatttgatagagaaaattatttataggtgttggg

SEQ ID NO: 62359 - DNA, 75 bp, Artificial Sequence
  Synthetic
ttttgattttttagtggatatattatttataaagggataattgttttgtgattaattatttatttttttataaat

SEQ ID NO: 62360 - DNA, 75 bp, Artificial Sequence
  Synthetic
gtaagaaaagatgaaatggatgtttttaaaaataatttggttgtatttgagagttttttgttatttgtagtattg

SEQ ID NO: 62361 - DNA, 75 bp, Artificial Sequence
  Synthetic
tttatgtaaatagaaaaatgaggattaatatttattaattgtgatataatgtttgtatgtttgaatgttggttta

SEQ ID NO: 62362 - DNA, 75 bp, Artificial Sequence
  Synthetic
agtatttgtaatgagtgatgtggtagattatgaatttgagtagttaagtaatataaaaaattgttaagtgttaat

SEQ ID NO: 62363 - DNA, 75 bp, Artificial Sequence
  Synthetic
tttttagtttgaagaattgtattgttaagataataatttataaaggttttaaaattgtatagaagttttattttg

SEQ ID NO: 62364 - DNA, 75 bp, Artificial Sequence
  Synthetic
ggataagttaagaaatgggtagtgaatgattttgtttttttattgttaattgggtttgtagatgaattgttgtta

SEQ ID NO: 62365 - DNA, 75 bp, Artificial Sequence
  Synthetic
ttgcgatggccaaatgatacttatgactgtttaaaatcaagttagactaatagtctatcatgtcataagcttata

SEQ ID NO: 62366 - DNA, 75 bp, Artificial Sequence
  Synthetic
tttgaaataattgattgtatgatggttttggttagtttttatttagataagtgaggtagttgaataagattattt

SEQ ID NO: 62367 - DNA, 75 bp, Artificial Sequence
  Synthetic
tttataatgtttagttgtttattttggaaaaatggattattgaatgagatattgtaattgagttttttttttaga

SEQ ID NO: 62368 - DNA, 75 bp, Artificial Sequence
  Synthetic
ggattattgttataaattaatttgtttttttggtattttgttaaatttaaatttaatgtagatgtgtatgttaaa

SEQ ID NO: 62369 - DNA, 75 bp, Artificial Sequence
  Synthetic
tattgagttggtattttttgggtgtaatatttagttagatgaaggtgagtatgattatattggatatttgtagtt

SEQ ID NO: 62370 - DNA, 75 bp, Artificial Sequence
  Synthetic
ttagtgtttttaaatttaatattgaatagtgtaattgtataatttataatattttggaaaataatattgttgttg

SEQ ID NO: 62371 - DNA, 75 bp, Artificial Sequence
  Synthetic
tgtgtagattggttattttttgaaaatttatttaaagtgtttgtagaaataattaattgtgttgttgaattattt

SEQ ID NO: 62372 - DNA, 75 bp, Artificial Sequence
  Synthetic
gaaacacctccagtaaagaaatcaaatcttatctatagcaactcaatcgacttttaggaagctagcagtacatat

SEQ ID NO: 62373 - DNA, 75 bp, Artificial Sequence
  Synthetic
atatgattggttatgaaagaatgaggattgtattgattgttgtatttgtgaataatattttttgagtaatgtgaa

SEQ ID NO: 62374 - DNA, 75 bp, Artificial Sequence
  Synthetic
ggggttatttgaagtattttttgaatatttaaatttatttgtgtttttaaaaatggttttattagtaagttattg

SEQ ID NO: 62375 - DNA, 75 bp, Artificial Sequence
  Synthetic
tttgaattgttttgagttatttatgttaaatgggatgttaatttaatggttttttttaaggttgtggaaggatat

SEQ ID NO: 62376 - DNA, 75 bp, Artificial Sequence
  Synthetic
tttggtttaatagtaggttgttttattttattttttgtttttgatttaatgtatgggattttatttttgatagtt

SEQ ID NO: 62377 - DNA, 75 bp, Artificial Sequence
  Synthetic
tagtttatttgggatgtgtttggttatgtattaataatatgttttttgattgttattgatatgaatggtttttta

SEQ ID NO: 62378 - DNA, 75 bp, Artificial Sequence
  Synthetic
tttggttgttttgtatttgaatattgtggatattgtttgtagggttttagttaaaatattttgaattgtttaatt

SEQ ID NO: 62379 - DNA, 75 bp, Artificial Sequence
  Synthetic
atatatgggagtgtggttttaataagaggttttttttttaaaatatgagtttatgaatatttttttagaatttgt

SEQ ID NO: 62380 - DNA, 75 bp, Artificial Sequence
  Synthetic
gttaaattaattgtgtaagttatttgggttaaagtttttgttaggatattattataatgattaagataattaaat

SEQ ID NO: 62381 - DNA, 75 bp, Artificial Sequence
  Synthetic
tataggttttatttttgtaatgttattttttttagtttgtttaaaattggtgtttttgtattattgttgatgatt

SEQ ID NO: 62382 - DNA, 75 bp, Artificial Sequence
  Synthetic
ttagaggttaataatgtgtgtgttttttttaggtattttagaatttgtaattgttttttgtttggtgtgtgtgaa

SEQ ID NO: 62383 - DNA, 75 bp, Artificial Sequence
  Synthetic
aagatattggttgtaaaatgatttataataggagttgatgataatagttatttataaattattttgtttttgaag

SEQ ID NO: 62384 - DNA, 75 bp, Artificial Sequence
  Synthetic
ttagttgatgtatgaaataaggtattaataagtttgttttttgtatttagggtgatggttttgtgtataatttgg

SEQ ID NO: 62385 - DNA, 75 bp, Artificial Sequence
  Synthetic
tgtagaaatgaagttaagttttgtgatttagggatatttaatttgttaggatttagtataaagttaatggtagtg

SEQ ID NO: 62386 - DNA, 75 bp, Artificial Sequence
  Synthetic
tagtttttagggttttttgtaattaaaggtaagaataaattatttattttaattatttggagataagtttttaat

SEQ ID NO: 62387 - DNA, 75 bp, Artificial Sequence
  Synthetic
tggaataagtttgaggtaattggattttttagattttggtagaaatattttttaggatttaagaaggataatttt

SEQ ID NO: 62388 - DNA, 75 bp, Artificial Sequence
  Synthetic
ttaagtatttgtggtattgttagtgttaatgatattgttttgaaatttagaggtttgttgagtgttaattgttta

SEQ ID NO: 62389 - DNA, 75 bp, Artificial Sequence
  Synthetic
aggttaaaatttttattgaatttgagatgatgatattgtaagatttttattgaaaaaaatgtatggaaagttgtg

SEQ ID NO: 62390 - DNA, 75 bp, Artificial Sequence
  Synthetic
gttattttgtaaggaaagatatgttgtgttttagagatggattgtttaaaagtagtgtttatattagttagggtt

SEQ ID NO: 62391 - DNA, 75 bp, Artificial Sequence
  Synthetic
ttttgaagattattaaaaattgtattagataatggtgttatttttgtagttgttttaagggattgaggtaattgg

SEQ ID NO: 62392 - DNA, 75 bp, Artificial Sequence
  Synthetic
attttatttaaatattgtttttttttaaaatagataaaatttgaatgtataaatgttttattaggttttaaaaag

SEQ ID NO: 62393 - DNA, 75 bp, Artificial Sequence
  Synthetic
attttataggtatttgtaatttttgttaggttggtggttatttttgttgtattgtttttggtgttttgtttttgt

SEQ ID NO: 62394 - DNA, 75 bp, Artificial Sequence
  Synthetic
ttgtttgtgttagtttttaaggggaagattgataaaatagtaatgtattgattgttatttattatagttgagtgt

SEQ ID NO: 62395 - DNA, 75 bp, Artificial Sequence
  Synthetic
aatttaaaattagttttaattttaattaaagaaatttgagtatatgaaatatttgtttagagtttttgttgtagt

SEQ ID NO: 62396 - DNA, 75 bp, Artificial Sequence
  Synthetic
tttttaattttttttatatgatttttgtatgaattaggttttttgggggggttgttttgattttttagtgtgagg

SEQ ID NO: 62397 - DNA, 75 bp, Artificial Sequence
  Synthetic
ttatgtggtggattataataattattgatatgtatataatattgtgggattgtataatgtatttaattaaaaata

SEQ ID NO: 62398 - DNA, 75 bp, Artificial Sequence
  Synthetic
tttttaatattatagtaatggttgtaatattttataaaaggtgttgtaaatttatatttaaatgtaagattgtat

SEQ ID NO: 62399 - DNA, 75 bp, Artificial Sequence
  Synthetic
ttttttaaattagttataaagttattttttttaattgtggtatgtttattaaaattattatttgtgtggtgttat

SEQ ID NO: 62400 - DNA, 75 bp, Artificial Sequence
  Synthetic
gatgtttgatgtaataagttttttttttgtttatgttttgtaattattattatattgttaggaaatgttttagta

SEQ ID NO: 62401 - DNA, 75 bp, Artificial Sequence
  Synthetic
agattattagttaatagagttttataaagtgtttgaatattgtgagttggataaggtaattttttgaaggtttta

SEQ ID NO: 62402 - DNA, 75 bp, Artificial Sequence
  Synthetic
tttatatttaatttttttttttttaatgagaaagaaaagttttgatattgtggtagtagatatttgagtttttgt

SEQ ID NO: 62403 - DNA, 75 bp, Artificial Sequence
  Synthetic
gtgtaggaaagaatatttttaatagaaaagtttttttgttttaaaaattgttttggtatatgtttagtattaaat

SEQ ID NO: 62404 - DNA, 75 bp, Artificial Sequence
  Synthetic
ttgtgaggtggattatattttagaatattaggtttgaatattgtattttagtatgttttttttattgtggtagtt

SEQ ID NO: 62405 - DNA, 75 bp, Artificial Sequence
  Synthetic
ttgttttttataaaaatatttaagttattaataattttggttgagaaaagtggagggtggttaaggtggtaaaat

SEQ ID NO: 62406 - DNA, 75 bp, Artificial Sequence
  Synthetic
ccctaaactaaggacatgccgtttaccgaaacatatctacagattaaaatatgacactattgttttacgatttat

SEQ ID NO: 62407 - DNA, 75 bp, Artificial Sequence
  Synthetic
ttttatagtagttttttaattattggtaatggagggaattgattttttttgatataagaattaagatttggtgtt

SEQ ID NO: 62408 - DNA, 75 bp, Artificial Sequence
  Synthetic
cagtgatgtccctgtagctacaatcccaatagactacattgctccgatgttaataaatgttctggcagatagtaa

SEQ ID NO: 62409 - DNA, 75 bp, Artificial Sequence
  Synthetic
agatttttatttgaagtaatattgtattaagatttttgattattaaaataatgtttggtaatattatatttaaaa

SEQ ID NO: 62410 - DNA, 75 bp, Artificial Sequence
  Synthetic
atatagtatgttttgaaaattattatagggtgtaatgtttttagtattgtagtatgttttttaattttttggatt

SEQ ID NO: 62411 - DNA, 75 bp, Artificial Sequence
  Synthetic
gttgttttattatgtagtataggatgtttttagtgtttttgaatggaaaatagtttataaagttgttgtggtgtt

SEQ ID NO: 62412 - DNA, 75 bp, Artificial Sequence
  Synthetic
atttttagttttattaatgttttatggaatttatggattttttgagtttgtgaaggttttagtgtatgtattttt

SEQ ID NO: 62413 - DNA, 75 bp, Artificial Sequence
  Synthetic
gtaattttttttagggtgtgatttatagttaaatgtatttgtgttaagaattggtttttttttttagtgtatttt

SEQ ID NO: 62414 - DNA, 75 bp, Artificial Sequence
  Synthetic
gagtataattgaattttggttaagtataatggtttgaggaatttaataattttatatttattagattttaatatg

SEQ ID NO: 62415 - DNA, 75 bp, Artificial Sequence
  Synthetic
gagagtaagtaatttttgttttggtaaagtatagatataattttaaaattgggataattagaataaattggattt

SEQ ID NO: 62416 - DNA, 75 bp, Artificial Sequence
  Synthetic
ttaatttttgttatttttgagattagagttgtgttgaattgatatgtaattaaatttttgtatattattaagatg

SEQ ID NO: 62417 - DNA, 75 bp, Artificial Sequence
  Synthetic
ttggtagtagaaatagaaataatgtgtgtatgtttttgaattgtttttttgaatattgatgtttgatattagttt

SEQ ID NO: 62418 - DNA, 75 bp, Artificial Sequence
  Synthetic
atagtagtatgggggattttttgtgtgtttagtggtaatattgaaattgggattttttaaaaaatatagttttta

SEQ ID NO: 62419 - DNA, 75 bp, Artificial Sequence
  Synthetic
tagtttaagatgtttattaaattattatgaataaattatgttgatttagagtttttttgatttaatttatttttt

SEQ ID NO: 62420 - DNA, 75 bp, Artificial Sequence
  Synthetic
tgagttaaaatagttagattatattagaaaaatatttgatgtaaaaatttattgttttgaattgaagataagatt

SEQ ID NO: 62421 - DNA, 75 bp, Artificial Sequence
  Synthetic
tttttttgaaagtgtttattaatatagtttttttgagtatttatatttttgagataatattttaagaagagagta

SEQ ID NO: 62422 - DNA, 75 bp, Artificial Sequence
  Synthetic
ttttgtattgtgtatttaatgattttatttaagaattgttggtattgtggtttaataggatagaatttattgttt

SEQ ID NO: 62423 - DNA, 75 bp, Artificial Sequence
  Synthetic
ttgggatacctcgagggaaccagaactttattagcatctaaaatgataagcaataatgcagagacaccaatcttg

SEQ ID NO: 62424 - DNA, 75 bp, Artificial Sequence
  Synthetic
gatagtgttttgagaagaattgggattatgaaatttatgggtaatgttgttattggtatattatttaagaatttg

SEQ ID NO: 62425 - DNA, 75 bp, Artificial Sequence
  Synthetic
gtaatagttatattgtattttaaatggtagatatgttttgggagtttatagttgtgtagttgtggattaagggag

SEQ ID NO: 62426 - DNA, 75 bp, Artificial Sequence
  Synthetic
tatgatgaatataatttgtaagttttagtgattaggttatattggtttaatataattggtgatgataatttagtg

SEQ ID NO: 62427 - DNA, 75 bp, Artificial Sequence
  Synthetic
tttgggtattgggtatgttgtgtagttatttaatattaagaggaagaattttaattgttttatttaaaatatgga

SEQ ID NO: 62428 - DNA, 75 bp, Artificial Sequence
  Synthetic
aagatttaataagtagttttttttaattttttttaggttttttttttaatttatttatttaatgttaattatgag

SEQ ID NO: 62429 - DNA, 75 bp, Artificial Sequence
  Synthetic
tatagagttagtaatatatagaatttgtgaaatttaatatatgtgatttgtgggtttagttataattaattattt

SEQ ID NO: 62430 - DNA, 75 bp, Artificial Sequence
  Synthetic
agtatataggatttttggtgataaaatgtttatttatataataaagtaattttatgatgttgttttggaattttt

SEQ ID NO: 62431 - DNA, 75 bp, Artificial Sequence
  Synthetic
tgtttgagggattttgagttttggtttttgtaagggtgttaatttggaagttggtttatagtgaggatttatttg

SEQ ID NO: 62432 - DNA, 75 bp, Artificial Sequence
  Synthetic
tggttaaataaattattaagaaatatgagtatttatttattatgtttatatatttgattatgaaagtagagatgt

SEQ ID NO: 62433 - DNA, 75 bp, Artificial Sequence
  Synthetic
cctaagaagactataggtgcaaccaacgcgacaacagctccacacatcatcctgccaccaggaaactctgatcga

SEQ ID NO: 62434 - DNA, 75 bp, Artificial Sequence
  Synthetic
taagataattattgagttagtatatatgagttagtttaatatgaagtattttattttagttagatagtaagagag

SEQ ID NO: 62435 - DNA, 75 bp, Artificial Sequence
  Synthetic
gccaaagagttcccatccaatccgcatcgtttagtagtaccattctttaaattaacaaaagatggggaatacagt

SEQ ID NO: 62436 - DNA, 75 bp, Artificial Sequence
  Synthetic
ttattaaatttaagaattaaattttgtatttgtgttgaggatttttgtgtaaatgtttttagtgtggatttatga

SEQ ID NO: 62437 - DNA, 75 bp, Artificial Sequence
  Synthetic
aggagggaaaattttgttggtttaggttttatgtggtttattgttgatttgttgggtttttggagttttattaga

SEQ ID NO: 62438 - DNA, 75 bp, Artificial Sequence
  Synthetic
aaatttatgttagtttgagttatgatgattgtatgattttgagttttaattttaatattgtttaataatttgttg

SEQ ID NO: 62439 - DNA, 75 bp, Artificial Sequence
  Synthetic
tagtttatgatatgtagagtatttaatttgttaataaatttgagaatattggattgaattaatgatagtattttt

SEQ ID NO: 62440 - DNA, 75 bp, Artificial Sequence
  Synthetic
aggtttaattgttttttgatatgttgtgtttgtatgttgaaatggttagtgttggttgttagtagttaattagag

SEQ ID NO: 62441 - DNA, 75 bp, Artificial Sequence
  Synthetic
attagattaagggtttttgttaagggtttaattaaagattggttaattagttggttttgtatttttgttgtaagg

SEQ ID NO: 62442 - DNA, 75 bp, Artificial Sequence
  Synthetic
atgatttttaatgtttatagtggtgatttaattgtggaatttggattttgaaataaatgaggaaagagatttttt

SEQ ID NO: 62443 - DNA, 75 bp, Artificial Sequence
  Synthetic
gttattgattatgtaggggtaaagttattagtttttagtttatgtaatagggttatttttttgtgagttatatta

SEQ ID NO: 62444 - DNA, 75 bp, Artificial Sequence
  Synthetic
aatttaatattagtttaataaattttttatttttgaatagtttggttaattaagaagttatagaggttgtttaag

SEQ ID NO: 62445 - DNA, 75 bp, Artificial Sequence
  Synthetic
ataatttttttttttaggttttttttgggtgatattagattgtattgttttgtagttttagttatggtttttttt

SEQ ID NO: 62446 - DNA, 75 bp, Artificial Sequence
  Synthetic
atcttgacctcgccaggaaaattaagcgcacacaaataaattaaaaaatctgtattttctcttttttgtgtgtcc

SEQ ID NO: 62447 - DNA, 75 bp, Artificial Sequence
  Synthetic
taggttttgtttggtgtttggagtattaatattttgttgtttagatatttttagtttaattttgaaattttgtgt

SEQ ID NO: 62448 - DNA, 75 bp, Artificial Sequence
  Synthetic
ttgattgttggaatgatgtttttattttttaattgtgagggtgtttaaagtgatgtttgttgtaggtaagttttt

SEQ ID NO: 62449 - DNA, 75 bp, Artificial Sequence
  Synthetic
ttttagttaatggagttgatttggtggtgttagtttagatttatgtattaaattttaaatggttaagtttaatta

SEQ ID NO: 62450 - DNA, 75 bp, Artificial Sequence
  Synthetic
gatattattgtttttaatataatgtatgggatgtgtatagattaatttagtttagagatatttttgtggtgtatt

SEQ ID NO: 62451 - DNA, 75 bp, Artificial Sequence
  Synthetic
ttaggggtgattgatatatagttaaaagatgtgttattaattggattattttgaaatagtattttgttaaaagga

SEQ ID NO: 62452 - DNA, 75 bp, Artificial Sequence
  Synthetic
gatgaagaatgttttttggggtttaatttgaataataaggtttatttttattagatttttgtattaatttttatt

SEQ ID NO: 62453 - DNA, 75 bp, Artificial Sequence
  Synthetic
attagtttagtatttttggttataatttattttttgaaataagaataatatttttataagtttgttattgattgt

SEQ ID NO: 62454 - DNA, 75 bp, Artificial Sequence
  Synthetic
aatataataatagttaatattaaatattttttttatagtttgaagtataaagaatttatgttttgttagtttttt

SEQ ID NO: 62455 - DNA, 75 bp, Artificial Sequence
  Synthetic
ttaatattttaagagattattagtaagttatgaaatatttattttttgatgggatggattgttgttattttttgt

SEQ ID NO: 62456 - DNA, 75 bp, Artificial Sequence
  Synthetic
ttggttgagtgagaaggaggccttagagaaagaaaatcgttatctggtcattgatggccagcaattcctctggcc

SEQ ID NO: 62457 - DNA, 75 bp, Artificial Sequence
  Synthetic
agagtaaaatattatttgtgtataagaattattttgtgtaagaggtatgtttggtaggttatattatgagtgata

SEQ ID NO: 62458 - DNA, 75 bp, Artificial Sequence
  Synthetic
tgagattatgattttttttgattattgttagggttgtattatatttttttatatattagggtaattatgtatatt

SEQ ID NO: 62459 - DNA, 75 bp, Artificial Sequence
  Synthetic
ttattaatttgaaatgagagtgattatagtattgaataagttttaaaggatattgttttgattaaatatatgatg

SEQ ID NO: 62460 - DNA, 75 bp, Artificial Sequence
  Synthetic
ataggtatatggagtattgtgattaagtagaaggttatatagtgttttagttagttttattaaggggtattttta

SEQ ID NO: 62461 - DNA, 75 bp, Artificial Sequence
  Synthetic
tgagcttaggaggataatatcctgatgaattctatagaacttaggattaagaaaaaatccatgatgaagattaaa

SEQ ID NO: 62462 - DNA, 75 bp, Artificial Sequence
  Synthetic
ttagattatgagtatgtttttgggttggttgaagtttttttattatttgattgaggaattaatgtttttaatttt

SEQ ID NO: 62463 - DNA, 75 bp, Artificial Sequence
  Synthetic
ttaatgtctaagagctattattttgtaccctcttagcctagacactgcccaacatataagccatgcagcaggata

SEQ ID NO: 62464 - DNA, 75 bp, Artificial Sequence
  Synthetic
gaaataatgatagtagaatttttatatggtaattggagagtaatatttaagaatgtagtgataaatataattagg

SEQ ID NO: 62465 - DNA, 75 bp, Artificial Sequence
  Synthetic
gattgttggttttattgttgttatagtgtagttttaaaattgttttttttattattgtgtaattgttgatatatt

SEQ ID NO: 62466 - DNA, 75 bp, Artificial Sequence
  Synthetic
ttgagaatgggttttgtttgattttgtttaagttttttgtgttttaggtgtgttttatataaaagatttagttgg

SEQ ID NO: 62467 - DNA, 75 bp, Artificial Sequence
  Synthetic
gattttgagaatttttttgttattatagtatatagagttaataatgtttttaattttgaattttttatggttttg

SEQ ID NO: 62468 - DNA, 75 bp, Artificial Sequence
  Synthetic
atgttttgttttgtttagtgttttgttgttttgattagtgttaataaggtaatttttggattttttttttgttgg

SEQ ID NO: 62469 - DNA, 75 bp, Artificial Sequence
  Synthetic
aaattattagttgttggatttgttaagtgtgagtttttgggtgtagttatatttaattgttgttttattgattta

SEQ ID NO: 62470 - DNA, 75 bp, Artificial Sequence
  Synthetic
taagttttatgggtgattagtaggagtaattttttattagttaaattttttaattggtgattttttttgtaaaaa

SEQ ID NO: 62471 - DNA, 75 bp, Artificial Sequence
  Synthetic
ttattgttatataaaaattttttttttaaggttggatatatgtttttaggtgttggaggaattgttaatggttta

SEQ ID NO: 62472 - DNA, 75 bp, Artificial Sequence
  Synthetic
attttttttttatgaaatatagtaggaatgtgtatttgtgaggtgttttttgattgatggtatttattttgataa

SEQ ID NO: 62473 - DNA, 75 bp, Artificial Sequence
  Synthetic
cctaatcaattgataatgctgtcaatagggaaattcccctgtattgtaataagacatttttaacatatttcccct

SEQ ID NO: 62474 - DNA, 75 bp, Artificial Sequence
  Synthetic
ttttttttggatgatgattgtgtttgaatatggtggttgtgtttattttttgaatgttgtttggtagtttgtggg

SEQ ID NO: 62475 - DNA, 75 bp, Artificial Sequence
  Synthetic
tgtttttttttatatgaagtttttatttaaaagttgtttttatttattgtttaaatttttattgattttttgatt

SEQ ID NO: 62476 - DNA, 75 bp, Artificial Sequence
  Synthetic
aatgttttatgtgtgttaggttgtaattaaattttattggtttgtagatttgattattataatttaataaaaagg

SEQ ID NO: 62477 - DNA, 75 bp, Artificial Sequence
  Synthetic
ttttttttttttgttattaaagataattgttatgattgtagaattaaggatgaagattaaagataattgaaagat

SEQ ID NO: 62478 - DNA, 75 bp, Artificial Sequence
  Synthetic
tattttttttttaatttttattaagtttattatttttaaagagataattagattgatgttaaattttgtttatga

SEQ ID NO: 62479 - DNA, 75 bp, Artificial Sequence
  Synthetic
ttaattgtgagtttaaaggagttagaattatattggttatgtttaaagttttagtgtattatattattatttgtt

SEQ ID NO: 62480 - DNA, 75 bp, Artificial Sequence
  Synthetic
aagtaattttagatttaagtaatttatataattaaattttggttttattgatttgaggttgagtttttttatgaa

SEQ ID NO: 62481 - DNA, 75 bp, Artificial Sequence
  Synthetic
gtaatttgaagaaaaattaaaagataaatttgtatatatagaataaagtgataattgtaattataatgtttgtaa

SEQ ID NO: 62482 - DNA, 75 bp, Artificial Sequence
  Synthetic
ttttaatatttgttggtatttattgtttttattttgtttattaattgttattgtttttttggtttggaagggttt

SEQ ID NO: 62483 - DNA, 75 bp, Artificial Sequence
  Synthetic
tattaataaaattatgaataatttgattaattttgtttgttatgtttttggtttaattatgtggtttgatatagt

SEQ ID NO: 62484 - DNA, 75 bp, Artificial Sequence
  Synthetic
agtttggttttagaatgtggtatgtgttgttttattgttgtagtaagaaattaattgttttatggttgaggattg

SEQ ID NO: 62485 - DNA, 75 bp, Artificial Sequence
  Synthetic
aaaaggtgtgtagtttagttgtggtttttaggaatagttgaagagtttgagttgttttgttggttagttgtttta

SEQ ID NO: 62486 - DNA, 75 bp, Artificial Sequence
  Synthetic
ttccttttccagctgaatgataccattcaccttcaccaacagttgagcaataccactgggagactgatttggaca

SEQ ID NO: 62487 - DNA, 75 bp, Artificial Sequence
  Synthetic
cattgcacataccagaaggggaaacaacattgccgtctcagaattcgacagaaggtcgaagagtaggtgtgaata

SEQ ID NO: 62488 - DNA, 75 bp, Artificial Sequence
  Synthetic
atttatagattaaattattttgattgtgtattagtttttttatgtaaatttttttggttgttggtttgaaatatg

SEQ ID NO: 62489 - DNA, 75 bp, Artificial Sequence
  Synthetic
gtatttaggttagtttgattgtagtatttttattttgagtagtttagtaatgtaaattagggttgtatttgggtt

SEQ ID NO: 62490 - DNA, 75 bp, Artificial Sequence
  Synthetic
gagtattgataattgtttttttttgagttttttttttgtttgtgattagttttgtgattttagtaatagtattgg

SEQ ID NO: 62491 - DNA, 75 bp, Artificial Sequence
  Synthetic
taattaagtttagttttttgttgttggtatttttttttttggtattttggtgatgagtgttgttgttgttagtgg

SEQ ID NO: 62492 - DNA, 75 bp, Artificial Sequence
  Synthetic
ttttgttgtggttttggggatttgttgtggtggtggggtttaggaagttagtgtttttgtttgtgttggtgtttt

SEQ ID NO: 62493 - DNA, 75 bp, Artificial Sequence
  Synthetic
ttgtttttgggggtttggttgtggttgtggtagagggagtgttggaggttgtgttgttgttgtttgttttgtggt

SEQ ID NO: 62494 - DNA, 75 bp, Artificial Sequence
  Synthetic
gaaaatcaggctaatgccaagttctgtgcaaaacttgaaagtaggtttacaaaaatcctttgaactggaatgctt

SEQ ID NO: 62495 - DNA, 75 bp, Artificial Sequence
  Synthetic
gtgcaaaacttgaaagtaggtttacaaaaatcctttgaactggaatgctttgatactctttctcaatactatata

SEQ ID NO: 62496 - DNA, 75 bp, Artificial Sequence
  Synthetic
gatgttgtttaatttgagttgttttagagatgttaagtttatatatgggtgtattatgggtgttgttgtttggat

SEQ ID NO: 62497 - DNA, 75 bp, Artificial Sequence
  Synthetic
ttggtttggttgtgagggattggggatttgtggagattgtggtaagggttgttagatgtgatattgtagtttttt

SEQ ID NO: 62498 - DNA, 75 bp, Artificial Sequence
  Synthetic
ttttttgattgtgtatttgaattattgtagaggaattttttgaagttatgattttgtggtttttagttgttgtgt

SEQ ID NO: 62499 - DNA, 75 bp, Artificial Sequence
  Synthetic
tggtttttgggttggaagaagtttgtgttggattttgattattgatgtttttggttttgtttgatataattgtga

SEQ ID NO: 62500 - DNA, 75 bp, Artificial Sequence
  Synthetic
tactgtccctccagcacctaaggatatttgtcctactctcagaaaaggatttctatgtgatagtaatttctgtaa

SEQ ID NO: 62501 - DNA, 75 bp, Artificial Sequence
  Synthetic
aagataattttttattgtgaatttttttagtgaggtttttttagttttttagaaggtttattttttgattgttgt

SEQ ID NO: 62502 - DNA, 75 bp, Artificial Sequence
  Synthetic
attaattttggggttgattttttaaattagtttttttgtggtattgtttttttttttatttgtatatattgtttt

SEQ ID NO: 62503 - DNA, 75 bp, Artificial Sequence
  Synthetic
atttagttggagtagaaattgtggtgtgaattttgatttaagttggatgtaggttaaattgttaattttgaataa

SEQ ID NO: 62504 - DNA, 75 bp, Artificial Sequence
  Synthetic
gtattttgttttattggttttaaaattggtagtttgatatttaattgtggtagaatagtagttattagatgggtt

SEQ ID NO: 62505 - DNA, 75 bp, Artificial Sequence
  Synthetic
ttttgttgtattgattggtttttttaaggggtgtgagttgaagaagttttttttagtttggggtagtattagaaa

SEQ ID NO: 62506 - DNA, 75 bp, Artificial Sequence
  Synthetic
tgtaatgatatttttagtgaaagttgttttttggtagataattgtggaagtaagttgattatataggaagaaagt

SEQ ID NO: 62507 - DNA, 75 bp, Artificial Sequence
  Synthetic
attttttttatggaaggtaaagtttttggtatatggttttgtttttgatattttgtgtatatattggtattgggg

SEQ ID NO: 62508 - DNA, 75 bp, Artificial Sequence
  Synthetic
gaagttttgaattttgtttggtgttgttggtagatatttatttttgttaggttttttgattttaagattgtagta

SEQ ID NO: 62509 - DNA, 75 bp, Artificial Sequence
  Synthetic
gtttttagtttatttattagttttataattgattatttttggtgggatattggatttgaagttttattttttagt

SEQ ID NO: 62510 - DNA, 75 bp, Artificial Sequence
  Synthetic
tgtagatggtatgttagttgttattttattttttttgagatttagtttaattgattttaattgatttgtggatga

SEQ ID NO: 62511 - DNA, 75 bp, Artificial Sequence
  Synthetic
ccctgaacttaattgctgattggttactaacaacatctactaatcacttcaacatgagaactcaacgagtgaagg

SEQ ID NO: 62512 - DNA, 75 bp, Artificial Sequence
  Synthetic
tagtttgttatgataaattagtttgttgatattattaatttgtaatgtgttattgtggatgattttaagtgggat

SEQ ID NO: 62513 - DNA, 75 bp, Artificial Sequence
  Synthetic
ggaaaatgttttttggaaaaggataattatttaaagaaagaatgatgtttttttgaattgattatgaggtaattg

SEQ ID NO: 62514 - DNA, 75 bp, Artificial Sequence
  Synthetic
taatatttttgtaatgtttattgtgttgttgttttataatatttttttagtggagtttattttggttatatgatt

SEQ ID NO: 62515 - DNA, 75 bp, Artificial Sequence
  Synthetic
gaaaaggatttgatgatttttattttggaaaataaataatttaagagagatgaagattatgtttattgttggttt

SEQ ID NO: 62516 - DNA, 75 bp, Artificial Sequence
  Synthetic
aatttttattgttgatttttttttaattagaagggtaatgtttgtatttggattgtgaataatttagaaatgggt

SEQ ID NO: 62517 - DNA, 75 bp, Artificial Sequence
  Synthetic
tttgattttttttttatatttttaatttaagttatattggttatttttagatgtaagtatgtaggtaatttgagg

SEQ ID NO: 62518 - DNA, 75 bp, Artificial Sequence
  Synthetic
ataagggtaaaaagtatgtgtaatgagaaagattaatatttgaattattgtattgattatagtaggattatttgt

SEQ ID NO: 62519 - DNA, 75 bp, Artificial Sequence
  Synthetic
aatgttattagttatgattttttattaattaattttttaaaaataagtatattatgagttttttgttaagtttta

SEQ ID NO: 62520 - DNA, 75 bp, Artificial Sequence
  Synthetic
tatttaggagagaaaaaagataatggtgtaaagtatttttagtatattgattaattaaaagtgttttttttaatg

SEQ ID NO: 62521 - DNA, 75 bp, Artificial Sequence
  Synthetic
gatggattattaaatagatgttattattatttttgagaagattttataaaattggatttgagttaattattgtaa

SEQ ID NO: 62522 - DNA, 75 bp, Artificial Sequence
  Synthetic
ttattttttaattatagttggaagatttgtaggagaatgatatgtgttataattttgtgtgattattatggtgag

SEQ ID NO: 62523 - DNA, 75 bp, Artificial Sequence
  Synthetic
gttttttggagttattgggtttaatttaatgtattttggtaaaagaatagggatgattggttgtttatttttaga

SEQ ID NO: 62524 - DNA, 75 bp, Artificial Sequence
  Synthetic
acagagagggaacaaaaggagagcctccttcaccaagcatcctggcatcatacaagtgatgatttcggagagcat

SEQ ID NO: 62525 - DNA, 75 bp, Artificial Sequence
  Synthetic
agttatttttttattggttagtttgtggattagagtttttggtattttgatttttatgatatttttggttggatt

SEQ ID NO: 62526 - DNA, 75 bp, Artificial Sequence
  Synthetic
aattggaatgattttaaagttttggagtgaagttattattgtttggattttttttggagatgttagattggtatt

SEQ ID NO: 62527 - DNA, 75 bp, Artificial Sequence
  Synthetic
gttttttttttttttatttttgttgggtaaaagaatggggtgaagttttggatgaaatgaaatttttggatgtaa

SEQ ID NO: 62528 - DNA, 75 bp, Artificial Sequence
  Synthetic
tgttttatttgattttgttggagtgttattggtttatgttgtagtaggtagtggttgggtgattagtttgagtgt

SEQ ID NO: 62529 - DNA, 75 bp, Artificial Sequence
  Synthetic
tgttaaattaaaggtgaaatattggggtagttggattggtggaagaatgaatttttggaggaaagtttggttttt

SEQ ID NO: 62530 - DNA, 75 bp, Artificial Sequence
  Synthetic
aatttgtaggagtttgaggggatgatttgggattttaggatttagttgattgattttgataagtggattggttgt

SEQ ID NO: 62531 - DNA, 75 bp, Artificial Sequence
  Synthetic
tttgttgaaatgggtgatagtgtatgaagtaagtatgatggtggttgtagttgagttaaagttgtaggttttttg

SEQ ID NO: 62532 - DNA, 75 bp, Artificial Sequence
  Synthetic
attagtgatatttagaggaagttaaattggaatttgttttattagtattttggggtttgatatgatatttattat

SEQ ID NO: 62533 - DNA, 75 bp, Artificial Sequence
  Synthetic
acaagatcctttacaacccacttcttaacgtatcctaaaatagggctcctatacagttttggagccctcataagt

SEQ ID NO: 62534 - DNA, 75 bp, Artificial Sequence
  Synthetic
agttttaaggatgaatgttgatgatatattgtttggtgtgtggttggtatggttgatggtgttattggtaattgg

SEQ ID NO: 62535 - DNA, 75 bp, Artificial Sequence
  Synthetic
tttgagtggatttgatggagtgtttttattgattgattttggtgttaggaagtttgtattgttgttgttattttt

SEQ ID NO: 62536 - DNA, 75 bp, Artificial Sequence
  Synthetic
agtaattgttgaatttgatttgatagggtatatggtttttatatatttaggaggagtagtaggtaatataatttg

SEQ ID NO: 62537 - DNA, 75 bp, Artificial Sequence
  Synthetic
ttttatatttttaataattttgtttaatgtttataagatgaaggttaatgaaaaaatatttttttagttgaggta

SEQ ID NO: 62538 - DNA, 75 bp, Artificial Sequence
  Synthetic
ggttttttttaatttttattatttttggtttgggttatttaataataattgattataatattgttagagatatag

SEQ ID NO: 62539 - DNA, 75 bp, Artificial Sequence
  Synthetic
caagcaattttttccatgcatcattggcttattggagaggtcgacatagacctaagaagactataggtgcaacta

SEQ ID NO: 62540 - DNA, 75 bp, Artificial Sequence
  Synthetic
tttttattatatttatattttaagttgttagtgagatatgaataattttattttggttgtttaattgatttatat

SEQ ID NO: 62541 - DNA, 75 bp, Artificial Sequence
  Synthetic
tatttagggttgatatttataagtgtattattaatgtaatgtattttatagtttagtagttgaagtttttgttat

SEQ ID NO: 62542 - DNA, 75 bp, Artificial Sequence
  Synthetic
tatttgttttttttggagggaagggagattggtttaaattttgagtttaagtgttttattattttgaagttgaaa

SEQ ID NO: 62543 - DNA, 75 bp, Artificial Sequence
  Synthetic
aatatatatttaattttgattaattttgggtgatggtgggattggatgtaagtttttttggtaagtttggggaat

SEQ ID NO: 62544 - DNA, 75 bp, Artificial Sequence
  Synthetic
gttattttgagagtggatgtggatgataggtggagtagtattttggaagattggaattttttttgtaatttgaat

SEQ ID NO: 62545 - DNA, 75 bp, Artificial Sequence
  Synthetic
tagggtatattgaggagagttttttttagttaggttggtttggaatttagtatgaatgatgtttaatgagttgtt

SEQ ID NO: 62546 - DNA, 75 bp, Artificial Sequence
  Synthetic
atttttttttaatttataaattatttgtattaattggtggaaagtagttttaaaattaggtaagtgattatatat

SEQ ID NO: 62547 - DNA, 75 bp, Artificial Sequence
  Synthetic
aatgttttttaaattttttgttgaaatgttaggttttttaaaattttttttagttagtgaagtggtattgtttag

SEQ ID NO: 62548 - DNA, 75 bp, Artificial Sequence
  Synthetic
attgttgaatgtttttttaatattttgagggatggttttatttttagatttaattttattttgaattgtattttt

SEQ ID NO: 62549 - DNA, 75 bp, Artificial Sequence
  Synthetic
tttataaagtgatggtttaggtggtggttgattatgtttggtttaataagttttagttgttgtagtggttgttgt

SEQ ID NO: 62550 - DNA, 75 bp, Artificial Sequence
  Synthetic
gaagcaccgattcaaggtttctaagacgctctatcgattatgttgataatgtaaataacagcttttcctgtccat

SEQ ID NO: 62551 - DNA, 75 bp, Artificial Sequence
  Synthetic
tgtttgattggttgttattattagaagattatattttgtaattattttagtataaattttgtttaatgaggagat

SEQ ID NO: 62552 - DNA, 75 bp, Artificial Sequence
  Synthetic
tgtttttgttatattataaattggttttagattatttttaagatttgtaatgtgttgttttaatgattttgatgt

SEQ ID NO: 62553 - DNA, 75 bp, Artificial Sequence
  Synthetic
tagtaatgtgtttcacatgacagattatttctaacactaaattgcaatttcaatttaaaagctaaggttagcacc

SEQ ID NO: 62554 - DNA, 75 bp, Artificial Sequence
  Synthetic
gatggtttgttgttgtataatagtagttaatgaagttaatgtttgtattatttttttaaaattatgattgtaaat

SEQ ID NO: 62555 - DNA, 75 bp, Artificial Sequence
  Synthetic
tgggtttgtttgggtttgattgttgtgtgtttttgggtttggttttgtttgttgtatttgggatgtgtagtataa

SEQ ID NO: 62556 - DNA, 75 bp, Artificial Sequence
  Synthetic
tcttgacctcgccaggaaaattaagcgcacacaaataaattaaaaaatctgtattttctcttttttgtgtgtcca

SEQ ID NO: 62557 - DNA, 75 bp, Artificial Sequence
  Synthetic
ttttggattgtttttaatattatagaagatgttgtttataggaatttttttggttattagttgtttagagattta

SEQ ID NO: 62558 - DNA, 75 bp, Artificial Sequence
  Synthetic
gtttgaaagtttagggtttggtattttgttgttttgagttgtggttgtagtatggtttttgttttttgttttagt

SEQ ID NO: 62559 - DNA, 75 bp, Artificial Sequence
  Synthetic
gtgtggaacctcattggatatttgatcgtacacaaaatatctttacaaaattgttttctcttttttgtgtgtcca

SEQ ID NO: 62560 - DNA, 75 bp, Artificial Sequence
  Synthetic
tgttattttgttagattagttttttttttatattgaagataataagttttgagtgttagagaatttaattgatgt

SEQ ID NO: 62561 - DNA, 75 bp, Artificial Sequence
  Synthetic
aaggatgatgaaggttttaatttttattattagtttttttttaattataaaatgattgtgtaaatgttgggtagg

SEQ ID NO: 62562 - DNA, 75 bp, Artificial Sequence
  Synthetic
ttagtaggtaagttataaaagtataatgtaatttaatttagataaattgttagttagaatattgagttataatta

SEQ ID NO: 62563 - DNA, 75 bp, Artificial Sequence
  Synthetic
tggttataattgtggtttaatgtttatttgtattaagatttaaattgaattttgaaaaatggttagtaataataa

SEQ ID NO: 62564 - DNA, 75 bp, Artificial Sequence
  Synthetic
gttagttttaaatttaaaaataagaattatttttattgtgataataatttatattttagatattaaaaatttttt

SEQ ID NO: 62565 - DNA, 75 bp, Artificial Sequence
  Synthetic
ttgtttttgttttttgattatttaatgttagttatttgttggttgaattattttattgttttatgtttatttatt

SEQ ID NO: 62566 - DNA, 75 bp, Artificial Sequence
  Synthetic
gatgatgttgtaggattgttatgaatttatttttgtgatttattattggttaataaaattgttgattatttaatg

SEQ ID NO: 62567 - DNA, 75 bp, Artificial Sequence
  Synthetic
taataaatttattttttttatttatagttttttttttagtgagttatggtggatatttttttttaagggagtttg

SEQ ID NO: 62568 - DNA, 75 bp, Artificial Sequence
  Synthetic
gatatgtgtattttttgttattattggtattgaaaattataggtttattttttattatatgataatataaaatag

SEQ ID NO: 62569 - DNA, 75 bp, Artificial Sequence
  Synthetic
tattaaatggtttttgtgattttagaatgtggtgatatatttttttaaaagagtgttttgattgggtgttgttat

SEQ ID NO: 62570 - DNA, 75 bp, Artificial Sequence
  Synthetic
tgttttggtttttggttttttgagtgtggttttgattttgttgtttgttttgtgggagttttttttttttagagt

SEQ ID NO: 62571 - DNA, 75 bp, Artificial Sequence
  Synthetic
gatttttgtatatgggagttggtggggtgatagtgggtgtgtggttggaagttttgtttttgttttgttttttat

SEQ ID NO: 62572 - DNA, 75 bp, Artificial Sequence
  Synthetic
tatttgattttaagggtggaaggttagatgttttgttgttggtattgtttagtgggtttgtttttttgttaattg

SEQ ID NO: 62573 - DNA, 75 bp, Artificial Sequence
  Synthetic
gtgttagtatgtgagggttggttgagttggagggtttattttttttgttattgtttgtgagtggtgtattggtgt

SEQ ID NO: 62574 - DNA, 75 bp, Artificial Sequence
  Synthetic
ggtggattgttttgtgagggtttgggatattttgaattggtttggattgtgtttgtttgttttttatatgttggt

SEQ ID NO: 62575 - DNA, 75 bp, Artificial Sequence
  Synthetic
ttttttgattgtttttttgttgtttatttttggttgatttattaggtattggtttagtgtttttgttgtttttgt

SEQ ID NO: 62576 - DNA, 75 bp, Artificial Sequence
  Synthetic
ttagattgaataggattaagttatttggtgtatttatgttgttttttgagtaattttggtatttgttgtagtttt

SEQ ID NO: 62577 - DNA, 75 bp, Artificial Sequence
  Synthetic
tattattgggattaattattatattgggaatggttgtattttgtgagttagttggattattattttgatggttag

SEQ ID NO: 62578 - DNA, 75 bp, Artificial Sequence
  Synthetic
gattgttgttattattgatgggttttggaaagggaatgttgttattattattgtaatgtttatttgttttgggta

SEQ ID NO: 62579 - DNA, 75 bp, Artificial Sequence
  Synthetic
gtgatgtagtagtgatagtttttgttagtttggttaggtgttttttttttagagttattatagtgtttgtttgtt

SEQ ID NO: 62580 - DNA, 75 bp, Artificial Sequence
  Synthetic
ggaagttgattttgttttttttttgatggaagtttataagaattttttttttttgattattaagtttaagatggt

SEQ ID NO: 62581 - DNA, 75 bp, Artificial Sequence
  Synthetic
taagtttgtgagattttgtatattgttggagttgttttttagttttagtggtagtttttttgagttgttgatatt

SEQ ID NO: 62582 - DNA, 75 bp, Artificial Sequence
  Synthetic
gttttttaatatttatttttgtgagggtatttttgtgtgttgtggtgattttgagtgtaattgttgatagttgag

SEQ ID NO: 62583 - DNA, 75 bp, Artificial Sequence
  Synthetic
ggaaaagattatgtttaagattatttattttagaaaggtttaaaagttgggtgaaaggagtatattttttatgtt

SEQ ID NO: 62584 - DNA, 75 bp, Artificial Sequence
  Synthetic
tggttagggagttgagtgtagttttaaaggagtttattttattttttattttggtggtttttgtaagaggatgga

SEQ ID NO: 62585 - DNA, 75 bp, Artificial Sequence
  Synthetic
gatgaattttttgttttgttttttgtaggatatgattaagtattgttttgataattaataagtttgaaaaatgag

SEQ ID NO: 62586 - DNA, 75 bp, Artificial Sequence
  Synthetic
tttgagttattgaatttgaaattatagtattgttggtattatgtttggtaattatgtgtattttttggtgtatta

SEQ ID NO: 62587 - DNA, 75 bp, Artificial Sequence
  Synthetic
ggagaaatttgattagaaaatttgtttgtattaaatggaaaattattattatgtgttttattgattgttaagttg

SEQ ID NO: 62588 - DNA, 75 bp, Artificial Sequence
  Synthetic
ttggatattgtattagtttttgttttgtatgtatttgaatttgtttttgaatttttttaaggtaagttttttttt

SEQ ID NO: 62589 - DNA, 75 bp, Artificial Sequence
  Synthetic
ttattattaattttggaaggaatagatttgtaaaggagagaaattgattggtattagttttagttgttttttttt

SEQ ID NO: 62590 - DNA, 75 bp, Artificial Sequence
  Synthetic
ttggtatggtagtaagtgtttttttaatgttttttttattagatattgttggtagtaattttttaaggtgtttta

SEQ ID NO: 62591 - DNA, 75 bp, Artificial Sequence
  Synthetic
ttttattatgttttttgattttaaaatggaatttgtgtttttttaaatatttgattgtgttattttttaagaaaa

SEQ ID NO: 62592 - DNA, 75 bp, Artificial Sequence
  Synthetic
gtttgtaatttttttggtatgtatgatgaagataaagtatgagaaggaaattgtttgtatttttttgaaaattaa

SEQ ID NO: 62593 - DNA, 75 bp, Artificial Sequence
  Synthetic
tatttgttttaaaggtttgtatgataagttggtaaatttttttaagattgtttatttgatatattgggatgattt

SEQ ID NO: 62594 - DNA, 75 bp, Artificial Sequence
  Synthetic
tttgttgaataattttttgttgaatggatagatttgttgttaagattttgtggtaatttatgttagatttagtga

SEQ ID NO: 62595 - DNA, 75 bp, Artificial Sequence
  Synthetic
gatttggtgttatttagattttttgaggatgagaatttatatttggaattttgtgattttgagtaatttgttttt

SEQ ID NO: 62596 - DNA, 75 bp, Artificial Sequence
  Synthetic
taattatttttaatgttttattttaagttttagggttgttgaatttttaattttttaagtgtttaagtttaaaat

SEQ ID NO: 62597 - DNA, 75 bp, Artificial Sequence
  Synthetic
taaggttaatttttaattttgtttgtttgattgtgaattaatgttgttttttaataataatgtttttattaaggt

SEQ ID NO: 62598 - DNA, 75 bp, Artificial Sequence
  Synthetic
tgttggattattttgtagagtttgaggtggaatttgtgatgtgataagatttaggtgttgataagggatttttaa

SEQ ID NO: 62599 - DNA, 75 bp, Artificial Sequence
  Synthetic
ttgagtatattgatgtttttgttttttttggagatttaggttgttttttatttttgtgatgtggttttgaaataa

SEQ ID NO: 62600 - DNA, 75 bp, Artificial Sequence
  Synthetic
attaggtgtgattatagtaataattttaatttaaattttgatataaattttaatgagaggaaaattattaatttt

SEQ ID NO: 62601 - DNA, 75 bp, Artificial Sequence
  Synthetic
gaaaattattaattttttttatagttatttgtatataaaagattttaaaaatttttttttttttttgtgtgtttg

SEQ ID NO: 62602 - DNA, 75 bp, Artificial Sequence
  Synthetic
agacacacaaaaacaagagatgatgattttgtgtatcatataaataaagaagaatattaacattgacattgagac

SEQ ID NO: 62603 - DNA, 75 bp, Artificial Sequence
  Synthetic
ttgtcagtctgttaatattcttgaagagatggatttacacagtttgttggagttgggtacaaaacccactgcccc

SEQ ID NO: 62604 - DNA, 75 bp, Artificial Sequence
  Synthetic
tcatgttcgtaataagaaagtgatattatttgacacaaatcatcaggttagtatctgtaatcagataatagatgc

SEQ ID NO: 62605 - DNA, 75 bp, Artificial Sequence
  Synthetic
aataaactcagggattgatcttggagatctcctagaagggggtttgctgacgttgtgtgttgagcattactataa

SEQ ID NO: 62606 - DNA, 75 bp, Artificial Sequence
  Synthetic
ttctgataaggataaattcaacacaagtcctatcgcgaagtacttacgtgatgcgggctatgaatttgatgtcat

SEQ ID NO: 62607 - DNA, 75 bp, Artificial Sequence
  Synthetic
caagaatgcagatgcaacccgctttctggatgtgattcctaatgaacctcattacagccctttaattctagccct

SEQ ID NO: 62608 - DNA, 75 bp, Artificial Sequence
  Synthetic
taagacattggaaagtactgaatctcagagggggagaattgggctctttttatcattttgcagtcttttcctccc

SEQ ID NO: 62609 - DNA, 75 bp, Artificial Sequence
  Synthetic
aaaacttgtcgtcggagaccgagctagtatcgaaaaggctttaagacaagtaacagtgcatcaagaacaggggat

SEQ ID NO: 62610 - DNA, 75 bp, Artificial Sequence
  Synthetic
ctagtttataattgcaagagtacagcaagcaattttttccatgcatcattggcttattggagaggtcgacataga

SEQ ID NO: 62611 - DNA, 75 bp, Artificial Sequence
  Synthetic
cgtcacataccctaatcattggcttaccacaggccacatgaaagtaattttcgggattttgaggtccagcttcat

SEQ ID NO: 62612 - DNA, 75 bp, Artificial Sequence
  Synthetic
tttaaagtttgtgttgattcatcaaggagtaaatttggtgacaggtcatgatgcctatgacagtatcattagtaa

SEQ ID NO: 62613 - DNA, 75 bp, Artificial Sequence
  Synthetic
ttcagtaggtcaaactagattctcaggacttcttatcgtgaaaacagttctcgagttcatcttgcaaaaaactga

SEQ ID NO: 62614 - DNA, 75 bp, Artificial Sequence
  Synthetic
ttcaggggtgacactacatcctttggtgcggacctccaaagtaaaaaatgaagttgctagtttcaagcaggcgtt

SEQ ID NO: 62615 - DNA, 75 bp, Artificial Sequence
  Synthetic
gagcaacctagcccgacatggggaatacgcaccatttgcacgggttctgaatttatcagggattaacaacctcga

SEQ ID NO: 62616 - DNA, 75 bp, Artificial Sequence
  Synthetic
acatggactctatcctcagctttcagcaattgcgctgggtgtggcaacagcacacggcagtacattggctggtgt

SEQ ID NO: 62617 - DNA, 75 bp, Artificial Sequence
  Synthetic
caatgttggcgaacaatatcaacaactacgagaggcggcacatgatgcggaagtaaaactacaaaggcgacatga

SEQ ID NO: 62618 - DNA, 75 bp, Artificial Sequence
  Synthetic
acatcaggaaattcaagctattgccgaggatgacgaggaaaggaagatattagaacaattccaccttcagaaaac

SEQ ID NO: 62619 - DNA, 75 bp, Artificial Sequence
  Synthetic
tgaaatcacacacagtcagacactagccgtcctcagccagaaacgagaaaaattagctcgtctcgctgcagaaat

SEQ ID NO: 62620 - DNA, 75 bp, Artificial Sequence
  Synthetic
tgaaaacaatattgtggaagatcagggatttaagcaatcacagaatcgggtgtcacagtcgtttttgaatgaccc

SEQ ID NO: 62621 - DNA, 75 bp, Artificial Sequence
  Synthetic
tacacctgtggaagtaacggttcaagccaggcccatgaatcgaccaactgctctgcctcccccagttgacgacaa

SEQ ID NO: 62622 - DNA, 75 bp, Artificial Sequence
  Synthetic
gattgagcatgaatctacagaagatagctcttcttcaagtagctttgttgacttgaatgatccatttgcactgct

SEQ ID NO: 62623 - DNA, 75 bp, Artificial Sequence
  Synthetic
gaatgaggacgaggatactcttgatgacagtgtcatgatcccgggcacaacatcgagagaatttcaagggattcc

SEQ ID NO: 62624 - DNA, 75 bp, Artificial Sequence
  Synthetic
tgaaccgccaagacaatcccaagacctcaataacagccaaggaaagcaggaagatgaatccacaaatccgattaa

SEQ ID NO: 62625 - DNA, 75 bp, Artificial Sequence
  Synthetic
gaaacagtttctgagatatcaagaattgcctcctgttcaagaggatgatgaatcggaatacacaactgactctca

SEQ ID NO: 62626 - DNA, 75 bp, Artificial Sequence
  Synthetic
agaaagcatcgaccaaccaggatccgacaatgaacaaggagttgatcttccacctcctccgttgtacgctcagga

SEQ ID NO: 62627 - DNA, 75 bp, Artificial Sequence
  Synthetic
aaaaagacaggacccaatacagcacccagcagcaaaccctcaggatcccttcggcagtattggtgatgtaaatgg

SEQ ID NO: 62628 - DNA, 75 bp, Artificial Sequence
  Synthetic
tgatatcttagaacctataagatcaccttcttcaccatctgctcctcaggaagacacaaggatgagggaagccta

SEQ ID NO: 62629 - DNA, 75 bp, Artificial Sequence
  Synthetic
tgaattgtcgcctgatttcacaaatgatgaggataatcagcagaattggccacaaagagtggtgacaaagaaggg

SEQ ID NO: 62630 - DNA, 75 bp, Artificial Sequence
  Synthetic
tagaactttcctttatcctaatgatcttctgcaaacaaatcctccagagtcacttataacagccctcgttgagga

SEQ ID NO: 62631 - DNA, 75 bp, Artificial Sequence
  Synthetic
ataccaaaatcctgtctcagctaaggagcttcaagcagattggcccgacatgtcatttgatgaaaggagacatgt

SEQ ID NO: 62632 - DNA, 75 bp, Artificial Sequence
  Synthetic
tgcgatgaacttgtagtccagataacacagcacggttactcacttatctattttgatatgactcatcctcagatc

SEQ ID NO: 62633 - DNA, 75 bp, Artificial Sequence
  Synthetic
acagcaatcaaatttatttgaatatttgaaccaccttttagtatcctattacttgttactattgtgtgagacaac

SEQ ID NO: 62634 - DNA, 75 bp, Artificial Sequence
  Synthetic
ataagccatcaaataacaatcacgggcaaggactgggcatactatggtggtcttagagcattgtccagtgctaca

SEQ ID NO: 62635 - DNA, 75 bp, Artificial Sequence
  Synthetic
aattcttttttcaattgctataattatacaactacaaacctccatacatttgccgcaacactgtaatcaacactg

SEQ ID NO: 62636 - DNA, 75 bp, Artificial Sequence
  Synthetic
ctgtatctcttcttcaagccatctgatttaacttaataaacatgacttgattcaaagaatatactgacaatgtta

SEQ ID NO: 62637 - DNA, 75 bp, Artificial Sequence
  Synthetic
ctgtttgaatttctcaagtggtgcactatcctactgttttgctcagcttagtatattgtaatatgtaagtggact

SEQ ID NO: 62638 - DNA, 75 bp, Artificial Sequence
  Synthetic
ctccccttctcctctcgtgtattctttataaatcacttacttgatagaatgtcgagtctactggtttggagtttc

SEQ ID NO: 62639 - DNA, 75 bp, Artificial Sequence
  Synthetic
cttactctaatggatgtaataattaactgttggcctagatgataacagatatgaggttatataattactcatagt

SEQ ID NO: 62640 - DNA, 75 bp, Artificial Sequence
  Synthetic
gtaaagtataattcttacctctgtttcttctgttttccctttcttttataatatgccaattaagaaaaactaaaa

SEQ ID NO: 62641 - DNA, 75 bp, Artificial Sequence
  Synthetic
atcgaagaatattaaagattttctttaatattcagaaaaggctttttattctattctttctttttacaaacgtat

SEQ ID NO: 62642 - DNA, 75 bp, Artificial Sequence
  Synthetic
tgaaatagtaattctcacaatgtgggactcatcatacatgcagcaagtcagcgaagggttgatgactggaaaagt

SEQ ID NO: 62643 - DNA, 75 bp, Artificial Sequence
  Synthetic
acccatagatcaagtgtttggtgccaatcccttagagaagttatacaagagaagaaaaccaaaaggcacagttgg

SEQ ID NO: 62644 - DNA, 75 bp, Artificial Sequence
  Synthetic
actacaatgtagcccttgtctaatgtcaaaggcgacaagtactgatgatattatttgggaccaactgatcgtgaa

SEQ ID NO: 62645 - DNA, 75 bp, Artificial Sequence
  Synthetic
gagaacactagctgatctacttataccgataaataggcagatatcagacattcaaagcactctaagcgaagtaac

SEQ ID NO: 62646 - DNA, 75 bp, Artificial Sequence
  Synthetic
aacaagagtccatgaaattgagcggcaattacatgagattaccccagttttaaaaatgggaaggacactggaagc

SEQ ID NO: 62647 - DNA, 75 bp, Artificial Sequence
  Synthetic
aatttccaaggggatgtcagaaatgttagccaaatacgaccaccttgtaatttcaactggaagaaccactgcacc

SEQ ID NO: 62648 - DNA, 75 bp, Artificial Sequence
  Synthetic
agctgctgcctttgatgcctacttaaatgagcatggtgtccctccccctcaacccgcgattttcaaagatcttgg

SEQ ID NO: 62649 - DNA, 75 bp, Artificial Sequence
  Synthetic
ggttgcccaacaagcttgtagtaaggggaccatggttaaaaatgcaacaacagatgcagccgacaagatgtcgaa

SEQ ID NO: 62650 - DNA, 75 bp, Artificial Sequence
  Synthetic
ggttcttgaactcagtgaggaaacgttctccaagccaaacctttcagctaaggatttagcccttttattgtttac

SEQ ID NO: 62651 - DNA, 75 bp, Artificial Sequence
  Synthetic
ccatctacccggcaacaacactccattccatatcctagctcaggtcctttcaaaaattgcttacaagtcaggaaa

SEQ ID NO: 62652 - DNA, 75 bp, Artificial Sequence
  Synthetic
atccggagcattcttggatgcatttcaccagattctaagtgaaggagagaatgctcaggcggcattaactcgact

SEQ ID NO: 62653 - DNA, 75 bp, Artificial Sequence
  Synthetic
aagcagaacatttgacgctttccttggagtggttcctccagtgataagagtcaaaaacttccaaacagtccctcg

SEQ ID NO: 62654 - DNA, 75 bp, Artificial Sequence
  Synthetic
tccatgtcaaaaaagtcttcgggctgtccctccaaatccaacaattgacaaaggatgggtctgtgtttattcatc

SEQ ID NO: 62655 - DNA, 75 bp, Artificial Sequence
  Synthetic
tgagcaaggtgaaacacgggcccttaaaatctaattctcattgttcatagttgcaagggaagtgatctttccgag

SEQ ID NO: 62656 - DNA, 75 bp, Artificial Sequence
  Synthetic
ttgatacaaagacactaaacatttcaaaagcatgtatgtggacaaaacataattagaccatcttaattggagtag

SEQ ID NO: 62657 - DNA, 75 bp, Artificial Sequence
  Synthetic
taatttatttctgtcttaaatgtgattttcactttaaaagcgttaaatggtgatagattaatccttgaagttact

SEQ ID NO: 62658 - DNA, 75 bp, Artificial Sequence
  Synthetic
cttctatatattatagagaaaccaatgttactaacaaaaggggtctacctaacgcatatgattgagtaatccgta

SEQ ID NO: 62659 - DNA, 75 bp, Artificial Sequence
  Synthetic
tattttataaaccaaacaattaacttcttactttttaagaatcaactaacaacatagaaaagacatttatcctta

SEQ ID NO: 62660 - DNA, 75 bp, Artificial Sequence
  Synthetic
tgtaatcctcggcttagttgaaattaacttttgttggacctcaagacgcttattcatagtatattatatgatttt

SEQ ID NO: 62661 - DNA, 75 bp, Artificial Sequence
  Synthetic
ttataagtttaagatatcttaaattatacccacaaaagatactgttttaattaagaaaaactatgaagaacatta

SEQ ID NO: 62662 - DNA, 75 bp, Artificial Sequence
  Synthetic
agaagatctttctttcgtagtgttcttttactggaaggagtattccaatttcagcttgttggattaattgttact

SEQ ID NO: 62663 - DNA, 75 bp, Artificial Sequence
  Synthetic
taaattgtcctttttgaaattaattcacacaaggtagtttaaatttatatccaaaataaattttgatatggccag

SEQ ID NO: 62664 - DNA, 75 bp, Artificial Sequence
  Synthetic
ttccagcaattacaacacatacatgcaatacttgaacccccctccttatgctgatcacggtgcaaaccagttgat

SEQ ID NO: 62665 - DNA, 75 bp, Artificial Sequence
  Synthetic
cccggcggatcagctatcaaatcagcagggtataactccaaattacgtgggtgatttaaacctagatgatcagtt

SEQ ID NO: 62666 - DNA, 75 bp, Artificial Sequence
  Synthetic
caaagggaatgtctgccatgctttcactttagaggcaataattgacatatctgcatataacgagcgaacagtcaa

SEQ ID NO: 62667 - DNA, 75 bp, Artificial Sequence
  Synthetic
aggcgttccggcatggctgcctcttgggattatgagcaattttgaatatcctttagctcatactgtggccgcgtt

SEQ ID NO: 62668 - DNA, 75 bp, Artificial Sequence
  Synthetic
gctcacaggcagctatacaatcacccaatttactcacaacgggcaaaaattcgtccgtgttaatcgacttggtac

SEQ ID NO: 62669 - DNA, 75 bp, Artificial Sequence
  Synthetic
aggaatcccagcacacccactcagaatgttgcgtgaaggaaatcaagcttttattcagaatatggtgatccccag

SEQ ID NO: 62670 - DNA, 75 bp, Artificial Sequence
  Synthetic
gaatttttcaactaatcaattcacctacaatctcactaatttagtattgagtgtgcaaaaacttcctgatgatgc

SEQ ID NO: 62671 - DNA, 75 bp, Artificial Sequence
  Synthetic
ctggcgcccatccaaggacaaattaattgggaacactatgcatcccgcagtctccatccacccgaatctgccgcc

SEQ ID NO: 62672 - DNA, 75 bp, Artificial Sequence
  Synthetic
tattgttctaccaacagtcaagaagcaggcttatcgtcagcacaaaaatcccaacaatggaccattgctggccat

SEQ ID NO: 62673 - DNA, 75 bp, Artificial Sequence
  Synthetic
atctggcatcctccatcaactgagggtcgaaaaagtcccagagaagacgagcctgtttaggatctcgcttcctgc

SEQ ID NO: 62674 - DNA, 75 bp, Artificial Sequence
  Synthetic
cgacatgttctcagtaaaagagggtatgatgaagaaaaggggagaaaattcccccgtggtttattttcaagcacc

SEQ ID NO: 62675 - DNA, 75 bp, Artificial Sequence
  Synthetic
tgagaacttccctttgaatggcttcaataacagacaagttgtgctagcgtatgcgaatccaacgctcagtgccgt

SEQ ID NO: 62676 - DNA, 75 bp, Artificial Sequence
  Synthetic
ttgaaatgatgctcaaatgagacaggagtccatctgtataagaagtatggcttaaatggatatttgtcaaattct

SEQ ID NO: 62677 - DNA, 75 bp, Artificial Sequence
  Synthetic
tacaagattagtttgtattgatttcaacaatgctttaaccttacattgctgctttaaatagttgattaagctgat

SEQ ID NO: 62678 - DNA, 75 bp, Artificial Sequence
  Synthetic
cagcttgtaatatgtaatctcttctgggccatcagatccataatgggtttactagactatataagagaaatagta

SEQ ID NO: 62679 - DNA, 75 bp, Artificial Sequence
  Synthetic
atattttataaacaattcttgctcagttttactgtgatttaataacatatgtcattgtgccctccattgctaagt

SEQ ID NO: 62680 - DNA, 75 bp, Artificial Sequence
  Synthetic
caactcaactgacgataatactccttctgaaatagtaagaaaaactaatgaagaacattaattgctgggtaaaag

SEQ ID NO: 62681 - DNA, 75 bp, Artificial Sequence
  Synthetic
tgattaatttctttaaatttgaccagaataatattttgtcagtgaatatattctcatatcacttgattaaaaaca

SEQ ID NO: 62682 - DNA, 75 bp, Artificial Sequence
  Synthetic
gaaaattaccctaacatgaagaccacatgtttccttatcagtcttatcttaattcaagggacaaaaaatctcccc

SEQ ID NO: 62683 - DNA, 75 bp, Artificial Sequence
  Synthetic
attttagagatagctagtaataatcaaccccaaaatgtggattcggtatgctccggaactctccagaagacagaa

SEQ ID NO: 62684 - DNA, 75 bp, Artificial Sequence
  Synthetic
gacgtccatctgatgggattcacactgagtgggcaaaaagttgctgattcccctttggaggcatccaagcgatgg

SEQ ID NO: 62685 - DNA, 75 bp, Artificial Sequence
  Synthetic
gggacacacaaaagaaaaaggttttttaagattttttgtgtgcgagtaactatgaggaagattaacagttttcct

SEQ ID NO: 62686 - DNA, 75 bp, Artificial Sequence
  Synthetic
tatgaggaagattaacagttttcctcagtttaaggtatacactgaaattgagattgagattctcctctttgctat

SEQ ID NO: 62687 - DNA, 75 bp, Artificial Sequence
  Synthetic
gctttcaggacaggtgtacctcccaagaatgttgagtacacagagggggaggaagccaaaacatgctacaatata

SEQ ID NO: 62688 - DNA, 75 bp, Artificial Sequence
  Synthetic
tctgtaactttccctggttgtgacaattgaatcagttttatctattaccaattaccatcaacatggtatgtctag

SEQ ID NO: 62689 - DNA, 75 bp, Artificial Sequence
  Synthetic
agtgtaacggatccctctggaaaatccttgctgttagatcctcctaccaacatccgtgactatcctaaatgcaaa

SEQ ID NO: 62690 - DNA, 75 bp, Artificial Sequence
  Synthetic
actatccatcatattcaaggtcaaaaccctcatgcacaggggatcgcccttcatttatggggagcattttttctg

SEQ ID NO: 62691 - DNA, 75 bp, Artificial Sequence
  Synthetic
tatgatcgcattgcctccacaacaatgtaccgaggcaaagtcttcactgaagggaacatagcagctatgattgtc

SEQ ID NO: 62692 - DNA, 75 bp, Artificial Sequence
  Synthetic
aataagacagtgcacaaaatgattttctcgcggcaaggacaagggtaccgtcatatgaatctgacttctactaat

SEQ ID NO: 62693 - DNA, 75 bp, Artificial Sequence
  Synthetic
aaatattggacaagtagtaacggaacgcaaacgaatgacactggatgtttcggcgctcttcaagaatacaattct

SEQ ID NO: 62694 - DNA, 75 bp, Artificial Sequence
  Synthetic
gtacatcttgactaagtcgaacaaggggaagtcgatatggatcgtgggaccagaagaatctgggtgtcgcaaaat

SEQ ID NO: 62695 - DNA, 75 bp, Artificial Sequence
  Synthetic
acaaagaaccaaacatgtgctccgtccaaaatacctccaccactgcccacagcccgtccggagatcaaactcaca

SEQ ID NO: 62696 - DNA, 75 bp, Artificial Sequence
  Synthetic
agcaccccaactgatgccaccaaactcaataccacggacccaagcagtgatgatgaggacctcgcaacatccggc

SEQ ID NO: 62697 - DNA, 75 bp, Artificial Sequence
  Synthetic
tcagggtccggagaacgagaaccccacacaacttctgatgcggtcaccaagcaagggctttcatcaacaatgcca

SEQ ID NO: 62698 - DNA, 75 bp, Artificial Sequence
  Synthetic
cccactccctcaccacaaccaagcacgccacagcaaggaggaaacaacacaaaccattcccaagatgctgtgact

SEQ ID NO: 62699 - DNA, 75 bp, Artificial Sequence
  Synthetic
gaactagacaaaaataacacaactgcacaaccgtccatgccccctcataacactaccacaatctctactaacaac

SEQ ID NO: 62700 - DNA, 75 bp, Artificial Sequence
  Synthetic
acctccaaacacaacttcagcactctctctgcaccattacaaaacaccaccaatgacaacacacagagcacaatc

SEQ ID NO: 62701 - DNA, 75 bp, Artificial Sequence
  Synthetic
actgaaaatgagcaaaccagtgccccctcgataacaaccctgcctccaacgggaaatcccaccacagcaaagagc

SEQ ID NO: 62702 - DNA, 75 bp, Artificial Sequence
  Synthetic
accagcagcaaaaaaggccccgccacaacggcaccaaacacgacaaatgagcatttcaccagtcctccccccacc

SEQ ID NO: 62703 - DNA, 75 bp, Artificial Sequence
  Synthetic
cccagctcgactgcacaacatcttgtatatttcagaagaaagcgaagtatcctctggagggaaggcgacatgttc

SEQ ID NO: 62704 - DNA, 75 bp, Artificial Sequence
  Synthetic
ccttttctggatgggttaataaatgctccaattgattttgacccagttccaaatacaaaaacaatctttgatgaa

SEQ ID NO: 62705 - DNA, 75 bp, Artificial Sequence
  Synthetic
tcctctagttctggtgcctcggctgaggaagatcaacatgcctcccccaatattagtttaactttatcttatttt

SEQ ID NO: 62706 - DNA, 75 bp, Artificial Sequence
  Synthetic
cctaatataaatgagaacactgcctactctggagaaaatgagaatgattgtgatgcagagttaagaatttggagc

SEQ ID NO: 62707 - DNA, 75 bp, Artificial Sequence
  Synthetic
gttcaggaggatgacctggccgcagggctcagttggataccgttttttggccctggaattgaaggactttacact

SEQ ID NO: 62708 - DNA, 75 bp, Artificial Sequence
  Synthetic
gctgttttaattaaaaatcaaaacaatttggtctgcaggttgaggcgtctagccaatcaaactgccaaatccttg

SEQ ID NO: 62709 - DNA, 75 bp, Artificial Sequence
  Synthetic
gaactcttattgagagtcacaactgaggaaagaacattctccttaatcaatagacatgctattgactttctactc

SEQ ID NO: 62710 - DNA, 75 bp, Artificial Sequence
  Synthetic
acaagatggggaggaacatgcaaagtgcttggacctgattgttgcatcgggatagaagacttgtccaaaaatatt

SEQ ID NO: 62711 - DNA, 75 bp, Artificial Sequence
  Synthetic
aacagaagctataacgctggcctcaagacctaacctcgggtctagacaagacgacgacaatgaaataccgttccc

SEQ ID NO: 62712 - DNA, 75 bp, Artificial Sequence
  Synthetic
tcagagcaaattgaccaaattaaaaaggacgaacaaaaagaggggactggttggggtctgggtggtaaatggtgg

SEQ ID NO: 62713 - DNA, 75 bp, Artificial Sequence
  Synthetic
acgacgacaatgaaataccgttccctgggcctataagcaacaacccagaccaagatcatctggaggatgatccta

SEQ ID NO: 62714 - DNA, 75 bp, Artificial Sequence
  Synthetic
acatccgactggggtgttcttactaacttgggcattttgctactattatccatagctgtcttgattgctctatcc

SEQ ID NO: 62715 - DNA, 75 bp, Artificial Sequence
  Synthetic
gagactccagagacactatcattcctaatagtgcaattgaccccgaggatggtgattttgaaaattacaatggct

SEQ ID NO: 62716 - DNA, 75 bp, Artificial Sequence
  Synthetic
tgtatttgtcgtatctttactaaatatatcggataacgttaaatgtgtaatgattaggactttaggacaattgct

SEQ ID NO: 62717 - DNA, 75 bp, Artificial Sequence
  Synthetic
gacgatcatgaggatgacaataaagcttttgagctacaggacagctcaccacaatcccaaagggaaatagagaga

SEQ ID NO: 62718 - DNA, 75 bp, Artificial Sequence
  Synthetic
actgagccctttttctaatctactgaaatcaacttgggagatttttaagaagctgataacttaatgtgaatcaat

SEQ ID NO: 62719 - DNA, 75 bp, Artificial Sequence
  Synthetic
acaatcccaaagggaaatagagagagaaagattaattcatccacccccaggcaacaacaaggacgacaatcgggc

SEQ ID NO: 62720 - DNA, 75 bp, Artificial Sequence
  Synthetic
agtttatgtattatcgattattatggtttgatattcaattgttattattgtcaggagtgaccttttctatttgat

SEQ ID NO: 62721 - DNA, 75 bp, Artificial Sequence
  Synthetic
ctcagacaacaatcaacaatcagcagattctgaggaacaagaaggtcaatacaacaggcaccgaggcccagaacg

SEQ ID NO: 62722 - DNA, 75 bp, Artificial Sequence
  Synthetic
gattctgaggaacaagaaggtcaatacaacaggcaccgaggcccagaacgtacgaccgccaatcgaagactctca

SEQ ID NO: 62723 - DNA, 75 bp, Artificial Sequence
  Synthetic
gcattaatgttttaaactacctcttaagcctttgagggcggtcccaatatgtgcgtaggggttaatttaaaggga

SEQ ID NO: 62724 - DNA, 75 bp, Artificial Sequence
  Synthetic
acaacaggcaccgaggcccagaacgtacgaccgccaatcgaagactctcaccagtgcacgaagaggacaccccta

SEQ ID NO: 62725 - DNA, 75 bp, Artificial Sequence
  Synthetic
tttcttattgtacagttttctgtattacttatttgggcttgaagacatagttaagatttgccgaaaatgctctcc

SEQ ID NO: 62726 - DNA, 75 bp, Artificial Sequence
  Synthetic
agtcaattccatcccctctcagaaaagacgtgctgttcaaagagtcttaatttataaccaactattgcaagaatt

SEQ ID NO: 62727 - DNA, 75 bp, Artificial Sequence
  Synthetic
aatttactttttccgttatacttagttacattaatcttttgactgttcagcattattaacgacttgtcttaattc

SEQ ID NO: 62728 - DNA, 75 bp, Artificial Sequence
  Synthetic
aatcgttcggatgaaattcataaggaaaaatgagcctccttccccctattctgggctgagaaaatttctcttatc

SEQ ID NO: 62729 - DNA, 75 bp, Artificial Sequence
  Synthetic
cgcctaaaatctgatctgttaggtcatgggtccttcataatctgtttgagcatgaatattgatcaaatgaccaaa

SEQ ID NO: 62730 - DNA, 75 bp, Artificial Sequence
  Synthetic
tgatagtgcatttgtatagactcaattatcctttattaagaaaaagataaatagaacacaaagaattgacaaaat

SEQ ID NO: 62731 - DNA, 75 bp, Artificial Sequence
  Synthetic
tttactttgattgattttgcaaggagttataaaaatcttgaaggataaattgttataaagtagagtcgaagaaca

SEQ ID NO: 62732 - DNA, 75 bp, Artificial Sequence
  Synthetic
ttaaatgttctttgttagaattattcatctaagttgtttttgagtatattcgcttcaatacaactcctctttata

SEQ ID NO: 62733 - DNA, 75 bp, Artificial Sequence
  Synthetic
tttgatttaagttttaaaatgcaacaacctcgcggaagaagtcgaacccgcaaccaccaagtcacaccgactata

SEQ ID NO: 62734 - DNA, 75 bp, Artificial Sequence
  Synthetic
tatcatgaaactcaattgccctccaaacctcattataccaattatcatccacgtgcaagatcgatgagctcaacc

SEQ ID NO: 62735 - DNA, 75 bp, Artificial Sequence
  Synthetic
ctatccaagatgtggctcaatgttcttaatttgaacatagtcataaggggataaataatactttatatttctgat

SEQ ID NO: 62736 - DNA, 75 bp, Artificial Sequence
  Synthetic
cgtagtagtgcagaaagtagtcccaccaatcatattccccgtgctcgaccaccctcaacattcaacttatcgaaa

SEQ ID NO: 62737 - DNA, 75 bp, Artificial Sequence
  Synthetic
ccccctcctcctccaaaagacatgtgcaggaacatgaaaattggattgccgtgcgctgatcccacttgtaataga

SEQ ID NO: 62738 - DNA, 75 bp, Artificial Sequence
  Synthetic
attaagaaaaacatttgatgaagattaaaaccttcatcgccagtaaatgattatattgtctgtaggcaggtgttt

SEQ ID NO: 62739 - DNA, 75 bp, Artificial Sequence
  Synthetic
gatcatgaccttgataatctaacaaatcgtgaacttttgctattgatggcccgaaaaatgctccccaatacagac

SEQ ID NO: 62740 - DNA, 75 bp, Artificial Sequence
  Synthetic
aagacctttagaagtccgcaggactgtggatcaccgtctctttctaaaggtctctcaaaagataaacaggagcaa

SEQ ID NO: 62741 - DNA, 75 bp, Artificial Sequence
  Synthetic
acgaaagatgtgttgaccttggaaaatctaggacacattctgagctatctccacagatcagaaattgggaaattg

SEQ ID NO: 62742 - DNA, 75 bp, Artificial Sequence
  Synthetic
gatgagacatcacttcgtgcagcattaagtctgacgtgtgctggaattcgaaagacgaatagatccttgatcaac

SEQ ID NO: 62743 - DNA, 75 bp, Artificial Sequence
  Synthetic
tacaagtagcagtcagacggaggtcaactatgtacctctccttaaaaaggttgaggatacattaactatgctagt

SEQ ID NO: 62744 - DNA, 75 bp, Artificial Sequence
  Synthetic
accatgacagaattacacatgaaccatgaaaatctcccgcaagaccaaaacggtgttatcaagcagacctataca

SEQ ID NO: 62745 - DNA, 75 bp, Artificial Sequence
  Synthetic
ggtattcaccttgacaaaggaggtcaattcgaagccgccttatggcaaggttgggataagagatcgatatctcta

SEQ ID NO: 62746 - DNA, 75 bp, Artificial Sequence
  Synthetic
ttcgtacaagcagctttatatgtaatgaacaatatcccctgtgaatcatcaatcagtgtgcaagcctcatacgat

SEQ ID NO: 62747 - DNA, 75 bp, Artificial Sequence
  Synthetic
cattttattcttcctcaaagtcaaggtaaaggacagtgattattgttcgaaagttgacaatttgatcactttcag

SEQ ID NO: 62748 - DNA, 75 bp, Artificial Sequence
  Synthetic
cgtactggaaagagcacaaacagccaccaccagggccagcgttgtatgaagagaatgcgcttaaaggaaaaatcg

SEQ ID NO: 62749 - DNA, 75 bp, Artificial Sequence
  Synthetic
ttttcagtttcaacccttatcgcgagacttgaatacaatcctactaacttcaataagtgaccccaaattcaagtt

SEQ ID NO: 62750 - DNA, 75 bp, Artificial Sequence
  Synthetic
tgctgaaagctaagatgacaatgatcactagttcattgtaaattactcgatcaaaatgttcttaagctatcttaa

SEQ ID NO: 62751 - DNA, 75 bp, Artificial Sequence
  Synthetic
gcttactgatgcggctctgcttcacttttcttttgattttaaagccatagctatatctaagtgtctaattaacaa

SEQ ID NO: 62752 - DNA, 75 bp, Artificial Sequence
  Synthetic
cttgtacctctaaggaaaaacatgaagaacattaagaaaaaggatgttcttattctttgactaaacctgcatatt

SEQ ID NO: 62753 - DNA, 75 bp, Artificial Sequence
  Synthetic
tggtgactctccccaatgtgcactcatacagataaccaaaagagtcccaatctttcaggatgtgccgcccccgac

SEQ ID NO: 62754 - DNA, 75 bp, Artificial Sequence
  Synthetic
ctttgttgataccctcgagagacaacttttgacaccagatcacggatcaagcacacttcaatcaagcaccctaaa

SEQ ID NO: 62755 - DNA, 75 bp, Artificial Sequence
  Synthetic
aatccacattagatcccgtggtgatatcccacgagcatgccaaaagagtctccgaccagcaccaccatcacccaa

SEQ ID NO: 62756 - DNA, 75 bp, Artificial Sequence
  Synthetic
ttttcaatcatacacataataaccattttagtagcgttgcctttcagtacagtctaggtgattgttgaaagactt

SEQ ID NO: 62757 - DNA, 75 bp, Artificial Sequence
  Synthetic
ccaagcatggcagaattatcaacgcgttacaacttgcctgcaaatgttacggaaaatagtataaatcttgacctt

SEQ ID NO: 62758 - DNA, 75 bp, Artificial Sequence
  Synthetic
ttggacttaagatctaaggatcaagatttatttaacaaggcaagccacaaccttagatagaacctcagccagact

SEQ ID NO: 62759 - DNA, 75 bp, Artificial Sequence
  Synthetic
aattccacagcacgatggataaaagaacccagtgttgggggctggacagtgaagtggggaaactttgttttccat

SEQ ID NO: 62760 - DNA, 75 bp, Artificial Sequence
  Synthetic
attgaactattgacgctgttgatgataatatataattaatggtcatatttgaatatgacaacatcttgcttcttg

SEQ ID NO: 62761 - DNA, 75 bp, Artificial Sequence
  Synthetic
taatatataattaatggtcatatttgaatatgacaacatcttgcttcttgttttgccttgtatctctttgagttg

SEQ ID NO: 62762 - DNA, 75 bp, Artificial Sequence
  Synthetic
ataccaaatactggaatgacattgttgcatcatttaaagtctaacttcgttgttccagagtggcaacaaacaagg

SEQ ID NO: 62763 - DNA, 75 bp, Artificial Sequence
  Synthetic
aatctattctcccacctctttaaaaacccaaaatcaacaattatagaaccgtttttggccctgaggattttgctt

SEQ ID NO: 62764 - DNA, 75 bp, Artificial Sequence
  Synthetic
aatgtaaatataacaagtgatgaagattaagaaaaaccagtcggtattttccagacttggcatttcttatcttca

SEQ ID NO: 62765 - DNA, 75 bp, Artificial Sequence
  Synthetic
ggagttgctttgaaggatcaagaattacagcaatcattgattcctggatttagatctattgttcatatgctatca

SEQ ID NO: 62766 - DNA, 75 bp, Artificial Sequence
  Synthetic
gaatggctgctcctggaggtcacgtcggcaatccatattagccctaatctgttgggaatctatttgacttcagac

SEQ ID NO: 62767 - DNA, 75 bp, Artificial Sequence
  Synthetic
atgtttaaaattctgatggcaggtgtgaaaaatttcttcaataagatgttcactcttcatgttgtaaatgaccac

SEQ ID NO: 62768 - DNA, 75 bp, Artificial Sequence
  Synthetic
ggaaaacccagcagtattgaaataaagttaactggacaacagatcattatcactcgtgttaatatggggtttcta

SEQ ID NO: 62769 - DNA, 75 bp, Artificial Sequence
  Synthetic
gtggaagtcaggaggattgatattgaaccttgctgtggtgagacagtcctctcagaatcagttgtttttggacta

SEQ ID NO: 62770 - DNA, 75 bp, Artificial Sequence
  Synthetic
gtggctgaggcagttctaagagaacacagtcaaatggagaagggccaacctctcaatctgacacaatacatgaac

SEQ ID NO: 62771 - DNA, 75 bp, Artificial Sequence
  Synthetic
agctttgattcaacaacagccgcaattatgttggcttcctacacagtgacacacttcgggaagatatctaacccg

SEQ ID NO: 62772 - DNA, 75 bp, Artificial Sequence
  Synthetic
acacttcgggaagatatctaacccgctggtacgtgtcaacaggctaggcccaggaatacccgatcatccgctacg

SEQ ID NO: 62773 - DNA, 75 bp, Artificial Sequence
  Synthetic
agcaaaattgctatataagtggcttaaattagcatgggtattcctagttcgaccacataataatgttggaggcac

SEQ ID NO: 62774 - DNA, 75 bp, Artificial Sequence
  Synthetic
agtacattatagttaattgtcttgtatactaagggatatacctaacctgatttatatttactggtataaaatagt

SEQ ID NO: 62775 - DNA, 75 bp, Artificial Sequence
  Synthetic
agcatcatcttattgaatagttatcatacaataggctgttcctataatctgattgtgagattataaacttgtaga

SEQ ID NO: 62776 - DNA, 75 bp, Artificial Sequence
  Synthetic
attaccgtgggtcacaactgttgcatatcctccaaaatatatcttttgcaagtgatgtgtgcttgaatacttcga

SEQ ID NO: 62777 - DNA, 75 bp, Artificial Sequence
  Synthetic
ctctcactccatcccaagcttcgtccaattcttctaccggggaagataggaaagaaaggtcatgcttcagactta

SEQ ID NO: 62778 - DNA, 75 bp, Artificial Sequence
  Synthetic
tataatacatactaataacgattgattaagaaaaatcaatgatggatattaaatgtccatcaagcaagtgttgta

SEQ ID NO: 62779 - DNA, 75 bp, Artificial Sequence
  Synthetic
gaataccaggggtttcacaggctgctaaacttactaaattttacataggattatataattcttttcgatacacgt

SEQ ID NO: 62780 - DNA, 75 bp, Artificial Sequence
  Synthetic
tatatctttagcaaagtgaggaaaacagctttatcatgttagatgccagttatccattttaagtgaatcctttcc

SEQ ID NO: 62781 - DNA, 75 bp, Artificial Sequence
  Synthetic
tcaacatgcagcatccaactcaatatcctgatgcaaggttgtcctctcctataatcctagaccagtgtgacttat

SEQ ID NO: 62782 - DNA, 75 bp, Artificial Sequence
  Synthetic
atcgccaggggacttaactatggttatcacccaggattgtgattcatgccactctccagccagccatccgtatca

SEQ ID NO: 62783 - DNA, 75 bp, Artificial Sequence
  Synthetic
actctccagccagccatccgtatcacatggacaagcaggatagttaccaataatttaaattccattcgagctatt

SEQ ID NO: 62784 - DNA, 75 bp, Artificial Sequence
  Synthetic
tagccagaagtttagggttgtatagtcattattcacataatccgaaattgcgtaattgtaggattccacatcaca

SEQ ID NO: 62785 - DNA, 75 bp, Artificial Sequence
  Synthetic
attctgctagtaattccgacgggatcaatagactaaaaatctgattgtatagaattataaaagaatcaagcagag

SEQ ID NO: 62786 - DNA, 75 bp, Artificial Sequence
  Synthetic
tttaccgtttaaggaattcgacagcattaaagacatttcttcagaattgttcgatactcaccgttccttttcatt

SEQ ID NO: 62787 - DNA, 75 bp, Artificial Sequence
  Synthetic
caatttgggatcatattttaacttccattcaatatgatgcaattaatcatgttgatgattttaaatacctattgc

SEQ ID NO: 62788 - DNA, 75 bp, Artificial Sequence
  Synthetic
tgcatttgttaacttatcggtgcgagatttccttgagaacccggcggggcttctactatctgtagtaaccagaag

SEQ ID NO: 62789 - DNA, 75 bp, Artificial Sequence
  Synthetic
catctgagctagtcaagtatgcgaattgggacaacgagttcttaaaagcatatcttaataagatcttaggacttg

SEQ ID NO: 62790 - DNA, 75 bp, Artificial Sequence
  Synthetic
agaagttcaacccagtcaaaactaaaccaagcaatattctgaatgctctatagtctattctaatcagaggtataa

SEQ ID NO: 62791 - DNA, 75 bp, Artificial Sequence
  Synthetic
accatgttttttcagcttctgcaaggtcacagtgtgaggatttttctcctaaggaaaatccttattattggggga

SEQ ID NO: 62792 - DNA, 75 bp, Artificial Sequence
  Synthetic
caatggctaagatttcaatgactcgttaacaatcgctagtaattttaatctccagattaagaaaaagatatacga

SEQ ID NO: 62793 - DNA, 75 bp, Artificial Sequence
  Synthetic
tgttattactcgtgcatctatctcaacttgccaggaggataaaaggacaaagagggtcattaagaagtaactgga

SEQ ID NO: 62794 - DNA, 75 bp, Artificial Sequence
  Synthetic
tgaagattaaggcgacaacgagccgaaacttcatctcttttaaagatctaacattatctgttccaaagtcataca

SEQ ID NO: 62795 - DNA, 75 bp, Artificial Sequence
  Synthetic
aatttataggaacagatttggagctgtttggaatagcagattttgttatttttaaggttccagtaaaaacaataa

SEQ ID NO: 62796 - DNA, 75 bp, Artificial Sequence
  Synthetic
tccgaaatgctgtaagcttacaagcttcaaaaccgggattaagaatatggtaccgtgaccaaaacttgacccctt

SEQ ID NO: 62797 - DNA, 75 bp, Artificial Sequence
  Synthetic
atatcaacttctccaattgcctcgggaacgttttcgtaaaacttcgttcttagtatgggtaatcatcctcttcca

SEQ ID NO: 62798 - DNA, 75 bp, Artificial Sequence
  Synthetic
atctatgcgacgatgagtttattgtaagcgtcgctagttatgaatgttttatcatgattaaagacgtcttcattg

SEQ ID NO: 62799 - DNA, 75 bp, Artificial Sequence
  Synthetic
agaggtataacacatgggaaatctgtgcccgcgcttggctcgaagacagtgatggagctgattatcctcctcttg

SEQ ID NO: 62800 - DNA, 75 bp, Artificial Sequence
  Synthetic
atgtgttaggtgaattatacaaccagggagaccaaattattgccatgtacctggaggacggtttcaaattgatta

SEQ ID NO: 62801 - DNA, 75 bp, Artificial Sequence
  Synthetic
cagctcaagtctgtggggctgaatctggaaggaaatggaattgcaaccgatgtcccatcagcaacaaaacgctgg

SEQ ID NO: 62802 - DNA, 75 bp, Artificial Sequence
  Synthetic
aacacttagaacccttgtgtgtcagctgtatacaaacacatggcatctttacaccaagaaaatactggttccaat

SEQ ID NO: 62803 - DNA, 75 bp, Artificial Sequence
  Synthetic
ggattccgttcaggtgtgcctcccaaggtggtcagctatgaagccggagaatgggcagaaaattgctacaatctg

SEQ ID NO: 62804 - DNA, 75 bp, Artificial Sequence
  Synthetic
cacagatgattaagtcatattatgatgaactccatgatctcaatttgaaacttcaaatttcagacaataaggctg

SEQ ID NO: 62805 - DNA, 75 bp, Artificial Sequence
  Synthetic
agtgtgcccaaaactttattaaaactatagttcaggcgaaattgactcctcaacaatactgtgaattattctccc

SEQ ID NO: 62806 - DNA, 75 bp, Artificial Sequence
  Synthetic
tacaaaagcattggggtcatcccgttttatacaatgatgttgcactagataaggttaaaaaacatgcgcaatcga

SEQ ID NO: 62807 - DNA, 75 bp, Artificial Sequence
  Synthetic
caaaaatcttaaaacctaaagtcatgtttgaaactttttgtgttttcaaatttatagtagcaaagaatcattatc

SEQ ID NO: 62808 - DNA, 75 bp, Artificial Sequence
  Synthetic
gaacacaacagatgattccacaagctactacatgaccctgacactcagctacgagatgtcaaattttggaggcga

SEQ ID NO: 62809 - DNA, 75 bp, Artificial Sequence
  Synthetic
attctcaaggatcatggtataaaaccacacatgatttgcatttgactccatatcttagacaacatattgtgtcaa

SEQ ID NO: 62810 - DNA, 75 bp, Artificial Sequence
  Synthetic
ggaaagtaacaccctttttaaggtagacaaccacacatatgtgcaactagatcgtccacacactccgcagttcct

SEQ ID NO: 62811 - DNA, 75 bp, Artificial Sequence
  Synthetic
attcatttccatcacaagccgaaatttatcagcatctttgggagtggtatttcgtggagcatgaacctcttttct

SEQ ID NO: 62812 - DNA, 75 bp, Artificial Sequence
  Synthetic
atcgtccacacactccgcagttccttgttcagctcaatgaaacacttcgaagaaataatcgccttagcaacagta

SEQ ID NO: 62813 - DNA, 75 bp, Artificial Sequence
  Synthetic
caactaaaataataagtgatttaagtatctttataaaagacagggctaccgctgtgaaccaggagtgttgggaca

SEQ ID NO: 62814 - DNA, 75 bp, Artificial Sequence
  Synthetic
gtgtcttcgatagaagtgtattaggatataaccctcctgttagatttcaatcaaagagagtgccagagcaatttt

SEQ ID NO: 62815 - DNA, 75 bp, Artificial Sequence
  Synthetic
gagtgggccttctgggaaactaaaaaaacttttcccaacaacttcatggagaaaacttgcatttccaaattctat

SEQ ID NO: 62816 - DNA, 75 bp, Artificial Sequence
  Synthetic
aaacttttcccaacaacttcatggagaaaacttgcatttccaaattctatcaacccacaccaacaactcctcaga

SEQ ID NO: 62817 - DNA, 75 bp, Artificial Sequence
  Synthetic
tgggtcaagcagacttttccttgaatcaaatattagagtttgctgaaaagttagagtatttggctccttcttata

SEQ ID NO: 62818 - DNA, 75 bp, Artificial Sequence
  Synthetic
tcagagcccggcgggaactgtccaaggaaaaattagctaccacccacccaccaacaactccgagctggttccaac

SEQ ID NO: 62819 - DNA, 75 bp, Artificial Sequence
  Synthetic
ggaatttttccttctcattaaaagaaaaagagttgaatataggaagaacttttgggaagttaccgtatcgtgtca

SEQ ID NO: 62820 - DNA, 75 bp, Artificial Sequence
  Synthetic
gaaatgtccaaacactcgcagaagccctgctagcagatggactggcaaaagcattccctagtaacatgatggttg

SEQ ID NO: 62821 - DNA, 75 bp, Artificial Sequence
  Synthetic
tcactgagagggaacagaaagaagcattattacatcaggcttcttggcaccacaattcagcaagcataggggaga

SEQ ID NO: 62822 - DNA, 75 bp, Artificial Sequence
  Synthetic
tgataacaatgtaccaagtgaacaaccgaacaacacagcatccattgaagactcccccccatcggcaagcaacga

SEQ ID NO: 62823 - DNA, 75 bp, Artificial Sequence
  Synthetic
acgctatagtgaggggtgcaagttttgttactgatcttgagaaatacaacctcgccttccgatatgaatttacac

SEQ ID NO: 62824 - DNA, 75 bp, Artificial Sequence
  Synthetic
ccgaacaacacagcatccattgaagactcccccccatcggcaagcaacgagacaattgaccactccgaaatgaat

SEQ ID NO: 62825 - DNA, 75 bp, Artificial Sequence
  Synthetic
tcgatccaaggctcgaacaactccgcccagagcccacagaccaaggccacgccagcgcccacagcatccccgatg

SEQ ID NO: 62826 - DNA, 75 bp, Artificial Sequence
  Synthetic
ggcatttcatagactactgtaatcgatgttatggtgtgaagaatttatttgattggatgcattttttaataccac

SEQ ID NO: 62827 - DNA, 75 bp, Artificial Sequence
  Synthetic
tatgttatatgcatgtcagtgacttttatagcccaccacattgtgtgacagaagataatcgaaataacccacctg

SEQ ID NO: 62828 - DNA, 75 bp, Artificial Sequence
  Synthetic
cccggactcactataaatacaataagtaaggtagctgattcactgagtcccaccaggaaacaaaagcgatcggtt

SEQ ID NO: 62829 - DNA, 75 bp, Artificial Sequence
  Synthetic
attgtgctaatgcttatcattatcacttaggaggtatagagggacttcagcagaaattgtggacatgcatatcat

SEQ ID NO: 62830 - DNA, 75 bp, Artificial Sequence
  Synthetic
cgacaaaacaccgctaataaatgtaacccagatcttcactattggacagctgttgatgagggggcagcagcagga

SEQ ID NO: 62831 - DNA, 75 bp, Artificial Sequence
  Synthetic
gtgcccaaatcacccttgtggagttaaaaactaaattaaaattgaagtccagcgtcatgggtgataatcaatgta

SEQ ID NO: 62832 - DNA, 75 bp, Artificial Sequence
  Synthetic
taacaactctaagtctttttccaattgatgctcccaacgattatcaagagaacgaggctgaattgaatgcggcac

SEQ ID NO: 62833 - DNA, 75 bp, Artificial Sequence
  Synthetic
gggtgtaatgcataatcagaatgggcttatttgcgggctacgtcagctagccaatgaaactacccaggctcttca

SEQ ID NO: 62834 - DNA, 75 bp, Artificial Sequence
  Synthetic
gagttgctgtcgaattagctattactacaggttatagtggtatatttttaaagcctgaggaaacatttgtccatt

SEQ ID NO: 62835 - DNA, 75 bp, Artificial Sequence
  Synthetic
cagggttcatttattttggtaaaaagcaatatctcaacggtgttcaactgccgcaatcattgaaaacaatggcaa

SEQ ID NO: 62836 - DNA, 75 bp, Artificial Sequence
  Synthetic
gaaaagctattgattttcttcttcaacgatggggaggtacctgtcgaatcctaggaccatcttgttgcattgagc

SEQ ID NO: 62837 - DNA, 75 bp, Artificial Sequence
  Synthetic
ggtgtggacccttatctgactctattttcgatgatcttcaaggttctctggccagtattggtacatcctttgaga

SEQ ID NO: 62838 - DNA, 75 bp, Artificial Sequence
  Synthetic
gaggaacaagcgagacacggcacatttttccgagccgttggatagcttcattccattcaatgttagcaataaatt

SEQ ID NO: 62839 - DNA, 75 bp, Artificial Sequence
  Synthetic
tattaaatcagaatcaccttgggtttcctctagggttcaatattgatatttcttgtttcaaaaagcctcttacct

SEQ ID NO: 62840 - DNA, 75 bp, Artificial Sequence
  Synthetic
taattgctataatagccctactttgtatatgtaagattttgtgttgatttattctgagatctgagagaaaaaaat

SEQ ID NO: 62841 - DNA, 75 bp, Artificial Sequence
  Synthetic
tctcggaaaaattaattgctctcataacgccccaagttttaggagggttatcatttttaaatccagaaaaattgt

SEQ ID NO: 62842 - DNA, 75 bp, Artificial Sequence
  Synthetic
ctcagggttactctaaggagaaatattatttttaaaatttacttaaatgctgaccacttatcttaaatgagcaat

SEQ ID NO: 62843 - DNA, 75 bp, Artificial Sequence
  Synthetic
tctaccggaacataagtgatcctctcacttcaggtctatttcaactcaagaatgcattggaatttcttgaaaagg

SEQ ID NO: 62844 - DNA, 75 bp, Artificial Sequence
  Synthetic
taataatatgtttttctgcttctttgcttgatttacaatatgatatttctcttaataatgattaatatattaaga

SEQ ID NO: 62845 - DNA, 75 bp, Artificial Sequence
  Synthetic
aagaattattctatatcttgatttctaaaaaacctggtttagcagatgcctcagattttgtcatgaatccattag

SEQ ID NO: 62846 - DNA, 75 bp, Artificial Sequence
  Synthetic
aaaacttatgacgaagattaaaggggaggatcgttaacgggaaaatctcccatctcgttcgtcgaagccacgttg

SEQ ID NO: 62847 - DNA, 75 bp, Artificial Sequence
  Synthetic
gcttaaatgtaccaggatcaaaggaaataataacgttccttagacaaacagttcgcgaaaatatcacgatcacgt

SEQ ID NO: 62848 - DNA, 75 bp, Artificial Sequence
  Synthetic
cacaaaatagaataataaattctcttttccacataggttctgatttagaggaccaaagagtgtgtgagtggcttt

SEQ ID NO: 62849 - DNA, 75 bp, Artificial Sequence
  Synthetic
tatcatcaaaccctgtaatgagccgatttgctgctgacatcttttcaagaacacctagtggaaaacggcttcaag

SEQ ID NO: 62850 - DNA, 75 bp, Artificial Sequence
  Synthetic
tcttaggctatctagaaggaacaagaacattactagcttctcggacaatcagtttaactacagaaggaacaatgt

SEQ ID NO: 62851 - DNA, 75 bp, Artificial Sequence
  Synthetic
tcgtaggcagcctcgaagtgcatcccaaattcgtgttccgaatctgttccatcggaaaaagactgatgcactcat

SEQ ID NO: 62852 - DNA, 75 bp, Artificial Sequence
  Synthetic
tgatgaaattaagagaattaacgagaaaccgatggaaaagttggttttcttatattgatgcactggacgatgatt

SEQ ID NO: 62853 - DNA, 75 bp, Artificial Sequence
  Synthetic
tatctgagtccttggaaaagttcacatgtactgttgatgtggctaatttcttgagggcatattcatggtctgacg

SEQ ID NO: 62854 - DNA, 75 bp, Artificial Sequence
  Synthetic
tcttaaaagggaaaaggctaattggtgccacactgccatgtttactagagcaatttgaggtaaagtggattaatt

SEQ ID NO: 62855 - DNA, 75 bp, Artificial Sequence
  Synthetic
gagcaattcgcagattacatccccaaaagatatgcggttagcgaatccaacagctgaagacttctcacaaggtaa

SEQ ID NO: 62856 - DNA, 75 bp, Artificial Sequence
  Synthetic
tatctgaggatttaagggaacaatttaatctatcttcagactcaaaatcaactataaacttgttgccgtatgact

SEQ ID NO: 62857 - DNA, 75 bp, Artificial Sequence
  Synthetic
gtaaggaactgcgacttgaaggaagcaatgacacagagttaaattatgtcagttgtgctcttgaccggaaagttg

SEQ ID NO: 62858 - DNA, 75 bp, Artificial Sequence
  Synthetic
tccagaaacatccctctgttaatcgtctagcttggacgataggaaatcgagcaccgtatattggctcacggacag

SEQ ID NO: 62859 - DNA, 75 bp, Artificial Sequence
  Synthetic
aagataagatcggttatcctcccttaagagtaaattgcccatcagcagcacttaaagaagctattgagatggttt

SEQ ID NO: 62860 - DNA, 75 bp, Artificial Sequence
  Synthetic
ctagattgttatgggtgactcaaggcactgcagaccgagaaaaattgcttattcctcttctcaattcaagagtaa

SEQ ID NO: 62861 - DNA, 75 bp, Artificial Sequence
  Synthetic
atctggactatcagacggtgcttaactttttacctacacactactcaggcaacatagttcatagatataatgatc

SEQ ID NO: 62862 - DNA, 75 bp, Artificial Sequence
  Synthetic
aatatggacaacattcctttatggcaaacaggatgagtaatacatctacacgtgcaattatatcaactaacacac

SEQ ID NO: 62863 - DNA, 75 bp, Artificial Sequence
  Synthetic
gaaaaccactggagctatttttccacgattgctctcagtcaataaattaatatagatataatacgacttcggtgt

SEQ ID NO: 62864 - DNA, 75 bp, Artificial Sequence
  Synthetic
tgggtaaatatgctgggggaggtcaagctgctattgatagtaatataatctttcaaaatactattaatttaggag

SEQ ID NO: 62865 - DNA, 75 bp, Artificial Sequence
  Synthetic
ttgcagttttagatattgcattgtctcttgctaaattgtcgtcagcatcaaatgtcactttccgtttaatgttaa

SEQ ID NO: 62866 - DNA, 75 bp, Artificial Sequence
  Synthetic
ctatttgacggtacatgacttgaatgtaataaggtaagttggtatctgaggtattttgtctagagtatactcaaa

SEQ ID NO: 62867 - DNA, 75 bp, Artificial Sequence
  Synthetic
ataagtgctgcacgcggcatgtaccgtccgaatacctatattttgataaacctttagatgtggatttgaacaagt

SEQ ID NO: 62868 - DNA, 75 bp, Artificial Sequence
  Synthetic
atcgtatgtctagcaaattatcaatagcaaagttaaattctcctaacctcatattttgatcaagtaatcatgatt

SEQ ID NO: 62869 - DNA, 75 bp, Artificial Sequence
  Synthetic
atatggacaatgagttggtttatgacaatgaccctctttgcagtgggattaaagggagattaggcagagtatctc

SEQ ID NO: 62870 - DNA, 75 bp, Artificial Sequence
  Synthetic
atattttgatcaagtaatcatgattttatggtaattctttgcagattatcggtttaatctttattaagaaaaaat

SEQ ID NO: 62871 - DNA, 75 bp, Artificial Sequence
  Synthetic
gatcaacactcacattgagtttgaatgtcagtgacattggttcttatgactttccaactattgctgcatggacac

SEQ ID NO: 62872 - DNA, 75 bp, Artificial Sequence
  Synthetic
taggagaaactatagtcggaagcattttttctgatgaatcttctcaaagtacggatccaataagctcaggttgca

SEQ ID NO: 62873 - DNA, 75 bp, Artificial Sequence
  Synthetic
caaaaactttcgtcacacatttccttgtgtatccagttgagagtatattttatgcattcggagctaacttaatag

SEQ ID NO: 62874 - DNA, 75 bp, Artificial Sequence
  Synthetic
ttgaaagtttaagtctaagtaggatcaaatcaattaagaacctctcagatttgacattccttatatcatccacaa

SEQ ID NO: 62875 - DNA, 75 bp, Artificial Sequence
  Synthetic
tcaggaatttatcacatagatcacttcggattcttcaatctactttccgacatgaattggtgctcacccgactag

SEQ ID NO: 62876 - DNA, 75 bp, Artificial Sequence
  Synthetic
gctataaagttgaaatgtctaatgcttaaatgaacatttctttgaagctgacatacgaatacatcatatcatatg

SEQ ID NO: 62877 - DNA, 75 bp, Artificial Sequence
  Synthetic
cccaccacataccgttaatttctttaatgttagggggctctgcaggagagaagagttcatcagatgctgttcggc

SEQ ID NO: 62878 - DNA, 75 bp, Artificial Sequence
  Synthetic
tatttcttacagcaagttatcagaattttatcaataatttcagttgtctgatgaagaagggtcagtcatcgctac

SEQ ID NO: 62879 - DNA, 75 bp, Artificial Sequence
  Synthetic
aagctcttggggagacaagaagaggtcccagagagtcccaacaggttggcataaggtcattaacaccagcatagt

SEQ ID NO: 62880 - DNA, 75 bp, Artificial Sequence
  Synthetic
cggtttggctttactttcctagtgaagggcaacaattaaagcctatattaaaaatcttacagagattatcagact

SEQ ID NO: 62881 - DNA, 75 bp, Artificial Sequence
  Synthetic
ataaggtcattaacaccagcatagtcagctcgatcaagactgtaagcgagtcgattgcaactaaaaagattattt

SEQ ID NO: 62882 - DNA, 75 bp, Artificial Sequence
  Synthetic
tgttatcacctgacaaaattcaaaagcgtaaaattttggctgacacctgttgtccaattggcagcttttgggtct

SEQ ID NO: 62883 - DNA, 75 bp, Artificial Sequence
  Synthetic
atccaagcaagtccacaaggactaaccattattatgcaagccttaattattggagagacaaagctaataaggtta

SEQ ID NO: 62884 - DNA, 75 bp, Artificial Sequence
  Synthetic
agaatactcctttttcacacttgataaattgttcatttcctgaattttcttcacataccagttcagtctcctcta

SEQ ID NO: 62885 - DNA, 75 bp, Artificial Sequence
  Synthetic
atcaacaagtgaccaattcgaagtatattgtttatccagaaaatatcactgaaataaatgcaagaaccagattaa

SEQ ID NO: 62886 - DNA, 75 bp, Artificial Sequence
  Synthetic
taaattatggatcaacagctctacaggggatggacaccaagatgccactctcagagcaaaatctagtcgaaaatt

SEQ ID NO: 62887 - DNA, 75 bp, Artificial Sequence
  Synthetic
gtcgaccatcagagggcatcagattcaaggacaatcaaaaaataacaaaacatgaccagagatgtgagagggagg

SEQ ID NO: 62888 - DNA, 75 bp, Artificial Sequence
  Synthetic
aatcttcaccgcaacagatgttccctgaagataacatgcagactcctgcgcacatacatagttcctccccatttc

SEQ ID NO: 62889 - DNA, 75 bp, Artificial Sequence
  Synthetic
aaatccttataaaatcactagatgcacatgaggactttgatgcctcgaagataatcttaaattctgaaataaata

SEQ ID NO: 62890 - DNA, 75 bp, Artificial Sequence
  Synthetic
atcttaaccttacggagtatactcttaatacaaagttattgacaactcctaccaggacagaaattttagatacaa

SEQ ID NO: 62891 - DNA, 75 bp, Artificial Sequence
  Synthetic
gtccgttacaatcctctagatattcatcaacttccagggaacggtctctactatccagagaacaagcttcatatt

SEQ ID NO: 62892 - DNA, 75 bp, Artificial Sequence
  Synthetic
tgtacgttgattgcagtaatattccttctatctctctagacccaggttttcggagtatgtctgatcagaatcaag

SEQ ID NO: 62893 - DNA, 75 bp, Artificial Sequence
  Synthetic
ttcaaatgttaatcaatacctacaaacgtgatttacatgcttgttttgatagcaatcaattctgtcggtttacag

SEQ ID NO: 62894 - DNA, 75 bp, Artificial Sequence
  Synthetic
gggtagtctcatcaatgcattacaagctttatgatcttttgcctccaggtaaattgaaaaaggcaatttgtttgg

SEQ ID NO: 62895 - DNA, 75 bp, Artificial Sequence
  Synthetic
ccgaaggggaaggaagtggtgctcggttacttttgaagtggaaggaaacggattatttattcttcaacactttgg

SEQ ID NO: 62896 - DNA, 75 bp, Artificial Sequence
  Synthetic
tttttaaaatggagattatcagcatttcttcaatgggaggagttagcaatcagaaattggagataaatggacatc

SEQ ID NO: 62897 - DNA, 75 bp, Artificial Sequence
  Synthetic
ttcttcaatgggaggagttagcaatcagaaattggagataaatggacatcgggatagaacaatgcctaactattg

SEQ ID NO: 62898 - DNA, 75 bp, Artificial Sequence
  Synthetic
ctacggattcacaacaagaagccgagattttgagtggccgggtaataccgagaatgttgtataacatagacagat

SEQ ID NO: 62899 - DNA, 75 bp, Artificial Sequence
  Synthetic
gggatagaacaatgcctaactattgggcggctttcatttttaaatgtgtatataaccaatcttttcctatctttg

SEQ ID NO: 62900 - DNA, 75 bp, Artificial Sequence
  Synthetic
taagtgctttgcttgaatcaaggagactaatattgaacaacctaactatccaaattacagatattacaaatccat

SEQ ID NO: 62901 - DNA, 75 bp, Artificial Sequence
  Synthetic
cttatattggtgtaactttactttaataacatgtcaatgctatactgttaagagaaggtctgaggaagattaaga

SEQ ID NO: 62902 - DNA, 75 bp, Artificial Sequence
  Synthetic
tatggctagattctgtaatacaatatttacctgaagatagtgacattcttacaatggacgcagagaccaccaagg

SEQ ID NO: 62903 - DNA, 75 bp, Artificial Sequence
  Synthetic
aaaaggtctcgtgttcacttggttgccgtcaagtatcctgtggtttttttctacctaacttcctcatgccatatg

SEQ ID NO: 62904 - DNA, 75 bp, Artificial Sequence
  Synthetic
atgaaacaagggaacagctttataaaactattgtgaatatttggacacgtacttctcctaatatcccaaaaatta

SEQ ID NO: 62905 - DNA, 75 bp, Artificial Sequence
  Synthetic
gctacccagcatacccagtacccggatgcacgtttatcttcacctatagtcctggatcaatgtgatttggtaact

SEQ ID NO: 62906 - DNA, 75 bp, Artificial Sequence
  Synthetic
gcatcatcaaggtatttttattagactatgaagggactttattcttaatgaagaatgctattcagtattatgggc

SEQ ID NO: 62907 - DNA, 75 bp, Artificial Sequence
  Synthetic
aagttcaactcaagaaaccatatagctcaaatgcaaaaaactcagaatggtacttgtgttgcggtaaacgaagaa

SEQ ID NO: 62908 - DNA, 75 bp, Artificial Sequence
  Synthetic
ttcaacggctccaaattgatttctcagaccaggtgggaatttttctgatttgtaaagcaatgtcacgccaaagac

SEQ ID NO: 62909 - DNA, 75 bp, Artificial Sequence
  Synthetic
aagcaattccttactggttaaaacatatagaaaagaattatcctgcttcattacacgagtttttcctaactttgg

SEQ ID NO: 62910 - DNA, 75 bp, Artificial Sequence
  Synthetic
gtttcccttctttagagtcatctttctgccatcgttatactattccattcagtgaaggaaaggctctttttcaca

SEQ ID NO: 62911 - DNA, 75 bp, Artificial Sequence
  Synthetic
ttgacaaacattacaactagagagaagcttaaaaacgaaattctaaacaatgattatgtccatcaattgttcttc

SEQ ID NO: 62912 - DNA, 75 bp, Artificial Sequence
  Synthetic
aggtccagtcttatgttcgtcaaggcaaacaacatttacattctcttatgttggattatgaaaacaattcacctc

SEQ ID NO: 62913 - DNA, 75 bp, Artificial Sequence
  Synthetic
tactagacttgagaaatcactttatttgctcattaaggggaaagataactaaatattacaatgatatattaaagt

SEQ ID NO: 62914 - DNA, 75 bp, Artificial Sequence
  Synthetic
taaatctagtcatcaaggcagtagaaaaaggtaaaaattggtcacaacttgttgagatccttcctaatatgcatt

SEQ ID NO: 62915 - DNA, 75 bp, Artificial Sequence
  Synthetic
cagtatgcatagtgcacgtggatcatgagtgttctggatgcgagaaacggttattacttaaattggattttatca

SEQ ID NO: 62916 - DNA, 75 bp, Artificial Sequence
  Synthetic
gaaatacaaagatcgcagaacaaaaattacttaacagagtaatcgggtatatcctattctttccattcggtctgt

SEQ ID NO: 62917 - DNA, 75 bp, Artificial Sequence
  Synthetic
ttaaatctggatcattaagggcataatttcaacagagagaacttcatttaattcacaaaaacaatctatttaaga

SEQ ID NO: 62918 - DNA, 75 bp, Artificial Sequence
  Synthetic
gtgagggttacattgtctaagatattgtatgagaagtaataaaataaataagaaaacgaaaagactattagacag

SEQ ID NO: 62919 - DNA, 75 bp, Artificial Sequence
  Synthetic
cttattttatacaagataatcttatatcgctttaggcctcacacaagtgagaaaattacgcgcacagattaacta

SEQ ID NO: 62920 - DNA, 75 bp, Artificial Sequence
  Synthetic
gtgattagtgtttggtcacaccagaggtaactttttaacgttaattactcagatgttattgctcataattagcat

SEQ ID NO: 62921 - DNA, 75 bp, Artificial Sequence
  Synthetic
taatattggcacattgggtgaatccttgagctttatccctaatatggtgtaagaaattaaggaaatactgagata

SEQ ID NO: 62922 - DNA, 75 bp, Artificial Sequence
  Synthetic
cactagttgaattgaattatgacataccatatatcataaatataaaaaagtgtctgctgtaatctacaagcacct

SEQ ID NO: 62923 - DNA, 75 bp, Artificial Sequence
  Synthetic
cttttaaatacattaggaaaagaattaagttaccgttgagatcaaaaaaaccacgtcatgttttctctgatgaca

SEQ ID NO: 62924 - DNA, 75 bp, Artificial Sequence
  Synthetic
agtgataaaacttcgtagttaaatttctagaatgtcgatgtgaatgtaaattaagaaaaaccaatatataaaatt

SEQ ID NO: 62925 - DNA, 75 bp, Artificial Sequence
  Synthetic
caatatataaaattaaaaaattaaaaagctttgatataagtaacacaaaacattcttcatcttttttgtgtgtcc

SEQ ID NO: 62926 - DNA, 75 bp, Artificial Sequence
  Synthetic
tcaatcgaaagtgtcctgaattatgcacaggaattacattatttattaccacagaataggaatttttccttttct

SEQ ID NO: 62927 - DNA, 75 bp, Artificial Sequence
  Synthetic
tcctcctgaaggcccgagttcgtaccgagggcacttaggaggcatagagggattacaacaaaaactgtggacgag

SEQ ID NO: 62928 - DNA, 75 bp, Artificial Sequence
  Synthetic
aaagtgtttttatcgaaacttcggagatcctgtgacttctggacttttccagctacgggtgtacctagaaatggt

SEQ ID NO: 62929 - DNA, 75 bp, Artificial Sequence
  Synthetic
agaattagcatcaaggctcacttgggttacacaaggaagttctaatagtgaacaattaatccggcctttcttaga

SEQ ID NO: 62930 - DNA, 75 bp, Artificial Sequence
  Synthetic
tcatttatggcgaatcgcatgagcaatactgcgacccgtctcatagtgtcaactaatacacttggagaattttca

SEQ ID NO: 62931 - DNA, 75 bp, Artificial Sequence
  Synthetic
ctgatataaggcataatagggctcatcttcacctgacagagtgctgtactaaagaggtcccggcccagtatttga

SEQ ID NO: 62932 - DNA, 75 bp, Artificial Sequence
  Synthetic
tggatgggagttagcgaaaacggtggtacaatccatcatctcagacaatagcaactcatcaacagatccaatcag

SEQ ID NO: 62933 - DNA, 75 bp, Artificial Sequence
  Synthetic
tagcggagaaacacgctctttcacaactcattttctcacttaccctcagattggccttctttacagtttcggggc

SEQ ID NO: 62934 - DNA, 75 bp, Artificial Sequence
  Synthetic
attatgaacagtttctatattatttgcataaccagctgcacaacttacctcatcgagcactccgtgtttttaaac

SEQ ID NO: 62935 - DNA, 75 bp, Artificial Sequence
  Synthetic
caacatttaagcatgccagtgtgatgtcccgattaatggaaattgattccaacttctcaatttatattggcggga

SEQ ID NO: 62936 - DNA, 75 bp, Artificial Sequence
  Synthetic
catctggagatcgagggctgtctgatgctgctcgactgtttcttcggacagcaatcgcgagttttttacaatttc

SEQ ID NO: 62937 - DNA, 75 bp, Artificial Sequence
  Synthetic
gcattcaaaatgatggacatttggatttggcagaaaataattatgtttacaatagtaagagcactgctagtaatt

SEQ ID NO: 62938 - DNA, 75 bp, Artificial Sequence
  Synthetic
tttggcagaaaataattatgtttacaatagtaagagcactgctagtaatttcttccatgcatccttagcttactg

SEQ ID NO: 62939 - DNA, 75 bp, Artificial Sequence
  Synthetic
caagaccataatgatttctcaagaggggatggaacacttacagaacccgtgtgtaagttctcaagcaatcatcag

SEQ ID NO: 62940 - DNA, 75 bp, Artificial Sequence
  Synthetic
tcagatgaaaagtactacaatgtgacatgtggaaagtcaccgaagccgcaagaacgcaaagacttctcgcaatac

SEQ ID NO: 62941 - DNA, 75 bp, Artificial Sequence
  Synthetic
tgagtaatcatcgtaagaaagggaagttccacaagtggaatccctgcaaagtgttaatggagagtcaaaggggaa

SEQ ID NO: 62942 - DNA, 75 bp, Artificial Sequence
  Synthetic
ctgttctaaaagagggtgactactttcaaaacaatactccaccaacagatgatgtatcaagtcctcaccgactca

SEQ ID NO: 62943 - DNA, 75 bp, Artificial Sequence
  Synthetic
ttctaccattttttaaattgggaaatcacaaccatgcacatgatcaagatgcccaagaattgataaatcaaaata

SEQ ID NO: 62944 - DNA, 75 bp, Artificial Sequence
  Synthetic
ttaccaataatgcaaaaggttcatgaaggacaagtcactgttatcttaaataattcagcaagtcagataactgac

SEQ ID NO: 62945 - DNA, 75 bp, Artificial Sequence
  Synthetic
ggagatcggcccatcagactcacaaggcatgtcttggtgttatcagagatgctttgcaagcacaagtccagcgag

SEQ ID NO: 62946 - DNA, 75 bp, Artificial Sequence
  Synthetic
acagtatgctacaaagaatctccattgtgaatacatatgccttggtttcccacctctagaaaaggtcctatatca

SEQ ID NO: 62947 - DNA, 75 bp, Artificial Sequence
  Synthetic
cacctctagaaaaggtcctatatcacaggtataatctagttgatactggactcggtccattgtcgtcagttatta

SEQ ID NO: 62948 - DNA, 75 bp, Artificial Sequence
  Synthetic
aatgactttctgaagttttctttaattgtccaggcactcaaaaataattcttcttggtatactgagcttaaaaaa

SEQ ID NO: 62949 - DNA, 75 bp, Artificial Sequence
  Synthetic
ttcttggtatactgagcttaaaaaattacctgaggtgattaatgtgtgtaatcgattttatcatactcacagttg

SEQ ID NO: 62950 - DNA, 75 bp, Artificial Sequence
  Synthetic
acgccttaccgggttaatgcgattttatccagaagggttaatatattccaatcacacataggtactaaatcatca

SEQ ID NO: 62951 - DNA, 75 bp, Artificial Sequence
  Synthetic
attctaagtatatcggaagagagtatgccaatcttaattattaaaggtaacaagctattagttattacttattga

SEQ ID NO: 62952 - DNA, 75 bp, Artificial Sequence
  Synthetic
tgcatttctaatcctagtatttattagaatgtactatcagagaaatgaccccagttcctatctttaaataatgat

SEQ ID NO: 62953 - DNA, 75 bp, Artificial Sequence
  Synthetic
tgtgtgtattaaattattagtttattaggtttatgagttggttacacagtgagtattagtaattgaggattatgt

SEQ ID NO: 62954 - DNA, 75 bp, Artificial Sequence
  Synthetic
cccatctgatgtcaccatatccaaatattgtgctagtcgcatttaaacatgctatcttcagttaagtaacataga

SEQ ID NO: 62955 - DNA, 75 bp, Artificial Sequence
  Synthetic
caagtcaaaaataatgtcaatataattgtttagtaatatgagttataatgtgaattttgataactaactagcttt

SEQ ID NO: 62956 - DNA, 75 bp, Artificial Sequence
  Synthetic
ttgtttagtaatatgagttataatgtgaattttgataactaactagctttagtagttaagatcaaatgcaaacat

SEQ ID NO: 62957 - DNA, 75 bp, Artificial Sequence
  Synthetic
atgcaaacattctaagaatgttaagcgcacacaaaaacattataaaaaaccaattttttcctttttgtgtgtccc

SEQ ID NO: 62958 - DNA, 75 bp, Artificial Sequence
  Synthetic
gtgtgcgagtaactatgaggaagattaacagttttcctcagtttaaggtatacactgaaattgaaattgagattc

SEQ ID NO: 62959 - DNA, 75 bp, Artificial Sequence
  Synthetic
ccagggagttgcgtgtcatcattaattaggaagatcaaggaaacagtttgttccaataatatcgtatatcttgac

SEQ ID NO: 62960 - DNA, 75 bp, Artificial Sequence
  Synthetic
gaggacacccttatagatcaaggcgatgatgatctctcaagcccacctccgctggaatctgatgatgacgatgca

SEQ ID NO: 62961 - DNA, 75 bp, Artificial Sequence
  Synthetic
taagagtttaagcaatatacatatacacttacaccggtctatccaagatgtggctcaatgttcttaatttgaaca

SEQ ID NO: 62962 - DNA, 75 bp, Artificial Sequence
  Synthetic
cgccagtaaatgattatattgtctgtaggcaggtgtttactccaccttaaagtcggaaatatcctaccttaggac

SEQ ID NO: 62963 - DNA, 75 bp, Artificial Sequence
  Synthetic
cattgttaagaggtgcataggcattaccatccttgagaacatgtacaataataaattgaagatatgttcaggccc

SEQ ID NO: 62964 - DNA, 75 bp, Artificial Sequence
  Synthetic
caacaagaacttgtacaagtagcagtcagacggaggtcaactatgtacctctccttaaaaaggttgaggatacat

SEQ ID NO: 62965 - DNA, 75 bp, Artificial Sequence
  Synthetic
aatggtcatacttgaatatgacaacatcttgcttcttgttttgccttgtgtttctttgaattgaaagatcattcc

SEQ ID NO: 62966 - DNA, 75 bp, Artificial Sequence
  Synthetic
aaacttacaaacatgcacaagatgttatggtttagcaaagaattgataggagtactggtatataatgtaaatata

SEQ ID NO: 62967 - DNA, 75 bp, Artificial Sequence
  Synthetic
aaactccagcaggagcagtcaatgctcttcgtcctgggctctcactccatcccaagcttcgtccaattcttctac

SEQ ID NO: 62968 - DNA, 75 bp, Artificial Sequence
  Synthetic
taccggacctcaaaattgtcccgattgatccaaccaagaacatagttggaattgaggttccagaattactagttc

SEQ ID NO: 62969 - DNA, 75 bp, Artificial Sequence
  Synthetic
aaaggctgaccggcaaaaagccacaacccaaaaatggccaaccaattattccagttcttcttccgaaatatgttg

SEQ ID NO: 62970 - DNA, 75 bp, Artificial Sequence
  Synthetic
cagcttacgcctagataactaatattaaggagttttttaatctaattttcaagtcttaagtaataagtatttctt

SEQ ID NO: 62971 - DNA, 75 bp, Artificial Sequence
  Synthetic
ttgtaattaattatgcatttgttaacttatcggtgcgagatttccttgagagcccggcggggcttctactatctg

SEQ ID NO: 62972 - DNA, 75 bp, Artificial Sequence
  Synthetic
acatggggtcaggatatcaacttcttcaattgcctcgggaacgttttcgtaaaacttcattcctagtatgggcaa

SEQ ID NO: 62973 - DNA, 75 bp, Artificial Sequence
  Synthetic
ctccgcagttccttgttcagctcaatgaaacacttcggagaaataatcgccttagcaacagtacagggagattaa

SEQ ID NO: 62974 - DNA, 75 bp, Artificial Sequence
  Synthetic
cttggacattggatcccaaaattgaaccaaatgttggtgagtgggccttttgggaaactaaaaaaacttttccaa

SEQ ID NO: 62975 - DNA, 75 bp, Artificial Sequence
  Synthetic
accaccattgccctaagtccaaccatgacaagcaaggttgacaacaatgtaccaagtgaacaaccgaacaacacg

SEQ ID NO: 62976 - DNA, 75 bp, Artificial Sequence
  Synthetic
cggcaagcaacgagacaattgaccactccgaaatgaattcgatccagggctcgaacaactccacccagagcccac

SEQ ID NO: 62977 - DNA, 75 bp, Artificial Sequence
  Synthetic
tcgaacaactccacccagagcccacagaccaagaccaagccagcgcccacagcatccctgatgaccctgggcccg

SEQ ID NO: 62978 - DNA, 75 bp, Artificial Sequence
  Synthetic
taatatattaagaaaaacttatgacgaagattaaaggggaggatcgttaacgggaaaatctcccatctcgttcgt

SEQ ID NO: 62979 - DNA, 75 bp, Artificial Sequence
  Synthetic
gtacagttgaatagaaaaccactggagctatttttccacgattgctctcagtcaataaattaatatagatataat

SEQ ID NO: 62980 - DNA, 75 bp, Artificial Sequence
  Synthetic
acgacttcggtgtgcaattgtcaagggttccatttagtaataatgattcttaaaacaatctactatcgcaattat

SEQ ID NO: 62981 - DNA, 75 bp, Artificial Sequence
  Synthetic
gactgtaagcgagtcgattgcaactaaaaagattatttcttgttgtttaaacaaattccttttgtgtgagacatc

SEQ ID NO: 62982 - DNA, 75 bp, Artificial Sequence
  Synthetic
acttcatgagtctgccttcaaacctttcactcgtgttccgcaatctgggatgcaatcattaataatggagttcaa

SEQ ID NO: 62983 - DNA, 75 bp, Artificial Sequence
  Synthetic
ttttcactaactgcattgagcactgctagtaggtttgcattacgttaaagattcagagtgtatgaattgtgaaga

SEQ ID NO: 62984 - DNA, 75 bp, Artificial Sequence
  Synthetic
cttcacctatagtcctggatcaatgtgatttggtaactcgagcatgtgggttatattcatcttattctctaaatc

SEQ ID NO: 62985 - DNA, 75 bp, Artificial Sequence
  Synthetic
ttgattactatctcaaggcaacaggtgcacaggaccatttgacaaacattacaactagagagaagcttaaaaacg

SEQ ID NO: 62986 - DNA, 75 bp, Artificial Sequence
  Synthetic
ccaaggaacttggtacagtgtaatctcagacaggaatttaactccgggactcaactccttcataaaacgtaatca

SEQ ID NO: 62987 - DNA, 75 bp, Artificial Sequence
  Synthetic
ttagcagatggactggctaaggccttccccagtaacatgatggtagtaactgaacgtgaacaaaaagagagcctt

SEQ ID NO: 62988 - DNA, 75 bp, Artificial Sequence
  Synthetic
ggaggcatagagggattacaacaaaaactgtggacgagtatatcctgtgcacaaatctccttagtggaaattaaa

SEQ ID NO: 62989 - DNA, 75 bp, Artificial Sequence
  Synthetic
tttttacaatttcttaaaagctggatcatcgatcgccaaaagacaattcctttatggatagtatatccgcttgaa

SEQ ID NO: 62990 - DNA, 75 bp, Artificial Sequence
  Synthetic
tttatggatagtatatccgcttgaaggtcaacagccggaatccatcaatgaatttctacataaaattttgggtct

SEQ ID NO: 62991 - DNA, 75 bp, Artificial Sequence
  Synthetic
caccaaagccacaagaacgcaaagacttctcgcaatacagactcagcaataacagacgaacaatgagtaatcatc

SEQ ID NO: 62992 - DNA, 75 bp, Artificial Sequence
  Synthetic
tattacttattgataagaataaactttatcatagcgtaacacatcataactttataacgattttgcatttctaat

SEQ ID NO: 62993 - DNA, 75 bp, Artificial Sequence
  Synthetic
tttaaataatgattgtgtgtattaaattattagtttattaggtttatgagttggttacacagtgagtattagtaa

SEQ ID NO: 62994 - DNA, 75 bp, Artificial Sequence
  Synthetic
ttgaggattatgtagataggcaatctaatactgaatcacccatctgatgtcaccatatccaaatattgtgctagt

SEQ ID NO: 62995 - DNA, 75 bp, Artificial Sequence
  Synthetic
taatatgagttataatgtgaattttgataactaactaactttagtagttaagatcaaatgcaaacattctaagaa

SEQ ID NO: 62996 - DNA, 75 bp, Artificial Sequence
  Synthetic
atcaaggtgatactgatttagattatcataaaattttgacagctggccttactgttcaacagggaattgtcaggc

SEQ ID NO: 62997 - DNA, 75 bp, Artificial Sequence
  Synthetic
aaaattagaagagacatatcaccatctgctgagaactcaaggtccatttgaagctatcaattattatcacatgat

SEQ ID NO: 62998 - DNA, 75 bp, Artificial Sequence
  Synthetic
tttacataaataatcaacagttcttctggcctgtcatgagtcccagagacaaatttcttgcaatcttgcagcacc

SEQ ID NO: 62999 - DNA, 75 bp, Artificial Sequence
  Synthetic
attgtggattgacccattctgcttaaaatgcttcgcccattaaaaatgtgatctaatagatagccctgactagac

SEQ ID NO: 63000 - DNA, 75 bp, Artificial Sequence
  Synthetic
gcttggacttaagatctaaggatcaagatttatttaacaaggcaagccacaaccttagatagaacctcagccaga

SEQ ID NO: 63001 - DNA, 75 bp, Artificial Sequence
  Synthetic
ctcccaacccgaccaagtgtcatagtcaatgagaccaaatcagatgtactggcagtgccaggagcagatgttcca

SEQ ID NO: 63002 - DNA, 75 bp, Artificial Sequence
  Synthetic
accagtccagcttccccagtatttcacatttgatctaacagctctaaagctcatcactcaaccattgccagctgc

SEQ ID NO: 63003 - DNA, 75 bp, Artificial Sequence
  Synthetic
aggcaacagactcacagcttacgcctagatgactaatattaaggagttttttaatctaattttccagtcttaagt

SEQ ID NO: 63004 - DNA, 75 bp, Artificial Sequence
  Synthetic
caccaacaactccgagctggttccaacggattcccctccagtggtttcagtgctcactgcaggacggacagagga

SEQ ID NO: 63005 - DNA, 75 bp, Artificial Sequence
  Synthetic
tgaccctggacccgcaagagacggccaacagcagcaaaccaggaaccagcccaggaagcgcagccgaaccaagtc

SEQ ID NO: 63006 - DNA, 75 bp, Artificial Sequence
  Synthetic
caacagcagcaaaccaggaaccagcccaggaagcgcagccgaaccaagtcagcccggactcactataaatacaat

SEQ ID NO: 63007 - DNA, 75 bp, Artificial Sequence
  Synthetic
tataattgctataatagccctactttgtatatgtaagattttgtgttgatttattctgagatctgagagaaaaaa

SEQ ID NO: 63008 - DNA, 75 bp, Artificial Sequence
  Synthetic
acattgtacccagcacaagacaattctacaccatccgaggcaactaatgataccacctggtcaagtacagttgaa

SEQ ID NO: 63009 - DNA, 75 bp, Artificial Sequence
  Synthetic
ggaatcaggaattcaactttagttccttaaggcctcgtctgaatcttcatcagttagtaagttcttttatagaag

SEQ ID NO: 63010 - DNA, 75 bp, Artificial Sequence
  Synthetic
ctgccttcaaacctttcactcgtgttccacaatctgggatgcaatcattaataatggagttcaacagtttgttgg

SEQ ID NO: 63011 - DNA, 75 bp, Artificial Sequence
  Synthetic
caatttaacaaggtgatcttaaaataagtacatgaatgagaattagttgtgggtcttacctagcattgttgagtt

SEQ ID NO: 63012 - DNA, 75 bp, Artificial Sequence
  Synthetic
aagtacatgaatgagaattagttgtgggtcttacctagcattgttgagttagctatctaatctattttcactaat

SEQ ID NO: 63013 - DNA, 75 bp, Artificial Sequence
  Synthetic
agctatctaatctattttcactaattgcattgagcactgctagtaggtttgcaccacgttaaagattcagagtgt

SEQ ID NO: 63014 - DNA, 75 bp, Artificial Sequence
  Synthetic
atgaattgtgcagatttaaacttgggttttgccttatgcttcataggtggtctttttaaaatggagattatcagc

SEQ ID NO: 63015 - DNA, 75 bp, Artificial Sequence
  Synthetic
gaagcgagagtcaaccttagtgtcagtgaagtcctgcaaatgacaccatcacattattcaggaaatattgtccat

SEQ ID NO: 63016 - DNA, 75 bp, Artificial Sequence
  Synthetic
tattaaacagtacctacatcagctaaggtctatgttggacaccactatatattgtagattcacagggattgtctc

SEQ ID NO: 63017 - DNA, 75 bp, Artificial Sequence
  Synthetic
tatttttgaacacattggcaacagaacacagtatagagtcagaagttgtatcaggtttttctactccgagaatgt

SEQ ID NO: 63018 - DNA, 75 bp, Artificial Sequence
  Synthetic
gtagataggtaatctaacactgaatcacccatctgatgtcaccatatccaaatattgtgctagtcgcatttaaac

SEQ ID NO: 63019 - DNA, 75 bp, Artificial Sequence
  Synthetic
atgctatcttcagttaagtaacatagactgaaaatgctaagaagagattggagtaaaagtataaaataaatttaa

SEQ ID NO: 63020 - DNA, 75 bp, Artificial Sequence
  Synthetic
ttaaacttcaaagtgattaaatgataatgatcttgggaactcgatatgacctcaagtcaaaaataatgtcaatat

SEQ ID NO: 63021 - DNA, 75 bp, Artificial Sequence
  Synthetic
cggacacacaaaaagaaaaaaggttttttaagactttttgtgtgcgagtaactatgaggaagattaacagttttc

SEQ ID NO: 63022 - DNA, 75 bp, Artificial Sequence
  Synthetic
caccagtgcacgaagaggacacccttatggatcaaggtgatgatgatccctcaagcttacctccgctggaatctg

SEQ ID NO: 63023 - DNA, 75 bp, Artificial Sequence
  Synthetic
atcagtaaccacagcacaaagcgcggtccacttcgtaaagctaaatacacttaagacttgaccgattcatctaca

SEQ ID NO: 63024 - DNA, 75 bp, Artificial Sequence
  Synthetic
aaaactaatccattataacttattagtgctacttttctataagtgattcttaatctaaggccattaagagtttaa

SEQ ID NO: 63025 - DNA, 75 bp, Artificial Sequence
  Synthetic
aaatgcttcgcccattgaaaatgtgatctaatagatagccctgactagacaaattaagaaaaacatttgatgaag

SEQ ID NO: 63026 - DNA, 75 bp, Artificial Sequence
  Synthetic
ggttgaggatacattaactatgctagtgaatgccaccagtcgtcagaatgctgcaatcgaggcccttgaaaaccg

SEQ ID NO: 63027 - DNA, 75 bp, Artificial Sequence
  Synthetic
cgaggaaaattttgggaaaccttatatatctgctaaagacctgaaggagatcatgtatgatcatctacctggttt

SEQ ID NO: 63028 - DNA, 75 bp, Artificial Sequence
  Synthetic
tgttctgccttgtagctctttgaattggaagatcattccaaacttacaaacatgcacaagatgttatggtttagc

SEQ ID NO: 63029 - DNA, 75 bp, Artificial Sequence
  Synthetic
ttccagacttggcatttcttatcttcatcttctaaagtgagatattttatcatcaaaaaatgaggcgcggagtgt

SEQ ID NO: 63030 - DNA, 75 bp, Artificial Sequence
  Synthetic
catcaaaaaatgaggcgcggagtgttaccaacggctcctccagcatataatgatattgcataccctatgagcata

SEQ ID NO: 63031 - DNA, 75 bp, Artificial Sequence
  Synthetic
ggaaagaaaggacatgcttcagacttaacatcacctgacaagattcaaacaatcatgaatgcaataccggacctc

SEQ ID NO: 63032 - DNA, 75 bp, Artificial Sequence
  Synthetic
ttatcacccaggattgtgattcatgccactctccagccagccatccgtatcacatggacaagcagaatagttacc

SEQ ID NO: 63033 - DNA, 75 bp, Artificial Sequence
  Synthetic
gtaagctgctatttcttacctccccaaattacctatacaacatggggtcaggatatcaacttctccaattgcctc

SEQ ID NO: 63034 - DNA, 75 bp, Artificial Sequence
  Synthetic
gaatgggcagaaaattgctacaatctggagatcaaaaagtcagacggaagtgaatgcctccctctccctcccgac

SEQ ID NO: 63035 - DNA, 75 bp, Artificial Sequence
  Synthetic
agccgaacaacacagcatccattgaagactcccccccatcggcaagcaacgagacaatttaccactccgagatgg

SEQ ID NO: 63036 - DNA, 75 bp, Artificial Sequence
  Synthetic
atccgatccaaggctcgaacaactccgcccagagcccacagaccaagaccacgccagcacccacaacatccccga

SEQ ID NO: 63037 - DNA, 75 bp, Artificial Sequence
  Synthetic
cccaaattcgtgttccgaatctgttccatcggaaaaagactgatgcactcatagttcctccggctcctaaagata

SEQ ID NO: 63038 - DNA, 75 bp, Artificial Sequence
  Synthetic
gtaataatgattcttaaaacaatctactatcgcaattatcgatggatctaccctatttgacggtacatgacttga

SEQ ID NO: 63039 - DNA, 75 bp, Artificial Sequence
  Synthetic
aactatctaatctattttcgctaattgcattgagcactgctaataggtttgtatcacgttaaagatttagagtgt

SEQ ID NO: 63040 - DNA, 75 bp, Artificial Sequence
  Synthetic
gtatcacgttaaagatttagagtgtatgaattgtgcagatttaaacttgggttttgccttatgcttcataggtgg

SEQ ID NO: 63041 - DNA, 75 bp, Artificial Sequence
  Synthetic
ctaatgtcatctttgagacatattgtgtattcaagtacaatattgccaagcactatttcgacagccaaggaactt

SEQ ID NO: 63042 - DNA, 75 bp, Artificial Sequence
  Synthetic
ccagctacgggtgtacctagaaatggttaacatgaaagacctattttgtccattaatatcgaaaaatccaggaaa

SEQ ID NO: 63043 - DNA, 75 bp, Artificial Sequence
  Synthetic
gacatatacaagtgcacttaatctggatttaagccgttatcgtgataatgaactaatatatgactcaaatccact

SEQ ID NO: 63044 - DNA, 75 bp, Artificial Sequence
  Synthetic
attcagctatcacattagctgaaggtgaggggtcaggggctctattacttttgcaaaaatatagtacaaggttat

SEQ ID NO: 63045 - DNA, 75 bp, Artificial Sequence
  Synthetic
caatcacacataggtactaaatcatcatagtatgaggaataagataatgataattcctgacgacagttttagttc

SEQ ID NO: 63046 - DNA, 75 bp, Artificial Sequence
  Synthetic
cccaggaatacccgatcatccgttccggctcctgaggttgggcaaaaaagcgttccttcccgggtttgttcttcc

SEQ ID NO: 63047 - DNA, 75 bp, Artificial Sequence
  Synthetic
aataattcatcaagtcacataactgacataactagctcaatgtggctaagtagtaatcaaaaatataatctacct

SEQ ID NO: 63048 - DNA, 75 bp, Artificial Sequence
  Synthetic
tatcacaggtataatctagttgatactggactcggtccattgtcgtcagttattagacatttaactaacctccag

SEQ ID NO: 63049 - DNA, 75 bp, Artificial Sequence
  Synthetic
ggtaacaagctattagttattacttattgataagaatacactttatcatagcgtaacacatcataactttataac

SEQ ID NO: 63050 - DNA, 75 bp, Artificial Sequence
  Synthetic
cggacacacaaaaagaaagaaggttttttgatctttattgtgtgcgaataactatgaggaagattaataattttc

SEQ ID NO: 63051 - DNA, 75 bp, Artificial Sequence
  Synthetic
ctctcattgacacttacattaagattaagattctcattgatctgttacttactctgaggataataattggtgttc

SEQ ID NO: 63052 - DNA, 75 bp, Artificial Sequence
  Synthetic
agaagtaccccattccccagtgggggcaaagacagtccaaaagactcaacttgtcctattcaactaatctgtttt

SEQ ID NO: 63053 - DNA, 75 bp, Artificial Sequence
  Synthetic
gtctcagtagttcacatattgatcatacccaggagttggacctaattccaaagcttagagtgggacctagtgtat

SEQ ID NO: 63054 - DNA, 75 bp, Artificial Sequence
  Synthetic
cctcggggctgtaatataatcagccatttaacacataacaagccctactgttttcttgttttgccgtgcatttag

SEQ ID NO: 63055 - DNA, 75 bp, Artificial Sequence
  Synthetic
aataagagacaacttaaacctccgattcggcaacacagggaataatctcaccagacccggcagtgtcttcaggct

SEQ ID NO: 63056 - DNA, 75 bp, Artificial Sequence
  Synthetic
tcatagccccaagatggagagtcgggcccacaaagcatggatgacgcacaccgcatcaggtttcgaaacagatta

SEQ ID NO: 63057 - DNA, 75 bp, Artificial Sequence
  Synthetic
ccataagattttaacagcaggattgtcagtccaacaaggcattgtgagacaacgggtcattcaagtccaccaggt

SEQ ID NO: 63058 - DNA, 75 bp, Artificial Sequence
  Synthetic
tacaaacctagaagaaatatgccaattgatcattcaagcctttgaagctggtgttgattttcaagagagtgcaga

SEQ ID NO: 63059 - DNA, 75 bp, Artificial Sequence
  Synthetic
cagtttcttgctgatgctatgtttacatcatgcttatcagggtgactacaagcaattcttggaaagcaatgcagt

SEQ ID NO: 63060 - DNA, 75 bp, Artificial Sequence
  Synthetic
caagtaccttgagggtcatggctttcgctttgaggtcaggaaaaaggaaggagtcaagcgactcgaagaattgct

SEQ ID NO: 63061 - DNA, 75 bp, Artificial Sequence
  Synthetic
tcctgctgcatccagtggcaagagcatcaggagaacactggctgcaatgcctgaagaggagacaacagaagcaaa

SEQ ID NO: 63062 - DNA, 75 bp, Artificial Sequence
  Synthetic
tgccggacagttcctctcttttgctagcttatttcttcctaagctagttgtcggagaaaaagcctgtctagaaaa

SEQ ID NO: 63063 - DNA, 75 bp, Artificial Sequence
  Synthetic
ggtgcagcggcaaattcaagttcattctgagcagggattgatccaataccccacagcctggcagtcagttggaca

SEQ ID NO: 63064 - DNA, 75 bp, Artificial Sequence
  Synthetic
catgatggtcattttcagactgatgagaacaaattttctaattaagttcctccttatacatcaagggatgcatat

SEQ ID NO: 63065 - DNA, 75 bp, Artificial Sequence
  Synthetic
ggtagcaggacacgatgctaacgatgctgtcatcgcaaactctgtagctcaagcacgtttttcaggattattgat

SEQ ID NO: 63066 - DNA, 75 bp, Artificial Sequence
  Synthetic
cgttaaaacagtgctagatcacatccttcagaaaacagagcacggagtgcgtcttcatcctttggcaagaactgc

SEQ ID NO: 63067 - DNA, 75 bp, Artificial Sequence
  Synthetic
taaggtcaagaacgaagtaaattcctttaaggctgcccttagctcgctagcacaacatggagagtatgctccttt

SEQ ID NO: 63068 - DNA, 75 bp, Artificial Sequence
  Synthetic
tgctcgcttgctgaatctttctggagtcaacaatctcgagcacggactgtttcctcagctttctgcaattgccct

SEQ ID NO: 63069 - DNA, 75 bp, Artificial Sequence
  Synthetic
aggtgtcgcaacggcacacggcagtaccctggcaggagtaaatgtgggggaacagtatcagcaactacgagaagc

SEQ ID NO: 63070 - DNA, 75 bp, Artificial Sequence
  Synthetic
agccactgaggcagaaaaacaattgcagaaatacgctgaatctcgcgagcttgaccatctaggtctcgatgatca

SEQ ID NO: 63071 - DNA, 75 bp, Artificial Sequence
  Synthetic
agagaagaagatcttgaaagacttccatcagaagaaaaatgaaatcagcttccagcagacaacagccatggtcac

SEQ ID NO: 63072 - DNA, 75 bp, Artificial Sequence
  Synthetic
actacggaaggaaaggctagccaagctcactgaggcaatcacctccacatcccttctcaagacaggaaaacagta

SEQ ID NO: 63073 - DNA, 75 bp, Artificial Sequence
  Synthetic
tgatgatgacaacgatatcccctttcctgggcccatcaatgataacgaaaactcagaacagcaagacgatgatcc

SEQ ID NO: 63074 - DNA, 75 bp, Artificial Sequence
  Synthetic
aacagattctcaggacactaccatccctgatatcattgttgacccggatgatggcagatacaacaattatggaga

SEQ ID NO: 63075 - DNA, 75 bp, Artificial Sequence
  Synthetic
ctatcctagtgagacggcgaatgcccctgaagaccttgttctttttgaccttgaagatggtgacgaggatgatca

SEQ ID NO: 63076 - DNA, 75 bp, Artificial Sequence
  Synthetic
ccgaccgtcaagttcatcagagaacaacaacaaacacagtcttacaggaactgacagtaacaaaacaagtaactg

SEQ ID NO: 63077 - DNA, 75 bp, Artificial Sequence
  Synthetic
gaatcgaaacccgactaatatgccaaagaaagactccacacaaaacaatgacaatcctgcacagcgggctcaaga

SEQ ID NO: 63078 - DNA, 75 bp, Artificial Sequence
  Synthetic
atacgccagggataacatccaggatacaccaacaccccatcgagctctaactcccatcagcgaagaaaccggctc

SEQ ID NO: 63079 - DNA, 75 bp, Artificial Sequence
  Synthetic
caatggtcacaatgaagatgacattgatagcatccctcctttggaatcagacgaagaaaacaacactgagacaac

SEQ ID NO: 63080 - DNA, 75 bp, Artificial Sequence
  Synthetic
cattaccaccacaaaaaataccactgctccaccagcacctgtttatcggagtaattcagaaaaggagcccctccc

SEQ ID NO: 63081 - DNA, 75 bp, Artificial Sequence
  Synthetic
gcaagaaaaatcccagaagcaaccaaaccaagtgagtggtagtgagaataccgacaataaacctcactcagagca

SEQ ID NO: 63082 - DNA, 75 bp, Artificial Sequence
  Synthetic
atcagtggaagaaatgtatcgacacatcctccaaacacaaggaccatttgatgccatcctatactattacatgat

SEQ ID NO: 63083 - DNA, 75 bp, Artificial Sequence
  Synthetic
gacggaggagccgattgtctttagcactagtgatgggaaagaatacgtataccctgattctcttgaaggggagca

SEQ ID NO: 63084 - DNA, 75 bp, Artificial Sequence
  Synthetic
tccaccgtggctcagtgaaaaagaggccttgaatgaggacaataggtttatcacaatggatgatcaacaattcta

SEQ ID NO: 63085 - DNA, 75 bp, Artificial Sequence
  Synthetic
ctggcctgtaatgaatcacaggaacaaattcatggctatccttcagcaccacaagtaatttcttcataatgacag

SEQ ID NO: 63086 - DNA, 75 bp, Artificial Sequence
  Synthetic
atcattgtaaggttattaccaccatccctgcaacaaagcatgaaaaccacactcaacaacgccctaccacaggat

SEQ ID NO: 63087 - DNA, 75 bp, Artificial Sequence
  Synthetic
accttggagaccatacaccaagatcagcagctgtgcaaccacccccatgcgaatccaccaccacaaccaccaaac

SEQ ID NO: 63088 - DNA, 75 bp, Artificial Sequence
  Synthetic
aataatcccaagaccaaaccgcacacatccagatcaacccaaaccctcaaacaccaccccactccgcgatcccag

SEQ ID NO: 63089 - DNA, 75 bp, Artificial Sequence
  Synthetic
accaaactccgccccagacaagcaccccacccatcccagaaaccgcacggccgagaatcgatccccagcattcaa

SEQ ID NO: 63090 - DNA, 75 bp, Artificial Sequence
  Synthetic
aatgcgttattaagaaaaaacatatgatgaagattaaaaccttcatcaacattgcacagactttgatccttagga

SEQ ID NO: 63091 - DNA, 75 bp, Artificial Sequence
  Synthetic
gtttattctagctatctacaaaacgggtccaaaacggaatgatttccactagggctgcagcaatcaatgatcctt

SEQ ID NO: 63092 - DNA, 75 bp, Artificial Sequence
  Synthetic
cattaccaatcagaaaccagtgtacacgtggccctgaactatcaggatggatctccgaacaattaatgacaggca

SEQ ID NO: 63093 - DNA, 75 bp, Artificial Sequence
  Synthetic
aaattccggtacatgaaatcttcaacgacactgagccccacataagctcagggtccgactgccttcccagaccca

SEQ ID NO: 63094 - DNA, 75 bp, Artificial Sequence
  Synthetic
aaaacacggccccccggactcgcaacacccagacacagaccgatccggtttgcaatcacaattttgaagacgtta

SEQ ID NO: 63095 - DNA, 75 bp, Artificial Sequence
  Synthetic
cacaagcactaacatcattaaccaatgtcatacaaaaacaggctcttaacttagagtctctcgaacaacgcatca

SEQ ID NO: 63096 - DNA, 75 bp, Artificial Sequence
  Synthetic
tagatctagagaatggcttaaagccaatgtatgacatggctaaagtcatttctgcattgaatagatcttgtgctg

SEQ ID NO: 63097 - DNA, 75 bp, Artificial Sequence
  Synthetic
agatggtagcaaaatatgatctcctggtgatgacaactggccgcgcaaccgccaccgccgctgcaactgaggctt

SEQ ID NO: 63098 - DNA, 75 bp, Artificial Sequence
  Synthetic
attgggaggaacatggacaaccaccacctggaccatcactttatgaagagagtgcgattagaggcaagattaaca

SEQ ID NO: 63099 - DNA, 75 bp, Artificial Sequence
  Synthetic
agcaagaggataaagtacctaaggaagttcaagaagcttttcgtaatctggacagtaccagctcactaacagaag

SEQ ID NO: 63100 - DNA, 75 bp, Artificial Sequence
  Synthetic
ttaatgataattaagacattgaccacgctcatcagaaggctcgccagaataaacgttgcaaaaaggattcctgga

SEQ ID NO: 63101 - DNA, 75 bp, Artificial Sequence
  Synthetic
ttttaggatcttttgtgtgcgaataactatgaggaagattaataattttcctctcattgaaatttatatcggaat

SEQ ID NO: 63102 - DNA, 75 bp, Artificial Sequence
  Synthetic
actatgaggaagattaataattttcctctcattgaaatttatatcggaatttaaattgaaattgttactgtaatc

SEQ ID NO: 63103 - DNA, 75 bp, Artificial Sequence
  Synthetic
attattataatccaccgcataacctcacactggaaaatcgaaacaacccccctgaagggcctagttcatacaggg

SEQ ID NO: 63104 - DNA, 75 bp, Artificial Sequence
  Synthetic
ttaaattgaaattgttactgtaatcatacctggtttgtttcagagccatatcaccaagatagagaacaacctagg

SEQ ID NO: 63105 - DNA, 75 bp, Artificial Sequence
  Synthetic
ctctcattgaaatttatatcggaatttaaattgaaattgttactgtaatcatacctggtttgtttcagagccata

SEQ ID NO: 63106 - DNA, 75 bp, Artificial Sequence
  Synthetic
gcaacaaaaactctggacaagtatttcatgtgctcaaatttctttagttgaaattaagactggttttaagttgcg

SEQ ID NO: 63107 - DNA, 75 bp, Artificial Sequence
  Synthetic
tctccggagggggcaagggcatcagtgtgctcagttgaaaatcccttgtcaacatctaggccttatcacatcaca

SEQ ID NO: 63108 - DNA, 75 bp, Artificial Sequence
  Synthetic
tgtgctcagttgaaaatcccttgtcaacatctaggccttatcacatcacaagttccgccttaaactctgcagggt

SEQ ID NO: 63109 - DNA, 75 bp, Artificial Sequence
  Synthetic
tcaccaagatagagaacaacctaggtctccggagggggcaagggcatcagtgtgctcagttgaaaatcccttgtc

SEQ ID NO: 63110 - DNA, 75 bp, Artificial Sequence
  Synthetic
gaacagagcgccgaagacaatgcagcgagggtggccgctagcctagcaaaagttacaagtgcctgtggaatcttt

SEQ ID NO: 63111 - DNA, 75 bp, Artificial Sequence
  Synthetic
aacaaccttaatagcaacattattgttaaaggacagcattagttcacagtcaaacaagcaagattgagaattaac

SEQ ID NO: 63112 - DNA, 75 bp, Artificial Sequence
  Synthetic
aagaactcccgcaagatgaacaacaagatcaggaccacattcaagaggccaggaaccaagacagtgacaacaccc

SEQ ID NO: 63113 - DNA, 75 bp, Artificial Sequence
  Synthetic
aaatagtttaaagacaaattgctcggaatcacaaaattccgagtatggattctcgtcctcagaaagtctggatga

SEQ ID NO: 63114 - DNA, 75 bp, Artificial Sequence
  Synthetic
ggtctgtccgttcaacaggggattgttcggcaaagagtcatcccagtgtatcaagtaaacaatcttgaggaaatt

SEQ ID NO: 63115 - DNA, 75 bp, Artificial Sequence
  Synthetic
ttcggcaaagagtcatcccagtgtatcaagtaaacaatcttgaggaaatttgccaacttatcatacaggcctttg

SEQ ID NO: 63116 - DNA, 75 bp, Artificial Sequence
  Synthetic
gccattgactttgtgctaaatcctagcggattaaatgtccctgggtcgcaagacttaacttcatttctgcgccag

SEQ ID NO: 63117 - DNA, 75 bp, Artificial Sequence
  Synthetic
cgaagaggcagacccactggacgatgccgacgacgagacgtctagccttccgcccttggagtcagatgatgaaga

SEQ ID NO: 63118 - DNA, 75 bp, Artificial Sequence
  Synthetic
cgagaggaagggccgattcttaacacaaatgcatttagctgtaaatcacaccctggaagaaattacagaaatacg

SEQ ID NO: 63119 - DNA, 75 bp, Artificial Sequence
  Synthetic
aactatttagataacgaaaggagtctttacattatacactatatttggcctctctccctgcgtgataatcaaaaa

SEQ ID NO: 63120 - DNA, 75 bp, Artificial Sequence
  Synthetic
tagacgaggacgacgaggacaccaagccagtgcctaacagatcgaccaagggtggacaacagaaaaacagtcaaa

SEQ ID NO: 63121 - DNA, 75 bp, Artificial Sequence
  Synthetic
tttgcaagtctattccttccgaaattggtagtaggagaaaaggcttgccttgagaaggttcaaaggcaaattcaa

SEQ ID NO: 63122 - DNA, 75 bp, Artificial Sequence
  Synthetic
tggtagtaggagaaaaggcttgccttgagaaggttcaaaggcaaattcaagtacatgcagagcaaggactgatac

SEQ ID NO: 63123 - DNA, 75 bp, Artificial Sequence
  Synthetic
agatagagaacaacctaggtctccgaagggagcaagggcatcagtgtgctcagttgaaaatcccttgtcaacatc

SEQ ID NO: 63124 - DNA, 75 bp, Artificial Sequence
  Synthetic
aagggagcaagggcatcagtgtgctcagttgaaaatcccttgtcaacatctaggtcttatcacatcacaggttcc

SEQ ID NO: 63125 - DNA, 75 bp, Artificial Sequence
  Synthetic
aatatccaacagcttggcaatcagtaggacacatgatggtgattttccgtttgatgcgaacaaattttttgatca

SEQ ID NO: 63126 - DNA, 75 bp, Artificial Sequence
  Synthetic
ccccaatcaacgaagaggcagacccactggacgatgccgacgacgagacgtctagccttccgcccttagagtcag

SEQ ID NO: 63127 - DNA, 75 bp, Artificial Sequence
  Synthetic
aaacaagcaagattgagaattaaccttgattttgaacttgaacacctagaggattggagattcaacaaccctaaa

SEQ ID NO: 63128 - DNA, 75 bp, Artificial Sequence
  Synthetic
tggctcaagctcgtttttcaggtctattgattgtcaaaacagtacttgatcatatcctacaaaagacagaacgag

SEQ ID NO: 63129 - DNA, 75 bp, Artificial Sequence
  Synthetic
gaccgccaaggtaaaaaatgaggtgaactccttcaaggctgcactcagctccctggccaagcatggagagtatgc

SEQ ID NO: 63130 - DNA, 75 bp, Artificial Sequence
  Synthetic
tctggagtaaataatcttgagcatggtcttttccctcaactgtcggcaattgcactcggagtcgccacagcccac

SEQ ID NO: 63131 - DNA, 75 bp, Artificial Sequence
  Synthetic
cttatcctcaaattgcctacatgcttacatctgaggacagccagtgtgacttggattggagatgtggaggaaaaa

SEQ ID NO: 63132 - DNA, 75 bp, Artificial Sequence
  Synthetic
gtcttttccctcaactgtcggcaattgcactcggagtcgccacagcccacgggagcaccctcgcaggagtaaatg

SEQ ID NO: 63133 - DNA, 75 bp, Artificial Sequence
  Synthetic
tggcttcattggctactgttgtgcaacaacaaaccatcgcatcagaatcattagaacaacgcattacgagtcttg

SEQ ID NO: 63134 - DNA, 75 bp, Artificial Sequence
  Synthetic
gccagcagtatctagtggaaaaaacattaagagaacacttgctgccatgccggaagaggagacgactgaagctaa

SEQ ID NO: 63135 - DNA, 75 bp, Artificial Sequence
  Synthetic
ctgcatcactgcccaaaacaagtggacattacgatgatgatgacgacattccctttccaggacccatcaatgatg

SEQ ID NO: 63136 - DNA, 75 bp, Artificial Sequence
  Synthetic
tgatccgactgactcacaggatacgaccattcccgatgtggtagttgaccccgatgatggaggctacggcgaata

SEQ ID NO: 63137 - DNA, 75 bp, Artificial Sequence
  Synthetic
attgatttatgacaataatcctctaaaaggaggactcaattgcaatatctcattcgataacccatttttccaagg

SEQ ID NO: 63138 - DNA, 75 bp, Artificial Sequence
  Synthetic
ccagcgatttatctaaattaaattacattatgcttttataacttacctactagcctgcccaacatttacacgatc

SEQ ID NO: 63139 - DNA, 75 bp, Artificial Sequence
  Synthetic
aaaagaaagaagaatttttaggatcttttgtgtgcgaataactatgaggaagattaataattttcctctcattga

SEQ ID NO: 63140 - DNA, 75 bp, Artificial Sequence
  Synthetic
gttactcggaaaacggcatgagtgcaccagatgacttggtcctattcgatctagacgaggacgacgaggacacca

SEQ ID NO: 63141 - DNA, 75 bp, Artificial Sequence
  Synthetic
cagcaatattattttccagaatgttataaattatgcagttgcactgttcgatattaaatttagaaacactgaggc

SEQ ID NO: 63142 - DNA, 75 bp, Artificial Sequence
  Synthetic
accaagggtggacaacagaaaaacagtcaaaagggccagcatacagagggcagacagacacaatccacgccaact

SEQ ID NO: 63143 - DNA, 75 bp, Artificial Sequence
  Synthetic
agactgatgcaggcgagcaggaacagagcgccgaggacaatgcagcgagggtggccgccagcctagcaaaagtta

SEQ ID NO: 63144 - DNA, 75 bp, Artificial Sequence
  Synthetic
ccacctcagactctgcagggtgatccaacaaccctaatagaaaaattattgttaacggacagcattagttcacag

SEQ ID NO: 63145 - DNA, 75 bp, Artificial Sequence
  Synthetic
agacccactggacgatgccgacgacgagacgtctagccttccgcccttagagtcagatgatgaagaacaggacag

SEQ ID NO: 63146 - DNA, 75 bp, Artificial Sequence
  Synthetic
cactggacgatgccgacgacgagacgtctagccttccgcccttagagtcagatgatgaagaacaggacagggacg

SEQ ID NO: 63147 - DNA, 75 bp, Artificial Sequence
  Synthetic
cgccccaccggctcccgtatacagagatcactccgaaaagaaagaactcccgcaagatgaacaacaagatcagga

SEQ ID NO: 63148 - DNA, 75 bp, Artificial Sequence
  Synthetic
acacctgttaataattttctctatcagatcgtagaactgctggtgcatgattcatcaagacaacaggctttaaaa

SEQ ID NO: 63149 - DNA, 75 bp, Artificial Sequence
  Synthetic
cgccacattctaagatcacaggggccatttgatgccgttttgtattatcatatgatgaaggatgagcctgtagtt

SEQ ID NO: 63150 - DNA, 75 bp, Artificial Sequence
  Synthetic
ttgcaataattgactcagatccagttttacagaatcttctcagggatagtgataacatctttttaataatccgtc

SEQ ID NO: 63151 - DNA, 75 bp, Artificial Sequence
  Synthetic
tatgatgaaggatgagcctgtagttttcagtaccagtgatggtaaagagtacacgtatccggactcccttgaaga

SEQ ID NO: 63152 - DNA, 75 bp, Artificial Sequence
  Synthetic
cgtccatttcatcttttcttacatttgtaaaggaatggataattaatcgcggaacaattgtccctttatggatag

SEQ ID NO: 63153 - DNA, 75 bp, Artificial Sequence
  Synthetic
ccaaaccaggtccggacaacagcacttataatacacccgtatataaacttgacacctctgaggcaactcaagttg

SEQ ID NO: 63154 - DNA, 75 bp, Artificial Sequence
  Synthetic
aacacctgttaataatttcctccatcagatcgtagaactgctggtgcatgattcatcaagacaccaggcttttaa

SEQ ID NO: 63155 - DNA, 75 bp, Artificial Sequence
  Synthetic
ctaaggtgtgaattattatcacaataaaagtgattcttagttttgaatttaaagctagcttattattactagccg

SEQ ID NO: 63156 - DNA, 75 bp, Artificial Sequence
  Synthetic
cgcaaacaggaagaatttttgatgtctaaggtgtgaattattatcacaataaaagtgattcttagttttgaattt

SEQ ID NO: 63157 - DNA, 75 bp, Artificial Sequence
  Synthetic
agccgagggaatttacacagaggggctaatgcacaatcaagatggtttaatctgtgggttgaggcagctggccaa

SEQ ID NO: 63158 - DNA, 75 bp, Artificial Sequence
  Synthetic
atttcatttcatccaaaacttcgccccattcttttacccaacaaaagtgggaagaaggggaacagtgccgatcta

SEQ ID NO: 63159 - DNA, 75 bp, Artificial Sequence
  Synthetic
gtgccagcagcgggaagctaggcttaattaccaatactattgctggagtagcaggactgatcacaggcgggagaa

SEQ ID NO: 63160 - DNA, 75 bp, Artificial Sequence
  Synthetic
aaacattattttgatagtcaagggtcttggtacagtgttacttcagataggaatttaacaccaggtcttaattct

SEQ ID NO: 63161 - DNA, 75 bp, Artificial Sequence
  Synthetic
aaattcatggcaatcctgcaacatcatcagtgaatgagcatggaataatgggatgatttaaccgacaaatagcta

SEQ ID NO: 63162 - DNA, 75 bp, Artificial Sequence
  Synthetic
cgacatcttctgtgatattgagaacaatccaggattatgctacgcatcccaaatgcaacaaacgaagccaaaccc

SEQ ID NO: 63163 - DNA, 75 bp, Artificial Sequence
  Synthetic
aagtcgaggttataaccatggatgcagagacgacagagaatataaacagatcgaaattgtacgaagctgtatata

SEQ ID NO: 63164 - DNA, 75 bp, Artificial Sequence
  Synthetic
ttacattactggactactcaggatgaaggtgctgcaatcggattggcctggataccatatttcgggccagcagcc

SEQ ID NO: 63165 - DNA, 75 bp, Artificial Sequence
  Synthetic
cttccagcaaacaaacgctatggtaactctaagaaaagagcgcctggccaagctgacagaagctatcactgctgc

SEQ ID NO: 63166 - DNA, 75 bp, Artificial Sequence
  Synthetic
ttcattggctactgttgtgcaacaacaaaccatcgcatcagaatcattagaacaacgcattacgagtcttgagaa

SEQ ID NO: 63167 - DNA, 75 bp, Artificial Sequence
  Synthetic
ctcctgaatatatggaggccatataccctgccaggtcaaattcaacaattgctaggggtggcaacagcaatacag

SEQ ID NO: 63168 - DNA, 75 bp, Artificial Sequence
  Synthetic
tggaaggaacacgcacattattagcctctaagatcatcaacaataatacagagacgccggttttggacagactga

SEQ ID NO: 63169 - DNA, 75 bp, Artificial Sequence
  Synthetic
gcaaaaacaatctcctcattgaacagggtttgtgctgagatggttgcaaaatatgatcttctggtgatgacaacc

SEQ ID NO: 63170 - DNA, 75 bp, Artificial Sequence
  Synthetic
gggtttgtgctgagatggttgcaaaatatgatcttctggtgatgacaaccggtcgggcaacagcaaccgctgcgg

SEQ ID NO: 63171 - DNA, 75 bp, Artificial Sequence
  Synthetic
cttacgtcaattgaattctctagcactcgaagcttattgtcttcaatgtaaaagaaaagctagtctaacaagatg

SEQ ID NO: 63172 - DNA, 75 bp, Artificial Sequence
  Synthetic
caactgaggcttattgggctgaacatggtcaaccaccacctggaccatcactttatgaagaaagtgcgattcggg

SEQ ID NO: 63173 - DNA, 75 bp, Artificial Sequence
  Synthetic
tggtcaaccaccacctggaccatcactttatgaagaaagtgcgattcggggtaagattgaatctagagatgagac

SEQ ID NO: 63174 - DNA, 75 bp, Artificial Sequence
  Synthetic
tgtccctcaaagtgttagggaggcattcaacaatctagacagtaccacttcactaactgaggaaaattttgggaa

SEQ ID NO: 63175 - DNA, 75 bp, Artificial Sequence
  Synthetic
tcaaatgttaatctttctcattgcacatactctttgcccttatcctcaaattgcctacatgcttacatctgagga

SEQ ID NO: 63176 - DNA, 75 bp, Artificial Sequence
  Synthetic
agaaacattatgtatgatcacttgcctggttttggaactgctttccaccaattagtacaagtgatttgtaaattg

SEQ ID NO: 63177 - DNA, 75 bp, Artificial Sequence
  Synthetic
gttgttcacaatctaagtacagacattgctcttctaattaagaaaaaatcggcgatgaagattaagccgacagtg

SEQ ID NO: 63178 - DNA, 75 bp, Artificial Sequence
  Synthetic
cctggctgaaggagactcccctcaatgtgccctaattcaaattacaaaaagagttccaatcttccaagatgctgc

SEQ ID NO: 63179 - DNA, 75 bp, Artificial Sequence
  Synthetic
tccacctgtcatccacatccgctctcgaggtgacattccccgagcttgccagaagagcttgcgtccagtcccacc

SEQ ID NO: 63180 - DNA, 75 bp, Artificial Sequence
  Synthetic
ttagttgtaacctaacacacacaaagcattggtaaaaaagtcaatagaaatttaaacagtgagtgcagacaactc

SEQ ID NO: 63181 - DNA, 75 bp, Artificial Sequence
  Synthetic
acatacagattataaaaaactcataaattgctctcatacatcatattgatctgatttcaataaacaactatttaa

SEQ ID NO: 63182 - DNA, 75 bp, Artificial Sequence
  Synthetic
tcagcacttagcacatcttagggcagagattcgagaattgaccaatgattataatcaacagcgacaaagtcggac

SEQ ID NO: 63183 - DNA, 75 bp, Artificial Sequence
  Synthetic
gagcgcctggccaagctgacagaagctatcactgctgcatcactgcccaaaacaagtggacattacgatgatgat

SEQ ID NO: 63184 - DNA, 75 bp, Artificial Sequence
  Synthetic
tcaaagttcaatttgagtcttaatgcaaataggcgttaagccacagttatagccataattgtaactcaatatctt

SEQ ID NO: 63185 - DNA, 75 bp, Artificial Sequence
  Synthetic
gtaaacgttgagcaaaattgttaaaaatatgaggcgggttatattgcctactgctcctcctgaatatatggaggc

SEQ ID NO: 63186 - DNA, 75 bp, Artificial Sequence
  Synthetic
caggatacgaccattcccgatgtggtagttgaccccgatgatggaggctacggcgaataccaaagttactcggaa

SEQ ID NO: 63187 - DNA, 75 bp, Artificial Sequence
  Synthetic
acaattgctaggggtggcaacagcaatacaggcttcctgacaccggagtcagtcaatggagacactccatcgaat

SEQ ID NO: 63188 - DNA, 75 bp, Artificial Sequence
  Synthetic
ctcgaagctatggtgaatgtcatatcgggccccaaagtgctaatgaagcaaattccaatttggcttcctctaggt

SEQ ID NO: 63189 - DNA, 75 bp, Artificial Sequence
  Synthetic
acgccaactcaaaacgtcacaggccctcgcagaacaatccaccatgccagtgctccactcacggacaatgacaga

SEQ ID NO: 63190 - DNA, 75 bp, Artificial Sequence
  Synthetic
aattccaatttggcttcctctaggtgtcgctgatcaaaagacctacagctttgactcaactacggccgccatcat

SEQ ID NO: 63191 - DNA, 75 bp, Artificial Sequence
  Synthetic
aatcaagattcacaccacagtttctgctccagctgaatgagacaatatatgcaagtgggaagaggagcaacacca

SEQ ID NO: 63192 - DNA, 75 bp, Artificial Sequence
  Synthetic
aatcccggatcaccccctcaggctcctgcgaattggaaaccaggctttcctccaggagttcgttcttccaccagt

SEQ ID NO: 63193 - DNA, 75 bp, Artificial Sequence
  Synthetic
ctgcgaattggaaaccaggctttcctccaggagttcgttcttccaccagtccaactaccccagtatttcaccttt

SEQ ID NO: 63194 - DNA, 75 bp, Artificial Sequence
  Synthetic
tttaacgataggtctgggctcatattgttattgatatagtaatgttgtatcaatatcttgccagatggaatagtg

SEQ ID NO: 63195 - DNA, 75 bp, Artificial Sequence
  Synthetic
ctcccgtatacagagatcactccgaaaagaaagaactcccgcaagatgaacaacaagatcaggaccacattcaag

SEQ ID NO: 63196 - DNA, 75 bp, Artificial Sequence
  Synthetic
atttgtcgatttaaaaatggtgatagccttaatctttgtgtaaaataagagattaggtgtaataactttaacatt

SEQ ID NO: 63197 - DNA, 75 bp, Artificial Sequence
  Synthetic
acactgggggcatcctgtgctacatagtgaaacagcaatccaaaaagttaaaaaacatgctacggtgctaaaagc

SEQ ID NO: 63198 - DNA, 75 bp, Artificial Sequence
  Synthetic
cccaaaaccacagcgagaccgctggcaacaacaacactcatcaccaagataccggagaagagagtgccagcagcg

SEQ ID NO: 63199 - DNA, 75 bp, Artificial Sequence
  Synthetic
aaggggaacagtgccgatctaacatctccggagaaaatccaagcaataatgacttcactccaggactttaagatc

SEQ ID NO: 63200 - DNA, 75 bp, Artificial Sequence
  Synthetic
ggaagctaggcttaattaccaatactattgctggagtcgcaggactgatcacaggcgggagaagaactcgaagag

SEQ ID NO: 63201 - DNA, 75 bp, Artificial Sequence
  Synthetic
cttctttacaatatagcagactagataataatcttcgtgttaatgataattaaggcattgaccacgctcatcaga

SEQ ID NO: 63202 - DNA, 75 bp, Artificial Sequence
  Synthetic
taataatcttcgtgttaatgataattaaggcattgaccacgctcatcagaaggctcactagaataaacgttgcaa

SEQ ID NO: 63203 - DNA, 75 bp, Artificial Sequence
  Synthetic
tcatgggtatcgaagtgccagaaactctggtccacaagctgaccggtaagaaggtgacttccaaaaatggacaac

SEQ ID NO: 63204 - DNA, 75 bp, Artificial Sequence
  Synthetic
tctggtccacaagctgaccggtaagaaggtgacttccaaaaatggacaaccaatcatccctgttcttttgccaaa

SEQ ID NO: 63205 - DNA, 75 bp, Artificial Sequence
  Synthetic
gcacccataatacacccgtgtataaacttgacatctctgaggcaactcaagttggacaacatcaccgtagagcag

SEQ ID NO: 63206 - DNA, 75 bp, Artificial Sequence
  Synthetic
cccttaaaagcagagaacaccaacacgagtaagagcgctgactccctggacctcgccaccacgacaagcccccaa

SEQ ID NO: 63207 - DNA, 75 bp, Artificial Sequence
  Synthetic
gtacattgggttggacccggtggctccaggagacctcaccatggtaatcacacaggattgtgacacgtgtcattc

SEQ ID NO: 63208 - DNA, 75 bp, Artificial Sequence
  Synthetic
caagctaaaattgttcatatcccgctagcagcttaaaatataaatgaaataggagctatatctctgacagtatta

SEQ ID NO: 63209 - DNA, 75 bp, Artificial Sequence
  Synthetic
aaaaatattgttcttgtttcaggaggtatattgtgaccggaaaagctaaactaatgatgaagattaatgcggagg

SEQ ID NO: 63210 - DNA, 75 bp, Artificial Sequence
  Synthetic
taatccgtctactagaagagatacttctaattgatcaatatactaaaggtgctttacaccattgtctcttttctc

SEQ ID NO: 63211 - DNA, 75 bp, Artificial Sequence
  Synthetic
taatcaattgttattaagtaacccaaaccaaaaatgatgaagattaagaaaaacctacctcgactgagagagtgt

SEQ ID NO: 63212 - DNA, 75 bp, Artificial Sequence
  Synthetic
tgatcaatatactaaaggtgctttacaccgttgtctcttttttctcctaaatgtagaacttaacaaaaaactcat

SEQ ID NO: 63213 - DNA, 75 bp, Artificial Sequence
  Synthetic
aaagatttaattacatgtcgattcaacacaactctaatctcaaaaatagcagaggttgaggatccagtttgttct

SEQ ID NO: 63214 - DNA, 75 bp, Artificial Sequence
  Synthetic
actcataatatacctgtttttaaaagattgattgatgaaagatcatgactaataacattacaaacaatcctacta

SEQ ID NO: 63215 - DNA, 75 bp, Artificial Sequence
  Synthetic
ctgagctaaagtggtctgtacacatctcatacattgtattaggggcaataatatctaattgaacttagccattta

SEQ ID NO: 63216 - DNA, 75 bp, Artificial Sequence
  Synthetic
tctcattgcacatactctttgcccttatcctcaaattgcctacatgcttacatttggggataaccagtgtgactt

SEQ ID NO: 63217 - DNA, 75 bp, Artificial Sequence
  Synthetic
tcttctaattaagaaaaaatcggcgatgaagattaagccgacagtgagcgtaatcttcatctctcttagattatt

SEQ ID NO: 63218 - DNA, 75 bp, Artificial Sequence
  Synthetic
aaacatgctacggtgctaaaagcattacgccctatagtgattttcgagacatattgtgtttttaaatatagtatt

SEQ ID NO: 63219 - DNA, 75 bp, Artificial Sequence
  Synthetic
attaagccgacagtgagcgtaatcttcatctctcttagattatttgttttccagagtaggggtcatcaggtcctt

SEQ ID NO: 63220 - DNA, 75 bp, Artificial Sequence
  Synthetic
ccagagtaggggtcatcaggtccttttcaatcgtataaccaaagtaaacttcactagaaggatattgtggggcaa

SEQ ID NO: 63221 - DNA, 75 bp, Artificial Sequence
  Synthetic
gcaatggttcaagtgcacagtcaaggaaggaaagctgcagtgtcgcatctgacaacccttgccacaatctccacg

SEQ ID NO: 63222 - DNA, 75 bp, Artificial Sequence
  Synthetic
ggaatattgcagttacctcgtgatcgattcaagaggacatcattctttctttgggtaattatccttttccaaaga

SEQ ID NO: 63223 - DNA, 75 bp, Artificial Sequence
  Synthetic
aattatccttttccaaagaacattttccatcccacttggagtcatccacaatagcacattacaggttagtgatgt

SEQ ID NO: 63224 - DNA, 75 bp, Artificial Sequence
  Synthetic
acattttccatcccgcttggagttatccacaatagtacattacaggttagtgatgtcgacaaactagtttgtcgt

SEQ ID NO: 63225 - DNA, 75 bp, Artificial Sequence
  Synthetic
gacaaactgtcatccacaaatcaattgagatcagttggactgaatctcgaggggaatggagtggcaactgacgtg

SEQ ID NO: 63226 - DNA, 75 bp, Artificial Sequence
  Synthetic
acgacaagcccccaaaactacagcgagactgctggcaacaacaacactcatcaccaagataccggagaagagagt

SEQ ID NO: 63227 - DNA, 75 bp, Artificial Sequence
  Synthetic
tcaggtccggtgtcccaccaaaggtggtcaattatgaagctggtgaatgggctgaaaactgctacaatcttgaaa

SEQ ID NO: 63228 - DNA, 75 bp, Artificial Sequence
  Synthetic
tactggaggagcaggcacagaaacagcaaccgaaaatacttggcaagagactcttcaactggatcaagcacaaac

SEQ ID NO: 63229 - DNA, 75 bp, Artificial Sequence
  Synthetic
ctgggcgagacaagacatcagaaccatagaggattcaaaattaagagcattgttgactctatgtgctgtgatgac

SEQ ID NO: 63230 - DNA, 75 bp, Artificial Sequence
  Synthetic
tctaccagcagcgccagacgggattcggggcttcccccggtgccggtatgtgcacaaagtatcaggaacgggacc

SEQ ID NO: 63231 - DNA, 75 bp, Artificial Sequence
  Synthetic
atcgacttgcttccacagttatctaccgaggaacgactttcgctgaaggtgtcgttgcatttctgatactgcccc

SEQ ID NO: 63232 - DNA, 75 bp, Artificial Sequence
  Synthetic
cattggacattattcatgctgagttccaggccagcctggctgaaggagactcccctcaatgtgccctaattcaaa

SEQ ID NO: 63233 - DNA, 75 bp, Artificial Sequence
  Synthetic
tacaccattgtcttttttctctcctaaatgtagaacttaacaaaagactcacaatatacttgtcttaaagagatt

SEQ ID NO: 63234 - DNA, 75 bp, Artificial Sequence
  Synthetic
aagctaagaaggacttcttcagctcacaccccttgagagagccggtcaatgcaacggaggacccgtcgagtggct

SEQ ID NO: 63235 - DNA, 75 bp, Artificial Sequence
  Synthetic
actatataaccttctacttgatcacaatactccgtatacctattatcatatatttaatcaagacgatatccttta

SEQ ID NO: 63236 - DNA, 75 bp, Artificial Sequence
  Synthetic
acctttctggagtaaataatcttgagcatggtcttttccctcaactgtcggcaattgcactcggagtcgccacag

SEQ ID NO: 63237 - DNA, 75 bp, Artificial Sequence
  Synthetic
caatacggtgattcaaatattaatctttctaattgcacatactctctgcccccatcctcaaattgcctacatgcc

SEQ ID NO: 63238 - DNA, 75 bp, Artificial Sequence
  Synthetic
aatagctctcttgctatctaactaagatggaatacttcatattgggctaactcatatatgctgactcaatagtta

SEQ ID NO: 63239 - DNA, 75 bp, Artificial Sequence
  Synthetic
atttgacctacgtccaacttgaatcaagattcacaccacagtttctgctccagctgaatgagacaatatatgcaa

SEQ ID NO: 63240 - DNA, 75 bp, Artificial Sequence
  Synthetic
gaccaagaacataacagacaaaattgatcagattattcatgattttgttgataaaacccttccggaccaggggga

SEQ ID NO: 63241 - DNA, 75 bp, Artificial Sequence
  Synthetic
tacatctgaggatagccagtgtgacttggattggagatgtagggaagaaatcggaacccatctccaggttgttca

SEQ ID NO: 63242 - DNA, 75 bp, Artificial Sequence
  Synthetic
gcgatggtaactctaagaaaagagcgcctggccaagctgacagaagctatcactgctgcatcactgcccaaaaca

SEQ ID NO: 63243 - DNA, 75 bp, Artificial Sequence
  Synthetic
ctcactagaaaaattcgcagtgaagagttgtctttcacagctgtatcaaacggacccaaaaacatcagtggtcag

SEQ ID NO: 63244 - DNA, 75 bp, Artificial Sequence
  Synthetic
tagaaaaattcgcagtgaagagttgtctttcacagctgtatcaaacggacccaaaaacatcagtggtcagagtcc

SEQ ID NO: 63245 - DNA, 75 bp, Artificial Sequence
  Synthetic
tacaatatagcagactagataataatcttcgtgttaatgataattaaggcattgaccacgctcatcagaaggctc

SEQ ID NO: 63246 - DNA, 75 bp, Artificial Sequence
  Synthetic
agtccggcgcgaacttcttccgacccagagaccaacacaacaaatgaagaccacaaaatcatggcttcagaaaat

SEQ ID NO: 63247 - DNA, 75 bp, Artificial Sequence
  Synthetic
attaagtaacccaaaccaaaaatgatgaagattaagaaaaacctacctcgactgagagagtgttttttcattaac

SEQ ID NO: 63248 - DNA, 75 bp, Artificial Sequence
  Synthetic
ccacaaaatcatggcttcagaaaattcctctgcaatggttcaagtgcacagtcaaggaaggaaagctgcagtgtc

SEQ ID NO: 63249 - DNA, 75 bp, Artificial Sequence
  Synthetic
acgaccgcagccggacacccaaaagcagagaacaccaacacgagcaagagcgctgactccctggaccccgccacc

SEQ ID NO: 63250 - DNA, 75 bp, Artificial Sequence
  Synthetic
aacataataaactccgcactctttataattaagctttaacgataggtctgggctcatattgttattgatatagta

SEQ ID NO: 63251 - DNA, 75 bp, Artificial Sequence
  Synthetic
cccgccacgaccgcagccggacccttaaaagcagagaacaccaacacgagtaagagcgctgactccctggacctc

SEQ ID NO: 63252 - DNA, 75 bp, Artificial Sequence
  Synthetic
ttaccaatactattgctggagtcgcaggactgatcacaggcgggagaagaactcgaagagaagcaattgtcaatg

SEQ ID NO: 63253 - DNA, 75 bp, Artificial Sequence
  Synthetic
gcacagcctccgacactccccccgccacgaccgcagccggacccttaaaagcagagaacaccaacacgagtaaga

SEQ ID NO: 63254 - DNA, 75 bp, Artificial Sequence
  Synthetic
aagatcaggaccacattcaagaggccaggaaccaagacagtgacaacacccagccagaacattcttttgaggaga

SEQ ID NO: 63255 - DNA, 75 bp, Artificial Sequence
  Synthetic
tataacctgccaagcatacctcttgcacaaagtgattcttgtacacaaataatgtttgactctacaggaggtagc

SEQ ID NO: 63256 - DNA, 75 bp, Artificial Sequence
  Synthetic
aatgtttgactctacaggaggtagcaacgatccatctcatcaaaaaataagtattttatgatttactaatgatct

SEQ ID NO: 63257 - DNA, 75 bp, Artificial Sequence
  Synthetic
aataaaggttttgaccttggacagttaacactcggcaaacctctggatttcggaacaatatcattggcactagcg

SEQ ID NO: 63258 - DNA, 75 bp, Artificial Sequence
  Synthetic
tctgtgggttgaggcagctggccaacgaaacgactcaagctctccaactgttcctgagagccacaactgagctgc

SEQ ID NO: 63259 - DNA, 75 bp, Artificial Sequence
  Synthetic
cggcgcgaacttcttccgacccagagacctacacaacaactggagaccacaaaatcatggcttcagaagattcct

SEQ ID NO: 63260 - DNA, 75 bp, Artificial Sequence
  Synthetic
tttgtcttttagtttttcttcagattgcttcatggcaaagctcagcctcaaatcaatgaaattaggatttaatta

SEQ ID NO: 63261 - DNA, 75 bp, Artificial Sequence
  Synthetic
ttgttgataaaacccttccggaccagggggacaatgacaattggtggacaggatggagacaatggataccggcag

SEQ ID NO: 63262 - DNA, 75 bp, Artificial Sequence
  Synthetic
tgcagttatcgctttattctgtatatgcaaatttgtcttttagtctttcttcagattgtttcacggcaaaactca

SEQ ID NO: 63263 - DNA, 75 bp, Artificial Sequence
  Synthetic
cttccaagttgacacccttacaaaaaccaggactcagaatccctcaaataagagattccaagacaacatcataga

SEQ ID NO: 63264 - DNA, 75 bp, Artificial Sequence
  Synthetic
gcaggactgatcacaggcgggagaagaactcgaagagaagcaattgtcaatgctcaacccaaatgcaaccccaat

SEQ ID NO: 63265 - DNA, 75 bp, Artificial Sequence
  Synthetic
tcttcaatgtaaaagaaaagctggcctaacaagatgacaactagaacaaagggcaggggccatactgtggccacg

SEQ ID NO: 63266 - DNA, 75 bp, Artificial Sequence
  Synthetic
aatgataaacttgatgaagattaagaaaaaggtaatctttcgattatctttagtcttcatccttgattctacaat

SEQ ID NO: 63267 - DNA, 75 bp, Artificial Sequence
  Synthetic
aaaataagagattaggtgtaataactttaacatttttgtctagtaagctactatttcatacagaatgataaaatt

SEQ ID NO: 63268 - DNA, 75 bp, Artificial Sequence
  Synthetic
ttcatccttgattctacaatcatgacagttgtctttaatgaaaaaggaaaaaagcctttttattaagttgtaata

SEQ ID NO: 63269 - DNA, 75 bp, Artificial Sequence
  Synthetic
agacattgaccacgctcatcagaaggctcgccaaaataaacgttgcaaaaaggattcctggaaaaatggggacac

SEQ ID NO: 63270 - DNA, 75 bp, Artificial Sequence
  Synthetic
gagaggacgcccccgagctgccagacagcattcaagggatggacacgaccaccatgttcgagcacgatcatcatc

SEQ ID NO: 63271 - DNA, 75 bp, Artificial Sequence
  Synthetic
cgtcaatcaaggagcgcctcacaagtgcgcgttcctactgtatttcataagaagagagttgaaccattaacagtt

SEQ ID NO: 63272 - DNA, 75 bp, Artificial Sequence
  Synthetic
tataatcactctcgtttcaaattaataagatatgcataattgccttaatatatgaagaggtatgatacaacccta

SEQ ID NO: 63273 - DNA, 75 bp, Artificial Sequence
  Synthetic
cctccagcacctaaagacatatgtccgaccttgaaaaaaggatttttgtgtgacagtagtttttgcaaaaaagac

SEQ ID NO: 63274 - DNA, 75 bp, Artificial Sequence
  Synthetic
caccagttagaaagtttaactgatagggaattactcctactaatcgcccgtaagacttgtggatcagtagaacaa

SEQ ID NO: 63275 - DNA, 75 bp, Artificial Sequence
  Synthetic
cccatcgaaaaataagtattttatgacttactaatgatctcttataatattaagaaaaactgatggaacataaat

SEQ ID NO: 63276 - DNA, 75 bp, Artificial Sequence
  Synthetic
acaagacatccgaaccatagaggattccaaattaagggcattgttaactctatgtgctgtgatgacgaggaaatt

SEQ ID NO: 63277 - DNA, 75 bp, Artificial Sequence
  Synthetic
gattaataattttcctctcattgaaatttatatcggaatttaaattgaaattgttactgtaatcatacctggttt

SEQ ID NO: 63278 - DNA, 75 bp, Artificial Sequence
  Synthetic
tcgccccaccggctcccgtatacagagatcactccgaaaagaaagaactcccgcaagatgagcaacaagatcagg

SEQ ID NO: 63279 - DNA, 75 bp, Artificial Sequence
  Synthetic
atttatatcggaatttaaattgaaattgttactgtaatcatacctggtttgtttcagagccatatcaccaagata

SEQ ID NO: 63280 - DNA, 75 bp, Artificial Sequence
  Synthetic
ttgttactgtaatcatacctggtttgtttcagagccatatcaccaagatagagaacaacctaggtctccggaggg

SEQ ID NO: 63281 - DNA, 75 bp, Artificial Sequence
  Synthetic
ggcttgggcaagatcaggcagaacccgttctcgaagtatatcaacgattacacagtgataaaggaggcagttttg

SEQ ID NO: 63282 - DNA, 75 bp, Artificial Sequence
  Synthetic
cgttctcgaagtatatcaacgattacacagtgataaaggaggcagttttgaagctgcactatggcaacaatggga

SEQ ID NO: 63283 - DNA, 75 bp, Artificial Sequence
  Synthetic
ccgacaatccctaattatgtttatcactgcattcttgaatatcgctctccagttaccgtgtgaaagttctgctgt

SEQ ID NO: 63284 - DNA, 75 bp, Artificial Sequence
  Synthetic
actgcattcttgaatatcgctctccagttaccgtgtgaaagttctgctgtcgttgtttcagggttaagaacattg

SEQ ID NO: 63285 - DNA, 75 bp, Artificial Sequence
  Synthetic
cctggataccatatttcgggccagcagccgagggaatttacacagaggggctaatgcacaaccaagatggtttaa

SEQ ID NO: 63286 - DNA, 75 bp, Artificial Sequence
  Synthetic
gttcctcaatcagataatgaggaagcttcaaccaacccggggacatgctcatggtctgatgagggtaccccttaa

SEQ ID NO: 63287 - DNA, 75 bp, Artificial Sequence
  Synthetic
atttagtgcataaatctgggctaactcccccaggttaactccattagctgaaaagaagcccacccacaacgaaca

SEQ ID NO: 63288 - DNA, 75 bp, Artificial Sequence
  Synthetic
tcccccaggttaactccattagctgaaaagaagcccacccacaacgaacatcactttgagcgccctcacaattta

SEQ ID NO: 63289 - DNA, 75 bp, Artificial Sequence
  Synthetic
cttcaaccaacccggggacatgctcatggtctgatgagggtaccccttaataaggctgactaaaacactatataa

SEQ ID NO: 63290 - DNA, 75 bp, Artificial Sequence
  Synthetic
tgagagtgtctagacaacaaaatatcgatactccagacaccaagcaagacctgagaaaaaaccatggctaaagct

SEQ ID NO: 63291 - DNA, 75 bp, Artificial Sequence
  Synthetic
tctccgaagggagcaagggcatcagtgtgctcagttgaaaatcccttgtcaacatctaggtcttatcacatcaca

SEQ ID NO: 63292 - DNA, 75 bp, Artificial Sequence
  Synthetic
tttatgatttactaatgatctcttaaaatattaagaaaaactgacggaacataaattctttctgcttcaagttgt

SEQ ID NO: 63293 - DNA, 75 bp, Artificial Sequence
  Synthetic
ggaggaggtctatggtattcgctattgttatattacaatcaataacaagcttgtaaaaatattgttcttgtttca

SEQ ID NO: 63294 - DNA, 75 bp, Artificial Sequence
  Synthetic
ctcccacaaccaaaacaggtccggacaacagcacccataatacacccgtgtataaacttgacatctctgaggcaa

SEQ ID NO: 63295 - DNA, 75 bp, Artificial Sequence
  Synthetic
taaactaatgatgaagattaatgcggaggtctgatgagaataaaccttattattcagattaggccccaagaggca

SEQ ID NO: 63296 - DNA, 75 bp, Artificial Sequence
  Synthetic
ctatttcaggatagtccagctagtgacacgtcttttagctgtataccagttgcccctgagatacgccacaaaagt

SEQ ID NO: 63297 - DNA, 75 bp, Artificial Sequence
  Synthetic
aataatatctaattgaacttagccatttaaaatttagtgcataaatctgggctaactccaccaggtcaactccat

SEQ ID NO: 63298 - DNA, 75 bp, Artificial Sequence
  Synthetic
aacaatcgagcgcaaggttacaaggttgaactgagagtgtctagacaacaaaatatcgatactccagacaccaag

SEQ ID NO: 63299 - DNA, 75 bp, Artificial Sequence
  Synthetic
actaaatggttaattgtaactgaacccgcaggtcacgtgtgttaggtttcacagattatatatattactaactct

SEQ ID NO: 63300 - DNA, 75 bp, Artificial Sequence
  Synthetic
aaagctacgggacgatacaatctaatatcgcccaaaaaggacctggagaaaggggttgtcttaagcgacctctgt

SEQ ID NO: 63301 - DNA, 75 bp, Artificial Sequence
  Synthetic
atactcgtaattaacattagataagtagattaagaaaaaagcttgaggaagattaagaaaaactgcttattgggt

SEQ ID NO: 63302 - DNA, 75 bp, Artificial Sequence
  Synthetic
atggtttaatctgtgggttgaggcagctggccaacgaaacgactcaagctctccaactgttcctgagagccacaa

SEQ ID NO: 63303 - DNA, 75 bp, Artificial Sequence
  Synthetic
tattgagtttgatgtgactcacaaaggaatggccctattgcatagactgaaaactaatgactttgcccctgcatg

SEQ ID NO: 63304 - DNA, 75 bp, Artificial Sequence
  Synthetic
ctggaaaatcgagacaacccccccgaagggcctagttcatacaggggtcatatgggagggattgaaggactgcaa

SEQ ID NO: 63305 - DNA, 75 bp, Artificial Sequence
  Synthetic
cctgagatacgccacaaaagtgtctctaagctaaattggtctgtacacatctcatacattgtattaggggcaata

SEQ ID NO: 63306 - DNA, 75 bp, Artificial Sequence
  Synthetic
ggaatggccctattgcatagactgaaaactaatgactttgcccctgcatggtcaatgacaaggaacctatttccc

SEQ ID NO: 63307 - DNA, 75 bp, Artificial Sequence
  Synthetic
atgatgacgacattccctttccaggacccatcaatgatgacgacaatcctggccatcaagatgatgatccgactg

SEQ ID NO: 63308 - DNA, 75 bp, Artificial Sequence
  Synthetic
tggtctgatctctgattggctgctaacaaccaacactaaccatttcaacatgcgaacacaacgtgtcaaggaaca

SEQ ID NO: 63309 - DNA, 75 bp, Artificial Sequence
  Synthetic
attgagcgcaaggtttcaaggttgaactgagagtgcctaaacaccaaaatatcgataattcagacaccaagcaag

SEQ ID NO: 63310 - DNA, 75 bp, Artificial Sequence
  Synthetic
caaaagttacaagtgcctgtggaatctttttaaaacctgatgaaacatttgtacattcaggttttatctattttg

SEQ ID NO: 63311 - DNA, 75 bp, Artificial Sequence
  Synthetic
attgagcctaaaaatgctgtcgttgattcgatccaatattctcaagtttattaacaaattggatgctctacatgt

SEQ ID NO: 63312 - DNA, 75 bp, Artificial Sequence
  Synthetic
taatgactttgcccctgcatggtcaatgacaaggaatctatttcctcatttatttcaaaatccgaattccacaat

SEQ ID NO: 63313 - DNA, 75 bp, Artificial Sequence
  Synthetic
gcaagaagcctgggccggcgaaattttccctccttcatgagtccacactgaaagcatttacacaagggtcctcga

SEQ ID NO: 63314 - DNA, 75 bp, Artificial Sequence
  Synthetic
aggccctcgcagaacaatccaccatgccagtgctccactcacggacaatgacagaagaaacgaaccctccggctc

SEQ ID NO: 63315 - DNA, 75 bp, Artificial Sequence
  Synthetic
ttccctccttcatgagtccacactgaaagcatttacacaagggtcctcgacacgaatgcaaagtttaattcttga

SEQ ID NO: 63316 - DNA, 75 bp, Artificial Sequence
  Synthetic
ttcaaagaagcggttcaagggcatacacacattgtttctgtttctactgccgatgtcttgataatgtgcaaagat

SEQ ID NO: 63317 - DNA, 75 bp, Artificial Sequence
  Synthetic
aatcagatatataagcataataaataaatactcatatttcttgataatttgtttaaccacagataaatcctcact

SEQ ID NO: 63318 - DNA, 75 bp, Artificial Sequence
  Synthetic
gaccacgctcatcagaaggctcactagaataaacgttgcaaaaaggatccctggaaaaatggtcgcacacaaaaa

SEQ ID NO: 63319 - DNA, 75 bp, Artificial Sequence
  Synthetic
ctaaccgcacacccactgtcgccccaccggctcccgtatacagagatcactccgaaaagaaagaactcccgcaag

SEQ ID NO: 63320 - DNA, 75 bp, Artificial Sequence
  Synthetic
tgtgcttggccaaaattcaattatgctcaaagtacaccgagaggaagggccgattcttaacacaaatgcatttag

SEQ ID NO: 63321 - DNA, 75 bp, Artificial Sequence
  Synthetic
ttgaggagatgtatcgccacattctaagatcacaggggccatttgatgccgttttgtattatcatatgatgaagg

SEQ ID NO: 63322 - DNA, 75 bp, Artificial Sequence
  Synthetic
catcatagaattgctttattatattaataagcattttatcactagaaatccaatatacgaaatggttaattgtaa

SEQ ID NO: 63323 - DNA, 75 bp, Artificial Sequence
  Synthetic
gactcccttgaagaggaatatccaccatggctcactgaaaaagaggccatgaatgatgagaatagatttgttaca

SEQ ID NO: 63324 - DNA, 75 bp, Artificial Sequence
  Synthetic
taactgatagggaattactcctactaatcgcccgtaagacttgtggatcagtagaacaacaattaaatataactg

SEQ ID NO: 63325 - DNA, 75 bp, Artificial Sequence
  Synthetic
cactaagccagtgcctaatagatcgaccaagggtggacaacagaaaaacagtcaaaagggccagcatacagaggg

SEQ ID NO: 63326 - DNA, 75 bp, Artificial Sequence
  Synthetic
caatcggggagtgggccttctgggaaactaaaaaaacctcactagaaaaattcgcagtgaagagttgtctttcac

SEQ ID NO: 63327 - DNA, 75 bp, Artificial Sequence
  Synthetic
cacggacaatgacagaagaaatgaaccctccggctcaaccagccctcgcatgctgacaccaatcaacgaagaggc

SEQ ID NO: 63328 - DNA, 75 bp, Artificial Sequence
  Synthetic
aactgttaccaagttcttaagtgatgtaccagtggcgacattgcccatagatttcatagtcccaattcttctcaa

SEQ ID NO: 63329 - DNA, 75 bp, Artificial Sequence
  Synthetic
attattactagccgtttttcaaagttcaatttgagtcttaatgcaaataagcgttaagccacagttatagccata

SEQ ID NO: 63330 - DNA, 75 bp, Artificial Sequence
  Synthetic
cagagctaccgcagtagaaaggacatgctgggatgcagtattcgagcctaatgttctaggatataatccacctca

SEQ ID NO: 63331 - DNA, 75 bp, Artificial Sequence
  Synthetic
ggacaacagcacccataatacacccgtgtataaacttgacatctctgaggcaactcaagttggacaacatcaccg

SEQ ID NO: 63332 - DNA, 75 bp, Artificial Sequence
  Synthetic
tcatactcccttaatccgcaactacgcaactgtaaactcccgaaacatatctaccgtttaaaatatgatgtaact

SEQ ID NO: 63333 - DNA, 75 bp, Artificial Sequence
  Synthetic
aatgcaagatgctctcttcctgaaatattatctcaaaaatgtgggtgctcaagaagactgtgttgatgaccactt

SEQ ID NO: 63334 - DNA, 75 bp, Artificial Sequence
  Synthetic
aaaaagaaagcttattgcatcaagcatcatggcaccacacaagtgatgattttggtgagcatgccacagttagag

SEQ ID NO: 63335 - DNA, 75 bp, Artificial Sequence
  Synthetic
cgaggaaactctagatcaacgtggtttgttcatgatgatttaatagacatcttaggctatggggactatgttttt

SEQ ID NO: 63336 - DNA, 75 bp, Artificial Sequence
  Synthetic
ccaaaaattaccttgttgacactgatcaagacggcagaacactgggcgagacaagacatccgaaccatagaggat

SEQ ID NO: 63337 - DNA, 75 bp, Artificial Sequence
  Synthetic
tggaagatcccaatttcactgttaccactgaacacacaaggaatcccccatgctgctatggattggtatcagaca

SEQ ID NO: 63338 - DNA, 75 bp, Artificial Sequence
  Synthetic
tcagtattcaaagaagcggttcaagggcatacacacattgtttctgtttctactgccgatgtcttgataatgtgc

SEQ ID NO: 63339 - DNA, 75 bp, Artificial Sequence
  Synthetic
gagtttacagcaccttttatagaatattgcaaccgttgctatggtgttaagaatgtttttaattggatgcattat

SEQ ID NO: 63340 - DNA, 75 bp, Artificial Sequence
  Synthetic
gattatcccaattttaagattgtgtctatgctttaccagagcggagattacttactctccatattagggtctgat

SEQ ID NO: 63341 - DNA, 75 bp, Artificial Sequence
  Synthetic
caactgagctgcgaaccttttcaatcctcaaccgtaaggcaattgacttcctgctgcagcgatggggtggcacat

SEQ ID NO: 63342 - DNA, 75 bp, Artificial Sequence
  Synthetic
cttactctccatattagggtctgatgggtataaaatcattaagtttctcgaaccattgtgcttggctaaaattca

SEQ ID NO: 63343 - DNA, 75 bp, Artificial Sequence
  Synthetic
cacgacacatctttccttgcaggataaccgcagctttccatacgtttttttcggtgagaatcttgcaatatcatc

SEQ ID NO: 63344 - DNA, 75 bp, Artificial Sequence
  Synthetic
tataatcgtgctcaccttcatctaactaagtgttgcacccgggaggtaccagctcagtatttaacatacacatct

SEQ ID NO: 63345 - DNA, 75 bp, Artificial Sequence
  Synthetic
aagggccgattcttaacacaaatgcatttagctgtaaatcacaccctggaagaaattacagaaatacgtgcacta

SEQ ID NO: 63346 - DNA, 75 bp, Artificial Sequence
  Synthetic
actgggggcatcctgtgctacatagtgaaacagcaatccaaaaagttaaaaaacatgctacggtgctaaaagcat

SEQ ID NO: 63347 - DNA, 75 bp, Artificial Sequence
  Synthetic
ggtctgtacacatctcatacattgtattaggggcaataatatctaattgaacttagccatttaaaatttagtgca

SEQ ID NO: 63348 - DNA, 75 bp, Artificial Sequence
  Synthetic
agcgatggggtggcacatgccacattttgggaccggactgctgtatcgaaccacatgattggaccaagaacataa

SEQ ID NO: 63349 - DNA, 75 bp, Artificial Sequence
  Synthetic
gatcttggtacagtgttacctcagatagaaatctaacaccaggtcttaattcttatatcaaaagaaatcaattcc

SEQ ID NO: 63350 - DNA, 75 bp, Artificial Sequence
  Synthetic
gctatgggaattttaccaccttgaccatcctccacttttctcaaccaaaattattagtgacttaagtatttttat

SEQ ID NO: 63351 - DNA, 75 bp, Artificial Sequence
  Synthetic
tgacttcgaagacgaaatggtttgtaaatggctattatcatcaactcctgttatgagtcgttttgcagccgatat

SEQ ID NO: 63352 - DNA, 75 bp, Artificial Sequence
  Synthetic
accatggccaaagctacgggacgatacaatctaatatcgcccaaaaaggacctggagaaaggggttgtcttaagc

SEQ ID NO: 63353 - DNA, 75 bp, Artificial Sequence
  Synthetic
gccatgaaataaaaagaacgacaattccacaagaaaacacgcaccagggtccgtcgttccagtcctttctaagtg

SEQ ID NO: 63354 - DNA, 75 bp, Artificial Sequence
  Synthetic
tccacaagaaaacacgcaccagggtccgtcgttccagtcctttctaagtgactctgcttgtggtacagcaaatcc

SEQ ID NO: 63355 - DNA, 75 bp, Artificial Sequence
  Synthetic
gtaccggaacaatttttagagcaagaaaacttttctattgagaatgttctttcctacgcgcaaaaactcgagtat

SEQ ID NO: 63356 - DNA, 75 bp, Artificial Sequence
  Synthetic
aaaactaaatttcgatcgatcgagacacaatgtgaaatctcaggatcataactcggcatccaagagggaaggtca

SEQ ID NO: 63357 - DNA, 75 bp, Artificial Sequence
  Synthetic
ctttctcattgaaagagaaagagttgaatgtaggtagaactttcggaaaattgccttatccgactcgcaatgttc

SEQ ID NO: 63358 - DNA, 75 bp, Artificial Sequence
  Synthetic
tttaaagataaatgtaataggagctatacctctgacagtattataattaattgttattaagtaacccaaaccaaa

SEQ ID NO: 63359 - DNA, 75 bp, Artificial Sequence
  Synthetic
tgatggtcttgctaaagcatttcctagcaatatgatggtagttacggaacgtgaacaaaaagaaagcttattgca

SEQ ID NO: 63360 - DNA, 75 bp, Artificial Sequence
  Synthetic
ttagagggagtagctttgtaactgatttagagaaatacaatcttgcatttaggtatgagtttacagcacctttta

SEQ ID NO: 63361 - DNA, 75 bp, Artificial Sequence
  Synthetic
gtgttcaagaaatacttcaaatgaccccttcacattactcaggaaatattgttcacaggtacaacgatcaataca

SEQ ID NO: 63362 - DNA, 75 bp, Artificial Sequence
  Synthetic
tgttaagaatgtttttaattggatgcattatacaatcccacagtgttatatgcatgtcagtgattattataatcc

SEQ ID NO: 63363 - DNA, 75 bp, Artificial Sequence
  Synthetic
gcagtcaagtatttggaagggcacgggttccgttttgaagtcaagaagcgtgatggagtgaagcgccttgaggaa

SEQ ID NO: 63364 - DNA, 75 bp, Artificial Sequence
  Synthetic
gattgaaggactgcaacaaaaactctggacaagtatttcatgtgctcaaatttctttagttgaaattaagactgg

SEQ ID NO: 63365 - DNA, 75 bp, Artificial Sequence
  Synthetic
caaggactcgcgcttagcaaatccaacggctgatgatttccagcaagaggaaggtcccaaaattaccttgttgac

SEQ ID NO: 63366 - DNA, 75 bp, Artificial Sequence
  Synthetic
ccagcctagcaaaagttacaagtgcctgtggaatctttttaaaacctgatgaaacatttgtacattcaggtttta

SEQ ID NO: 63367 - DNA, 75 bp, Artificial Sequence
  Synthetic
gaatggggtccaattgccccagtcccttaaaacggctacaagaatggcaccattgtctgatgcaatttttgatga

SEQ ID NO: 63368 - DNA, 75 bp, Artificial Sequence
  Synthetic
tattatattaataagcattttatcactagaaatccaatatacgaaatggttaattgtaactaaacccgcaggtca

SEQ ID NO: 63369 - DNA, 75 bp, Artificial Sequence
  Synthetic
cttaaaacggctacaagaatggcaccattgtctgatgcaatttttgatgatcttcaagggaccctggctagtata

SEQ ID NO: 63370 - DNA, 75 bp, Artificial Sequence
  Synthetic
atatcctacaaaagacagaacgaggagttcgtctccatcctcttgcaaggaccgccaaggtaaaaaatgaggtga

SEQ ID NO: 63371 - DNA, 75 bp, Artificial Sequence
  Synthetic
agatagcaacaattcgtctacagacccaattagcagtggagaaacaagatcattcactacccatttcttaactta

SEQ ID NO: 63372 - DNA, 75 bp, Artificial Sequence
  Synthetic
ttttgaccttggacagttaacactcggcaaacctctggatttcggaacaatatcattggcactagcggtaccgca

SEQ ID NO: 63373 - DNA, 75 bp, Artificial Sequence
  Synthetic
ccaaagaaaatcataatctcgtatcgctcgcaatataacctgccaagcatacctcttgcacaaagtgattcttgt

SEQ ID NO: 63374 - DNA, 75 bp, Artificial Sequence
  Synthetic
ttatcatcaccaattgtattggaccaatgtgaccttgtcactagagcttgcgggttgtattcatcatactccctt

SEQ ID NO: 63375 - DNA, 75 bp, Artificial Sequence
  Synthetic
tatcattggcactagcggtaccgcaggtgcttggagggttatccttcttgaatcctgagaaatgtttctaccgga

SEQ ID NO: 63376 - DNA, 75 bp, Artificial Sequence
  Synthetic
cagtactataatcactctcgtttcaaattaataagatgtgcatgattgccttaatatatgaagaggtatgataca

SEQ ID NO: 63377 - DNA, 75 bp, Artificial Sequence
  Synthetic
tttattccagttaaaaacttatctccgaatgattgagatggatgatttattcttacctttaattgcgaagaaccc

SEQ ID NO: 63378 - DNA, 75 bp, Artificial Sequence
  Synthetic
tacttgcaaaggttggttatcaacatacagattataaaaaactcataaattgctctcatacatcatattgatctg

SEQ ID NO: 63379 - DNA, 75 bp, Artificial Sequence
  Synthetic
tattccattcagaatgataaaattaaaagaaaagacatgactgtaaaatcagaaataccttctttacaatatagc

SEQ ID NO: 63380 - DNA, 75 bp, Artificial Sequence
  Synthetic
ttcctgggtcgcaagacttaacttcatttctgcgccagattgtacgtaggactatcaccctaagtgcgaaaaaca

SEQ ID NO: 63381 - DNA, 75 bp, Artificial Sequence
  Synthetic
tgaatttaacgcaacataataaactctgcactctttataattaagctttaacgaaaggtctgggctcatattgtt

SEQ ID NO: 63382 - DNA, 75 bp, Artificial Sequence
  Synthetic
gcctctctccctgcgtgataatcaaaaaattcacaatacagcatgtgtgacatattactgccgcaatgagtctaa

SEQ ID NO: 63383 - DNA, 75 bp, Artificial Sequence
  Synthetic
tgaggaagataacattgcaaaggtggagtctatggtttagttatcttgatcattgtgataatatcctggcggagg

SEQ ID NO: 63384 - DNA, 75 bp, Artificial Sequence
  Synthetic
cattgtgataatatcctggcggaggctttaacccaaataacttgcacagttgatttagcacagatcctgagggaa

SEQ ID NO: 63385 - DNA, 75 bp, Artificial Sequence
  Synthetic
tattcatgggcacatattttagaggggagacctcttattggagccacactcccatgtatgattgagcaattcaaa

SEQ ID NO: 63386 - DNA, 75 bp, Artificial Sequence
  Synthetic
ggagacctcttattggagccacactcccatgtatgattgagcaattcaaagtggtttggctgaaaccctacgaac

SEQ ID NO: 63387 - DNA, 75 bp, Artificial Sequence
  Synthetic
ttatctcaagggacacgcaaattaacgtcatccaatgagtcacaaacccaagacgagatatcaaaatacttacgg

SEQ ID NO: 63388 - DNA, 75 bp, Artificial Sequence
  Synthetic
aaagtgtctctgagctaaagtggtctgtacacatctcatacattgtattaggggcaataatatctaattgaactt

SEQ ID NO: 63389 - DNA, 75 bp, Artificial Sequence
  Synthetic
tgcaaaaaggattcctggaaaaatggtcgcacacaaaaatttaaaaataaatctatttttatattttaaggtgag

SEQ ID NO: 63390 - DNA, 75 bp, Artificial Sequence
  Synthetic
tcagtagcagtcaagaaacatattgttagtgcatggccaaatgcatcccgaataagctggactatcggggatgga

SEQ ID NO: 63391 - DNA, 75 bp, Artificial Sequence
  Synthetic
atcccatacattggatcaaggacagaagataagatagggcaacctgctattaaaccaaaatgtccttccgcagcc

SEQ ID NO: 63392 - DNA, 75 bp, Artificial Sequence
  Synthetic
aagataagatagggcaacctgctattaaaccaaaatgtccttccgcagccttaagagaggccattgaattggcgt

SEQ ID NO: 63393 - DNA, 75 bp, Artificial Sequence
  Synthetic
cccgtttaacatgggtaactcaaggcagttcgaacagtgacttgctaataaaaccatttttggaagcacgagtaa

SEQ ID NO: 63394 - DNA, 75 bp, Artificial Sequence
  Synthetic
aatgaccccttcacattactcgggaaatattgttcataggtacaacgatcaatacagtcctcattctttcatggc

SEQ ID NO: 63395 - DNA, 75 bp, Artificial Sequence
  Synthetic
tattcaagggtggaaagtttattgggctggtattgagtttgatgtgactcacaaaggaatggccctattgcatag

SEQ ID NO: 63396 - DNA, 75 bp, Artificial Sequence
  Synthetic
ttccagaatgttataaattatgcagttgcactgttcgatattaaatttagaaacactgaggctacagatatccag

SEQ ID NO: 63397 - DNA, 75 bp, Artificial Sequence
  Synthetic
acattggatttagatttaacaagataccgagaaaatgaattgatttatgacaataatcctctaaaaggaggactc

SEQ ID NO: 63398 - DNA, 75 bp, Artificial Sequence
  Synthetic
agaagcaactccaacaatatgcagagtctcgcgaacttgaccatcttggacttgatgatcaggaaaagaaaattc

SEQ ID NO: 63399 - DNA, 75 bp, Artificial Sequence
  Synthetic
attcaaagagaggtccactagtctctatcactcagcacttagcacatcttagagcagagattcgagaattgacta

SEQ ID NO: 63400 - DNA, 75 bp, Artificial Sequence
  Synthetic
tttgagaacgtccatttcatcttttcttacatttataaaagagtggataattaatcgcggaacaattgtcccttt

SEQ ID NO: 63401 - DNA, 75 bp, Artificial Sequence
  Synthetic
ctaatgatgaagattaaaaccttcatcatccttacgtcaattgaattctctagcactagaagcttattgtcttca

SEQ ID NO: 63402 - DNA, 75 bp, Artificial Sequence
  Synthetic
acagacccaattagcagtggagaaacaagatcattcactacccatttcttaacttatcccaaaataggacttctg

SEQ ID NO: 63403 - DNA, 75 bp, Artificial Sequence
  Synthetic
caaaacccaacacctgttaataatttcctccatcagatcgtagaactgctggtgcatgattcatcaagacaacag

SEQ ID NO: 63404 - DNA, 75 bp, Artificial Sequence
  Synthetic
atcccaaaataggacttctgtacagttttggggcctttgtaagttattatcttggcaatacaattcttcggacta

SEQ ID NO: 63405 - DNA, 75 bp, Artificial Sequence
  Synthetic
ggttcaagtgcacagtcaaggaaggaaagctgcagtgtcgcatctgacaacccttgccacaatctccacgagtcc

SEQ ID NO: 63406 - DNA, 75 bp, Artificial Sequence
  Synthetic
tttttatattacttaactacccaaattcataatctaccacatcgctcattgcgaatacttaagccaacattcaaa

SEQ ID NO: 63407 - DNA, 75 bp, Artificial Sequence
  Synthetic
tgaagttaagcttatcgaaaggctgacagggcttctgagtttatttccagatggtctctacaggttcgattgaat

SEQ ID NO: 63408 - DNA, 75 bp, Artificial Sequence
  Synthetic
ttcataatctaccacatcgctcattgcgaatacttaagccaacattcaaacatgcaagcgttatgtcacgattaa

SEQ ID NO: 63409 - DNA, 75 bp, Artificial Sequence
  Synthetic
tgagtattgatccccatttttctatttacataggcggtgctgcaggtgacagaggactctcagatgcggccaggt

SEQ ID NO: 63410 - DNA, 75 bp, Artificial Sequence
  Synthetic
aatgcaacaaacgaagccaaacccgaagatgcgcaacagtcaaacccaaacggacccaatttgcaatcatagttt

SEQ ID NO: 63411 - DNA, 75 bp, Artificial Sequence
  Synthetic
aacaccaacacgagtaagagcgctgactccctggacctcgccaccacgacaagcccccaaaactacagcgagact

SEQ ID NO: 63412 - DNA, 75 bp, Artificial Sequence
  Synthetic
ctaacgcaacataataaactccgcactctttataattaagctttaacgataggtctgggctcatattgttattga

SEQ ID NO: 63413 - DNA, 75 bp, Artificial Sequence
  Synthetic
gatcatgtacatcctcacgacaatcttgtttacacatgtaagagtacagccagcaatttcttccatgcgtcattg

SEQ ID NO: 63414 - DNA, 75 bp, Artificial Sequence
  Synthetic
gcgtactggaggagcaggcacagaaacagcaaccgaaaagacttgacaagaaactcttcaactggatcaagcaca

SEQ ID NO: 63415 - DNA, 75 bp, Artificial Sequence
  Synthetic
tgtgtgttaggtttcacaaattatatatattactaactccatactcgtaactaacattagataagtaggttaaga

SEQ ID NO: 63416 - DNA, 75 bp, Artificial Sequence
  Synthetic
gtgatagccttaatctttgtgtaaaataagagattgggtgtaataactttaactttttgtctagtaagctactat

SEQ ID NO: 63417 - DNA, 75 bp, Artificial Sequence
  Synthetic
tttgtgtaaaataagagattaggtgtaataactttaacatttttgtctagtaagctactattccattcagaatga

SEQ ID NO: 63418 - DNA, 75 bp, Artificial Sequence
  Synthetic
tcgtgttaatgataattaaggcattgaccacgctcatcagaaggctcactagaataaacgttgcaaaaaggatcc

SEQ ID NO: 63419 - DNA, 75 bp, Artificial Sequence
  Synthetic
tcactagaataaacgttgcaaaaaggatccctggaaaaatggtcacacacaaaaatttaaaaataaatctatttc

SEQ ID NO: 63420 - DNA, 75 bp, Artificial Sequence
  Synthetic
ataccacagtttattgtaggtttaccggtatagtctcgtccatgcattacaaacttgatgaggtcctttgggaaa

SEQ ID NO: 63421 - DNA, 75 bp, Artificial Sequence
  Synthetic
cggtatagtctcgtccatgcattacaaacttgatgaggtcctttgggaaatagagaattttaagtcggctgtgac

SEQ ID NO: 63422 - DNA, 75 bp, Artificial Sequence
  Synthetic
gaggcagacccactggacgatgccgacgacgagacgtctagccttccgcccttagagtcagatgatgaagaacag

SEQ ID NO: 63423 - DNA, 75 bp, Artificial Sequence
  Synthetic
gctggcagagggagaaggtgctggtgccttactattgattcagaaataccaagttaagaccttattcttcaacac

SEQ ID NO: 63424 - DNA, 75 bp, Artificial Sequence
  Synthetic
gccttactattgattcagaaataccaagttaagaccttattcttcaacacgctagctactgagtccagtatagag

SEQ ID NO: 63425 - DNA, 75 bp, Artificial Sequence
  Synthetic
tcagaaatagtatcaggaatgactactcctaggatgcttctacctgttatgtcaaaattccataatgaccaaatt

SEQ ID NO: 63426 - DNA, 75 bp, Artificial Sequence
  Synthetic
ctcctaggatgcttctacctgttatgtcaaaattccataatgaccaaattgagattattcttaacaactcagcaa

SEQ ID NO: 63427 - DNA, 75 bp, Artificial Sequence
  Synthetic
ctccccccgccacgaccgcagccggacccttaaaagcagagaacaccaacacgagtaagagcgctgactccctgg

SEQ ID NO: 63428 - DNA, 75 bp, Artificial Sequence
  Synthetic
gccaaataacagacataacaaatcctacttggtttaaagaccaaagagcaaggctacctaggcaagtcgaggtta

SEQ ID NO: 63429 - DNA, 75 bp, Artificial Sequence
  Synthetic
acgagtaagagcgctgactccctggacctcgccaccacgacaagcccccaaaactacagcgagactgctggcaac

SEQ ID NO: 63430 - DNA, 75 bp, Artificial Sequence
  Synthetic
tacttggtttaaagaccaaagagcaaggctacctaggcaagtcgaggttataaccatggatgcagagacgacaga

SEQ ID NO: 63431 - DNA, 75 bp, Artificial Sequence
  Synthetic
tgtgtctatgctttaccagagcggagattacttactctccatattagggtctgatgggtataaaatcattaagtt

SEQ ID NO: 63432 - DNA, 75 bp, Artificial Sequence
  Synthetic
taaatgataatctagccccgttttttgccactgggtatttaattaagccaataacgtcaagtgccaggtctagtg

SEQ ID NO: 63433 - DNA, 75 bp, Artificial Sequence
  Synthetic
agtggtatctttgtctgacgaacttcttatcaactacacgtaagatgccacaccaaaaccatctcagttgtaagc

SEQ ID NO: 63434 - DNA, 75 bp, Artificial Sequence
  Synthetic
tgattatcaacgtacagattataaaaaactcataaattgctctcatacatcatattgatcgaatttcaataaata

SEQ ID NO: 63435 - DNA, 75 bp, Artificial Sequence
  Synthetic
tcggcaaggcaaccaatccgcttgtcagagtcaatcggctgggtcctggaatcccggatcaccccctcaggctcc

SEQ ID NO: 63436 - DNA, 75 bp, Artificial Sequence
  Synthetic
ggagaacagtatcaacagctcagagaggcagccactgaggctgagaagcaactccaacaatatgcggagtctcgt

SEQ ID NO: 63437 - DNA, 75 bp, Artificial Sequence
  Synthetic
tcagatagaaatctaacaccaggtcttaattcttatatcaaaagaaatcaattccctccgttgccaatgattaaa

SEQ ID NO: 63438 - DNA, 75 bp, Artificial Sequence
  Synthetic
acaaagtcggactcaaacatatcactttattcgtactgcaaaaggacgaatcacaaaactagtcaatgattattt

SEQ ID NO: 63439 - DNA, 75 bp, Artificial Sequence
  Synthetic
tttattcgtactgcaaaaggacgaatcacaaaactagtcaatgattatttaaaattctttcttattgtacaagca

SEQ ID NO: 63440 - DNA, 75 bp, Artificial Sequence
  Synthetic
ttaaacgaccaagataaaattgttcatatctcgctagcagcttaaaatataaatgtaataggagctatatctctg

SEQ ID NO: 63441 - DNA, 75 bp, Artificial Sequence
  Synthetic
gaatagtgttttggttgataacacgacttcttaaaacaaaattgatcttcaagattaagtttttttataattatc

SEQ ID NO: 63442 - DNA, 75 bp, Artificial Sequence
  Synthetic
ttaaaacataatgggacatggcaagctgagtttaagaaattaccagagttgattagtgtgtgcaataggttctat

SEQ ID NO: 63443 - DNA, 75 bp, Artificial Sequence
  Synthetic
aacgtttcttagttcaaaccttatatttacatagaatgcaggattctgaagttaagcttatcgaaaggctgacag

SEQ ID NO: 63444 - DNA, 75 bp, Artificial Sequence
  Synthetic
tcagcaacgcgattgattgtttctacaaacactttaggtgagttttcaggaggtggccaatcggcacgcgacagc

SEQ ID NO: 63445 - DNA, 75 bp, Artificial Sequence
  Synthetic
tctctacaggttcgattgaataaccgtgcatagtattttgatacttgtaaaggttggttatcaacatacagatta

SEQ ID NO: 63446 - DNA, 75 bp, Artificial Sequence
  Synthetic
tgacaccatcgaccatgccagccacacaccaggcagtgtgtcatcagcattcatccttgaagctatggtgaatgt

SEQ ID NO: 63447 - DNA, 75 bp, Artificial Sequence
  Synthetic
aactcataaattgctctcatacatcatcttgatctgatttcaataaataactatttagataacgaaaggagtcct

SEQ ID NO: 63448 - DNA, 75 bp, Artificial Sequence
  Synthetic
ctgggctcatattgttattgatatagtaatgttgtatcaatatcttgccagatggaatagtgctttggttgataa

SEQ ID NO: 63449 - DNA, 75 bp, Artificial Sequence
  Synthetic
cacgacttcttaaaacaaaactgatctttaagattaagttttttataattgtcattgctttaatttgtcgattta

SEQ ID NO: 63450 - DNA, 75 bp, Artificial Sequence
  Synthetic
aatccaccgcataacctcacactggaaaatcgaaacaacccccctgaagggcctagttcatacaggggtcatatg

SEQ ID NO: 63451 - DNA, 75 bp, Artificial Sequence
  Synthetic
ctttaagattaagttttttataattgtcattgctttaatttgtcgatttaaaaatggtgatagccttaatctttg

SEQ ID NO: 63452 - DNA, 75 bp, Artificial Sequence
  Synthetic
gacttggattggagatgtggaggaaaaatcggggcccatttctaagttgttcacaatctaagtacagacattgct

SEQ ID NO: 63453 - DNA, 75 bp, Artificial Sequence
  Synthetic
ctgcttcaagttgtggaggaggtctatggtattcgctattgttatattacaatcaataacaagcttgtaaaaata

SEQ ID NO: 63454 - DNA, 75 bp, Artificial Sequence
  Synthetic
aaaatggtgatagccttaatctttgtgtaaaataagagattaggtgtaataactttaacatttttgtctagtaag

SEQ ID NO: 63455 - DNA, 75 bp, Artificial Sequence
  Synthetic
caattttattggccggtaatgaatcacaagaataaattcatggcaatcctgcaacatcatcagtgaatgagcatg

SEQ ID NO: 63456 - DNA, 75 bp, Artificial Sequence
  Synthetic
ttcctctcattgaaatttatatcggaatttaaattgaaattgttactgtaatcatacctggtttgtttcagagcc

SEQ ID NO: 63457 - DNA, 75 bp, Artificial Sequence
  Synthetic
aaagtggtctgtacacatctcatacattgtattaggggcaataatatctaattgaacttagccatttaaaattta

SEQ ID NO: 63458 - DNA, 75 bp, Artificial Sequence
  Synthetic
gagaaaaaatcgggacccatttctaggttgttcacaatccaagtacagacattgcccttctaattaagaaaaaat

SEQ ID NO: 63459 - DNA, 75 bp, Artificial Sequence
  Synthetic
catccttacgtcaattgaattctctagcactagaagcttattgtcttcaatgtaaaagaaaagctggcctaacaa

SEQ ID NO: 63460 - DNA, 75 bp, Artificial Sequence
  Synthetic
ctgtaatcatacctggtttgtttcagagccatatcaccaagatagagaacaacctaggtctccggagggggcaag

SEQ ID NO: 63461 - DNA, 75 bp, Artificial Sequence
  Synthetic
agtcatccacaatagcacattacaggttagtgatgtcgacaaactagtttgtcgtgacaaactgtcatccacaaa

SEQ ID NO: 63462 - DNA, 75 bp, Artificial Sequence
  Synthetic
gggcacgggttccgttttgaagtcaagaagcgtgatggagtgaagcgccttgaggaattgctgccagcagtatct

SEQ ID NO: 63463 - DNA, 75 bp, Artificial Sequence
  Synthetic
attgagaattaactttgattttgaacctgaacacccagaggactggagactcaacaaccctaaagcctggggtaa

SEQ ID NO: 63464 - DNA, 75 bp, Artificial Sequence
  Synthetic
gatggaatagtgttttggttgataacacgacttcttaaaacaaaattgatctttaagattaagtttttataatta

SEQ ID NO: 63465 - DNA, 75 bp, Artificial Sequence
  Synthetic
tatcaggctaccggttttggaaccaatgagacagagtacttgttcgaggttgacaatttgacctacgtccaactt

SEQ ID NO: 63466 - DNA, 75 bp, Artificial Sequence
  Synthetic
caacatctaggccttatcacatcacaagttccgccttaaactctgcagggtgatccaacaaccttaatagcaaca

SEQ ID NO: 63467 - DNA, 75 bp, Artificial Sequence
  Synthetic
cacaaccaaaccaggtccggacaacagcacccataatacacccgtgtataaacttgacatctctgaggcaactca

SEQ ID NO: 63468 - DNA, 75 bp, Artificial Sequence
  Synthetic
cttcaaatgaccccttcacattactcgggaaatattgttcataggtacaacgatcaatacagtcctcattctttc

SEQ ID NO: 63469 - DNA, 75 bp, Artificial Sequence
  Synthetic
tgatgatcaggaaaagaaaattcttatgaacttccatcagaaaaagaacgaaatcagcttccagcaaacaaacgc

SEQ ID NO: 63470 - DNA, 75 bp, Artificial Sequence
  Synthetic
gtagcaggactgatcacaggcgggagaaggactcgaagagaagtaattgtcaatgctcaacccaaatgcaacccc

SEQ ID NO: 63471 - DNA, 75 bp, Artificial Sequence
  Synthetic
accccgccaccacaacaagtccccaaaaccacagcgagaccgctggcaacaacaacactcatcaccaagataccg

SEQ ID NO: 63472 - DNA, 75 bp, Artificial Sequence
  Synthetic
cacagcctccgacactccccccgccacgaccgcagccggacccctaaaagcagagaacaccaacacgagcaagag

SEQ ID NO: 63473 - DNA, 75 bp, Artificial Sequence
  Synthetic
aagttattatcttggcaatacaattcttcggactaagaaattaacacttgacaattttttatattacttaactac

SEQ ID NO: 63474 - DNA, 75 bp, Artificial Sequence
  Synthetic
gacgagacgtctagccttccgcccttagagtcagatgatgaagaacaggacagggacggaacttctaaccgcaca

SEQ ID NO: 63475 - DNA, 75 bp, Artificial Sequence
  Synthetic
cgaagctatggtgaatgtcatatcgggccccaaagtgctaatgaagcaaattccaatttggcttcctctaggtgt

SEQ ID NO: 63476 - DNA, 75 bp, Artificial Sequence
  Synthetic
aagattgattgatgaaagatcatgactaataacattacaaataatcctactataatcaatacggtgattcaaatg

SEQ ID NO: 63477 - DNA, 75 bp, Artificial Sequence
  Synthetic
ctaataacattacaaataatcctactataatcaatacggtgattcaaatgttaatctttctcattgcacatactc

SEQ ID NO: 63478 - DNA, 75 bp, Artificial Sequence
  Synthetic
ttaagaaaaaggtaatctttcgattatctttaatcttcatccttgattctacaatcatgacagttgtctttagtg

SEQ ID NO: 63479 - DNA, 75 bp, Artificial Sequence
  Synthetic
gtgtgcgaataactatgaggaagattaataattttcctctcattgaaatttatatcggaatttaaattgaaattg

SEQ ID NO: 63480 - DNA, 75 bp, Artificial Sequence
  Synthetic
tccactcacggacaatgacagaagaaacgaaccctccggctcaaccagccctcgcatgctgaccccaatcaacga

SEQ ID NO: 63481 - DNA, 75 bp, Artificial Sequence
  Synthetic
tgaaataaaaagaacgacaattccacaagagaacacgcaccagggtccgtcgttccagtcatttctaagtgactc

SEQ ID NO: 63482 - DNA, 75 bp, Artificial Sequence
  Synthetic
tcccgtatacagagatcactccgaaaagaaagaactcccgcaagatgaacaacaagatcaggaccacattcaaga

SEQ ID NO: 63483 - DNA, 75 bp, Artificial Sequence
  Synthetic
agaggcagacccactggacgatgccgacgacgagacgtctagccttccgcccttagagtcagatgatgaagaaca

SEQ ID NO: 63484 - DNA, 75 bp, Artificial Sequence
  Synthetic
cttgaagaggaatatccaccatggctcactgaaaaagaggccatgaatgatgagaatagatttgttacactggat

SEQ ID NO: 63485 - DNA, 75 bp, Artificial Sequence
  Synthetic
gcaggggccatactgtggccacgactcaaaacgacagaatgccaggccctgagctttcgggctggatctctgagc

SEQ ID NO: 63486 - DNA, 75 bp, Artificial Sequence
  Synthetic
tcaaaacgacagaatgccaggccctgagctttcgggctggatctctgagcagctaatgaccggaaggattcctgt

SEQ ID NO: 63487 - DNA, 75 bp, Artificial Sequence
  Synthetic
aaatcataatctcgtatcgctcgtaatataacctgccaagcatacctcttgcacaaagtgattcttgtacacaaa

SEQ ID NO: 63488 - DNA, 75 bp, Artificial Sequence
  Synthetic
gcacaaagtgattcttgtacacaaataatgttttactctacaggaggtagcaacgatccatcccatcaaaaaata

SEQ ID NO: 63489 - DNA, 75 bp, Artificial Sequence
  Synthetic
aactcccgcaagatgaacaacaagatcaggaccacattcaagaggccaggaaccaagacagtgacaacacccagc

SEQ ID NO: 63490 - DNA, 75 bp, Artificial Sequence
  Synthetic
gctattgttatattacaatcaataacaagcttgtaaaaatattgttcttgtttcaagaggtagattgtgaccgga

SEQ ID NO: 63491 - DNA, 75 bp, Artificial Sequence
  Synthetic
aacacttgctgccatgccggaagaggagacgactgaagctaatgccggtcagttcctctcctttgcaagtctatt

SEQ ID NO: 63492 - DNA, 75 bp, Artificial Sequence
  Synthetic
aagaatttttaggatcttttgtgtgcgaataactatgaggaagattaataattttcctctcattgaaatttatat

SEQ ID NO: 63493 - DNA, 75 bp, Artificial Sequence
  Synthetic
cctgccaagcatacctcttgcacaaagtgattcttgtacacaaataatgtttgactctacaggaggtagcaacga

SEQ ID NO: 63494 - DNA, 75 bp, Artificial Sequence
  Synthetic
aatgtccgcagtgttcaaatgccaagcaacctggtgggaaaccattcgtgtcagtggcagtcaagaaacatattg

SEQ ID NO: 63495 - DNA, 75 bp, Artificial Sequence
  Synthetic
tcttcatctccttttagcaaaatactatttcaggatagtccagctagtgacacgtcttttagctgtataccagtt

SEQ ID NO: 63496 - DNA, 75 bp, Artificial Sequence
  Synthetic
acattaatgatacacttgtgagtatcagccctagataatataagtcaattaaacaaccaagataaaattgttcat

SEQ ID NO: 63497 - DNA, 75 bp, Artificial Sequence
  Synthetic
aaacaaccaagataaaattgttcatatcccgctagcagctttaaagataaatgtaataggagctatacctctgac

SEQ ID NO: 63498 - DNA, 75 bp, Artificial Sequence
  Synthetic
caaatgcaacaaacgaagccaaacccgaagatgcgcaacagtcaaacccaaacggacccaatttgcaatcatagt

SEQ ID NO: 63499 - DNA, 75 bp, Artificial Sequence
  Synthetic
gattcacaccacagtttctgctccagctgaatgagacaatatatgcaagtgggaagaggagcaacaccacgggaa

SEQ ID NO: 63500 - DNA, 75 bp, Artificial Sequence
  Synthetic
ttgtctttcacagctgtatcaaacggacccaaaaacatcagtggtcagagtccggcgcgaacttcttccgaccca

SEQ ID NO: 63501 - DNA, 75 bp, Artificial Sequence
  Synthetic
ccagttacctcaggtttattccagttaaaaacttatctccgaatgattgagatggatgatttattcttaccttta

SEQ ID NO: 63502 - DNA, 75 bp, Artificial Sequence
  Synthetic
ctcacagttaatcataaacaaggtttgacatcaatctagttatatctttgagaatgataaacttgatgaagatta

SEQ ID NO: 63503 - DNA, 75 bp, Artificial Sequence
  Synthetic
actctttataattaagctttaacgataggtctgggctcatattgttattgatatagtaatgttgtatcaatatct

SEQ ID NO: 63504 - DNA, 75 bp, Artificial Sequence
  Synthetic
ccaccaggtcaactccattggctgaaaagaagcccacctacaacgaacattactttgagcgccctcacaattaaa

SEQ ID NO: 63505 - DNA, 75 bp, Artificial Sequence
  Synthetic
atatgaataagcattttatcaccagaaatcctatatactaaatggttaattgtaactgaacccgcaggtcacatg

SEQ ID NO: 63506 - DNA, 75 bp, Artificial Sequence
  Synthetic
catctctgaggcaactcaagttggacaacatcaccgtagagcagacaacgacagcacagcctccgacactccccc

SEQ ID NO: 63507 - DNA, 75 bp, Artificial Sequence
  Synthetic
tgccagatggaatagtgctttggttgataacacgacttcttaaaacaaaactgatctttaagattaagtttttta

SEQ ID NO: 63508 - DNA, 75 bp, Artificial Sequence
  Synthetic
catgcttgcttcatatactatcacccatttcggcaaggcaaccaatccgcttgtcagagtcaatcggctgggtcc

SEQ ID NO: 63509 - DNA, 75 bp, Artificial Sequence
  Synthetic
tagaaatttaaacagtgagtggagacaacttttaaatggaagcttcatatgagagaggacgcccccgagctgcca

SEQ ID NO: 63510 - DNA, 75 bp, Artificial Sequence
  Synthetic
tgcactcggagtcgccacagcacacgggagcaccctcgcaggagtaaatgttggagaacagtatcaacagctcag

SEQ ID NO: 63511 - DNA, 75 bp, Artificial Sequence
  Synthetic
tcctccaggagttcgttcttccaccagtccaactaccccagtatttcacctttgatttgacagcactcaaactga

SEQ ID NO: 63512 - DNA, 75 bp, Artificial Sequence
  Synthetic
gaaaagaaagaactcccgcaagatgaacaacaagatcaggaccacattcaagaggccaggaaccaagacagtgac

SEQ ID NO: 63513 - DNA, 75 bp, Artificial Sequence
  Synthetic
agaataaacgttgcaaaaaggatccctggaaaaatggtcgcacacaaaaatttaaaaataaatctatttcttctt

SEQ ID NO: 63514 - DNA, 75 bp, Artificial Sequence
  Synthetic
ctgaccccaatcaacgaagaggcagacccactggacgatgccgacgacgagacgtctagccttccgcccttagag

SEQ ID NO: 63515 - DNA, 75 bp, Artificial Sequence
  Synthetic
ccgtatacagagatcactccgaaaagaaagaactcccgcaagatgaacaacaagatcaggaccacattcaagagg

SEQ ID NO: 63516 - DNA, 75 bp, Artificial Sequence
  Synthetic
aagaaggggaacagtgccgatctaacatctccggagaaaatccaagcaataatgacttcactccaggactttaag

SEQ ID NO: 63517 - DNA, 75 bp, Artificial Sequence
  Synthetic
gagagagtgttttttcattaaccttcatcttgtaaacgttgagcaaaattgttaaaaatatgaggcgggttatat

SEQ ID NO: 63518 - DNA, 75 bp, Artificial Sequence
  Synthetic
gggggcaagggcatcagtgtgctcagttgaaaatcccttgtcaacatctaggccttatcacatcacaagttccgc

SEQ ID NO: 63519 - DNA, 75 bp, Artificial Sequence
  Synthetic
gatggtcaacaattttattggccagtaatgaatcacaggaataaattcatggcaatcctgcaacatcatcagtga

SEQ ID NO: 63520 - DNA, 75 bp, Artificial Sequence
  Synthetic
taacctgccaagcatacctcttacacaaagtgattcttgtacacaaataatgttttactctacaggaggtagcaa

SEQ ID NO: 63521 - DNA, 75 bp, Artificial Sequence
  Synthetic
gttaccactgaacacacaaggaatcccccatgctgctatggactggtatcaggcatcagtattcaaagaagcggt

SEQ ID NO: 63522 - DNA, 75 bp, Artificial Sequence
  Synthetic
ttatagccataattgtaactcaatatcttagctagcgatttatctaaattaaattacattatgcttttataactt

SEQ ID NO: 63523 - DNA, 75 bp, Artificial Sequence
  Synthetic
tactatttcagggtagtccaattagtgacacgtcttttagctgtataccagtcgcccttgagatacgccacaaaa

SEQ ID NO: 63524 - DNA, 75 bp, Artificial Sequence
  Synthetic
gtgtctctaagctaaattggtctgtacacatctcatacattgtattagaggcaatagtatctaattgaacttagc

SEQ ID NO: 63525 - DNA, 75 bp, Artificial Sequence
  Synthetic
accatgtgccggagactttgccttccacaaagagggtgctttcttcctgtatgatcgacttgcttccacagttat

SEQ ID NO: 63526 - DNA, 75 bp, Artificial Sequence
  Synthetic
agacccactggatgacgccgacgacgagacgtccagccttccgcccctggagtcagacgatgaagagcaggacag

SEQ ID NO: 63527 - DNA, 75 bp, Artificial Sequence
  Synthetic
agaccacaaaatcatggcttcagaaaattcctctgcaatggttcaagtgcacagtcaaggaaggaaagctgcagt

SEQ ID NO: 63528 - DNA, 75 bp, Artificial Sequence
  Synthetic
cctgtatgatcgacttgcttccacagttatctaccgaggaacgactttcgctgaaggtgtcgttgcatttctgat

SEQ ID NO: 63529 - DNA, 75 bp, Artificial Sequence
  Synthetic
catctctgagacacgacatatctttccttgcaggataaccgcagctttccatacgtttttttcggtgagaatctt

SEQ ID NO: 63530 - DNA, 75 bp, Artificial Sequence
  Synthetic
tggacgatgccgacgacgagacgtctagccttccgcccttagagtcagatgatgaagaacaggacagggacggaa

SEQ ID NO: 63531 - DNA, 75 bp, Artificial Sequence
  Synthetic
cttagaggattggagattcaacaaccctaaagcttggggtaaaacattggaaatagttaaaagacaaattgctcg

SEQ ID NO: 63532 - DNA, 75 bp, Artificial Sequence
  Synthetic
aaccctgggaactgcactgccattgactttgtgctaaatcctagcggattaaatgtccctgggtcgcaagactta

SEQ ID NO: 63533 - DNA, 75 bp, Artificial Sequence
  Synthetic
cactccgaaaagaaagaactcccgcaagatgaacaacaagatcaggaccacattcaagaggccaggaaccaagac

SEQ ID NO: 63534 - DNA, 75 bp, Artificial Sequence
  Synthetic
cattcaagaggccaggaaccaagacagtgacaacacccagccagaacattcttttgaggagatgtatcgccacat

SEQ ID NO: 63535 - DNA, 75 bp, Artificial Sequence
  Synthetic
actacagcgagactgctggcaacaacaacactcatcaccaagataccggagaagagagtgccagcagcgggaagc

SEQ ID NO: 63536 - DNA, 75 bp, Artificial Sequence
  Synthetic
cttcatctccttttagcaaaatactatttcaggatagtccagctagtgacacgtcttttagctgtataccagttg

SEQ ID NO: 63537 - DNA, 75 bp, Artificial Sequence
  Synthetic
tcccgaataagctggactatcggggatggaatcccatacattggatcaaggacagaagataagataggacaacct

SEQ ID NO: 63538 - DNA, 75 bp, Artificial Sequence
  Synthetic
caacaacactcatcaccaagataccggagaagagagtgccagcagcgggaagctaggcttaattaccaatactat

SEQ ID NO: 63539 - DNA, 75 bp, Artificial Sequence
  Synthetic
cccataatacacccgtgtataaacttgacatctctgaggcaactcaagttggacaacatcaccgtagagcagaca

SEQ ID NO: 63540 - DNA, 75 bp, Artificial Sequence
  Synthetic
gaatgccaggccctgagctttcgggctggatctctgagcagctaatgaccggaaggattcctgtaaacgacatct

SEQ ID NO: 63541 - DNA, 75 bp, Artificial Sequence
  Synthetic
tcctctgcaatggttcaagtgcacaatcaaggaagggaagctgcagtgtcgcatctgataacccttgccacaatc

SEQ ID NO: 63542 - DNA, 75 bp, Artificial Sequence
  Synthetic
ccctccggctcaaccagccctcgcatgctgacaccaatcaacgaagaggcagacccactggacgatgccgacgac

SEQ ID NO: 63543 - DNA, 75 bp, Artificial Sequence
  Synthetic
ctactgttgtgcaacaacaaaccatcgcatcagaatcattagaacaacgcattacgagtcttgagaatggtctaa

SEQ ID NO: 63544 - DNA, 75 bp, Artificial Sequence
  Synthetic
agacagcattcaagggatggacacgaccaccatgttcgagcacgatcatcatccagagagaattatcgaggtgag

SEQ ID NO: 63545 - DNA, 75 bp, Artificial Sequence
  Synthetic
ctatcaccctaagtgcgaaaaacaaacttattaataccttatttcatgcatcagctgacttcgaagacgaaatgg

SEQ ID NO: 63546 - DNA, 75 bp, Artificial Sequence
  Synthetic
tttcggcaaaggatttgagaaacattatgtatgatcacttgcctggttttggaactgctttccaccaattagtac

SEQ ID NO: 63547 - DNA, 75 bp, Artificial Sequence
  Synthetic
tcatcttttcttacatttgtaaaagaatggataattaatcgcggaacaattgtccctttatggatagtatatccg

SEQ ID NO: 63548 - DNA, 75 bp, Artificial Sequence
  Synthetic
tacaatcatgacagttgtctttaatgaaaaaggaaaaaagcctttttattaagttgtaataatcagatctgcaaa

SEQ ID NO: 63549 - DNA, 75 bp, Artificial Sequence
  Synthetic
agattgatcgaggttgggtatgtgtttttcagcttcaagatggtaaaacacttggactcaaaatttgagccaatc

SEQ ID NO: 63550 - DNA, 75 bp, Artificial Sequence
  Synthetic
tcatcatccagagagaattatcgaggtgagtaccgtcaatcaaggagcgcctcacaagtgcgcgttcctactgta

SEQ ID NO: 63551 - DNA, 75 bp, Artificial Sequence
  Synthetic
taaccttctacttgatcacaatactccgtatacctatcatcatatatttaatcaagacgatatcctttaaaactt

SEQ ID NO: 63552 - DNA, 75 bp, Artificial Sequence
  Synthetic
cacaggctcacaagatccgtgaattccatagaacattgataaggctggagatgacgccacaacaactttgtgagc

SEQ ID NO: 63553 - DNA, 75 bp, Artificial Sequence
  Synthetic
aactcttaaatggaagcttcatatgagagaggacgcccccgagctgccagacagcattcaagggatggacacgac

SEQ ID NO: 63554 - DNA, 75 bp, Artificial Sequence
  Synthetic
taattgtcattgctttaatttgtcgattttaaaaatggtgatagccttaatctttgtgtaaaataagagattagg

SEQ ID NO: 63555 - DNA, 75 bp, Artificial Sequence
  Synthetic
ttgccacaatctccacgagtcctcaacctcccacaaccaaaacaggtccggacaacagcacccataatacacccg

SEQ ID NO: 63556 - DNA, 75 bp, Artificial Sequence
  Synthetic
acctcccacaaccaaaacaggtccggacaacagcacccataatacacccgtgtataaacttgacatctctgaggc

SEQ ID NO: 63557 - DNA, 75 bp, Artificial Sequence
  Synthetic
aaagtgctaatgaagcaaattccaatttggcttcctctaggtgtcgctgatcaaaagacctacagctttgactca

SEQ ID NO: 63558 - DNA, 75 bp, Artificial Sequence
  Synthetic
tattattcagattaggccccaagaggcattcttcatctccttttagcaaaatactatttcaggatagtccagcta

SEQ ID NO: 63559 - DNA, 75 bp, Artificial Sequence
  Synthetic
ccacgctcatcagaaggctcactagaataaacgttgcaaaaaggatccctggaaaaatggtcgcacacaaaaatt

SEQ ID NO: 63560 - DNA, 75 bp, Artificial Sequence
  Synthetic
tcatttcaaattgataagatatgcataattgccttaatatataaagaggtatgatataacccaaacattgaccaa

SEQ ID NO: 63561 - DNA, 75 bp, Artificial Sequence
  Synthetic
aaatgcaaccccaatttacattactggactactcaggatgaaggtgctgcaatcggattggcctggataccatat

SEQ ID NO: 63562 - DNA, 75 bp, Artificial Sequence
  Synthetic
gacagggcttctgagtttatttccggatggtctctacaggtttgattgaattaccgtgcatagtatcctgatact

SEQ ID NO: 63563 - DNA, 75 bp, Artificial Sequence
  Synthetic
agcaaaagttacaagtgcctgtggaatctttttaaaacctgatgaaacatttgtacattcaggttttatctattt

SEQ ID NO: 63564 - DNA, 75 bp, Artificial Sequence
  Synthetic
aaactaatgactttgcccctgcatggtcaatgacaaggaatctatttcctcatttatttcaaaatccgaattcca

SEQ ID NO: 63565 - DNA, 75 bp, Artificial Sequence
  Synthetic
taaacttcactagaaggatattgtggggcaacaacacaatgggtgttacaggaatattgcagttacctcgtgatc

SEQ ID NO: 63566 - DNA, 75 bp, Artificial Sequence
  Synthetic
gataacacaacttcttaaaacaaaattgatctttaagattaagttttttataattatcattactttaatttgtcg

SEQ ID NO: 63567 - DNA, 75 bp, Artificial Sequence
  Synthetic
cagtactataatcactctcatttcaaatcgacaagatatgcacaattgcctcaatatataaagaggtatgatata

SEQ ID NO: 63568 - DNA, 75 bp, Artificial Sequence
  Synthetic
aaagcatttacacaagggtcctcgacacgaatgcaaagtttgattcttgaatttaatagctctcttgctatctaa

SEQ ID NO: 63569 - DNA, 75 bp, Artificial Sequence
  Synthetic
gacaagtatttcatgtgctcaaatttctttagttgaaattaagactggttttaagttgcgctcagctgtgatggg

SEQ ID NO: 63570 - DNA, 75 bp, Artificial Sequence
  Synthetic
cttacaaaaaccaggactcagaatccctcaaataagagattccaagacaacatcatagaattgctttattatatg

SEQ ID NO: 63571 - DNA, 75 bp, Artificial Sequence
  Synthetic
ttgagcagtattgaaattggaactcaaaatcatacaatcatcataactcgaactaacatgggttttctggtggag

SEQ ID NO: 63572 - DNA, 75 bp, Artificial Sequence
  Synthetic
gaacaacatcaccgcagaacagacaacgacagcacagcctccgacactccccccgccacgaccgcagccggaccc

SEQ ID NO: 63573 - DNA, 75 bp, Artificial Sequence
  Synthetic
acgacagcacagcctccgacactccccccgccacgaccgcagccggacccccaaaagcagagaacaccaacacga

SEQ ID NO: 63574 - DNA, 75 bp, Artificial Sequence
  Synthetic
ggacgatgccgacgacgagacgtctagccttccgcccttagagtcagatgatgaagaacaggacagggacggaac

SEQ ID NO: 63575 - DNA, 75 bp, Artificial Sequence
  Synthetic
aatggttcaagtgcacagtcaaggaaggaaagctgcagtgtcgcatctgacaacccttgccacaatctccacgag

SEQ ID NO: 63576 - DNA, 75 bp, Artificial Sequence
  Synthetic
cacccgtgtataaacttgacatctctgaggcaactcaagttggacaacatcaccgtagagcagacaacgacagca

SEQ ID NO: 63577 - DNA, 75 bp, Artificial Sequence
  Synthetic
tgaggcaactcaagttggacaacatcaccgtagagcagacaacgacagcacagcctccgacactccccccgccac

SEQ ID NO: 63578 - DNA, 75 bp, Artificial Sequence
  Synthetic
tacccaatacccagacgccaggttatcatcaccaattgtattggaccaatgtgaccttgtcactagagcttgcgg

SEQ ID NO: 63579 - DNA, 75 bp, Artificial Sequence
  Synthetic
atattgtgtttttaaatatagtattgcaaaacattattttgatagtcaaggatcttggtacagtgttacttcaga

SEQ ID NO: 63580 - DNA, 75 bp, Artificial Sequence
  Synthetic
gaccgcagccggacccttaaaagcagagaacaccaacacgagtaagagcgctgactccctggacctcgccaccac

SEQ ID NO: 63581 - DNA, 75 bp, Artificial Sequence
  Synthetic
gtgctttggttgataacacgacttcttaaaacaaaactgatctttaagattaagtttttaataattgtcatagca

SEQ ID NO: 63582 - DNA, 75 bp, Artificial Sequence
  Synthetic
gtgctttggttgataacacgacttcttaaaacaaaactgatctttaagattaagtttttaataattgtcatagct

SEQ ID NO: 63583 - DNA, 75 bp, Artificial Sequence
  Synthetic
gtgctttggttgataacacgacttcttaaaacaaaactgatctttaagattaagtttttaataattgtcatagcc

SEQ ID NO: 63584 - DNA, 75 bp, Artificial Sequence
  Synthetic
gtgctttggttgataacacgacttcttaaaacaaaactgatctttaagattaagtttttaataattgtcatagcg

SEQ ID NO: 63585 - DNA, 75 bp, Artificial Sequence
  Synthetic
gtgctttggttgataacacgacttcttaaaacaaaactgatctttaagattaagtttttaataattgtcattgca

SEQ ID NO: 63586 - DNA, 75 bp, Artificial Sequence
  Synthetic
gtgctttggttgataacacgacttcttaaaacaaaactgatctttaagattaagtttttaataattgtcattgct

SEQ ID NO: 63587 - DNA, 75 bp, Artificial Sequence
  Synthetic
gtgctttggttgataacacgacttcttaaaacaaaactgatctttaagattaagtttttaataattgtcattgcc

SEQ ID NO: 63588 - DNA, 75 bp, Artificial Sequence
  Synthetic
gtgctttggttgataacacgacttcttaaaacaaaactgatctttaagattaagtttttaataattgtcattgcg

SEQ ID NO: 63589 - DNA, 75 bp, Artificial Sequence
  Synthetic
gtgctttggttgataacacgacttcttaaaacaaaactgatctttaagattaagtttttaataattgtcatcgca

SEQ ID NO: 63590 - DNA, 75 bp, Artificial Sequence
  Synthetic
gtgctttggttgataacacgacttcttaaaacaaaactgatctttaagattaagtttttaataattgtcatcgct

SEQ ID NO: 63591 - DNA, 75 bp, Artificial Sequence
  Synthetic
gtgctttggttgataacacgacttcttaaaacaaaactgatctttaagattaagtttttaataattgtcatcgcc

SEQ ID NO: 63592 - DNA, 75 bp, Artificial Sequence
  Synthetic
gtgctttggttgataacacgacttcttaaaacaaaactgatctttaagattaagtttttaataattgtcatcgcg

SEQ ID NO: 63593 - DNA, 75 bp, Artificial Sequence
  Synthetic
gtgctttggttgataacacgacttcttaaaacaaaactgatctttaagattaagtttttaataattgtcatggca

SEQ ID NO: 63594 - DNA, 75 bp, Artificial Sequence
  Synthetic
gtgctttggttgataacacgacttcttaaaacaaaactgatctttaagattaagtttttaataattgtcatggct

SEQ ID NO: 63595 - DNA, 75 bp, Artificial Sequence
  Synthetic
gtgctttggttgataacacgacttcttaaaacaaaactgatctttaagattaagtttttaataattgtcatggcc

SEQ ID NO: 63596 - DNA, 75 bp, Artificial Sequence
  Synthetic
gtgctttggttgataacacgacttcttaaaacaaaactgatctttaagattaagtttttaataattgtcatggcg

SEQ ID NO: 63597 - DNA, 75 bp, Artificial Sequence
  Synthetic
gtgctttggttgataacacgacttcttaaaacaaaactgatctttaagattaagttttttataattgtcatagca

SEQ ID NO: 63598 - DNA, 75 bp, Artificial Sequence
  Synthetic
gtgctttggttgataacacgacttcttaaaacaaaactgatctttaagattaagttttttataattgtcatagct

SEQ ID NO: 63599 - DNA, 75 bp, Artificial Sequence
  Synthetic
gtgctttggttgataacacgacttcttaaaacaaaactgatctttaagattaagttttttataattgtcatagcc

SEQ ID NO: 63600 - DNA, 75 bp, Artificial Sequence
  Synthetic
gtgctttggttgataacacgacttcttaaaacaaaactgatctttaagattaagttttttataattgtcatagcg

SEQ ID NO: 63601 - DNA, 75 bp, Artificial Sequence
  Synthetic
gtgctttggttgataacacgacttcttaaaacaaaactgatctttaagattaagttttttataattgtcattgca

SEQ ID NO: 63602 - DNA, 75 bp, Artificial Sequence
  Synthetic
gtgctttggttgataacacgacttcttaaaacaaaactgatctttaagattaagttttttataattgtcattgct

SEQ ID NO: 63603 - DNA, 75 bp, Artificial Sequence
  Synthetic
gtgctttggttgataacacgacttcttaaaacaaaactgatctttaagattaagttttttataattgtcattgcc

SEQ ID NO: 63604 - DNA, 75 bp, Artificial Sequence
  Synthetic
gtgctttggttgataacacgacttcttaaaacaaaactgatctttaagattaagttttttataattgtcattgcg

SEQ ID NO: 63605 - DNA, 75 bp, Artificial Sequence
  Synthetic
gtgctttggttgataacacgacttcttaaaacaaaactgatctttaagattaagttttttataattgtcatcgca

SEQ ID NO: 63606 - DNA, 75 bp, Artificial Sequence
  Synthetic
gtgctttggttgataacacgacttcttaaaacaaaactgatctttaagattaagttttttataattgtcatcgct

SEQ ID NO: 63607 - DNA, 75 bp, Artificial Sequence
  Synthetic
gtgctttggttgataacacgacttcttaaaacaaaactgatctttaagattaagttttttataattgtcatcgcc

SEQ ID NO: 63608 - DNA, 75 bp, Artificial Sequence
  Synthetic
gtgctttggttgataacacgacttcttaaaacaaaactgatctttaagattaagttttttataattgtcatcgcg

SEQ ID NO: 63609 - DNA, 75 bp, Artificial Sequence
  Synthetic
gtgctttggttgataacacgacttcttaaaacaaaactgatctttaagattaagttttttataattgtcatggca

SEQ ID NO: 63610 - DNA, 75 bp, Artificial Sequence
  Synthetic
gtgctttggttgataacacgacttcttaaaacaaaactgatctttaagattaagttttttataattgtcatggct

SEQ ID NO: 63611 - DNA, 75 bp, Artificial Sequence
  Synthetic
gtgctttggttgataacacgacttcttaaaacaaaactgatctttaagattaagttttttataattgtcatggcc

SEQ ID NO: 63612 - DNA, 75 bp, Artificial Sequence
  Synthetic
gtgctttggttgataacacgacttcttaaaacaaaactgatctttaagattaagttttttataattgtcatggcg

SEQ ID NO: 63613 - DNA, 75 bp, Artificial Sequence
  Synthetic
gtgctttggttgataacacgacttcttaaaacaaaactgatctttaagattaagtttttcataattgtcatagca

SEQ ID NO: 63614 - DNA, 75 bp, Artificial Sequence
  Synthetic
gtgctttggttgataacacgacttcttaaaacaaaactgatctttaagattaagtttttcataattgtcatagct

SEQ ID NO: 63615 - DNA, 75 bp, Artificial Sequence
  Synthetic
gtgctttggttgataacacgacttcttaaaacaaaactgatctttaagattaagtttttcataattgtcatagcc

SEQ ID NO: 63616 - DNA, 75 bp, Artificial Sequence
  Synthetic
gtgctttggttgataacacgacttcttaaaacaaaactgatctttaagattaagtttttcataattgtcatagcg

SEQ ID NO: 63617 - DNA, 75 bp, Artificial Sequence
  Synthetic
gtgctttggttgataacacgacttcttaaaacaaaactgatctttaagattaagtttttcataattgtcattgca

SEQ ID NO: 63618 - DNA, 75 bp, Artificial Sequence
  Synthetic
gtgctttggttgataacacgacttcttaaaacaaaactgatctttaagattaagtttttcataattgtcattgct

SEQ ID NO: 63619 - DNA, 75 bp, Artificial Sequence
  Synthetic
gtgctttggttgataacacgacttcttaaaacaaaactgatctttaagattaagtttttcataattgtcattgcc

SEQ ID NO: 63620 - DNA, 75 bp, Artificial Sequence
  Synthetic
gtgctttggttgataacacgacttcttaaaacaaaactgatctttaagattaagtttttcataattgtcattgcg

SEQ ID NO: 63621 - DNA, 75 bp, Artificial Sequence
  Synthetic
gtgctttggttgataacacgacttcttaaaacaaaactgatctttaagattaagtttttcataattgtcatcgca

SEQ ID NO: 63622 - DNA, 75 bp, Artificial Sequence
  Synthetic
gtgctttggttgataacacgacttcttaaaacaaaactgatctttaagattaagtttttcataattgtcatcgct

SEQ ID NO: 63623 - DNA, 75 bp, Artificial Sequence
  Synthetic
gtgctttggttgataacacgacttcttaaaacaaaactgatctttaagattaagtttttcataattgtcatcgcc

SEQ ID NO: 63624 - DNA, 75 bp, Artificial Sequence
  Synthetic
gtgctttggttgataacacgacttcttaaaacaaaactgatctttaagattaagtttttcataattgtcatcgcg

SEQ ID NO: 63625 - DNA, 75 bp, Artificial Sequence
  Synthetic
gtgctttggttgataacacgacttcttaaaacaaaactgatctttaagattaagtttttcataattgtcatggca

SEQ ID NO: 63626 - DNA, 75 bp, Artificial Sequence
  Synthetic
gtgctttggttgataacacgacttcttaaaacaaaactgatctttaagattaagtttttcataattgtcatggct

SEQ ID NO: 63627 - DNA, 75 bp, Artificial Sequence
  Synthetic
gtgctttggttgataacacgacttcttaaaacaaaactgatctttaagattaagtttttcataattgtcatggcc

SEQ ID NO: 63628 - DNA, 75 bp, Artificial Sequence
  Synthetic
gtgctttggttgataacacgacttcttaaaacaaaactgatctttaagattaagtttttcataattgtcatggcg

SEQ ID NO: 63629 - DNA, 75 bp, Artificial Sequence
  Synthetic
gtgctttggttgataacacgacttcttaaaacaaaactgatctttaagattaagtttttgataattgtcatagca

SEQ ID NO: 63630 - DNA, 75 bp, Artificial Sequence
  Synthetic
gtgctttggttgataacacgacttcttaaaacaaaactgatctttaagattaagtttttgataattgtcatagct

SEQ ID NO: 63631 - DNA, 75 bp, Artificial Sequence
  Synthetic
gtgctttggttgataacacgacttcttaaaacaaaactgatctttaagattaagtttttgataattgtcatagcc

SEQ ID NO: 63632 - DNA, 75 bp, Artificial Sequence
  Synthetic
gtgctttggttgataacacgacttcttaaaacaaaactgatctttaagattaagtttttgataattgtcatagcg

SEQ ID NO: 63633 - DNA, 75 bp, Artificial Sequence
  Synthetic
gtgctttggttgataacacgacttcttaaaacaaaactgatctttaagattaagtttttgataattgtcattgca

SEQ ID NO: 63634 - DNA, 75 bp, Artificial Sequence
  Synthetic
gtgctttggttgataacacgacttcttaaaacaaaactgatctttaagattaagtttttgataattgtcattgct

SEQ ID NO: 63635 - DNA, 75 bp, Artificial Sequence
  Synthetic
gtgctttggttgataacacgacttcttaaaacaaaactgatctttaagattaagtttttgataattgtcattgcc

SEQ ID NO: 63636 - DNA, 75 bp, Artificial Sequence
  Synthetic
gtgctttggttgataacacgacttcttaaaacaaaactgatctttaagattaagtttttgataattgtcattgcg

SEQ ID NO: 63637 - DNA, 75 bp, Artificial Sequence
  Synthetic
gtgctttggttgataacacgacttcttaaaacaaaactgatctttaagattaagtttttgataattgtcatcgca

SEQ ID NO: 63638 - DNA, 75 bp, Artificial Sequence
  Synthetic
gtgctttggttgataacacgacttcttaaaacaaaactgatctttaagattaagtttttgataattgtcatcgct

SEQ ID NO: 63639 - DNA, 75 bp, Artificial Sequence
  Synthetic
gtgctttggttgataacacgacttcttaaaacaaaactgatctttaagattaagtttttgataattgtcatcgcc

SEQ ID NO: 63640 - DNA, 75 bp, Artificial Sequence
  Synthetic
gtgctttggttgataacacgacttcttaaaacaaaactgatctttaagattaagtttttgataattgtcatcgcg

SEQ ID NO: 63641 - DNA, 75 bp, Artificial Sequence
  Synthetic
gtgctttggttgataacacgacttcttaaaacaaaactgatctttaagattaagtttttgataattgtcatggca

SEQ ID NO: 63642 - DNA, 75 bp, Artificial Sequence
  Synthetic
gtgctttggttgataacacgacttcttaaaacaaaactgatctttaagattaagtttttgataattgtcatggct

SEQ ID NO: 63643 - DNA, 75 bp, Artificial Sequence
  Synthetic
gtgctttggttgataacacgacttcttaaaacaaaactgatctttaagattaagtttttgataattgtcatggcc

SEQ ID NO: 63644 - DNA, 75 bp, Artificial Sequence
  Synthetic
gtgctttggttgataacacgacttcttaaaacaaaactgatctttaagattaagtttttgataattgtcatggcg

SEQ ID NO: 63645 - DNA, 75 bp, Artificial Sequence
  Synthetic
gatccaacaaccttaatagaaacattattgttaaaggacagcattagttcacagtcaaacaagcaagattgagaa

SEQ ID NO: 63646 - DNA, 75 bp, Artificial Sequence
  Synthetic
caacccaaatgcaaccccaatttacattactggactactcaggatgaaggtgctgcaatcggattggcctggata

SEQ ID NO: 63647 - DNA, 75 bp, Artificial Sequence
  Synthetic
cattacgccctatcgtgattttcgagacatattgtgtttttaaatatagcattgcaaaacattattttgatagtc

SEQ ID NO: 63648 - DNA, 75 bp, Artificial Sequence
  Synthetic
tccctccgttgccaatgattaaagaactgctatgggaattttaccaccttgaccatcctccacttttctcaacca

SEQ ID NO: 63649 - DNA, 75 bp, Artificial Sequence
  Synthetic
ttttgtgtgcgaataactatgaggaagattaataattttcctctcattgaaatttatatcggaatttaaattgaa

SEQ ID NO: 63650 - DNA, 75 bp, Artificial Sequence
  Synthetic
gttacaggtgttataattgcagttatcgctttattctgtatatgcaaatttgtcttttagtctttcttcagattg

SEQ ID NO: 63651 - DNA, 75 bp, Artificial Sequence
  Synthetic
ttcaaacactttgtgaagctctgttagctgatggtcttgctaaagcatttcctagcaatatgatggtagttacgg

SEQ ID NO: 63652 - DNA, 75 bp, Artificial Sequence
  Synthetic
tactgtaatcatacctggtttgtttcagagccatatcaccaagatagagaacaacctaggtctccggagggggca

SEQ ID NO: 63653 - DNA, 75 bp, Artificial Sequence
  Synthetic
ttgctatctaactaagatggaatacttcatattgggctaactcatatatgctgactcaatagttaacttgacatc

SEQ ID NO: 63654 - DNA, 75 bp, Artificial Sequence
  Synthetic
ttagcaaatccaacggctgatgatttccagcaagaggaaggtcccaaaattaccttgttgacactgatcaagacg

SEQ ID NO: 63655 - DNA, 75 bp, Artificial Sequence
  Synthetic
accaagggtggacaacagaagaacagtcaaaagggccagcatatagagggcagacagacacaattcaggccaatt

SEQ ID NO: 63656 - DNA, 75 bp, Artificial Sequence
  Synthetic
caaaatgtcccaggccctcacagaacaatccaccacgccagtgcgccactcacggacaatgacagaagaaatgaa

SEQ ID NO: 63657 - DNA, 75 bp, Artificial Sequence
  Synthetic
cacggacaatgacagaagaaatgaaccctccggctcaaccagccctcgcatgctgacaccaattaacgaagaggc

SEQ ID NO: 63658 - DNA, 75 bp, Artificial Sequence
  Synthetic
tctctgagacacgacatatctttccttgcagaataaccgcagctttccatacgttcttttcggtgagaatcttgc

SEQ ID NO: 63659 - DNA, 75 bp, Artificial Sequence
  Synthetic
caggaccacactcaagaggccaggaaccaggacagtgacaacacccagtcagaacactcccttgaggagatgtat

SEQ ID NO: 63660 - DNA, 75 bp, Artificial Sequence
  Synthetic
acttacggcattgcaactgcaaattcaacggagcccatactggctaagtcatttaactcagtatgctgactgcga

SEQ ID NO: 63661 - DNA, 75 bp, Artificial Sequence
  Synthetic
agcgggaagcgattgcaaattctaggatacttggaaggaacacgcacattattagcctctaagatcatcaacaat

SEQ ID NO: 63662 - DNA, 75 bp, Artificial Sequence
  Synthetic
ttactaatgatctcttaaaatattaagaaaaactgacggaacataaattctttctgcttcaagttgtggaggagg

SEQ ID NO: 63663 - DNA, 75 bp, Artificial Sequence
  Synthetic
ctagcactcgaagcttattgtcttcaatgtaaaagaaaagctggtctaacaagatgacaactagaacaaagggca

SEQ ID NO: 63664 - DNA, 75 bp, Artificial Sequence
  Synthetic
ctcacaagatccgtgaattccatagaacattgataaggctggagatgacgccacaacaactttgtgagctatttt

SEQ ID NO: 63665 - DNA, 75 bp, Artificial Sequence
  Synthetic
aaaaaggacctggagaaaggggttgtcttaagcgacctctgtaacttcttagttagtcaaactattcaagggtgg

SEQ ID NO: 63666 - DNA, 75 bp, Artificial Sequence
  Synthetic
attagtacaagtgatttgtaaattgggaaaagatagcaactcattggacatcattcatgctgagttccaggccag

SEQ ID NO: 63667 - DNA, 75 bp, Artificial Sequence
  Synthetic
aagaaacgaaccctccggctcaaccagccctcgcatgctgaccccaatcaacgaagaggcagacccactggacga

SEQ ID NO: 63668 - DNA, 75 bp, Artificial Sequence
  Synthetic
gggtgacaatcagtgcattaccgttttatcagtcttccccttagagactgacgcagacgagcaggaacagagcgc

SEQ ID NO: 63669 - DNA, 75 bp, Artificial Sequence
  Synthetic
tcaaaatccgaattccactattgaatcaccgctgtgggcactgagagtcatccttgcagcagggatacaggacca

SEQ ID NO: 63670 - DNA, 75 bp, Artificial Sequence
  Synthetic
tcaccgctgtgggcactgagagtcatccttgcagcagggatacaggaccagttaattgaccagtctttgattgaa

SEQ ID NO: 63671 - DNA, 75 bp, Artificial Sequence
  Synthetic
aatgaatcacaggaataaattcatggcaatcctgcaacatcatcagtgaatgagcatgtaataatgggatgattt

SEQ ID NO: 63672 - DNA, 75 bp, Artificial Sequence
  Synthetic
agagggtcaaaatccaacacctgttaataatttcctccatcagatcgtagaactgctggtgcatgattcatcaag

SEQ ID NO: 63673 - DNA, 75 bp, Artificial Sequence
  Synthetic
agacgatgaagaacaggacagggacggaacctctaaccgcacacccactgtcgccccaccggctcccgtatacag

SEQ ID NO: 63674 - DNA, 75 bp, Artificial Sequence
  Synthetic
aatgatcatgtacatcctcacgacaatcttgtttacacatgtaagagtacagccagcaatttcttccatgcgtca

SEQ ID NO: 63675 - DNA, 75 bp, Artificial Sequence
  Synthetic
acaaacaacagtgatggtcatattaagagaagtcaagaacaaaccaccagagatccacatgatggcactgaacgg

SEQ ID NO: 63676 - DNA, 75 bp, Artificial Sequence
  Synthetic
agagaagtcaagaacaaaccaccagagatccacatgatggcactgaacggagtctagtcctgcaaatgagccatg

SEQ ID NO: 63677 - DNA, 75 bp, Artificial Sequence
  Synthetic
caagaatggcaccattgtctgatgcaatttttgatgatcttcaagggaccctggctagtataggtactgcttttg

SEQ ID NO: 63678 - DNA, 75 bp, Artificial Sequence
  Synthetic
catccaagagggaaggtcatcaaataatctcacatcgtctagtcctacctttctttacattatctcaagggacac

SEQ ID NO: 63679 - DNA, 75 bp, Artificial Sequence
  Synthetic
tgtgcaacaacaaaccatcgcatcagaatcattagaacaacgcattacgagtcttgagaatggtctaaagccagt

SEQ ID NO: 63680 - DNA, 75 bp, Artificial Sequence
  Synthetic
gattgattgatgaaagatcataactaataacattacaaataatcctactataatcaatacggtgattcaaatgtt

SEQ ID NO: 63681 - DNA, 75 bp, Artificial Sequence
  Synthetic
tcacaagatccgtgaattccatagaacattgataaggctggagatgacgccacaacaactttgtgagctattttc

SEQ ID NO: 63682 - DNA, 75 bp, Artificial Sequence
  Synthetic
catcttgatctgatttcaataaataactatttagataacgaaaggagtccttacattatacactatattaggaca

SEQ ID NO: 63683 - DNA, 75 bp, Artificial Sequence
  Synthetic
catcttgatctgatttcaataaataactatttagataacgaaaggagtccttacattatacactatattaggact

SEQ ID NO: 63684 - DNA, 75 bp, Artificial Sequence
  Synthetic
catcttgatctgatttcaataaataactatttagataacgaaaggagtccttacattatacactatattaggacc

SEQ ID NO: 63685 - DNA, 75 bp, Artificial Sequence
  Synthetic
catcttgatctgatttcaataaataactatttagataacgaaaggagtccttacattatacactatattaggacg

SEQ ID NO: 63686 - DNA, 75 bp, Artificial Sequence
  Synthetic
catcttgatctgatttcaataaataactatttagataacgaaaggagtccttacattatacactatattaggtca

SEQ ID NO: 63687 - DNA, 75 bp, Artificial Sequence
  Synthetic
catcttgatctgatttcaataaataactatttagataacgaaaggagtccttacattatacactatattaggtct

SEQ ID NO: 63688 - DNA, 75 bp, Artificial Sequence
  Synthetic
catcttgatctgatttcaataaataactatttagataacgaaaggagtccttacattatacactatattaggtcc

SEQ ID NO: 63689 - DNA, 75 bp, Artificial Sequence
  Synthetic
catcttgatctgatttcaataaataactatttagataacgaaaggagtccttacattatacactatattaggtcg

SEQ ID NO: 63690 - DNA, 75 bp, Artificial Sequence
  Synthetic
catcttgatctgatttcaataaataactatttagataacgaaaggagtccttacattatacactatattaggcca

SEQ ID NO: 63691 - DNA, 75 bp, Artificial Sequence
  Synthetic
catcttgatctgatttcaataaataactatttagataacgaaaggagtccttacattatacactatattaggcct

SEQ ID NO: 63692 - DNA, 75 bp, Artificial Sequence
  Synthetic
catcttgatctgatttcaataaataactatttagataacgaaaggagtccttacattatacactatattaggccc

SEQ ID NO: 63693 - DNA, 75 bp, Artificial Sequence
  Synthetic
catcttgatctgatttcaataaataactatttagataacgaaaggagtccttacattatacactatattaggccg

SEQ ID NO: 63694 - DNA, 75 bp, Artificial Sequence
  Synthetic
catcttgatctgatttcaataaataactatttagataacgaaaggagtccttacattatacactatattagggca

SEQ ID NO: 63695 - DNA, 75 bp, Artificial Sequence
  Synthetic
catcttgatctgatttcaataaataactatttagataacgaaaggagtccttacattatacactatattagggct

SEQ ID NO: 63696 - DNA, 75 bp, Artificial Sequence
  Synthetic
catcttgatctgatttcaataaataactatttagataacgaaaggagtccttacattatacactatattagggcc

SEQ ID NO: 63697 - DNA, 75 bp, Artificial Sequence
  Synthetic
catcttgatctgatttcaataaataactatttagataacgaaaggagtccttacattatacactatattagggcg

SEQ ID NO: 63698 - DNA, 75 bp, Artificial Sequence
  Synthetic
catcttgatctgatttcaataaataactatttagataacgaaaggagtccttacattatacactatatttggaca

SEQ ID NO: 63699 - DNA, 75 bp, Artificial Sequence
  Synthetic
catcttgatctgatttcaataaataactatttagataacgaaaggagtccttacattatacactatatttggact

SEQ ID NO: 63700 - DNA, 75 bp, Artificial Sequence
  Synthetic
catcttgatctgatttcaataaataactatttagataacgaaaggagtccttacattatacactatatttggacc

SEQ ID NO: 63701 - DNA, 75 bp, Artificial Sequence
  Synthetic
catcttgatctgatttcaataaataactatttagataacgaaaggagtccttacattatacactatatttggacg

SEQ ID NO: 63702 - DNA, 75 bp, Artificial Sequence
  Synthetic
catcttgatctgatttcaataaataactatttagataacgaaaggagtccttacattatacactatatttggtca

SEQ ID NO: 63703 - DNA, 75 bp, Artificial Sequence
  Synthetic
catcttgatctgatttcaataaataactatttagataacgaaaggagtccttacattatacactatatttggtct

SEQ ID NO: 63704 - DNA, 75 bp, Artificial Sequence
  Synthetic
catcttgatctgatttcaataaataactatttagataacgaaaggagtccttacattatacactatatttggtcc

SEQ ID NO: 63705 - DNA, 75 bp, Artificial Sequence
  Synthetic
catcttgatctgatttcaataaataactatttagataacgaaaggagtccttacattatacactatatttggtcg

SEQ ID NO: 63706 - DNA, 75 bp, Artificial Sequence
  Synthetic
catcttgatctgatttcaataaataactatttagataacgaaaggagtccttacattatacactatatttggcca

SEQ ID NO: 63707 - DNA, 75 bp, Artificial Sequence
  Synthetic
catcttgatctgatttcaataaataactatttagataacgaaaggagtccttacattatacactatatttggcct

SEQ ID NO: 63708 - DNA, 75 bp, Artificial Sequence
  Synthetic
catcttgatctgatttcaataaataactatttagataacgaaaggagtccttacattatacactatatttggccc

SEQ ID NO: 63709 - DNA, 75 bp, Artificial Sequence
  Synthetic
catcttgatctgatttcaataaataactatttagataacgaaaggagtccttacattatacactatatttggccg

SEQ ID NO: 63710 - DNA, 75 bp, Artificial Sequence
  Synthetic
catcttgatctgatttcaataaataactatttagataacgaaaggagtccttacattatacactatatttgggca

SEQ ID NO: 63711 - DNA, 75 bp, Artificial Sequence
  Synthetic
catcttgatctgatttcaataaataactatttagataacgaaaggagtccttacattatacactatatttgggct

SEQ ID NO: 63712 - DNA, 75 bp, Artificial Sequence
  Synthetic
catcttgatctgatttcaataaataactatttagataacgaaaggagtccttacattatacactatatttgggcc

SEQ ID NO: 63713 - DNA, 75 bp, Artificial Sequence
  Synthetic
catcttgatctgatttcaataaataactatttagataacgaaaggagtccttacattatacactatatttgggcg

SEQ ID NO: 63714 - DNA, 75 bp, Artificial Sequence
  Synthetic
catcttgatctgatttcaataaataactatttagataacgaaaggagtccttacattatacactatattcggaca

SEQ ID NO: 63715 - DNA, 75 bp, Artificial Sequence
  Synthetic
catcttgatctgatttcaataaataactatttagataacgaaaggagtccttacattatacactatattcggact

SEQ ID NO: 63716 - DNA, 75 bp, Artificial Sequence
  Synthetic
catcttgatctgatttcaataaataactatttagataacgaaaggagtccttacattatacactatattcggacc

SEQ ID NO: 63717 - DNA, 75 bp, Artificial Sequence
  Synthetic
catcttgatctgatttcaataaataactatttagataacgaaaggagtccttacattatacactatattcggacg

SEQ ID NO: 63718 - DNA, 75 bp, Artificial Sequence
  Synthetic
catcttgatctgatttcaataaataactatttagataacgaaaggagtccttacattatacactatattcggtca

SEQ ID NO: 63719 - DNA, 75 bp, Artificial Sequence
  Synthetic
catcttgatctgatttcaataaataactatttagataacgaaaggagtccttacattatacactatattcggtct

SEQ ID NO: 63720 - DNA, 75 bp, Artificial Sequence
  Synthetic
catcttgatctgatttcaataaataactatttagataacgaaaggagtccttacattatacactatattcggtcc

SEQ ID NO: 63721 - DNA, 75 bp, Artificial Sequence
  Synthetic
catcttgatctgatttcaataaataactatttagataacgaaaggagtccttacattatacactatattcggtcg

SEQ ID NO: 63722 - DNA, 75 bp, Artificial Sequence
  Synthetic
catcttgatctgatttcaataaataactatttagataacgaaaggagtccttacattatacactatattcggcca

SEQ ID NO: 63723 - DNA, 75 bp, Artificial Sequence
  Synthetic
catcttgatctgatttcaataaataactatttagataacgaaaggagtccttacattatacactatattcggcct

SEQ ID NO: 63724 - DNA, 75 bp, Artificial Sequence
  Synthetic
catcttgatctgatttcaataaataactatttagataacgaaaggagtccttacattatacactatattcggccc

SEQ ID NO: 63725 - DNA, 75 bp, Artificial Sequence
  Synthetic
catcttgatctgatttcaataaataactatttagataacgaaaggagtccttacattatacactatattcggccg

SEQ ID NO: 63726 - DNA, 75 bp, Artificial Sequence
  Synthetic
catcttgatctgatttcaataaataactatttagataacgaaaggagtccttacattatacactatattcgggca

SEQ ID NO: 63727 - DNA, 75 bp, Artificial Sequence
  Synthetic
catcttgatctgatttcaataaataactatttagataacgaaaggagtccttacattatacactatattcgggct

SEQ ID NO: 63728 - DNA, 75 bp, Artificial Sequence
  Synthetic
catcttgatctgatttcaataaataactatttagataacgaaaggagtccttacattatacactatattcgggcc

SEQ ID NO: 63729 - DNA, 75 bp, Artificial Sequence
  Synthetic
catcttgatctgatttcaataaataactatttagataacgaaaggagtccttacattatacactatattcgggcg

SEQ ID NO: 63730 - DNA, 75 bp, Artificial Sequence
  Synthetic
catcttgatctgatttcaataaataactatttagataacgaaaggagtccttacattatacactatattgggaca

SEQ ID NO: 63731 - DNA, 75 bp, Artificial Sequence
  Synthetic
catcttgatctgatttcaataaataactatttagataacgaaaggagtccttacattatacactatattgggact

SEQ ID NO: 63732 - DNA, 75 bp, Artificial Sequence
  Synthetic
catcttgatctgatttcaataaataactatttagataacgaaaggagtccttacattatacactatattgggacc

SEQ ID NO: 63733 - DNA, 75 bp, Artificial Sequence
  Synthetic
catcttgatctgatttcaataaataactatttagataacgaaaggagtccttacattatacactatattgggacg

SEQ ID NO: 63734 - DNA, 75 bp, Artificial Sequence
  Synthetic
catcttgatctgatttcaataaataactatttagataacgaaaggagtccttacattatacactatattgggtca

SEQ ID NO: 63735 - DNA, 75 bp, Artificial Sequence
  Synthetic
catcttgatctgatttcaataaataactatttagataacgaaaggagtccttacattatacactatattgggtct

SEQ ID NO: 63736 - DNA, 75 bp, Artificial Sequence
  Synthetic
catcttgatctgatttcaataaataactatttagataacgaaaggagtccttacattatacactatattgggtcc

SEQ ID NO: 63737 - DNA, 75 bp, Artificial Sequence
  Synthetic
catcttgatctgatttcaataaataactatttagataacgaaaggagtccttacattatacactatattgggtcg

SEQ ID NO: 63738 - DNA, 75 bp, Artificial Sequence
  Synthetic
catcttgatctgatttcaataaataactatttagataacgaaaggagtccttacattatacactatattgggcca

SEQ ID NO: 63739 - DNA, 75 bp, Artificial Sequence
  Synthetic
catcttgatctgatttcaataaataactatttagataacgaaaggagtccttacattatacactatattgggcct

SEQ ID NO: 63740 - DNA, 75 bp, Artificial Sequence
  Synthetic
catcttgatctgatttcaataaataactatttagataacgaaaggagtccttacattatacactatattgggccc

SEQ ID NO: 63741 - DNA, 75 bp, Artificial Sequence
  Synthetic
catcttgatctgatttcaataaataactatttagataacgaaaggagtccttacattatacactatattgggccg

SEQ ID NO: 63742 - DNA, 75 bp, Artificial Sequence
  Synthetic
catcttgatctgatttcaataaataactatttagataacgaaaggagtccttacattatacactatattggggca

SEQ ID NO: 63743 - DNA, 75 bp, Artificial Sequence
  Synthetic
catcttgatctgatttcaataaataactatttagataacgaaaggagtccttacattatacactatattggggct

SEQ ID NO: 63744 - DNA, 75 bp, Artificial Sequence
  Synthetic
catcttgatctgatttcaataaataactatttagataacgaaaggagtccttacattatacactatattggggcc

SEQ ID NO: 63745 - DNA, 75 bp, Artificial Sequence
  Synthetic
catcttgatctgatttcaataaataactatttagataacgaaaggagtccttacattatacactatattggggcg

SEQ ID NO: 63746 - DNA, 75 bp, Artificial Sequence
  Synthetic
acaccccttgagagagccggtcaatgcaacggaggacccgtctagtggctactattctaccacaattagatatca

SEQ ID NO: 63747 - DNA, 75 bp, Artificial Sequence
  Synthetic
ctttggttgataacacgacttcttaaaacaaaactgatctttaagattaagttttttataattgtcattgcttta

SEQ ID NO: 63748 - DNA, 75 bp, Artificial Sequence
  Synthetic
ctttggttgataacacgacttcttaaaacaaaactgatctttaagattaagttttttataattgtcattgctttt

SEQ ID NO: 63749 - DNA, 75 bp, Artificial Sequence
  Synthetic
ctttggttgataacacgacttcttaaaacaaaactgatctttaagattaagttttttataattgtcattgctttc

SEQ ID NO: 63750 - DNA, 75 bp, Artificial Sequence
  Synthetic
ctttggttgataacacgacttcttaaaacaaaactgatctttaagattaagttttttataattgtcattgctttg

SEQ ID NO: 63751 - DNA, 75 bp, Artificial Sequence
  Synthetic
caaagtacaccgagaggaagggccgattcttaacacaaatgcatttagctgtaaatcacaccctggaagaaatta

SEQ ID NO: 63752 - DNA, 75 bp, Artificial Sequence
  Synthetic
cagaaatacgtgcactaaagccttcacaggctcacaagatccgtgaattccatagaacattgataaggctggaga

SEQ ID NO: 63753 - DNA, 75 bp, Artificial Sequence
  Synthetic
gtatgttacattaatgatacacttgtgagtatcagccctagataatataagtcaattaaacaaccaagataaaat

SEQ ID NO: 63754 - DNA, 75 bp, Artificial Sequence
  Synthetic
cctggccatcaagatgatgatccgactgactcacaggatacgaccattcccgatgtggtagttgatcccgatgat

SEQ ID NO: 63755 - DNA, 75 bp, Artificial Sequence
  Synthetic
tatcatattagagattgtaattgtgaagaacgtttcttagttcaaaccttatatttacatagaatgcaggattct

SEQ ID NO: 63756 - DNA, 75 bp, Artificial Sequence
  Synthetic
acaatttttagagcaagaaaacttttctattgagaatgttctttcctacgcgcaaaaactcgagtatctactacc

SEQ ID NO: 63757 - DNA, 75 bp, Artificial Sequence
  Synthetic
cttccagctgtggttgagaagtaattgcaataattgactcagatccagttttacagaatcttctcagggatagtg

SEQ ID NO: 63758 - DNA, 75 bp, Artificial Sequence
  Synthetic
ttccaccagtccaactaccccagtatttcacctttgatttgacagcactcaaactgatcactcaaccactgcctg

SEQ ID NO: 63759 - DNA, 75 bp, Artificial Sequence
  Synthetic
ctaatgcacaatcaagatggtttaatctgtgggttgagacagctggccaacgagacgactcaagctcttcaactg

SEQ ID NO: 63760 - DNA, 75 bp, Artificial Sequence
  Synthetic
cgagacgactcaagctcttcaactgttcctgagagccacaactgagctacgcaccttttcaatcctcaaccgtaa

SEQ ID NO: 63761 - DNA, 75 bp, Artificial Sequence
  Synthetic
tttaataaaggttttgaccttggacagttaacactcggcaaacctctggatttcggaacaatatcattggcacta

SEQ ID NO: 63762 - DNA, 75 bp, Artificial Sequence
  Synthetic
ttaaaaatggtgatagccttaatctttgtgtaaaataagagattaggtgtaataactttaacatttttgtctagt

SEQ ID NO: 63763 - DNA, 75 bp, Artificial Sequence
  Synthetic
aagctactattccattcagaatgataaaattaaaagaaaagacatgactgtaaaatcagaaataccttctttaca

SEQ ID NO: 63764 - DNA, 75 bp, Artificial Sequence
  Synthetic
tgcagttatcgctttattctgtatatgcaaatttgtcttttagtttttcttcagattgcttcatggaaaagctca

SEQ ID NO: 63765 - DNA, 75 bp, Artificial Sequence
  Synthetic
ataattaaggcattgaccacgctcatcagaaggctcactagaataaacgttgcaaaaaggatccctggaaaaatg

SEQ ID NO: 63766 - DNA, 75 bp, Artificial Sequence
  Synthetic
agattacttgacaaatgataatataatacactggagctttaaacatagccaatgtgattctaactcctttaaact

SEQ ID NO: 63767 - DNA, 75 bp, Artificial Sequence
  Synthetic
tttcagagccatatcaccaagatagagaacaacctaggtctccggagggggcaagggcatcagtgtgctcagttg

SEQ ID NO: 63768 - DNA, 75 bp, Artificial Sequence
  Synthetic
aagacgaaatggtttgtaagtggctcttatcatcaactcctgttatgagtcgtttcgcagccgatatattttcac

SEQ ID NO: 63769 - DNA, 75 bp, Artificial Sequence
  Synthetic
caataattgactcagatccagttttacagaatcttctcagggatagtgacaacatccttccaataatccgtctac

SEQ ID NO: 63770 - DNA, 75 bp, Artificial Sequence
  Synthetic
ggaaagaagcctttttattaagttgtaataatcagatctgcgaaccggtagagtttagttgcaacctaacacaca

SEQ ID NO: 63771 - DNA, 75 bp, Artificial Sequence
  Synthetic
gtctaacgcaacataataaactccgcactctttataattaagctttaacgataggtctgggctcatattgttatt

SEQ ID NO: 63772 - DNA, 75 bp, Artificial Sequence
  Synthetic
tagaagggatacttccaattgatcaatacactaaaggtgctttacaccactgtctcccctctctcccaaatgtag

SEQ ID NO: 63773 - DNA, 75 bp, Artificial Sequence
  Synthetic
gacaaattgctcggaatcacaaaattccgagtatggattctcgtcctcagaaagtctggatgacgccgagtctca

SEQ ID NO: 63774 - DNA, 75 bp, Artificial Sequence
  Synthetic
gatccagttacctcaggtttattccagttaaaaacttatctccgaatgattgagatggatgatttattcttacct

SEQ ID NO: 63775 - DNA, 75 bp, Artificial Sequence
  Synthetic
attttcaagagagtgcggacagtttccttctcatgctttgtcttcatcatgcgtaccaaggagattacaaacttt

SEQ ID NO: 63776 - DNA, 75 bp, Artificial Sequence
  Synthetic
cctaagtgcgaaaaacaaacttattaataccttatttcatgcatcagctgacttcgaagacgaaatggtttgtaa

SEQ ID NO: 63777 - DNA, 75 bp, Artificial Sequence
  Synthetic
tacaccaagggatgcacatggttgccggacatgatgccaacgatgctgtgatttcaaattcagtggctcaagctc

SEQ ID NO: 63778 - DNA, 75 bp, Artificial Sequence
  Synthetic
tttcttcagattgtttcacggcaaaacccaacctcaaatcaatgaaactaggattcaaccacatgaatcacttga

SEQ ID NO: 63779 - DNA, 75 bp, Artificial Sequence
  Synthetic
tcgaaattgtacgaagctgtacataaattgatcttacaccatgttgatcccagcgtattgaaagcagtggtcctt

SEQ ID NO: 63780 - DNA, 75 bp, Artificial Sequence
  Synthetic
tccggacaacagcacccataatacacccgtgtataaacttgacatctctgaggcaactcaagttggacaacatca

SEQ ID NO: 63781 - DNA, 75 bp, Artificial Sequence
  Synthetic
acttttgaacctttctggagtaaataatcttgagcatggtcttttccctcaactgtcggcaattgcactcggagt

SEQ ID NO: 63782 - DNA, 75 bp, Artificial Sequence
  Synthetic
gcctccgacactccccccgccacgaccgcagccggacccttaaaagcagagaacaccaacacgagtaagagcgct

SEQ ID NO: 63783 - DNA, 75 bp, Artificial Sequence
  Synthetic
gactccctggacctcgccaccacgacaagcccccaaaactacagcgagactgctggcaacaacaacactcatcac

SEQ ID NO: 63784 - DNA, 75 bp, Artificial Sequence
  Synthetic
gaccaagataaaattgttcatatctcgctagcagcttaaaatataaatgtaataggagctatatctctgacagta

SEQ ID NO: 63785 - DNA, 75 bp, Artificial Sequence
  Synthetic
ccaaaacaagtggacattacgatgatgatgacgacattccctttccaggacccatcaatgatgacgacaatcctg

SEQ ID NO: 63786 - DNA, 75 bp, Artificial Sequence
  Synthetic
ccaacacgagtaagagcgctgactccctggacctcgccaccacgacaagcccccaaaactacagcgagactgctg

SEQ ID NO: 63787 - DNA, 75 bp, Artificial Sequence
  Synthetic
gactagataataatcttcgtgttaatgataattaaggcattgaccacgctcatcagaaggctcactagaataaac

SEQ ID NO: 63788 - DNA, 75 bp, Artificial Sequence
  Synthetic
ccaaccactgcctgctgcaacatggaccgatgacactccaacaggatcaaatggagcgttgcgtccaggaatttc

SEQ ID NO: 63789 - DNA, 75 bp, Artificial Sequence
  Synthetic
aagaacaggacagggacggaacttctaaccgcacacccactgtcgccccaccggctcccgtatacagagatcact

SEQ ID NO: 63790 - DNA, 75 bp, Artificial Sequence
  Synthetic
ccgaaaagaaagaactcccgcaagatgaacaacaagatcaggaccacattcaagaggccaggaaccaagacagtg

SEQ ID NO: 63791 - DNA, 75 bp, Artificial Sequence
  Synthetic
ccaaaactaaatttcgatagatcgagacacaatgtgaaatctcaggatcataactcagcatccaagagggaaggt

SEQ ID NO: 63792 - DNA, 75 bp, Artificial Sequence
  Synthetic
tttggttgataacacgacttcttaaaacaaaactgatctttaagattaagttttttataattgtcattgctttaa

SEQ ID NO: 63793 - DNA, 75 bp, Artificial Sequence
  Synthetic
aacaaaactgatctttaagattaagttttttataattgtcattgctttaatttgtcgatttaaaaatggtgatag

SEQ ID NO: 63794 - DNA, 75 bp, Artificial Sequence
  Synthetic
cctggtttgtttcagagccatatcaccaagatagagaacaacctaggtctccggagggggcaagggcatcagtgt

SEQ ID NO: 63795 - DNA, 75 bp, Artificial Sequence
  Synthetic
gtctttaatgaaaaaggaaaaaagcctttttattaagttgtaataatcagatctgcaaaccggtagaatttagtt

SEQ ID NO: 63796 - DNA, 75 bp, Artificial Sequence
  Synthetic
cagaatgataaaattaaaagaaaagacatgactgtaaaatcagaaataccttctttacaatatagcagactagat

SEQ ID NO: 63797 - DNA, 75 bp, Artificial Sequence
  Synthetic
ctgaacccgcaggtcacatgtgttaggtttcacagattctatatattactaactctatactcgtaattaacatta

SEQ ID NO: 63798 - DNA, 75 bp, Artificial Sequence
  Synthetic
agacagacacaatccaggccaactcaaaatgtcccaggccctcacagaacaatccaccacgccagtgctccactc

SEQ ID NO: 63799 - DNA, 75 bp, Artificial Sequence
  Synthetic
tgagagtcatccttgcagcagggatacaggaccagctgattgaccagtctttgattgaacccttagcaggagccc

SEQ ID NO: 63800 - DNA, 75 bp, Artificial Sequence
  Synthetic
gcccaacatttacacgatcgttttataattaagaaaaaactaatgatgaagattaaaaccttcatcatccttacg

SEQ ID NO: 63801 - DNA, 75 bp, Artificial Sequence
  Synthetic
taattaagaaaaaactaatgatgaagattaaaaccttcatcatccttacgtcaattgaattctctagcactagaa

SEQ ID NO: 63802 - DNA, 75 bp, Artificial Sequence
  Synthetic
gattaaaaccttcatcatccttacgtcaattgaattctctagcactagaagcttattgtcttcaatgtaaaagaa

SEQ ID NO: 63803 - DNA, 75 bp, Artificial Sequence
  Synthetic
ctaacacacacaaagcattggtaaaaaagtcaatagaaatttaaacagtgagtgcagacaactcttaaatggaag

SEQ ID NO: 63804 - DNA, 75 bp, Artificial Sequence
  Synthetic
gtctagtcctacctttctttacattatctcaagggacacgccaattaacgtcatccaatgagtcacaaacccaag

SEQ ID NO: 63805 - DNA, 75 bp, Artificial Sequence
  Synthetic
cagctgagtcttttgtgtgagacacacctaaggcgcgaagggcttgggcaagatcaggcagaacccgttctcgaa

SEQ ID NO: 63806 - DNA, 75 bp, Artificial Sequence
  Synthetic
cgaagccaaacccgaagatgcgcaacagtcaaacccaaacggacccaatttgcaatcatagttttgaggaggtag

SEQ ID NO: 63807 - DNA, 75 bp, Artificial Sequence
  Synthetic
attgggtctttccgtgttttagatgaagcagttgacattcttcctcttgatattaaatggctacacaacataccc

SEQ ID NO: 63808 - DNA, 75 bp, Artificial Sequence
  Synthetic
catcaagatgatgatccaactgactcacaagatacgaccattcctgatgtggtggttgatcccgatgatggaagc

SEQ ID NO: 63809 - DNA, 75 bp, Artificial Sequence
  Synthetic
agtttatgatatggcaaaaacaatctcctcattgaacagggtttgtgctgagatggttgcaaaatatgatcttct

SEQ ID NO: 63810 - DNA, 75 bp, Artificial Sequence
  Synthetic
tacggcgaataccagagttactcggaaaacggcatgaatgcaccagatgacttggtcctattcgatctagacgag

SEQ ID NO: 63811 - DNA, 75 bp, Artificial Sequence
  Synthetic
gatcccagcgtattgaaagcagtggtccttaaagtctttctaagtgataccgagggtatgttatggctaaatgat

SEQ ID NO: 63812 - DNA, 75 bp, Artificial Sequence
  Synthetic
atcgctcgcaatataacctgccaagcatacctcttgcacaaagtgattcttgtacacaaataatgtttgactcta

SEQ ID NO: 63813 - DNA, 75 bp, Artificial Sequence
  Synthetic
cgacgacgagacgtctagccttccgcccttagagtcagatgatgaagaacaggacagggacggaacttctaaccg

SEQ ID NO: 63814 - DNA, 75 bp, Artificial Sequence
  Synthetic
agaggccaggaaccaggacagtgacaacacccagccagaacactcttttgaggagatgtatcgccacattctaag

SEQ ID NO: 63815 - DNA, 75 bp, Artificial Sequence
  Synthetic
cccgtatacagagatcactccgaaaagaaagaactcccgcaagatgaacaacaagatcaggaccacattcaagag

SEQ ID NO: 63816 - DNA, 75 bp, Artificial Sequence
  Synthetic
gcagaggcttcaactgctgaactatagggtatgttacattaatgatacacttgtgagtatcagccctagataata

SEQ ID NO: 63817 - DNA, 75 bp, Artificial Sequence
  Synthetic
agggtatgttacattaatgatacacttgtgagtatcagccctagataatataagtcaattaaacaaccaagataa

SEQ ID NO: 63818 - DNA, 75 bp, Artificial Sequence
  Synthetic
cttaatctttgtgtaaaataagagattaggtgtaataactttaacatttttgtctagtaagctactattccattc

SEQ ID NO: 63819 - DNA, 75 bp, Artificial Sequence
  Synthetic
ccaggtcaactccattggctgaaaagaagcccacctacaacgaacattactttgagcgccctcacaattaaaaaa

SEQ ID NO: 63820 - DNA, 75 bp, Artificial Sequence
  Synthetic
catgactgtaaaatcagaaataccttctttacaatatagcagactagataataatcttcgtgttaatgataatta

SEQ ID NO: 63821 - DNA, 75 bp, Artificial Sequence
  Synthetic
cgacaaatagctaacattaaatagtcaaggaacgcaaacaggaagaatttttgatgtctaaggtgtgaattatta

SEQ ID NO: 63822 - DNA, 75 bp, Artificial Sequence
  Synthetic
gtgagcaaaaagaaagcttattgcatcaagcatcatggcaccacacaagtgatgattttggtgaacatgccacag

SEQ ID NO: 63823 - DNA, 75 bp, Artificial Sequence
  Synthetic
cggaacttctaaccgcacacccactgtcgccccaccggctcccgtatacagagatcactccgaaaagaaagaact

SEQ ID NO: 63824 - DNA, 75 bp, Artificial Sequence
  Synthetic
agagagtgtttttccattaaccttcatcttgtaaacgttgagcaaaattgttaaaaatatgaggcgggttatatt

SEQ ID NO: 63825 - DNA, 75 bp, Artificial Sequence
  Synthetic
gtcgccccaccggctcccgtatacagagatcactccgaaaagaaagaactcccgcaagatgaacaacaagatcag

SEQ ID NO: 63826 - DNA, 75 bp, Artificial Sequence
  Synthetic
agtgctttggttgataacacgacttcttaaaacaaaactgatctttaagattaagttttttataattgtcattgc

SEQ ID NO: 63827 - DNA, 75 bp, Artificial Sequence
  Synthetic
tactatcacccatttcggcaaggcaaccaatccgcttgtcagagtcaatcggctgggtcctggaatcccggatca

SEQ ID NO: 63828 - DNA, 75 bp, Artificial Sequence
  Synthetic
ctttacaccattgtctttttcctctcctaaatgtagaacttaacaaaagactcataatatacttgtttttaaaag

SEQ ID NO: 63829 - DNA, 75 bp, Artificial Sequence
  Synthetic
aagagattaggtgtaataactttaacatttttgtctagtaagctactattccattcagaatgataaaattaaaag

SEQ ID NO: 63830 - DNA, 75 bp, Artificial Sequence
  Synthetic
gtatttcacctttgatttgacagcactcaaactgatcactcaaccactgcctgctgcaacatggaccgatgacac

SEQ ID NO: 63831 - DNA, 75 bp, Artificial Sequence
  Synthetic
ctgctgcaacatggaccgatgacactccaactggatcaaatggagcgttgcgtccaggaatttcatttcatccaa

SEQ ID NO: 63832 - DNA, 75 bp, Artificial Sequence
  Synthetic
aaagatcatgactaataacattacaaacaatcctactataatcaatacggtgattcaaatgtcaatctttctcat

SEQ ID NO: 63833 - DNA, 75 bp, Artificial Sequence
  Synthetic
cattatagaagatgaccttattcgactgcctcacttatctggatgggagctagctaagaccatcatgcaatcaat

SEQ ID NO: 63834 - DNA, 75 bp, Artificial Sequence
  Synthetic
caagatggtaaaacacttggactcaaaatttgagccaatctcttttccctccgaaagaggcaactaatagcagag

SEQ ID NO: 63835 - DNA, 75 bp, Artificial Sequence
  Synthetic
taaacgttgcaaaaaggatccctggaaaaatggtcgcacacaaaaatttaaaaataaatctatttcttctttttt

SEQ ID NO: 63836 - DNA, 75 bp, Artificial Sequence
  Synthetic
taggggtcatcaggtccttttcaattggataaccaaaataagcttcactagaaggatattgtgaggcgacaacac

SEQ ID NO: 63837 - DNA, 75 bp, Artificial Sequence
  Synthetic
gctcagttgaaaatcccttgtcaacatctaggtcttatcacatcacaagttccacctcagactctgcagggtgat

SEQ ID NO: 63838 - DNA, 75 bp, Artificial Sequence
  Synthetic
caatcgtatgagtaattcagcaacgcgattgattgtttctacaaacactttaggtgagttttcaggaggtggcca

SEQ ID NO: 63839 - DNA, 75 bp, Artificial Sequence
  Synthetic
gaacaacctaggtctccggagggggcaagggcatcagtgtgctcagttgaaaatcccttgtcaacatctaggcct

SEQ ID NO: 63840 - DNA, 75 bp, Artificial Sequence
  Synthetic
aaaagatggggcttcaggtccggtgtcccaccaaaggtggtcaattatgaagctggtgaatgggctgaaaactgc

SEQ ID NO: 63841 - DNA, 75 bp, Artificial Sequence
  Synthetic
cattaccgttttatcagtcttccccttagagactgatgcagacgagcaggaacagagcgccgaggacaatgcagc

SEQ ID NO: 63842 - DNA, 75 bp, Artificial Sequence
  Synthetic
gcaacaccacgggaaaactaatttggaaggtcaaccccgaaattgatacaacaatcggggagtgggccttctggg

SEQ ID NO: 63843 - DNA, 75 bp, Artificial Sequence
  Synthetic
catctatttagtaatccgtccattagaggagatacttttaattgatcaatatactaaaggtgctttacaccattg

SEQ ID NO: 63844 - DNA, 75 bp, Artificial Sequence
  Synthetic
gacagtgagcgtaatcttcatctctcttagattatttgtcctccagagtagggatcgtcaggtccttttcaatcg

SEQ ID NO: 63845 - DNA, 75 bp, Artificial Sequence
  Synthetic
atactattgctggagtagcaggactgatcacaggcgggagaaggactcgaagagaagtaattgtcaatgctcaac

SEQ ID NO: 63846 - DNA, 75 bp, Artificial Sequence
  Synthetic
ctggactactcaggatgaaggtgctgcaatcggattggcctggataccatatttcgggccagcagccgaaggaat

SEQ ID NO: 63847 - DNA, 75 bp, Artificial Sequence
  Synthetic
cctcaaataagagattccaagacaacatcatagaattgctttatcatatgaataagcattttatcaccagaaatc

SEQ ID NO: 63848 - DNA, 75 bp, Artificial Sequence
  Synthetic
aattgatcaatatactaaaggtgctttacaccattgtctcttttctctcctaaatgtagagcttaacaaaagact

SEQ ID NO: 63849 - DNA, 75 bp, Artificial Sequence
  Synthetic
taaatgataatttagccccgttttttgccactggttatttaattaagccaataacgtcaagtgctagatctagtg

SEQ ID NO: 63850 - DNA, 75 bp, Artificial Sequence
  Synthetic
cccttccggaccagggggacaatgacaattggtggacaggatggagacaatggataccggcaggtattggagtta

SEQ ID NO: 63851 - DNA, 75 bp, Artificial Sequence
  Synthetic
attattcatgattttgttgataaaacccttccggaccagggggacaatgacaattggtggacaggatggagacaa

SEQ ID NO: 63852 - DNA, 75 bp, Artificial Sequence
  Synthetic
ccgccttggttttccatcattagagaaagtactataccacaggtataacctcgtcgattcaaaaagaggtccact

SEQ ID NO: 63853 - DNA, 75 bp, Artificial Sequence
  Synthetic
gtgagtgtctaccagcagcgccagacgggattcggggcttcccccggtgccggtatgtgcacaaagtatcaggaa

SEQ ID NO: 63854 - DNA, 75 bp, Artificial Sequence
  Synthetic
actcctttaaactcacagttaatcataaacaaggtttgacatcaatctagctatatctttaagaatgataaactt

SEQ ID NO: 63855 - DNA, 75 bp, Artificial Sequence
  Synthetic
caattaacgtcatccaatgagtcacaaacccaagacgagatatcaaagtacttacggcaattgagatccgtcatt

SEQ ID NO: 63856 - DNA, 75 bp, Artificial Sequence
  Synthetic
aaccgcacacccactgtcgccccaccggctcccgtatacagagatcactccgaaaagaaagaactcccgcaagat

SEQ ID NO: 63857 - DNA, 75 bp, Artificial Sequence
  Synthetic
cggctcccgtatacagagatcactccgaaaagaaagaactcccgcaagatgaacaacaagatcaggaccacattc

SEQ ID NO: 63858 - DNA, 75 bp, Artificial Sequence
  Synthetic
ccagaacattcttttgaggagatgtatcgccacattctaagatcacaggggccatttgatgccgttttgtattat

SEQ ID NO: 63859 - DNA, 75 bp, Artificial Sequence
  Synthetic
ctcctggaccccgccaccacaacaagtccccaaaaccacagcgagaccgctggcaacaacaacactcatcaccaa

SEQ ID NO: 63860 - DNA, 75 bp, Artificial Sequence
  Synthetic
aaaattcacaatgcagcatgtgtgacatattactgccgcaatgaatttaacgcaacataataaactctgcactct

SEQ ID NO: 63861 - DNA, 75 bp, Artificial Sequence
  Synthetic
ttataattaagctttaacgaaaggtctgggctcatattgttattgatataataatgttgtatcaatatcctgtca

SEQ ID NO: 63862 - DNA, 75 bp, Artificial Sequence
  Synthetic
tttagtttttcttcagattgcttcatggcaaagctcagcctcaaatcaatgaaaccaggatttaattatatggat

SEQ ID NO: 63863 - DNA, 75 bp, Artificial Sequence
  Synthetic
ctactatttcatacagaatgataaaattaaaagaaaaggcaggactgtaaaatcagaaataccttctttacaata

SEQ ID NO: 63864 - DNA, 75 bp, Artificial Sequence
  Synthetic
attaaaagaaaaggcaggactgtaaaatcagaaataccttctttacaatatagcagactagataataatcttcgt

SEQ ID NO: 63865 - DNA, 75 bp, Artificial Sequence
  Synthetic
aagctaggcttaattaccaatactattgctggagtagcaggactgatcacaggcgggagaaggactcgaagagaa

SEQ ID NO: 63866 - DNA, 75 bp, Artificial Sequence
  Synthetic
attctaggatacttggaaggaacacgcacattattagcctctaagatcatcaacaataatacagagacgccggtt

SEQ ID NO: 63867 - DNA, 75 bp, Artificial Sequence
  Synthetic
gcaaccccaatttacattactggactactcaggatgaaggtgctgcaatcggattggcctggataccatatttcg

SEQ ID NO: 63868 - DNA, 75 bp, Artificial Sequence
  Synthetic
acctaacacacataaagcattgatcaaaaagtcaatagaaatttaaacagtgagtggagacaacttttaaatgga

SEQ ID NO: 63869 - DNA, 75 bp, Artificial Sequence
  Synthetic
cgactaatagcagaggcttcaactgctgaactatagggtacgttacattaatgatacacttgtgagtatcagccc

SEQ ID NO: 63870 - DNA, 75 bp, Artificial Sequence
  Synthetic
agtccctatattatatactatatttagcctctctccctgcgtgataatcaaaaaattcacaatgcagcatgtgtg

SEQ ID NO: 63871 - DNA, 75 bp, Artificial Sequence
  Synthetic
taatacacccgtgtataaacttgacatctctgaggcaactcaagttggacaacatcaccgtagagcagacaacga

SEQ ID NO: 63872 - DNA, 75 bp, Artificial Sequence
  Synthetic
aaaaaataagtattttatgatttactaatgatctcttaaaatattaagaaaaactgacggaacataaattctttc

SEQ ID NO: 63873 - DNA, 75 bp, Artificial Sequence
  Synthetic
cattgttgactctatgtgctgtgatgacgaggaaattctcaaaatcccagctgagtcttttatgtgagacacacc

SEQ ID NO: 63874 - DNA, 75 bp, Artificial Sequence
  Synthetic
taccacaagatcttgacagcaggtctgtccgttcaacaggggattgttcggcaaagagtcatcccagtgtatcaa

SEQ ID NO: 63875 - DNA, 75 bp, Artificial Sequence
  Synthetic
taggatttaattatatgaatcacttgaatctaagattacttgacaaatgataacataatacactggagcttcaaa

SEQ ID NO: 63876 - DNA, 75 bp, Artificial Sequence
  Synthetic
aaatcagaaataccttctttacaatatagcagactagataataatcttcgtgttaatgataattaagacattgac

SEQ ID NO: 63877 - DNA, 75 bp, Artificial Sequence
  Synthetic
gaagattaatgcggaggtctgatgagaataaaccttattattcagattaggccccaagaggcattcttcatctcc

SEQ ID NO: 63878 - DNA, 75 bp, Artificial Sequence
  Synthetic
ggagcgttgcgcccaggaatttcatttcatccaaaacttcgccccattcttttacccaacaagagtgggaagaag

SEQ ID NO: 63879 - DNA, 75 bp, Artificial Sequence
  Synthetic
ttgtattaggggcaataatatctaattgaacttagccatttaaaatttagtgcataaatctgggctaactccacc

SEQ ID NO: 63880 - DNA, 75 bp, Artificial Sequence
  Synthetic
aaaaattcacaatacagcatgtgtgacatattactgctgcaatgagtctaacgcaacataataaactccgcactc

SEQ ID NO: 63881 - DNA, 75 bp, Artificial Sequence
  Synthetic
aataaaccttattattcagattaggccccaagaggcattcttcatctccttttagcaaagtactatttcagggta

SEQ ID NO: 63882 - DNA, 75 bp, Artificial Sequence
  Synthetic
ccccaagaggcattcttcatctccttttagcaaagtactatttcagggtagtccaattagtgacacgtctcttag

SEQ ID NO: 63883 - DNA, 75 bp, Artificial Sequence
  Synthetic
gcctacctacaacgaacatcactttgagcgccctcacatttaaaaaataggaacgtcgttccaacaatcgagcgc

SEQ ID NO: 63884 - DNA, 75 bp, Artificial Sequence
  Synthetic
gctactattccattcagaatgataaaattaaaagaaaagacatgactgtaaaatcagaaataccttctttacaat

SEQ ID NO: 63885 - DNA, 75 bp, Artificial Sequence
  Synthetic
ccttatcctcaaattgcctacatgcttacatctgaggatagccagtgtgacttggattggagatgtggagaaaaa

SEQ ID NO: 63886 - DNA, 75 bp, Artificial Sequence
  Synthetic
atttaaacagtgagtgcagacaactcttaaatggaagcttcatatgagagaggacgcccccgagctgccagacag

SEQ ID NO: 63887 - DNA, 75 bp, Artificial Sequence
  Synthetic
ccaatccgcttgtcagagtcaatcggctgggtcctggaatcccggatcaccccctcaggctcctgcgaattggaa

SEQ ID NO: 63888 - DNA, 75 bp, Artificial Sequence
  Synthetic
tcggcaatgaaccgcaagaagcctgggccggcgaaattttccctccttcatgagtccacactgaaggcatttaca

SEQ ID NO: 63889 - DNA, 75 bp, Artificial Sequence
  Synthetic
gtccctatattatacactatatttagcctctctccctgcgtgataatcaaaaaattcacaatgcagcatgtgtga

SEQ ID NO: 63890 - DNA, 75 bp, Artificial Sequence
  Synthetic
acttcgccccattcttttacccaacaaaagtgggaagaaggggaacagtgccgatctaacatctccggagaaaat

SEQ ID NO: 63891 - DNA, 75 bp, Artificial Sequence
  Synthetic
tttaatcaagacgatatcctttaaaacttattcagtactataatcactctcatttcaaattgataagatatgcat

SEQ ID NO: 63892 - DNA, 75 bp, Artificial Sequence
  Synthetic
caaccaaaaatatcatgggtatcgaagtgccagaaactctggtccacaagctgaccggtaagaaggtgacttcca

SEQ ID NO: 63893 - DNA, 75 bp, Artificial Sequence
  Synthetic
cttgctatctaactaagatggaatacttcatattgagctaactcatatatgctgactcaatagttatcttgacat

SEQ ID NO: 63894 - DNA, 75 bp, Artificial Sequence
  Synthetic
ttgagaagtaattgcaataattgactcagatccagttttacagaatcttctcagggatagtgataacatcttttt

SEQ ID NO: 63895 - DNA, 75 bp, Artificial Sequence
  Synthetic
gaccccaatcaacgaagaggcagacccactggacgatgccgacgacgagacgtctagccttccgcccttagagtc

SEQ ID NO: 63896 - DNA, 75 bp, Artificial Sequence
  Synthetic
tatatatattactaactccatactcgtaactaacattagataagtaggttaagaaaaaagcttgaggaagattaa

SEQ ID NO: 63897 - DNA, 75 bp, Artificial Sequence
  Synthetic
ccactggacgatgccgacgacgagacgtctagccttccgcccttagagtcagatgatgaagaacaggacagggac

SEQ ID NO: 63898 - DNA, 75 bp, Artificial Sequence
  Synthetic
attccaagacaacatcatagaattgctttatcatatgaataagcattttatcaccagaaatcttatatactaaat

SEQ ID NO: 63899 - DNA, 75 bp, Artificial Sequence
  Synthetic
gaaaaactgcttattgggtctttccgtgttttagatgaagcagttgacattcttcctcttgatattaaatggcta

SEQ ID NO: 63900 - DNA, 75 bp, Artificial Sequence
  Synthetic
gctcttctaattaagaaaaaatcggcgatgaagattaagccgacagtgagcgtaatcttcatctctcttagatta

SEQ ID NO: 63901 - DNA, 75 bp, Artificial Sequence
  Synthetic
cttatcttcaattcagggcaatgaatttttacatcaaatgtttttctggtatgacctggctattttaactcgaag

SEQ ID NO: 63902 - DNA, 75 bp, Artificial Sequence
  Synthetic
aattcttctcaaggcactgtcaggcaatgggttctgtcctgttgagccgcggtgccaacagttcttagatgaaat

SEQ ID NO: 63903 - DNA, 75 bp, Artificial Sequence
  Synthetic
ctagcttattattactagccgtttttcaaagttcaatttgagtcttaatgcaaataagcgttaagccacagttat

SEQ ID NO: 63904 - DNA, 75 bp, Artificial Sequence
  Synthetic
agccagcgatttatctaaattaaattacattatgcttttataacttacctactagcctgcccaacatttacacga

SEQ ID NO: 63905 - DNA, 75 bp, Artificial Sequence
  Synthetic
cttgataatgtgcaaagatttaattacatgtcgattcaacacaactctaatctcaaaaatagcagaggttgagga

SEQ ID NO: 63906 - DNA, 75 bp, Artificial Sequence
  Synthetic
tatcggaatttaaattgaaattgttactgtaatcacacctgttttgtttcagagccacatcacaaagatagagaa

SEQ ID NO: 63907 - DNA, 75 bp, Artificial Sequence
  Synthetic
gtacaccgagaggaagggccgattcttaacacaaatgcatttagctgtaaatcacaccctggaagaaattacaga

SEQ ID NO: 63908 - DNA, 75 bp, Artificial Sequence
  Synthetic
ggacaacagaaaaacagtcaaaagggccagcatacagagggcagacagacacaatccacgccaactcaaaacgtc

SEQ ID NO: 63909 - DNA, 75 bp, Artificial Sequence
  Synthetic
attaaggcattgaccacgctcatcagaaggctcactagaataaacgttgcaaaaaggatccctggaaaaatggtc

SEQ ID NO: 63910 - DNA, 75 bp, Artificial Sequence
  Synthetic
gaaggctcactagaataaacgttgcaaaaaggatccctggaaaaatggtcgcacacaaaaatttaaaaataaatc

SEQ ID NO: 63911 - DNA, 75 bp, Artificial Sequence
  Synthetic
tactgcagtagaaaggacatgctgggatgcagtattcgagcctaatgttctgggatataatccacctcacaaatt

SEQ ID NO: 63912 - DNA, 75 bp, Artificial Sequence
  Synthetic
cttaaaagcagagaacaccaacacgagtaagagcgctgactccctggacctcgccaccacgacaagcccccaaaa

SEQ ID NO: 63913 - DNA, 75 bp, Artificial Sequence
  Synthetic
cccgacaaatcggcaatgaaccgcaagaagcctgggccggcgaaattttccctccttcatgagtccacactgaaa

SEQ ID NO: 63914 - DNA, 75 bp, Artificial Sequence
  Synthetic
ttaatctttgtgtaaaataagagattaggtgtaataactttaacatttttgtctagtaagctactattccattca

SEQ ID NO: 63915 - DNA, 75 bp, Artificial Sequence
  Synthetic
gttcaatttgagtcttaatgcaaataagcgttaagccacagttatagccataatggtaactcaatatcttagcca

SEQ ID NO: 63916 - DNA, 75 bp, Artificial Sequence
  Synthetic
ggccttctgggaaactaaaaaaacctcactagaaaaattcgcagtgaagagttgtctttcacagctgtatcaaac

SEQ ID NO: 63917 - DNA, 75 bp, Artificial Sequence
  Synthetic
atagggtacggtgtagaggcaaccaccctatttccacctatccaaaatggagaaagttcatgttgacttagacgc

SEQ ID NO: 63918 - DNA, 75 bp, Artificial Sequence
  Synthetic
agaaagttcatgttgacttagacgcagacagcccattcgtcaagtcactgcaaagatgctttccacattttgaga

SEQ ID NO: 63919 - DNA, 75 bp, Artificial Sequence
  Synthetic
agacagcccattcgtcaagtcactgcaaagatgctttccacattttgagatagaagcaacgcaggtcactgacaa

SEQ ID NO: 63920 - DNA, 75 bp, Artificial Sequence
  Synthetic
gtttcgctatggagcatacccagcgctactgggttcgatgtgcgtacttcttcatcgttgagtctagagcagcct

SEQ ID NO: 63921 - DNA, 75 bp, Artificial Sequence
  Synthetic
agggagaagtggatacagaccaggtgatcctggatatcgggagcgcgcctgtaaggcacacgcattccaaacata

SEQ ID NO: 63922 - DNA, 75 bp, Artificial Sequence
  Synthetic
gagcgcagaagaccctgacagactctaccgctacgcagacaagcttagaaagagtgatgtcactgacaaatgtat

SEQ ID NO: 63923 - DNA, 75 bp, Artificial Sequence
  Synthetic
tgcctctaaggccgcggacctgctaacagtaatgtcgacgcctgacgctgagacaccctcgttatgcatgcacac

SEQ ID NO: 63924 - DNA, 75 bp, Artificial Sequence
  Synthetic
tgaactacgtgtcactaatcatcacagcgttgaccacattagcatcttcagttagcaactttaaacacataagag

SEQ ID NO: 63925 - DNA, 75 bp, Artificial Sequence
  Synthetic
tgactcaacttgcaggtaccacggctccgtggccgtatatcaggatgtatatgcagtgcatgcaccgacttccat

SEQ ID NO: 63926 - DNA, 75 bp, Artificial Sequence
  Synthetic
tccgtggccgtatatcaggatgtatatgcagtgcatgcaccgacttccatttactaccaggcgctgaaaggtgta

SEQ ID NO: 63927 - DNA, 75 bp, Artificial Sequence
  Synthetic
ttactaccaggcgctgaaaggtgtacgaactatctattggatcgggttcgatactacaccgttcatgtataagaa

SEQ ID NO: 63928 - DNA, 75 bp, Artificial Sequence
  Synthetic
atactacaccgttcatgtataagaacatggcaggcgcctaccctacatacaacactaattgggccgatgaaagtg

SEQ ID NO: 63929 - DNA, 75 bp, Artificial Sequence
  Synthetic
tgttggaagccagaaatatagggctgggtagttcagacttgcacgaaaagagtttcggaaaagtatccattatga

SEQ ID NO: 63930 - DNA, 75 bp, Artificial Sequence
  Synthetic
agtgcattgccacgctggcaccggagcctctagttgagcacaaacaccgtaccctgattttacacctgcacccgg

SEQ ID NO: 63931 - DNA, 75 bp, Artificial Sequence
  Synthetic
ggaagaagaaattacaacccaccaataaagtaatattttctgtggggtcaactatttatactgaagagagaatac

SEQ ID NO: 63932 - DNA, 75 bp, Artificial Sequence
  Synthetic
attacactacaggtaatataccacctcttataaacactacaggcagcgcataatgctgtcttttatatcaatcta

SEQ ID NO: 63933 - DNA, 75 bp, Artificial Sequence
  Synthetic
aatcagataccctccagtacaccagtgacaagcctcctggcttttataactggcatcatggagctgtacagtatg

SEQ ID NO: 63934 - DNA, 75 bp, Artificial Sequence
  Synthetic
tcgtcagctgcgaaggttacgttgtcaagaagattacgctcagtcctgggatttacgggaaagtggataatcttg

SEQ ID NO: 63935 - DNA, 75 bp, Artificial Sequence
  Synthetic
ccgtgtgtacgtacgtgccagcgacactgtgcgaccagatgaccgggatactggcgactgacgtcagtgtcgatg

SEQ ID NO: 63936 - DNA, 75 bp, Artificial Sequence
  Synthetic
actgtgcgaccagatgaccgggatactggcgactgacgtcagtgtcgatgacgcccagaagctgctggttgggct

SEQ ID NO: 63937 - DNA, 75 bp, Artificial Sequence
  Synthetic
acgcccagaagctgctggttgggctcaaccagcgaattgtcgtcaatggcagaacacaacgtaacacaaatacca

SEQ ID NO: 63938 - DNA, 75 bp, Artificial Sequence
  Synthetic
atagggtatggtgtagaggcagccacccgacctatcctatccaaaatggagaaagtacacgtggacttagacgct

SEQ ID NO: 63939 - DNA, 75 bp, Artificial Sequence
  Synthetic
agatccgaaacaatgcggcttctttaatatgatgtgtctaaaagtacattttaatcacgagatatgcacagaagt

SEQ ID NO: 63940 - DNA, 75 bp, Artificial Sequence
  Synthetic
tgcagaattatctattaccagtggtcgcccaggcgttctcgcggtgggcgcgggaacaccgcgcagacctggagg

SEQ ID NO: 63941 - DNA, 75 bp, Artificial Sequence
  Synthetic
tttcacccagtataagctggcacgcccgtatattgctgattgccctaactgtgggcatagtcggtgcgacagccc

SEQ ID NO: 63942 - DNA, 75 bp, Artificial Sequence
  Synthetic
gacagcccttacgtcaagttactgcagaagtgctttccgcattttgagatagaagccacgcaggtcaccgacaat

SEQ ID NO: 63943 - DNA, 75 bp, Artificial Sequence
  Synthetic
acgaaaaagggctaggggtacgggaacgttccctagtcatgggctgctgctgggctttcaaaactcacaagatca

SEQ ID NO: 63944 - DNA, 75 bp, Artificial Sequence
  Synthetic
gaccatgccaatgctagagcgttttcgcatctagccaccaaactcatcgaaagcgaagtggacccggaccaggtt

SEQ ID NO: 63945 - DNA, 75 bp, Artificial Sequence
  Synthetic
gaagacggatggagtcgatttggcctacatgagtttcatgaacggcaaaacgtcgaaatcaataaagatcgacaa

SEQ ID NO: 63946 - DNA, 75 bp, Artificial Sequence
  Synthetic
atcctggatattggaagcgcgcctgtgcggcacacgcattccaagcacaagtaccactgtatctgcccaatgatc

SEQ ID NO: 63947 - DNA, 75 bp, Artificial Sequence
  Synthetic
caagcgtgcagaccaaggacactatgttgagatgcatcaacccgggctagttgccgaccactctctccttagcat

SEQ ID NO: 63948 - DNA, 75 bp, Artificial Sequence
  Synthetic
aaccaaccagctatgggcttgatataggattgcgtcgccgaattaagatgctattcgacgcaaagaaggcacccg

SEQ ID NO: 63949 - DNA, 75 bp, Artificial Sequence
  Synthetic
agcgcggaagaccctgatcgactccaaaggtatgcagataagctgagaaagagtgatgtaacagataggtttata

SEQ ID NO: 63950 - DNA, 75 bp, Artificial Sequence
  Synthetic
ctccaattattactgaggccgacgttgcacaccttaaaggcctgcaggatgaagctgaagccgtggctgaggctg

SEQ ID NO: 63951 - DNA, 75 bp, Artificial Sequence
  Synthetic
gcctccaaagctgctgacctactgacggtgatgtcaacaccagacgtagagactccatcattatgcatgcacaca

SEQ ID NO: 63952 - DNA, 75 bp, Artificial Sequence
  Synthetic
gaagctgaagccgtggctgaggctgaagccgtacgtgcagcactacctccacttctgccggaggtcgacaaggag

SEQ ID NO: 63953 - DNA, 75 bp, Artificial Sequence
  Synthetic
aagccgtacgtgcagcactacctccacttctgccggaggtcgacaaggagaccgtagaggctgacatcgacctga

SEQ ID NO: 63954 - DNA, 75 bp, Artificial Sequence
  Synthetic
gattccacttgcaggtaccacggtactgttgccgtataccaagatgtatacgcagtgcatgcacctacctctatt

SEQ ID NO: 63955 - DNA, 75 bp, Artificial Sequence
  Synthetic
accgtagaggctgacatcgacctgatcatgcaggaggcaggagcaggcagcgtggagacacctagacgacacatc

SEQ ID NO: 63956 - DNA, 75 bp, Artificial Sequence
  Synthetic
acggtgtagaggcaaccaccctatttccacctatccaaaatggagaaagttcatgttgacttagacgcagacagc

SEQ ID NO: 63957 - DNA, 75 bp, Artificial Sequence
  Synthetic
taccaccaagcactgaaaggtgtgcgcaccatctactggatagggtttgataccaccccattcatgtacaagaat

SEQ ID NO: 63958 - DNA, 75 bp, Artificial Sequence
  Synthetic
aaatgatcggctcatacgcagtgctttctccacaagcggtccttaacagcgagaagctcgcttgtattcacccgt

SEQ ID NO: 63959 - DNA, 75 bp, Artificial Sequence
  Synthetic
atggcaggtgcgtacccgacttataacactaactgggccgatgaaagtgtgctagaggcaaggaacattggtctg

SEQ ID NO: 63960 - DNA, 75 bp, Artificial Sequence
  Synthetic
tagctgagcaagtgctcgtgatgactcacaaagggcgcgcaggacgatacaaggtagagccataccacggtagag

SEQ ID NO: 63961 - DNA, 75 bp, Artificial Sequence
  Synthetic
tgcagctcagacctgcatgaaaaacgacttggaaagatctccatcatgaggaaaaagaaattgcaacctactaac

SEQ ID NO: 63962 - DNA, 75 bp, Artificial Sequence
  Synthetic
ttatcgtccctagtggtacagctataccaatccccgatttccaggctctgagtgaaagtgcaaccatagtattta

SEQ ID NO: 63963 - DNA, 75 bp, Artificial Sequence
  Synthetic
accaatccccgatttccaggctctgagtgaaagtgcaaccatagtatttaacgaacgggagttcgttaaccgtta

SEQ ID NO: 63964 - DNA, 75 bp, Artificial Sequence
  Synthetic
aaagttgtgttttctgtaggttcaacaatatacactgaagaaagaatacttttgcgcagctggcatctgccgaac

SEQ ID NO: 63965 - DNA, 75 bp, Artificial Sequence
  Synthetic
gttttccatcttaaagggaagacgagttttacaggcagatgcaatactatcgttagctgcgatggttacgttgta

SEQ ID NO: 63966 - DNA, 75 bp, Artificial Sequence
  Synthetic
aagaagattaccatcagtcccggtatctacgggaaggttgataatctggcttctaccttgcaccgcgagggtttc

SEQ ID NO: 63967 - DNA, 75 bp, Artificial Sequence
  Synthetic
ttgagctgcaaggtgacagatacgttgcgaggggagagggtatcctttcccgtgtgcacgtatgtaccggcaaca

SEQ ID NO: 63968 - DNA, 75 bp, Artificial Sequence
  Synthetic
ttccacgaatttgcgtacgagagtttaaaaacacgtcctgctgcaccacacaaagtgcctaccatcggagtttat

SEQ ID NO: 63969 - DNA, 75 bp, Artificial Sequence
  Synthetic
ctgtgcgatcagatgacagggattctggctactgatgtcagtgttgacgacgctcagaaactgctggttgggctc

SEQ ID NO: 63970 - DNA, 75 bp, Artificial Sequence
  Synthetic
ggagtcccaggttccggaaagtctggtataatcaaaagcgctgttaccaaacgtgatctggtggtcagtgcaaag

SEQ ID NO: 63971 - DNA, 75 bp, Artificial Sequence
  Synthetic
aaccagcgcatcgtcgtcaatgggagaacacaacgtaacacaaatactatgcaaaattaccttttgccagtagta

SEQ ID NO: 63972 - DNA, 75 bp, Artificial Sequence
  Synthetic
aaagaaaattgcatggaaatcattaaagacgtcaaacgtatgcgcggcatggacatcgccgcccgcacagtggat

SEQ ID NO: 63973 - DNA, 75 bp, Artificial Sequence
  Synthetic
gcccaagcgttctccaggtgggcgcgtgaatatcgcgctgacttggaggacgaaaaagacctaggggtgcgggaa

SEQ ID NO: 63974 - DNA, 75 bp, Artificial Sequence
  Synthetic
tcggtgctgctaaatggggtaaaacactccgtcgacacactgtacatagacgaggcattcgcttgccatgcaggg

SEQ ID NO: 63975 - DNA, 75 bp, Artificial Sequence
  Synthetic
atactgaagagagaatactgttacgcagctggcatctacctaatgtttttcatctaaaaggtaaaactagcttta

SEQ ID NO: 63976 - DNA, 75 bp, Artificial Sequence
  Synthetic
cgctccctagtcatgggctgctgctgggccttcaagactcataaaatcacatccatctacaagaaacctggtacc

SEQ ID NO: 63977 - DNA, 75 bp, Artificial Sequence
  Synthetic
caaactatcaagaaggtaccagcggtctttaactccttcgtcatcccccaattcaacagctacgggttgaatata

SEQ ID NO: 63978 - DNA, 75 bp, Artificial Sequence
  Synthetic
tggagatccgaaacaatgcggcttctttaacatgatgtgtctaaaagtgcattttaaccacgagatatgcacaga

SEQ ID NO: 63979 - DNA, 75 bp, Artificial Sequence
  Synthetic
gggttacgccgcagaattaaaatgctcctggaagagaagaggaagccggcccctattatcaccgaagccgacgtt

SEQ ID NO: 63980 - DNA, 75 bp, Artificial Sequence
  Synthetic
cgatgcactaagacagtgacatccatcgtttccaccctgttctatgataaacggatgagaactgtcaacccatgc

SEQ ID NO: 63981 - DNA, 75 bp, Artificial Sequence
  Synthetic
gcccatcttaaggggatgcaagaagaggcagaggcggtagcagaagctgaagctgtgagagcagctttaccgcca

SEQ ID NO: 63982 - DNA, 75 bp, Artificial Sequence
  Synthetic
aatgataagatcataatagataccaccagtactaccaaacctttaaaggatgacataatattaacctgctttaga

SEQ ID NO: 63983 - DNA, 75 bp, Artificial Sequence
  Synthetic
ccagtactaccaaacctttaaaggatgacataatattaacctgctttagagggtgggttaaacaactgcagattg

SEQ ID NO: 63984 - DNA, 75 bp, Artificial Sequence
  Synthetic
cttttgcctgaagtagagagagagaccattgaagcagacatagatctgataatgcaagaagcaggtgcgggaagt

SEQ ID NO: 63985 - DNA, 75 bp, Artificial Sequence
  Synthetic
tgacataatattaacctgctttagagggtgggttaaacaactgcagattgactacaagaaccacgagatcatgac

SEQ ID NO: 63986 - DNA, 75 bp, Artificial Sequence
  Synthetic
gtcgagacgcccagacggcacataaaagtcacaacatatccaggtgaagagacgatcggatcttatgcagtgctc

SEQ ID NO: 63987 - DNA, 75 bp, Artificial Sequence
  Synthetic
agaaaaggggtatacgcagtgcgctacaaggtcaatgagaacccactatacgcacagacatctgagcatgtgaat

SEQ ID NO: 63988 - DNA, 75 bp, Artificial Sequence
  Synthetic
acaaggtcaatgagaacccactatacgcacagacatctgagcatgtgaatgtgttacttacacgcactgaaaaac

SEQ ID NO: 63989 - DNA, 75 bp, Artificial Sequence
  Synthetic
tcgccacaggctgtccttaacagcgagaaattagcctgcatccacccgctggctgagcaggtgctcgtcatgacc

SEQ ID NO: 63990 - DNA, 75 bp, Artificial Sequence
  Synthetic
cataaagggcgtgcaggtaggtataaagtcgaaccctaccatggacgggtagttgtacctagtggtactgccatt

SEQ ID NO: 63991 - DNA, 75 bp, Artificial Sequence
  Synthetic
ccaattccagacttccaagcgctgagcgagagtgcaaccatcgtctacaatgaacgggaatttgtcaatcggtat

SEQ ID NO: 63992 - DNA, 75 bp, Artificial Sequence
  Synthetic
ctgggccaaagcgctagaacctgtgttggccaccgccaatattactctgacccgctcgcagtgggagactattcc

SEQ ID NO: 63993 - DNA, 75 bp, Artificial Sequence
  Synthetic
ttacaccatattgccatcaatggaggtgcgataaacaccgacgaagagtactacaaagttcttagaagtagcgag

SEQ ID NO: 63994 - DNA, 75 bp, Artificial Sequence
  Synthetic
agcgttcaaggatgacaaagcgtattcgcctgagatggccttaaactttttctgcaccagattctttggcgtcga

SEQ ID NO: 63995 - DNA, 75 bp, Artificial Sequence
  Synthetic
gcggattcggagtacgtcttcgatattgacgccagaaagtgcgtcaaaaaggctgacgcaggaccgatgtgcctt

SEQ ID NO: 63996 - DNA, 75 bp, Artificial Sequence
  Synthetic
gttggtgagctggttgacccaccctttcacgagtttgcatacgaaagtctgaaaacccgtccagcggcgccccat

SEQ ID NO: 63997 - DNA, 75 bp, Artificial Sequence
  Synthetic
ccaactgttccgctgacttacaccaatgaacactgggataatagcccgggtccaaacatgtatggtttgtgcatg

SEQ ID NO: 63998 - DNA, 75 bp, Artificial Sequence
  Synthetic
aaggtgccgaccattggagtctacggagttcctggctcaggaaaatcgggaatcatcaagagcgcagtcacgaaa

SEQ ID NO: 63999 - DNA, 75 bp, Artificial Sequence
  Synthetic
cgcactgctaaagaacttgcacgtcggtatccttgtattctgaaagccgtggatacaggtagagtggctgacgtt

SEQ ID NO: 64000 - DNA, 75 bp, Artificial Sequence
  Synthetic
agagacctagtggtcagcgcaaagaaggagaactgcacggaaattatcaaagatgttaaacgtatgcgaggcatg

SEQ ID NO: 64001 - DNA, 75 bp, Artificial Sequence
  Synthetic
gatattgcagcccgtacggtggactccgtgttgcttaacggggtcaaacacccggtagacacactgtacattgac

SEQ ID NO: 64002 - DNA, 75 bp, Artificial Sequence
  Synthetic
cacctatcctgctcccatgtattcaagtactgcaagcaacagcttttcatcagcagaagtggccgtcaaagtctg

SEQ ID NO: 64003 - DNA, 75 bp, Artificial Sequence
  Synthetic
gaggcctttgcatgccacgcggggacgttactagcactcattgccattgtcaaaccaaagaaagtagtattgtgt

SEQ ID NO: 64004 - DNA, 75 bp, Artificial Sequence
  Synthetic
caagatgaccggaaaaaccgtactagtagtgggcacacctatgaacataccaggaaagagagtcgagacactagg

SEQ ID NO: 64005 - DNA, 75 bp, Artificial Sequence
  Synthetic
cccaagcccacaatgtacatataaagcggaactggacctgggcattcctgccgctttaggcaaatatgacatcat

SEQ ID NO: 64006 - DNA, 75 bp, Artificial Sequence
  Synthetic
ggagacccgaaacagtgtggattctttaacatgatgtgtctaaaagtgcatttcaaccatgaaatatgcaccgaa

SEQ ID NO: 64007 - DNA, 75 bp, Artificial Sequence
  Synthetic
gctgcggtgccactcaatgtacctctaaaccccatcctgactatcagtgtcaggtgtttacaggtgtttacccat

SEQ ID NO: 64008 - DNA, 75 bp, Artificial Sequence
  Synthetic
gtgtaccacaagagtatctcccgcaggtgcaccaagacagtcacagctatcgtctctacattattctatgacaag

SEQ ID NO: 64009 - DNA, 75 bp, Artificial Sequence
  Synthetic
cgacaccaccattaccaacagtgcgaggaccatgcgatccaccacagcatgcttaccagaaaagcagtggaccat

SEQ ID NO: 64010 - DNA, 75 bp, Artificial Sequence
  Synthetic
gaattagtagacccgccattccacgaatttgcgtacgagagtttaaaaacacgtcctgctgcaccacacaaagtg

SEQ ID NO: 64011 - DNA, 75 bp, Artificial Sequence
  Synthetic
agaatgagaacggtgaatccgtgcagtgacaagatcattatagacaccaccagcacaacaaaaccacaacgagat

SEQ ID NO: 64012 - DNA, 75 bp, Artificial Sequence
  Synthetic
aggaccatgcgatccaccacagcatgcttaccagaaaagcagtggaccatttgaacaagggcggtacgtgcatcg

SEQ ID NO: 64013 - DNA, 75 bp, Artificial Sequence
  Synthetic
cattgggctatgggactgcggacagagccaccgagaacattatctctgcagtcgcccgctcattcaggttctcac

SEQ ID NO: 64014 - DNA, 75 bp, Artificial Sequence
  Synthetic
gacattatactgacatgctttagagggtgggttaagcaactacaaattgactataaaaaccacgagatcatgaca

SEQ ID NO: 64015 - DNA, 75 bp, Artificial Sequence
  Synthetic
aatttgcgtacgagagtttaaaaacacgtcctgctgcaccacacaaagtgcctaccatcggagtttatggagtcc

SEQ ID NO: 64016 - DNA, 75 bp, Artificial Sequence
  Synthetic
gtgtgtgccagccgaagtgtgcctgggaaaacactgaggtcgcgttcgtgtttttcggcaaggacaacggcaacc

SEQ ID NO: 64017 - DNA, 75 bp, Artificial Sequence
  Synthetic
gcggccgcatctcaaggattaacccgcaaaggtgtgtacgcagtcagatacaaagtcaatgaaaatcccctctat

SEQ ID NO: 64018 - DNA, 75 bp, Artificial Sequence
  Synthetic
tttttcggcaaggacaacggcaaccatctccaagatcaagataggttgagtgttgtgttaaacaacatataccaa

SEQ ID NO: 64019 - DNA, 75 bp, Artificial Sequence
  Synthetic
gcacagacatctgaacacgtaaatgtcctcttgacccgcaccgagaaacgcattgtttggaaaactcttgccggg

SEQ ID NO: 64020 - DNA, 75 bp, Artificial Sequence
  Synthetic
tccaatcctggagcgttccgtccatgagaaattttacgccccgcgcctcgatctcgagcgtgagaggctgctgca

SEQ ID NO: 64021 - DNA, 75 bp, Artificial Sequence
  Synthetic
gacccttggataaagaccctaacggctcactaccctggggaattttcggcaacattggaggagtggcaagccgag

SEQ ID NO: 64022 - DNA, 75 bp, Artificial Sequence
  Synthetic
gtgtggcgccctttacaggaagtggcctggagcttttgataagcagccggtagcaactggtaaagcgcacctcgt

SEQ ID NO: 64023 - DNA, 75 bp, Artificial Sequence
  Synthetic
gaacactttcaattcggcgacgcggtgttagagacagacatagcttcttttgataaaagcgaggacgatgctatc

SEQ ID NO: 64024 - DNA, 75 bp, Artificial Sequence
  Synthetic
catgatgccattatggagcgtatcctggaaactccagctagtagcgatgtataccagaataaagtgcatgtatgc

SEQ ID NO: 64025 - DNA, 75 bp, Artificial Sequence
  Synthetic
tgggcaaaagcacttgaaccagttttggccactgccaatataacactcactcgttcccaatgggagaccatccct

SEQ ID NO: 64026 - DNA, 75 bp, Artificial Sequence
  Synthetic
tagcaactggtaaagcgcacctcgtcaagcattctccgaacatcatccatgccgttggccctaatttttctcggc

SEQ ID NO: 64027 - DNA, 75 bp, Artificial Sequence
  Synthetic
gcctttaaagacgacaaggctttctccccggaaatggcgttgaacttcttgtgcaccaggttcttcggggttgac

SEQ ID NO: 64028 - DNA, 75 bp, Artificial Sequence
  Synthetic
attgacagtggattattctcagcgccaactgtacctttaacatacacaaatgaacattgggataacagccctggc

SEQ ID NO: 64029 - DNA, 75 bp, Artificial Sequence
  Synthetic
accatttatttacagccatggatactaccgacgcagacattactatttactgtctagataagcaatgggagtcaa

SEQ ID NO: 64030 - DNA, 75 bp, Artificial Sequence
  Synthetic
ccgaacagatacggcttgtgcatgcgtactgccaaagaactggcccgtcgctacccatgcatactgaaagctgta

SEQ ID NO: 64031 - DNA, 75 bp, Artificial Sequence
  Synthetic
tgtctagataagcaatgggagtcaagaataaaggaagctatcactcggaaggaaagcgttgaagagcttactgag

SEQ ID NO: 64032 - DNA, 75 bp, Artificial Sequence
  Synthetic
gatacaggccgccttgcggatgtgcgtaccaataccatcaaagactacagccccctgatcaacgtggtgccactc

SEQ ID NO: 64033 - DNA, 75 bp, Artificial Sequence
  Synthetic
atgctgtcttttatatcaatttacaaaatcatattaaatttttcttttatgtttttattttgtttttaatatttc

SEQ ID NO: 64034 - DNA, 75 bp, Artificial Sequence
  Synthetic
tggtacgggtgcacccgttgagcagcttggcaggtagacctggttattcaaccaccgagggcaaggtgtattcgt

SEQ ID NO: 64035 - DNA, 75 bp, Artificial Sequence
  Synthetic
aaccgtcgtcttccacactcattggtcgtgtcgcacagatataccggtgacggaaattattctcagctgctgtca

SEQ ID NO: 64036 - DNA, 75 bp, Artificial Sequence
  Synthetic
ggaagaatggcaagctgagcatgacgctatcatggcgaaaatacttgagacaccagctagcagcgacgttttcca

SEQ ID NO: 64037 - DNA, 75 bp, Artificial Sequence
  Synthetic
ggaaagcgttgaagagcttactgaggatgacagaccagttgacattgaactggtacgggtgcacccgttgagcag

SEQ ID NO: 64038 - DNA, 75 bp, Artificial Sequence
  Synthetic
aagttgataggaaaaaccgtgctggtaataggaaccccaatttccgttcctggaaaacgtgttgagacactaggc

SEQ ID NO: 64039 - DNA, 75 bp, Artificial Sequence
  Synthetic
cttggcaggtagacctggttattcaaccaccgagggcaaggtgtattcgtacctagaggggactaggtttcatca

SEQ ID NO: 64040 - DNA, 75 bp, Artificial Sequence
  Synthetic
cctggtccacagtgcacatacaaggcagacttggacttaggcatccccagcacgattggaaaatatgacataata

SEQ ID NO: 64041 - DNA, 75 bp, Artificial Sequence
  Synthetic
actgttacgcagttggcatctacctaatgtttttcatctaaaaggtaaaactagctttacaggcagatgtaacac

SEQ ID NO: 64042 - DNA, 75 bp, Artificial Sequence
  Synthetic
caccctatttccacctatccaaaatggagaaagttcatgttgacttagacgcagacagcccattcgtcaagtcac

SEQ ID NO: 64043 - DNA, 75 bp, Artificial Sequence
  Synthetic
tttgtcaacgtcaggacaccgtacaagcaccaccattatcagcagtgcgaagaccatgccattcaccacagcatg

SEQ ID NO: 64044 - DNA, 75 bp, Artificial Sequence
  Synthetic
ggagaaagttcatgttgacttagacgcagacagcccattcgtcaagtcactgcaaagatgctttccacattttga

SEQ ID NO: 64045 - DNA, 75 bp, Artificial Sequence
  Synthetic
cttactagaaaggccgttgatcacctgaacaagggaggcacttgcgtggcactaggctacggcaccgcagataga

SEQ ID NO: 64046 - DNA, 75 bp, Artificial Sequence
  Synthetic
attcgcagtttgttcgtcctttcagttaccgaaatacaggattacaggggttcagaaaattcaatgcagtaaacc

SEQ ID NO: 64047 - DNA, 75 bp, Artificial Sequence
  Synthetic
tgtgatattctctggcactgtacccccggccatacatccaagaaaattcgcatctgtgacagtggaagacactcc

SEQ ID NO: 64048 - DNA, 75 bp, Artificial Sequence
  Synthetic
gcgaccgaaaatattatttcagcggtagctcgatcttttagattctcgagagtctgtcagcctaagtgtgcgtgg

SEQ ID NO: 64049 - DNA, 75 bp, Artificial Sequence
  Synthetic
ccggccatacatccaagaaaattcgcatctgtgacagtggaagacactccggtggtccaacctgaaaggttggtg

SEQ ID NO: 64050 - DNA, 75 bp, Artificial Sequence
  Synthetic
gaaaacactgaagtcgcgtttgtcttttttggcaaggacaatggtaaccacctacgcgaccaggatcaactaagt

SEQ ID NO: 64051 - DNA, 75 bp, Artificial Sequence
  Synthetic
aataaatgtggtacccttgaatagaagactcccacactcattggttgtcacacatagatacactgggaacggtga

SEQ ID NO: 64052 - DNA, 75 bp, Artificial Sequence
  Synthetic
agcgtggagacacctagacgacacatcaaggttacgacatacccaggagaagaaatgatcggctcatacgcagtg

SEQ ID NO: 64053 - DNA, 75 bp, Artificial Sequence
  Synthetic
attgtactgaataacatctatcaaggttctacccagtacgaagcgggcagagcaccagcttacagagtgattcgg

SEQ ID NO: 64054 - DNA, 75 bp, Artificial Sequence
  Synthetic
cacatagatacactgggaacggtgattactcccagctagtgaccaagatgaccggaaagaccgtactagtagtgg

SEQ ID NO: 64055 - DNA, 75 bp, Artificial Sequence
  Synthetic
cctaggcgacctgcaccgcctgtgcccgtacctgcaagaatccccagtcctccatgtacaacgatcaacggatcg

SEQ ID NO: 64056 - DNA, 75 bp, Artificial Sequence
  Synthetic
ggagacatatctaagagcaccgacgaagccattgttaatgcagctaacaataaaggacaaccgggagccggagta

SEQ ID NO: 64057 - DNA, 75 bp, Artificial Sequence
  Synthetic
taaagacgtcaaacgtatgcgcggcatggacatcgccgcccgcacagtggattcggtgctgctaaatggggtaaa

SEQ ID NO: 64058 - DNA, 75 bp, Artificial Sequence
  Synthetic
ctactgggttcgatgtgcgtacctccacatcgttgagtctggagcagccgacctttccgacaatggttgtcgaag

SEQ ID NO: 64059 - DNA, 75 bp, Artificial Sequence
  Synthetic
tgtggagcattgtataagaaatggccaggggcttttgataaggtgcccattgcgacaggtactgcgcacctagtt

SEQ ID NO: 64060 - DNA, 75 bp, Artificial Sequence
  Synthetic
cggagctgaaatctctgtagaccaggtttcgctatggagcatacccagcgctactgggttcgatgtgcgtacctc

SEQ ID NO: 64061 - DNA, 75 bp, Artificial Sequence
  Synthetic
cagagattcacgccagtcaaggatcactgtggagcatacccagtatcaccggatctgaaacccgtgctccgtcac

SEQ ID NO: 64062 - DNA, 75 bp, Artificial Sequence
  Synthetic
aagcatacgcccaacattatccatgcagtcgggccgaatttctcccgcgtatccgaagtggaaggcaatcagaaa

SEQ ID NO: 64063 - DNA, 75 bp, Artificial Sequence
  Synthetic
cggctctatcagtggtgacatggaaccaaaagggggttacagtcaaagatacaccagagggatcggagccatggt

SEQ ID NO: 64064 - DNA, 75 bp, Artificial Sequence
  Synthetic
actgtggagcatacccagtatcaccggatctgaaacccgtgctccgtcacctccaagtcaggatagtagaccttc

SEQ ID NO: 64065 - DNA, 75 bp, Artificial Sequence
  Synthetic
ctatcggaggtctacatggacatcgcaaaaatcattaacagggaacgatacaataaggtgtcaatacctctgtta

SEQ ID NO: 64066 - DNA, 75 bp, Artificial Sequence
  Synthetic
acgtccgtggacttaatcacgtttgacagcgttgcagagattttggaggatttcagtcgttcgccgtttcaattt

SEQ ID NO: 64067 - DNA, 75 bp, Artificial Sequence
  Synthetic
taccgcctcttataaacactacaggcagcgcataatgctgtcttttatatcaatttacaaaatcatattaatttt

SEQ ID NO: 64068 - DNA, 75 bp, Artificial Sequence
  Synthetic
tcaactggcatttacgcaggtggcaaggatcgcgtgatgcaatcgttaaaccacctgtttactgccatggacacc

SEQ ID NO: 64069 - DNA, 75 bp, Artificial Sequence
  Synthetic
ggcaggagcaggcagcgtggagacacctagacgacacatcaaggtcacgacgtacccaggagaagaaatgatcgg

SEQ ID NO: 64070 - DNA, 75 bp, Artificial Sequence
  Synthetic
cagcgcataatgctgtcttttatatcaatttacaaaatcatattaattttttctttatgttttattttgttttta

SEQ ID NO: 64071 - DNA, 75 bp, Artificial Sequence
  Synthetic
gagccgcagcgcagacacgatcaaaccaattccaaagccgcgtaaatgccaggtgaagtacacgcagccacctgg

SEQ ID NO: 64072 - DNA, 75 bp, Artificial Sequence
  Synthetic
accgatgcagatgtaactatctattgcctggataaacagtgggaagcacgaatcaaagacgccatcgcccggaag

SEQ ID NO: 64073 - DNA, 75 bp, Artificial Sequence
  Synthetic
catcgtcaagccaaagaaagttgtattgtgtggagatccgaaacaatgcggcttctttaacatgatgtgtctaaa

SEQ ID NO: 64074 - DNA, 75 bp, Artificial Sequence
  Synthetic
cgtcgccagggccatatcggcagcggaatttgacgagtttgtgcggaggcactcgaattgacggtacgaagcggg

SEQ ID NO: 64075 - DNA, 75 bp, Artificial Sequence
  Synthetic
gaaagcgtcgaggaactcgtagaagatgacaaacctgtcgacatcgagttggtccgtgtgcacccactaagtagt

SEQ ID NO: 64076 - DNA, 75 bp, Artificial Sequence
  Synthetic
tgcttcgaccatgcaccgagagggattcttaagttgcaaggttacagatacgttaagaggggagagggtctcttt

SEQ ID NO: 64077 - DNA, 75 bp, Artificial Sequence
  Synthetic
cgcgtacattttctcatccgagacgggacaagggcacctgcaacaaaaatctacgcggcaatgcaaactccagta

SEQ ID NO: 64078 - DNA, 75 bp, Artificial Sequence
  Synthetic
ctggtcgggagaccaggttactctacggacgaaggcaaggtgcactcctatctggaaggaacgaggttccaccaa

SEQ ID NO: 64079 - DNA, 75 bp, Artificial Sequence
  Synthetic
cttttgataagcagccggtagcaactggtaaagcgcacctcgtcaagcattctccgaacgtcatccatgccgttg

SEQ ID NO: 64080 - DNA, 75 bp, Artificial Sequence
  Synthetic
actgccaaagacatcgcagagatctacgctatgtggcctaataaacaagaagctaacgagcaaatctgtctgtac

SEQ ID NO: 64081 - DNA, 75 bp, Artificial Sequence
  Synthetic
gaagaaactacaattgtgtgcttctgaaggtaatcggagcaggtatcagtctcgtaaagtagagaacatgaaggc

SEQ ID NO: 64082 - DNA, 75 bp, Artificial Sequence
  Synthetic
gtattaggagaaagcatgaccagtatccgctctaagtgccctgtagaagattccgaagcctcatctccaccgcac

SEQ ID NO: 64083 - DNA, 75 bp, Artificial Sequence
  Synthetic
aatcaccgttgagcgtctactgcaggggataggctcatacctctctgcagaaccgcaaccagttgaatgctacaa

SEQ ID NO: 64084 - DNA, 75 bp, Artificial Sequence
  Synthetic
acgattccgtgtctttgcaattatgccatgacggccgagcgggtttacagattacgcatggcaaagaatgagcag

SEQ ID NO: 64085 - DNA, 75 bp, Artificial Sequence
  Synthetic
tttgccgtgtgttcatcatttcaattacccaagtacagaataacgggcgtgcagaagatccagtgcaataagcca

SEQ ID NO: 64086 - DNA, 75 bp, Artificial Sequence
  Synthetic
tcaagtactgcaagcaatagcttttcatcagcagaagtggccgtcaaagtctgcaacctagtactgcaggagaac

SEQ ID NO: 64087 - DNA, 75 bp, Artificial Sequence
  Synthetic
gtcatattctcgggggtcgtaccaccagcaatacatccacggaaattctcggctatcgaggaaacagtgccagta

SEQ ID NO: 64088 - DNA, 75 bp, Artificial Sequence
  Synthetic
gttgaagagcttactgaggatgacagaccagttgacattgaactggtacgggtgcacccgttgagcagcttggca

SEQ ID NO: 64089 - DNA, 75 bp, Artificial Sequence
  Synthetic
acaaccaaccagctatgggcttgatatagggttgcgtcgccgcattaagatgctattcgacgcaaagaaggcacc

SEQ ID NO: 64090 - DNA, 75 bp, Artificial Sequence
  Synthetic
acaattgaacggcttgtcccaagacgtcctgctccaccggtgccggtacctgcccgtattcctagcccacgctgc

SEQ ID NO: 64091 - DNA, 75 bp, Artificial Sequence
  Synthetic
tgtttagatactgccaccttttgcccagccaaattaaggagctttccaaagaagcacagttatttgcggcctgag

SEQ ID NO: 64092 - DNA, 75 bp, Artificial Sequence
  Synthetic
tcaccagcagttagcatgcagtctttgggcggtagtagtacatcggacgttgtcatctccgaagccgaagttcat

SEQ ID NO: 64093 - DNA, 75 bp, Artificial Sequence
  Synthetic
gggtgggttaagcaactgcagattgactacaagaaccacgagatcatgactgcagcggcctcacaggggcttact

SEQ ID NO: 64094 - DNA, 75 bp, Artificial Sequence
  Synthetic
aaagacatagctgaaatttacgctatgtggcctaacaagcaagaagcaaacgagcagatttgcttatacgtgttg

SEQ ID NO: 64095 - DNA, 75 bp, Artificial Sequence
  Synthetic
agcagcagccacgaaacggaattgcaatgtcactcaaatgagggaacttccagtgttggattcagctgccttcaa

SEQ ID NO: 64096 - DNA, 75 bp, Artificial Sequence
  Synthetic
gattcagattccgattgcagtatccctccaatgcctttcgtcgtggaggcagaggttcacgcaagtcagggctca

SEQ ID NO: 64097 - DNA, 75 bp, Artificial Sequence
  Synthetic
gaagcacagttatttgcggcctgagatacgatcagcagtgccatcaccgattcaaaacacgctccagaatgtact

SEQ ID NO: 64098 - DNA, 75 bp, Artificial Sequence
  Synthetic
cactggagcattcctagcgcgtctggcttcgaaatccgtgaactgccggaagatcgcagcatatccggctcaccg

SEQ ID NO: 64099 - DNA, 75 bp, Artificial Sequence
  Synthetic
ccgtgtctgtgcaactatgcaatgactgcagagcgagtttacagattacgtatggcaaagaatgaacaattcgca

SEQ ID NO: 64100 - DNA, 75 bp, Artificial Sequence
  Synthetic
acacgcacgtcggtaatttccgaccactccgtgaacctgatcacatttgacagcgttactgacatatttgaaaac

SEQ ID NO: 64101 - DNA, 75 bp, Artificial Sequence
  Synthetic
actaagttaaagggacccaaagcagctgccctttttgcgaaaacgcataacttacagccattgcatgagatacca

SEQ ID NO: 64102 - DNA, 75 bp, Artificial Sequence
  Synthetic
ggagtacatcacctgcaagtacaagacaaaagtgccgtctccagtagtgaaatgctgcggtgccactcaatgtac

SEQ ID NO: 64103 - DNA, 75 bp, Artificial Sequence
  Synthetic
ttcaaacaagcgccttttcagtttctatcagagatccgcccaataccagcaccgcgtcgcagagtgggagggttt

SEQ ID NO: 64104 - DNA, 75 bp, Artificial Sequence
  Synthetic
gacaaaacatactgaagaaagaccaaaagttcaggtgatacaggcagctgatccacttgcaaccgcctacctatg

SEQ ID NO: 64105 - DNA, 75 bp, Artificial Sequence
  Synthetic
gagactgatactaagcgctacgacaagacagaggaaaaaccaattcctaagccacgtacgcgcacaacgaagtat

SEQ ID NO: 64106 - DNA, 75 bp, Artificial Sequence
  Synthetic
atccacttgcaaccgcctacctatgtggtatacatcgagagcttgtgcgcaggttgaacgcagtgctgctaccga

SEQ ID NO: 64107 - DNA, 75 bp, Artificial Sequence
  Synthetic
aagcagcccccaggtgtagccaggtccatttcggaagcagaattggatgagttcatccgccgacattcaaattga

SEQ ID NO: 64108 - DNA, 75 bp, Artificial Sequence
  Synthetic
cggtatgaagcgggtgcgtatattttctcgtcagagacagggcaagggcatctgcaacagaaatcaactcggcag

SEQ ID NO: 64109 - DNA, 75 bp, Artificial Sequence
  Synthetic
tgcaaactccaaaatcctatcttggagcgctctgtccacgagaaattctacgccccgcgcctcgacttggaacgt

SEQ ID NO: 64110 - DNA, 75 bp, Artificial Sequence
  Synthetic
cattccacgaatttgcgtacgagagtttaaaaacacgtcctgctgcaccacacaaagtgcctaccatcggagttt

SEQ ID NO: 64111 - DNA, 75 bp, Artificial Sequence
  Synthetic
gagaaactgttacagaaaaaattgcaattgtgcgcgtcggaaggtaataggagtaggtaccaatcacgtaaagtc

SEQ ID NO: 64112 - DNA, 75 bp, Artificial Sequence
  Synthetic
tttgggaacataacatctgtgcacttaccaacaggcacccgatttaagttcggggcaatgatgaaatccgggatg

SEQ ID NO: 64113 - DNA, 75 bp, Artificial Sequence
  Synthetic
actgttaaacctaattgaagcagcctttgggaacataacatctgtgcacttaccaacaggcacccgatttaagtt

SEQ ID NO: 64114 - DNA, 75 bp, Artificial Sequence
  Synthetic
gagaatatgaaagcaattacggcggaacgtctgttgcaagggataggggcttatctttcagctgaatcgcagcca

SEQ ID NO: 64115 - DNA, 75 bp, Artificial Sequence
  Synthetic
tttttgacactctttattaatactgttgtcaatatcatgatcgctagccgcgtgctccgcgagcggttgaccact

SEQ ID NO: 64116 - DNA, 75 bp, Artificial Sequence
  Synthetic
gtggagtgttataaagttaattaccccgtccccatttactccaccacacgcagcaacagattctcatcggcagac

SEQ ID NO: 64117 - DNA, 75 bp, Artificial Sequence
  Synthetic
cagagattcacgccagtcaaggatcactgtggagtgtacccagtatccccggatctgaaacccgcgttccgtcac

SEQ ID NO: 64118 - DNA, 75 bp, Artificial Sequence
  Synthetic
gtcgcggtaagagtatgtaatttggtattgcaagagaactttcctactgtggcgagctacaccatcaccgatgag

SEQ ID NO: 64119 - DNA, 75 bp, Artificial Sequence
  Synthetic
tgcgccacgtggttgaacatggaagtgaagatcatcgatgcagtagtcggagtaaaggcaccgtacttttgcgga

SEQ ID NO: 64120 - DNA, 75 bp, Artificial Sequence
  Synthetic
caatggatagattcgtgatggaccttaaacgggatgtcaaggttacacccgggacaaaacatactgaagaaagac

SEQ ID NO: 64121 - DNA, 75 bp, Artificial Sequence
  Synthetic
cgtcaagccaaagaaagttgtattgtgtggagatccgaaacaatgcggcttctttaacatgatgtgtctaaaagt

SEQ ID NO: 64122 - DNA, 75 bp, Artificial Sequence
  Synthetic
gggttcatcgtagtcgatcagatcacaggaactgcgtgcagagtcgccgaccccctgaagagactgtttaagcta

SEQ ID NO: 64123 - DNA, 75 bp, Artificial Sequence
  Synthetic
caggaactgcgtgcagagtcgccgaccccctgaagagactgtttaagctaggtaagccgcttccactggacgatg

SEQ ID NO: 64124 - DNA, 75 bp, Artificial Sequence
  Synthetic
gcattttaaccacgagatatgcacagaagtgtatcacaagagtatttctcggcgatgcactaagacagtgacatc

SEQ ID NO: 64125 - DNA, 75 bp, Artificial Sequence
  Synthetic
cgcggtgttagagacagacatagcttcttttgataaaagcgaggacgatgctatcgccatgtctgctctaatgat

SEQ ID NO: 64126 - DNA, 75 bp, Artificial Sequence
  Synthetic
tacgacgcctatttagatatggttgacggagcatcgtgctgcttggatactgcgaccttctgcccggctaagcta

SEQ ID NO: 64127 - DNA, 75 bp, Artificial Sequence
  Synthetic
cgcagtttcccgaaaaagcatagctacttgcgtcctgagataagatcagctgttccgtcccccatacagaacaca

SEQ ID NO: 64128 - DNA, 75 bp, Artificial Sequence
  Synthetic
aacagaattggcatcactgaagagctggtgaaagcagttgaatcacgctacgaggtgaactacgtgtcactaatc

SEQ ID NO: 64129 - DNA, 75 bp, Artificial Sequence
  Synthetic
tggtgaaagcagttgaatcacgctacgaggtgaactacgtgtcactaatcatcacagcgttgactacattagcat

SEQ ID NO: 64130 - DNA, 75 bp, Artificial Sequence
  Synthetic
ctggagcgttccgtccatgagaaattttacgccccgcgcctcgatctcgagcgtgagaagctgttgcagaagaaa

SEQ ID NO: 64131 - DNA, 75 bp, Artificial Sequence
  Synthetic
cgaggtgaactacgtgtcactaatcatcacagcgttgactacattagcatcttcagttagcaactttaaacacat

SEQ ID NO: 64132 - DNA, 75 bp, Artificial Sequence
  Synthetic
cttcagttagcaactttaaacacataagaggtcaccccataaccctctacggctgacctaaataggttgtgcatt

SEQ ID NO: 64133 - DNA, 75 bp, Artificial Sequence
  Synthetic
acgacaacattgtgaaaggggttacatctgacgcgctgatggcagagcggtgcgccacgtggttgaacatggaag

SEQ ID NO: 64134 - DNA, 75 bp, Artificial Sequence
  Synthetic
cttcagaacgttttagcggcagccaccaaacgaaactgtaacgtcacccagatgcgcgagttaccagtcctggac

SEQ ID NO: 64135 - DNA, 75 bp, Artificial Sequence
  Synthetic
tcggccgcatttaatgtggagtgctttaaaaaatatgcatgtaacgacgagtactgggatacatttaaaaataac

SEQ ID NO: 64136 - DNA, 75 bp, Artificial Sequence
  Synthetic
cccattaggcttactactgagaatgtcactcagtacgttactaagctcaaaggaccaaaagctgctgcactgttc

SEQ ID NO: 64137 - DNA, 75 bp, Artificial Sequence
  Synthetic
gctaagacgcataacttacaaccactgcatgaaattccgatggatagatttgtgatggatcttaagcgcgacgtc

SEQ ID NO: 64138 - DNA, 75 bp, Artificial Sequence
  Synthetic
ccataccctacacttaactacccgcctatggcgccgattaacccgatggcctaccgggatcctaatccgcctagg

SEQ ID NO: 64139 - DNA, 75 bp, Artificial Sequence
  Synthetic
aaagtaactccggggaccaagcataccgaagaacgaccgaaagtccaagtgatacaggcggcggaacccctggcg

SEQ ID NO: 64140 - DNA, 75 bp, Artificial Sequence
  Synthetic
ctaccgggatcctaatccgcctaggcgcaggtggcggccctttaggccaccacttgcagctcaaattgaggacct

SEQ ID NO: 64141 - DNA, 75 bp, Artificial Sequence
  Synthetic
accgcatatttgtgcggaatacatagggagttggtaagaagactgaacgccgtactgctgcctaacattcacacg

SEQ ID NO: 64142 - DNA, 75 bp, Artificial Sequence
  Synthetic
ggtgtagaggcaaccaccctatttccacctatccaaaatggagaaagttcatgttgacttagacgcagacagccc

SEQ ID NO: 64143 - DNA, 75 bp, Artificial Sequence
  Synthetic
ttgttcgatatgtccgctgaggactttgatgccatcatagccgaacatttccaattcggagacgcagtattggaa

SEQ ID NO: 64144 - DNA, 75 bp, Artificial Sequence
  Synthetic
attaaggagctttccaaagaagcacagttatttgcggcctgagatacgatcagcagtgccatcaccgattcaaaa

SEQ ID NO: 64145 - DNA, 75 bp, Artificial Sequence
  Synthetic
gaagcctgcgcccaagcctaagcctgcgcaggcgaaaaagaagcgaccaccaccacctgccaagaaacaaaaacg

SEQ ID NO: 64146 - DNA, 75 bp, Artificial Sequence
  Synthetic
acagatatcgcttcgttcgacaaaagtgaggatgatgccattgctatgtctgcacttatgatccttgaagacctg

SEQ ID NO: 64147 - DNA, 75 bp, Artificial Sequence
  Synthetic
ctcaaatgagggaacttccagtgttggattcagctgccttcaacgtggagtgtttcaaaaagtacgcctgtaacg

SEQ ID NO: 64148 - DNA, 75 bp, Artificial Sequence
  Synthetic
ggtgtcgatcaggccctcctagatcttatagaagctgcttttgggaatatcacatctgtccacctcccaacaggg

SEQ ID NO: 64149 - DNA, 75 bp, Artificial Sequence
  Synthetic
acacgcttcaagttcggagctatgatgaagtcaggtatgttcttaaccctgtttattaatactgtggttaatatt

SEQ ID NO: 64150 - DNA, 75 bp, Artificial Sequence
  Synthetic
ctgaagaaggccagcatatatgaccttgagtacggtgatgtgccacaatgcatgaaatcagataccctccagtac

SEQ ID NO: 64151 - DNA, 75 bp, Artificial Sequence
  Synthetic
atgattgccagccgcgtgttgcgtgagaggctaaccaattcgccttgcgctgcttttattggcgatgataatatt

SEQ ID NO: 64152 - DNA, 75 bp, Artificial Sequence
  Synthetic
gtggatacaggtagagtggctgacgttcgcacagacactatcaaagactataacccgctaataaatgtggtaccc

SEQ ID NO: 64153 - DNA, 75 bp, Artificial Sequence
  Synthetic
accagtgacaagcctcctggcttttataactggcatcatggagctgtgcagtatgagaacaacaggttcaccgta

SEQ ID NO: 64154 - DNA, 75 bp, Artificial Sequence
  Synthetic
gtgaaaggagtcaagtctgacgcactcatggctgaacgttgtgccacttggttgaatatggaagtaaagataata

SEQ ID NO: 64155 - DNA, 75 bp, Artificial Sequence
  Synthetic
gctcctaagtaattctatacacactttataatcaggcataattgccgtatatacaattacactacaggtaatata

SEQ ID NO: 64156 - DNA, 75 bp, Artificial Sequence
  Synthetic
gatgcaaccgtgggtgtaaaagctccgtatttctgcggcggctttatcgtcgtggaccaagtgactggtacagca

SEQ ID NO: 64157 - DNA, 75 bp, Artificial Sequence
  Synthetic
tgcagagtggcagacccccttaagaggctgtttaaacttggtaagcctttgcccttggacgacgatcaggatggg

SEQ ID NO: 64158 - DNA, 75 bp, Artificial Sequence
  Synthetic
ctcaagtcccaatactcctggcgttactttgttgcattaagccgacgagggcagacgacaccttgcaagtgctga

SEQ ID NO: 64159 - DNA, 75 bp, Artificial Sequence
  Synthetic
cctggccaatatcacgtttccatgtgatcaaccaccctgcatgccatgctgttatgaaaagaatccacacgaaac

SEQ ID NO: 64160 - DNA, 75 bp, Artificial Sequence
  Synthetic
ccacttgcagcgcttatcgtatgcatgcgcatgctgcgctgcttattttgctgtgggccggcttttttacttgtc

SEQ ID NO: 64161 - DNA, 75 bp, Artificial Sequence
  Synthetic
gataggcgcagagcattgtacgacgaagcgctcagatggaaccggatcggtatcactgatgagctaatcaaagcc

SEQ ID NO: 64162 - DNA, 75 bp, Artificial Sequence
  Synthetic
gttgaatcacgatatgaagtgttttacatctcattggttatcaccgctttgactactcttgcagctacagtcagc

SEQ ID NO: 64163 - DNA, 75 bp, Artificial Sequence
  Synthetic
attttctgtggggtcaactatttatactgaagagagaatactgttacgcagttggcacttacctaatgtttttca

SEQ ID NO: 64164 - DNA, 75 bp, Artificial Sequence
  Synthetic
aatttcaaatatataagaggaaatcctataaccctctacggctgacctaaataggttgtgcagaagaagctaacc

SEQ ID NO: 64165 - DNA, 75 bp, Artificial Sequence
  Synthetic
aggcacccgatttaagttcggggcaatgatgaaatccgggatgtttttgacactctttattaatactgttgtcaa

SEQ ID NO: 64166 - DNA, 75 bp, Artificial Sequence
  Synthetic
taactgtgggcatagtcggtgcgacagccctatagctatagaagaagtcagaggggatgcgcatgcaggagtcat

SEQ ID NO: 64167 - DNA, 75 bp, Artificial Sequence
  Synthetic
tatcatgatcgctagccgcgtgctccgcgagcggttgaccacttccccctgcgcagcatttatcggcgacgacaa

SEQ ID NO: 64168 - DNA, 75 bp, Artificial Sequence
  Synthetic
ttggagacctgcaatcacgcacatcaaccagcaacgatctgtacgcaaacaccaacttgaagctacaacgacccc

SEQ ID NO: 64169 - DNA, 75 bp, Artificial Sequence
  Synthetic
ccgcatccagacatcagctatgttcggtctgaagacggatggagtcgatttggcctacatgagtttcatgaacgg

SEQ ID NO: 64170 - DNA, 75 bp, Artificial Sequence
  Synthetic
ggtctgaagacggatggagtcgatttggcctacatgagtttcatgaacggcaaaacgcagaaatcaataaagatc

SEQ ID NO: 64171 - DNA, 75 bp, Artificial Sequence
  Synthetic
tattatacaacactcagtgtatcacaagcgcaataccgaaacgatgtttccgtatccaacattgaactacccgcc

SEQ ID NO: 64172 - DNA, 75 bp, Artificial Sequence
  Synthetic
tatggcaccggttaatccgatggcatacagggaccccaatccaccaagacgtaggtggcggccatttcggccgcc

SEQ ID NO: 64173 - DNA, 75 bp, Artificial Sequence
  Synthetic
gacaacctgcatgtgcgcacctcagccccttgttccctcgtgtcgcaccacggctattacatcttggctcaatgc

SEQ ID NO: 64174 - DNA, 75 bp, Artificial Sequence
  Synthetic
cctagctgctcaaatcgaggatttgagacgttccatcgctaacctaacgtttaagcaaagggccccgaatccgcc

SEQ ID NO: 64175 - DNA, 75 bp, Artificial Sequence
  Synthetic
agcaggccccccggcaaaacgtaagaagccagcacctaaaccgaagcctgcggcgcccaagaaaaagaggcaacc

SEQ ID NO: 64176 - DNA, 75 bp, Artificial Sequence
  Synthetic
ccaccaggggacacggttacagttgggtttcacgacgggcctaaccgccatacgtgcacagttgcccataaggta

SEQ ID NO: 64177 - DNA, 75 bp, Artificial Sequence
  Synthetic
acctccagctaagaagcagaagcgcaaacaaaagcctggtaaacggcaaaggatgtgtatgaaactggaatccga

SEQ ID NO: 64178 - DNA, 75 bp, Artificial Sequence
  Synthetic
caagactttccccatcatgttgaatggtcaagtgaacggctatgcgtgcgtagtcggcgggcgcgtgttcaaacc

SEQ ID NO: 64179 - DNA, 75 bp, Artificial Sequence
  Synthetic
aaaactcacaagatcacatccatttacaagagacctgggactcaaactatcaagaaggtgcccgccgtattcaat

SEQ ID NO: 64180 - DNA, 75 bp, Artificial Sequence
  Synthetic
agttgaattaccgtgtaaccgttacactcacaagcgtgcagaccaaggacactatgttgagatgcatcaaccagg

SEQ ID NO: 64181 - DNA, 75 bp, Artificial Sequence
  Synthetic
gctgcatgttgaaggcaagattgacaacgaacagttggccgccattaaattgaagaaagcaagtatctatgatct

SEQ ID NO: 64182 - DNA, 75 bp, Artificial Sequence
  Synthetic
ttacggtaccgagcggcgcccaagtgaaatactactgcaagtgtccagatgtacgagagggaattaccagcagcg

SEQ ID NO: 64183 - DNA, 75 bp, Artificial Sequence
  Synthetic
cgagtatggcgatgttccacaatgtatgaaatcggacaccctccagtacaccagtgagaagccgccgggtttcta

SEQ ID NO: 64184 - DNA, 75 bp, Artificial Sequence
  Synthetic
gtacgagagggaattaccagcagcgaccatacaaccacctgcacggatgtcaaacaatgcagggcttacctgatt

SEQ ID NO: 64185 - DNA, 75 bp, Artificial Sequence
  Synthetic
taaaggcctgcaggatgaagctgaagccgtggctgaggctgaagccgtacgtgcagcactacctccacttctgcc

SEQ ID NO: 64186 - DNA, 75 bp, Artificial Sequence
  Synthetic
caattggcaccacggagccgtgcagtatgaaaacaacaggttcaccgtgccacgaggagtgggcggaaaagggga

SEQ ID NO: 64187 - DNA, 75 bp, Artificial Sequence
  Synthetic
ctggaagactgcctcgaggagagggcgacacttttaaaggaaaacttcatgtgccctttgtgcctgttaaggcca

SEQ ID NO: 64188 - DNA, 75 bp, Artificial Sequence
  Synthetic
tagcggacgcccgattttagacaaccgcggccgtgtggtcgctatagtactaggcggagctaacgaaggatctcg

SEQ ID NO: 64189 - DNA, 75 bp, Artificial Sequence
  Synthetic
cacagcgctgtcagtggtcacgtggaaccagaaaggggttaccgtaaaggatacccccgaaggttccgaaccttg

SEQ ID NO: 64190 - DNA, 75 bp, Artificial Sequence
  Synthetic
gtcactgactacagttatgtgcgtcttagctaacatcaccttcccatgtgaccagccaccctgtatgccctgctg

SEQ ID NO: 64191 - DNA, 75 bp, Artificial Sequence
  Synthetic
actcgacaatggattgagcgaccaacaactgtcaatttcacagtcaccggagaagggttggagtatacctgggga

SEQ ID NO: 64192 - DNA, 75 bp, Artificial Sequence
  Synthetic
tacgtgttgggagagagtatgaacagcatccgctctaagtgtccagttgaagagtcggaggcctcttccccccct

SEQ ID NO: 64193 - DNA, 75 bp, Artificial Sequence
  Synthetic
ttacgagaaaaatccgcacgagacgctcagcatgctcgaacagaactatgacagccaggcttatgacctactgct

SEQ ID NO: 64194 - DNA, 75 bp, Artificial Sequence
  Synthetic
aaccatccaccaaaaagagtatgggctcaagagtcaggagaagggaacccacatggatggccgcacgaagtggta

SEQ ID NO: 64195 - DNA, 75 bp, Artificial Sequence
  Synthetic
ctcaagagtcaggagaagggaacccacatggatggccgcacgaagtggtagtctattactacaacagatacccgt

SEQ ID NO: 64196 - DNA, 75 bp, Artificial Sequence
  Synthetic
ggacgcggccgtcaaatgtaacggcaggagaacccgtagagacctggaaacccatttcacacagtacaagctggc

SEQ ID NO: 64197 - DNA, 75 bp, Artificial Sequence
  Synthetic
gtctattactacaacagatacccgttaaccacaattatcgggttatgcacctgtgtggctatcatcatggtctct

SEQ ID NO: 64198 - DNA, 75 bp, Artificial Sequence
  Synthetic
caactgtcaatttcacagtcaccggagaagggttggagtatacctggggaaaccatccaccaaaaagagtatggg

SEQ ID NO: 64199 - DNA, 75 bp, Artificial Sequence
  Synthetic
tcgcccatacatagcagactgctccaattgcggccacggcagatgcgacagtcccattgccatcgaggacattcg

SEQ ID NO: 64200 - DNA, 75 bp, Artificial Sequence
  Synthetic
tgtgtcacatccgtgtggctcctttgcaggactcgcaatctttgcataaccccgtataaactagccccgaacgct

SEQ ID NO: 64201 - DNA, 75 bp, Artificial Sequence
  Synthetic
acatggatggccgcacgaagtggtagtctattactacaacagatacccgttaaccacaattatcgggttatgcac

SEQ ID NO: 64202 - DNA, 75 bp, Artificial Sequence
  Synthetic
tgagtacgtatttgacatcgacgcaaagaagtgcgtgaagaaaggggatgccggaccaatgtgcctggtcggcga

SEQ ID NO: 64203 - DNA, 75 bp, Artificial Sequence
  Synthetic
cggagacgctcatgcaggctacatccgaatacaaacatcggcaatgttcggcctgaagtcggatggagtagatct

SEQ ID NO: 64204 - DNA, 75 bp, Artificial Sequence
  Synthetic
agcctatatgagcttcatgaacggcaaaaccctgaaggccataaaaatagaacatttgtatgctcgtacatcagc

SEQ ID NO: 64205 - DNA, 75 bp, Artificial Sequence
  Synthetic
cgacgaccagtatacaatcactgggggaggatcaaagcgcatctgcttctagcggagctgaaatctctgtagacc

SEQ ID NO: 64206 - DNA, 75 bp, Artificial Sequence
  Synthetic
accatgctctctggtttcctaccatggttactacatccttgcccagtgtcctcccggagacactgtgacagtggg

SEQ ID NO: 64207 - DNA, 75 bp, Artificial Sequence
  Synthetic
tctatcagtggtgacatggaaccaaaagggggttacagtcaaagatacaccagaggggtcagagccatggtcgct

SEQ ID NO: 64208 - DNA, 75 bp, Artificial Sequence
  Synthetic
gtttcaagacggtgccatcaagcacatgtgcaccatcgcccataaagttgagttcaaacctgtaggaagagagaa

SEQ ID NO: 64209 - DNA, 75 bp, Artificial Sequence
  Synthetic
gaacacacagcagtgatgccgaacaaggtggggatcccgtataaagctttagtcgaacgcccaggttatgcaccc

SEQ ID NO: 64210 - DNA, 75 bp, Artificial Sequence
  Synthetic
ttacaaaatcatattaattttcttttatgtttttattttgtttttaatatttcaaaaaaaaaaaaaaaaaaaaaa

SEQ ID NO: 64211 - DNA, 75 bp, Artificial Sequence
  Synthetic
gtaccgccatcctcctgaacacggcgtggagttaccctgcaccaagtacacgcacaaacgtgcagaccagggcca

SEQ ID NO: 64212 - DNA, 75 bp, Artificial Sequence
  Synthetic
acctccaagtcaggatagtagaccttccaccccatctgcaagtggttcacacacgtccgtggacttaatcacgtt

SEQ ID NO: 64213 - DNA, 75 bp, Artificial Sequence
  Synthetic
ctatgtcgaaatgcaccaaccagggctggtagccgaccactcgctactgagcatgagcagtacgaaagtgaagat

SEQ ID NO: 64214 - DNA, 75 bp, Artificial Sequence
  Synthetic
gcacttattgccatcgtcaagccgaagaaagttgtattgtgcggagatccgaaacaatgcggcttctttaacatg

SEQ ID NO: 64215 - DNA, 75 bp, Artificial Sequence
  Synthetic
caccgtcccaagtggttctcaagtgaagtattactgtaagtgccccgacgtaaaggagggaacaaccggcagcga

SEQ ID NO: 64216 - DNA, 75 bp, Artificial Sequence
  Synthetic
ttccacgaatttgcgtacgagagtttaaaaacacgtcctgctgcaccacacaaagtgcctaccattggagtttat

SEQ ID NO: 64217 - DNA, 75 bp, Artificial Sequence
  Synthetic
acccattcatgtggggaggagcctactgcttctgcgacaccgaaaacacccagatgagcgaggcgtatgtagagc

SEQ ID NO: 64218 - DNA, 75 bp, Artificial Sequence
  Synthetic
ctacacgactgcttgcacggacttgaagcagtgtcgagcgtaccttattgacaataagaaatgggtctacaactc

SEQ ID NO: 64219 - DNA, 75 bp, Artificial Sequence
  Synthetic
ctgcttctgcgacaccgaaaacacccagatgagcgaggcgtatgtagagcgctcggaagagtgctctatcgatca

SEQ ID NO: 64220 - DNA, 75 bp, Artificial Sequence
  Synthetic
cgcaaaagcttataaagtacacacaggcactgttcaggcaatggtgaacataacttatgggagcgtcagctggag

SEQ ID NO: 64221 - DNA, 75 bp, Artificial Sequence
  Synthetic
tggcaaactacctagaggagaaggcgaaacctttaaaggtaaactccatgtgccgttcgtcccggtcacgagcaa

SEQ ID NO: 64222 - DNA, 75 bp, Artificial Sequence
  Synthetic
taacttatgggagcgtcagctggagatctgcagatgtctacgtcaatggtgaaactcccgcgaaaataggagatg

SEQ ID NO: 64223 - DNA, 75 bp, Artificial Sequence
  Synthetic
gtgtaccgcgaccttggcccccgaaccactggtggaacacaagcatcgatccctagttttacacctgcacccaga

SEQ ID NO: 64224 - DNA, 75 bp, Artificial Sequence
  Synthetic
gaaactcccgcgaaaataggagatgccaaactcatcataggtccactgtcatctgcgtggtccccattcgataac

SEQ ID NO: 64225 - DNA, 75 bp, Artificial Sequence
  Synthetic
acacccaacactactgacgactagagcactgggaagtaacgcgaggccgacaaggcagtggatcgaacaaccaac

SEQ ID NO: 64226 - DNA, 75 bp, Artificial Sequence
  Synthetic
cggagctgaaatctctgtagaccaggtttcgctatggagcatacccagcgcatctgggttcgatgtgcgtacctc

SEQ ID NO: 64227 - DNA, 75 bp, Artificial Sequence
  Synthetic
cacagtcaattttacagtaacaggagaaggttttgaatacacctggggcaatcacccgcccaaacgagtttgggc

SEQ ID NO: 64228 - DNA, 75 bp, Artificial Sequence
  Synthetic
caacttgaagctacaacgaccccaggctggtatcgtgcacacacctttcacccaggcgccctctggcttcgaacg

SEQ ID NO: 64229 - DNA, 75 bp, Artificial Sequence
  Synthetic
ccaagaatcaggtgaaggaaatcctcatggttggccgcacgaaatagtaatttattactacaaccggtatccaat

SEQ ID NO: 64230 - DNA, 75 bp, Artificial Sequence
  Synthetic
atggaaaagggacaaaggggcaccgttgaacgacgtagccccgtttggctgttcgattgccctggagccgctccg

SEQ ID NO: 64231 - DNA, 75 bp, Artificial Sequence
  Synthetic
agaaccgcaaccagttgaatgctacaaagtcacctatcctgctcccatgtattcaagtactgcaagcaacagctt

SEQ ID NO: 64232 - DNA, 75 bp, Artificial Sequence
  Synthetic
gacgactgtcattggactgtgcacgtgcgtagccatcattatggtttcctgtgttacatctgtatggcttctttg

SEQ ID NO: 64233 - DNA, 75 bp, Artificial Sequence
  Synthetic
ccgcactcgcaatctttgcataacaccatacagattggcacctaacgcccaggtacccatcttgttagcagtcct

SEQ ID NO: 64234 - DNA, 75 bp, Artificial Sequence
  Synthetic
aacaccgacagtctcagacctggaatgcaaaattacggagtgtacttatgcctccgatttcggtggtatagccac

SEQ ID NO: 64235 - DNA, 75 bp, Artificial Sequence
  Synthetic
atgctgcgtgaaaccaaccagagcagatgatactttgcaggtcctaaattatctgtggaataacaaccagaactt

SEQ ID NO: 64236 - DNA, 75 bp, Artificial Sequence
  Synthetic
cttttggatgcagacccttataccactggcagctttgatagtgtgcatgcgcatgttgcgctgcttgctatgctg

SEQ ID NO: 64237 - DNA, 75 bp, Artificial Sequence
  Synthetic
ggaaactgtccaattcattctccatcaggtgttgcagttattaaagagaatgacgtcacccttgctgagagcgga

SEQ ID NO: 64238 - DNA, 75 bp, Artificial Sequence
  Synthetic
cggtccggcttttttacttgtctgcggcgccttgggcgccgcagcatacgaacacgcagcagtgatgccgaacaa

SEQ ID NO: 64239 - DNA, 75 bp, Artificial Sequence
  Synthetic
tcatttacattccacttctccactgcaaacatccatcctgcttttaagctgcaggtctgcaccagtgcagttacc

SEQ ID NO: 64240 - DNA, 75 bp, Artificial Sequence
  Synthetic
ggtggggatcccctacaaagcgctggttgaacgcccgggctatgcaccagtccacctgcaaattcaattggtaac

SEQ ID NO: 64241 - DNA, 75 bp, Artificial Sequence
  Synthetic
actatcaaagactataacccgctaataaatgtggtacccctgaatagaagactcccacactcattggttgtcaca

SEQ ID NO: 64242 - DNA, 75 bp, Artificial Sequence
  Synthetic
aacgtggagtgtttcaaaaagtacgcctgtaacgatgagtactgggacttctacaagacaaacccgataagactc

SEQ ID NO: 64243 - DNA, 75 bp, Artificial Sequence
  Synthetic
actcccacactcattggttgtcacacatagatacactgggaacggtgattactcccagctagtgaccaagatgac

SEQ ID NO: 64244 - DNA, 75 bp, Artificial Sequence
  Synthetic
cctgtaacgatgagtactgggacttctacaagacaaacccgataagactcaccgcagaaaatgttactcagtatg

SEQ ID NO: 64245 - DNA, 75 bp, Artificial Sequence
  Synthetic
actcccagctagtgaccaagatgaccggaaaaaccgtactagtagtgggtacacctatgaacataccaggaaaga

SEQ ID NO: 64246 - DNA, 75 bp, Artificial Sequence
  Synthetic
gcgatatccgccaccgcgtggtcgtggctaaaagtgctggtaggaggaacatcagcatttattgttctggggctt

SEQ ID NO: 64247 - DNA, 75 bp, Artificial Sequence
  Synthetic
tactaaaatcatcccgtcagcgaatctggaatatatcacctgcaagtataaaaccaaggtgccctctcctgtagt

SEQ ID NO: 64248 - DNA, 75 bp, Artificial Sequence
  Synthetic
caaatgctgcggctccacccagtgctcagcaaaatcactccctgactaccaatgtcaagtgttcacaggggtcta

SEQ ID NO: 64249 - DNA, 75 bp, Artificial Sequence
  Synthetic
cccatttatgtggggaggagcctattgcttctgcgataccgaaaatacgcagatgagcgaagtgtacattgaacg

SEQ ID NO: 64250 - DNA, 75 bp, Artificial Sequence
  Synthetic
tgcaaaggagattgcaagccaccgaaagatcatatcgtcgattatccagcacaacataccgaatcctttacgtcg

SEQ ID NO: 64251 - DNA, 75 bp, Artificial Sequence
  Synthetic
gacctgggcattcctgccgctttaggcaaatatgacatcatttttattaacgtgaggactccctaccgacaccac

SEQ ID NO: 64252 - DNA, 75 bp, Artificial Sequence
  Synthetic
cgccgaggaatgttcagtcgaccaggctaaggcatacaaggtgcacactggcacagtgcaggcggtggtcaacat

SEQ ID NO: 64253 - DNA, 75 bp, Artificial Sequence
  Synthetic
aacactaagggcagtgcataatgctgctcctaagtaattttatacacactttataatcaggcataattgccgtat

SEQ ID NO: 64254 - DNA, 75 bp, Artificial Sequence
  Synthetic
gatgcagacgcttatcccacttgcagcgcttatcgtatgcatgcgcatgctgcgttgcttattttgctgtgggcc

SEQ ID NO: 64255 - DNA, 75 bp, Artificial Sequence
  Synthetic
cacctacgggagcgtcagctggcgatcggctgacgtttacgtcaacggtgaaacacctgcaaagatcggcgatgc

SEQ ID NO: 64256 - DNA, 75 bp, Artificial Sequence
  Synthetic
caaattaactataggacctttgtcctccgcctggtctccgttcgactcaaaggttgtagtgtatgggcacgaggt

SEQ ID NO: 64257 - DNA, 75 bp, Artificial Sequence
  Synthetic
caggccagtgggtagagagaaataccgtcacccacctgaacatggagttgaattaccgtgtgaccgttacaccca

SEQ ID NO: 64258 - DNA, 75 bp, Artificial Sequence
  Synthetic
gctcctaagtaattttatacacactttataatcaggcataattgccgtatatacaattacactacaggtaatata

SEQ ID NO: 64259 - DNA, 75 bp, Artificial Sequence
  Synthetic
gtataattatgactttccagaatacggcacaggaaaagccggttcttttggtgatctgcaatccagaacactcac

SEQ ID NO: 64260 - DNA, 75 bp, Artificial Sequence
  Synthetic
acaaaatcatattaaatttttcttttatgtttttattttgtttttaatatttcaaaaaaaaaaaaaaaaaaaaaa

SEQ ID NO: 64261 - DNA, 75 bp, Artificial Sequence
  Synthetic
tagaggcaaccaccctatttccacctatccaaaatggagaaagttcatgttgacttagacgcagacagcccattc

SEQ ID NO: 64262 - DNA, 75 bp, Artificial Sequence
  Synthetic
cagtaacgacttgtacgccaacacaaacctgaagttgcaacgaccacaaccaggagtagtccatacgccttatac

SEQ ID NO: 64263 - DNA, 75 bp, Artificial Sequence
  Synthetic
ccaggcgccatccgggttcgaacgctggaagaaagaccggggagctcctttgaatgacatcgctccctttgggtg

SEQ ID NO: 64264 - DNA, 75 bp, Artificial Sequence
  Synthetic
gctagggcgttttcgcacctagctactaagctcattgagggagaagtggatacagaccaggtgatcctggatatt

SEQ ID NO: 64265 - DNA, 75 bp, Artificial Sequence
  Synthetic
cgacgacaacatcgtgaaaggggttacatctgacgcgctgatggcagagcggtgcgccacgtggttgaacatgga

SEQ ID NO: 64266 - DNA, 75 bp, Artificial Sequence
  Synthetic
cacgatagctttagacccactgcgagcggagaactgcgctgtgggcaacatccccctttctatagacatcccgga

SEQ ID NO: 64267 - DNA, 75 bp, Artificial Sequence
  Synthetic
gggagcgcgcctgtaaggcacacgcattccaaacataagtaccactgtatttgcccaatgaagagcgcagaagac

SEQ ID NO: 64268 - DNA, 75 bp, Artificial Sequence
  Synthetic
gcgaggcgtatgtagagcgctcggaagagtgctctatcgaccacgcaaaagcttataaagtacacacaggcactg

SEQ ID NO: 64269 - DNA, 75 bp, Artificial Sequence
  Synthetic
cctaatttttctcggctatcagaaaacgaaggagaccagaaattgtctgaagtgtacatggacattgccagaatt

SEQ ID NO: 64270 - DNA, 75 bp, Artificial Sequence
  Synthetic
acaccttgcaagtgctgaattacctgtggaacaacaatcaaaactttttctggatgcagacgcttatcccacttg

SEQ ID NO: 64271 - DNA, 75 bp, Artificial Sequence
  Synthetic
tgccgcatttaccaggatcgcagagacgcccactgtgtccgacctggaatgcaaggttactgaatgcacatatgc

SEQ ID NO: 64272 - DNA, 75 bp, Artificial Sequence
  Synthetic
atccgacttcgggggaattgccactatcagctataaggcaagcaaagcaggtaactgccccattcactccccgtc

SEQ ID NO: 64273 - DNA, 75 bp, Artificial Sequence
  Synthetic
gcttataaagtacacacaggcactgttcaggcaatggtgaacataacttatgggagcgtcagctggagatctgca

SEQ ID NO: 64274 - DNA, 75 bp, Artificial Sequence
  Synthetic
aggcattgcagtaatcaaagaaaacgatgttacactggcagacagcggtgccttcacgtttcacttttccacagc

SEQ ID NO: 64275 - DNA, 75 bp, Artificial Sequence
  Synthetic
ttacagccatggatactaccgacgcagacattactatttactgtctagataagcaatgggagtcaagaataaagg

SEQ ID NO: 64276 - DNA, 75 bp, Artificial Sequence
  Synthetic
cagcatccacccggcatttaaaatgcaggtgtgtactagcgtagttacctgcaaaggtgactgtaagccaccaaa

SEQ ID NO: 64277 - DNA, 75 bp, Artificial Sequence
  Synthetic
ggcaaagcaggctcttttggagacctgcaatcacgcacatcaaccagcaacgatctgtacgcaaataccaacttg

SEQ ID NO: 64278 - DNA, 75 bp, Artificial Sequence
  Synthetic
ggaccacattgtcgattacccggcccaacatacagaaacgtacacatcagcagtatcggcaaccgcttggtcatg

SEQ ID NO: 64279 - DNA, 75 bp, Artificial Sequence
  Synthetic
gctgaaagtgctagtgggaagcacatcagcatttatcgtgctggggttgattgctactgcagtggtcgccctggt

SEQ ID NO: 64280 - DNA, 75 bp, Artificial Sequence
  Synthetic
aaagtgctggtaggaggaacatcagcatttattgttctggggcttattgctacagcagtggttgccctagttctg

SEQ ID NO: 64281 - DNA, 75 bp, Artificial Sequence
  Synthetic
actatttacccacagacactaacgtactatcatatcatatatcatcatggttcgacgtacttccgagccacgatg

SEQ ID NO: 64282 - DNA, 75 bp, Artificial Sequence
  Synthetic
acggtggtgcataatgccacctgcgcagtgcataatgctgcgacttataggtagtacgctaccctttataacact

SEQ ID NO: 64283 - DNA, 75 bp, Artificial Sequence
  Synthetic
actggcagtgcataatgctgccttttataaaaacactactggcggcgcataatgctgccttttataacactactg

SEQ ID NO: 64284 - DNA, 75 bp, Artificial Sequence
  Synthetic
ttacggagtgtacttatgcctccgatttcggtggtatagccaccgttgcctacaaatccagcaaagcaggaaact

SEQ ID NO: 64285 - DNA, 75 bp, Artificial Sequence
  Synthetic
gcagttacaacgctgccttttataaacttttacaacactactggcggcgcataatgctgccttttataaaatctt

SEQ ID NO: 64286 - DNA, 75 bp, Artificial Sequence
  Synthetic
ccgagagggattcttaagttgcaaggttacagatacgttaagaggggagagggtctcttttcccgtgtgtacgta

SEQ ID NO: 64287 - DNA, 75 bp, Artificial Sequence
  Synthetic
tgctgccttttataaaatctttaaaattcatatacaattttttcttttatgtttttattttgtttttaatatttc

SEQ ID NO: 64288 - DNA, 75 bp, Artificial Sequence
  Synthetic
tgcaccagtgcagttacctgcaaaggagattgcaagccaccgaaagatcatatcgtcgattatccagcacaacat

SEQ ID NO: 64289 - DNA, 75 bp, Artificial Sequence
  Synthetic
atcgaccaacggatcgacgaccagtatacaatcactgggggaggatcaaagcgcatctgcttctagcggagctga

SEQ ID NO: 64290 - DNA, 75 bp, Artificial Sequence
  Synthetic
aggggtacgggaacgttccctagtcatgggctgctgctgggctttcaaaactcacaagatcacatccatttacaa

SEQ ID NO: 64291 - DNA, 75 bp, Artificial Sequence
  Synthetic
taccacgaggggtcggtggaaagggcgacagcgggagacctattcttgacaacaaaggtagagtcgtcgcaattg

SEQ ID NO: 64292 - DNA, 75 bp, Artificial Sequence
  Synthetic
tcgatgtgcgtacctcgtcatcgttgagtctagagcagcctaactttccgacaatggttgtcgaagcagagattc

SEQ ID NO: 64293 - DNA, 75 bp, Artificial Sequence
  Synthetic
gagacctgggactcaaactatcaagaaggtgcccgccgtattcaattcctttgtcatcccacaaccaaccagcta

SEQ ID NO: 64294 - DNA, 75 bp, Artificial Sequence
  Synthetic
tcgcctgagatggccttaaactttttctgcaccagattctttggtgtcgacatcgacagcgggttgttctccgcg

SEQ ID NO: 64295 - DNA, 75 bp, Artificial Sequence
  Synthetic
atggtcgctcgccactgtcatgtgcgtcctggccaatatcacgtttccatgtgatcaaccaccctgcatgccatg

SEQ ID NO: 64296 - DNA, 75 bp, Artificial Sequence
  Synthetic
agaaggcacccgctccaattattactgaggccgacgttgcacaccttaaaggcctgcaggatgaagctgaagccg

SEQ ID NO: 64297 - DNA, 75 bp, Artificial Sequence
  Synthetic
atgcagtgcatgcaccgacttccatctactatcaggcgctgaaaggcgtacgaactatctattggatcgggttcg

SEQ ID NO: 64298 - DNA, 75 bp, Artificial Sequence
  Synthetic
ccatagtatttaacgaacgggagttcgttaaccgttacttacaccacattgccgttaacggaggggcactgaata

SEQ ID NO: 64299 - DNA, 75 bp, Artificial Sequence
  Synthetic
cttgagacaccagctagcagtgacgttttccaaaataaagtgaacgtctgctgggccaaagcgctagaacctgtg

SEQ ID NO: 64300 - DNA, 75 bp, Artificial Sequence
  Synthetic
cagatgaagagtactacaaggttgtgaaaagcactgagacagactctgagtacgtatttgacatcgacgcaaaga

SEQ ID NO: 64301 - DNA, 75 bp, Artificial Sequence
  Synthetic
ggatctgaaacccgcgttccgtcacctccaagtcagggtagcagacattccaccccatctgtaagtgcttcacac

SEQ ID NO: 64302 - DNA, 75 bp, Artificial Sequence
  Synthetic
atggggtaaaacactccgtcgacacactgtacatagacgaggcattcgcttgccatgcagggaccctgctagcac

SEQ ID NO: 64303 - DNA, 75 bp, Artificial Sequence
  Synthetic
tgacccttggatcaagacgttgacagcatcgtatccgggtaatttcaccgccacattggaagaatggcaagctga

SEQ ID NO: 64304 - DNA, 75 bp, Artificial Sequence
  Synthetic
tgacatggtggacggagcatcctgctgtttagatactgccactttttgcccagctaaattgaggagctttccaaa

SEQ ID NO: 64305 - DNA, 75 bp, Artificial Sequence
  Synthetic
tcgcctgagatggccttaaactttttctgcaccagattctttggcgtcgacatcgacagtgggttgttctccgca

SEQ ID NO: 64306 - DNA, 75 bp, Artificial Sequence
  Synthetic
ggaccatccgaccttgctgacgaccaggtcacttggaagtgatgcaaatccaactcgacaatggattgagcgacc

SEQ ID NO: 64307 - DNA, 75 bp, Artificial Sequence
  Synthetic
aagcgaggacgatgctatcgccatgtccgctctaatgattcttgaagacctaggagttgatcaggcactgttaaa

SEQ ID NO: 64308 - DNA, 75 bp, Artificial Sequence
  Synthetic
agttgaattaccatgcaaccgttacactcacaagcgtgcagaccaaggacactacgttgagatgcatcaacccgg

SEQ ID NO: 64309 - DNA, 75 bp, Artificial Sequence
  Synthetic
gactttggccggtgacccttggatcaagacgttgacagcatcgtatccgggtaatttcaccgccacactggaaga

SEQ ID NO: 64310 - DNA, 75 bp, Artificial Sequence
  Synthetic
atggcaagctgagcatgacgctatcatggcgaaaatacttgagacaccagctagcagcgacgttttccaaaataa

SEQ ID NO: 64311 - DNA, 75 bp, Artificial Sequence
  Synthetic
cctaggcgacctgcaccgcctgtgcccgtacctgcaagaatccccagccctccatgtacatctatcaacggatcg

SEQ ID NO: 64312 - DNA, 75 bp, Artificial Sequence
  Synthetic
ctagcagcgacgttttccaaaataaagtgaacgtctgctgggccaaagcgctagaacctgtgttggccaccgcca

SEQ ID NO: 64313 - DNA, 75 bp, Artificial Sequence
  Synthetic
agtgaacgtctgctgggccaaagcgctagaacctgtgttggccaccgccaatattacgctgacccgctcgcagtg

SEQ ID NO: 64314 - DNA, 75 bp, Artificial Sequence
  Synthetic
gtctattactacaacaggtacccgttaaccacaattatcggattatgcacctgtgtggctatcattatggtctct

SEQ ID NO: 64315 - DNA, 75 bp, Artificial Sequence
  Synthetic
ctagaacctgtgttggccaccgccaatattacgctgacccgctcgcagtgggagaccattccagcgttcaaggat

SEQ ID NO: 64316 - DNA, 75 bp, Artificial Sequence
  Synthetic
ctttggcgtcgacatcgacagcgggttgttctccgcgccaactgttccgctgacttacaccaatgaacactggga

SEQ ID NO: 64317 - DNA, 75 bp, Artificial Sequence
  Synthetic
ttgttctccgcgccaactgttccgctgacttacaccaatgaacactgggataatagcccaggtccaaacatgtat

SEQ ID NO: 64318 - DNA, 75 bp, Artificial Sequence
  Synthetic
aacttgcacgtcggtatccttgtattctgaaagccgtggatacaggtagagtggctgacgttcgcacagacacta

SEQ ID NO: 64319 - DNA, 75 bp, Artificial Sequence
  Synthetic
tgttacgcagctggcatctacctaatgtctttcatctaaaaggtaaaactagctttacaggtagatgtaatacca

SEQ ID NO: 64320 - DNA, 75 bp, Artificial Sequence
  Synthetic
acaaggtggtggtttatgggcatgaagtgtataattacgactttcctgagtacggcaccggcaaagcaggctctt

SEQ ID NO: 64321 - DNA, 75 bp, Artificial Sequence
  Synthetic
aatgtcactcaaatgagggaacttccagtgttggattcagctgccttcaacgtggagtgtttcaaaaagtacgcc

SEQ ID NO: 64322 - DNA, 75 bp, Artificial Sequence
  Synthetic
atcggctcgtacgcagtgctttcgccacaagcggtccttaacagcgagaagctcgcttgtatccacccgttagct

SEQ ID NO: 64323 - DNA, 75 bp, Artificial Sequence
  Synthetic
acaacggcaaccatctccaagatcaagataggctgagtgttgtgctaaacaacatataccaagggtcaactcaac

SEQ ID NO: 64324 - DNA, 75 bp, Artificial Sequence
  Synthetic
agcgttcaaggatgacaaagcgtattctcctgagatggccttaaactttttctgcaccagattctttggcgtcga

SEQ ID NO: 64325 - DNA, 75 bp, Artificial Sequence
  Synthetic
catcgacagcgggttgttctctgcgccaactgttccgctgacttataccaacgaacactgggataatagcccagg

SEQ ID NO: 64326 - DNA, 75 bp, Artificial Sequence
  Synthetic
cattccgttgttatctaccggcatctacgcaggtggtaaggacagggttatgcaatcgctgaaccatttatttac

SEQ ID NO: 64327 - DNA, 75 bp, Artificial Sequence
  Synthetic
tacgcaggtggtaaggacagggttatgcaatcgctgaaccatttatttacagccatggatactaccgacgcagac

SEQ ID NO: 64328 - DNA, 75 bp, Artificial Sequence
  Synthetic
cctggagcttttgataagcagccggtagcaactggtaaagcgcaccttgttaaacattctccgaacgtcatccat

SEQ ID NO: 64329 - DNA, 75 bp, Artificial Sequence
  Synthetic
ctttataatcaggcataattgccgtatatacaattacactacaggtaatataccgcctcttataaacactacagg

SEQ ID NO: 64330 - DNA, 75 bp, Artificial Sequence
  Synthetic
taaagtaatattttctgtggggtcaactatttatactgaagagagaatactgttacgcagctggcatctacctaa

SEQ ID NO: 64331 - DNA, 75 bp, Artificial Sequence
  Synthetic
ctacaggtaatataccgcctcttataaacactacaggcagcgcataatgctgtcttttatatcaatttacaaaat

SEQ ID NO: 64332 - DNA, 75 bp, Artificial Sequence
  Synthetic
ctaacaagcaagaagcaaacgagcagatttgcttatacgtgttgggagagagtatgaacagcatccgctctaagt

SEQ ID NO: 64333 - DNA, 75 bp, Artificial Sequence
  Synthetic
tgcagaattacctattaccagtggtagcccaggcgttctcgcggtgggcgcgggaacaccgcgcagacctggagg

SEQ ID NO: 64334 - DNA, 75 bp, Artificial Sequence
  Synthetic
ttccccccctcacaccatcccgtgtctgtgcaactatgcaatgactgcagagcgagtttacagattacgtatggc

SEQ ID NO: 64335 - DNA, 75 bp, Artificial Sequence
  Synthetic
gtttcgctatggagcatacccagcgctactgggttcgatgtgcgaaccacctcatcgttgagtctagagcagcct

SEQ ID NO: 64336 - DNA, 75 bp, Artificial Sequence
  Synthetic
taaaaacacgtcctgctgcaccacacaaagtgcctaccatcggagtctatggagtcccaggttccggaaagtctg

SEQ ID NO: 64337 - DNA, 75 bp, Artificial Sequence
  Synthetic
aaagaatgaacaattcgcagtttgttcgtcctttcagttaccgaaatacaggattacaggggttcagaaaattca

SEQ ID NO: 64338 - DNA, 75 bp, Artificial Sequence
  Synthetic
cgtagagtgtttcaaaaagtacgcctgtaacgatgaatactgggacttctacaagacaaacccaataagactcac

SEQ ID NO: 64339 - DNA, 75 bp, Artificial Sequence
  Synthetic
cttacagccattgcatgagataccaatggatagatttgtgatggaccttaaacgggatgtcaaggtcacacccgg

SEQ ID NO: 64340 - DNA, 75 bp, Artificial Sequence
  Synthetic
tggttgtcgaagcagagattcacgccagtcaaggatcactgtggagcatacccagtatcaccggatctgaaaccc

SEQ ID NO: 64341 - DNA, 75 bp, Artificial Sequence
  Synthetic
cccagtatcaccggatctgaaacccgtgctccgtcacctccaagtcaggatagtagaccttccaccccatctgca

SEQ ID NO: 64342 - DNA, 75 bp, Artificial Sequence
  Synthetic
tacaaaatcatattaatttttttttttttttttttttttttttttaatatttcaaaaaaaaaaaaaaaaaaaaaa

SEQ ID NO: 64343 - DNA, 75 bp, Artificial Sequence
  Synthetic
ccacgctggcaccggagcctctagttgagcacaaacaccgcaccctgattttacacctgcacccggaccatccga

SEQ ID NO: 64344 - DNA, 75 bp, Artificial Sequence
  Synthetic
tagtagaccttccaccccatctgcaagtggttcacacacgtccgtggacttaatcacgtttgacagcgttgcaga

SEQ ID NO: 64345 - DNA, 75 bp, Artificial Sequence
  Synthetic
aagactcccacactcgttggtcgtcacacatagatacactgggaacggtgattactcccagctagtgaccaagat

SEQ ID NO: 64346 - DNA, 75 bp, Artificial Sequence
  Synthetic
gagccgcagcgcagacacgatcaaaccgattccaaagccgcgtaaaagccaggtgaagtacacgcagccacctgg

SEQ ID NO: 64347 - DNA, 75 bp, Artificial Sequence
  Synthetic
caaactccagtatccaatcctggagcgttccgtccatgagaaattttacgccccgcgcctcgatctcgagcgtga

SEQ ID NO: 64348 - DNA, 75 bp, Artificial Sequence
  Synthetic
agcagcagccacaaaacggaattgcaatgttactcaaatgagggaactcccagtgttggattcagctgccttcaa

SEQ ID NO: 64349 - DNA, 75 bp, Artificial Sequence
  Synthetic
ggccgtcaaagtctgcaacctagtactgcaagagaattttcccaccgtagccagctataacataacggatgagta

SEQ ID NO: 64350 - DNA, 75 bp, Artificial Sequence
  Synthetic
ccagctataacataacggatgagtatgatgcctatcttgatatggtggacggagcatcctgctgtttagatactg

SEQ ID NO: 64351 - DNA, 75 bp, Artificial Sequence
  Synthetic
ggagcatcctgctgtttagatactgccaccttttgcccagccaaattaaggagctttccaaagaagcacagttat

SEQ ID NO: 64352 - DNA, 75 bp, Artificial Sequence
  Synthetic
tgttggccaccgccaatattacgctgacccgctcgcagtgggagactattccagcgttcaaggatgacaaagcgt

SEQ ID NO: 64353 - DNA, 75 bp, Artificial Sequence
  Synthetic
gataagactcaccgcagaaaatgttactcagtatgttactaagttaaagggacccaaagcagctgccctttttgc

SEQ ID NO: 64354 - DNA, 75 bp, Artificial Sequence
  Synthetic
ggtaatataccgcctcttataaacactacaggcagcgcataatgctgtcttttatatcaatttacaaaatcatat

SEQ ID NO: 64355 - DNA, 75 bp, Artificial Sequence
  Synthetic
ctctaatgattcttgaagacctaggagttgatcaggcactgttaaacctaattgaagcagcctttgggaacataa

SEQ ID NO: 64356 - DNA, 75 bp, Artificial Sequence
  Synthetic
gcccgtacctgcaagaatccccagccctccatgtacatcgaccaacggatcgacgaccagtatacaatcactggg

SEQ ID NO: 64357 - DNA, 75 bp, Artificial Sequence
  Synthetic
tgcagtagtcggagtaaaggcaccgtacttttgcggagggttcatcgtagtcgatcagatcacaggaactgcgtg

SEQ ID NO: 64358 - DNA, 75 bp, Artificial Sequence
  Synthetic
gaataaaggaagctatcactcggaaggaaagcgttgaagagcttaccgaggatgacagacccgttgatattgaac

SEQ ID NO: 64359 - DNA, 75 bp, Artificial Sequence
  Synthetic
taatgctgtcttttatatcaatttacaaaatcatattaattttcttttatgtttttattttgtttttaatatttc

SEQ ID NO: 64360 - DNA, 75 bp, Artificial Sequence
  Synthetic
ataaccctctacggctgacctaaataggttgtgcattagtacctaacctatttatattatattgctatctaaata

SEQ ID NO: 64361 - DNA, 75 bp, Artificial Sequence
  Synthetic
tgttacgcagttggcatctacctaatgtttttcatctaaaaggtaaaactagctttacaggcagatgtaatacta

SEQ ID NO: 64362 - DNA, 75 bp, Artificial Sequence
  Synthetic
cgcgtacattttctcatccgaaacgggacaagggcacctgcaacaaaaatctacacggcaatgcaaactccagta

SEQ ID NO: 64363 - DNA, 75 bp, Artificial Sequence
  Synthetic
cctttaggccaccacttgcagctcaaattgaggacctgagacgttccattgctaacctgactttgaaacaacgag

SEQ ID NO: 64364 - DNA, 75 bp, Artificial Sequence
  Synthetic
cacctaaccctccagcaggaccgcccgccaaacgcaagaagcctgcgcccaagcctaagcctgcgcaggcgaaaa

SEQ ID NO: 64365 - DNA, 75 bp, Artificial Sequence
  Synthetic
gggctagttgccgaccactctctccttagcatccacagtgccaaggtgaaaattacggtaccgagcggcgcccaa

SEQ ID NO: 64366 - DNA, 75 bp, Artificial Sequence
  Synthetic
agaagcgaccaccaccacctgccaagaaacaaaaacgtaaacctaaaccaggcaaacgacagcgaatgtgtatga

SEQ ID NO: 64367 - DNA, 75 bp, Artificial Sequence
  Synthetic
ggcaaacgacagcgaatgtgtatgaagctagagtcagataaaacgtttccgatcatgttgaacggacaggtgaat

SEQ ID NO: 64368 - DNA, 75 bp, Artificial Sequence
  Synthetic
agctagagtcagataaaacgtttccgatcatgttgaacggacaggtgaatggttacgcgtgcgtcgtgggtggac

SEQ ID NO: 64369 - DNA, 75 bp, Artificial Sequence
  Synthetic
gagtgtttaaaccgctgcacgtagaaggcagaatagacaatgagcaactggccgctatcaagctgaagaaggcca

SEQ ID NO: 64370 - DNA, 75 bp, Artificial Sequence
  Synthetic
aggcagaatagacaatgagcaactggccgctatcaagctgaagaaggccagcatatatgaccttgagtacggtga

SEQ ID NO: 64371 - DNA, 75 bp, Artificial Sequence
  Synthetic
accctccagtacaccagtgacaagcctcctggcttttataactggcatcatggagctgtgcagtatgagaacaac

SEQ ID NO: 64372 - DNA, 75 bp, Artificial Sequence
  Synthetic
tattcttgacaacaaaggtagagtcgtcgcaattgtcctgggtggagtcaacgaaggatccaggacggctctatc

SEQ ID NO: 64373 - DNA, 75 bp, Artificial Sequence
  Synthetic
gcatgccatgctgttatgaaaagaatccacacgaaacactcaccatgctggaacagaattacgacagccgagcct

SEQ ID NO: 64374 - DNA, 75 bp, Artificial Sequence
  Synthetic
atgatcagctgctcgatgccgctgtgaaatgtaatgctaggagaaccaggagagatttggacactcatttcaccc

SEQ ID NO: 64375 - DNA, 75 bp, Artificial Sequence
  Synthetic
cagaagaccctgacagactctaccgctatgcagacaagcttagaaagagtgatgtcactgacaaatatattgcct

SEQ ID NO: 64376 - DNA, 75 bp, Artificial Sequence
  Synthetic
agtataagttggcacgcccgtatattgctgattgccctaactgtgggcatagtcggtgcgacagccctatagcta

SEQ ID NO: 64377 - DNA, 75 bp, Artificial Sequence
  Synthetic
tgctgattgccctaactgtgggcatagtcggtgcgacagccctatagctatagaagaagtcagaggggatgcgca

SEQ ID NO: 64378 - DNA, 75 bp, Artificial Sequence
  Synthetic
ggagattgcaagccaccgaaagatcatatcgtcgattatccagcacaacataccgagtcctttacatcggcgata

SEQ ID NO: 64379 - DNA, 75 bp, Artificial Sequence
  Synthetic
ttgtctgaaatcaaacctattcctgcacctcgtacccgagttactaacatgagccgcagcgcagacacgatcaaa

SEQ ID NO: 64380 - DNA, 75 bp, Artificial Sequence
  Synthetic
gcctaaccgccatacgtgcacagttgcccataaggtagaattcaggccagtgggtagagagaaataccgtcaccc

SEQ ID NO: 64381 - DNA, 75 bp, Artificial Sequence
  Synthetic
gcccataaggtagaattcaggccagtgggtagagagaaataccgtcacccacctgaacatggagttgaattaccg

SEQ ID NO: 64382 - DNA, 75 bp, Artificial Sequence
  Synthetic
tgtaaccgttacactcacaagcgtgcagaccaaggacactatgttgagatgcatcaaccagggctagttgccgac

SEQ ID NO: 64383 - DNA, 75 bp, Artificial Sequence
  Synthetic
tgctatattaccaaattataacactaagggcagtgcataatgctgctcctaagtaattttttttacacactttat

SEQ ID NO: 64384 - DNA, 75 bp, Artificial Sequence
  Synthetic
cactctctccttagcatccacagtgccaaggtgaaaattacggtaccgagcggcgcccaagtgaaatactactgc

SEQ ID NO: 64385 - DNA, 75 bp, Artificial Sequence
  Synthetic
gtgtagaggcaaccaccctatttccacctatccaaaatggagaaagttcatgttgacttagacgcagacagccca

SEQ ID NO: 64386 - DNA, 75 bp, Artificial Sequence
  Synthetic
gaacatccacactttgtttgacatgtctgcagaagattttgatgctatcattgccgaacacttccaattcggcga

SEQ ID NO: 64387 - DNA, 75 bp, Artificial Sequence
  Synthetic
ctgttaaggccaagtgcatcgccacgctggcaccggagcctctagttgagcacaaacaccgcaccctgattttac

SEQ ID NO: 64388 - DNA, 75 bp, Artificial Sequence
  Synthetic
atagggtacggtgtagaggcaaccaccctatttttcacctatccaaaatggagaaagttcatgttgacttagacg

SEQ ID NO: 64389 - DNA, 75 bp, Artificial Sequence
  Synthetic
accatacaaccacctgcacggatgtcaaacaatgcagggcttacctgattgacaacaagaaatgggtgtacaact

SEQ ID NO: 64390 - DNA, 75 bp, Artificial Sequence
  Synthetic
gccccgaacgctcaagtcccaatactcctggcgttactttgctgcattaagccgacgagggcagacgacaccttg

SEQ ID NO: 64391 - DNA, 75 bp, Artificial Sequence
  Synthetic
caagtgctgaattatctgtggaacaacaatcaaaactttttctggatgcagacgcttatcccacttgcagcgctt

SEQ ID NO: 64392 - DNA, 75 bp, Artificial Sequence
  Synthetic
tttacttgtctgcggcgccttgggcgccgcagcgtacgaacacacagcagtgatgccgaacaaggtggggatccc

SEQ ID NO: 64393 - DNA, 75 bp, Artificial Sequence
  Synthetic
ggtgcataatgccgccgatgcagtgcataaggctgctatattaccaaatataacactaagggcagtgcataatgc

SEQ ID NO: 64394 - DNA, 75 bp, Artificial Sequence
  Synthetic
atagggtatgctgtagaggcagccacccgacctatcctatccaaaatggagaaagtacacgtagacttagacgct

SEQ ID NO: 64395 - DNA, 75 bp, Artificial Sequence
  Synthetic
gacagcccatacgtcaagtcgttgcaaaagtgctttccgcattttgagatagaagccacgcaggtcactgacaat

SEQ ID NO: 64396 - DNA, 75 bp, Artificial Sequence
  Synthetic
gaccatgctaatgctagagcgttttcgcatctggctacaaaactcatcgaaagcgaagtggacccagaccaggtg

SEQ ID NO: 64397 - DNA, 75 bp, Artificial Sequence
  Synthetic
atcctggatattggaagcgcgcctgtccggcacacgcattccaaacacaagtaccactgtatctgcccaatgatc

SEQ ID NO: 64398 - DNA, 75 bp, Artificial Sequence
  Synthetic
agtgcagaagaccctgatcgactccatcgatatgcagataagctaagaaagagtgacgtaacagataggttcata

SEQ ID NO: 64399 - DNA, 75 bp, Artificial Sequence
  Synthetic
gcctccaaagctgcagatctactaacggtgatgtcaacaccggatgtagaaaccccgtcattatgcatgcacaca

SEQ ID NO: 64400 - DNA, 75 bp, Artificial Sequence
  Synthetic
cctgcaagaatccccagccctccatgtacaccgaccaacggatcgacgaccagtctacaatcactgggggaagat

SEQ ID NO: 64401 - DNA, 75 bp, Artificial Sequence
  Synthetic
gactccacttgtaggtaccatggtaccgttgccgtataccaagacgtatatgcagtgcatgcacctacctctatt

SEQ ID NO: 64402 - DNA, 75 bp, Artificial Sequence
  Synthetic
taccaccaagcactaaaaggagtgcgcaccatctactggatagggtttgacaccaccccattcatgtataaaaat

SEQ ID NO: 64403 - DNA, 75 bp, Artificial Sequence
  Synthetic
atggctggtgcgtatccgacttataacactaattgggctgacgaaagtgtgctagaggcaaggaacataggtctg

SEQ ID NO: 64404 - DNA, 75 bp, Artificial Sequence
  Synthetic
tgcagctcagacctccacgagcaacgatttggaaagatctcgatcatgaggaaaaagaaattgcaaccaaccaac

SEQ ID NO: 64405 - DNA, 75 bp, Artificial Sequence
  Synthetic
tcagacctggaatgcaaaattacggagtgtacttatgcctccgatttcggtggtatagccaccgttgcctacaaa

SEQ ID NO: 64406 - DNA, 75 bp, Artificial Sequence
  Synthetic
aaagtcgtgttttccgtcggttcgacgatttacaccgaggagagaatattattgcgcagctggcatctgccgaac

SEQ ID NO: 64407 - DNA, 75 bp, Artificial Sequence
  Synthetic
gttttccacctaaaagggaagacgagtttcacgggcagatgcaataccatcgtcagctgtgagggttacgttgta

SEQ ID NO: 64408 - DNA, 75 bp, Artificial Sequence
  Synthetic
caaccatagtatttaacgaacgggagttcgttaaccgttacttacaccacattgccgttaacggaggggcattga

SEQ ID NO: 64409 - DNA, 75 bp, Artificial Sequence
  Synthetic
aagaagattaccatcagtcccggtatttacgggaaagttgataatctcgcgtctaccatgcaccgcgagggattc

SEQ ID NO: 64410 - DNA, 75 bp, Artificial Sequence
  Synthetic
ttgagctgcaaggtgactgatacgctgcgcggggagagggtatcctttcccgtgtgcacgtacgtgcccgcgaca

SEQ ID NO: 64411 - DNA, 75 bp, Artificial Sequence
  Synthetic
agaagtgcgtgaagaaaggggatgccggaccaatgtgcctggtcggcgaattagtagacccgccattccacgaat

SEQ ID NO: 64412 - DNA, 75 bp, Artificial Sequence
  Synthetic
gttctggggcttattgctacagcagtggttgccctagttctgttcttccatagacattaacatcttgtcaaccac

SEQ ID NO: 64413 - DNA, 75 bp, Artificial Sequence
  Synthetic
tggttgccctagttctgttcttccatagacattaacatcttgtcaaccacataacactacaggcagtgtataagg

SEQ ID NO: 64414 - DNA, 75 bp, Artificial Sequence
  Synthetic
aaccagcgaatcgtcgtcaacggaagaacacaacgtaacactaatacaatgccaaactacctactacccatagtg

SEQ ID NO: 64415 - DNA, 75 bp, Artificial Sequence
  Synthetic
cctagttcgatgtacttccgagctatggtgacggtggtgcataatgccgccgatgcagtgcataaggctgctata

SEQ ID NO: 64416 - DNA, 75 bp, Artificial Sequence
  Synthetic
gctcaagcgttctccagatgggcgcgggaataccacgccgatctggaggacgagaaagatcttggggtgcgggaa

SEQ ID NO: 64417 - DNA, 75 bp, Artificial Sequence
  Synthetic
cgatgcagtgcataaggctgctatattaccaaattataacactaagggcagtgcataatgctgctcctaagtaat

SEQ ID NO: 64418 - DNA, 75 bp, Artificial Sequence
  Synthetic
cgctcccttgtaatgggctgctgttgggcttttaaaacacataaaataacctcaatctacaagaaaccaggtaca

SEQ ID NO: 64419 - DNA, 75 bp, Artificial Sequence
  Synthetic
cagaccaccaaaaaggtacctgcggtcttcaactcctttgtcgtcccgcagctaacaagctacggattagatatt

SEQ ID NO: 64420 - DNA, 75 bp, Artificial Sequence
  Synthetic
gaattacgcaggagaatcaaaatgcttctggaagagaagaagaagcccgcccctatcattaccgaagccgatgtg

SEQ ID NO: 64421 - DNA, 75 bp, Artificial Sequence
  Synthetic
tacaaaatcatattaatttttcttttatgtttttattttgtttttaatatttcaaaaaaaaaaaaaaaaaaaaaa

SEQ ID NO: 64422 - DNA, 75 bp, Artificial Sequence
  Synthetic
gcccaccttaaaggtatgcaagaagaagcggaggtagtggctgaagcagaagccatacgagcggctttaccgcca

SEQ ID NO: 64423 - DNA, 75 bp, Artificial Sequence
  Synthetic
tgaccatgctaatgctagggcgttttcgcacctagctactaagctcattgagggagaagtggatacagaccaggt

SEQ ID NO: 64424 - DNA, 75 bp, Artificial Sequence
  Synthetic
tggagtcccaggttctggaaagtctggtataatcaaaagcgctgttaccaagcgtgatctggtggtcagtgcaaa

SEQ ID NO: 64425 - DNA, 75 bp, Artificial Sequence
  Synthetic
ctgctgccagaagtggaaagagaaaccgttgaagcggacattgatttaataatgcaagaagcaggagcgggtagt

SEQ ID NO: 64426 - DNA, 75 bp, Artificial Sequence
  Synthetic
aaagacgtcaaacgcatgcgcggcatggacatcgccgcccgcacagtggattcagtgctgctaaatggggtaaaa

SEQ ID NO: 64427 - DNA, 75 bp, Artificial Sequence
  Synthetic
gtcgaaacgcccaggcgacacattaaagttactacctaccctggggaagaaatgattggatcatatgctgtgcta

SEQ ID NO: 64428 - DNA, 75 bp, Artificial Sequence
  Synthetic
gagcgcagaagaccctgacagactctaccgctacgcagacaagcttagaaaaagtgatgtcactgacaaatgtat

SEQ ID NO: 64429 - DNA, 75 bp, Artificial Sequence
  Synthetic
tcgccgcaggcagtccttaacagcgaaaagttggcttgcatccatccgctggccgaacaggtgctagttatgacc

SEQ ID NO: 64430 - DNA, 75 bp, Artificial Sequence
  Synthetic
cacaaagggcgcgccggtaggtacaaagtagaaccctaccatggccgcgtcattgtccctagtggtaccgctatt

SEQ ID NO: 64431 - DNA, 75 bp, Artificial Sequence
  Synthetic
atactacaccgttcatgtacaagaacatggcaggcgcctaccctacatacaacacaaattgggccgatgaaagtg

SEQ ID NO: 64432 - DNA, 75 bp, Artificial Sequence
  Synthetic
aacacaaattgggccgatgaaagtgtgttggaagccagaaatatagggctgggtagttcagacttgcacgaaaag

SEQ ID NO: 64433 - DNA, 75 bp, Artificial Sequence
  Synthetic
ccaattccggactttcaagcgttgagcgaaagtgcgactattgtctataacgaacgggagtttgtcaatcgttat

SEQ ID NO: 64434 - DNA, 75 bp, Artificial Sequence
  Synthetic
ggaagaagaaattacaacccactaataaagtaatattttctgtggggtcaactatttatactgaagagagaatac

SEQ ID NO: 64435 - DNA, 75 bp, Artificial Sequence
  Synthetic
cgggtaatttcaccgccacactggaagaatggcaagctgagcatgacgctatcatggcgaaaatacttgagacac

SEQ ID NO: 64436 - DNA, 75 bp, Artificial Sequence
  Synthetic
ttacatcacatcgccattaacggtggggctctaaacacagatgaagagtactacaaagtcctcagaagtggtgaa

SEQ ID NO: 64437 - DNA, 75 bp, Artificial Sequence
  Synthetic
tgtctttcatctaaaaggtaaaactagctttacaggcagatgtaacaccatcgtcagctgcgaaggttacgttgt

SEQ ID NO: 64438 - DNA, 75 bp, Artificial Sequence
  Synthetic
gcggaatcggagtacgtcttcgacatcgacgccaagaaatgtgtaaaaaaggcggaggcagggccaatgtgcctt

SEQ ID NO: 64439 - DNA, 75 bp, Artificial Sequence
  Synthetic
cttcgaccatgcaccgagagggattcttaagttgcaaggttacagacacgttaagaggggagagggtctctttcc

SEQ ID NO: 64440 - DNA, 75 bp, Artificial Sequence
  Synthetic
gttggtgatctagtggaccctccgttccatgagttcgcgtatgaaagtctgaagactcgccctgcagcaccacac

SEQ ID NO: 64441 - DNA, 75 bp, Artificial Sequence
  Synthetic
ccaatattacgctgacccgctcgcagtgggagactattccagcgttcaaggatgacaaagcgtattcgcctgaga

SEQ ID NO: 64442 - DNA, 75 bp, Artificial Sequence
  Synthetic
tgaagctacaacgaccccaggctggtattgtgcacacacctttcacccaggcgccttctggcttcgaacgatgga

SEQ ID NO: 64443 - DNA, 75 bp, Artificial Sequence
  Synthetic
aaggtacctaccatcggtgtctacggcgtcccaggctcaggtaaatcgggtatcatcaagagtgcagtcacgaag

SEQ ID NO: 64444 - DNA, 75 bp, Artificial Sequence
  Synthetic
cgggacctagtggtcagtgcaaagaaggaaaactgcacagagatcattaaagatgttaagcgtatgcgtggtatg

SEQ ID NO: 64445 - DNA, 75 bp, Artificial Sequence
  Synthetic
gtacggtgtagaggcaaccaccctatctccacctatccaaaatggagaaagttcatgttgacttagacgcagaca

SEQ ID NO: 64446 - DNA, 75 bp, Artificial Sequence
  Synthetic
gatgttgcggcccgtacggtggactccgtactattgaacggtgtcaaacatccggtggacacattgtacatcgat

SEQ ID NO: 64447 - DNA, 75 bp, Artificial Sequence
  Synthetic
tcaaccacataacactacaggcagtgtataaggctgtcttactcaacactaaatccaccctagttcgatgtactt

SEQ ID NO: 64448 - DNA, 75 bp, Artificial Sequence
  Synthetic
gaggcgttcgcatgccacgctgggacgctgcttgcacttattgccattgtgaaacctaagaaggtagtgctgtgc

SEQ ID NO: 64449 - DNA, 75 bp, Artificial Sequence
  Synthetic
ggtgacccgaagcagtgcggattcttcaacatgatgtgcctcaaggtgcacttcaaccatgaaatttgtaccgaa

SEQ ID NO: 64450 - DNA, 75 bp, Artificial Sequence
  Synthetic
cgtggagacacctagacgacacatcaaggtcacgacgtatccaggagaagaaatgatcggctcgtacgcagtgct

SEQ ID NO: 64451 - DNA, 75 bp, Artificial Sequence
  Synthetic
aaatgatcggctcgtacgcagtgctctcaccacaagcggtccttaacagcgagaagctagcttgcattcacccgt

SEQ ID NO: 64452 - DNA, 75 bp, Artificial Sequence
  Synthetic
gtgtaccacaagagtatctcacgcaggtgcacaagaacagtcacggcaatagtttctacactgttctatgacaaa

SEQ ID NO: 64453 - DNA, 75 bp, Artificial Sequence
  Synthetic
gtccaaacatgtatgggttgtgcatgcgcactgctaaagaacttgcacgtcggtatccttgtattctgaaagccg

SEQ ID NO: 64454 - DNA, 75 bp, Artificial Sequence
  Synthetic
cgaatgcgaacagtgaatccgtgcagcgataagatcatcatagataccacgagcactacgaagccgctgaaagat

SEQ ID NO: 64455 - DNA, 75 bp, Artificial Sequence
  Synthetic
gacatcatactgacgtgctttagggggtgggttaagcagctgcaaattgactataagaaccacgaaatcatgact

SEQ ID NO: 64456 - DNA, 75 bp, Artificial Sequence
  Synthetic
gctgccgcatcccaggggttgacccgtaaaggtgtgtacgcggtcagatataaggtcaacgaaaacccactttat

SEQ ID NO: 64457 - DNA, 75 bp, Artificial Sequence
  Synthetic
agtagtgggtacacctatgaacataccaggaaagagagtcgagacattaggcccaagcccacaatgtacatataa

SEQ ID NO: 64458 - DNA, 75 bp, Artificial Sequence
  Synthetic
tatctattggatcgggttcgatactacaccgttcatgtataagaacatggcaggcgcctaccctacatacaacac

SEQ ID NO: 64459 - DNA, 75 bp, Artificial Sequence
  Synthetic
agaagctgctggttgggctcaaccagcgaattgtcgtcaacggcagaacacaacgtaacaccaataccatgcaga

SEQ ID NO: 64460 - DNA, 75 bp, Artificial Sequence
  Synthetic
gcacagacgtccgaacacgtaaatgtccttttgacccgtaccgagaaacgcattgtctggaaaactcttgcaggc

SEQ ID NO: 64461 - DNA, 75 bp, Artificial Sequence
  Synthetic
ggagtcccaggttccggaaagtctggtataatcaaaagcgctgttaccaagcgtgatctggtggtcagtgcaaag

SEQ ID NO: 64462 - DNA, 75 bp, Artificial Sequence
  Synthetic
gtataatcaaaagcgctgttaccaagcgtgatctggtggtcagtgcaaagaaagaaaattgcatggaaatcatta

SEQ ID NO: 64463 - DNA, 75 bp, Artificial Sequence
  Synthetic
gatccttggataaagactttgacagctcactatccaggagagttctcggctactttggaggaatggcaggctgag

SEQ ID NO: 64464 - DNA, 75 bp, Artificial Sequence
  Synthetic
catgacgccatcatgaagcgagtgttagaaactcccgccaatagcgacgtttaccagaacaaagtacacgtatgc

SEQ ID NO: 64465 - DNA, 75 bp, Artificial Sequence
  Synthetic
gacaccagctagcagcgacgttttccaaaataaagtaaacgtctgctgggccaaagcgctagaacctgtgttggc

SEQ ID NO: 64466 - DNA, 75 bp, Artificial Sequence
  Synthetic
tgggcgaaggcactggaaccagtgttggctactgccaacattactctcactcgttcgcaatgggaaaccattcct

SEQ ID NO: 64467 - DNA, 75 bp, Artificial Sequence
  Synthetic
gctttcaaggacgacaaagccttttcaccagaaatggccctaaacttcctgtgcaccaggttctttggggtagac

SEQ ID NO: 64468 - DNA, 75 bp, Artificial Sequence
  Synthetic
attgatagcgggctgttctcagcgcctacagtgccattgacgtacaccaatgaacattgggataacagccctggt

SEQ ID NO: 64469 - DNA, 75 bp, Artificial Sequence
  Synthetic
cgatgcactaagacagtgacatccattgtttccaccctgttctatgataaacggatgagaactgtcaacccatgc

SEQ ID NO: 64470 - DNA, 75 bp, Artificial Sequence
  Synthetic
ccaaacaggtacggtctatgtatgcgcactgccaaggaactagcgcgacgttacccttgtatactaaaggccgtg

SEQ ID NO: 64471 - DNA, 75 bp, Artificial Sequence
  Synthetic
gacacagggcgcgttgcggatgtgcgcactaataccatcagagattacaaccctatgatcaacgtagtccctctg

SEQ ID NO: 64472 - DNA, 75 bp, Artificial Sequence
  Synthetic
aatcggcgacttccacattctctggtggtatcacatagatacactggcgacggtaattattcgcaactgctgtca

SEQ ID NO: 64473 - DNA, 75 bp, Artificial Sequence
  Synthetic
gtattacttacacgcacagaaaaacgtatagtatggaagactttggccggtgacccttggatcaagacgttgaca

SEQ ID NO: 64474 - DNA, 75 bp, Artificial Sequence
  Synthetic
gtatagtatggaagactttggccggtgacccttggatcaagacgttgacagcatcgtatccgggtaatttcaccg

SEQ ID NO: 64475 - DNA, 75 bp, Artificial Sequence
  Synthetic
aaattgaccggaaaaaccattctggtgatcggaacaccaatcaatgtcccaggcaaacgagtggagacactgggt

SEQ ID NO: 64476 - DNA, 75 bp, Artificial Sequence
  Synthetic
agacctggttattcaaccaccgagggcaaggtgtattcgtacctagaggggactaggtttcatcaaactgccaaa

SEQ ID NO: 64477 - DNA, 75 bp, Artificial Sequence
  Synthetic
ccgggccctcaatgcacatacaaagcagacctggaccttggcatccctagtatgatagggaaatatgacattata

SEQ ID NO: 64478 - DNA, 75 bp, Artificial Sequence
  Synthetic
cgccgtcggccctaatttttctcggctatcagaaaatgaaggagaccagaaattgtctgaagtgtacatgaacat

SEQ ID NO: 64479 - DNA, 75 bp, Artificial Sequence
  Synthetic
tttgtcaatgtacgaacaccgtacaaacatcaccactatcagcagtgtgaagaccatgcaattcaccatagcatg

SEQ ID NO: 64480 - DNA, 75 bp, Artificial Sequence
  Synthetic
cttaccaggaaagccgtcgaccacttgaacaaaggaggcacctgcgttgcactgggttatggcactgctgataga

SEQ ID NO: 64481 - DNA, 75 bp, Artificial Sequence
  Synthetic
gacaccatcaaagactataacccgctaataaatgtggtacccctgaatagaagactcccacactcattggttgtc

SEQ ID NO: 64482 - DNA, 75 bp, Artificial Sequence
  Synthetic
gcaactgaaaacattatctctgcagttgcacgctcctttagattttcacgtgtttgccagccgaaatgtgcctgg

SEQ ID NO: 64483 - DNA, 75 bp, Artificial Sequence
  Synthetic
agtgtttcaaaaaatacgcctgcaacgatgagtactgggacttctacaagacaaacccgataagactcaccgcag

SEQ ID NO: 64484 - DNA, 75 bp, Artificial Sequence
  Synthetic
tgttcgtcctttcagttaccgaaatacaggattacaggggttcagaaaattcaatgcagtaaacctgtgatattc

SEQ ID NO: 64485 - DNA, 75 bp, Artificial Sequence
  Synthetic
gagaatacggaggttgccttcgtattcttcggcaaggataatgggaaccacttacgcgatcaagatcaactaagt

SEQ ID NO: 64486 - DNA, 75 bp, Artificial Sequence
  Synthetic
ccaactgttccgctgacttacaccaatgaacactgggataatagcccaggtccaaacatgtatgggttgtgcatg

SEQ ID NO: 64487 - DNA, 75 bp, Artificial Sequence
  Synthetic
gtcgtgctgaacaacatctaccaaggttccacgcagtacgaagccggtcgtgcgccagcatacagagtcattcga

SEQ ID NO: 64488 - DNA, 75 bp, Artificial Sequence
  Synthetic
cctgaaaggttggtgcctaggcgacctgcaccgcctgtgcccgtacctgcaagaatccccagccctccatgtaca

SEQ ID NO: 64489 - DNA, 75 bp, Artificial Sequence
  Synthetic
ggagacatatctaaaagcacagacgaagtcattgttaacgcggcgaacaacaaaggacaacccggcgcaggggtc

SEQ ID NO: 64490 - DNA, 75 bp, Artificial Sequence
  Synthetic
tgcggggcactgtataagaaatggcccggagcttttgataaggcgccgatcgcgaccggcacagcacatttagta

SEQ ID NO: 64491 - DNA, 75 bp, Artificial Sequence
  Synthetic
atctctgtagaccaggtttcgctatggagcatacccagcgctactgggttcgatgtgcgtacctcctcatcgttg

SEQ ID NO: 64492 - DNA, 75 bp, Artificial Sequence
  Synthetic
aagcatacacccaatattatccacgcggtagggccgaatttttcccgcatgtcagaggtggaaggcaaccagaaa

SEQ ID NO: 64493 - DNA, 75 bp, Artificial Sequence
  Synthetic
tttttcggcaaggacaacggcaaccatctccaagatcaagataggctgagtgttgtgttaaacaacatataccaa

SEQ ID NO: 64494 - DNA, 75 bp, Artificial Sequence
  Synthetic
ctgtcagaagtttatatggatatcgctaaaatcattaataaggagcggtacaacaaggtgtcaataccattgcta

SEQ ID NO: 64495 - DNA, 75 bp, Artificial Sequence
  Synthetic
gggtcaactcaacatgaagctggcagagcacctgcgtatagagtggtgcgcggcgacataacaaagagcaatgat

SEQ ID NO: 64496 - DNA, 75 bp, Artificial Sequence
  Synthetic
atacccagtatcaccggatctgaaacccgcgttccgtcacctccaagtcaggatagtagaccttccaccccatct

SEQ ID NO: 64497 - DNA, 75 bp, Artificial Sequence
  Synthetic
gaggttattgttaacgcggcgaacaacaaagggcaacccggtggcggtgtgtgtggcgccctttacaggaagtgg

SEQ ID NO: 64498 - DNA, 75 bp, Artificial Sequence
  Synthetic
gcatctgtgacagtggaagacactccggtggtccaacctgaaagattggtgcctaggcgacctgcaccacctgtg

SEQ ID NO: 64499 - DNA, 75 bp, Artificial Sequence
  Synthetic
aggtgaatggttacgcgtgcgtcgtgggaggacgagtgtttaaaccgctgcacgtagaaggcagaatagacaatg

SEQ ID NO: 64500 - DNA, 75 bp, Artificial Sequence
  Synthetic
tcaacaggagtctatgccggaggcaaggaccgcgtcatgcaatcacttaatcacttgtttacagccatggacact

SEQ ID NO: 64501 - DNA, 75 bp, Artificial Sequence
  Synthetic
accgacgctgacgtcaccatctactgtctggacaaacagtgggaaacacggatcaaggatgccattgcccgaaaa

SEQ ID NO: 64502 - DNA, 75 bp, Artificial Sequence
  Synthetic
gccgttggccctaatttttctaggctatcagaaaacgaaggagaccagaaattgtctgaagtgtacatggacatt

SEQ ID NO: 64503 - DNA, 75 bp, Artificial Sequence
  Synthetic
gaaagtgttgaagagctcgtggaggacgacaaaccggtggatattgaattagtccgcgtgcacccacagagcagc

SEQ ID NO: 64504 - DNA, 75 bp, Artificial Sequence
  Synthetic
ctggtagggagacctgggtactctacgaatgaaggtaaagtacactcctacttggaagggacgcgatttcatcag

SEQ ID NO: 64505 - DNA, 75 bp, Artificial Sequence
  Synthetic
gaaacccgcgttccgtcacctccaagtcaggatagtagaccttccaccccatctgcaagtggttcacacacatcc

SEQ ID NO: 64506 - DNA, 75 bp, Artificial Sequence
  Synthetic
gctgagattcacgccagtcaaggatcactgtggagtatacccagtatcaccggatctgaaactcgtgttccatca

SEQ ID NO: 64507 - DNA, 75 bp, Artificial Sequence
  Synthetic
acggcaaaagacatcgcagagatctacgccatgtggcccaacaagcaggaagccaatgagcaaatatgcctatac

SEQ ID NO: 64508 - DNA, 75 bp, Artificial Sequence
  Synthetic
attgccctggagccgctccgtgcagaaaattgtgcagtgggaagcatccctatatctatagatatacccgacgca

SEQ ID NO: 64509 - DNA, 75 bp, Artificial Sequence
  Synthetic
tgtctagataagcaatgggagtcaagaataaaggaagctatcacccggaaggaaagtgttgaagagcttactgag

SEQ ID NO: 64510 - DNA, 75 bp, Artificial Sequence
  Synthetic
gctagcacttattgccatcgtcaagccaaagaaagttgtattgtgtggagatccgaaacaatgcggcttctttaa

SEQ ID NO: 64511 - DNA, 75 bp, Artificial Sequence
  Synthetic
gtgctgggggagagtatgactagtattcgctctaagtgccctgttgaggaatccgaagcatcctcaccaccgcat

SEQ ID NO: 64512 - DNA, 75 bp, Artificial Sequence
  Synthetic
acaattccatgtctatgtaattacgctatgacagctgagagagtctacagactgcgaatggcaaagaatgaacag

SEQ ID NO: 64513 - DNA, 75 bp, Artificial Sequence
  Synthetic
tttgccgtgtgttcctcattccagctgcctaaatacagaataacaggtgtgcagaagatccagtgcaacaaacca

SEQ ID NO: 64514 - DNA, 75 bp, Artificial Sequence
  Synthetic
gtcatattctctggggttgtgccgccggcaatacacccacggaagttctctaccgtagaggaaacacaacctacg

SEQ ID NO: 64515 - DNA, 75 bp, Artificial Sequence
  Synthetic
ggtggtccaacctgaaaggttggtgcctaggcgacctgcaccgcctgtgcccgtacctgcaagaatccccagccc

SEQ ID NO: 64516 - DNA, 75 bp, Artificial Sequence
  Synthetic
actattgcagaacggctcattccaagacgcccagctccaccggtacccgtgcctgcacgtattccaagcccacgc

SEQ ID NO: 64517 - DNA, 75 bp, Artificial Sequence
  Synthetic
tgttcgcctgcagttagcatgcaatcactaggcggtagtagtacatcggaagtgattatctctgaagctgaggtc

SEQ ID NO: 64518 - DNA, 75 bp, Artificial Sequence
  Synthetic
catgactctgactcggattgtagcattccgccaatgccgtttgtcgtagaggcagaggttcatgctagtcaaggt

SEQ ID NO: 64519 - DNA, 75 bp, Artificial Sequence
  Synthetic
tcgcaatggagcattccaagcgcctcaggatttgaaatccgcgaaccactagacgatcttggctcaattactcgc

SEQ ID NO: 64520 - DNA, 75 bp, Artificial Sequence
  Synthetic
acgccagcgatctctgaccattccgtagacttaatcactttcgatagtgtcactgacattttcgagaacttcaaa

SEQ ID NO: 64521 - DNA, 75 bp, Artificial Sequence
  Synthetic
ctcgtaaagtagagaacatgaaggcaatcaccgttgagcgtctactgcaggggataggctcatatctctctgcag

SEQ ID NO: 64522 - DNA, 75 bp, Artificial Sequence
  Synthetic
caggcaccgtttcagtttctatctgacatacgtccgattccagcgccacgtcgacggagggagccggagactgac

SEQ ID NO: 64523 - DNA, 75 bp, Artificial Sequence
  Synthetic
gttactcagtatgttactaagttaaagggacccaaagcagctgccctttttgcgaaaacgcataacttacagcca

SEQ ID NO: 64524 - DNA, 75 bp, Artificial Sequence
  Synthetic
attcaacgtttcgacaaatcggaggagaaaccagttccgaaacctcgcacccgcacggctaagtacaaaaagcca

SEQ ID NO: 64525 - DNA, 75 bp, Artificial Sequence
  Synthetic
tgcgaaaacgcataacttacagccattgcatgagataccaatggatagattcgtgatggaccttaaacgggatgt

SEQ ID NO: 64526 - DNA, 75 bp, Artificial Sequence
  Synthetic
catcagcagaagtggccgtcaaagtctgcaacctagtactgcaagagaattttcccaccgtagccagctataaca

SEQ ID NO: 64527 - DNA, 75 bp, Artificial Sequence
  Synthetic
cctggcgtagcaagatccatctcagaagccgaactggacgagtttatccgtcggcactctaactgacggtatgaa

SEQ ID NO: 64528 - DNA, 75 bp, Artificial Sequence
  Synthetic
ctgtttagatactgccaccttttgcccagctaaattaaggagctttccaaagaagcacagttatttgcggcctga

SEQ ID NO: 64529 - DNA, 75 bp, Artificial Sequence
  Synthetic
tttcccaccgtagccagctataacataacggatgagtatgatgcctatcttgacatggtggacggagcatcctgc

SEQ ID NO: 64530 - DNA, 75 bp, Artificial Sequence
  Synthetic
gcgggtgcgtatatcttctcatcagagacagggcaagggcatctgcaacagaaatccaccaggcagtgcaaactc

SEQ ID NO: 64531 - DNA, 75 bp, Artificial Sequence
  Synthetic
caacaccctattctggagcgctctgtccatgagaagttctacgccccgcgcctcgacctggaacgtgagaaattg

SEQ ID NO: 64532 - DNA, 75 bp, Artificial Sequence
  Synthetic
ctgcagagaaagctacaactatgtgcgtcagaagggaataggagcaggtatcaatcgcgtaaagtcgaaaacatg

SEQ ID NO: 64533 - DNA, 75 bp, Artificial Sequence
  Synthetic
aaagcaatcacagcagaacgtttactgcaagggataggggcttatctctcggctgaacctcagcctgtagagtgt

SEQ ID NO: 64534 - DNA, 75 bp, Artificial Sequence
  Synthetic
cttacagccattgcatgagataccaatggatagattcgtgatggaccttaaacgggatgtcaaggtcacacccgg

SEQ ID NO: 64535 - DNA, 75 bp, Artificial Sequence
  Synthetic
tataagatcaattaccctgtccccgtgtattctaccactcgcagtaatagattctcttcggcagacgtcgcggtg

SEQ ID NO: 64536 - DNA, 75 bp, Artificial Sequence
  Synthetic
gcccacaatgtacatataaagcggaactggacctgggcattcctgccgctttaggcaaatatgatatcattttta

SEQ ID NO: 64537 - DNA, 75 bp, Artificial Sequence
  Synthetic
tggtatacatcgagagcttgtgcgcaggttgaacgcagtgctgctaccgaatatccacactttgtttgacatgtc

SEQ ID NO: 64538 - DNA, 75 bp, Artificial Sequence
  Synthetic
aggttgaacgcagtgctgctaccgaatatccacactttgtttgacatgtctgcagaagattttgatgctatcatt

SEQ ID NO: 64539 - DNA, 75 bp, Artificial Sequence
  Synthetic
agggtgtgtaacctagttatgcaggagaacttcccgactgtggctagttacacaatcacagacgagtatgatgca

SEQ ID NO: 64540 - DNA, 75 bp, Artificial Sequence
  Synthetic
gagcggttgaccacttccccctgcgcagcatttatcggcgacgacaacatcgtgaaaggggttacatctgacgcg

SEQ ID NO: 64541 - DNA, 75 bp, Artificial Sequence
  Synthetic
tacttggacatggtcgatggggcatcctgctgtttagacaccgccaccttctgccctgctaaactgcgtagcttc

SEQ ID NO: 64542 - DNA, 75 bp, Artificial Sequence
  Synthetic
ctgatggcagagcggtgcgccacgtggttgaacatggaagtgaagatcatcgatgcagtagtcggagtaaaggca

SEQ ID NO: 64543 - DNA, 75 bp, Artificial Sequence
  Synthetic
ccgaagaaacatagctatttgaagcccgagatacgatcggccgtcccctcacctatacagaataccctacagaat

SEQ ID NO: 64544 - DNA, 75 bp, Artificial Sequence
  Synthetic
gtgttggcggcagcgaccaaaagaaattgcaacgtcacacagatgcgcgaattaccagttttagactctgctgcg

SEQ ID NO: 64545 - DNA, 75 bp, Artificial Sequence
  Synthetic
cggggcaatgatgaaatccgggatgtttttgacactctttatcaataccgttgtcaatatcatgatcgctagccg

SEQ ID NO: 64546 - DNA, 75 bp, Artificial Sequence
  Synthetic
tcggggcaatgatgaaatctgggatgtttttgacactctttatcaacactgttgttaatatcatgatcgctagcc

SEQ ID NO: 64547 - DNA, 75 bp, Artificial Sequence
  Synthetic
ttccactggacgatgaccaagacgtcgacaggcgcagagctctgcatgatgaagcggcacgttggaacagaattg

SEQ ID NO: 64548 - DNA, 75 bp, Artificial Sequence
  Synthetic
tttaacgtagagtgctttaaaaaatatgcgtgtaacgatgaatactgggagacattcaagaacaaccccatcaga

SEQ ID NO: 64549 - DNA, 75 bp, Artificial Sequence
  Synthetic
ttgaccaccgaaaacgtcacgcagtacgtgactaagctaaagggtccaaaggctgcagccttgtttgcgaagact

SEQ ID NO: 64550 - DNA, 75 bp, Artificial Sequence
  Synthetic
cggtgtagaggcaaccaccctatttccacctatccaaaatggagaaagttcatgttgacttagacgcagacagcc

SEQ ID NO: 64551 - DNA, 75 bp, Artificial Sequence
  Synthetic
cacaatctacaacccttgcatgaaattccaatggatagattcgtgatggacctcaagcgtgacgtcaaagtgacc

SEQ ID NO: 64552 - DNA, 75 bp, Artificial Sequence
  Synthetic
ggtaagccgcttccactggacgatgaccaagacgtcgacaggcgcagagctctgcatgatgaagcggcacgttgg

SEQ ID NO: 64553 - DNA, 75 bp, Artificial Sequence
  Synthetic
ccagggaccaaacacactgaggaacggccaaaagtacaagtaatacaggcagcagacccgcttgcaaccgcatat

SEQ ID NO: 64554 - DNA, 75 bp, Artificial Sequence
  Synthetic
ttatgcgggatacacagagagctggtaaggagactgaatgctgtactactgcctaacatccacacactttttgac

SEQ ID NO: 64555 - DNA, 75 bp, Artificial Sequence
  Synthetic
ctctgcatgatgaagcggcacgttggaacagaatcggtattactgaagagctggtgaaagcagttgaatcacgct

SEQ ID NO: 64556 - DNA, 75 bp, Artificial Sequence
  Synthetic
atgtccgccgaagattttgatgccatcatagccgaacactttcaattcggcgacgcagtgttagaaacagatatc

SEQ ID NO: 64557 - DNA, 75 bp, Artificial Sequence
  Synthetic
aagaggtcaccccataaccctctacggctgacctaaataggttgtgcattagtatctaacctatttatattatat

SEQ ID NO: 64558 - DNA, 75 bp, Artificial Sequence
  Synthetic
tgctatctaaatatcagagatgttcccataccctacacttaactacccgcctatggcgccgattaacccgatggc

SEQ ID NO: 64559 - DNA, 75 bp, Artificial Sequence
  Synthetic
gcttcctttgacaagagtgaagatgatgcaatagctatgtcggcgctcatgatccttgaggatctgggtgtcgac

SEQ ID NO: 64560 - DNA, 75 bp, Artificial Sequence
  Synthetic
caggcacttctggatctgatagaagctgccttcggaaacatcacatctgttcacttacctacagggacacgcttc

SEQ ID NO: 64561 - DNA, 75 bp, Artificial Sequence
  Synthetic
cacttgcagctcaaattgaggacctgagacgttccattgctaacctgactttgaaacaacgagcacctaaccctc

SEQ ID NO: 64562 - DNA, 75 bp, Artificial Sequence
  Synthetic
gagacgttccattgctaacctgactttgaaacaacgagcacctaaccctccagcaggaccgcccgccaaacgcaa

SEQ ID NO: 64563 - DNA, 75 bp, Artificial Sequence
  Synthetic
aaattcggagcgatgatgaagtcgggtatgttcctgactctgtttattaatactgtcgtaaacatcatgattgct

SEQ ID NO: 64564 - DNA, 75 bp, Artificial Sequence
  Synthetic
agccgtgtattgcgagagaggcttaccaattcgccatgcgctgcgttcatcggcgatgataacatcgtgaaaggc

SEQ ID NO: 64565 - DNA, 75 bp, Artificial Sequence
  Synthetic
gttaagtcggacgcactcatggccgagcgttgcgccacatggctgaacatggaggtaaagataatagatgccgta

SEQ ID NO: 64566 - DNA, 75 bp, Artificial Sequence
  Synthetic
gtgggggtgaaggcaccgtacttctgcggaggcttcatcgtcgtggaccaaataactggcacagcctgcagagtg

SEQ ID NO: 64567 - DNA, 75 bp, Artificial Sequence
  Synthetic
aacaggttcaccgtaccacgaggggtcggtggaaagggcgacagcgggagacctattcttgacaacaaaggtaga

SEQ ID NO: 64568 - DNA, 75 bp, Artificial Sequence
  Synthetic
gcagacccccttaagagacttttcaaactcggtaaacctttacctttggatgacgaccaagacggcgataggcgc

SEQ ID NO: 64569 - DNA, 75 bp, Artificial Sequence
  Synthetic
cagtttgttcgtcctttcagttaccgaaatacaggattacaggggttcagaaaattcaatgcagtaaacctgtga

SEQ ID NO: 64570 - DNA, 75 bp, Artificial Sequence
  Synthetic
agggcattgtatgatgaagcgctccgatggaataggatcggtatcaccgacgagttagttaaggcggtcgaatcg

SEQ ID NO: 64571 - DNA, 75 bp, Artificial Sequence
  Synthetic
cgctatgatgtgttatacatctctttagtcatcacagccttgtccacccttgcagccacggtcagcaacttcaag

SEQ ID NO: 64572 - DNA, 75 bp, Artificial Sequence
  Synthetic
cacataagaggaaaccccataaccctctacggctgacctaaataggttatgcagtagaagctaacctattatttt

SEQ ID NO: 64573 - DNA, 75 bp, Artificial Sequence
  Synthetic
aacactcagtgtgtatcacaagcgcaatacagaaacgatgtttccgtatccaacactaaactattcacccatggc

SEQ ID NO: 64574 - DNA, 75 bp, Artificial Sequence
  Synthetic
gggttcgatgtgcgtacctcctcatcgttgagtctagagcagcctacctttccgacaatggttgtcgaagcagag

SEQ ID NO: 64575 - DNA, 75 bp, Artificial Sequence
  Synthetic
aataccgtcacccacctgaacatggagttgaattaccgtgtaaccgttacactcacaagcgtgcagaccaaggac

SEQ ID NO: 64576 - DNA, 75 bp, Artificial Sequence
  Synthetic
gccggttaatccgatggcgtacagggatcccaacccgccaaggcgaaggtggaggccgttcaggccgcccctcgc

SEQ ID NO: 64577 - DNA, 75 bp, Artificial Sequence
  Synthetic
tacgtgcacagttgcccataaggtagaattcaggccagtgggtagagagaaataccgtcacccacctgaacatgg

SEQ ID NO: 64578 - DNA, 75 bp, Artificial Sequence
  Synthetic
cgcccaaattgaagatttgaggcgctctattgcgaacctcaccttcaaacaacgggctccgaatccaccggcggg

SEQ ID NO: 64579 - DNA, 75 bp, Artificial Sequence
  Synthetic
tggtcgcttgccactgtcatgtgcgtcctggccaatatcacgtttccatgtgatcaaccaccctgcatgccatgc

SEQ ID NO: 64580 - DNA, 75 bp, Artificial Sequence
  Synthetic
ttacggtaccgagcggcgcccaagtgaaatactactgcaagtgcccagacgtacgagagggaattaccagcagcg

SEQ ID NO: 64581 - DNA, 75 bp, Artificial Sequence
  Synthetic
tccccccgcaaaacgcaagaaaccggccccaaagcctaaacctgcggcgccaaagaagaagcggcagccgccccc

SEQ ID NO: 64582 - DNA, 75 bp, Artificial Sequence
  Synthetic
tgttatgaaaagaatccacacgaaacacttaccatgttggaacagaattatgacagccgagcatatgatcagctg

SEQ ID NO: 64583 - DNA, 75 bp, Artificial Sequence
  Synthetic
accatacaaccacctgcacggatgtcaaacaatgcagggcttacctgattgacaacaaaaaatgggtgtacaact

SEQ ID NO: 64584 - DNA, 75 bp, Artificial Sequence
  Synthetic
agctaagaagcagaaacgcaagcagaagccaggtaaaagacaaaggatgtgtatgaaattggagtccgacaaaac

SEQ ID NO: 64585 - DNA, 75 bp, Artificial Sequence
  Synthetic
ctagaagaaccaggagagatttggacactcatttcacccagtataagctggcacgcccctacattgctgattgcc

SEQ ID NO: 64586 - DNA, 75 bp, Artificial Sequence
  Synthetic
cttccccatcttgctgaatgggcaggtgaatggatacgcgtgcgtagtgggaggacgcgtgttcaagcccctgca

SEQ ID NO: 64587 - DNA, 75 bp, Artificial Sequence
  Synthetic
accctgattttacacctgcacccggaccatccgactttgctgacgaccaggtcacttggaagtgatgcaaatcca

SEQ ID NO: 64588 - DNA, 75 bp, Artificial Sequence
  Synthetic
tgtagaaggaaaaattgacaacgaacaacttgccgccatcaagctgaagaaagcaagcatttatgacctcgagta

SEQ ID NO: 64589 - DNA, 75 bp, Artificial Sequence
  Synthetic
aaccatccaccaaaaagagtatgggctcaagagtcaggagaagggaatccacatggatggccgcacgaagtggta

SEQ ID NO: 64590 - DNA, 75 bp, Artificial Sequence
  Synthetic
cggtgatgttccgcaatgcatgaaatctgacactctccagtacaccagtgagaaacctcccgggttctacaactg

SEQ ID NO: 64591 - DNA, 75 bp, Artificial Sequence
  Synthetic
gcaccacggcgcagtgcaatacgaaaataacaggttcactgtcccacgaggagtaggcggtaaaggggacagcgg

SEQ ID NO: 64592 - DNA, 75 bp, Artificial Sequence
  Synthetic
agatgacaccttgcaagtattgaattatctgtggaacaacaaccaaaactttttctggatgcagacgcttatccc

SEQ ID NO: 64593 - DNA, 75 bp, Artificial Sequence
  Synthetic
tgcaagtgcccagatgtacgagagggaattaccagcagcgaccatacaaccacctgcacggatgtcaaacaatgc

SEQ ID NO: 64594 - DNA, 75 bp, Artificial Sequence
  Synthetic
tcgtccgattctggacaaccgcggtcgcgtggttgccattgtgctaggcggagcaaatgaagggtcgcgcacagc

SEQ ID NO: 64595 - DNA, 75 bp, Artificial Sequence
  Synthetic
acttgcagcgcttattgtatgcatgcgcatgctgcgctgcttattttgctgtgggccggcttttttacttgtctg

SEQ ID NO: 64596 - DNA, 75 bp, Artificial Sequence
  Synthetic
actgtcagtggtcacctggaaccagaaaggagttaccgtgaaggacactcccgaaggttctgaaccatggtcact

SEQ ID NO: 64597 - DNA, 75 bp, Artificial Sequence
  Synthetic
acctagtactgcaagagaattttcccaccgtagccagctataacataacggatgagtatgatgcctatcttgaca

SEQ ID NO: 64598 - DNA, 75 bp, Artificial Sequence
  Synthetic
cctggagtacatcacctgcaagtacaagacaaaagtgccttctccagtagtgaaatgctgcggtgccactcaatg

SEQ ID NO: 64599 - DNA, 75 bp, Artificial Sequence
  Synthetic
gactacggttatgtgcgttttagccaacatcaccttcccgtgcgatcagccgccttgcatgccgtgctgctatga

SEQ ID NO: 64600 - DNA, 75 bp, Artificial Sequence
  Synthetic
tgaaatgctgcggtgccactcaatgtacctccaaaccccatcctgactatcagtgtcaggtgtttacaggtgttt

SEQ ID NO: 64601 - DNA, 75 bp, Artificial Sequence
  Synthetic
tactgcaagcaacagcttttcatcagcagaagtggccgtcaaagtctgcaatctagtactgcaagagaattttcc

SEQ ID NO: 64602 - DNA, 75 bp, Artificial Sequence
  Synthetic
ctgcttctgcgacaccgaaaacacccagatgagcgaggcgtatgtagagcgctcggaagagtgctctattgacca

SEQ ID NO: 64603 - DNA, 75 bp, Artificial Sequence
  Synthetic
gaaaaatcctcatgagacgcttactatgctggaacaaaattacgacagccaggcttacgaccaactattagaagc

SEQ ID NO: 64604 - DNA, 75 bp, Artificial Sequence
  Synthetic
ggctgtcaagtgcaacagcagacggacccgcagagatttggaaacccatttcacgcagtacaaacttgctcgccc

SEQ ID NO: 64605 - DNA, 75 bp, Artificial Sequence
  Synthetic
atcagcagtgccatcaccgattcaaaacacgctccagaatgtactagcagcagccacgaaacggaattgcaatgt

SEQ ID NO: 64606 - DNA, 75 bp, Artificial Sequence
  Synthetic
atacatagccgattgttctaattgcggccacggtagatgtgacagtccaattgccatcgaggacgtgcgcggaaa

SEQ ID NO: 64607 - DNA, 75 bp, Artificial Sequence
  Synthetic
cgcgcacgccggttacatccgcatacaaacatcagcaatgttcggcctaaagtcggacggagttgacctggcgta

SEQ ID NO: 64608 - DNA, 75 bp, Artificial Sequence
  Synthetic
tgcagaaaattgtgcagtgggaagcatccctatatctatagatatacccgatgcggctttcaccagaatatctga

SEQ ID NO: 64609 - DNA, 75 bp, Artificial Sequence
  Synthetic
tatgagctttatgaacgggaagactctgaaagccatcaaaattgaacacctgtacgctcgcacgtcggcaccgtg

SEQ ID NO: 64610 - DNA, 75 bp, Artificial Sequence
  Synthetic
ctccctggtgtcataccatgggtactacctacttgctcagtgccctccaggggatacggtcacagtaggatttca

SEQ ID NO: 64611 - DNA, 75 bp, Artificial Sequence
  Synthetic
agatggtgcgaataagcacatgtgcaccattgcccataaggtagaattcagaccagttgggagagaaaagtatcg

SEQ ID NO: 64612 - DNA, 75 bp, Artificial Sequence
  Synthetic
cacgagatatgcacagaagtgtatcacaagagtatttctcggcgatgcactaagacagtgacatccatcgtttcc

SEQ ID NO: 64613 - DNA, 75 bp, Artificial Sequence
  Synthetic
gcatccacccgcgcatggtgttgaattaccctgcaataagtacacgcacaaacgtgcagatcagggacactacgt

SEQ ID NO: 64614 - DNA, 75 bp, Artificial Sequence
  Synthetic
agaaatgcaccagcctgggctggttgccgatcactcgctgctgagcctaagcagtacaaaggtaaagattaccgt

SEQ ID NO: 64615 - DNA, 75 bp, Artificial Sequence
  Synthetic
tccaagcggctctcaagtgaagtattactgtaaatgcccagacgtacaggaaggaacaaccagcggcgatcatac

SEQ ID NO: 64616 - DNA, 75 bp, Artificial Sequence
  Synthetic
gagtcaggagaagggaatccacatggatggccgcacgaagtggtagtctattactacaacaggtacccgttaacc

SEQ ID NO: 64617 - DNA, 75 bp, Artificial Sequence
  Synthetic
gaccacctgcacagatctgaagcagtgccgagcatatctaattgacaacaagaaatgggtctttaactccgggaa

SEQ ID NO: 64618 - DNA, 75 bp, Artificial Sequence
  Synthetic
acaaaatcatattaattttttcttttatgtttttattttgtttttaatatttcaaaaaaaaaaaaaaaaaaaaaa

SEQ ID NO: 64619 - DNA, 75 bp, Artificial Sequence
  Synthetic
gttaccaagaggtgagggcgaaacctttaaagggaaactccacgtgccgttcgtaccagttacatctaagtgcac

SEQ ID NO: 64620 - DNA, 75 bp, Artificial Sequence
  Synthetic
gggtacggtgtagaggcaaccaccctatttccacctatccaaaatggagaaagttcatgttgacttagacgcaga

SEQ ID NO: 64621 - DNA, 75 bp, Artificial Sequence
  Synthetic
ggcaactctggcccccgagccattggtggagcataaacacagatcgctgattttgcacctacacccagaacatcc

SEQ ID NO: 64622 - DNA, 75 bp, Artificial Sequence
  Synthetic
aacgctgctgacgaccagagcactcggaaatgatgccagaccaactaggcaatgggtcgaccaaccaaccacagt

SEQ ID NO: 64623 - DNA, 75 bp, Artificial Sequence
  Synthetic
taacttcacagtaactggagaagggttcgaatacacctggggcaaccaccctccaaaaagagtatgggcccaaga

SEQ ID NO: 64624 - DNA, 75 bp, Artificial Sequence
  Synthetic
gtacctccaaacctcatcctgactaccagtgccaggtgtttacaggtgtttacccattcatgtggggaggagcct

SEQ ID NO: 64625 - DNA, 75 bp, Artificial Sequence
  Synthetic
atcaggagaaggtaacccgcatggctggccgcacgaggtagtcatttattactacaaccggtacccgatgacgac

SEQ ID NO: 64626 - DNA, 75 bp, Artificial Sequence
  Synthetic
tatcgtgggactgtgtacgtgtgcggccattattatggtctcttgcatcacatccgtatggctcctgtgccgcac

SEQ ID NO: 64627 - DNA, 75 bp, Artificial Sequence
  Synthetic
ccgcaacctgtgcatcactccatacagactggcaccaaatgcccaagtacctattctgctggcagttttgtgctg

SEQ ID NO: 64628 - DNA, 75 bp, Artificial Sequence
  Synthetic
accctatctccacctatccaaaatggagaaagttcatgttgacttagacgcagacagcccattcgtcaagtcact

SEQ ID NO: 64629 - DNA, 75 bp, Artificial Sequence
  Synthetic
cgttaaacccaccagagcagatgacaccctgcaggttctaaattatctgtggaacaataaccagaactttttctg

SEQ ID NO: 64630 - DNA, 75 bp, Artificial Sequence
  Synthetic
gatgcaaaccctgatcccccttgctgctttaattgtatgcatgcgcatgctacgctgcttactgtgttgcgggcc

SEQ ID NO: 64631 - DNA, 75 bp, Artificial Sequence
  Synthetic
acatggcaggcgcctaccctacatacaacacaaattgggccgatgaaagtgtgttggaagccagaaatatagggc

SEQ ID NO: 64632 - DNA, 75 bp, Artificial Sequence
  Synthetic
caaggtggtggtttatgggcatgaagtgtataattacgattttcctgagtacggcactggcaaagcaggctcttt

SEQ ID NO: 64633 - DNA, 75 bp, Artificial Sequence
  Synthetic
ttgggcgccgcagcgtacgaacacacagccgtgatgccgaacaaggtggggatcccttacaaagcactggttgaa

SEQ ID NO: 64634 - DNA, 75 bp, Artificial Sequence
  Synthetic
cgccccggatacgcgccagttcaccttcaaatccagctggtgaccacaaaaatcatcccgtcagcaaacctggag

SEQ ID NO: 64635 - DNA, 75 bp, Artificial Sequence
  Synthetic
cttgctgagagcggatcatttacattccacttctccactgcaaacatccatcctgcttttaagctgcaggtctgc

SEQ ID NO: 64636 - DNA, 75 bp, Artificial Sequence
  Synthetic
tacatcacctgtaagtacaagaccaaagtgccttcccctgtggtgaaatgttgcggcgccactcaatgcacatcg

SEQ ID NO: 64637 - DNA, 75 bp, Artificial Sequence
  Synthetic
aaacagcatcctgactaccagtgccaggtatttgcaggagtatacccattcatgtggggaggagcctattgcttc

SEQ ID NO: 64638 - DNA, 75 bp, Artificial Sequence
  Synthetic
gaatcctttacgtcggcgatatccgccaccgcgtggtcgtggctaaaagtgctggtaggaggaacatcagcattt

SEQ ID NO: 64639 - DNA, 75 bp, Artificial Sequence
  Synthetic
tgcgatacggagaatacgcaaatgagcgaagcgtacattgaacgtgccgaggaatgctcagtagaccaggctaaa

SEQ ID NO: 64640 - DNA, 75 bp, Artificial Sequence
  Synthetic
gcatataaggtgcacacaggaacagtgcaagccgtcgttaacatcacctatggaagcgtcagctggagatccgct

SEQ ID NO: 64641 - DNA, 75 bp, Artificial Sequence
  Synthetic
gatgtctatgttaacggcgaaactccagcaaagatcggtgacgccaaactaactatagggccgttgtcttccgcc

SEQ ID NO: 64642 - DNA, 75 bp, Artificial Sequence
  Synthetic
tggactccattcgattctaaggtagtagtgtatggacatgaggtgtacaactacgactttccggaatatggcacc

SEQ ID NO: 64643 - DNA, 75 bp, Artificial Sequence
  Synthetic
ggcaaggccggttcctttggagacctgcaatcccggacccttacaagcaacgacctgtacgccaacaccaatttg

SEQ ID NO: 64644 - DNA, 75 bp, Artificial Sequence
  Synthetic
aaattacaaagaccacaaccgggggtggtgcatacaccctatacccaagcgccttcagggtttgaacgctggaag

SEQ ID NO: 64645 - DNA, 75 bp, Artificial Sequence
  Synthetic
atagggtatggtgtagaggcagccacccgacctatcctatccaaaatggagaaagtacacgtagacttagacgca

SEQ ID NO: 64646 - DNA, 75 bp, Artificial Sequence
  Synthetic
aaagaccgtggcgcaccattgaacgacattgctccgttcgggtgcacaatagccctggatcctctgcgtgcagag

SEQ ID NO: 64647 - DNA, 75 bp, Artificial Sequence
  Synthetic
gacagtccatacgtcaagtcgctgcaaaagtgttttccacattttgagatagaagcaacgcaggtcactgacaat

SEQ ID NO: 64648 - DNA, 75 bp, Artificial Sequence
  Synthetic
gtctccattccgttgttatctaccggcatctacgcaggtggtaaggacagggttatgcaatcgctgaaccattta

SEQ ID NO: 64649 - DNA, 75 bp, Artificial Sequence
  Synthetic
aattgcgcggtcggaaacattcccctttccatagacatccctgatgccgcgttcacgaggatctcggagacgcca

SEQ ID NO: 64650 - DNA, 75 bp, Artificial Sequence
  Synthetic
gaccatgctaatgctagagcgttttcgcatctggctactaaactcatcgaaagcgaagtggatcttgaccatgta

SEQ ID NO: 64651 - DNA, 75 bp, Artificial Sequence
  Synthetic
actgtgtccgatctggaatgcaagatcactgaatgtacctacgcgtctgatttcggaggaatagccacagttgcc

SEQ ID NO: 64652 - DNA, 75 bp, Artificial Sequence
  Synthetic
atcctggatattgggagcgcgcctgtaaggcacacgcattccaagcataagtaccactgtatctgcccgatgatc

SEQ ID NO: 64653 - DNA, 75 bp, Artificial Sequence
  Synthetic
tctgccggaggtcgataaggagaccgtagaggctgacatcgacctgatcatgcaggaggcaggagcaggcagcgt

SEQ ID NO: 64654 - DNA, 75 bp, Artificial Sequence
  Synthetic
tacaaggcaagtaaagctggaaattgtcctatccattccccctcaggcatcgcagtgattaaagagaacgacgtt

SEQ ID NO: 64655 - DNA, 75 bp, Artificial Sequence
  Synthetic
agtgcagaagaccctgatcgtctccatcgctatgcagataagctaagaaagagtgacgtaactgataggttcata

SEQ ID NO: 64656 - DNA, 75 bp, Artificial Sequence
  Synthetic
agggtacggtgtagaggcaaccaccctatttccacctatccaaaatggagaaagttcatgttgacttagacgcag

SEQ ID NO: 64657 - DNA, 75 bp, Artificial Sequence
  Synthetic
acgttggcagacagcggttcatttacattccatttctccacggccagtattcacccggcgttcaaaatgcagatt

SEQ ID NO: 64658 - DNA, 75 bp, Artificial Sequence
  Synthetic
gccccgaaagctgcagatctgctgacagtgatgtcaacaccggacgcagagactccaacactatgcatgcacaca

SEQ ID NO: 64659 - DNA, 75 bp, Artificial Sequence
  Synthetic
tgcaccagtgtagttacctgcaaaggggattgcaaaccacccaaggaccacattgtcgattacccagcccaacat

SEQ ID NO: 64660 - DNA, 75 bp, Artificial Sequence
  Synthetic
gatgccacctgccggtatcacggcacagttgccatttatcaagatgtatatgccgtgcatgcacctacctccatt

SEQ ID NO: 64661 - DNA, 75 bp, Artificial Sequence
  Synthetic
caaagggcgcgcaggacgatacaaggtagagccataccacggtagagttatcgtccccagtggtacagctatacc

SEQ ID NO: 64662 - DNA, 75 bp, Artificial Sequence
  Synthetic
acagaaacattcacttctgcggtatcggccacggcgtggtcatggctgaaagtgctagtaggtagcacttcggca

SEQ ID NO: 64663 - DNA, 75 bp, Artificial Sequence
  Synthetic
tactaccaagcactaaaaggagtacgcacaatttattggattgggtttgatactacgccattcatgtataaaaac

SEQ ID NO: 64664 - DNA, 75 bp, Artificial Sequence
  Synthetic
ttcatagtcctagggctgatcgccactgcggtggtcgcactggtactatttacccacaaacactaaagtagatgc

SEQ ID NO: 64665 - DNA, 75 bp, Artificial Sequence
  Synthetic
atggccggtgcgtaccctacctacaatactaattgggctgatgaaagtgtgttagaggcaaggaatatcggtctg

SEQ ID NO: 64666 - DNA, 75 bp, Artificial Sequence
  Synthetic
gcattgaatacagatgaagagtactacaaggttgtgaaaagcactgagacagactctgagtacgtatttgacatc

SEQ ID NO: 64667 - DNA, 75 bp, Artificial Sequence
  Synthetic
taccaacattactgtattatcgttgttcgatgtacttccgagcagcggtaagggtggtgcataatgccacctgcg

SEQ ID NO: 64668 - DNA, 75 bp, Artificial Sequence
  Synthetic
tgcagctcagacctacatgaaaaaagatttggaaaaatttcgatcatgagaaagaaaaacctgcaaccaaccaac

SEQ ID NO: 64669 - DNA, 75 bp, Artificial Sequence
  Synthetic
cagtgcataatgctgcgaatatttagcctattggcctatataatcacactacaggtagcttactaccattaataa

SEQ ID NO: 64670 - DNA, 75 bp, Artificial Sequence
  Synthetic
aaagttgtgttttccgtcggttcaacaatttacacagaagatagggcactcttacgcagctggcatctacctaat

SEQ ID NO: 64671 - DNA, 75 bp, Artificial Sequence
  Synthetic
cacgaatttgcgtacgagagtttaaaaacacgtcctgctgcaccacacaaagtgcctaccatcggagtctatgga

SEQ ID NO: 64672 - DNA, 75 bp, Artificial Sequence
  Synthetic
cactaccggcagtgcataatactgccctttataaacactactggcagtgcataatgctgccttttataacactac

SEQ ID NO: 64673 - DNA, 75 bp, Artificial Sequence
  Synthetic
gttttccaccttaaaggaaaaaccagttttacaggcagatgcaataccattgtcagctgcgagggttacgttgtg

SEQ ID NO: 64674 - DNA, 75 bp, Artificial Sequence
  Synthetic
tggcagtgcataatactgccttttataaaatcttttaaaaccatatacagtttttcttttatgttttattttgtt

SEQ ID NO: 64675 - DNA, 75 bp, Artificial Sequence
  Synthetic
aagaagattaccatcagtccgggagtttacggaaaagttgataatcttgcgtccaccatgcaccgcgaggggttc

SEQ ID NO: 64676 - DNA, 75 bp, Artificial Sequence
  Synthetic
tgatctggtggtcagtgcaaagaaagaaaattgcatggaaatcattaaagacgtcaaacgcatgcgcggcatgga

SEQ ID NO: 64677 - DNA, 75 bp, Artificial Sequence
  Synthetic
aatactgccttttataaaatcttttaaaaccatatacagtttttcttttatgttttattttgtttttaatatttc

SEQ ID NO: 64678 - DNA, 75 bp, Artificial Sequence
  Synthetic
ttgagttgcaaggtgacggacacgttgcgtggggagagggtatcctttcccgtatgcacgtacgtacccgcgaca

SEQ ID NO: 64679 - DNA, 75 bp, Artificial Sequence
  Synthetic
tgagtctagagcagcctacctttccgacaatggttgtcgaagcagagattcacgccagtcaaggatcactgtgga

SEQ ID NO: 64680 - DNA, 75 bp, Artificial Sequence
  Synthetic
ctgtgcgatcagatgacagggattctggctactgacgtcagtgtcgatgatgctcagaaactgctggttgggctc

SEQ ID NO: 64681 - DNA, 75 bp, Artificial Sequence
  Synthetic
aaccagcggatcgtcgtcaacgggagaacgcaacgtaacactaatacaatgcagaattatctattgcccgtggta

SEQ ID NO: 64682 - DNA, 75 bp, Artificial Sequence
  Synthetic
ctgcaagtggttcacacacatccgtggacttaatcacgtttgacagcgttgcagagattttggaggatttcagtc

SEQ ID NO: 64683 - DNA, 75 bp, Artificial Sequence
  Synthetic
gcacaggcattctccagatgggcacgtgaacatcgcgccgacctggaggatgagagggacctaggggtgcgggaa

SEQ ID NO: 64684 - DNA, 75 bp, Artificial Sequence
  Synthetic
gttcgccgtttcaatttttgtctgaaatcaaacctattcctgcacctcgtacccgagttaataacatgagccgca

SEQ ID NO: 64685 - DNA, 75 bp, Artificial Sequence
  Synthetic
cgctccctggtcatgggctgctgctgggctttcaagacacagaagattacatctatatataagaaacccgggact

SEQ ID NO: 64686 - DNA, 75 bp, Artificial Sequence
  Synthetic
acaattatcgggttatgcacctgtgtggctatcatcatggtctcttgtgtcacatccgtgtggctcctttgcagg

SEQ ID NO: 64687 - DNA, 75 bp, Artificial Sequence
  Synthetic
cataatattaacctgctttagagggtgggttaagcaactgcagattgactacaagaaccacgagatcatgaccgc

SEQ ID NO: 64688 - DNA, 75 bp, Artificial Sequence
  Synthetic
cagtctataaagaaggtgccggcagtgttcaattcatttgtccttccacagctgacaagctatgggttagacata

SEQ ID NO: 64689 - DNA, 75 bp, Artificial Sequence
  Synthetic
ggcttgcgccggagaatcaaactgcttttggaagcgaagaagactccggcccctatcatcactgaagcggatgtt

SEQ ID NO: 64690 - DNA, 75 bp, Artificial Sequence
  Synthetic
gctcaccttaaggggatgcaggaggaggcagaagccgtggctgaagcggaagctgtaagagcagctttaccccca

SEQ ID NO: 64691 - DNA, 75 bp, Artificial Sequence
  Synthetic
ctgcggcctgacattgaaagagaaaccatcgaagctgacatagacctgataatgcaggaagcaggcgcagggagc

SEQ ID NO: 64692 - DNA, 75 bp, Artificial Sequence
  Synthetic
gtcgaaacgccaagaagacacatcaaggttacgacgtacccaggagaggaggtgataggctcctatgcgatactg

SEQ ID NO: 64693 - DNA, 75 bp, Artificial Sequence
  Synthetic
aacgcccaggttatgcacccgttcacctacagatacagctggttaataccaggataattccatcaactaacctgg

SEQ ID NO: 64694 - DNA, 75 bp, Artificial Sequence
  Synthetic
tctcctcaggctgttcttaacagcgaaaaactagcctgcattcaccccctagctgagcaagtgcttgttatgacc

SEQ ID NO: 64695 - DNA, 75 bp, Artificial Sequence
  Synthetic
cataaagggaggatcggacgatacaaggtagaaccatatcatggacgggtcgttgtccccagtggtactgccatt

SEQ ID NO: 64696 - DNA, 75 bp, Artificial Sequence
  Synthetic
ccgatcccggactttcagtcactaagtgaaagtgctactatcgtctttaacgaacgagaattcgttaaccgctac

SEQ ID NO: 64697 - DNA, 75 bp, Artificial Sequence
  Synthetic
ttgcaccacattgccatcaatggtggggcgctgaacaccgacgaagaatactataaagtcctcaaaagcagcgaa

SEQ ID NO: 64698 - DNA, 75 bp, Artificial Sequence
  Synthetic
gcagactcagagtacgtcttcgatattgatgccagaaaatgcgtcaaaaagacagacgcaggacctatgtgtctg

SEQ ID NO: 64699 - DNA, 75 bp, Artificial Sequence
  Synthetic
gtcggtgagttagttgaccctccttttcacgaattcgcatatgaaagtctgaaaacgcgtccagcagcaccgcac

SEQ ID NO: 64700 - DNA, 75 bp, Artificial Sequence
  Synthetic
gtgattactcccagctagtgaccaagatgacaggaaaaaccgtactagtagtgggtacacctatgaacataccag

SEQ ID NO: 64701 - DNA, 75 bp, Artificial Sequence
  Synthetic
aaagtgccaaccattggcatttacggagtccccggctcgggcaaatcaggaattataaagagtgcagtcacaaag

SEQ ID NO: 64702 - DNA, 75 bp, Artificial Sequence
  Synthetic
aaagatttggtagttagtgcaaaaaaagaaaattgcaccgaaattattaaagatgtcaaacggatgcgtagcatg

SEQ ID NO: 64703 - DNA, 75 bp, Artificial Sequence
  Synthetic
ctttaggcaaatatgacatcatttttattaacgtgaggactccctaccgacaccaccattaccaacagtgcgagg

SEQ ID NO: 64704 - DNA, 75 bp, Artificial Sequence
  Synthetic
gatatcgcagctcgcacagtggactccgtcctattgaacggagtcaaacaatcagtggatatcttatacatagat

SEQ ID NO: 64705 - DNA, 75 bp, Artificial Sequence
  Synthetic
gaagcctttgcatgccacgctgggacgctacttgcacttatcgctatcgccaaaccaaagaaggtagtactttgt

SEQ ID NO: 64706 - DNA, 75 bp, Artificial Sequence
  Synthetic
ggagatccaaaacagtgcggcttcttcaatatgatgtgcttgaaggttcactttaaccatgagatatgcacagaa

SEQ ID NO: 64707 - DNA, 75 bp, Artificial Sequence
  Synthetic
gctttcaccagaatatctgaaacaccgacagtctcagacctggaatgcaaaattacggagtgtacttatgcctcc

SEQ ID NO: 64708 - DNA, 75 bp, Artificial Sequence
  Synthetic
gtgtaccacaaaagtatctcgcgcaggtgcacaaagaccgttacagcgatagtttccacgcttttctatgacaag

SEQ ID NO: 64709 - DNA, 75 bp, Artificial Sequence
  Synthetic
cctacaaatccagtaaagcaggaaactgtccaattcattctccatcaggtgttgcagttattaaagagaatgacg

SEQ ID NO: 64710 - DNA, 75 bp, Artificial Sequence
  Synthetic
cggatgcggacggttaacccttgcgcagacaaaatcattatcgataccactagcacaacaaaaccacagaaggac

SEQ ID NO: 64711 - DNA, 75 bp, Artificial Sequence
  Synthetic
gacatcatattgacgtgttttagaggatgggtcaaacaattgcaaattgactacaagaatcatgaaataatgact

SEQ ID NO: 64712 - DNA, 75 bp, Artificial Sequence
  Synthetic
gctgctgcatctcaaggattaacacgtaaaggtgtatacgcagtcaggtacaaagtcaatgaaaatccactctat

SEQ ID NO: 64713 - DNA, 75 bp, Artificial Sequence
  Synthetic
gcacaaacttctgaacacgtgaatgtccttctgacgcgaactgaaaaacgcattgtttggaagactttggcaggc

SEQ ID NO: 64714 - DNA, 75 bp, Artificial Sequence
  Synthetic
gtctgaagtgtacatggacattgccagaattatcaacaacgagaggtttactaaagtctccattccgttgttatc

SEQ ID NO: 64715 - DNA, 75 bp, Artificial Sequence
  Synthetic
gacccatggataaagacactgacggcacagtaccctggggatttctccgcaactcttgaggaatggcaagccgaa

SEQ ID NO: 64716 - DNA, 75 bp, Artificial Sequence
  Synthetic
gtttccaccctgttttatgataaacggatgagaactgtcaacccatgcaatgataagatcataatagataccacc

SEQ ID NO: 64717 - DNA, 75 bp, Artificial Sequence
  Synthetic
cacgatgctatcatggcgagagtgctagagacacctgcacgctgcgacgtttaccagaacaaggtgcacgtgtgt

SEQ ID NO: 64718 - DNA, 75 bp, Artificial Sequence
  Synthetic
atttatttacagccatggatactaccgacgcagacatcactatttactgtctagataagcaatgggagtcaagaa

SEQ ID NO: 64719 - DNA, 75 bp, Artificial Sequence
  Synthetic
tgggcgaaggcactggaaccagttctagccactgccaacataaccctcacaagatcccaatgggacaccatacca

SEQ ID NO: 64720 - DNA, 75 bp, Artificial Sequence
  Synthetic
gcttttagggaggacaaagcgttttctccagaaatggcattaaactttctgtgcaccaggttcttcggcgtagat

SEQ ID NO: 64721 - DNA, 75 bp, Artificial Sequence
  Synthetic
atcgacagcggactgttttcggccccgactgttcccctgacgtacaataatgagcactgggacaatagtccaggt

SEQ ID NO: 64722 - DNA, 75 bp, Artificial Sequence
  Synthetic
accccataaccctctacggctgacctaaataggttgtgcattagtacctaacctatttatattatattgctatct

SEQ ID NO: 64723 - DNA, 75 bp, Artificial Sequence
  Synthetic
cctaataggtatggtttgtgtgcacgcacagccaaggaattggcccgccgctacccatgcatactgaaagctgtc

SEQ ID NO: 64724 - DNA, 75 bp, Artificial Sequence
  Synthetic
aaatatcagagatgttcccataccctacacttaactacccgcctatggcgccgattaacccgatggcctaccggg

SEQ ID NO: 64725 - DNA, 75 bp, Artificial Sequence
  Synthetic
gacacaggtcgggttgcggacgtgcgtaccaacaccattaaggactatagtcccacaattaatgttgtgccattg

SEQ ID NO: 64726 - DNA, 75 bp, Artificial Sequence
  Synthetic
aaccggcgccttccacattccttggtcgtatcacacaggtatgtaggcgatggtaactactcgcagttgctgtca

SEQ ID NO: 64727 - DNA, 75 bp, Artificial Sequence
  Synthetic
aaattgactggaaaaactgtattggtgatcgggacccccatccaggtccctgggaaaagagtagagacactaggc

SEQ ID NO: 64728 - DNA, 75 bp, Artificial Sequence
  Synthetic
agaaaattcaatgcagtaaacctgtgatattctccggcactgtacccccggccatacatccaagaaaattcgcat

SEQ ID NO: 64729 - DNA, 75 bp, Artificial Sequence
  Synthetic
ccgagcccgcagtgcatgtacaaggcggacttggacttgggaattcccagtacgatcgggaagtatgacataata

SEQ ID NO: 64730 - DNA, 75 bp, Artificial Sequence
  Synthetic
tttgtcaatatgagaacaccatacaagcaccaccattatcagcaatgcgaggaccatgccattcatcatagcatg

SEQ ID NO: 64731 - DNA, 75 bp, Artificial Sequence
  Synthetic
cgcacagacactatcaaagactataacccgctaataaatgtggtacccctgaatagaagactcccacactcgttg

SEQ ID NO: 64732 - DNA, 75 bp, Artificial Sequence
  Synthetic
cttaccagaaaagccgtcgaccatctaaacaagggaggtacctgtgttgccctaggctacggaaccgcggataga

SEQ ID NO: 64733 - DNA, 75 bp, Artificial Sequence
  Synthetic
acccgctaataaatgtggtacccctgaatagaagactcccacactcgttggttgtcacacacagatacactggga

SEQ ID NO: 64734 - DNA, 75 bp, Artificial Sequence
  Synthetic
gttgtcacacacagatacactgggaacggtgattactcccagctagtgaccaagatgaccggaaaaaccgtacta

SEQ ID NO: 64735 - DNA, 75 bp, Artificial Sequence
  Synthetic
gcaactgaaaatatcatcgccgcggttgcccgttcatttagattctcacgggtctgccagccgaaatgtgcttgg

SEQ ID NO: 64736 - DNA, 75 bp, Artificial Sequence
  Synthetic
ggaaagagagtcgagacactaggcccaagcccacaatgtacatataaagcggaactggacctgggcattcctgcc

SEQ ID NO: 64737 - DNA, 75 bp, Artificial Sequence
  Synthetic
gaaaatacagaggtagcctttgtcttctttggtaaagataacggaaatcatttacacgatcaaaaccaactaagt

SEQ ID NO: 64738 - DNA, 75 bp, Artificial Sequence
  Synthetic
gtcgtgctgaataacatctaccagggctccactcagtatgaagctggtagagcaccagcgtatagggtaattaga

SEQ ID NO: 64739 - DNA, 75 bp, Artificial Sequence
  Synthetic
catctgtgacagtggaagacactccggtggtccaacctgaaaggttggtgcctagacgacctgcaccgcctgtgc

SEQ ID NO: 64740 - DNA, 75 bp, Artificial Sequence
  Synthetic
ggagatatatctaaaagtacggatgaggccatcgtgaacgcagccaacaataaaggccagccaggagcaggcgtc

SEQ ID NO: 64741 - DNA, 75 bp, Artificial Sequence
  Synthetic
gtttcgctatggagcatacccagcgctactgggtttgatgtgcgtacctcctcatcgttgagtctagagcagtct

SEQ ID NO: 64742 - DNA, 75 bp, Artificial Sequence
  Synthetic
tgtggagcactgtacaagagatggccgggagcttttgataagttaccaatcgcgactggaacagcacacttagtg

SEQ ID NO: 64743 - DNA, 75 bp, Artificial Sequence
  Synthetic
ccccctgaagagactgtttaagctaggtaagccgcttccactggacgatgaccaggatgtcgacaggcgcagagc

SEQ ID NO: 64744 - DNA, 75 bp, Artificial Sequence
  Synthetic
ctccaagtcaggatagtagaccttccaccccatctgcaagtgcttcacacacgtccgtggacttaatcacgtttg

SEQ ID NO: 64745 - DNA, 75 bp, Artificial Sequence
  Synthetic
aaacatacaccgaatattatccatgcagtgggacctaatttttcccgagtgtccgaaacggaaggtaaccaaaaa

SEQ ID NO: 64746 - DNA, 75 bp, Artificial Sequence
  Synthetic
ctgtcagaagtttacatggaaattgctaaaattatcaacaaagagagatacaacaaggtgtcaatccctctgctg

SEQ ID NO: 64747 - DNA, 75 bp, Artificial Sequence
  Synthetic
tccaccggaatttatgcgggcggtaaggatcgcgtcatgcagtcgctgaaccatttgtttaccgccatggatact

SEQ ID NO: 64748 - DNA, 75 bp, Artificial Sequence
  Synthetic
accgacgcggatgtgactatctactgtctggacaaacaatgggaaacacgtataaaagatgctatcacccgtaaa

SEQ ID NO: 64749 - DNA, 75 bp, Artificial Sequence
  Synthetic
gaaagtgtggaggagcttgtggaagacgacaagccggttgacatagaactggtccgcgtgcacccgctaagctgt

SEQ ID NO: 64750 - DNA, 75 bp, Artificial Sequence
  Synthetic
tctgcatgatgaagcggcacgttggaacagaattggcatcactgaagagctggtgaaagcagttgaatcacgcta

SEQ ID NO: 64751 - DNA, 75 bp, Artificial Sequence
  Synthetic
ttggtgggacggcctggctactccacgaatgaagggaaagtgcattcttatttggaaggtacgcgcttccatcag

SEQ ID NO: 64752 - DNA, 75 bp, Artificial Sequence
  Synthetic
cgcaaccagttgaatgctacaaagttacctatcctgctcccatgtattcaagtactgcaagcaacagcttttcat

SEQ ID NO: 64753 - DNA, 75 bp, Artificial Sequence
  Synthetic
accagtgacaagcctcctggcttttataactggcatcatggagctgtacagtatgagaacaacaggttcaccgta

SEQ ID NO: 64754 - DNA, 75 bp, Artificial Sequence
  Synthetic
acggccaaagacattgccgagatctatgctatgtggccgaacaaacaagaagccaatgaacagatatgcttatac

SEQ ID NO: 64755 - DNA, 75 bp, Artificial Sequence
  Synthetic
gtgctcggtgagagtatgaccagtatccgctccaagtgcccagtagaagagtctgaagcatcctcaccgccgcat

SEQ ID NO: 64756 - DNA, 75 bp, Artificial Sequence
  Synthetic
accatcccatgtctctgcaattacgccatgacagcagagcgcgtttttagactgcgcatggcaaagaatgaacag

SEQ ID NO: 64757 - DNA, 75 bp, Artificial Sequence
  Synthetic
tttgcagtatgctcttctttccagctacctaaatataggatatcaggagtgcaaaaaatccagtgcaacaaacct

SEQ ID NO: 64758 - DNA, 75 bp, Artificial Sequence
  Synthetic
attattttctccggtgtagtacccccggccatacatccgcgaaaattttccgctgtcgaggagactgcaccggcg

SEQ ID NO: 64759 - DNA, 75 bp, Artificial Sequence
  Synthetic
atcattccagaacggctcgtcccacgacgtccagccccaccagtgccagagccagctcgcattcccagcccgcgc

SEQ ID NO: 64760 - DNA, 75 bp, Artificial Sequence
  Synthetic
tgctcccctgcaatcagcatgcaatccctggacggcaacaccgacacatccgtatctggaactgctcttagcagc

SEQ ID NO: 64761 - DNA, 75 bp, Artificial Sequence
  Synthetic
gttgcctcggtgaccactattgaagccgaaattcctgattctgactcggagtgcagtattccacctatgcctttc

SEQ ID NO: 64762 - DNA, 75 bp, Artificial Sequence
  Synthetic
gttgtagaagctgaagtgcacgccagcttcggatcacagtggagtatccctagcgccaccggatttgacatccca

SEQ ID NO: 64763 - DNA, 75 bp, Artificial Sequence
  Synthetic
gaagactgcagcgtttcctctgaaggctcaatcagcacccatacatctggggtctcaggtcactctgtaaacctg

SEQ ID NO: 64764 - DNA, 75 bp, Artificial Sequence
  Synthetic
attacctttgatagtgtcacagatatttttgaaaacttcaagcaagcacctttccaatttttatctgacatacgc

SEQ ID NO: 64765 - DNA, 75 bp, Artificial Sequence
  Synthetic
gatcaaagcgcatctgcttctagcggagctgaaatctctgtagaccaggtttcgctatggagcatacccagcgct

SEQ ID NO: 64766 - DNA, 75 bp, Artificial Sequence
  Synthetic
ccgatccctgcaccacgtcgacacgtggtaacacctgaagacaaccagcagcgcatgagaccaattccgaagcct

SEQ ID NO: 64767 - DNA, 75 bp, Artificial Sequence
  Synthetic
cgcagtactgtcaggtacagcaagcctccaggagtagctagatcaatctccgaggcggagttggatgagtttatc

SEQ ID NO: 64768 - DNA, 75 bp, Artificial Sequence
  Synthetic
ggcaatgatgaaatccgggatgtttttgacactctttatcaatactgttgtcaatatcatgatcgctagccgcgt

SEQ ID NO: 64769 - DNA, 75 bp, Artificial Sequence
  Synthetic
cgccagcactcaaattgacggtacgaagcgggagcgtatattttctcatcggaaacaggacaagggcatctccaa

SEQ ID NO: 64770 - DNA, 75 bp, Artificial Sequence
  Synthetic
cagaaatccactagacagtgcacacttcagcatcctatattggagcgctctgtccatgagagattctacgccccg

SEQ ID NO: 64771 - DNA, 75 bp, Artificial Sequence
  Synthetic
cgcctcgaccttgaaaaagaaaaactactacaaaagaaactgcaactgtgtgcatcagaagggaacaggagtagg

SEQ ID NO: 64772 - DNA, 75 bp, Artificial Sequence
  Synthetic
tatcaatcacgtaaggttgaaaacatgaaggctcttactgtggaacggctgttacaagggataggagcgtacctc

SEQ ID NO: 64773 - DNA, 75 bp, Artificial Sequence
  Synthetic
tcagctgagtcgcaatcagtagagtgctacaaagttaactatcccgtccccatatactccaccacacgcagtaac

SEQ ID NO: 64774 - DNA, 75 bp, Artificial Sequence
  Synthetic
aggttctcttcggcagacgtggcggtgagggtgtgcaacttggttttacaggaaaattttccaacagtggccagc

SEQ ID NO: 64775 - DNA, 75 bp, Artificial Sequence
  Synthetic
tataacatcaccgacgagtatgacgcctacttagatatggtggatggagcttcctgctgcttggataccgctacc

SEQ ID NO: 64776 - DNA, 75 bp, Artificial Sequence
  Synthetic
ttttgccccgctaaactacgcagttttccgaagaagcacagttacttgaagcctgagattcggtcagctgttcca

SEQ ID NO: 64777 - DNA, 75 bp, Artificial Sequence
  Synthetic
tctcctatacagaacacacttcaaaatgtgctagcagcggccaccaaacggaactgtaacgtcactcaaatgaga

SEQ ID NO: 64778 - DNA, 75 bp, Artificial Sequence
  Synthetic
ccgggatcctaatccgcctaggcgcaggtggcggccctttaggccaccacttgcagctcaaattgaggacctgag

SEQ ID NO: 64779 - DNA, 75 bp, Artificial Sequence
  Synthetic
gaactccccgtgttggactcagccgcatttaatgtggaatgctttaagaagtacgcttgtaatgatgattactgg

SEQ ID NO: 64780 - DNA, 75 bp, Artificial Sequence
  Synthetic
gagacgttcagagacaatcccattagactcactactgaaaacgtcacccagtacgtaactaagctaaaagggcca

SEQ ID NO: 64781 - DNA, 75 bp, Artificial Sequence
  Synthetic
aaagctgcggcgttgttcgccaaaactcacaacctgcaaccattgcacgaaattccaatggataggttcgtaatg

SEQ ID NO: 64782 - DNA, 75 bp, Artificial Sequence
  Synthetic
gatcttaagcgggacgtgaaagtgaccccgggaaccaaacatactgaagaacgcccaaaggttcaagttatacaa

SEQ ID NO: 64783 - DNA, 75 bp, Artificial Sequence
  Synthetic
aaacgtttccgatcatgttgaacggacaggtgaatggatacgcgtgcgtcgtgggtggacgagtgtttaaaccgc

SEQ ID NO: 64784 - DNA, 75 bp, Artificial Sequence
  Synthetic
gctgcagaaccactagcaaccgcatatttatgtggaatacacagggagttagttagaaggctaaatgctgtactg

SEQ ID NO: 64785 - DNA, 75 bp, Artificial Sequence
  Synthetic
tacggtgtagaggcaaccaccctatttccacctatccaaaatggagaaagttcatgttgacttagacgcagacag

SEQ ID NO: 64786 - DNA, 75 bp, Artificial Sequence
  Synthetic
ctgcctaatgtgcatacactctttgacatgtctgcagaagattttgacgccatcattgctgagcatttccaattt

SEQ ID NO: 64787 - DNA, 75 bp, Artificial Sequence
  Synthetic
ggagatgccgtgttagaaacagatatcgcatcgttcgataagagcgaagacgatgcgattgccttgtcagcgctt

SEQ ID NO: 64788 - DNA, 75 bp, Artificial Sequence
  Synthetic
tgagaacaataggttcaccgtaccacgaggggtcggtggaaagggtgacagcgggagacctattcttgacaacaa

SEQ ID NO: 64789 - DNA, 75 bp, Artificial Sequence
  Synthetic
atgatccttgaggacttgggtgtcgatcaggcacttctggatctgatagaagctgcctttggggatataacgtct

SEQ ID NO: 64790 - DNA, 75 bp, Artificial Sequence
  Synthetic
cccttgctgagagcggatcatttacattccacttctccactgcaaacatccatccagcttttaagctgcaggtct

SEQ ID NO: 64791 - DNA, 75 bp, Artificial Sequence
  Synthetic
gtccacttacctacaggcacccgctttaaatttggagcaatgatgaagtcgggcatgtttttgactctctttatt

SEQ ID NO: 64792 - DNA, 75 bp, Artificial Sequence
  Synthetic
atcgtcgattatccagcacaacataccgaatcctttacgtcggcgatatccgccaccgcgtggtcgtggctaaaa

SEQ ID NO: 64793 - DNA, 75 bp, Artificial Sequence
  Synthetic
cggctctatcagtggtgacatggaaccaaaaaggggttacagtcaaagatacaccagaggggtcagagccatggt

SEQ ID NO: 64794 - DNA, 75 bp, Artificial Sequence
  Synthetic
aacaccgttgttaacatcatgatcgccagtcgagtattgcgggagaggttaacaaattcaccgtgcgccgcattt

SEQ ID NO: 64795 - DNA, 75 bp, Artificial Sequence
  Synthetic
atcggagatgacaacattgtgaaaggtgttaagtcagatgcacttatggctgaccggtgtgctacatggctgaat

SEQ ID NO: 64796 - DNA, 75 bp, Artificial Sequence
  Synthetic
atggaagtcaaaataatagacgcagtagtgggcttaaaagctccgtacttctgtgggggattcatcatcacggac

SEQ ID NO: 64797 - DNA, 75 bp, Artificial Sequence
  Synthetic
gagaaccaggagagatttggacactcacttcacccagtataagctggcacgcccgtatattgctgattgtcctaa

SEQ ID NO: 64798 - DNA, 75 bp, Artificial Sequence
  Synthetic
cgaataactggtactgcctgtagggttgcggaccccttaaagcgactgtttaagttagggaaaccgctcccgttg

SEQ ID NO: 64799 - DNA, 75 bp, Artificial Sequence
  Synthetic
aattgggccgatgaaagtgtgttggaagccagaaatatagggctgggtagttcagacttgcacgaaaagagtttc

SEQ ID NO: 64800 - DNA, 75 bp, Artificial Sequence
  Synthetic
gaagacgagcaggacgtcgacaggcgccgagctctacatgatgaagccctccgctggaacagaatcggaatcact

SEQ ID NO: 64801 - DNA, 75 bp, Artificial Sequence
  Synthetic
acactacaggtaatataccgccttttataaacactacaggcagcgcataatgctgtcttttatatcaatttacaa

SEQ ID NO: 64802 - DNA, 75 bp, Artificial Sequence
  Synthetic
gacgaactgataaaagcggttgagtcacgctatgaggtacactacatctccttaatcatcactgcattgacgacc

SEQ ID NO: 64803 - DNA, 75 bp, Artificial Sequence
  Synthetic
cttgcagctacagtcagcaactttaagcacataagaggaaaccctataaccctctacggctgacctaaataggtt

SEQ ID NO: 64804 - DNA, 75 bp, Artificial Sequence
  Synthetic
acgcagtagaggctaacctattataacaacaccaagtgtatcacaagtgcaataccgaaacgatgtttccgtatc

SEQ ID NO: 64805 - DNA, 75 bp, Artificial Sequence
  Synthetic
aaggggatgccggaccaatgtgcctggtcggcgaattagttgacccgccattccacgaatttgcgtacgagagtt

SEQ ID NO: 64806 - DNA, 75 bp, Artificial Sequence
  Synthetic
caacattaaatttcccgcctatggcgcctattaatccaatggcgtatagggatccaaacccacccaggcgcaggt

SEQ ID NO: 64807 - DNA, 75 bp, Artificial Sequence
  Synthetic
ggcggccttttaggccaccacttgccgcacagattgaggatctgagacgatcaatcgcaaacctcaccttcaagc

SEQ ID NO: 64808 - DNA, 75 bp, Artificial Sequence
  Synthetic
aacgggcacctaatccaccacctggtcctccggcaaaacgtaagaaaccggcccctaagcccaagccagctgctc

SEQ ID NO: 64809 - DNA, 75 bp, Artificial Sequence
  Synthetic
cgaagaagaaacggcaaataccccctgcaaagaagcaaaaacgtaaacagaagccaggtaaaaggcaacggatgt

SEQ ID NO: 64810 - DNA, 75 bp, Artificial Sequence
  Synthetic
atacaaccacctgcacggatgtcaaacaatgcagggcttacctgattgacaacaaaaaatgggtgtacaactctg

SEQ ID NO: 64811 - DNA, 75 bp, Artificial Sequence
  Synthetic
gcatgaaactggagtcagacaagaccttccctatcatgctgaatggacaagtgaacggctatgcatgtgtagtcg

SEQ ID NO: 64812 - DNA, 75 bp, Artificial Sequence
  Synthetic
gtggacgagttttcaaaccattgcacgtggaaggcagaatcgataacgagcagctagctaccatcaagctgaaga

SEQ ID NO: 64813 - DNA, 75 bp, Artificial Sequence
  Synthetic
aagccagcatttacgatcttgagtatggtgacgttccccaatgcatgaaatcagacaccctccagtataccagcg

SEQ ID NO: 64814 - DNA, 75 bp, Artificial Sequence
  Synthetic
agaaacccccaggtttctataactggcaccacggagcggtacagtatgaaaacaaccgatttactgtaccccgcg

SEQ ID NO: 64815 - DNA, 75 bp, Artificial Sequence
  Synthetic
gagttggaggaaaaggagacagtggtcgacctattctggacaacaaggggcgagtcgtggccattgtgctaggcg

SEQ ID NO: 64816 - DNA, 75 bp, Artificial Sequence
  Synthetic
tggatggccgcacgaagtggtagtctattactacaacagatacccattaaccacaattatcgggttatgcacctg

SEQ ID NO: 64817 - DNA, 75 bp, Artificial Sequence
  Synthetic
gagcaaatgaaggttcgcgcacagcgctgtcggtggttacgtggaaccagaagggggtcacggtcaaagataccc

SEQ ID NO: 64818 - DNA, 75 bp, Artificial Sequence
  Synthetic
ccgaaggttctgaaccttggtcactgacagctgttatgtgcgttctagccaatatcaccttcccatgcgatcaac

SEQ ID NO: 64819 - DNA, 75 bp, Artificial Sequence
  Synthetic
caccttgcatgccgtgctgctatgagaagaacccgcatgagacacttaatatgcttgaacagaattacgacagcc

SEQ ID NO: 64820 - DNA, 75 bp, Artificial Sequence
  Synthetic
aggcctatgaccagctgctggaagcggcagttaagtgcaatggcagaagaacaagaagggatgtggacgctcact

SEQ ID NO: 64821 - DNA, 75 bp, Artificial Sequence
  Synthetic
ttacccagtataaattagcccgcccgtatatagccgactgcccaaattgcggtcatggcagatgtgacagtccga

SEQ ID NO: 64822 - DNA, 75 bp, Artificial Sequence
  Synthetic
tcttgtcaaccacataacactataggcagtgtataaggctgtcttattcaacactaaattcaccctagttcgatg

SEQ ID NO: 64823 - DNA, 75 bp, Artificial Sequence
  Synthetic
ggccggcttttttacttgtctgcggcgccttgggcgccgcagcgtacgaacacacagcagtgatgccgaacaagg

SEQ ID NO: 64824 - DNA, 75 bp, Artificial Sequence
  Synthetic
tcgctatcgaggacgtgcgcggagacgcgcacgccggttacatccgcatacagacatccgcaatgttcggcatga

SEQ ID NO: 64825 - DNA, 75 bp, Artificial Sequence
  Synthetic
agtcggaaggggttgatctggcttacatgagctatatgaacggaaaggttttaaaagccatcaagattgatagcc

SEQ ID NO: 64826 - DNA, 75 bp, Artificial Sequence
  Synthetic
cacctacagatacagctggttaataccaggataattccatcaactaacctggagtacatcacctgcaagtataag

SEQ ID NO: 64827 - DNA, 75 bp, Artificial Sequence
  Synthetic
tgtacgtccgtacatcagcaccttgttctctggtttcttatcacggatactacctcctcgcgcagtgcccaccag

SEQ ID NO: 64828 - DNA, 75 bp, Artificial Sequence
  Synthetic
aatgctgcggtgccactcaatgtacctccaaaccccaacctgactatcagtgccaggtgtttacaggtgtttacc

SEQ ID NO: 64829 - DNA, 75 bp, Artificial Sequence
  Synthetic
gagatactgtaacagtagggttcctagaaggtacccacaagtatatgtgtacagtagcgcaccaggtaaaattta

SEQ ID NO: 64830 - DNA, 75 bp, Artificial Sequence
  Synthetic
acccggtggggagagagaaatacagacatccaccagaacacggtgttgaactaccctgcaacaaatacacccata

SEQ ID NO: 64831 - DNA, 75 bp, Artificial Sequence
  Synthetic
gaagccgtggctgaggctgaagccgtacgtgcagcactacctccacttctgccggaggtcgataaggagaccgta

SEQ ID NO: 64832 - DNA, 75 bp, Artificial Sequence
  Synthetic
agcgtgccgatcaaggccattatgtagaaatgcaccaaccgggtatggtcgccgaccacactctgttgagcatga

SEQ ID NO: 64833 - DNA, 75 bp, Artificial Sequence
  Synthetic
gacacctagacgacacatcaaggtcacgacgtatccaggggaagaaatgatcggctcgtacgcagtgctttcacc

SEQ ID NO: 64834 - DNA, 75 bp, Artificial Sequence
  Synthetic
gcggcaccaaggtgaaagtcaccgcaccgagcagttcgcaagtgaaatattactgcaaatgtccagatcttcaag

SEQ ID NO: 64835 - DNA, 75 bp, Artificial Sequence
  Synthetic
aaggaactaccagcggtgaacacacaacaacatgtaccgatgttaagcaatgccgagcgtatctgattgacaaca

SEQ ID NO: 64836 - DNA, 75 bp, Artificial Sequence
  Synthetic
ggaagtgggtgtacaactcaggaaaattacctagaggagaaggcgaaacctttaaaggcaaactccatgtaccat

SEQ ID NO: 64837 - DNA, 75 bp, Artificial Sequence
  Synthetic
ggatctgaaacccgcgttccgtcacctccaagtcaggatagtagaccttccaccccatctacaagtggttcgcac

SEQ ID NO: 64838 - DNA, 75 bp, Artificial Sequence
  Synthetic
ttgtacctgttgcggccacctgcacagcgacccttgctccagagcctctcgtcgagcacaagcaccgctccctga

SEQ ID NO: 64839 - DNA, 75 bp, Artificial Sequence
  Synthetic
tcctccacttgcatccagagcaccccacgctattgacaacaagggcgctcggaagtcaagcacaaccgactaggc

SEQ ID NO: 64840 - DNA, 75 bp, Artificial Sequence
  Synthetic
aatggatagaccgcccaaccaccgtcaacttcacagttaccggagaaggttttgaatatacctggggcaaccatc

SEQ ID NO: 64841 - DNA, 75 bp, Artificial Sequence
  Synthetic
cgattataagaatcacgagatcatgactgcagcggcctcacaggggcttactagaaaaggggtatacgcagtgcg

SEQ ID NO: 64842 - DNA, 75 bp, Artificial Sequence
  Synthetic
ccccgaaaagagtatgggcccaagagtcaggagaaggcaacccgcacggctggcctcacgaggtggtaatctact

SEQ ID NO: 64843 - DNA, 75 bp, Artificial Sequence
  Synthetic
actacaataggtacccgatgacaactatcgtgggattatgcacgtgtgccgctattattatggtgtcatgcgtta

SEQ ID NO: 64844 - DNA, 75 bp, Artificial Sequence
  Synthetic
ttgaaacaacgagcacctaaccctccagcaggaccgcccgccaagcgcaagaagcctgcgcccaagcctaagcct

SEQ ID NO: 64845 - DNA, 75 bp, Artificial Sequence
  Synthetic
cgtcactcttgctgagagcggatcatttacattccacttctccactgcaaacatccatcctgcttttaagctgca

SEQ ID NO: 64846 - DNA, 75 bp, Artificial Sequence
  Synthetic
catctgtatggcttttatgccgcacccgtaacctttgcataacaccctacagattggcaccaaatgcccacgtac

SEQ ID NO: 64847 - DNA, 75 bp, Artificial Sequence
  Synthetic
cgttttccaaaataaagtgaacgtctgctgggccaaagcgctagaacctgtgttggccactgccaatattacgct

SEQ ID NO: 64848 - DNA, 75 bp, Artificial Sequence
  Synthetic
ctctcttagtagcgttgctgtgctgcgttaaaccaactagagcagacgacaccttgcaagttctaggatacctat

SEQ ID NO: 64849 - DNA, 75 bp, Artificial Sequence
  Synthetic
ggaaccacaaccagaactttttctggatgcagaccttgattcctttggctgctctaatcgtgtgcatgcgcgtac

SEQ ID NO: 64850 - DNA, 75 bp, Artificial Sequence
  Synthetic
atgcttaccagaaaagcagtggaccatttgaacaaaggtggtacgtgcgtcgcattgggctatggaactgcggac

SEQ ID NO: 64851 - DNA, 75 bp, Artificial Sequence
  Synthetic
gttccgctgacttacaccaatgaacactgggataatagcccaggtccaaacatgtatggtttgtgcatgcgcact

SEQ ID NO: 64852 - DNA, 75 bp, Artificial Sequence
  Synthetic
tgcggtgctttttgtgctgcggtccggcttttttacttgtctgcggcgccttgggcgccgcagcatacgagcaca

SEQ ID NO: 64853 - DNA, 75 bp, Artificial Sequence
  Synthetic
cggctgtgatgtcgaacaaggtggggatcccttacaaagccctagttgaaaggccagggtacgcacccgtacatc

SEQ ID NO: 64854 - DNA, 75 bp, Artificial Sequence
  Synthetic
ttccgagctatggtgacggtggtgcataatgccgccgatgcagtgcataaggctgctatattaccacattataac

SEQ ID NO: 64855 - DNA, 75 bp, Artificial Sequence
  Synthetic
tccagatccagctggtaagcacaaaaataatccctacagcgaacttggaatacattacctgtaaatataagacta

SEQ ID NO: 64856 - DNA, 75 bp, Artificial Sequence
  Synthetic
actaagggcagtgcataatgctgctcctaagtaattttatacacactttataatcaggcataattgccgcatata

SEQ ID NO: 64857 - DNA, 75 bp, Artificial Sequence
  Synthetic
aggtgccttccccagtagtaaaatgttgcggatccacccaatgtacgtctaaacaatacccagactatcagtgcc

SEQ ID NO: 64858 - DNA, 75 bp, Artificial Sequence
  Synthetic
aagtcttcacgggagtctacccatttatgtggggaggagcctactgtttctgtgatactgaaaatacacaaatga

SEQ ID NO: 64859 - DNA, 75 bp, Artificial Sequence
  Synthetic
cgctactgggttcgatgtgcgtacctcctcatcgttgagtctagagcagcctaccttttcgtcaatggttgtcga

SEQ ID NO: 64860 - DNA, 75 bp, Artificial Sequence
  Synthetic
gcgaagcgtatgtcgaacgctcagaagaatgctcagtggaccaggccaaagcctacaaagtacacacaggaacgg

SEQ ID NO: 64861 - DNA, 75 bp, Artificial Sequence
  Synthetic
tgcaggctgtagttaatatcacctacgggggcgtcagctggagatctgccgacgtctatgtcaacggagagaccc

SEQ ID NO: 64862 - DNA, 75 bp, Artificial Sequence
  Synthetic
ctgccaaaataggtgatgctaaactaactataggccctctctcttccgcatggtcaccttttgactctaaagtca

SEQ ID NO: 64863 - DNA, 75 bp, Artificial Sequence
  Synthetic
tagtgtacgggcacgaggtgtataactatgactttcccgaatacggtaccggcaaagccggttcgttcggagact

SEQ ID NO: 64864 - DNA, 75 bp, Artificial Sequence
  Synthetic
tgcaatccaggacacttacaagtaaggacttgtactctaacaccaatttgaaactgcaacgtccccagccaggag

SEQ ID NO: 64865 - DNA, 75 bp, Artificial Sequence
  Synthetic
tggtccacaccccatacacccaggcaccctcggggtttgaacgttggaagaaagatcgaggggcaccgctaaacg

SEQ ID NO: 64866 - DNA, 75 bp, Artificial Sequence
  Synthetic
acgtcgctccttttggatgcaacatagccctggaaccactgcgtgctgagaactgtgcggtggggagtatccctc

SEQ ID NO: 64867 - DNA, 75 bp, Artificial Sequence
  Synthetic
tctccatcgacatacccgatgccgcttttaccaggatatcggagacaccgactgtctccgatctggaatgtaaaa

SEQ ID NO: 64868 - DNA, 75 bp, Artificial Sequence
  Synthetic
ggtcctaatttctctcggctatcagaaaacgaaggagaccagaaattgtctgaagtgtacatggacattgccaga

SEQ ID NO: 64869 - DNA, 75 bp, Artificial Sequence
  Synthetic
ttactgagtgcacgtatgcgtcagattttgggggaatagctactatgtcgtataaagctagcaaggcaggaaact

SEQ ID NO: 64870 - DNA, 75 bp, Artificial Sequence
  Synthetic
gccctattcattccccttcgggcattgcagtaattaaagagaacgatgttattctttctggaagcggctcgttca

SEQ ID NO: 64871 - DNA, 75 bp, Artificial Sequence
  Synthetic
tatttacagccatggatactaccgacgcagacatcactatttactgtctagataagcaatgggagtcaagaataa

SEQ ID NO: 64872 - DNA, 75 bp, Artificial Sequence
  Synthetic
cgttccatttttcaacagcgagcatccacccagcgttcaagatgcaggtatgcaccagcgtagtcacctgcaaag

SEQ ID NO: 64873 - DNA, 75 bp, Artificial Sequence
  Synthetic
gtgactgcaagccacctaaggaccatatcgtcgattacccagcccagcatactgagacgtttacatcagcagttt

SEQ ID NO: 64874 - DNA, 75 bp, Artificial Sequence
  Synthetic
ccgcaactgcatggtcatggctgaaagtgctagttgggggcacatccgtctttatcattcttgggctaatcgcta

SEQ ID NO: 64875 - DNA, 75 bp, Artificial Sequence
  Synthetic
agcgttgactacattagcatcttcagttagcaactttaaacacataagaggtcaccctataaacctctacggctg

SEQ ID NO: 64876 - DNA, 75 bp, Artificial Sequence
  Synthetic
cagcagtggttgccctggtgctattcacccacaaacactaatactagcagtaaattaccactatattatatcaac

SEQ ID NO: 64877 - DNA, 75 bp, Artificial Sequence
  Synthetic
atagttcgatgtacttccgagctatgttgctggtggtgcataatgccaccggtgtagagcccgcacccatacact

SEQ ID NO: 64878 - DNA, 75 bp, Artificial Sequence
  Synthetic
aatcccatcgtagttcgatgtacttccgagctacgatgaaggtggtgtataacgccaccaaagcagtgcataatg

SEQ ID NO: 64879 - DNA, 75 bp, Artificial Sequence
  Synthetic
ctgccaccacacactacatacaattttacaacactactggcagcgcataatgctgcctttttacttttcttttat

SEQ ID NO: 64880 - DNA, 75 bp, Artificial Sequence
  Synthetic
ccgagcctacgatcagctgctcgatgccgctgtgaaatgtaatgctaggagaaccaggagggatttggacactca

SEQ ID NO: 64881 - DNA, 75 bp, Artificial Sequence
  Synthetic
aaaaacttatgggcagtgacactgccccctcttttaaaaacttaaaaatttttcttcttttatgtttttattttg

SEQ ID NO: 64882 - DNA, 75 bp, Artificial Sequence
  Synthetic
agaaaaggggtatacgcagtgcgctacaaggtcaatgagaacccgctatacgcacagacatctgagcatgtgaat

SEQ ID NO: 64883 - DNA, 75 bp, Artificial Sequence
  Synthetic
aaaacttaaaaatttttcttcttttatgtttttattttgtttttaatatttcaaaaaaaaaaaaaaaaaaaaaaa

SEQ ID NO: 64884 - DNA, 75 bp, Artificial Sequence
  Synthetic
ttgtcaaccacataacactacaggcagtgtataaggctgtcttactaaacactaaattcaccctagttcgatgta

SEQ ID NO: 64885 - DNA, 75 bp, Artificial Sequence
  Synthetic
acaattacactacaggtaatataccgcctcttataaacactacaggcagcgcataatgctgtcttttatatcaat

SEQ ID NO: 64886 - DNA, 75 bp, Artificial Sequence
  Synthetic
gttgtcacacacagatacactgggaacggtgattactcccagctagtgaccaagatgacaggaaaaaccgtacta

SEQ ID NO: 64887 - DNA, 75 bp, Artificial Sequence
  Synthetic
ctatcctgctcccatgtattcaagtactgcaagcaacagcttttcatcagcagaagtggccgtcaaagtttgcaa

SEQ ID NO: 64888 - DNA, 75 bp, Artificial Sequence
  Synthetic
cctagtactgcaagagaattttcccactgtagccagctacaacataacggacgagtatgatgcctatcttgacat

SEQ ID NO: 64889 - DNA, 75 bp, Artificial Sequence
  Synthetic
cctggagcttttgataagcagccggtagcaactggtaaagcgcaccttgtcaagcattctccgaacgtcatccat

SEQ ID NO: 64890 - DNA, 75 bp, Artificial Sequence
  Synthetic
actgtagccagctacaacataacggacgagtatgatgcctatcttgacatggtagatggagcatcctgctgttta

SEQ ID NO: 64891 - DNA, 75 bp, Artificial Sequence
  Synthetic
actcaaatgagggaacttccagtgctggattcggctgccttcaacgtagagtgtttcaaaaagtacgcctgtaaa

SEQ ID NO: 64892 - DNA, 75 bp, Artificial Sequence
  Synthetic
gttcgattgccctggagccgctccgtgcagaaaattgtgcagtgggaagcatccctatatctatagatatacctg

SEQ ID NO: 64893 - DNA, 75 bp, Artificial Sequence
  Synthetic
acctagaggggactaggtttcatcaaactgccaaagacatagctgaaatttacgctatgtggcctaacaagcaag

SEQ ID NO: 64894 - DNA, 75 bp, Artificial Sequence
  Synthetic
cgtgttgggagagagtatgaacagcatccgctctaagtgtcctgttgaagagtcggaagcctcttccccccctca

SEQ ID NO: 64895 - DNA, 75 bp, Artificial Sequence
  Synthetic
tgcagaattatctattaccagtggtcgcccaggcgttctcgcggtgccgggaacaccgcgcagacctggaggacg

SEQ ID NO: 64896 - DNA, 75 bp, Artificial Sequence
  Synthetic
ccatttacaagagacctgggactcaaactattaagaaggtgcccgccgtattcaattcatttgtcatcccacaac

SEQ ID NO: 64897 - DNA, 75 bp, Artificial Sequence
  Synthetic
gtttcgctatggagcatacccagcgctactgggttcgatgtgcgtacctcctcatcgttgagtctagagcagcct

SEQ ID NO: 64898 - DNA, 75 bp, Artificial Sequence
  Synthetic
acctttccgacaatggttgtcgaagctgagattcacgccagtcaaggatcactgtggagtatacccagtatcacc

SEQ ID NO: 64899 - DNA, 75 bp, Artificial Sequence
  Synthetic
actgtggagtatacccagtatcaccggatctgaaacccgtgttccgtcacctccaagtcaggatagtagaccatc

SEQ ID NO: 64900 - DNA, 75 bp, Artificial Sequence
  Synthetic
caccccatctgcaagtgcttcacacacgtccgtggacttaatcacgtttgacagcgttgcagagattttggagga

SEQ ID NO: 64901 - DNA, 75 bp, Artificial Sequence
  Synthetic
accaggcgctgaaaggtgtacgaactatctattggatcgggttcgatactacaccgttcatgtacaagaacatgg

SEQ ID NO: 64902 - DNA, 75 bp, Artificial Sequence
  Synthetic
gttcagacttgcacgaaaagagtttcggaaaagtatccattatgaggaagaagagactacaacccactaataaag

SEQ ID NO: 64903 - DNA, 75 bp, Artificial Sequence
  Synthetic
tttccaccctgttctatgataaacggatgagaactgtcaacccatgcaatgataagatcataatagataccacca

SEQ ID NO: 64904 - DNA, 75 bp, Artificial Sequence
  Synthetic
ttcaaaacacgctccagaatgtactagcagcagccacgaaacggaattgcaatgttactcaaatgagggaacttc

SEQ ID NO: 64905 - DNA, 75 bp, Artificial Sequence
  Synthetic
accagctatgggcttgatataggattgcgtcgccgaattaagatgctatttgatgcaaagaaggcacccgctcca

SEQ ID NO: 64906 - DNA, 75 bp, Artificial Sequence
  Synthetic
tgcagaattacctattaccagtggtagcccaggcgttctcgcggtgccgggaataccgcgcagacctggaagacg

SEQ ID NO: 64907 - DNA, 75 bp, Artificial Sequence
  Synthetic
agaggccgacatcgacctgatcatgcaggaggcaggagcaggcagcgtggagacacctagacgacacatcaaggt

SEQ ID NO: 64908 - DNA, 75 bp, Artificial Sequence
  Synthetic
gtcgtgggtggacgagtgtttaaaccgctgcacgtagaaggcagaatagacaatgagcaactggccgccatcaag

SEQ ID NO: 64909 - DNA, 75 bp, Artificial Sequence
  Synthetic
gttatgaaaagaatccacacgaaacactcaccatgttggaacagaattacgacagccgagcctatgatcagctgc

SEQ ID NO: 64910 - DNA, 75 bp, Artificial Sequence
  Synthetic
aagaaccacgagatcatgaccgcagcggcctcacaggggcttactagaaaaggggtatacgcagtgcgctacaag

SEQ ID NO: 64911 - DNA, 75 bp, Artificial Sequence
  Synthetic
taactgtgggcatagtcggtgcgacagccctatagctatagaagaagtcagaggggatgcgcacgcaggagtcat

SEQ ID NO: 64912 - DNA, 75 bp, Artificial Sequence
  Synthetic
gtacatcacctgcaagtataagacaaaagtgccttctccagtagtgaaatgctgcggtgccactcaatgtacctc

SEQ ID NO: 64913 - DNA, 75 bp, Artificial Sequence
  Synthetic
agatgtttacgtcaatggtgaaactcccgcgaaaataggagatgccaaactcatcataggtccactgtcatctgc

SEQ ID NO: 64914 - DNA, 75 bp, Artificial Sequence
  Synthetic
agtgcatcgccacgctggcaccagagcctctagttgagcacaaacaccgcaccctgattttacacctgcacccgg

SEQ ID NO: 64915 - DNA, 75 bp, Artificial Sequence
  Synthetic
aacactgggataatagcccaggtccaaacatgtatgggttgtgcatgcgcaacgctaaagaacttgcacgtcggt

SEQ ID NO: 64916 - DNA, 75 bp, Artificial Sequence
  Synthetic
caagtcccaatactcctggcgttactttgctgcattaagccgacgagggcagatgacaccttgcaagtgctgaat

SEQ ID NO: 64917 - DNA, 75 bp, Artificial Sequence
  Synthetic
cacaagcggtccttaacagcgagaagctagcttgtattcacccgttagctgagcaagtgctcgtgatgactcaca

SEQ ID NO: 64918 - DNA, 75 bp, Artificial Sequence
  Synthetic
ctgcactagtgcagttacctgcaaaggagattgtaagccaccgaaagaccacatcgtcgattatccagcacaaca

SEQ ID NO: 64919 - DNA, 75 bp, Artificial Sequence
  Synthetic
aaagtctccattccgttgttatctaccggcatttacgcaggtggtaaggacagggttatgcaatcgctgaaccat

SEQ ID NO: 64920 - DNA, 75 bp, Artificial Sequence
  Synthetic
atgcggcttttaccagaatatctgaaacaccgacagtctcagacctggaatgcaaaattacggagtgtacttatg

SEQ ID NO: 64921 - DNA, 75 bp, Artificial Sequence
  Synthetic
acgcagacatcaccatttactgtctagataagcaatgggagtcaagaataaaggaagctatcacccggaaggaaa

SEQ ID NO: 64922 - DNA, 75 bp, Artificial Sequence
  Synthetic
tgcaaaggagattgtaagccaccgaaagaccacatcgtcgattatccagcacaacatactgaatcctttacgtcg

SEQ ID NO: 64923 - DNA, 75 bp, Artificial Sequence
  Synthetic
tagaggggactaggtttcatcaaactgccaaagacgtagctgagattaacgctatgtggcctaacaagcaagaag

SEQ ID NO: 64924 - DNA, 75 bp, Artificial Sequence
  Synthetic
catcccgtgtctgtgcaactatgcaatgactgcagagcgagtttacagattacgtatggcaaagaacgaacaatt

SEQ ID NO: 64925 - DNA, 75 bp, Artificial Sequence
  Synthetic
tatgtggcctaacaagcaagaagcaaacgagcagatttgcttatatgtgttgggagagagtatgaacagcatccg

SEQ ID NO: 64926 - DNA, 75 bp, Artificial Sequence
  Synthetic
gcacacgcattccaaacataagtaccactgcatttgcccaatgaagagcgcagaagaccctgacagactctaccg

SEQ ID NO: 64927 - DNA, 75 bp, Artificial Sequence
  Synthetic
ttcatctaaaaggtaaaactagctttacaggcagatgtaacactatcgtcagctgcgaaggttacgttgtcaaga

SEQ ID NO: 64928 - DNA, 75 bp, Artificial Sequence
  Synthetic
tgttacgcagttggcatctacctaatgtttttcatctaaaaggtaaaactagctttacaggcagatgtaacacca

SEQ ID NO: 64929 - DNA, 75 bp, Artificial Sequence
  Synthetic
tccgacaatggttgtcgaagcagagattcacgccagtcaaggatcactgtggagtatacccagtatcaccggatc

SEQ ID NO: 64930 - DNA, 75 bp, Artificial Sequence
  Synthetic
aaatgatcggctcgtacgcagtgctttcaccacaagcggtccttaacagcgagaagctcgcttgtattcacccgt

SEQ ID NO: 64931 - DNA, 75 bp, Artificial Sequence
  Synthetic
attctccgaacgtcatccatgccgttggccctaatttttctcggctatcagaaaacgaaggagaccagaaattgt

SEQ ID NO: 64932 - DNA, 75 bp, Artificial Sequence
  Synthetic
gaagacttccacactcattggttgtcacacatagatacactgggaacggtgactactcccagctagtgactaaga

SEQ ID NO: 64933 - DNA, 75 bp, Artificial Sequence
  Synthetic
ccaactgttccgctgacttacaccaatgaacactgggataatagcccaggtccaaacatgtatggtttgtgcatg

SEQ ID NO: 64934 - DNA, 75 bp, Artificial Sequence
  Synthetic
tccacactttgtttgacatgtctgcagaagattttgatgctatcattgcagaacactttcaattcggcgacgcgg

SEQ ID NO: 64935 - DNA, 75 bp, Artificial Sequence
  Synthetic
ggtatccttgtattctgaaagccgtggatacaggtagagtggctgatgttcgcaccgacactatcaaagactata

SEQ ID NO: 64936 - DNA, 75 bp, Artificial Sequence
  Synthetic
gaacactttcaattcggcgacgcggtgctagagacagacatagcttcttttgataaaagcgaggacgatgctatc

SEQ ID NO: 64937 - DNA, 75 bp, Artificial Sequence
  Synthetic
aggaccatgcgatccaccacagcatgcttaccagaaaagcagtggaccatttgaacaaaggcggtacgtgcatcg

SEQ ID NO: 64938 - DNA, 75 bp, Artificial Sequence
  Synthetic
cagtttgttcgtcctttcagttaccgaaatacaggattacaggggttcagaaaattcaatgtagtaagcctgtga

SEQ ID NO: 64939 - DNA, 75 bp, Artificial Sequence
  Synthetic
acactttcaattcggcgacgcggtgttagagacagacatagcttcttttgacaaaagtgaggacgatgctatcgc

SEQ ID NO: 64940 - DNA, 75 bp, Artificial Sequence
  Synthetic
caggaccgcccgccaaacgcaagaagcctgcgccaagcctaagcctgcgcaggaaaaagaagcgaccaccaccac

SEQ ID NO: 64941 - DNA, 75 bp, Artificial Sequence
  Synthetic
attcacgccagtctaggatcactgtggagtgtacccagtatcaccggatctgaaactcgcgttccgtcacctcca

SEQ ID NO: 64942 - DNA, 75 bp, Artificial Sequence
  Synthetic
aatgctgtcttttatatcaatttacaaaatcatattaatttttcttttatgtttttattttgtttttaatatttc

SEQ ID NO: 64943 - DNA, 75 bp, Artificial Sequence
  Synthetic
aaaatgttactcagtatgttactaagttaaagggacccaaagcagctgcccttttttctaaaacacataacttac

SEQ ID NO: 64944 - DNA, 75 bp, Artificial Sequence
  Synthetic
atacgatcagcagtgccatcaccgattcaaaacacgctccaaaatgtactagcagcagccacgaaacggaattgc

SEQ ID NO: 64945 - DNA, 75 bp, Artificial Sequence
  Synthetic
gaacgcagtgctgctaccgaatatccacactttgtttgacatgtctgcagaagactttgatgctatcattgctga

SEQ ID NO: 64946 - DNA, 75 bp, Artificial Sequence
  Synthetic
agtaaattttgcgtgctagtcgcttggcgttagtccgtgaagtgagtttttggatacattgtaccagagattaac

SEQ ID NO: 64947 - DNA, 75 bp, Artificial Sequence
  Synthetic
tggatacattgtaccagagattaacacgttgaaattatttctgaaaacagaaaatcagaatcagacgcgatgaat

SEQ ID NO: 64948 - DNA, 75 bp, Artificial Sequence
  Synthetic
aatcgcagaagtaacacccggaaaaagggtgtcaacttaaaattgcaaaatcaaaataaaaaaggaccggggaaa

SEQ ID NO: 64949 - DNA, 75 bp, Artificial Sequence
  Synthetic
cccggtcctaagaagatgaggggaagaaacttcctcagtccgcttatgcggatccgagcgatgatcgtttacctc

SEQ ID NO: 64950 - DNA, 75 bp, Artificial Sequence
  Synthetic
ataacactgatcttaacaggcaggaaatggacaccggcgatgaaaaacttctggaaacggatcaaccctgacgtg

SEQ ID NO: 64951 - DNA, 75 bp, Artificial Sequence
  Synthetic
gggctgagcacattgcgcagagtgaagaacatcgccaacaacttgatgaaaggacttctagcccggaagcgtcga

SEQ ID NO: 64952 - DNA, 75 bp, Artificial Sequence
  Synthetic
agttccgccacgcacctatggcttctgttcacactcggtgccgcatgcggcattcatgtggagaggtttgtgttt

SEQ ID NO: 64953 - DNA, 75 bp, Artificial Sequence
  Synthetic
agtggaacacccggaatcctgatgaatgtgacaaggcatgacgtggggaagacgttcagaatctcaggggggaac

SEQ ID NO: 64954 - DNA, 75 bp, Artificial Sequence
  Synthetic
tgtacagttatgaccatcgatgccggacactggtgtccagatagcacaacataccaatgccccaccctcactgaa

SEQ ID NO: 64955 - DNA, 75 bp, Artificial Sequence
  Synthetic
aacgaacatccagaagatgtggactgttggtgccatggcgttccgagcgtgtacgtgacatacgggaagtgcaag

SEQ ID NO: 64956 - DNA, 75 bp, Artificial Sequence
  Synthetic
gccgacggggccccgcgacgctcgagaaggtcagtcgagatcacgagccacataacggaagggttgaacacccgc

SEQ ID NO: 64957 - DNA, 75 bp, Artificial Sequence
  Synthetic
caggaaacgtgggccattgaccgttatggaaaactccagctagaaaaagtggaaagatgggtaatacgcaacccc

SEQ ID NO: 64958 - DNA, 75 bp, Artificial Sequence
  Synthetic
atgtatgctctggctgttgcgctgatcagctacttctttggaagcaacaatgtacagcgagtggtgatcgggagc

SEQ ID NO: 64959 - DNA, 75 bp, Artificial Sequence
  Synthetic
cttcttctgctcattgctccggcttacagcactcactgcaccagcatagagaatcgggatttcttgagtggggcc

SEQ ID NO: 64960 - DNA, 75 bp, Artificial Sequence
  Synthetic
caggggacgacatggacctctgtggtcttggaacatggtggctgcgtcactttgacctcagacgataaacccagc

SEQ ID NO: 64961 - DNA, 75 bp, Artificial Sequence
  Synthetic
ttggacatatggctagactcagtcactataaatggcccaccattggtcaggaaagtgtgttatgatgctaacatt

SEQ ID NO: 64962 - DNA, 75 bp, Artificial Sequence
  Synthetic
tcagaccaaaaaaccgctaataaatgccctaccacgggggaagccatcttggatgaggaacacgaggtggagtac

SEQ ID NO: 64963 - DNA, 75 bp, Artificial Sequence
  Synthetic
gaatgcaaaagagggttttctgaccgaggttgggggaacgggtgtgggctgtttggaaaaggtagcatcgttgcc

SEQ ID NO: 64964 - DNA, 75 bp, Artificial Sequence
  Synthetic
tgtgcaaaatttgcatgcgcacacgacatgcaactgcatgaaattggccaggacaaggtgcactttgtcatcaaa

SEQ ID NO: 64965 - DNA, 75 bp, Artificial Sequence
  Synthetic
ctccaactacatacctctgagagggattccacttcagctgactggaagagaagcatagagttcaacatgctttcc

SEQ ID NO: 64966 - DNA, 75 bp, Artificial Sequence
  Synthetic
ggacaacaggtggttgtgttcactggatatggaactgtgacactcagttgcaacctgaaaaccaccatggacttg

SEQ ID NO: 64967 - DNA, 75 bp, Artificial Sequence
  Synthetic
ggcaattattacattgccatcctgggctctgataggtttcttgttaacaaaaactgggccactgacctgccactg

SEQ ID NO: 64968 - DNA, 75 bp, Artificial Sequence
  Synthetic
ccttggacgccggcttctgctgatgcttggcgtgaaaaacactacctggtacacttcgaggagccacatgcaacc

SEQ ID NO: 64969 - DNA, 75 bp, Artificial Sequence
  Synthetic
tcagtggcagtgacaactctgggggaccaggaaggggctgtaaaacttgccatgagtggggccaccagactgcaa

SEQ ID NO: 64970 - DNA, 75 bp, Artificial Sequence
  Synthetic
ctctccagtgggaaaaacgttctcaaggggggccacgctgtttgccaggtgcagacccatggattgaccttgaaa

SEQ ID NO: 64971 - DNA, 75 bp, Artificial Sequence
  Synthetic
ggcaagacctatgccatgtgtagaggaggatattcattttccaaaacccccgtcacttccggacaccaaacagtg

SEQ ID NO: 64972 - DNA, 75 bp, Artificial Sequence
  Synthetic
ttaatgaaagtgaaagtgtcgaaaggaactccatgcaggattccagtcacgatgtccgacagcctgacagtgaca

SEQ ID NO: 64973 - DNA, 75 bp, Artificial Sequence
  Synthetic
aagaaccaaggagtcatagtgaccacaaaccctatcgcattcgatgccaatgaggtcctgatcgaggttattcca

SEQ ID NO: 64974 - DNA, 75 bp, Artificial Sequence
  Synthetic
ccattcggagacagtcacataattattggtaatggagaggacaggctcacacaccgatggcaccagcctgggagc

SEQ ID NO: 64975 - DNA, 75 bp, Artificial Sequence
  Synthetic
accataggcaaggcgtttagagtgacaatgaggggcatggaaagaatgaccatcattggagatgacgcctgggac

SEQ ID NO: 64976 - DNA, 75 bp, Artificial Sequence
  Synthetic
tttggttccactggcggaatcttcaataccataggcaaggccattcacactgtgtttggaggtgcgttctcggca

SEQ ID NO: 64977 - DNA, 75 bp, Artificial Sequence
  Synthetic
atattcggaggggttaattggattgtgaaaatcctcataggcaccatctttttgtggctgggagtgaacgccaga

SEQ ID NO: 64978 - DNA, 75 bp, Artificial Sequence
  Synthetic
aatggcacgttgacccttgtgctgctcataactggtggtgttttggtctttcttggaacaggagtgggggctgag

SEQ ID NO: 64979 - DNA, 75 bp, Artificial Sequence
  Synthetic
actggctgcgccgtgtctttagagcagaaggagctgaaatgcggtgatggcgtgttcatcttccgcgacacgaat

SEQ ID NO: 64980 - DNA, 75 bp, Artificial Sequence
  Synthetic
gactttttgtcaaaataccgtctgtgtccattgtcaccccaggagcttgctagcataatacaggcaacgagtgag

SEQ ID NO: 64981 - DNA, 75 bp, Artificial Sequence
  Synthetic
cgtggggcctgcggcctgaactcagttgatgagcttgagcatcgaatgtggaaagagatcgaagatgaagtcaat

SEQ ID NO: 64982 - DNA, 75 bp, Artificial Sequence
  Synthetic
cacgttttagatgaaaacggtattgatctctcaatggtcgtgggcgaccctatgggggtctacagacgaggtgga

SEQ ID NO: 64983 - DNA, 75 bp, Artificial Sequence
  Synthetic
atgtctttttccaacgcaacgcgtgaactctcttatggctggaaaacatgggggaaaaccttttacaatgctgtg

SEQ ID NO: 64984 - DNA, 75 bp, Artificial Sequence
  Synthetic
gaaaggaagaaccattcattcataatagactcacgtgaccaaaacgaatgccccgatagccaacgggtgtggaac

SEQ ID NO: 64985 - DNA, 75 bp, Artificial Sequence
  Synthetic
tctttcattctggaagagttcggcatgggccttttcaaaacacgtgtctttttgaaaactgcccttcaatacact

SEQ ID NO: 64986 - DNA, 75 bp, Artificial Sequence
  Synthetic
cagaaatgtccgacaatgctattgggggctgctgtgaagaataaggtggcagcgcacagtgatcaaaacatgtgg

SEQ ID NO: 64987 - DNA, 75 bp, Artificial Sequence
  Synthetic
atgaaatcaagcctggtgaatggcacatggcaagtcaccgagctggaaacactgtcctacagggaatgcctgtgg

SEQ ID NO: 64988 - DNA, 75 bp, Artificial Sequence
  Synthetic
cccagcacacacacagtgggcacaagcacagttcaagaaagttcgatgttcatgcctaaggggataggaggccct

SEQ ID NO: 64989 - DNA, 75 bp, Artificial Sequence
  Synthetic
gttactgttcacaactacatcccgggctatgcgacgcagacccacggtgcttggcatgtgaagaatttgcgcatg

SEQ ID NO: 64990 - DNA, 75 bp, Artificial Sequence
  Synthetic
gtcagggaagtctgtccagggaccaaagtggatgtggaaacgaactgccagagacgcggagcctcagtgcgatcg

SEQ ID NO: 64991 - DNA, 75 bp, Artificial Sequence
  Synthetic
accacgcagagccacaaagtgatcacagactggtgttgtcggtcttgcatactacccccagtgacatacagaaat

SEQ ID NO: 64992 - DNA, 75 bp, Artificial Sequence
  Synthetic
gatactgaatgctggtacgccatggagatcagacccaagaatatgtttgaggagcaccttgtgaaaagctgggtg

SEQ ID NO: 64993 - DNA, 75 bp, Artificial Sequence
  Synthetic
tcggctgcagatggaaggcgttgtgatcaattcactggaggagtgttggccctctttgtgttattggatctcatt

SEQ ID NO: 64994 - DNA, 75 bp, Artificial Sequence
  Synthetic
gtctacaaacggctctctccccgaaagcatgtatggttggtgggtgtcctcttgctggtagccttcactggaggg

SEQ ID NO: 64995 - DNA, 75 bp, Artificial Sequence
  Synthetic
ataaccctccgtgacatgatgaaatgtctcatcctacttgggcacacctttaataccctacactcaggggaagag

SEQ ID NO: 64996 - DNA, 75 bp, Artificial Sequence
  Synthetic
gtgtcacatctggcaatggttgccgtcatggacctgagagcgggtttcgtcacgggctattacctggcaaaacct

SEQ ID NO: 64997 - DNA, 75 bp, Artificial Sequence
  Synthetic
ttaggaccaaagggaaagttcctcgtggtggttgccttgtccatatcccaagtggtactgtctgacaaaatcgga

SEQ ID NO: 64998 - DNA, 75 bp, Artificial Sequence
  Synthetic
ttcctagactggatggacgctgttgggctagtggctgccgtggtgcaggccttgattgagttgaaatcagaaaat

SEQ ID NO: 64999 - DNA, 75 bp, Artificial Sequence
  Synthetic
tgggcaatgctcggactactagctctgaaccccatggggtcgaagttggttgcaaagacaaccatcgtcacgctc

SEQ ID NO: 65000 - DNA, 75 bp, Artificial Sequence
  Synthetic
ctaggacttgcagggctcgcaattttgcaaaagcgggacacgagtgcaagaaggacatatcccaagttgataggg

SEQ ID NO: 65001 - DNA, 75 bp, Artificial Sequence
  Synthetic
gcagcaatggttctgttggggttcacccgtgggtggatcctaggattgctcacaatgctgagccagcagagcttg

SEQ ID NO: 65002 - DNA, 75 bp, Artificial Sequence
  Synthetic
aggacagcgaaaaggagcatggactggacagatggaattactgtgctgggagttgtggccgcattggccgggctg

SEQ ID NO: 65003 - DNA, 75 bp, Artificial Sequence
  Synthetic
actctaggagatcaggaggaacttatggctcccttcatgattggggctgtactgctgctatgctatgcgattggc

SEQ ID NO: 65004 - DNA, 75 bp, Artificial Sequence
  Synthetic
aacaggtctgacggcttggtgatagaaaaagtggcagacatcacttgggacagagaagcggagaccgaaggaacc

SEQ ID NO: 65005 - DNA, 75 bp, Artificial Sequence
  Synthetic
tctgaacgctttgacgtagctgtgaaccacaacggagagttttcactcatagaggagaaaccaatcccctggaag

SEQ ID NO: 65006 - DNA, 75 bp, Artificial Sequence
  Synthetic
caggtgcttatggccacaggactgttagttttctcaaccctgcacccaatctgcctgctgttagccgcaggaggg

SEQ ID NO: 65007 - DNA, 75 bp, Artificial Sequence
  Synthetic
tattgggtttttgagtacacgtctaggcgcagtaacatcatgtgggaattgccatctgtggctagagaaaccaga

SEQ ID NO: 65008 - DNA, 75 bp, Artificial Sequence
  Synthetic
aaattctcagggcaggtgccggatggggtgtatgccataaaccagaagggactcctgggaagcaaccaaagagga

SEQ ID NO: 65009 - DNA, 75 bp, Artificial Sequence
  Synthetic
gttggagtggtcaaggaaggggtgttccacaccatgtggcacgtgacgagaggagccctcttacgatatgaggaa

SEQ ID NO: 65010 - DNA, 75 bp, Artificial Sequence
  Synthetic
aactacatcacgccccaatgggccagtgtgaaaagtgatctgatcagctatggtggcaactggaaactcaattca

SEQ ID NO: 65011 - DNA, 75 bp, Artificial Sequence
  Synthetic
cgatgggaaaaaggggaagaagtgcagataatcgcatgtgtccctcgccaaaaagtcaagaacgtgacaacaacg

SEQ ID NO: 65012 - DNA, 75 bp, Artificial Sequence
  Synthetic
cctggagtgttcgccctgaaaacgggagaagaaattggagcggtatcactggattaccctgcaggaacctcaggt

SEQ ID NO: 65013 - DNA, 75 bp, Artificial Sequence
  Synthetic
tctcccatcatcaacaagaaaggtgatatcattggcttatatggaaatggaatcctgactgagaataaggacttt

SEQ ID NO: 65014 - DNA, 75 bp, Artificial Sequence
  Synthetic
gtgtctgccatcgctcaggctgactcatgtgacctgcgtaccccagaagttgatgttgagtttagaaaaggagag

SEQ ID NO: 65015 - DNA, 75 bp, Artificial Sequence
  Synthetic
atcaaggtgctggatctgcaccccggagcggggaagacccggaaggttctgccagagttgttacggaaatgcctt

SEQ ID NO: 65016 - DNA, 75 bp, Artificial Sequence
  Synthetic
gagcggcggctgcggaccttagtgctggctccgaccaaggtggtgctgacagagatgtatgaagcactcaaggac

SEQ ID NO: 65017 - DNA, 75 bp, Artificial Sequence
  Synthetic
atgcctatccggtatcatacaagtgctgcaatcgagacaaagaaatcaggagctctcattgacatcatgtgccat

SEQ ID NO: 65018 - DNA, 75 bp, Artificial Sequence
  Synthetic
gctacgctggcaaatcggttgcttgaaccagctagatatgtgaattgggaagtgataattatggatgaagcccat

SEQ ID NO: 65019 - DNA, 75 bp, Artificial Sequence
  Synthetic
ttcttggatccacatagtattgcggtgcgggggtggatgcagcagctggccaacttgaaactggcttcagtgatc

SEQ ID NO: 65020 - DNA, 75 bp, Artificial Sequence
  Synthetic
ttgatgaccgcgacaccacctggaaccagcgatgcttttccacactccaatgggaacatcgacgatacacagatg

SEQ ID NO: 65021 - DNA, 75 bp, Artificial Sequence
  Synthetic
acaataccagaagaaccctggaaaaaaggctttgaatggatactggaggatcagcggccaacagcgtggtttctg

SEQ ID NO: 65022 - DNA, 75 bp, Artificial Sequence
  Synthetic
ccatcgattcgctgtgcgaacgtgatggcaaatttcctcaaaaagaatggcaagacagtggttgtgttgaacaga

SEQ ID NO: 65023 - DNA, 75 bp, Artificial Sequence
  Synthetic
agaacttttgaccaagaatatccgaaaatcaaggactcaagacccgacttcatattgacaactgatatcgcagag

SEQ ID NO: 65024 - DNA, 75 bp, Artificial Sequence
  Synthetic
atgggcgcgaacctccctgtagaacgagtcatagacggaaggacatgcatgcgaccagtgttaaacgatgcgcgc

SEQ ID NO: 65025 - DNA, 75 bp, Artificial Sequence
  Synthetic
aaccgtgttgaaatccaaggacccatgccgataactgcttcctctgctgctcaaaggagagggcgagtgggacgc

SEQ ID NO: 65026 - DNA, 75 bp, Artificial Sequence
  Synthetic
aacccggaccgacacaccgacacgtatgtctatgacggtgacacaagtgaagacaactcagaccttgtgtgctgg

SEQ ID NO: 65027 - DNA, 75 bp, Artificial Sequence
  Synthetic
aaggaggccctcttgctgctagacaacatggagatccctggggggtttgccatgaccttattttccaatgaagcg

SEQ ID NO: 65028 - DNA, 75 bp, Artificial Sequence
  Synthetic
aggaaagtagagcatgtccctggggagtttagactcaatgctgaaggtaggaaatgctttaggcaactcctgaga

SEQ ID NO: 65029 - DNA, 75 bp, Artificial Sequence
  Synthetic
gcccatgaattcactccgtggttggcttggaaagttgcgaaacacacaaaacccttggacatgacatggatcacg

SEQ ID NO: 65030 - DNA, 75 bp, Artificial Sequence
  Synthetic
aaagggcctgaagagaatagggtcttcaatgaacatggggaagtcctcacattcaagacaagatatggttccgtg

SEQ ID NO: 65031 - DNA, 75 bp, Artificial Sequence
  Synthetic
gagcgcgtccaacccatctggagtgacgcccggatgtttgtggatgggtgtacaacgaaaaactttctgtcttat

SEQ ID NO: 65032 - DNA, 75 bp, Artificial Sequence
  Synthetic
gcaacagccaccaggtcgatgacaacaatactggaaagggttgtgcaggtgccagggctcatgaaggacaacttg

SEQ ID NO: 65033 - DNA, 75 bp, Artificial Sequence
  Synthetic
caagaggcctgggacacataccacaccctgctgagagcagatgaaaattctagtagacacagaatggcgctggat

SEQ ID NO: 65034 - DNA, 75 bp, Artificial Sequence
  Synthetic
aacatccccgaacccatgctcagtactatgtgtgtggcgtcagtcgcgtccatgaccatgggaatttttctgtac

SEQ ID NO: 65035 - DNA, 75 bp, Artificial Sequence
  Synthetic
atgctcgctccaaagggaacgtcacgaaagacgctcgcctttgtgacaatggttgccgcttcagtgggactatgg

SEQ ID NO: 65036 - DNA, 75 bp, Artificial Sequence
  Synthetic
gatggagatgtctcagttgtcaagattgctagcatgatgctggttttcttcatactgtgtgtcattctaattcca

SEQ ID NO: 65037 - DNA, 75 bp, Artificial Sequence
  Synthetic
gacgcaggactgcagagatcaacgcaggataactacttggcatattttgtgattgtgctcctgatgcttgtgggg

SEQ ID NO: 65038 - DNA, 75 bp, Artificial Sequence
  Synthetic
ctcgttgcagccaatgagaatggatacctcgaaaaaaccaaagcggatattttcggtcacaagcaaatgaggaca

SEQ ID NO: 65039 - DNA, 75 bp, Artificial Sequence
  Synthetic
atgccagtgaacggctcatggatgtcttttgacctgcgaccaggtagtgcatgggcagtttatgcctttgtggtg

SEQ ID NO: 65040 - DNA, 75 bp, Artificial Sequence
  Synthetic
gggatattctctccgctttatcatcatgcagagagcatcaactatggagccatttccttgcaaggcatcacccag

SEQ ID NO: 65041 - DNA, 75 bp, Artificial Sequence
  Synthetic
agcgcagcagctttcttccaaatggacaaaggctatccattcatgaaactacgcctaccgctcattttgatggcc

SEQ ID NO: 65042 - DNA, 75 bp, Artificial Sequence
  Synthetic
gtgggggcattgaataacatcaatgcggtagccctgttacttggtctagcatgcgctgtgttccactggtccttg

SEQ ID NO: 65043 - DNA, 75 bp, Artificial Sequence
  Synthetic
gtcctgccagggctgcgcgcgaaattggcgaaaatggcattaaggaggacgtaccatggagtaacaaaaaatgcc

SEQ ID NO: 65044 - DNA, 75 bp, Artificial Sequence
  Synthetic
atggtggacggcaccctgacaaatgatttggacgagggcgaggacatgccagagctttttgagaaacagctcggg

SEQ ID NO: 65045 - DNA, 75 bp, Artificial Sequence
  Synthetic
acaatagttctaatggtgctctcactcgccaacgtgttcacactccgcagcacactggccacaaccgaagctgtc

SEQ ID NO: 65046 - DNA, 75 bp, Artificial Sequence
  Synthetic
gtcttgatcacctcttccctgcctcagttggtgaacggcgttccctcgccggtttggaacacgcaagtggcggta

SEQ ID NO: 65047 - DNA, 75 bp, Artificial Sequence
  Synthetic
ggtgtggctgggcttcttagaggaaactacttggctctcatcagcactggccatgctctatggagtgtgcgaggc

SEQ ID NO: 65048 - DNA, 75 bp, Artificial Sequence
  Synthetic
aatcgccgaggtggtggaggaacatccacaactttgggagagctttggaaaaaacagctcaacaagatgactaaa

SEQ ID NO: 65049 - DNA, 75 bp, Artificial Sequence
  Synthetic
aaacagtttgagtcctacaagaaatcagggatcattgaagtggatcgcacggcagcgcaagatgccataaggaga

SEQ ID NO: 65050 - DNA, 75 bp, Artificial Sequence
  Synthetic
aacatcctagacggatccgctgtgtcaaggggcagtgcaaagatgaggtggatggaggagcgaggcttcgtcaaa

SEQ ID NO: 65051 - DNA, 75 bp, Artificial Sequence
  Synthetic
ctggcaggaacggttgtagacttgggatgtgggcgtggtggctggagctactatgccgcctcgctgaaagcggtc

SEQ ID NO: 65052 - DNA, 75 bp, Artificial Sequence
  Synthetic
aaatacgtggactacatgcaaacacaaacaaggtttgccacaatagttcgaacaatgttcggtgatgtgttgtaa

SEQ ID NO: 65053 - DNA, 75 bp, Artificial Sequence
  Synthetic
aagaaggtgctggcattcactctaggaacccaaggacatgaaaaacccctcatgaggacaacttatggctggaac

SEQ ID NO: 65054 - DNA, 75 bp, Artificial Sequence
  Synthetic
ataattcggttcaaggacagagttgacgtgttcacgttggaaacaattccaggagacaccctgctgtgcgacata

SEQ ID NO: 65055 - DNA, 75 bp, Artificial Sequence
  Synthetic
ggggaaagttccccgtcaatccaagtggaagaacagcggaccctgaaagtcctgatgaatgcgaagaaatggctg

SEQ ID NO: 65056 - DNA, 75 bp, Artificial Sequence
  Synthetic
tctgaaggcaggtacgagaacttctgcatcaaagtgctatgcccatacacgccgctcgtgatggaagaaatggcc

SEQ ID NO: 65057 - DNA, 75 bp, Artificial Sequence
  Synthetic
cgcctgcaaagggtttttggtggtggactcgtcagggtgccgctatccaggaactctacacacgagatgtactgg

SEQ ID NO: 65058 - DNA, 75 bp, Artificial Sequence
  Synthetic
gtttcggggacacgtaccgacgttgtaggtgcagtgaacaacgtgtcaagagtgttgatgcgcaggatgctcaat

SEQ ID NO: 65059 - DNA, 75 bp, Artificial Sequence
  Synthetic
aaaccacagccaccagtcattgaggaagatgtgacgctggatctagggacacgcctagtggaacacgagcttggt

SEQ ID NO: 65060 - DNA, 75 bp, Artificial Sequence
  Synthetic
ccgatcagcatggatgcaatcaaggaaagagttgatctcatcaagaacagccacagccagtcatggttccaggac

SEQ ID NO: 65061 - DNA, 75 bp, Artificial Sequence
  Synthetic
acggaacatccctaccgcacatggcactaccttgggtcttatatcacaaggggcggaggaacagctgcatcaatg

SEQ ID NO: 65062 - DNA, 75 bp, Artificial Sequence
  Synthetic
ctaaatggggtggtgaaactgatttcaatgccatgggattcagtgagcgctgtggcatgcatggcaatgaccgac

SEQ ID NO: 65063 - DNA, 75 bp, Artificial Sequence
  Synthetic
accacaccatttggacagcagagagttttcaaggagaaggtggacaccaagcctactgaaccaaatgaaaccgtc

SEQ ID NO: 65064 - DNA, 75 bp, Artificial Sequence
  Synthetic
cggaatgtcatgaggattaccaatgaatggatcttccagcaactggccacaggtaaaagacccaggatgtgcacc

SEQ ID NO: 65065 - DNA, 75 bp, Artificial Sequence
  Synthetic
cgagaggagttcatcaaaaaagtgcggagccatgctgctgtgggagcttatgttccagagttggaaaagtggagc

SEQ ID NO: 65066 - DNA, 75 bp, Artificial Sequence
  Synthetic
tcggcagcagatgcggtcaatgaccaggagttctgggacatggttgacagtgaaagagctttgcacaagaaagga

SEQ ID NO: 65067 - DNA, 75 bp, Artificial Sequence
  Synthetic
aaatgcaggacgtgcgtgtacaacatgatgggaaaaagggaaaagaaaccctccgaattcgggaaagcaaaaggg

SEQ ID NO: 65068 - DNA, 75 bp, Artificial Sequence
  Synthetic
agccgagccatatggtacatgtggctgggggcacgcttcctggagtttgaagccctaggtttcttgaatgaggac

SEQ ID NO: 65069 - DNA, 75 bp, Artificial Sequence
  Synthetic
cactggattgccagacgccactctagagcaggagtggaaggcattggactgcagtacctagggtatgtgctggaa

SEQ ID NO: 65070 - DNA, 75 bp, Artificial Sequence
  Synthetic
gaactggaggggaagaaaggaggaaagttctacgcagatgactcagcgggatgggacacaagaatcaccatagcg

SEQ ID NO: 65071 - DNA, 75 bp, Artificial Sequence
  Synthetic
gacctggaagacgaaatggaaattgtcaagtacatgaaaccagaacagcgcatcctcgctgaagcagttatgaca

SEQ ID NO: 65072 - DNA, 75 bp, Artificial Sequence
  Synthetic
cttgcttacagacacaaggtggtgaaagttgagcgtccaataccgggaggaagaacagccatggacatcatatac

SEQ ID NO: 65073 - DNA, 75 bp, Artificial Sequence
  Synthetic
cggcaagaacacagaggctcgggacaggtggtcacttatgcattcaacaccattaccaacatgaaagtgcaacta

SEQ ID NO: 65074 - DNA, 75 bp, Artificial Sequence
  Synthetic
ataagaatggccgagtcagaggaagtcctcccccacccagatgaaaaatggactgaggagcgcgccgacacactg

SEQ ID NO: 65075 - DNA, 75 bp, Artificial Sequence
  Synthetic
cgctgctggctgagagaaaatgggatagatcgcctagagcggatggcagttagtggagacgactgcgtggtcaag

SEQ ID NO: 65076 - DNA, 75 bp, Artificial Sequence
  Synthetic
ccaatcgacgacaggtttgcgacatccttgcattacctgaaccggatggccaagatcagaaaggacataggagaa

SEQ ID NO: 65077 - DNA, 75 bp, Artificial Sequence
  Synthetic
tggaaaccctcccagccacttcagaacatggatgaagtgccattctgctcccaccatttccacaaattaagactg

SEQ ID NO: 65078 - DNA, 75 bp, Artificial Sequence
  Synthetic
cgggatggcagggcaatcattgtgccctgcagggaccaagacgaactgataggaagggcaaggatatccccaggg

SEQ ID NO: 65079 - DNA, 75 bp, Artificial Sequence
  Synthetic
aatgggtggatggtgagggaaactgggccgctgagcaaagcttatgcaaacatgtggaaactgttttatttccac

SEQ ID NO: 65080 - DNA, 75 bp, Artificial Sequence
  Synthetic
cgaagggacctgaggctcatggcaaacgccatcagttcagctgtccccgttgactgggtcccgacaggaagaacg

SEQ ID NO: 65081 - DNA, 75 bp, Artificial Sequence
  Synthetic
acatggtccttgcatggaaaaggtgaatggatgacgtctgaggacatgttggaagtctggaatagggtctggata

SEQ ID NO: 65082 - DNA, 75 bp, Artificial Sequence
  Synthetic
catgacaatccccacatgcaggagaaaaaaccccttgaagattggaaagaaattccgtacctcaacaagtcacaa

SEQ ID NO: 65083 - DNA, 75 bp, Artificial Sequence
  Synthetic
gacgtacggtgtgggtcacacataggatgttcacaaaggaaaagctgggcagacgccctgcccagcacagtggaa

SEQ ID NO: 65084 - DNA, 75 bp, Artificial Sequence
  Synthetic
aaagtcaggtccataattggaaaagatggaaaatacgtggactacatgcaaacacaaacaaggtttgccacaata

SEQ ID NO: 65085 - DNA, 75 bp, Artificial Sequence
  Synthetic
gttcgaacaatgttcggtgatgtgttgtaaatgaaaatcttggaataaagtcaggccgcagcgtctaaaaccgga

SEQ ID NO: 65086 - DNA, 75 bp, Artificial Sequence
  Synthetic
gcctccgctgggaaaccagtcgacggggactagaggttagaggagaccccccgcgcccataaccaacataaaaca

SEQ ID NO: 65087 - DNA, 75 bp, Artificial Sequence
  Synthetic
gttagaggagaccccccgcgcccataaccaacataaaacagcatattgacacctgggaaaagaccggagactctg

SEQ ID NO: 65088 - DNA, 75 bp, Artificial Sequence
  Synthetic
atgaataatcgcagaagtaacacccggaaaaagggtgtcaacttaaaattgcaaaatcaaaataaaaaaggaccg

SEQ ID NO: 65089 - DNA, 75 bp, Artificial Sequence
  Synthetic
agatgagtgatggtcaagcacttctgttaccccgggcttagtaccaatagactgccatcgcggttgaaggggaaa

SEQ ID NO: 65090 - DNA, 75 bp, Artificial Sequence
  Synthetic
ggtgccagtcgcacagcaatcaccactctcgggaaatttggacagcagtctggggctatctacgtgggcaacttc

SEQ ID NO: 65091 - DNA, 75 bp, Artificial Sequence
  Synthetic
ctcttatggttggatgaagaagccatggaacagggagtgtctgactacatcaagggactcggcgatgcttttggt

SEQ ID NO: 65092 - DNA, 75 bp, Artificial Sequence
  Synthetic
gcctacagctctacgctgtaggacgcttgtgtatggacatggtgtgaagagcccattgcgctagggagtagtcct

SEQ ID NO: 65093 - DNA, 75 bp, Artificial Sequence
  Synthetic
aacgattgggcgaacttgatatgggaagacagtgctagggacctactggtatcttcaaccaccgcccaagggtgc

SEQ ID NO: 65094 - DNA, 75 bp, Artificial Sequence
  Synthetic
tgctcgcagtgggtcactcggaaccaggggattgtggtggtattcttagatgccaacacggtgtcgtagggatag

SEQ ID NO: 65095 - DNA, 75 bp, Artificial Sequence
  Synthetic
cacttcccccgtgtagatcaggtcgatgagtcactgcaatccccacgggcgaccgtggcagtggctgcgttggcg

SEQ ID NO: 65096 - DNA, 75 bp, Artificial Sequence
  Synthetic
cacccactcacaggacccacgcggtgctagcactctggttctacggaacctttgtgcgcctgttttacgtcccct

SEQ ID NO: 65097 - DNA, 75 bp, Artificial Sequence
  Synthetic
aactctgggatggaaccgactactttgggtgtccgtgtttcctgttttatttaccttggctgcttatggtgacaa

SEQ ID NO: 65098 - DNA, 75 bp, Artificial Sequence
  Synthetic
tctgtgtaccttaggatgacttttgggcacctttatgaaactttccatgcaaaccctggaactgtgaccggctca

SEQ ID NO: 65099 - DNA, 75 bp, Artificial Sequence
  Synthetic
tgggtgtccgtgtttcctgttttatttaccttggctgcttatggtgacaatctagtgttgttgccatatagcgat

SEQ ID NO: 65100 - DNA, 75 bp, Artificial Sequence
  Synthetic
gaccgtggcagtggctgcgttggcggcctgcctatggggtaacccataggacgctctaatgtggacatggtgcga

SEQ ID NO: 65101 - DNA, 75 bp, Artificial Sequence
  Synthetic
ctccagtatatgtttgttccccctggtgctcctaaaccagattctagagaatcacttgcttggcagacagccaca

SEQ ID NO: 65102 - DNA, 75 bp, Artificial Sequence
  Synthetic
aaatcagcaaatttattgattggctcaaggaaaagatcattccggccgcaaaggaaaaagtcgagtttcttaata

SEQ ID NO: 65103 - DNA, 75 bp, Artificial Sequence
  Synthetic
gggtgcacaggtttcaacacagaaaactggatcacatgaaaacgccaacatggcagtaggaggctccaccatcaa

SEQ ID NO: 65104 - DNA, 75 bp, Artificial Sequence
  Synthetic
cttggtggtatgccctctggttgttcaggaacatccatatttaattcaatgatcaataacattattattagagca

SEQ ID NO: 65105 - DNA, 75 bp, Artificial Sequence
  Synthetic
actggatcacatgaaaacgccaacatggcagtaggaggctccaccatcaactacaccactattaattactataag

SEQ ID NO: 65106 - DNA, 75 bp, Artificial Sequence
  Synthetic
caattacagaattgttaccatatagctattggattggccatccggtgtgcactagagctattatatacctatttg

SEQ ID NO: 65107 - DNA, 75 bp, Artificial Sequence
  Synthetic
agagagtgtacgccctagagaagagaatgaataattacatgcagttcaagagcaaacaccgtattgaacctgtat

SEQ ID NO: 65108 - DNA, 75 bp, Artificial Sequence
  Synthetic
aatgaataattacatgcagttcaagagcaaacaccgtattgaacctgtatgtttaattatcaggggctcaccagg

SEQ ID NO: 65109 - DNA, 75 bp, Artificial Sequence
  Synthetic
gctattaaagaatcctctgtcccactcaagtcaccatcagctgaagcgtgtgggtatagcgatcgtgttgcgcag

SEQ ID NO: 65110 - DNA, 75 bp, Artificial Sequence
  Synthetic
tcaagtcaccatcagctgaagcgtgtgggtatagcgatcgtgttgcgcagctgacactaggaaactccacagtca

SEQ ID NO: 65111 - DNA, 75 bp, Artificial Sequence
  Synthetic
agccacagaaggctccactattaattacaccactattaactactacaaagattcctatgctgcaacagcgggcaa

SEQ ID NO: 65112 - DNA, 75 bp, Artificial Sequence
  Synthetic
cagttgacaaacccactaggccggatgtttctgtcaacaggttctatacccttagtgctaaactatggcagaaag

SEQ ID NO: 65113 - DNA, 75 bp, Artificial Sequence
  Synthetic
tgtttctgtcaacaggttctatacccttagtgctaaactatggcagaaagattcaaagggatggtactggaaatt

SEQ ID NO: 65114 - DNA, 75 bp, Artificial Sequence
  Synthetic
cattcatgttcagtgcaatgcgagcaagttccatcagggtactctacttgttgttgctataccagaaatgacagt

SEQ ID NO: 65115 - DNA, 75 bp, Artificial Sequence
  Synthetic
aagttccatcagggtactctacttgttgttgctataccagaaatgacagttgcgagatctagtggtgacaccaag

SEQ ID NO: 65116 - DNA, 75 bp, Artificial Sequence
  Synthetic
agatttttcatggattgtgatatcgaagtgactgactcttacaagacagacttaggccgcttggatgcgggtagg

SEQ ID NO: 65117 - DNA, 75 bp, Artificial Sequence
  Synthetic
gttgtgcaaagatgccagtgatatcctgcagacaggcactatccagggagacagggtggcggatgtgatcgaaag

SEQ ID NO: 65118 - DNA, 75 bp, Artificial Sequence
  Synthetic
cactctgagcccggcgactgcggaggcatcttaaggtgccaacatggtgtagttggtatagtgtccacgggtggc

SEQ ID NO: 65119 - DNA, 75 bp, Artificial Sequence
  Synthetic
gttcttgatgcaggggtccccatctcccaagcactgatctacccccaccaatggatcaacctcaggaccaataac

SEQ ID NO: 65120 - DNA, 75 bp, Artificial Sequence
  Synthetic
cccaagcactgatctacccccaccaatggatcaacctcaggaccaataactgtgctaccatagtagtgccctata

SEQ ID NO: 65121 - DNA, 75 bp, Artificial Sequence
  Synthetic
cagaagacagtcaccccccttacaagcaaacacaaccaggtgccgacggatttgaattgcagcatccgtatgtgc

SEQ ID NO: 65122 - DNA, 75 bp, Artificial Sequence
  Synthetic
attacagtgagggtgctactactgccataccgattactatcaccatagcgcccatgtgttcagagtttggtggac

SEQ ID NO: 65123 - DNA, 75 bp, Artificial Sequence
  Synthetic
cataccgattactatcaccatagcgcccatgtgttcagagtttggtggactccgcaacgcggttactcaagggct

SEQ ID NO: 65124 - DNA, 75 bp, Artificial Sequence
  Synthetic
atttcaccctacgccagcaatacatatacctggagaagtgaagaacatcctagaaatcatgcaggttgagtcaat

SEQ ID NO: 65125 - DNA, 75 bp, Artificial Sequence
  Synthetic
cagttgtatcccttgtttatgttatctacaagctatttgctggtttccaaggcgcatattctggagcgcccaagc

SEQ ID NO: 65126 - DNA, 75 bp, Artificial Sequence
  Synthetic
atacctggagaagtgaagaacatcctagaaatcatgcaggttgagtcaatcttggaagtcaacaacttgaactca

SEQ ID NO: 65127 - DNA, 75 bp, Artificial Sequence
  Synthetic
cccaactccacctatacacataccaggggaagtacacaacctattggaaatatgcagagtggagaccatcctgga

SEQ ID NO: 65128 - DNA, 75 bp, Artificial Sequence
  Synthetic
tttcgagtggatcctggtcgggcagggccatgggaatcaacgttagtgggacagtactgcaagtactacacacaa

SEQ ID NO: 65129 - DNA, 75 bp, Artificial Sequence
  Synthetic
ggccatgggaatcaacgttagtgggacagtactgcaagtactacacacaatggtcgggctcgctggaagtcactt

SEQ ID NO: 65130 - DNA, 75 bp, Artificial Sequence
  Synthetic
tacctcgccactcacaaccagggaagaccatctgggttgagcacaagttaatcaatgtgcttgatgctgttgagc

SEQ ID NO: 65131 - DNA, 75 bp, Artificial Sequence
  Synthetic
ccaaccgccgcactgccatgttaggaacacatgtcatatgggattttggtctacaatcttcagtcacccttgtga

SEQ ID NO: 65132 - DNA, 75 bp, Artificial Sequence
  Synthetic
aacacatgtcatatgggattttggtctacaatcttcagtcacccttgtgattccatggattagcaatacacacta

SEQ ID NO: 65133 - DNA, 75 bp, Artificial Sequence
  Synthetic
taaaacgcctgtgggttgcacccactcacaggggccactgggcgcagcactctggtatcttggtacctttgtgct

SEQ ID NO: 65134 - DNA, 75 bp, Artificial Sequence
  Synthetic
cagaactatttattcaaagctaacccaaattatgctggtaactctatcaagccaaccggtgccagtcgcacggcg

SEQ ID NO: 65135 - DNA, 75 bp, Artificial Sequence
  Synthetic
tcttctgtgacgttggtcgtgccatggattagtaacacacactatagggcacacgcccgtgctgggtactttgac

SEQ ID NO: 65136 - DNA, 75 bp, Artificial Sequence
  Synthetic
ttgtgccagttggagatgtggtccagtatggatttttgaaccttagtggtaagcccactcataggactatgatgt

SEQ ID NO: 65137 - DNA, 75 bp, Artificial Sequence
  Synthetic
ttcatgttcaccgggtccttcatggccacgggtaagatgctcatagcttatacacctcctggtggccccttaccc

SEQ ID NO: 65138 - DNA, 75 bp, Artificial Sequence
  Synthetic
acagtgtggaggcgtggtaacatctgttggtaaaatcattggcatccacattggaggcaatgggcgacaagggtt

SEQ ID NO: 65139 - DNA, 75 bp, Artificial Sequence
  Synthetic
cttgcctctcacaatgattgggcgaaccttgtctgggaagatagttctcgcgacttgcttgtgtcatccaccacc

SEQ ID NO: 65140 - DNA, 75 bp, Artificial Sequence
  Synthetic
ttaaaacagcctgtgggttgttcccacccacagggcccactgggcgctagcacactgattctgcgggacctttgt

SEQ ID NO: 65141 - DNA, 75 bp, Artificial Sequence
  Synthetic
tactcactaccaccagaccctgatcattttgacgggtacaaacagcaagtggttacagtcatggatgatctgtgt

SEQ ID NO: 65142 - DNA, 75 bp, Artificial Sequence
  Synthetic
tgtggttcctgacggtgcacccaccagtgcttacataatagcactgggtgctgcacaaccaaatttcagtttgaa

SEQ ID NO: 65143 - DNA, 75 bp, Artificial Sequence
  Synthetic
gcactgacagcagcagacacacgcccaagcacacatcaagtagcgactggcaacactcctgcgctgcaagctgca

SEQ ID NO: 65144 - DNA, 75 bp, Artificial Sequence
  Synthetic
acacgcccgtgctgggtactttgactattacaccactggcattataaccatatggtatcaaactaactatgtagt

SEQ ID NO: 65145 - DNA, 75 bp, Artificial Sequence
  Synthetic
acagctaatatacaaggggatcctattgcagacatgattgaccagaccgtgaataatcaagtgaaccgctcctta

SEQ ID NO: 65146 - DNA, 75 bp, Artificial Sequence
  Synthetic
cgcactaagcttgaaccaagtgtctttcatgatgtgttcgagggcactaaagagccagcagtgctgactagtaaa

SEQ ID NO: 65147 - DNA, 75 bp, Artificial Sequence
  Synthetic
caagcacacatcaagtagcgactggcaacactcctgcgctgcaagctgcagagactggggcgacatcgaatgcta

SEQ ID NO: 65148 - DNA, 75 bp, Artificial Sequence
  Synthetic
ctggacgggctgctaagttatgctctgaaaacaacaccgcaaacttcaaacgatgcagccctctagtgtgtggga

SEQ ID NO: 65149 - DNA, 75 bp, Artificial Sequence
  Synthetic
tctcaagggcagcattagttggttatattagcatactgacatcaacaacgaccgctaatggcttcacaaattggg

SEQ ID NO: 65150 - DNA, 75 bp, Artificial Sequence
  Synthetic
tattagcatactgacatcaacaacgaccgctaatggcttcacaaattgggatattgacatcatgggttttgtcca

SEQ ID NO: 65151 - DNA, 75 bp, Artificial Sequence
  Synthetic
tctcattgagactagatgtgtgttgaaccatcactccacacaggagacagccattgggaatttctttagccgtgc

SEQ ID NO: 65152 - DNA, 75 bp, Artificial Sequence
  Synthetic
ttggctgcttatggtgacaattaaagaattgttaccatatagctattggattggccatccggtgtgcaacagagc

SEQ ID NO: 65153 - DNA, 75 bp, Artificial Sequence
  Synthetic
ccattgggaatttctttagccgtgccggtttggtcagcattattacaatgcccaccacgggtacacagaacacag

SEQ ID NO: 65154 - DNA, 75 bp, Artificial Sequence
  Synthetic
tttgttgcgtgcactcctactggtgaggttgttccacaattactccagtatatgtttgttccccctggtgctccc

SEQ ID NO: 65155 - DNA, 75 bp, Artificial Sequence
  Synthetic
cgggcaagcagacacgacgatgctccagtatatgtacatcccacctggagctcccaaacccactcaaagggactc

SEQ ID NO: 65156 - DNA, 75 bp, Artificial Sequence
  Synthetic
cagtatatgtacatcccacctggagctcccaaacccactcaaagggactcattcgagtggcaatctgcaaccaac

SEQ ID NO: 65157 - DNA, 75 bp, Artificial Sequence
  Synthetic
ggcatcatcgaatactagtgatgagagtatgattgagacacgatgcgtcctcaactcacacagtacagcagagac

SEQ ID NO: 65158 - DNA, 75 bp, Artificial Sequence
  Synthetic
caatggttttatgatggctacccaacatttggaacacatagtgcttccacagacagttggtatggtgtgtgccct

SEQ ID NO: 65159 - DNA, 75 bp, Artificial Sequence
  Synthetic
tgaccccgggcgaagtggaccatggcagtccaccttgttgggccagttgtgcgggtactacacccaatggtcagg

SEQ ID NO: 65160 - DNA, 75 bp, Artificial Sequence
  Synthetic
catttggaacacatagtgcttccacagacagttggtatggtgtgtgccctaataacctcatgggcacctttgctg

SEQ ID NO: 65161 - DNA, 75 bp, Artificial Sequence
  Synthetic
tagtggatgagcagggtgttaatttagaactcacattggtgacactagacactaatgagaaatttagagatatca

SEQ ID NO: 65162 - DNA, 75 bp, Artificial Sequence
  Synthetic
catggatccccaggcccttaagaaaccagccttatgtgctaaagaattaccctaactttgatggaacaaacatca

SEQ ID NO: 65163 - DNA, 75 bp, Artificial Sequence
  Synthetic
ccagccttatgtgctaaagaattaccctaactttgatggaacaaacatcaagtgcagctccaccagcaggcagag

SEQ ID NO: 65164 - DNA, 75 bp, Artificial Sequence
  Synthetic
cctagccactcaagaagactgggataacctggtctgggaggattatcagagagacgtgctggtgtcaaacacccg

SEQ ID NO: 65165 - DNA, 75 bp, Artificial Sequence
  Synthetic
aacctggtctgggaggattatcagagagacgtgctggtgtcaaacacccgtgcgcacggatgtgaccagttggca

SEQ ID NO: 65166 - DNA, 75 bp, Artificial Sequence
  Synthetic
gggttggttcatgcacaggcaaatgagtactaccccgagcgttaccagtcacatgtactactagctagtgggatt

SEQ ID NO: 65167 - DNA, 75 bp, Artificial Sequence
  Synthetic
agtactaccccgagcgttaccagtcacatgtactactagctagtgggatttcaaaaccaggcgattgtggtggaa

SEQ ID NO: 65168 - DNA, 75 bp, Artificial Sequence
  Synthetic
agtcgaagacagcttccatcctaggtattcccatggcgcagaaacagagcgattcctggctaaagaagttcaatg

SEQ ID NO: 65169 - DNA, 75 bp, Artificial Sequence
  Synthetic
cgtttgggaagacagctctcgtgacctattagtgtcgtccaccaccgcccagggctgtgatacaattgcacgttg

SEQ ID NO: 65170 - DNA, 75 bp, Artificial Sequence
  Synthetic
gggacctattgtggctagaagatgatgtcatggagcaaggagtcacagattacattaaaggcctgggtgatgctt

SEQ ID NO: 65171 - DNA, 75 bp, Artificial Sequence
  Synthetic
tgtcatggagcaaggagtcacagattacattaaaggcctgggtgatgcttttggcactggcttcaccgactccat

SEQ ID NO: 65172 - DNA, 75 bp, Artificial Sequence
  Synthetic
cagactccagagaatctctcgcatggcaaactgccactaatccctcagtctttgtgaagctgtcagaccccccag

SEQ ID NO: 65173 - DNA, 75 bp, Artificial Sequence
  Synthetic
tgagaagaaattggcttgaactattttagatttacagttaaaagctgaaccccaccagaaatctggtcgtgttaa

SEQ ID NO: 65174 - DNA, 75 bp, Artificial Sequence
  Synthetic
agttaaggtgatctctgcactagttattatcattcgcagtgattacgatatggtcacagctgccgccacacttgc

SEQ ID NO: 65175 - DNA, 75 bp, Artificial Sequence
  Synthetic
acagaggacacccaccctccttacatacaaacacaacctggcgccgacggtttcgagctgcagcacccgtacgtg

SEQ ID NO: 65176 - DNA, 75 bp, Artificial Sequence
  Synthetic
attatcattcgcagtgattacgatatggtcacagctgccgccacacttgctctgatcgggtgtcacacaagcccc

SEQ ID NO: 65177 - DNA, 75 bp, Artificial Sequence
  Synthetic
taaggggctcggtgacgcgtttggaacaggcttcaccgatgctgtgtccagggaagttgaagcccttaggaacca

SEQ ID NO: 65178 - DNA, 75 bp, Artificial Sequence
  Synthetic
aagaaattcaatgacatggcaaatgccgccaaaggcttggaatggattgcaaacaaaattagcaagttcatagat

SEQ ID NO: 65179 - DNA, 75 bp, Artificial Sequence
  Synthetic
ccgccaaaggcttggaatggattgcaaacaaaattagcaagttcatagattggctaaaagaaaagattattccag

SEQ ID NO: 65180 - DNA, 75 bp, Artificial Sequence
  Synthetic
ccctattacaatcactctagctccaatgtgctctgagtttgcaggtctcagacaggcagtcactcaaggctttcc

SEQ ID NO: 65181 - DNA, 75 bp, Artificial Sequence
  Synthetic
ttggttgccatggaagtccttgggcttggatcaaagccaagacagcatccattttaggcatccctattgcccaga

SEQ ID NO: 65182 - DNA, 75 bp, Artificial Sequence
  Synthetic
aacagtcagcagcgagccaggatgacctagaagcactctttgggaatgtgcaatacttggctatcaattgtagaa

SEQ ID NO: 65183 - DNA, 75 bp, Artificial Sequence
  Synthetic
gggaagtcccgcttgatagaagctagcagcctgaatgactcagtgtacctcagaatgacttttggccacctgtat

SEQ ID NO: 65184 - DNA, 75 bp, Artificial Sequence
  Synthetic
cctagaagcactctttgggaatgtgcaatacttggctatcaattgtagaaaataccaacccctttatgcctctga

SEQ ID NO: 65185 - DNA, 75 bp, Artificial Sequence
  Synthetic
ggcctcggtgacgcttttggtatgggtttcactgatgcagtgtctagggaagtagaggcattgaagaaccattta

SEQ ID NO: 65186 - DNA, 75 bp, Artificial Sequence
  Synthetic
tgggtcactctttgcctttgactactcaggatatgatgctagcctcagcccggtatggttcagggccctagaagt

SEQ ID NO: 65187 - DNA, 75 bp, Artificial Sequence
  Synthetic
agtatgtttaattattagaggcccaccaggcacaggaaaatcccttgccacaggcatcatagctagagccattgc

SEQ ID NO: 65188 - DNA, 75 bp, Artificial Sequence
  Synthetic
tgccagacaggagtgtattactgtaactcaatgagaaaacactatccggtcagtttctcgaaacccagtttgatc

SEQ ID NO: 65189 - DNA, 75 bp, Artificial Sequence
  Synthetic
ttttgccagatcaccagttcccattcttaattcaccctacaatgcccatgaaagaaatccatgaatctatccgat

SEQ ID NO: 65190 - DNA, 75 bp, Artificial Sequence
  Synthetic
ccaggcacaggaaaatcccttgccacaggcatcatagctagagccattgctgagaaatacaactctagtgtctac

SEQ ID NO: 65191 - DNA, 75 bp, Artificial Sequence
  Synthetic
gcttgcagtgggtcactcggaaccaggggattgcggtggcattcttagatgccaacacggcgtcgtagggatagt

SEQ ID NO: 65192 - DNA, 75 bp, Artificial Sequence
  Synthetic
aatcctgacggaaaggacatctcccttttctgccagatggtttctactgttgagttcatcccacccatggcctca

SEQ ID NO: 65193 - DNA, 75 bp, Artificial Sequence
  Synthetic
cagctccccttgttagagaaccagatctccaaccttgagcaatctgctgcttcgcaggaagatctagaggccatg

SEQ ID NO: 65194 - DNA, 75 bp, Artificial Sequence
  Synthetic
attacaaagtttataccagagactattagtccagctagtgacgccaccttggttatcaatactgaacacatgcct

SEQ ID NO: 65195 - DNA, 75 bp, Artificial Sequence
  Synthetic
ttttctgccagatggtttctactgttgagttcatcccacccatggcctcacttgaagaaaaagggctcccgttta

SEQ ID NO: 65196 - DNA, 75 bp, Artificial Sequence
  Synthetic
gaagaaggttttacatggactgtgacatagaagtacctgactcctacaaattagagaacaataaacttgatgcat

SEQ ID NO: 65197 - DNA, 75 bp, Artificial Sequence
  Synthetic
catagaagtacctgactcctacaaattagagaacaataaacttgatgcatcgagagcagccaaattgtgttctga

SEQ ID NO: 65198 - DNA, 75 bp, Artificial Sequence
  Synthetic
tgcccatgagagagatccatgagtccattcgatggactaaagacgcacgcaatacccaagaccacgtgcgctccc

SEQ ID NO: 65199 - DNA, 75 bp, Artificial Sequence
  Synthetic
caaggtgagatatagcttagattctgttgtttctgagctcattagggagtataataacaggtgtagtgttggtaa

SEQ ID NO: 65200 - DNA, 75 bp, Artificial Sequence
  Synthetic
gttgtttctgagctcattagggagtataataacaggtgtagtgttggtaacacaattgaagcactgttccaagga

SEQ ID NO: 65201 - DNA, 75 bp, Artificial Sequence
  Synthetic
gtagataatgaggaggtcagacaatactgtaaagaacaagggtggataataccagacgttccaaccaatgtagaa

SEQ ID NO: 65202 - DNA, 75 bp, Artificial Sequence
  Synthetic
caacttagagacaggaagtccaaggtcaggtacagcgtggacacagtggtctctgaacttattagagaatacaat

SEQ ID NO: 65203 - DNA, 75 bp, Artificial Sequence
  Synthetic
actgtaaagaacaagggtggataataccagacgttccaaccaatgtagaacgacatgtgaacagagcagttgcca

SEQ ID NO: 65204 - DNA, 75 bp, Artificial Sequence
  Synthetic
ggtttcagtgccattcatgtcacctgcgagtgcttatcaatggttttatgacggatatcccacattcggagaaca

SEQ ID NO: 65205 - DNA, 75 bp, Artificial Sequence
  Synthetic
gcgagtgcttatcaatggttttatgacggatatcccacattcggagaacacaagcaggagaaagatcttgaatac

SEQ ID NO: 65206 - DNA, 75 bp, Artificial Sequence
  Synthetic
aaggtgcttacacaggtatgccacgcacagcattgaagaaacccacactcaggaccgcaacagttcaaggcccag

SEQ ID NO: 65207 - DNA, 75 bp, Artificial Sequence
  Synthetic
cacagcattgaagaaacccacactcaggaccgcaacagttcaaggcccagcactagattttgccttatccctgct

SEQ ID NO: 65208 - DNA, 75 bp, Artificial Sequence
  Synthetic
agtcagctgcttcacaggaagacctcgaagcgatgtttggcaacgtgtcttacctggcccatttttgccgcaaat

SEQ ID NO: 65209 - DNA, 75 bp, Artificial Sequence
  Synthetic
ggtgcctagacatgcagaaccaggaaacactatctggattgagggtaaacaggtgaaagttttggacgctgtgga

SEQ ID NO: 65210 - DNA, 75 bp, Artificial Sequence
  Synthetic
aacactatctggattgagggtaaacaggtgaaagttttggacgctgtggaactggtggatgagcaacaagtaaat

SEQ ID NO: 65211 - DNA, 75 bp, Artificial Sequence
  Synthetic
cagttgtctcactggtgtatgtcatttacaaactctttgcaggatttcaaggcgcgtattctggggctcccaagc

SEQ ID NO: 65212 - DNA, 75 bp, Artificial Sequence
  Synthetic
taacatcatagtgccaacagtctcggattcagatgccatccgtcgtcggttctttatggactgcgatattgaggt

SEQ ID NO: 65213 - DNA, 75 bp, Artificial Sequence
  Synthetic
gtggtttagagcactagagatagtcctgcgggaagttggttattcagaagatgcagtttctctcatagaaggaat

SEQ ID NO: 65214 - DNA, 75 bp, Artificial Sequence
  Synthetic
gaagtagccaacgaagccactcttgtgattaacacgctccagatgccatccatgttcatcccagttgggaaggta

SEQ ID NO: 65215 - DNA, 75 bp, Artificial Sequence
  Synthetic
tgattaacacgctccagatgccatccatgttcatcccagttgggaaggtagagaattatgggtttctaaatttaa

SEQ ID NO: 65216 - DNA, 75 bp, Artificial Sequence
  Synthetic
catgatgtataatttccctacaaaagcaggacaatgtggaggtgtggtcacatcagtcggtaagattgttggtat

SEQ ID NO: 65217 - DNA, 75 bp, Artificial Sequence
  Synthetic
ggaactcacattggtgacactagacaccaatgaaaaatttagagatgtcaccaagttcattccagagaccattag

SEQ ID NO: 65218 - DNA, 75 bp, Artificial Sequence
  Synthetic
gtgtagggaaaatcattggaatccacgttgggggcaacgggaaacagggcttctgtgctgccctaaagagatgct

SEQ ID NO: 65219 - DNA, 75 bp, Artificial Sequence
  Synthetic
actacccttggaaagttcggccagcagtctggggccatctacgtgggcaacttcagagtggttaatcgtcacctc

SEQ ID NO: 65220 - DNA, 75 bp, Artificial Sequence
  Synthetic
ggtgtcatggaagcccttgggcatggattaaagcgaagacagcctctattcttggcattcccatagtgcagaaac

SEQ ID NO: 65221 - DNA, 75 bp, Artificial Sequence
  Synthetic
cgttgggggcaacgggaaacagggcttctgtgctgccctaaagagatgctacttcaccagtgaacaaggcgagat

SEQ ID NO: 65222 - DNA, 75 bp, Artificial Sequence
  Synthetic
gatcagttattgggaacaccattgaagctcttttccaaggaccccctaaatttagaccgataaggattagcctag

SEQ ID NO: 65223 - DNA, 75 bp, Artificial Sequence
  Synthetic
ggggatgatgtattggctagttaccctttccctattgattgctcagagctggcaaagacaggcaaggagtatgga

SEQ ID NO: 65224 - DNA, 75 bp, Artificial Sequence
  Synthetic
atcattggaagtcaccttcatgtttactggatccttcatggctaccggcaagatgctcatagcctacacaccgcc

SEQ ID NO: 65225 - DNA, 75 bp, Artificial Sequence
  Synthetic
ttgaccatgacacctgctgacaaatcaccctgttttaatgaagtcacatgggagaatgccactttccttaagaga

SEQ ID NO: 65226 - DNA, 75 bp, Artificial Sequence
  Synthetic
tgtcttctttgatgtctttgacggcgagaaagaacctgcaccattgacagcaaatgacaaaaggcttgacgtgaa

SEQ ID NO: 65227 - DNA, 75 bp, Artificial Sequence
  Synthetic
gagaaagaacctgcaccattgacagcaaatgacaaaaggcttgacgtgaattttgaggaagccttattttcaaaa

SEQ ID NO: 65228 - DNA, 75 bp, Artificial Sequence
  Synthetic
ttaaaacagcctgtgggttgtacccacccacagggccccctgggcgcaagcactttggtacttcggtacctttgt

SEQ ID NO: 65229 - DNA, 75 bp, Artificial Sequence
  Synthetic
ctaccgattctgctgcctgggtcactctttgcctttgactactcaggatatgatgctagtctcagcccggtatgg

SEQ ID NO: 65230 - DNA, 75 bp, Artificial Sequence
  Synthetic
caactgaacattgacacgtctagaatgtcaatggaagaggcctgctatggcactgagaatctagaagccattgac

SEQ ID NO: 65231 - DNA, 75 bp, Artificial Sequence
  Synthetic
catacagcgcccttggcatcaggaaaagagacattctcaaccccgtaactagggatgtgtctaagatgaaactct

SEQ ID NO: 65232 - DNA, 75 bp, Artificial Sequence
  Synthetic
actcacactaagctggagcctagtgtgtttcatgatgtgtttgaaggcaataaggaaccagcggtcctaacaagt

SEQ ID NO: 65233 - DNA, 75 bp, Artificial Sequence
  Synthetic
tgtcaatggaagaggcctgctatggcactgagaatctagaagccattgaccttagtactagtgcaggctacccat

SEQ ID NO: 65234 - DNA, 75 bp, Artificial Sequence
  Synthetic
acccggatcacttcgacgggtacaagcagcaggtggtcacagttatggatgatctttgccaaaatccagatggga

SEQ ID NO: 65235 - DNA, 75 bp, Artificial Sequence
  Synthetic
cagggccactttacaatgttaggagtgcgagaccacttggctgtgctccccagacactcccaaccaggaaagacc

SEQ ID NO: 65236 - DNA, 75 bp, Artificial Sequence
  Synthetic
ttgagcaggccctgttttccaagtatgcgggcaatgttttgcatgagcctgatgaatacgtgacacaagctgccc

SEQ ID NO: 65237 - DNA, 75 bp, Artificial Sequence
  Synthetic
tggatgagtatggattggacctcccttactccacttatgtcaaggatgaacttaggagtaaagaaaaagtgaaaa

SEQ ID NO: 65238 - DNA, 75 bp, Artificial Sequence
  Synthetic
cacttgcagggcccactgggcgctagcactctgattctgcgggatctttgtgcgcctgttttataaccccacccc

SEQ ID NO: 65239 - DNA, 75 bp, Artificial Sequence
  Synthetic
ttactccacttatgtcaaggatgaacttaggagtaaagaaaaagtgaaaaaggggaaagccaggctaattgaagc

SEQ ID NO: 65240 - DNA, 75 bp, Artificial Sequence
  Synthetic
tggtactgtgaccggttcggcagtgggttgcaacccagacgtgttttggagtaagctgccgatcctactgcctgg

SEQ ID NO: 65241 - DNA, 75 bp, Artificial Sequence
  Synthetic
tttccccggaccgagtatcaataaactgctcgcggggttaaaggaaaaaactttcgttttccggttaattacttc

SEQ ID NO: 65242 - DNA, 75 bp, Artificial Sequence
  Synthetic
ctgctcgcggggttaaaggaaaaaactttcgttttccggttaattacttcgggaaacctagtaaccccatgaaat

SEQ ID NO: 65243 - DNA, 75 bp, Artificial Sequence
  Synthetic
taccgtcaccggttctgctgtggggtgtaacccagatactttctggagcaagctacctattctcttgccagggtc

SEQ ID NO: 65244 - DNA, 75 bp, Artificial Sequence
  Synthetic
tgtaacccagatactttctggagcaagctacctattctcttgccagggtcactcttcgcttttgactatacgggg

SEQ ID NO: 65245 - DNA, 75 bp, Artificial Sequence
  Synthetic
gaggccgtgtccctcatagaaggaatcaaccacactcaccacgtctaccggaacaaaacatactgtgtacttggt

SEQ ID NO: 65246 - DNA, 75 bp, Artificial Sequence
  Synthetic
gggggggggctgctttgggggcctgcccatggggcaacccagggggcgctctaatacggacatggggcaaaaagt

SEQ ID NO: 65247 - DNA, 75 bp, Artificial Sequence
  Synthetic
actccacctacgtgaaggatgagcttagatctctggataaaatcaagaaagggaagtcacgcctgatagaggcta

SEQ ID NO: 65248 - DNA, 75 bp, Artificial Sequence
  Synthetic
gccatatcagtgatagagggcatcaaccattcccaccatatctatagaaacaagacatattgtgtgcttgggggt

SEQ ID NO: 65249 - DNA, 75 bp, Artificial Sequence
  Synthetic
ctactgagctatttagtattcctccggcccctgaatgcggttaatcctaactgcggagcacacccccacaaacca

SEQ ID NO: 65250 - DNA, 75 bp, Artificial Sequence
  Synthetic
aagaaattggctcgagttattttaatatacagtttaagctgaaccccaccagaagtctgtcggagtgttaatgac

SEQ ID NO: 65251 - DNA, 75 bp, Artificial Sequence
  Synthetic
caacccagacgtgttttggagtaagctgccgatcctactgcctggagcactctttgcctttgactactcagggta

SEQ ID NO: 65252 - DNA, 75 bp, Artificial Sequence
  Synthetic
accattcccaccatatctatagaaacaagacatattgtgtgcttgggggtatgccatccggatgctctggtacca

SEQ ID NO: 65253 - DNA, 75 bp, Artificial Sequence
  Synthetic
atgagttgaatatggtggcatatggtgatgatgtgcttgctagctaccctttccccatagattgtcaggaacttg

SEQ ID NO: 65254 - DNA, 75 bp, Artificial Sequence
  Synthetic
gggaaattgggtatccagaggaggccgtgtccctcatagaaggaatcaaccacactcaccacgtctaccggaaca

SEQ ID NO: 65255 - DNA, 75 bp, Artificial Sequence
  Synthetic
aagcgagtctatgttctagagaagagaatgaataactacatgcagttcaagagcaaacaccgtattgaacctgta

SEQ ID NO: 65256 - DNA, 75 bp, Artificial Sequence
  Synthetic
tgatgatgtgcttgctagctaccctttccccatagattgtcaggaacttgctaacacagggaaagaatatggctt

SEQ ID NO: 65257 - DNA, 75 bp, Artificial Sequence
  Synthetic
gagcgcaagtgtccacgcagcgatctggatctcatgagaccagcactgtagcgagggaaggctctacaataaatt

SEQ ID NO: 65258 - DNA, 75 bp, Artificial Sequence
  Synthetic
ggccagaatactgtccttctacggacgctacagctgtggacaagcctactcgccctgacgtgtcagtgaataggt

SEQ ID NO: 65259 - DNA, 75 bp, Artificial Sequence
  Synthetic
gtttaaaccagataaacagtttcctttcctcatacatcctaccatgcccatgaaagagatccatgagtcgatcag

SEQ ID NO: 65260 - DNA, 75 bp, Artificial Sequence
  Synthetic
ttcctcatacatcctaccatgcccatgaaagagatccatgagtcgatcaggtggaccagggatgcgcgcaacaca

SEQ ID NO: 65261 - DNA, 75 bp, Artificial Sequence
  Synthetic
tttggacccaacaactcgcgatgtcagcaagatgaaattctacatggataagtatgggttggatctaccgtactc

SEQ ID NO: 65262 - DNA, 75 bp, Artificial Sequence
  Synthetic
gaagacagaatctactggctggtactggaaattccctgatgtactaaatgacacaggagttttcggtcaaaatgc

SEQ ID NO: 65263 - DNA, 75 bp, Artificial Sequence
  Synthetic
caggattactcacaagatccttcgaagttcacccaaccagtcatggacgtgttaaaggaaatggcccccccacta

SEQ ID NO: 65264 - DNA, 75 bp, Artificial Sequence
  Synthetic
cgcaattggctcgaattattttagaggttatacacacctcaaccccaccaggaaatctggtcgtgaatgtgactg

SEQ ID NO: 65265 - DNA, 75 bp, Artificial Sequence
  Synthetic
ataagatcagtgccaattgggctggtactgtccataccagagtacaacaatttgagaagactttggttagaaaat

SEQ ID NO: 65266 - DNA, 75 bp, Artificial Sequence
  Synthetic
ttctaattggttaaataattcggcctaattagacaaagccttgaggttctgggctagttgttgcctcaaggtttc

SEQ ID NO: 65267 - DNA, 75 bp, Artificial Sequence
  Synthetic
gagatccttatgtcttggacgctggagtccccctaagtcaagcactggtttacccccatcaatggatcaatctac

SEQ ID NO: 65268 - DNA, 75 bp, Artificial Sequence
  Synthetic
attggattggccatccggtgtgcaatagagctattatatacctatttgttggctttgtaccactaaccttaaaat

SEQ ID NO: 65269 - DNA, 75 bp, Artificial Sequence
  Synthetic
aacaccgcaaacttcaaacgatgcagcccactagtgtgtgggaaagctattcaacttagagacaggaagtctaag

SEQ ID NO: 65270 - DNA, 75 bp, Artificial Sequence
  Synthetic
cttaaagctgaaccccactagaaatctggtcgtgttaatgactagtgggggtaaatttgttataaccagaatagc

SEQ ID NO: 65271 - DNA, 75 bp, Artificial Sequence
  Synthetic
gacccctgccgacaagtcaccctgctttaatgaagttacatgggaaaatgccactttcttgaagagaggattctt

SEQ ID NO: 65272 - DNA, 75 bp, Artificial Sequence
  Synthetic
atagaaaccatactagaagtcaataataccaccggcaccaccggggtcagtagattactaatccccgttcgagcg

SEQ ID NO: 65273 - DNA, 75 bp, Artificial Sequence
  Synthetic
aagttccatcaaggagcgctgttagtcgctatacttccagagtatgttatagggacagtggcaggcggcacagga

SEQ ID NO: 65274 - DNA, 75 bp, Artificial Sequence
  Synthetic
ggtagtggtgcctgtggcacctctcaagtatagcgccggcgccaccactgagatcccgatcactatcacaatagc

SEQ ID NO: 65275 - DNA, 75 bp, Artificial Sequence
  Synthetic
tgctctgatgacgatgctacagcggtggataaaccaacgcgcccagatgtgtcagtgaataggttttatacattg

SEQ ID NO: 65276 - DNA, 75 bp, Artificial Sequence
  Synthetic
ccccttgaattcggagttcagcggtcttaggcaagccgtgaaacaaggtattcctgttgagatgaagcctggaac

SEQ ID NO: 65277 - DNA, 75 bp, Artificial Sequence
  Synthetic
ttgcggagagcttcgttcagcactcccccagtgtagatcaggtcgatgagtcaccgcattccccacgggcgaccg

SEQ ID NO: 65278 - DNA, 75 bp, Artificial Sequence
  Synthetic
ctcgatgctgggatccctatatcacaattgacagtgtgccctcaccaatggattaacctacggaccaataactgt

SEQ ID NO: 65279 - DNA, 75 bp, Artificial Sequence
  Synthetic
ctctgcagcggaaccgactactttgggtgtccgtgtttccttttatttttatattggctgcttatggtgacaatt

SEQ ID NO: 65280 - DNA, 75 bp, Artificial Sequence
  Synthetic
gctattggattggccatccagtgaccaacagagctttgatatacttgttcgtgggtttcgttccactcaccagtc

SEQ ID NO: 65281 - DNA, 75 bp, Artificial Sequence
  Synthetic
tttgattctgaacaatagaaaatgggcgcccaagtttcaacagaaaaatctgggtcgcacgagacaaagaatgta

SEQ ID NO: 65282 - DNA, 75 bp, Artificial Sequence
  Synthetic
tttacgggttcatttatggcaacaggtaagatgctcatagcatacactcctccgggcagtgcacaacctacaaca

SEQ ID NO: 65283 - DNA, 75 bp, Artificial Sequence
  Synthetic
gcaagtgtctacacagcgctccggttctcacgaaaactcaaactcagccactgagggttctaccataaactacac

SEQ ID NO: 65284 - DNA, 75 bp, Artificial Sequence
  Synthetic
ccattgcaattttgggctgttggtagtgcccattagcccattagattttgaccaaggggcaactccggttatccc

SEQ ID NO: 65285 - DNA, 75 bp, Artificial Sequence
  Synthetic
ccccatccgctgaggcatgtggatacagtgatcgagtggcgcaattaactattggcaactccaccatcaccacgc

SEQ ID NO: 65286 - DNA, 75 bp, Artificial Sequence
  Synthetic
cttattgagactcgctgtgtgatgaatcgaaacggggttaatgaggcgagtgtggaacacttttactctcgtgca

SEQ ID NO: 65287 - DNA, 75 bp, Artificial Sequence
  Synthetic
agtgaacaggttttacacattggacactaaattgtgggagaaatcgtccaagggatggtactggaagttcccgga

SEQ ID NO: 65288 - DNA, 75 bp, Artificial Sequence
  Synthetic
agtggcaggcggtacagggacggaagatacccaccccccttacaagcagactcaacccggcgccgatggcttcga

SEQ ID NO: 65289 - DNA, 75 bp, Artificial Sequence
  Synthetic
ccaaacaataactaacactgcaaccgaccgtgcaagcataaccaccacggattatgaaggcggggtaccagcaaa

SEQ ID NO: 65290 - DNA, 75 bp, Artificial Sequence
  Synthetic
acatctcgccactcataatgattgggcaaatttagtatgggaaagtagctcacgagatcttctggtgtcctccac

SEQ ID NO: 65291 - DNA, 75 bp, Artificial Sequence
  Synthetic
tgcgcctgttttatctccccagacccccgcaacgttacattagaagatagacaatgcgaccaatagccagtgggg

SEQ ID NO: 65292 - DNA, 75 bp, Artificial Sequence
  Synthetic
gatcctgggcgaaatggaccatggcaatccaccttactgggtcagttgtgcgggtactacacccaatggtcagga

SEQ ID NO: 65293 - DNA, 75 bp, Artificial Sequence
  Synthetic
caataggctgcttgcgcggctgaaggggaacgcgcccgttacccggctaactacttcgagaaacctagtaccacc

SEQ ID NO: 65294 - DNA, 75 bp, Artificial Sequence
  Synthetic
tgtgggaagatagctcaagggatctcctcgtgtcgtccacaacagcccaagggtgcgacactattgcccgttgca

SEQ ID NO: 65295 - DNA, 75 bp, Artificial Sequence
  Synthetic
aacacaaccccagtgtagatcaggtcgatgagtcaccgtacaccccacgggcgaccgtgacggtggctgcgttgg

SEQ ID NO: 65296 - DNA, 75 bp, Artificial Sequence
  Synthetic
gaggctcttttccaaggtccacccaaattcaggccaattaggattagtcttgaagaaaaaccagccccagacgct

SEQ ID NO: 65297 - DNA, 75 bp, Artificial Sequence
  Synthetic
cattcggaactggttttactgatgcagtgtctagggaagtggaagctcttaagaactaccttataggatctgaag

SEQ ID NO: 65298 - DNA, 75 bp, Artificial Sequence
  Synthetic
tttatgtggaggccagtgagtactatcctgctaggtatcaatcacacctaatgctcgcggcaggccactctgaac

SEQ ID NO: 65299 - DNA, 75 bp, Artificial Sequence
  Synthetic
tcctgctaggtatcaatcacacctaatgctcgcggcaggccactctgaaccaggggattgtgggggtatcctccg

SEQ ID NO: 65300 - DNA, 75 bp, Artificial Sequence
  Synthetic
gtcatagtgatcagaagtgattatgacatggtaaccctcacagcaaccttagcactcatagggtgtcatggcagt

SEQ ID NO: 65301 - DNA, 75 bp, Artificial Sequence
  Synthetic
ggatgctagtgatatcctgcagacgggcaccatccagggagatagggtggcagatgtaattgaaagttccatagg

SEQ ID NO: 65302 - DNA, 75 bp, Artificial Sequence
  Synthetic
ggcaccatccagggagatagggtggcagatgtaattgaaagttccataggagatagcgtgagcagagccctcact

SEQ ID NO: 65303 - DNA, 75 bp, Artificial Sequence
  Synthetic
tctgtggttggatgaagaagcaatggagcaaggagtctctgattacatcaaagggcttggtgatgcatttggaac

SEQ ID NO: 65304 - DNA, 75 bp, Artificial Sequence
  Synthetic
agctattggattggccatccagtgtgtaatagagctattgtgtattcttttgttggctttgtgccattagattat

SEQ ID NO: 65305 - DNA, 75 bp, Artificial Sequence
  Synthetic
gagcaaggagtctctgattacatcaaagggcttggtgatgcatttggaactggtttcaccgatgcagtttccagg

SEQ ID NO: 65306 - DNA, 75 bp, Artificial Sequence
  Synthetic
tgtttgccggattccaaggtgcttactctggagcacccaagcaaacactcaagaagcctgtgctgagaacggcca

SEQ ID NO: 65307 - DNA, 75 bp, Artificial Sequence
  Synthetic
gacaattgaagaattgttaccatatagctattggattggccatccggtgtgtaacagagcgattatcttctcttt

SEQ ID NO: 65308 - DNA, 75 bp, Artificial Sequence
  Synthetic
ccgggtctcacgaaaatggaaacatcgcgacagggggctctacaataaattacaccaatattaactattatagag

SEQ ID NO: 65309 - DNA, 75 bp, Artificial Sequence
  Synthetic
ttgatctctgctctagtcattgtgattaggagtgattatgacatggtcaccctcactgcaactctagccttaatt

SEQ ID NO: 65310 - DNA, 75 bp, Artificial Sequence
  Synthetic
ttaggagtgattatgacatggtcaccctcactgcaactctagccttaattgggtgccacggtagtccctgggctt

SEQ ID NO: 65311 - DNA, 75 bp, Artificial Sequence
  Synthetic
gaaaagaggatgaacaattacatgcagttcaagagcaaacaccgtattgaacctgtatgtcttatcatcagaggc

SEQ ID NO: 65312 - DNA, 75 bp, Artificial Sequence
  Synthetic
taagccagattctagggaatcccttgcatggcaaactgccactaacccctcagtttttgtcaagctgtcagaccc

SEQ ID NO: 65313 - DNA, 75 bp, Artificial Sequence
  Synthetic
cacccacagggcccactgggcgctagcacaccggtatcacggtacccttgtgcgcctgttttatacaccctccct

SEQ ID NO: 65314 - DNA, 75 bp, Artificial Sequence
  Synthetic
tcaacgacagggccaacgctgctaaggggctggaatggatttccaacaaaatcagcaaatttatcgactggctta

SEQ ID NO: 65315 - DNA, 75 bp, Artificial Sequence
  Synthetic
ctgaaacagttgccactcctggaaaatcaaatctcaaatctagaacaatctgctgcctcacaggaggatcttgaa

SEQ ID NO: 65316 - DNA, 75 bp, Artificial Sequence
  Synthetic
cgttgacaaacccacgagaccagacgtgtcagttaatcgattttacaccctatcagccaaaatgtggcagaaaga

SEQ ID NO: 65317 - DNA, 75 bp, Artificial Sequence
  Synthetic
accagctaggtcttgatcaagcacttctgttaccccggactgagtatcaataagctgtacccacggctgaaagag

SEQ ID NO: 65318 - DNA, 75 bp, Artificial Sequence
  Synthetic
tgaacaactacatgcagttcaagagcaaacaccgtattgaacctgtatgcctcatcatcagaggatctccgggaa

SEQ ID NO: 65319 - DNA, 75 bp, Artificial Sequence
  Synthetic
cgagtacatcaaagaggcagctcttcattacgcaaaccaattaaagcaactagaaattaatacctctcaaatgag

SEQ ID NO: 65320 - DNA, 75 bp, Artificial Sequence
  Synthetic
cgccggacccagaccactttgatgggtataaacaacaagtagtcacagttatggatgacttgtgccaaaaccctg

SEQ ID NO: 65321 - DNA, 75 bp, Artificial Sequence
  Synthetic
gtataaacaacaagtagtcacagttatggatgacttgtgccaaaaccctgatggcaaggatatgtcactgttttg

SEQ ID NO: 65322 - DNA, 75 bp, Artificial Sequence
  Synthetic
gtgctacaatcataatgccttatatcaacagtgtgccatacgattcggccatcaatcattgtaacttcacattgt

SEQ ID NO: 65323 - DNA, 75 bp, Artificial Sequence
  Synthetic
acgcaattggctcgagttattttagaggtcgtacacacctcaaccccaccataactctgatagtgaacttgactg

SEQ ID NO: 65324 - DNA, 75 bp, Artificial Sequence
  Synthetic
attcgttattgcatccaccaatgccagtaacattatagtaccaacagtgtctgactcagacgccattcgtcgtag

SEQ ID NO: 65325 - DNA, 75 bp, Artificial Sequence
  Synthetic
atcaatcattgtaacttcacattgtttgtcattcccgtgagtccattgaactatgacgcaggtgccacggcagcc

SEQ ID NO: 65326 - DNA, 75 bp, Artificial Sequence
  Synthetic
tttattccaccaatggcttctctcgaagaaaagggagtttctttcacgtctaaatttgtaatcgcgtctaccaac

SEQ ID NO: 65327 - DNA, 75 bp, Artificial Sequence
  Synthetic
gggaagacagctctcgcgacttgctcgtgtcatccaccaccgcccaaggttgtgacacgattgcccgttgcgatt

SEQ ID NO: 65328 - DNA, 75 bp, Artificial Sequence
  Synthetic
agtaacattatagtaccaacagtgtctgactcagacgccattcgtcgtagattctatatggactgcgacattgag

SEQ ID NO: 65329 - DNA, 75 bp, Artificial Sequence
  Synthetic
tgggagctcaagtctcaacccaaaagactggatctcatgagaaccagaacatagctgctagcggttctaccataa

SEQ ID NO: 65330 - DNA, 75 bp, Artificial Sequence
  Synthetic
acagcaaactttaaacgctgcagcccgctagtatgtggcaaagccatccaactgagagacaggaaatccaaggtt

SEQ ID NO: 65331 - DNA, 75 bp, Artificial Sequence
  Synthetic
ggtatctgccccaatattgccaggattccaacccaccccagaaattcacattccaggcgaagttaggaatttgct

SEQ ID NO: 65332 - DNA, 75 bp, Artificial Sequence
  Synthetic
ttccaacccaccccagaaattcacattccaggcgaagttaggaatttgctggaattgtgtcaagttgagacgatc

SEQ ID NO: 65333 - DNA, 75 bp, Artificial Sequence
  Synthetic
cgctagtatgtggcaaagccatccaactgagagacaggaaatccaaggttaggtacagtgtggatacagtggtct

SEQ ID NO: 65334 - DNA, 75 bp, Artificial Sequence
  Synthetic
atgtagaggctagcgagtattacccagccaggtaccaatcacatctcatgctcgcacagggtcactcagaacctg

SEQ ID NO: 65335 - DNA, 75 bp, Artificial Sequence
  Synthetic
ccaagttcactcaacctgttgtagatgctctcaaagaaacagctccaccactcaaatcaccatcagctgaagcat

SEQ ID NO: 65336 - DNA, 75 bp, Artificial Sequence
  Synthetic
tgctctcaaagaaacagctccaccactcaaatcaccatcagctgaagcatgtggctatagtgatagggttgctca

SEQ ID NO: 65337 - DNA, 75 bp, Artificial Sequence
  Synthetic
agtttaggcctattagaatcagcctagaggagaagccagccccagatgctatcagtgaccttcttgccagtgtgg

SEQ ID NO: 65338 - DNA, 75 bp, Artificial Sequence
  Synthetic
gacaagctgtgtgcatcattcagagttgatcccgggcgaagcggcccgtgggagtctacgctcctgggacagatc

SEQ ID NO: 65339 - DNA, 75 bp, Artificial Sequence
  Synthetic
agaggagaagccagccccagatgctatcagtgaccttcttgccagtgtggatagcgaagaggtgcgccaatactg

SEQ ID NO: 65340 - DNA, 75 bp, Artificial Sequence
  Synthetic
cagggcgtgtccgactacatcaagggtctcggagatgcttttggaacaggcttcactgacgcagtctcaagggag

SEQ ID NO: 65341 - DNA, 75 bp, Artificial Sequence
  Synthetic
gtattccaaggacactgaggccacagcagttgacaaacctaccaggccagatgtgtcagtcaatagattctacac

SEQ ID NO: 65342 - DNA, 75 bp, Artificial Sequence
  Synthetic
tacgggctcctttatggctacaggcaagatgctcatagcctacacaccacccggtggagagcagcccaagacacg

SEQ ID NO: 65343 - DNA, 75 bp, Artificial Sequence
  Synthetic
gcaatccattgctacagtggtggcagttgtctcattggtgtatgttatctacaagctctttgctggtttccaggg

SEQ ID NO: 65344 - DNA, 75 bp, Artificial Sequence
  Synthetic
gttgtctcattggtgtatgttatctacaagctctttgctggtttccagggcgcatattcaggtgcgcctaagcag

SEQ ID NO: 65345 - DNA, 75 bp, Artificial Sequence
  Synthetic
tgtcatggcagtccttgggcttggatcaaagccaaaacagcctccatcttaggtatccctatcgctcaaaagcag

SEQ ID NO: 65346 - DNA, 75 bp, Artificial Sequence
  Synthetic
agcgcttcctggctcaagaagttcaatgacatggccaacgccgctaaggggttagagtgggtttccaacaagatc

SEQ ID NO: 65347 - DNA, 75 bp, Artificial Sequence
  Synthetic
gcatacatgtacaatgtaatgctagtaaatttcatcaaggcgcactcttggtggctgctataccagaattaatgc

SEQ ID NO: 65348 - DNA, 75 bp, Artificial Sequence
  Synthetic
agaaatatcagacaagttcagacagatcaaggacattttaccatgctaggagtcagggaccgcttggccgtcctt

SEQ ID NO: 65349 - DNA, 75 bp, Artificial Sequence
  Synthetic
cccccttcaatcgcctactgccgaagcgtgtggttatagcgatagagtggcacagctcactataggcaattctac

SEQ ID NO: 65350 - DNA, 75 bp, Artificial Sequence
  Synthetic
ttgccaggtcgagtgctgacactaacccagccactgccctccatccaccatataatgctacacaacctggagagg

SEQ ID NO: 65351 - DNA, 75 bp, Artificial Sequence
  Synthetic
gtagaaactggtggcatactcgattactactccacagggatagtgaccatctggtatcaaactaacttcgttgta

SEQ ID NO: 65352 - DNA, 75 bp, Artificial Sequence
  Synthetic
atcaaggacattttaccatgctaggagtcagggaccgcttggccgtccttccacgacactcgcagcctggaaaaa

SEQ ID NO: 65353 - DNA, 75 bp, Artificial Sequence
  Synthetic
agggatactgagtctatctctcagactgccatattacagggtgatccgattgctgacataatagaaggggctgtg

SEQ ID NO: 65354 - DNA, 75 bp, Artificial Sequence
  Synthetic
ctgccatattacagggtgatccgattgctgacataatagaaggggctgtgactcagaccactaatagagcaataa

SEQ ID NO: 65355 - DNA, 75 bp, Artificial Sequence
  Synthetic
agctcaccctggtcactctcgacactaatgaaaaattcagagacatcaccaaatttatcccagagaacattagtg

SEQ ID NO: 65356 - DNA, 75 bp, Artificial Sequence
  Synthetic
taatgaaaaattcagagacatcaccaaatttatcccagagaacattagtgctgccagtgacgccactctggtgat

SEQ ID NO: 65357 - DNA, 75 bp, Artificial Sequence
  Synthetic
aaagcctactcaccgtaccatgatgtacaacttccctactaaagcaggacagtgtggaggggtggtgacatcagt

SEQ ID NO: 65358 - DNA, 75 bp, Artificial Sequence
  Synthetic
ggaagtctctagccactggtattattgctcgagcaatcgctgataagtaccactccagcgtgtactcgctcccac

SEQ ID NO: 65359 - DNA, 75 bp, Artificial Sequence
  Synthetic
tacaacttccctactaaagcaggacagtgtggaggggtggtgacatcagttggaaaggtcatcggtatccacata

SEQ ID NO: 65360 - DNA, 75 bp, Artificial Sequence
  Synthetic
ggtctagcagggatcttgataattgaggactctggaacctctacaaaaggatatgccacttgggaaatcgatgtg

SEQ ID NO: 65361 - DNA, 75 bp, Artificial Sequence
  Synthetic
aggactctggaacctctacaaaaggatatgccacttgggaaatcgatgtgatgaggtttgtacaattgagacgca

SEQ ID NO: 65362 - DNA, 75 bp, Artificial Sequence
  Synthetic
ctcaaatgagcatggaagaggcttgctacggtacagacaatcttgaggctattgaccttcacactagtgcaggct

SEQ ID NO: 65363 - DNA, 75 bp, Artificial Sequence
  Synthetic
tgggtgaagcctaacaaggagactggaagactcaacattaatggtccgacccgcactaagcttgaacccagcgta

SEQ ID NO: 65364 - DNA, 75 bp, Artificial Sequence
  Synthetic
gtttccacccaaccccagagatgcacatcccaggtgaagtgaagaaccttttagaaatttgtcaagtggagtcca

SEQ ID NO: 65365 - DNA, 75 bp, Artificial Sequence
  Synthetic
gaagactcaacattaatggtccgacccgcactaagcttgaacccagcgtattccatgatgtgtttgagggcaaca

SEQ ID NO: 65366 - DNA, 75 bp, Artificial Sequence
  Synthetic
gtccgatacccgtccaatacatgtatgttccacccggggctcctgtccctaccggtagggacacgtttcagtggc

SEQ ID NO: 65367 - DNA, 75 bp, Artificial Sequence
  Synthetic
ccaccaatggcttctctcgaggagaagggagtttccttcacctctaagtttgtcatcgcatccactaatgccagt

SEQ ID NO: 65368 - DNA, 75 bp, Artificial Sequence
  Synthetic
aaactgcagtggacacactctgcgcagccttcaaagttgatcctggtcgcgatggaccgtggcaatcaacattag

SEQ ID NO: 65369 - DNA, 75 bp, Artificial Sequence
  Synthetic
tggggaacacgctacatgagcctgatgagtacatcagagaggctgccttacattatgcaaatcagttgaagcagc

SEQ ID NO: 65370 - DNA, 75 bp, Artificial Sequence
  Synthetic
ttcgaagatgacagacccgccagctcaggtgtcagtaccattcatgagcccagctagcacctatcaatggtttta

SEQ ID NO: 65371 - DNA, 75 bp, Artificial Sequence
  Synthetic
tagatatagatacttctcaaatgagcatggaggaagcttgttatggtacagactaccttgaggccattgaccttc

SEQ ID NO: 65372 - DNA, 75 bp, Artificial Sequence
  Synthetic
tggcaacagggaaaatgctcatcgcctacaccccaccgggtgcgccacaacctgccaacaggaggaccgcaatgt

SEQ ID NO: 65373 - DNA, 75 bp, Artificial Sequence
  Synthetic
gggtactttctgcatccgcatggtgtcaggagtatcaacgggcaaagacgtcacagtgcgcatttttatgaagct

SEQ ID NO: 65374 - DNA, 75 bp, Artificial Sequence
  Synthetic
ggagcaagttgccaatcttgctccctggttccctctttgcttttgactactcgggctatgatgctagcctcagcc

SEQ ID NO: 65375 - DNA, 75 bp, Artificial Sequence
  Synthetic
cagtgcccttggtatcaagaaaagagacattcttgaccccacaaccagggatgtgtctaagatgaaattctatat

SEQ ID NO: 65376 - DNA, 75 bp, Artificial Sequence
  Synthetic
tagggacgcatgtgatttgggattttggtctacaatcatctgttaccttggtgatcccctggattagcaacacac

SEQ ID NO: 65377 - DNA, 75 bp, Artificial Sequence
  Synthetic
agacccattaggagtcagccctacttgttgaagaactacccaaattttgataaggcaaatattgtagatgcttca

SEQ ID NO: 65378 - DNA, 75 bp, Artificial Sequence
  Synthetic
ccagatgtgtcagtaaatagattctacactttagatactaaagattgggaggccagttctaaagggtggtactgg

SEQ ID NO: 65379 - DNA, 75 bp, Artificial Sequence
  Synthetic
caagtatggccttgacctcccttactctacctatgttaaggatgagctacgctcaatggacaagatcaggaaggg

SEQ ID NO: 65380 - DNA, 75 bp, Artificial Sequence
  Synthetic
attacagagctatgggtagtaatgattattttgactactactctgcaggtattgtaacgatttggtatcagacca

SEQ ID NO: 65381 - DNA, 75 bp, Artificial Sequence
  Synthetic
gctgctgctcagaagaactttacattgagattgcccaaagacactggtgacatttcacaaactgctatcctacaa

SEQ ID NO: 65382 - DNA, 75 bp, Artificial Sequence
  Synthetic
aattttccatgcaaatcctgggactgtaactggttcggcagtagggtgtaacccagatgtgttttggagtaagct

SEQ ID NO: 65383 - DNA, 75 bp, Artificial Sequence
  Synthetic
gccaatcctgcttcctggttccctcttcgctttcgactactcgggctacgatgccagtctcagcccagtctggtt

SEQ ID NO: 65384 - DNA, 75 bp, Artificial Sequence
  Synthetic
gtctcttccaccaccgcacaggggtgtgacaccattgctcggtgcagttgccaaaccggagtgtactactgcaat

SEQ ID NO: 65385 - DNA, 75 bp, Artificial Sequence
  Synthetic
acaacagcccaaaacacacagcaaagtagccaccagattggaacaggagaagtccccgccctgcaagcagcagag

SEQ ID NO: 65386 - DNA, 75 bp, Artificial Sequence
  Synthetic
ccaaaccggagtgtactactgcaattctaagagaaagcactacccagttagtttctcaaaacctagcctcatctt

SEQ ID NO: 65387 - DNA, 75 bp, Artificial Sequence
  Synthetic
tatggtgagtggccttcctactgctcggattctgacgctacagcagtggataaaccaacgcgcccggatgtttca

SEQ ID NO: 65388 - DNA, 75 bp, Artificial Sequence
  Synthetic
gccaggtatcagtcccacctcatgcttgcggcaggtcattctgaaccaggagactgtgggggcatcctcaggtgc

SEQ ID NO: 65389 - DNA, 75 bp, Artificial Sequence
  Synthetic
cctcaggctgctcaggcacatccattttcaactcaatgattaacaacatcatcatcagagcattgcttatcagaa

SEQ ID NO: 65390 - DNA, 75 bp, Artificial Sequence
  Synthetic
cgattgactgcctagaactagcaaaaacaggcaaagagtatggtctaaccatgacacctgcagacaagtctccct

SEQ ID NO: 65391 - DNA, 75 bp, Artificial Sequence
  Synthetic
aacaggcaaagagtatggtctaaccatgacacctgcagacaagtctccctgctttaatgaagttaattgggagaa

SEQ ID NO: 65392 - DNA, 75 bp, Artificial Sequence
  Synthetic
tgaaaacctgagacgcaattggctcgaattattctagaggttgaacacacctcaaccccaccaggaatctggtcg

SEQ ID NO: 65393 - DNA, 75 bp, Artificial Sequence
  Synthetic
tgaatggcagactgcgaccaatccttccatctttgttaaaattagtgatcctccagcccaggtttcggtaccctt

SEQ ID NO: 65394 - DNA, 75 bp, Artificial Sequence
  Synthetic
gcctacccatcgcaccatgatgtacaactttcctactaaagcaggacagtgtggaggagtggtgacatctgttgg

SEQ ID NO: 65395 - DNA, 75 bp, Artificial Sequence
  Synthetic
ggagattcatgagtcaatccggtggaccaaagatgcacgcaacacacaagatcatgtgcgatccttatgcttgtt

SEQ ID NO: 65396 - DNA, 75 bp, Artificial Sequence
  Synthetic
ggcgtggcacaacggtaagcaagaatatgagaagtttgtgagcacaattagatctgtcccagtgggaaaggcatt

SEQ ID NO: 65397 - DNA, 75 bp, Artificial Sequence
  Synthetic
tttcacttgttgaggggatcaatcacacacaccatgtataccgcaacaaaacttactgtgtgcttggtggcatgc

SEQ ID NO: 65398 - DNA, 75 bp, Artificial Sequence
  Synthetic
cgaggctctcagagtgcgcatctatatgcgcatcaagcacgtcagagcatgggtccctagaccatttaggtcaca

SEQ ID NO: 65399 - DNA, 75 bp, Artificial Sequence
  Synthetic
tttgcaaatcctgtcaaagatattttcactgaaatggcggcgccactaaaatctccatctgctgaggcatgtgga

SEQ ID NO: 65400 - DNA, 75 bp, Artificial Sequence
  Synthetic
aaagttgaattcctgagcaaccttaagcaattgcctttactggagaatcaaatttccaacttggaacaatctgcc

SEQ ID NO: 65401 - DNA, 75 bp, Artificial Sequence
  Synthetic
tttaaaacagcctgtgggttgtacccacccacagggcccacgcggcgttagtactctggtatcacggtacctttg

SEQ ID NO: 65402 - DNA, 75 bp, Artificial Sequence
  Synthetic
cataacagctggagcatttggtcaacaatcaggagcagtctatgttgggaattacaaaatagttaatagacatct

SEQ ID NO: 65403 - DNA, 75 bp, Artificial Sequence
  Synthetic
gtactctggtatcacggtacctttgtatgcctgttttatctcccttcccccgtaacgttagaagaatgaacaaaa

SEQ ID NO: 65404 - DNA, 75 bp, Artificial Sequence
  Synthetic
ctttatgcaaccgaagcaaaaagggtttacgccctggagaaaagaatgaataattatatgcagttcaagagcaaa

SEQ ID NO: 65405 - DNA, 75 bp, Artificial Sequence
  Synthetic
tgtttccccggaccgagtatcaatagactgctcacgcggttgaaggagaaaacgttcgttatccggctaactact

SEQ ID NO: 65406 - DNA, 75 bp, Artificial Sequence
  Synthetic
cgtaacgttagaagaatgaacaaaagacaattagcaaatccaccaacccaggtgggttttcgtcaagcacttctg

SEQ ID NO: 65407 - DNA, 75 bp, Artificial Sequence
  Synthetic
caccgtattgaacctgtgtgtttaattattagaggctcaccaggaacaggcaaatcacttgccacaggcattatt

SEQ ID NO: 65408 - DNA, 75 bp, Artificial Sequence
  Synthetic
agttgcagagtgtttcgctcagcactccccccccagtgtagatcaggctgatggatcaccgcgttcctcacgggt

SEQ ID NO: 65409 - DNA, 75 bp, Artificial Sequence
  Synthetic
tgctcgtgtaaggcaggtgtttacttctgcaagtccatgaacaagcattaccccatcagtttccagggacctgga

SEQ ID NO: 65410 - DNA, 75 bp, Artificial Sequence
  Synthetic
gagaagcctagtaccaccaatgattgtctcaagtgttacgctcagcacaaccccagtgtagttcaggtcgatgag

SEQ ID NO: 65411 - DNA, 75 bp, Artificial Sequence
  Synthetic
caatcaggagcagtctatgttgggaattacaaaatagttaatagacatctagcaactaaggaagattggagcaac

SEQ ID NO: 65412 - DNA, 75 bp, Artificial Sequence
  Synthetic
attgtcgaggttcaagccaatgaattttacccacacagataccaaacccatgttctacttgggcatggtacatca

SEQ ID NO: 65413 - DNA, 75 bp, Artificial Sequence
  Synthetic
tatgaaaagtttgtgagcgcaattagatcagtaccagtaggaaaagcattggctattccaaattatgagaatctg

SEQ ID NO: 65414 - DNA, 75 bp, Artificial Sequence
  Synthetic
ttgattcatgacatggtgcgaagagcctattgagctaggcagtagtcctccggcccctgaatgcggctaatccta

SEQ ID NO: 65415 - DNA, 75 bp, Artificial Sequence
  Synthetic
cctattgagctaggcagtagtcctccggcccctgaatgcggctaatcctaaccacggagccatgcgtcacaaacc

SEQ ID NO: 65416 - DNA, 75 bp, Artificial Sequence
  Synthetic
tttccacgcaaatcctgggacgataactggatcagccgtggggtgtaaccctgacacattctggagcaagctgcc

SEQ ID NO: 65417 - DNA, 75 bp, Artificial Sequence
  Synthetic
acctgttttggctcgacgatgaagcgatggaacagggggtcacagattacatcaagggacttggcgatgctttcg

SEQ ID NO: 65418 - DNA, 75 bp, Artificial Sequence
  Synthetic
aattgagagattgttaccatatagctattggattggccatccggtgtctaacagagctataatatatctttttgt

SEQ ID NO: 65419 - DNA, 75 bp, Artificial Sequence
  Synthetic
ttaaaacagcctgtgggttgcacccactcacccgggtctattggggcgcaagcactctggtacctcggtaccttt

SEQ ID NO: 65420 - DNA, 75 bp, Artificial Sequence
  Synthetic
taccttggctgcttatggtgacaatctagagttgtcatcatatagcgattggattggccatccggatattacttt

SEQ ID NO: 65421 - DNA, 75 bp, Artificial Sequence
  Synthetic
agtttgcaaatcctgttaaagacattttcactgaaatggcagcgccactgaagtccccatccgctgaggcatgtg

SEQ ID NO: 65422 - DNA, 75 bp, Artificial Sequence
  Synthetic
gcacaagtttcatctcagaggtcaggatcccacgagactgggaatgtggctactggaggatcgaccatcaacttc

SEQ ID NO: 65423 - DNA, 75 bp, Artificial Sequence
  Synthetic
ctagagttgtcatcatatagcgattggattggccatccggatattactttgtgtgatttatctcttgctcgtaag

SEQ ID NO: 65424 - DNA, 75 bp, Artificial Sequence
  Synthetic
gatcccacgagactgggaatgtggctactggaggatcgaccatcaacttcaccaatataaattattacaaggatt

SEQ ID NO: 65425 - DNA, 75 bp, Artificial Sequence
  Synthetic
gttctgagttcgcaggtcttaggcaagcagttacgcaagggtttcctactgagctgaaacctggcacaaaccaat

SEQ ID NO: 65426 - DNA, 75 bp, Artificial Sequence
  Synthetic
aacgtggctactggtgggtccaccattcattataccaccattaattattataaagattcctatgctgcttcggcc

SEQ ID NO: 65427 - DNA, 75 bp, Artificial Sequence
  Synthetic
ttcattataccaccattaattattataaagattcctatgctgcttcggccaacaagcaggacttcagtcaagatc

SEQ ID NO: 65428 - DNA, 75 bp, Artificial Sequence
  Synthetic
tcagagagctgtctgcccccttgaattcaccatcagttgaagcgtgtggatatagtgaccgagtggcacaactaa

SEQ ID NO: 65429 - DNA, 75 bp, Artificial Sequence
  Synthetic
ttcaccatcagttgaagcgtgtggatatagtgaccgagtggcacaactaacggtgggtaactcctccattacgac

SEQ ID NO: 65430 - DNA, 75 bp, Artificial Sequence
  Synthetic
cgaggaggttcgacagtactgcagggaacaagggtggataatcccggaaacaccaactaatgtggagcgacacct

SEQ ID NO: 65431 - DNA, 75 bp, Artificial Sequence
  Synthetic
cctgtggctacagtgacagggtgtgccaaatgacagtcggtaactccaccatcacgacacaggaggcagctaatg

SEQ ID NO: 65432 - DNA, 75 bp, Artificial Sequence
  Synthetic
ccaaatgacagtcggtaactccaccatcacgacacaggaggcagctaatgtagtagtaggatatggtgagtggcc

SEQ ID NO: 65433 - DNA, 75 bp, Artificial Sequence
  Synthetic
ggacaagcctactcgtccggatgtgtcagttaatagattctacactttagattcaaagatgtggcaagagaactc

SEQ ID NO: 65434 - DNA, 75 bp, Artificial Sequence
  Synthetic
tcagttaatagattctacactttagattcaaagatgtggcaagagaactctactggatggtattggaagttccca

SEQ ID NO: 65435 - DNA, 75 bp, Artificial Sequence
  Synthetic
gctgttcgctggtttccagggcgcgtattctggagcgcccaaacaagccctcaagaagcctgtgttgagaacagc

SEQ ID NO: 65436 - DNA, 75 bp, Artificial Sequence
  Synthetic
acaattgaatagtagaaagagaaaatgggagctcaagtctcaacccaaaagactggatctcatgagaaccagaac

SEQ ID NO: 65437 - DNA, 75 bp, Artificial Sequence
  Synthetic
caccctgtcagcaaaattatgggagtcaactagcaaaggttggtattggaaattccccgatgtcttaactgaaac

SEQ ID NO: 65438 - DNA, 75 bp, Artificial Sequence
  Synthetic
agaatcaataattacatgcagttcaagagcaaacaccgaattgaacctgtatgcttaataattagaggaccccct

SEQ ID NO: 65439 - DNA, 75 bp, Artificial Sequence
  Synthetic
catgttcaatgtaacgctagcaaatttcaccagggggctcttcttgtggcagttatcccggagttcgttctagca

SEQ ID NO: 65440 - DNA, 75 bp, Artificial Sequence
  Synthetic
atatcaggcaggcgcaaactgaccaaggacacttcactatgctcggggtgcgcgaccgccttgccatcttgcccc

SEQ ID NO: 65441 - DNA, 75 bp, Artificial Sequence
  Synthetic
aaggacgcacgaaacactcaagatcatgtgcggtccttgtgcctcctagcatggcataatggtaagcaagaatat

SEQ ID NO: 65442 - DNA, 75 bp, Artificial Sequence
  Synthetic
tcaactagcaaaggttggtattggaaattccccgatgtcttaactgaaacaggcgtgttcggccagaacgcccaa

SEQ ID NO: 65443 - DNA, 75 bp, Artificial Sequence
  Synthetic
gccactcgcaaccaggaaaggctatctgggttgagcacaagttagttaatgtgctggatgctgttgaactggtgg

SEQ ID NO: 65444 - DNA, 75 bp, Artificial Sequence
  Synthetic
ctagttgcatgtttacctgagtacacgaatggtagaagcgatgcaaccaatactcctgctgatgcaaaacaccca

SEQ ID NO: 65445 - DNA, 75 bp, Artificial Sequence
  Synthetic
cgaatggtagaagcgatgcaaccaatactcctgctgatgcaaaacacccatcatacaacgccacacagcctggtc

SEQ ID NO: 65446 - DNA, 75 bp, Artificial Sequence
  Synthetic
ttgactctggggtacctcttagccaatccttaatatacccacatcagtggatcaacttaaggaccaacaattgtg

SEQ ID NO: 65447 - DNA, 75 bp, Artificial Sequence
  Synthetic
ccagatgggaaggacatgtcactcttttgccagatggtctctacagtagaattcattccacccatggctagcttg

SEQ ID NO: 65448 - DNA, 75 bp, Artificial Sequence
  Synthetic
agtatttggtcaaaacgcacagtatcattacttgtataggtctggattctgcatacatgtacagtgtaatgctag

SEQ ID NO: 65449 - DNA, 75 bp, Artificial Sequence
  Synthetic
ctgcaaccttggcgctgataggttgtcatggcagtccttgggcttggatcaaagccaaaacagcctccatcttag

SEQ ID NO: 65450 - DNA, 75 bp, Artificial Sequence
  Synthetic
aaagccaaaacagcctccatcttaggtatccctatcgctcaaaagcagagcgcttcctggctcaagaagttcaat

SEQ ID NO: 65451 - DNA, 75 bp, Artificial Sequence
  Synthetic
tcagcacctattctaccaaacttccaccccaccccgtgtatccacatacctggtgaagttaggaacttgctagag

SEQ ID NO: 65452 - DNA, 75 bp, Artificial Sequence
  Synthetic
accaatggatcaacctcagaacaaacaactgtgccactataatcatgccatacgcgaatgcagtgccttatgact

SEQ ID NO: 65453 - DNA, 75 bp, Artificial Sequence
  Synthetic
ctcttcaggggccaccactgcaatcccaatcacagtgaccatagcgcccctcaattccgaatttggtgggctgcg

SEQ ID NO: 65454 - DNA, 75 bp, Artificial Sequence
  Synthetic
ccaacccacagaaccatgatgtacaactttcccacaaaggctggacagtgcgggggcgtggtcacgtcagttggc

SEQ ID NO: 65455 - DNA, 75 bp, Artificial Sequence
  Synthetic
ctcatccaacatcatagtcccaactgtctcagatagtgacgccattagaaggaggttctatatggattgtgacat

SEQ ID NO: 65456 - DNA, 75 bp, Artificial Sequence
  Synthetic
caactgtgccactataatcatgccatacgcgaatgcagtgccttatgactcagcattgaaccactgtaattttgg

SEQ ID NO: 65457 - DNA, 75 bp, Artificial Sequence
  Synthetic
ccaatcacagtgaccatagcgcccctcaattccgaatttggtgggctgcgccaagctgtcagccagggactccct

SEQ ID NO: 65458 - DNA, 75 bp, Artificial Sequence
  Synthetic
caacactgctaactttaagaagtgcagccccctggtttgtggtaaggccattcaacttagggataggaaatcagg

SEQ ID NO: 65459 - DNA, 75 bp, Artificial Sequence
  Synthetic
tgcaccgctctgtgctgaattcgccggactgagaaatgctgtcactcaaggcttaccggttgagttaaagcctgg

SEQ ID NO: 65460 - DNA, 75 bp, Artificial Sequence
  Synthetic
tcccccaccccaagcatccacattccaggagaagtacgctcattactagaactgtgtagggtggaaaccatactg

SEQ ID NO: 65461 - DNA, 75 bp, Artificial Sequence
  Synthetic
agccccctggtttgtggtaaggccattcaacttagggataggaaatcaggagtcagatatggtttggactctgtt

SEQ ID NO: 65462 - DNA, 75 bp, Artificial Sequence
  Synthetic
ggactgagaaatgctgtcactcaaggcttaccggttgagttaaagcctggtagcaatcaatttcttaccacagac

SEQ ID NO: 65463 - DNA, 75 bp, Artificial Sequence
  Synthetic
gcttataatgaaggagccactactgctatacctattactataactgttgctccaatgtgctcagaattcagtggc

SEQ ID NO: 65464 - DNA, 75 bp, Artificial Sequence
  Synthetic
ataacaggttatgcgcaaatgcgtagaaaggtggagttgttcacctacatgcgttttgacgcagagttcaccttt

SEQ ID NO: 65465 - DNA, 75 bp, Artificial Sequence
  Synthetic
ttgttgcagttgtgtcaaattgagagcatactcgaagtcaacaatgttccatctgcatcccagatgcagagactt

SEQ ID NO: 65466 - DNA, 75 bp, Artificial Sequence
  Synthetic
cctagactggaagttgactttgagcaagctctattctccaaatacgtgggcaatgttctccatgagcctgatgaa

SEQ ID NO: 65467 - DNA, 75 bp, Artificial Sequence
  Synthetic
atcctggtcgtatcgggccctggcaatcgactttggttggtcaaatatgtaggtactacacacaatggtcaggct

SEQ ID NO: 65468 - DNA, 75 bp, Artificial Sequence
  Synthetic
ttgtcccacaattgctccaatatatgtttgtgccacctggggcccccaagccagactccagagaatccctcgcat

SEQ ID NO: 65469 - DNA, 75 bp, Artificial Sequence
  Synthetic
gcatactcgaagtcaacaatgttccatctgcatcccagatgcagagacttctaataccagtgtcagtgcagagtt

SEQ ID NO: 65470 - DNA, 75 bp, Artificial Sequence
  Synthetic
atgcaaaccagcttaaacaactggatataaataccaacaagatgagcatggaagaggcgtgttatggtacagaga

SEQ ID NO: 65471 - DNA, 75 bp, Artificial Sequence
  Synthetic
atcgactttggttggtcaaatatgtaggtactacacacaatggtcaggctcgttaaaggtcacattcatgtttac

SEQ ID NO: 65472 - DNA, 75 bp, Artificial Sequence
  Synthetic
tacaatcagtcactactgtagttgcagtgatttcacttgtgtacgtcatttacaaactctttgctggattccaag

SEQ ID NO: 65473 - DNA, 75 bp, Artificial Sequence
  Synthetic
aattatgcaggtactatacacaatggtctggttcgctggaggtcaccttcatgttcacaggcagttttatggcca

SEQ ID NO: 65474 - DNA, 75 bp, Artificial Sequence
  Synthetic
gtcatggcagtccttgggcttggatcaaagccaaaacagcttctatcttaggtatccctatcgctcaaaagcaaa

SEQ ID NO: 65475 - DNA, 75 bp, Artificial Sequence
  Synthetic
gaccgcaatgctcgggacccacgtcatatgggattttggattacaatcttcagtttcactggtgataccatggat

SEQ ID NO: 65476 - DNA, 75 bp, Artificial Sequence
  Synthetic
agtgatttcacttgtgtacgtcatttacaaactctttgctggattccaaggtgcctactcggggatgcccaaaac

SEQ ID NO: 65477 - DNA, 75 bp, Artificial Sequence
  Synthetic
gtctggttcgctggaggtcaccttcatgttcacaggcagttttatggccacaggcaagctcctgattgcttacac

SEQ ID NO: 65478 - DNA, 75 bp, Artificial Sequence
  Synthetic
atatgggattttggattacaatcttcagtttcactggtgataccatggatcagcaacacacacttcagaacagcc

SEQ ID NO: 65479 - DNA, 75 bp, Artificial Sequence
  Synthetic
gaagaacatcaggaagtgccaaacaaaccaggggcacttcaccttgttaggaattagagacagactggccgtact

SEQ ID NO: 65480 - DNA, 75 bp, Artificial Sequence
  Synthetic
acaatcctctataacattagtgattccctggattagcaacacacatttcagaacaaatgcctcaggaacctactt

SEQ ID NO: 65481 - DNA, 75 bp, Artificial Sequence
  Synthetic
cctgagacgcccggagaggcttacattatcgccatgggggctgctcaagacaacttcaccttgaagatatgtaaa

SEQ ID NO: 65482 - DNA, 75 bp, Artificial Sequence
  Synthetic
tgaatgactcagtgtacctcagaatgacttttggccatctttatgaagtgtttcacgccaacccagggactgtga

SEQ ID NO: 65483 - DNA, 75 bp, Artificial Sequence
  Synthetic
gatgaagcacgtcagagcatggatacctcgcccaatgcgtaaccaaaactatctgttcaaagccaacccaaacta

SEQ ID NO: 65484 - DNA, 75 bp, Artificial Sequence
  Synthetic
ttaaagtcttggatgctgttgagttggtagatgaacaacaggttaatcttgaactcacattgatcacccttgata

SEQ ID NO: 65485 - DNA, 75 bp, Artificial Sequence
  Synthetic
ccctggattagcaacacacatttcagaacaaatgcctcaggaacctactttgattactacactgcaggcatagtt

SEQ ID NO: 65486 - DNA, 75 bp, Artificial Sequence
  Synthetic
gctcaaccaaacttcaccatgcggctatgtaaggatactgatgaaatctcccagactgcagtgttacaaggtgac

SEQ ID NO: 65487 - DNA, 75 bp, Artificial Sequence
  Synthetic
cagagcactgctcataaaaacatttaagggcattgatttggatgaactcaacatggttgcttatggagacgatgt

SEQ ID NO: 65488 - DNA, 75 bp, Artificial Sequence
  Synthetic
gtggtcaagatgtcaacacagcggccggtaccgctcctagctctcacaggttggagactggtcgtgttcccgccc

SEQ ID NO: 65489 - DNA, 75 bp, Artificial Sequence
  Synthetic
tgactattttgactactactctgcaggtattgtaacaatttggtatcagaccaactttgtggtgccatcaggagc

SEQ ID NO: 65490 - DNA, 75 bp, Artificial Sequence
  Synthetic
tcaacacggaagccatgccatcaatgtttgtcccagttggtgacgttcaacagtacggctttcttaacctcagtg

SEQ ID NO: 65491 - DNA, 75 bp, Artificial Sequence
  Synthetic
gtttgtcccagttggtgacgttcaacagtacggctttcttaacctcagtggcaaaccaacacatagaaccatgat

SEQ ID NO: 65492 - DNA, 75 bp, Artificial Sequence
  Synthetic
tatgtaaggatactgatgaaatctcccagactgcagtgttacaaggtgacatcaaagatatgttagagactcaca

SEQ ID NO: 65493 - DNA, 75 bp, Artificial Sequence
  Synthetic
gctctcatagcctcatgacagggtccgcaccagcattacaggcagcagagacaggtgcaacatcagtcacctcag

SEQ ID NO: 65494 - DNA, 75 bp, Artificial Sequence
  Synthetic
actgtgtcctcggtgggatgccatcagggtgctcaggcacttccatcttcaattcaatgatcaacaacattataa

SEQ ID NO: 65495 - DNA, 75 bp, Artificial Sequence
  Synthetic
aagtcatttcttctcacgctcaggtttggtgggtgttgtcaatctaactgacggaggcaccgatacaacgggata

SEQ ID NO: 65496 - DNA, 75 bp, Artificial Sequence
  Synthetic
cgcaccagcattacaggcagcagagacaggtgcaacatcagtcacctcagatgagtcaatgatagagacaagatg

SEQ ID NO: 65497 - DNA, 75 bp, Artificial Sequence
  Synthetic
agggggtaatggccgccaaggtttctgtgctgcactcaaacgcagttacttcgcctccgagcaaggtgagattca

SEQ ID NO: 65498 - DNA, 75 bp, Artificial Sequence
  Synthetic
tcattattagaaccctcctaataaaaacctttaagggaatagacctggatgagttgaacatggtggcctatgggg

SEQ ID NO: 65499 - DNA, 75 bp, Artificial Sequence
  Synthetic
tgtgctgcactcaaacgcagttacttcgcctccgagcaaggtgagattcagtggatgaggtccaataaagagaca

SEQ ID NO: 65500 - DNA, 75 bp, Artificial Sequence
  Synthetic
aaccctactcacatctgaggatagtgccaatggttttaccaactggccaattgacataatgggatatgtgcaaca

SEQ ID NO: 65501 - DNA, 75 bp, Artificial Sequence
  Synthetic
ggggttcgccgatgtgagggatcttctatggttggatgatgaagctatggaacagggtgtgtctgattacattaa

SEQ ID NO: 65502 - DNA, 75 bp, Artificial Sequence
  Synthetic
tacgaactaataactgcgcaaccattattatgccatatgtcaatgcgcttccatttgattcagcgcttaaccact

SEQ ID NO: 65503 - DNA, 75 bp, Artificial Sequence
  Synthetic
ggtaaagagtacggactaaccatgacacctgcagacaaatcaccttgtttcaacgaagtgacgtgggagaacgcc

SEQ ID NO: 65504 - DNA, 75 bp, Artificial Sequence
  Synthetic
ctgtgtggttaactcccacagcgtggctgaaactagtgtctcgcacttcttttccagagctggattagttggtat

SEQ ID NO: 65505 - DNA, 75 bp, Artificial Sequence
  Synthetic
aaagaaccagcagtccttcactccaaagacaagaggcttgaggttgattttgaaactgctcttttctctaaatac

SEQ ID NO: 65506 - DNA, 75 bp, Artificial Sequence
  Synthetic
agggcttggtgatgctttcggcatgggattcacagacgcagtgtcaagagaggttgaagctttgaaaaatcactt

SEQ ID NO: 65507 - DNA, 75 bp, Artificial Sequence
  Synthetic
tacatgtacatcccaccaggcgcccccgcaccaactgccagagactcatttgcatggcagtccgccacaaatccg

SEQ ID NO: 65508 - DNA, 75 bp, Artificial Sequence
  Synthetic
atccacgaatctatacggtggaccaaggacgcgcgcaacactcaagatcatgtgcgctctctgtgcttattggct

SEQ ID NO: 65509 - DNA, 75 bp, Artificial Sequence
  Synthetic
acaacagaaaatggcgaggcaaggccatttatgttacagtatatgtatgtacctccaggtgcccctaagccaacg

SEQ ID NO: 65510 - DNA, 75 bp, Artificial Sequence
  Synthetic
gcagcgcaggaaactggagatgttcacatacatgagatttgatgcagagttcactttcttaactgtgggagcgac

SEQ ID NO: 65511 - DNA, 75 bp, Artificial Sequence
  Synthetic
ctagtgcctaccaatggttctatgacgggtatccaacatttggacaacacccggaaacatctaatacaacatatg

SEQ ID NO: 65512 - DNA, 75 bp, Artificial Sequence
  Synthetic
gcatggaggacgcttgttatggaacagattttctagaagggattgatttggcaacaagtgcagggtacccttaca

SEQ ID NO: 65513 - DNA, 75 bp, Artificial Sequence
  Synthetic
attgccagacaggggtgtactactgtaactcgatgagaaaacactacccagtcagtttttcaaaacccagcctga

SEQ ID NO: 65514 - DNA, 75 bp, Artificial Sequence
  Synthetic
ttggtacacaccctgcatctggtgatattaattatggtatcagtcccaacaacctcttcggaacatttgcattta

SEQ ID NO: 65515 - DNA, 75 bp, Artificial Sequence
  Synthetic
attccaaattttgagaatttgaggaggaattggctcgaattgttttaaatttacagtttgtaactgaaccccacc

SEQ ID NO: 65516 - DNA, 75 bp, Artificial Sequence
  Synthetic
gcatgtgagagcatggatccctaggccaataagatcccagccttacctcctaaagaattttccaaattatgatag

SEQ ID NO: 65517 - DNA, 75 bp, Artificial Sequence
  Synthetic
tattctaaatccccaaactagggatgtgaccaaaatgaaaatgtacttggacaaatatggtattgacctccctta

SEQ ID NO: 65518 - DNA, 75 bp, Artificial Sequence
  Synthetic
aatgccactagcttaatggagagactgcgcttcccggtctcagcacaagcagggaaaggtgagctgtgtgcggtg

SEQ ID NO: 65519 - DNA, 75 bp, Artificial Sequence
  Synthetic
tattaattatggtatcagtcccaacaacctcttcggaacatttgcatttagagtagtaggttctgaaaatataac

SEQ ID NO: 65520 - DNA, 75 bp, Artificial Sequence
  Synthetic
ggaaatccagattgattgaagctagtagcatcaatgattcagtttaccttagaatgtgtttcggtcacctatatg

SEQ ID NO: 65521 - DNA, 75 bp, Artificial Sequence
  Synthetic
accgtacatattgaagaactacccaaatttcaatggaaatgatattagacacatggctaaagataggactagtat

SEQ ID NO: 65522 - DNA, 75 bp, Artificial Sequence
  Synthetic
agaatgtgtttcggtcacctatatgagaaattccatgccaatccagggacaatcactggttcagcagttggttgt

SEQ ID NO: 65523 - DNA, 75 bp, Artificial Sequence
  Synthetic
agagtggtgaatagacacttggccacacataacgattgggtaaatctggtgtgggaggatagttctagagacttg

SEQ ID NO: 65524 - DNA, 75 bp, Artificial Sequence
  Synthetic
aatttcaatggaaatgatattagacacatggctaaagataggactagtataaccacaactggagccttcggtcag

SEQ ID NO: 65525 - DNA, 75 bp, Artificial Sequence
  Synthetic
ccaataagatcccagccttacctcctaaagaattttccaaattatgatagtagtaagatcacatacagcgcaaga

SEQ ID NO: 65526 - DNA, 75 bp, Artificial Sequence
  Synthetic
cacataacgattgggtaaatctggtgtgggaggatagttctagagacttgctggtctcatctactacagcacagg

SEQ ID NO: 65527 - DNA, 75 bp, Artificial Sequence
  Synthetic
cttgaatgggaggactaccaaagagacatccttgtttccaggacgaatgcacacggctgtgacagaattgctaga

SEQ ID NO: 65528 - DNA, 75 bp, Artificial Sequence
  Synthetic
acatccttgtttccaggacgaatgcacacggctgtgacagaattgctagatgcaattgcagcactggagtgtact

SEQ ID NO: 65529 - DNA, 75 bp, Artificial Sequence
  Synthetic
tcagcttttccaaacccagcctgatatttgttgaagctagcgaatattacccagctaggtaccagtcacacctca

SEQ ID NO: 65530 - DNA, 75 bp, Artificial Sequence
  Synthetic
atttgttgaagctagcgaatattacccagctaggtaccagtcacacctcatgcttgccgagggtcactcagaacc

SEQ ID NO: 65531 - DNA, 75 bp, Artificial Sequence
  Synthetic
actcccaccacatttacaggaatcagacgtactgtgtaatgggtggaatgccatctgggtgctctggcactagca

SEQ ID NO: 65532 - DNA, 75 bp, Artificial Sequence
  Synthetic
actatcctgaaagataccagtctcatgtcctattagcaaatggaatcgctgtggcaggtgattgtggtggcatcc

SEQ ID NO: 65533 - DNA, 75 bp, Artificial Sequence
  Synthetic
tgtcctattagcaaatggaatcgctgtggcaggtgattgtggtggcatcctgagatgccatcacggcgtgatcgg

SEQ ID NO: 65534 - DNA, 75 bp, Artificial Sequence
  Synthetic
ggggtttgctgatgtgagggacttactctggcttgatgaggaggctatggaacaaggagtgtctgactacatcaa

SEQ ID NO: 65535 - DNA, 75 bp, Artificial Sequence
  Synthetic
ctctggcttgatgaggaggctatggaacaaggagtgtctgactacatcaaaggtcttggtgatgcttttggcacg

SEQ ID NO: 65536 - DNA, 75 bp, Artificial Sequence
  Synthetic
ggagcgattatgatatggtcaccctcacagctactttagccctgattggttgccatggaagtccttgggcttgga

SEQ ID NO: 65537 - DNA, 75 bp, Artificial Sequence
  Synthetic
gatggaacaaggcgtcacagattatatcaaaggcttgggcgacgcttttggcactggattcactgaatctatctc

SEQ ID NO: 65538 - DNA, 75 bp, Artificial Sequence
  Synthetic
agtgcttacataatagcactgggtgctgcacaaccaaatttcagtttgaagttgtgtaaggacactgaagccatt

SEQ ID NO: 65539 - DNA, 75 bp, Artificial Sequence
  Synthetic
aaaatcttgaaaaacctggtgaagctaatttcagcattagttatagtcatcaggagtgactacgatatggtcact

SEQ ID NO: 65540 - DNA, 75 bp, Artificial Sequence
  Synthetic
atcaaaggcttgggcgacgcttttggcactggattcactgaatctatctctagagaaatccagaacatcaaagac

SEQ ID NO: 65541 - DNA, 75 bp, Artificial Sequence
  Synthetic
taatttcagcattagttatagtcatcaggagtgactacgatatggtcactcttacagctacgcttgccctgatcg

SEQ ID NO: 65542 - DNA, 75 bp, Artificial Sequence
  Synthetic
aaagtcatcggtatacacataggtggcaacggtagacaaggattttgtgcaggtcttaagagaagctactttgcc

SEQ ID NO: 65543 - DNA, 75 bp, Artificial Sequence
  Synthetic
attgtcaggagtgagtatgatctggtcactgttacagcaacacttgcattgattggttgtacaggcagtccatgg

SEQ ID NO: 65544 - DNA, 75 bp, Artificial Sequence
  Synthetic
agcgagcaaggagagatccaatgggttaaacccaataaagaaactgggaggcttaacatcaacggaccaacccgc

SEQ ID NO: 65545 - DNA, 75 bp, Artificial Sequence
  Synthetic
aaagcgcctcatggctgaagaagttcaatgatatggcaaatgccgcaaaagggctcgagtggatctccaataaga

SEQ ID NO: 65546 - DNA, 75 bp, Artificial Sequence
  Synthetic
gatctccctcttgagggcacaactaacccaaatggttatgccaactgggacatagacataacaggttacgcgcaa

SEQ ID NO: 65547 - DNA, 75 bp, Artificial Sequence
  Synthetic
tcactgttacagcaacacttgcattgattggttgtacaggcagtccatggaggtggctcaagacaaaggtggcct

SEQ ID NO: 65548 - DNA, 75 bp, Artificial Sequence
  Synthetic
atgatgtctttgagggcagcaaggagccagcagtcttacatagcaaagaccctcgccttgaggtagatttcgagc

SEQ ID NO: 65549 - DNA, 75 bp, Artificial Sequence
  Synthetic
taaataacaatttgaatttgtgttaattggcaacatctttggtgtaccctggggcttgacaaagtcaccaaagat

SEQ ID NO: 65550 - DNA, 75 bp, Artificial Sequence
  Synthetic
ctcgtggtcttgaatggatagcaaacaaaattagcaagtttattgattggattagagacaagattgtgcccattg

SEQ ID NO: 65551 - DNA, 75 bp, Artificial Sequence
  Synthetic
taaagcaactccctctgttggaaaatcaaatttccaatctcgagcaatctgccgcctcacaggaagatctagaag

SEQ ID NO: 65552 - DNA, 75 bp, Artificial Sequence
  Synthetic
tttaattgggtgtcacggaagtccttgggcctggctcaaatccaaagtttccaatctacttgatattcccattgc

SEQ ID NO: 65553 - DNA, 75 bp, Artificial Sequence
  Synthetic
gatataacaggttacgcgcaaatgcgtagaaaggtggagctattcacctacatgcgctttgatgcagagttcact

SEQ ID NO: 65554 - DNA, 75 bp, Artificial Sequence
  Synthetic
aaacacactacatgagcctgatgagtacatcagagaggcagcccttcactatgcgaaccagttgaagcaactgga

SEQ ID NO: 65555 - DNA, 75 bp, Artificial Sequence
  Synthetic
caaccttaaacagctccccttgctggagaaccaaatcaacaacctggagcaggctgctgctagtcaagagagtct

SEQ ID NO: 65556 - DNA, 75 bp, Artificial Sequence
  Synthetic
gaagactcaacatcaatggaccaacccgcaccaagttagaacctagtgtattccatgacatcttcgagggaaata

SEQ ID NO: 65557 - DNA, 75 bp, Artificial Sequence
  Synthetic
caccaaggcgctttactggtggctgtgctgcctgagtatgtactcggcactatcgcaggagggaccgggaacgag

SEQ ID NO: 65558 - DNA, 75 bp, Artificial Sequence
  Synthetic
tgcgcctgttttacaccccccccccagtgaaacttagaagcagcaaaccacgatcaatagcaggcataacgctcc

SEQ ID NO: 65559 - DNA, 75 bp, Artificial Sequence
  Synthetic
aaacaccgtattgaacctgtatgcttgatcattagaggctctccaggtacgggaaaatcacttgccacaggtatt

SEQ ID NO: 65560 - DNA, 75 bp, Artificial Sequence
  Synthetic
aaaaagagttttctctatggagaagagaatggtcaactacatgcagttcaagggcaaacaacgtattgaacctgt

SEQ ID NO: 65561 - DNA, 75 bp, Artificial Sequence
  Synthetic
caaaatgaagttttatatggataaatatggtcttgatctcccttactccacctatgtcaaagacgaacttcgctc

SEQ ID NO: 65562 - DNA, 75 bp, Artificial Sequence
  Synthetic
aattaagcacgtgagagcttgggtacctagaccccttcgatcccaagcttatatggtcaagaattacccgacata

SEQ ID NO: 65563 - DNA, 75 bp, Artificial Sequence
  Synthetic
aacaatcagcagctagtcaggaagatctagaaaatctattcagtaatgttgcctacttagcccattattgcagaa

SEQ ID NO: 65564 - DNA, 75 bp, Artificial Sequence
  Synthetic
agaatggtcaactacatgcagttcaagggcaaacaacgtattgaacctgtatgtttgattatcagaggctcccca

SEQ ID NO: 65565 - DNA, 75 bp, Artificial Sequence
  Synthetic
tataaacaacaggtggtcacagtcatggacgatctctgccagaatccagacgggaaagatatgtccttgttctgc

SEQ ID NO: 65566 - DNA, 75 bp, Artificial Sequence
  Synthetic
agggcaaacaacgtattgaacctgtatgtttgattatcagaggctccccagggacaggaaaatccctggcaacta

SEQ ID NO: 65567 - DNA, 75 bp, Artificial Sequence
  Synthetic
cggattatgaaggcggggtaccagcaaacccacaaagaacatctggtaagtttggccaacagtccggggctatct

SEQ ID NO: 65568 - DNA, 75 bp, Artificial Sequence
  Synthetic
atggatacaaacaacaagttgttacagtcatggatgatttatgtcaaaatcctgatggaaaggatatttcacttt

SEQ ID NO: 65569 - DNA, 75 bp, Artificial Sequence
  Synthetic
agtcatggatgatttatgtcaaaatcctgatggaaaggatatttcacttttctgtcaaatggtttctaccgttga

SEQ ID NO: 65570 - DNA, 75 bp, Artificial Sequence
  Synthetic
aaaaggcgtatccttcacctctaagtttgtcattgcatcgaccaacgctagcaacatcatagtccccacagtctc

SEQ ID NO: 65571 - DNA, 75 bp, Artificial Sequence
  Synthetic
gcaacatcatagtccccacagtctcagactcagatgcaatccgcaggagattctatatggactgtgatatagaag

SEQ ID NO: 65572 - DNA, 75 bp, Artificial Sequence
  Synthetic
caggcatcattggtagagctattgcagaaaagtaccattctagtgtatattccctacctccagacccggaccatt

SEQ ID NO: 65573 - DNA, 75 bp, Artificial Sequence
  Synthetic
ttcgggtaacattattgtaccaactgtgtctgactctgaggctattagaagaagattctacatggattgtgacat

SEQ ID NO: 65574 - DNA, 75 bp, Artificial Sequence
  Synthetic
gtgtctgactctgaggctattagaagaagattctacatggattgtgacatcgaggtcccagacagttttagattg

SEQ ID NO: 65575 - DNA, 75 bp, Artificial Sequence
  Synthetic
accaacccatctgtgtttgtgaaaatgacggacccaccagctcaagtgtcagtccccttcatgtcaccagccagt

SEQ ID NO: 65576 - DNA, 75 bp, Artificial Sequence
  Synthetic
gccaagctttgttcagagaataacactgctaacttcaaaagatgcagtccacttgtgtgtggcaaagccatccaa

SEQ ID NO: 65577 - DNA, 75 bp, Artificial Sequence
  Synthetic
attgcgtgcttggtggaatgccctcaggttgctcaggaacatccatctttaactcaatgattaataacatcatca

SEQ ID NO: 65578 - DNA, 75 bp, Artificial Sequence
  Synthetic
ggcgctagcactccgattctgcggaatctttgtgcgcctgttttataaccctcccccgaaacttgcaacttagaa

SEQ ID NO: 65579 - DNA, 75 bp, Artificial Sequence
  Synthetic
agtccattggtatgtggtaaagccatccaactgagagacagaaaatcgaaagtgagatacagcttggattcagtg

SEQ ID NO: 65580 - DNA, 75 bp, Artificial Sequence
  Synthetic
agagctaatcagagagtacaacaatagatctgctgttggaaacaccatagaagcactcttccaagggccccccaa

SEQ ID NO: 65581 - DNA, 75 bp, Artificial Sequence
  Synthetic
tccaactgagagacagaaaatcgaaagtgagatacagcttggattcagtgatttcagaactcattagagaataca

SEQ ID NO: 65582 - DNA, 75 bp, Artificial Sequence
  Synthetic
agcaagctttgttttcaaaatacgtgggaaacacgcttcatgagcccgatgagtttgtcagggaagcggctttgc

SEQ ID NO: 65583 - DNA, 75 bp, Artificial Sequence
  Synthetic
tttaaaacagcctgtgggttgcacccactcacagggcctactgggcgcaaacactttgtacctcggtacctttgt

SEQ ID NO: 65584 - DNA, 75 bp, Artificial Sequence
  Synthetic
tagcgaagaggtccgacagtattgcagagagcaagggtggataatcccagaaacaccaaccaacgtggaacgaca

SEQ ID NO: 65585 - DNA, 75 bp, Artificial Sequence
  Synthetic
ctctggacacaccagctcctgatgccattgcagaccttttgagaagtgtggacaatgaagaggtcagagaatact

SEQ ID NO: 65586 - DNA, 75 bp, Artificial Sequence
  Synthetic
accttcctcaagagaggcttcttgcctgatgagcaattcccgtttttgatccaccctaccatgccaatgaaggaa

SEQ ID NO: 65587 - DNA, 75 bp, Artificial Sequence
  Synthetic
agagagcaagggtggataatcccagaaacaccaaccaacgtggaacgacacctcaatagagcagttctggtaatg

SEQ ID NO: 65588 - DNA, 75 bp, Artificial Sequence
  Synthetic
atgtaggcaactatagggtagtgaatcggcaccttgccacacacaacgactgggcaaaccttgtgtgggaggaca

SEQ ID NO: 65589 - DNA, 75 bp, Artificial Sequence
  Synthetic
tgcgttggcggcctgcctatggggcaacccataggacgctctaaagtggacatggtgcgaagagtctattgagct

SEQ ID NO: 65590 - DNA, 75 bp, Artificial Sequence
  Synthetic
tggcataacggtaagcaagaatatgaaaaatttgtgagctcaattagatccgtcccaataggaaaagcattggca

SEQ ID NO: 65591 - DNA, 75 bp, Artificial Sequence
  Synthetic
aacatcaggcaagtccaaacagatcaggggcattttaccatgttaggtgtcagggatcacttggctgtcctccca

SEQ ID NO: 65592 - DNA, 75 bp, Artificial Sequence
  Synthetic
aagtatgggttggatctcccgtattctacttatgttaaagatgaactcagggccattgacaagatcaagaaaggg

SEQ ID NO: 65593 - DNA, 75 bp, Artificial Sequence
  Synthetic
gcctactctggagcacccaagcaggcgctcaagaagcctgtgctaagaacagctactgtccaaggacctagcttg

SEQ ID NO: 65594 - DNA, 75 bp, Artificial Sequence
  Synthetic
agcaaacaccgtattgaacctgtatgtctcattatcagaggttctccaggcactgggaaatccctggcgactggt

SEQ ID NO: 65595 - DNA, 75 bp, Artificial Sequence
  Synthetic
acagcagttgcacaaggtccagggttagactttgccatttccctgcttaaaaagaacatcagaaaagtacagaca

SEQ ID NO: 65596 - DNA, 75 bp, Artificial Sequence
  Synthetic
ttatggatgatttatgtcaaaatcctgatggcaaggatatgtcactattttgccagatggtgtccaccgtagact

SEQ ID NO: 65597 - DNA, 75 bp, Artificial Sequence
  Synthetic
cacgccactcacaaccagggaagaccatctggatagagcacaaattggtcaacgtactagatgcagttgagttgg

SEQ ID NO: 65598 - DNA, 75 bp, Artificial Sequence
  Synthetic
gatgaacagggcgttaatttggaactcacattggtgacactagacactaatgaaaaatttagagacatcaccaag

SEQ ID NO: 65599 - DNA, 75 bp, Artificial Sequence
  Synthetic
caacccagatgtgttttggagcaagttaccaattttgctccccggttctctcttcgcctttgactactcaggcta

SEQ ID NO: 65600 - DNA, 75 bp, Artificial Sequence
  Synthetic
atcgctagatgcaattgtcaaaccggaatatactattgcaactccaaaaggaaacactacccggttagtttcacc

SEQ ID NO: 65601 - DNA, 75 bp, Artificial Sequence
  Synthetic
gtaattggctcgaattgttttagaggtcgaacaaacctcaaccccaccagaaatctggtcgcgaaaatgactggt

SEQ ID NO: 65602 - DNA, 75 bp, Artificial Sequence
  Synthetic
ttaccaattttgctccccggttctctcttcgcctttgactactcaggctatgacgctagcctcagtccagtttgg

SEQ ID NO: 65603 - DNA, 75 bp, Artificial Sequence
  Synthetic
gaaaatgggggctcaagtctcgacgcaaaaatccggtagtcatgagactggtaacgtagccactggaggatctac

SEQ ID NO: 65604 - DNA, 75 bp, Artificial Sequence
  Synthetic
agttcatcccagagacaatagctggtgctagtgatgcaactctagttatcaacactgagcatatgccctcgatgt

SEQ ID NO: 65605 - DNA, 75 bp, Artificial Sequence
  Synthetic
tgaatgaaaaattcagagatatcactaaatttattcctgaatcatttgaacactgcatggatgccactctcatca

SEQ ID NO: 65606 - DNA, 75 bp, Artificial Sequence
  Synthetic
cacacacatcacgtgtatcgcaacaaaacatattgtgtgcttggtggaatgccctcgggctgttcgggaacatcc

SEQ ID NO: 65607 - DNA, 75 bp, Artificial Sequence
  Synthetic
tgctagtgatgcaactctagttatcaacactgagcatatgccctcgatgtttgtgccaataggtgacgttgtgca

SEQ ID NO: 65608 - DNA, 75 bp, Artificial Sequence
  Synthetic
caacccggcaagacttcacacaagatccaaagaaattcacacaaccagtgttagattctattagagaactatcag

SEQ ID NO: 65609 - DNA, 75 bp, Artificial Sequence
  Synthetic
aaacatattgtgtgcttggtggaatgccctcgggctgttcgggaacatccatttttaattcaatgattaacaaca

SEQ ID NO: 65610 - DNA, 75 bp, Artificial Sequence
  Synthetic
gtgtgggggggtagtcacttcagttggcaagatcattggaatccacattggcgggaatggacgccagggcttctg

SEQ ID NO: 65611 - DNA, 75 bp, Artificial Sequence
  Synthetic
gtaaacccacacacagaacaatgatgtacaacttcccaaccaaagctggtcagtgtggaggagtggttacaagta

SEQ ID NO: 65612 - DNA, 75 bp, Artificial Sequence
  Synthetic
ggcaagatcattggaatccacattggcgggaatggacgccagggcttctgcgctggtttaaagaggagctacttt

SEQ ID NO: 65613 - DNA, 75 bp, Artificial Sequence
  Synthetic
atgatgtgctggctagttaccctttcccaatcgactgcctggagctggcaagaacaggcaaggagtatggcctaa

SEQ ID NO: 65614 - DNA, 75 bp, Artificial Sequence
  Synthetic
tgtgcggcattgaagagaagttactttgctactgagcaaggtgagattcaatggatgaagtccaacaaggaaact

SEQ ID NO: 65615 - DNA, 75 bp, Artificial Sequence
  Synthetic
cgaaccaaactggaacctagcgtgttccacaatgtgttcgagggtaataaagagccagcagttctgaccagtaaa

SEQ ID NO: 65616 - DNA, 75 bp, Artificial Sequence
  Synthetic
caattgaaaagttgttaccatatagctattggattggccatccggtaaccaacagagctattgtttacctgttta

SEQ ID NO: 65617 - DNA, 75 bp, Artificial Sequence
  Synthetic
tcttgcctgatgagcaattcccgttcttgatccaccccactatgccaatgaaagaaatccacgagtccattcgct

SEQ ID NO: 65618 - DNA, 75 bp, Artificial Sequence
  Synthetic
tccacaatgtgttcgagggtaataaagagccagcagttctgaccagtaaagaccccaggcttgaggttgattttg

SEQ ID NO: 65619 - DNA, 75 bp, Artificial Sequence
  Synthetic
aaggaacctgcagcacttagtgcaaaggacccaaggttggaggttgactttgaggaagctctattcagtaagtac

SEQ ID NO: 65620 - DNA, 75 bp, Artificial Sequence
  Synthetic
aggacccaaggttggaggttgactttgaggaagctctattcagtaagtacattggcaatgctattcacgaaccag

SEQ ID NO: 65621 - DNA, 75 bp, Artificial Sequence
  Synthetic
gtcacaagtctctactcagcgatccgggtcgcatgagaactcaaactctgcatcggaaggctcaaccataaatta

SEQ ID NO: 65622 - DNA, 75 bp, Artificial Sequence
  Synthetic
attacgcaaatcaattaaaacaactagacataaacaccagcaagatgagcatggaggaggcgtgctatggtacag

SEQ ID NO: 65623 - DNA, 75 bp, Artificial Sequence
  Synthetic
ttcttgtggctgtgataccagaatttgtgattgctggcagaggatctaacacaaaaccaaatgaagcgccccacc

SEQ ID NO: 65624 - DNA, 75 bp, Artificial Sequence
  Synthetic
aacaacactgcaaatttcaaacgttgcagcccattagtgtgtgggaaagctatccaacttagagatagaaagtct

SEQ ID NO: 65625 - DNA, 75 bp, Artificial Sequence
  Synthetic
gggtcgcatgagaactcaaactctgcatcggaaggctcaaccataaattacacaactataaactactacaaggat

SEQ ID NO: 65626 - DNA, 75 bp, Artificial Sequence
  Synthetic
gcatggaggatgcttgctatgggacagaaaatttggaagcaattgatctcagcaccagtgcaggatatccttaca

SEQ ID NO: 65627 - DNA, 75 bp, Artificial Sequence
  Synthetic
accaatggcttctttagaggaaaaaggagtttctttcacgtccaaatttgtcattgcatccaccaatgctagtaa

SEQ ID NO: 65628 - DNA, 75 bp, Artificial Sequence
  Synthetic
ctccaagatgaaactatacatggacaagtatggactagatttaccctattcaacctatgtgaaggatgagcttag

SEQ ID NO: 65629 - DNA, 75 bp, Artificial Sequence
  Synthetic
ccatacgttctggattccggggtaccattgagtcaggctctaatatacccccatcaatggatcaatctccgcact

SEQ ID NO: 65630 - DNA, 75 bp, Artificial Sequence
  Synthetic
tttctgcttgcatgtacaatgtaatgccagtaaatttcaccagggggcccttcttgtggctgtgataccagaatt

SEQ ID NO: 65631 - DNA, 75 bp, Artificial Sequence
  Synthetic
agacataaacaccagcaagatgagcatggaggaggcgtgctatggtacagaaaatttagaagctatagacctaca

SEQ ID NO: 65632 - DNA, 75 bp, Artificial Sequence
  Synthetic
acaagtatggattagacctaccattctctacatacatcaaggatgaactgaggagtaaagaaaaagtcaagaaag

SEQ ID NO: 65633 - DNA, 75 bp, Artificial Sequence
  Synthetic
aagtatggactagatttaccctattcaacctatgtgaaggatgagcttaggtctctagataaaatcaagaagggg

SEQ ID NO: 65634 - DNA, 75 bp, Artificial Sequence
  Synthetic
gtggggtgcaacccagatgtgttttggagcaagttaccaattttgctccccggttctctcttcgcctttgactac

SEQ ID NO: 65635 - DNA, 75 bp, Artificial Sequence
  Synthetic
gtgtttcacgccaacccgggaactataaccgggtctgcagtggggtgtaatcctgatgtgttctggagcaagttg

SEQ ID NO: 65636 - DNA, 75 bp, Artificial Sequence
  Synthetic
agaagttccatgagaacccaggtaccatcacaggatctgcagtaggagcaaaccctgacaccttttggagtaaaa

SEQ ID NO: 65637 - DNA, 75 bp, Artificial Sequence
  Synthetic
ttgcgtttgactactcaagctatgatgcaagtcttagtcctgtatggttcagagctttagaattggttttacgag

SEQ ID NO: 65638 - DNA, 75 bp, Artificial Sequence
  Synthetic
catcacaggatctgcagtaggagcaaaccctgacaccttttggagtaaaattcctatccttctcccaggtagctt

SEQ ID NO: 65639 - DNA, 75 bp, Artificial Sequence
  Synthetic
gacaattaaagaattgttaccatatagctattggattggccatccggtgtctaacagagcaattgtgtatttatt

SEQ ID NO: 65640 - DNA, 75 bp, Artificial Sequence
  Synthetic
agatctaggttatgatgatgaggctgtcagtcttatcgagggcataaatcactcacaccatatctatcgcaataa

SEQ ID NO: 65641 - DNA, 75 bp, Artificial Sequence
  Synthetic
gactattttggaagtgaacaacaccacagaagcaacaggattaacaaggctcttaataccagtgtcctcgcagaa

SEQ ID NO: 65642 - DNA, 75 bp, Artificial Sequence
  Synthetic
gtagaggcattgaagaaccatttaattggctcagaaggagctgttgagaagatcttgaagaacttggtgaagcta

SEQ ID NO: 65643 - DNA, 75 bp, Artificial Sequence
  Synthetic
catactgtgtccttggtgggatgccttcaggttgctctggcacttccattttcaattccatgattaacaacataa

SEQ ID NO: 65644 - DNA, 75 bp, Artificial Sequence
  Synthetic
ggagcgcaagtttccacgcagcggtcggggtcccatgagaccagcactgtagcgagagaaggctcaacgataaac

SEQ ID NO: 65645 - DNA, 75 bp, Artificial Sequence
  Synthetic
tatgatgctagtctttctcctgcttggtttagggctttagaaattgttctcaaaagattaggttatgatcaagat

SEQ ID NO: 65646 - DNA, 75 bp, Artificial Sequence
  Synthetic
atgtactggctagctacccatttcccatcgactgtttggagttggcgagaactggcaaagagtatggactgacta

SEQ ID NO: 65647 - DNA, 75 bp, Artificial Sequence
  Synthetic
acattcaagggtattgacctagatgagttgaatatgattgcatatggtgatgatgtgctagcaagttacccattc

SEQ ID NO: 65648 - DNA, 75 bp, Artificial Sequence
  Synthetic
gtcagtcttatcgagggcataaatcactcacaccatatctatcgcaataagacatactgcgtagttggtggcatg

SEQ ID NO: 65649 - DNA, 75 bp, Artificial Sequence
  Synthetic
agttgaatatgattgcatatggtgatgatgtgctagcaagttacccattcccaattgactgcgcagaattggcaa

SEQ ID NO: 65650 - DNA, 75 bp, Artificial Sequence
  Synthetic
tcttgaaggaaatggcccctccactacaatctccatcagctgaagcatgtgggtacagtgacagggttgctcaat

SEQ ID NO: 65651 - DNA, 75 bp, Artificial Sequence
  Synthetic
tccccgcccggaagcgctcaaccagccaacagagaaaccgccatgctgggcacgcatgtcatttgggactttggg

SEQ ID NO: 65652 - DNA, 75 bp, Artificial Sequence
  Synthetic
taccagaccatcagttcccttttctaatccaccctaccatgcccatgagggaaatccacgagtccattcgttgga

SEQ ID NO: 65653 - DNA, 75 bp, Artificial Sequence
  Synthetic
ttgtgcagtatggctttttgaatctcagtggtaagcctacccatcgcaccatgatgtacaactttcctactaaag

SEQ ID NO: 65654 - DNA, 75 bp, Artificial Sequence
  Synthetic
atgcaaccttcttgaaaagaagtttcaaaccagatgaacaattcccattccttatccacccagtcatgcctatgt

SEQ ID NO: 65655 - DNA, 75 bp, Artificial Sequence
  Synthetic
acaatctccatcagctgaagcatgtgggtacagtgacagggttgctcaattaaccgtagggaactccactataac

SEQ ID NO: 65656 - DNA, 75 bp, Artificial Sequence
  Synthetic
agtggacaaacccaccagacccgatgtctctgtgaataggttttatacattgtctaccaaatcttggacccagaa

SEQ ID NO: 65657 - DNA, 75 bp, Artificial Sequence
  Synthetic
atgaaaaatttgtgagcacaatcagatcagttcctattggaaaagccttggcgataccaaattttgagaacttga

SEQ ID NO: 65658 - DNA, 75 bp, Artificial Sequence
  Synthetic
gatcatgtgcgttcactgtgtctcttggcttggcacgctggaagggaggagtacaatgaatttgttgaaaagatt

SEQ ID NO: 65659 - DNA, 75 bp, Artificial Sequence
  Synthetic
cccgtgctaagaacagccacggttcaaggaccgagcttagactttgccttatccctcttaaggcgcaacatcaga

SEQ ID NO: 65660 - DNA, 75 bp, Artificial Sequence
  Synthetic
gtacaatgaatttgttgaaaagattagaacagtaccaattggcaaagtgctgtcgatccctcagtatgacaactt

SEQ ID NO: 65661 - DNA, 75 bp, Artificial Sequence
  Synthetic
ttactttgctagtgaacaaggagagatccagtgggttaagcccaataaagaaactggaagactcaacatcaatgg

SEQ ID NO: 65662 - DNA, 75 bp, Artificial Sequence
  Synthetic
attcaaaccagatgaacaatacccattcctcatccacccaaccatgccaatgaaggagatacatgagtccattcg

SEQ ID NO: 65663 - DNA, 75 bp, Artificial Sequence
  Synthetic
gttcatgtgcaatgtaatgccagcaaattccaccagggagcactgttagtcgctatggtccctgaatttgtcatt

SEQ ID NO: 65664 - DNA, 75 bp, Artificial Sequence
  Synthetic
ggagaaattggctcgaattgttttaaacttacagcttaaagctgaaccccaccagaaacctggtcgtgcaaatga

SEQ ID NO: 65665 - DNA, 75 bp, Artificial Sequence
  Synthetic
tttgatctaattcggctgatcatgccagttctgggcttgcaaaagctggcatgtgacaattaccctaacccagta

SEQ ID NO: 65666 - DNA, 75 bp, Artificial Sequence
  Synthetic
gtctctgtgaataggttttatacattgtctaccaaatcttggacccagaattctaaaggttggtattggaaattc

SEQ ID NO: 65667 - DNA, 75 bp, Artificial Sequence
  Synthetic
gtgccagcgctacaggctgcagagacaggtgccacttctaatgccacagatgagaacatgattgagacccgttgt

SEQ ID NO: 65668 - DNA, 75 bp, Artificial Sequence
  Synthetic
aattccaccagggagcactgttagtcgctatggtccctgaatttgtcattgcctccaagagtgagcgctcaaagc

SEQ ID NO: 65669 - DNA, 75 bp, Artificial Sequence
  Synthetic
atgttttagacgctgggataccactgagtcaagcgttaatattcccccatcaatggatcaaccttaggactaaca

SEQ ID NO: 65670 - DNA, 75 bp, Artificial Sequence
  Synthetic
gagtcaagcgttaatattcccccatcaatggatcaaccttaggactaacaactgtgctaccattatcatgcctta

SEQ ID NO: 65671 - DNA, 75 bp, Artificial Sequence
  Synthetic
ggtactgagaatcttgaggctattgatcttcacactagtgcaggttacccctatagtgccctggggataaagaaa

SEQ ID NO: 65672 - DNA, 75 bp, Artificial Sequence
  Synthetic
taagtacagtgccggtgccaccactgagatcccgatcaccatcacaatagcccctctgaactctgagtttagcgg

SEQ ID NO: 65673 - DNA, 75 bp, Artificial Sequence
  Synthetic
gagatcccgatcaccatcacaatagcccctctgaactctgagtttagcggccttaggcaagctgtaaaacagggc

SEQ ID NO: 65674 - DNA, 75 bp, Artificial Sequence
  Synthetic
caaaccgacgggaagggatgccttccaatggcaaacagcaactaacccatcagtcttcgtcaaactcactgaccc

SEQ ID NO: 65675 - DNA, 75 bp, Artificial Sequence
  Synthetic
caatggcaaacagcaactaacccatcagtcttcgtcaaactcactgaccctcctgcacaagtctcagttcctttc

SEQ ID NO: 65676 - DNA, 75 bp, Artificial Sequence
  Synthetic
ggatttgaccccactccgacaatacacatccccggagaagtcagtagcatacttgagttgtgtcaagtggaaact

SEQ ID NO: 65677 - DNA, 75 bp, Artificial Sequence
  Synthetic
acatccccggagaagtcagtagcatacttgagttgtgtcaagtggaaactatacttgaggtaaacaatgtgactg

SEQ ID NO: 65678 - DNA, 75 bp, Artificial Sequence
  Synthetic
acatgatgggcacttttgcagtaagagttgttagtaggaaggcaagccaactaaagttgcagactagggtgtaca

SEQ ID NO: 65679 - DNA, 75 bp, Artificial Sequence
  Synthetic
aggttgatcctggtcgtgatggaccttggcaatccactctaatcggtcagctgtgtagatattacacccaatggt

SEQ ID NO: 65680 - DNA, 75 bp, Artificial Sequence
  Synthetic
ttggcaatccactctaatcggtcagctgtgtagatattacacccaatggtcgggctctctggagatcacatttat

SEQ ID NO: 65681 - DNA, 75 bp, Artificial Sequence
  Synthetic
tgagaagaaattggctcgaactattttagatttacagttgaaagctgaaccccaccagaaatctggtctgttaat

SEQ ID NO: 65682 - DNA, 75 bp, Artificial Sequence
  Synthetic
tcgtgagttggcaatgctcggtacgcacataatctgggactttggattacagtcttcagtcacccttgttgtacc

SEQ ID NO: 65683 - DNA, 75 bp, Artificial Sequence
  Synthetic
cacataatctgggactttggattacagtcttcagtcacccttgttgtaccctggataagtaacactcactttaga

SEQ ID NO: 65684 - DNA, 75 bp, Artificial Sequence
  Synthetic
agattaagaaagggaaatcccgtttgattgaagccagcagcctgaatgactcagtctaccttaggatgacttttg

SEQ ID NO: 65685 - DNA, 75 bp, Artificial Sequence
  Synthetic
actgcccagggttgcgacacgattgcccgttgtgagtgtcagacaggggtgtactattgtaactcaaggaggaaa

SEQ ID NO: 65686 - DNA, 75 bp, Artificial Sequence
  Synthetic
gtaccaccagacacgccgaatgaagctaatattatagcaatgggggcagggcaaaagaatttcacgctgaagctg

SEQ ID NO: 65687 - DNA, 75 bp, Artificial Sequence
  Synthetic
ctaatattatagcaatgggggcagggcaaaagaatttcacgctgaagctgtgcaaggacacgcctgagataaccc

SEQ ID NO: 65688 - DNA, 75 bp, Artificial Sequence
  Synthetic
ccggtgtgcaacagagctattatctacttgtttgttggatacattccattaacacctaaatccttcaatacattg

SEQ ID NO: 65689 - DNA, 75 bp, Artificial Sequence
  Synthetic
caaccaacactgttgggcaagatgcaacagctgctaacacagcacccagctctcatagtttgaacactggcctag

SEQ ID NO: 65690 - DNA, 75 bp, Artificial Sequence
  Synthetic
aagcaagctaatatgggtaaatgtgggcaaaactctgcatacatctacgttggtaattacagagtggtcaataga

SEQ ID NO: 65691 - DNA, 75 bp, Artificial Sequence
  Synthetic
aatcttagacgcaattggctcgagttattttagaggttatacacacctcaaccccaccagaaatctggtcgtgaa

SEQ ID NO: 65692 - DNA, 75 bp, Artificial Sequence
  Synthetic
tattttagaggttatacacacctcaaccccaccagaaatctggtcgtgaatgtgactggtgggggtaaatttgtt

SEQ ID NO: 65693 - DNA, 75 bp, Artificial Sequence
  Synthetic
gagggacctcttgtggttggatgaagaagccatggaacagggagtgtctgactatatcaagggactcggtgacgc

SEQ ID NO: 65694 - DNA, 75 bp, Artificial Sequence
  Synthetic
aacagctgctaacacagcacccagctctcatagtttgaacactggcctagtccccgcgcttcaagctgctgagac

SEQ ID NO: 65695 - DNA, 75 bp, Artificial Sequence
  Synthetic
aacccacattgagcatttcttctctaggtcagggctggtgggagttatggaggtagatgatacgggtactagtgg

SEQ ID NO: 65696 - DNA, 75 bp, Artificial Sequence
  Synthetic
agcagtggagaagatcctgaagaacttggtgaaactcatatcagctctggtcatagttatcagaagtgactatga

SEQ ID NO: 65697 - DNA, 75 bp, Artificial Sequence
  Synthetic
gggaatggacgccaaggcttctgtgctggattgaagagaggttactttgccagtgaacaaggagagatccaatgg

SEQ ID NO: 65698 - DNA, 75 bp, Artificial Sequence
  Synthetic
agatccctgcctcttctgcactttttgttataaccagaatagcatactcgatttttcggccgttttttgccgttt

SEQ ID NO: 65699 - DNA, 75 bp, Artificial Sequence
  Synthetic
atttttcggccgttttttgccgttttgttcagtatgcttctcacagcttgccgccgcaaggagcatgagcgcatc

SEQ ID NO: 65700 - DNA, 75 bp, Artificial Sequence
  Synthetic
aggtcagggctggtgggagttatggaggtagatgatacgggtactagtggcaagggattctcaaactgggacatt

SEQ ID NO: 65701 - DNA, 75 bp, Artificial Sequence
  Synthetic
tttgtcaccaatttggagaacgggctcacgaataatagtgtgatacagtacatgtatgtaccacctggagcgcct

SEQ ID NO: 65702 - DNA, 75 bp, Artificial Sequence
  Synthetic
tctatggctggatgaagaagcaatggaacaaggagtatctgactatatcaaaggcctcggtgatgcttttggtat

SEQ ID NO: 65703 - DNA, 75 bp, Artificial Sequence
  Synthetic
tcacgaataatagtgtgatacagtacatgtatgtaccacctggagcgcctaaacccgatgcccgggaatcattcc

SEQ ID NO: 65704 - DNA, 75 bp, Artificial Sequence
  Synthetic
aaacatagaagtaatgcgcaccactgatcaatagcaggcgtaacgcgccagttacgtctcgatcaagcacatctg

SEQ ID NO: 65705 - DNA, 75 bp, Artificial Sequence
  Synthetic
cgctgcaaagggattggagtggatctccaacaaaatcagcaaatttattgattggctcaaggaaaagatcattcc

SEQ ID NO: 65706 - DNA, 75 bp, Artificial Sequence
  Synthetic
attggctcaaggaaaagatcattccggctgcaaaggaaaaagttgagtttcttagtaacctcaagcaactacctt

SEQ ID NO: 65707 - DNA, 75 bp, Artificial Sequence
  Synthetic
ttaaaacagcctgtgggttgttcccactcacagggcccaagtggcgtagaactctggtatcacggtacctttgtt

SEQ ID NO: 65708 - DNA, 75 bp, Artificial Sequence
  Synthetic
tgtcaccagccagtgcctatcaatggttctatgacggttaccccacctttgggccccactcggagacatctaatc

SEQ ID NO: 65709 - DNA, 75 bp, Artificial Sequence
  Synthetic
gttctatgacggttaccccacctttgggccccactcggagacatctaatctatcttacgggcaatgtcccaataa

SEQ ID NO: 65710 - DNA, 75 bp, Artificial Sequence
  Synthetic
gcacagaagcagagtgcatcttggcttaagaagttcaacgatatggcgaacgctgcaaagggattggagtggatc

SEQ ID NO: 65711 - DNA, 75 bp, Artificial Sequence
  Synthetic
gtttaaagctgaaccccaccagaaatctggtcgtgttaatgactggtgggggtaaatttgttataaccagaatag

SEQ ID NO: 65712 - DNA, 75 bp, Artificial Sequence
  Synthetic
ccaaaatgaaattctacatggataaatatgggttagacttgccctattccacctatgtgaaagatgagcttagat

SEQ ID NO: 65713 - DNA, 75 bp, Artificial Sequence
  Synthetic
gtgggttgcacccacccacagggcccactgggcgccagcacactgattctatggaatctttgtgcgcctgtttta

SEQ ID NO: 65714 - DNA, 75 bp, Artificial Sequence
  Synthetic
acggctgaagagggtgagggcgtggatccccagacctttgagatcgcagccgtacatttacagaaactaccccac

SEQ ID NO: 65715 - DNA, 75 bp, Artificial Sequence
  Synthetic
atccccagacctttgagatcgcagccgtacatttacagaaactaccccacctatggtactaccatccaatacctg

SEQ ID NO: 65716 - DNA, 75 bp, Artificial Sequence
  Synthetic
tgtctagatcaagcacttctgtctccccggatcgagtatcaatagactgctaacgcggttgaaggagaaaacgtc

SEQ ID NO: 65717 - DNA, 75 bp, Artificial Sequence
  Synthetic
cgcctattttaaaacccccccccccgtaacttagaagaatgaacaaaacaaactcagtagtaggtaatgcatcca

SEQ ID NO: 65718 - DNA, 75 bp, Artificial Sequence
  Synthetic
tccggagctatctacgtggggaattttagggtagtgaaccgccatctcgccactcacaatgattgggcaaatctt

SEQ ID NO: 65719 - DNA, 75 bp, Artificial Sequence
  Synthetic
ttagggtagtgaaccgccatctcgccactcacaatgattgggcaaatcttgtctgggaagatagtgctcgcgacc

SEQ ID NO: 65720 - DNA, 75 bp, Artificial Sequence
  Synthetic
agctgttatatacctgtttgttggttttgtaccactaactttaaaatctataactacccttaattttatattgac

SEQ ID NO: 65721 - DNA, 75 bp, Artificial Sequence
  Synthetic
tggatcccgcgaccgatgcgcagtcaaccatatgtcgcaaagaactatcccaattacaaaggatctgagatcaag

SEQ ID NO: 65722 - DNA, 75 bp, Artificial Sequence
  Synthetic
gtaactcaaggagaaaacactacccagttagtttctcaaaacccagcctcgtttttgtggaggctagtgagtact

SEQ ID NO: 65723 - DNA, 75 bp, Artificial Sequence
  Synthetic
agttagtttctcaaaacccagcctcgtttttgtggaggctagtgagtactatccagccaggtatcaatcacatct

SEQ ID NO: 65724 - DNA, 75 bp, Artificial Sequence
  Synthetic
tactatcaactattacaaggactcttatgctgctacagcaggcaagcagagcctcaaacaagaccctgacaagtt

SEQ ID NO: 65725 - DNA, 75 bp, Artificial Sequence
  Synthetic
agaaaggagtgtctttcacctctaagtttgtcgttgcatcgaccaatgctagcaacatagtagttcctacagttt

SEQ ID NO: 65726 - DNA, 75 bp, Artificial Sequence
  Synthetic
agtgtccactggtggcaatgggttagtcggatttgctgacatcagggatcttttgtggttggacgaggaagcaat

SEQ ID NO: 65727 - DNA, 75 bp, Artificial Sequence
  Synthetic
gtcggatttgctgacatcagggatcttttgtggttggacgaggaagcaatggagcagggagtgtctgattacatc

SEQ ID NO: 65728 - DNA, 75 bp, Artificial Sequence
  Synthetic
tccaaagtcaggtatagcgtagacactgtggtatcagaattggttagggagtataataacaggtctgctatagga

SEQ ID NO: 65729 - DNA, 75 bp, Artificial Sequence
  Synthetic
tggctgcttatggtgacaattgagagattgttaccatatagctattggattggccatccagtgaccaacagagct

SEQ ID NO: 65730 - DNA, 75 bp, Artificial Sequence
  Synthetic
ctccacggcatctacgatctttactaacttgtgttcaacccagatggtttttcctggttgggagtgcctggggag

SEQ ID NO: 65731 - DNA, 75 bp, Artificial Sequence
  Synthetic
ctcatgggatctgaaggggcggttgagaagattctaaaaaaccttattaagctgatctctgcgctggtaattgta

SEQ ID NO: 65732 - DNA, 75 bp, Artificial Sequence
  Synthetic
ccagatgctattagtgacctgcttgctagtgttgacagtgaagaggtgcggcagtactgcagagatcaaggatgg

SEQ ID NO: 65733 - DNA, 75 bp, Artificial Sequence
  Synthetic
agtgaataggttttacacattagacactaaactgtgggaaaaatcatccaaggggtggtactggaaattccctga

SEQ ID NO: 65734 - DNA, 75 bp, Artificial Sequence
  Synthetic
gagacaaagaatgtagcgaccgaagggtctactatcaacttcaccaacatcaattactataaggactcttatgca

SEQ ID NO: 65735 - DNA, 75 bp, Artificial Sequence
  Synthetic
gattagtcttgatgagaaacccgctccagatgctattagtgacctgcttgctagtgttgacagtgaagaggtgcg

SEQ ID NO: 65736 - DNA, 75 bp, Artificial Sequence
  Synthetic
agaagattctaaaaaaccttattaagctgatctctgcgctggtaattgtaattaggagtgattatgatatggtta

SEQ ID NO: 65737 - DNA, 75 bp, Artificial Sequence
  Synthetic
tacagactagagtgtacatgaagcttaagcatgtgagggcctgggtcccaagaccgatcaggtctcagccatacc

SEQ ID NO: 65738 - DNA, 75 bp, Artificial Sequence
  Synthetic
ttctaggtatccccattgctcaaaaacaaagcgcgtcctggctcaagaaattcaatgacatggccaatgctgcca

SEQ ID NO: 65739 - DNA, 75 bp, Artificial Sequence
  Synthetic
atcagcgacctacttgctagtgtggatagcgaggaggttcggcaatactgcagggaacaggggtggataattcca

SEQ ID NO: 65740 - DNA, 75 bp, Artificial Sequence
  Synthetic
acaaagcgcgtcctggctcaagaaattcaatgacatggccaatgctgccaaggggttggaatggatatccaataa

SEQ ID NO: 65741 - DNA, 75 bp, Artificial Sequence
  Synthetic
aagtctagtaccgtcatgaaagttgctaagcgttacgctccccagtaaccccaactggtagttctggctgatgag

SEQ ID NO: 65742 - DNA, 75 bp, Artificial Sequence
  Synthetic
tctgaagcaactaccactgttagagaatcagatctcaaacctggaacagtctgccgcctcgcaagaggaccttga

SEQ ID NO: 65743 - DNA, 75 bp, Artificial Sequence
  Synthetic
catgcttggggtgcgtgaccgccttgctatcttacctcgtcactcacaaccagggaagaccatctgggttgagca

SEQ ID NO: 65744 - DNA, 75 bp, Artificial Sequence
  Synthetic
cccattagcccattagattttgaccaaggggcaaccccggttatccctattactatcactctagctccaatgtgc

SEQ ID NO: 65745 - DNA, 75 bp, Artificial Sequence
  Synthetic
ccaccagacccagatcacttcgacgggtacaagcagcaagtagttacggttatggatgacttatgtcagaatccc

SEQ ID NO: 65746 - DNA, 75 bp, Artificial Sequence
  Synthetic
ggtacaagcagcaagtagttacggttatggatgacttatgtcagaatcccgatggtaaagacatgtcattatttt

SEQ ID NO: 65747 - DNA, 75 bp, Artificial Sequence
  Synthetic
gatgctcatagcctatacaccgccaggaggccctttgcccaaggaccgggcgaccgccatgttgggcacgcacgt

SEQ ID NO: 65748 - DNA, 75 bp, Artificial Sequence
  Synthetic
ggaggccctttgcccaaggaccgggcgaccgccatgttgggcacgcacgtcatctgggattttgggctgcaatcg

SEQ ID NO: 65749 - DNA, 75 bp, Artificial Sequence
  Synthetic
agtttgtcattgcgtctaccaatgccagtaacatcatagtgccaacagtatccgattctgatgccattcgccgca

SEQ ID NO: 65750 - DNA, 75 bp, Artificial Sequence
  Synthetic
ctcggcccctgcacagttgccgtgcgcagcactggtttcttgagtgtttgcttgggggcgccggaatatgctcct

SEQ ID NO: 65751 - DNA, 75 bp, Artificial Sequence
  Synthetic
cagtaacatcatagtgccaacagtatccgattctgatgccattcgccgcagattttacatggattgtgatataga

SEQ ID NO: 65752 - DNA, 75 bp, Artificial Sequence
  Synthetic
ggagactgaacattaatggcccaacccgtaccaaattggagcccagtgtatttcatgatgtgtttgagggcagta

SEQ ID NO: 65753 - DNA, 75 bp, Artificial Sequence
  Synthetic
cactgcaaattttaagcgctgcagcccactagtgtgtggaaaagccattcaacttagagacagaaaatctaaagt

SEQ ID NO: 65754 - DNA, 75 bp, Artificial Sequence
  Synthetic
aactccattgattcacattcctggtgagttcacctctttgttagatttgtgtcaaatagaaaccatactagaagt

SEQ ID NO: 65755 - DNA, 75 bp, Artificial Sequence
  Synthetic
ggcaccatccagggagatagggtggcagatgtaattgaaagttccataggagatagtgtgagcagagccctcact

SEQ ID NO: 65756 - DNA, 75 bp, Artificial Sequence
  Synthetic
ccactagtgtgtggaaaagccattcaacttagagacagaaaatctaaagtcagatatagtgtggacacagtggtc

SEQ ID NO: 65757 - DNA, 75 bp, Artificial Sequence
  Synthetic
gagcaagctttgttttccaagtatgtgggaaacaccctgcacgaacctgatgagtacgtgacacaggctgctctc

SEQ ID NO: 65758 - DNA, 75 bp, Artificial Sequence
  Synthetic
acccacagggcctactgggcgctagcactctggcactgaggtacctttgtgcgcctgtttttacttcccttcccc

SEQ ID NO: 65759 - DNA, 75 bp, Artificial Sequence
  Synthetic
gggcgcaatggcccgtggcaatccacaatggttggtcagatctgtaggtattacactcaatggtctggttccctt

SEQ ID NO: 65760 - DNA, 75 bp, Artificial Sequence
  Synthetic
ataggagatagtgtgagcagagccctcactcacgctctaccagcacccacaggccagaacacacaggtgagcagt

SEQ ID NO: 65761 - DNA, 75 bp, Artificial Sequence
  Synthetic
aagttcagacccatcaggattagtcttgaggagaagccagccccagatgccatcagtgatctccttgccagtgtg

SEQ ID NO: 65762 - DNA, 75 bp, Artificial Sequence
  Synthetic
acgatcaatagcaggtgtgacacaccagtcatatcttgatcaagcacttctgtttccccggactgagtatcaata

SEQ ID NO: 65763 - DNA, 75 bp, Artificial Sequence
  Synthetic
tgccttgggtgttaagaaaagggacatactcgatccaatcactagagataccaccaaaatgaaattctacatgga

SEQ ID NO: 65764 - DNA, 75 bp, Artificial Sequence
  Synthetic
ttgaggagaagccagccccagatgccatcagtgatctccttgccagtgtggatagcgaggaagtgcgccaatact

SEQ ID NO: 65765 - DNA, 75 bp, Artificial Sequence
  Synthetic
tgcagtccatcgctactgtagtggcagttgtctcgctggtgtatgttatctacaagctgtttgcagggttccaag

SEQ ID NO: 65766 - DNA, 75 bp, Artificial Sequence
  Synthetic
agttgtctcgctggtgtatgttatctacaagctgtttgcagggttccaaggtgcatactctggtgcccctaagca

SEQ ID NO: 65767 - DNA, 75 bp, Artificial Sequence
  Synthetic
cctattgcgctaccatatagtcctccggcccctgaatgcggctaatcccaacctcggagcattcaactgcaaacc

SEQ ID NO: 65768 - DNA, 75 bp, Artificial Sequence
  Synthetic
ggctcgctatttgcctttgactattcaggctatgatgctagtcttagccccgtctggttcagggctttggagatg

SEQ ID NO: 65769 - DNA, 75 bp, Artificial Sequence
  Synthetic
gaggaacatcaggcaagttcagacagatcaagggcacttcactatgctaggtgtcagagaccgcttggccgtcct

SEQ ID NO: 65770 - DNA, 75 bp, Artificial Sequence
  Synthetic
gatcaagggcacttcactatgctaggtgtcagagaccgcttggccgtcctcccgcgacactcgcaacctggaaag

SEQ ID NO: 65771 - DNA, 75 bp, Artificial Sequence
  Synthetic
cctgcgagtgcttaccaatggttctatgacggatatcccacattcggagaacacaaacaggagaaagatcttgaa

SEQ ID NO: 65772 - DNA, 75 bp, Artificial Sequence
  Synthetic
ttgtcaagttgtcagaccctccagcacaggtttcagtaccattcatgtcacctgcgagtgcttaccaatggttct

SEQ ID NO: 65773 - DNA, 75 bp, Artificial Sequence
  Synthetic
aataaatcacacccatcatgtgtatcggaacaaaacatattgtgtccttggtgggatgccgtcaggatgttctgg

SEQ ID NO: 65774 - DNA, 75 bp, Artificial Sequence
  Synthetic
taccaaaatgatcccattgcaaatgcagtggaaagtgctgtgagcgcgcttgctgacaccacaatatcccgggtg

SEQ ID NO: 65775 - DNA, 75 bp, Artificial Sequence
  Synthetic
gagatcggctactcagaggaggctgtgtcactaatagaagggatcaaccacacccatcatgtgtatcggaacaag

SEQ ID NO: 65776 - DNA, 75 bp, Artificial Sequence
  Synthetic
gaactgaccctgatcactcttgataccaatgagaagtttagagatatcaccaaatttattccagaaaacattagt

SEQ ID NO: 65777 - DNA, 75 bp, Artificial Sequence
  Synthetic
gctcaacgttggtgggagagtcaggtacaatccatccctggtctctacagtattggcgaacctcttcactatcaa

SEQ ID NO: 65778 - DNA, 75 bp, Artificial Sequence
  Synthetic
tgcgtgcacccctactggtgaggttgttccacaattactccagtatatgtttgttccccctggcgctcccaagcc

SEQ ID NO: 65779 - DNA, 75 bp, Artificial Sequence
  Synthetic
ccaatgagaagtttagagatatcaccaaatttattccagaaaacattagtgctgctaatgacgccactctagtga

SEQ ID NO: 65780 - DNA, 75 bp, Artificial Sequence
  Synthetic
acatgcgctttgatgcagagttcacttttgttgcgtgcacacccaccggggaagttgtcccacaattgctccaat

SEQ ID NO: 65781 - DNA, 75 bp, Artificial Sequence
  Synthetic
cctttaaggggatcgatttggatgagttgaacatggtagcttacggagatgatgtgttggctagctatccattcc

SEQ ID NO: 65782 - DNA, 75 bp, Artificial Sequence
  Synthetic
ggaagcccactcaccgcactatgatgtacaacttccctactaaagcgggacaatgtggaggggtagtgacatctg

SEQ ID NO: 65783 - DNA, 75 bp, Artificial Sequence
  Synthetic
gtacaacttccctactaaagcgggacaatgtggaggggtagtgacatctgttggaaaggtcattggtatacacat

SEQ ID NO: 65784 - DNA, 75 bp, Artificial Sequence
  Synthetic
caccagtcgcacagcgatcactactcttgggaaatttgggcaacagtctggggccatttacgtgggtaactttag

SEQ ID NO: 65785 - DNA, 75 bp, Artificial Sequence
  Synthetic
gtgggtcaaacctaataaagagactggaaggctcaacatcaatggaccaacccacaccaagctcgagcctagtgt

SEQ ID NO: 65786 - DNA, 75 bp, Artificial Sequence
  Synthetic
tttagagtattcagattgtcatcataaactactaggtcttgccaaccggtctataatatattattttgttggatt

SEQ ID NO: 65787 - DNA, 75 bp, Artificial Sequence
  Synthetic
ggaaggctcaacatcaatggaccaacccacaccaagctcgagcctagtgtatttcatgatgtcttcgagggagac

SEQ ID NO: 65788 - DNA, 75 bp, Artificial Sequence
  Synthetic
gtattcgcaaaattgagtgatccacccccccaggtgtctgtcccgttcatgtcgccagcaacagcttatcagtgg

SEQ ID NO: 65789 - DNA, 75 bp, Artificial Sequence
  Synthetic
agaatttgagaagaaattggctcgaactattttagatttacagttgaaagctgaaccccaccagaaatctggtcg

SEQ ID NO: 65790 - DNA, 75 bp, Artificial Sequence
  Synthetic
cttggaaagttcggtcagcaatctggggccatctatgtgggcaacttcagggtggtcaatcgtcatctcgctact

SEQ ID NO: 65791 - DNA, 75 bp, Artificial Sequence
  Synthetic
gtggggaatacattacacgagcctgatgagtacattagagaagcagctcttcactatgcaaatcaattgaaacaa

SEQ ID NO: 65792 - DNA, 75 bp, Artificial Sequence
  Synthetic
gccactcacaatgattgggcaaatcttgtttgggaagacagctctcgcgacttgctcgtgtcatctaccaccgcc

SEQ ID NO: 65793 - DNA, 75 bp, Artificial Sequence
  Synthetic
cataccagtgcaggttacccctacagtgccctgggaataaaaaagagagacatcctagaccccaccaccagagat

SEQ ID NO: 65794 - DNA, 75 bp, Artificial Sequence
  Synthetic
gtgccctgggaataaaaaagagagacatcctagaccccaccaccagagatgtgagtaagatgaagttctacatgg

SEQ ID NO: 65795 - DNA, 75 bp, Artificial Sequence
  Synthetic
tacctaggccccttcggtcccaagcttatatggtcaagaattacccgacatacagccaaacaataactaacactg

SEQ ID NO: 65796 - DNA, 75 bp, Artificial Sequence
  Synthetic
ggaaatcccgcctaatcgaggctagtagcttgaatgactcagtgtacctcaggatggtttttggccacctatatg

SEQ ID NO: 65797 - DNA, 75 bp, Artificial Sequence
  Synthetic
ggtgttcccaataacggatctgttgttatactccctgacaagctcactcacaactgtgtccaaactatatctcac

SEQ ID NO: 65798 - DNA, 75 bp, Artificial Sequence
  Synthetic
aggatggtttttggccacctatatgaaaccttccacgcgaaccctgggactgtaactggttcagccgtggggtgc

SEQ ID NO: 65799 - DNA, 75 bp, Artificial Sequence
  Synthetic
atgacatggccaacgctgctaaggggctagagtgggtttccaataagatcagcaagttcattgattggcttaagg

SEQ ID NO: 65800 - DNA, 75 bp, Artificial Sequence
  Synthetic
aagagtctattgagctagttagtagtcctccggcccctgaatgcggctaatcctaactgcggagcgcataccctc

SEQ ID NO: 65801 - DNA, 75 bp, Artificial Sequence
  Synthetic
tcagggcactggagctagtcctcagggagataggctatagtgaggaggcggtttcactcattgaggggatcaatc

SEQ ID NO: 65802 - DNA, 75 bp, Artificial Sequence
  Synthetic
tgcctcacaagaggaccttgaagtcatgtttgggaatgtgtcgtatctagcccacttctgtcgcaagttccaacc

SEQ ID NO: 65803 - DNA, 75 bp, Artificial Sequence
  Synthetic
tgtcatggaagcccttgggcttggattaaagccaaaacagcatccattttaggtatccccatcgcccagaagcag

SEQ ID NO: 65804 - DNA, 75 bp, Artificial Sequence
  Synthetic
ttttcaattcgatgatcaacaacatcattattagggcactactcataaaaacattcaggggtattgatttagatg

SEQ ID NO: 65805 - DNA, 75 bp, Artificial Sequence
  Synthetic
acaattgagagattgttaccatatagctattggattggccatccagtgtctaacagagcaattgtatacttattt

SEQ ID NO: 65806 - DNA, 75 bp, Artificial Sequence
  Synthetic
ccaattgactgtctggaattggcaagaacgggtaaggagtatggtttgactatgactcctgcagacaaatcccct

SEQ ID NO: 65807 - DNA, 75 bp, Artificial Sequence
  Synthetic
gagcacaagtgtccacacagcgatctgggtctcatgagaccagcaccgtagcaagggaaggctcaacaataaatt

SEQ ID NO: 65808 - DNA, 75 bp, Artificial Sequence
  Synthetic
caggattattcacaagacccttcaaagttcacccaaccagtcatggacgtgctgaaagaaatggcccccccgctg

SEQ ID NO: 65809 - DNA, 75 bp, Artificial Sequence
  Synthetic
ttaaaacagcctgtgggttggccatccggtgggcccactgggcgttagcacactgattctacggaatctttgtgc

SEQ ID NO: 65810 - DNA, 75 bp, Artificial Sequence
  Synthetic
cactgattctacggaatctttgtgcgcctgttttatatccctcccctaaaatagtaacttagaagttgaacattt

SEQ ID NO: 65811 - DNA, 75 bp, Artificial Sequence
  Synthetic
atagtaacttagaagttgaacatttacacgaccaatagtgggcgtggcgcaccagccacgtcttggtcaagcact

SEQ ID NO: 65812 - DNA, 75 bp, Artificial Sequence
  Synthetic
cactccagtgtgtactcacttccaccagacccagatcattttgacgggtacaaacagcaggtggtcacagtaatg

SEQ ID NO: 65813 - DNA, 75 bp, Artificial Sequence
  Synthetic
ctccctgcatcgagcctgcccagttctgtcttataggaatcagttacctcaatatcgcagtccataaagaaccga

SEQ ID NO: 65814 - DNA, 75 bp, Artificial Sequence
  Synthetic
aacactgcaaattttaaacgttgcagcccattagtgtgtgggaaagccatccaacttagagatagaaagtctaaa

SEQ ID NO: 65815 - DNA, 75 bp, Artificial Sequence
  Synthetic
taactatcacattggccccaatgtgttctgaattcgcaggtcttaggcaggcagtcacgcaagggtttcccaccg

SEQ ID NO: 65816 - DNA, 75 bp, Artificial Sequence
  Synthetic
ccacgtgcaatgcaatgctagtaaattccaccaaggagcactcctagtcgctgtcctaccagagtatgtcattgg

SEQ ID NO: 65817 - DNA, 75 bp, Artificial Sequence
  Synthetic
tatctgtacagatcaggattttgtgttcatgtgcaatgtaatgccagtaaatttcatcagggagcactcttagtc

SEQ ID NO: 65818 - DNA, 75 bp, Artificial Sequence
  Synthetic
ttttttttttttgctattctggttataacaaatttacccccaccagtcgttagcgcgaccagattgctggtgggg

SEQ ID NO: 65819 - DNA, 75 bp, Artificial Sequence
  Synthetic
tagcgcgaccagattgctggtggggttcagttacaaactgtaaatttaaaacaattcgagccaattccttctcaa

SEQ ID NO: 65820 - DNA, 75 bp, Artificial Sequence
  Synthetic
ttcagttacaaactgtaaatttaaaacaattcgagccaattccttctcaaattctcaaaattcggtatagccaat

SEQ ID NO: 65821 - DNA, 75 bp, Artificial Sequence
  Synthetic
acaataatagtgccatacataaacgcactgccctttgattctgccttgaaccactgtaactttggcctgttagtt

SEQ ID NO: 65822 - DNA, 75 bp, Artificial Sequence
  Synthetic
gcaatagctgacaaataccactctagtgtgtactcacttccgccagatccagatcactttgatggttacaaacag

SEQ ID NO: 65823 - DNA, 75 bp, Artificial Sequence
  Synthetic
atgggaaggaatttacagacccatatgttttggatgcagggataccactgagccaagcattgatcttcccacatc

SEQ ID NO: 65824 - DNA, 75 bp, Artificial Sequence
  Synthetic
gcaaatttcaaacgctgcagcccactagtgtgtgggaaagccatccaacttagagacagaaagtctaaggtcagg

SEQ ID NO: 65825 - DNA, 75 bp, Artificial Sequence
  Synthetic
aagcagagggagcgcacatgatcttgtgtacttcgtgcgtctttagtccaacgaatagactcgtgaatctccctc

SEQ ID NO: 65826 - DNA, 75 bp, Artificial Sequence
  Synthetic
gtgtacttcgtgcgtctttagtccaacgaatagactcgtgaatctccctcattggcatcgtggggtgaatgagaa

SEQ ID NO: 65827 - DNA, 75 bp, Artificial Sequence
  Synthetic
aattgaaaggttgttaccatatagctattggattggccatccggtgactaacagagctttgatttatcaattcat

SEQ ID NO: 65828 - DNA, 75 bp, Artificial Sequence
  Synthetic
gcacagcaacagtgcagggcccgagccttgactttgctctctccctactgagaaggaacatcaggcaagtccaaa

SEQ ID NO: 65829 - DNA, 75 bp, Artificial Sequence
  Synthetic
ggtagtggtgcctgtggcacccctcaagtatagtgccggcgccaccactgagatcccaatcactattacaatagc

SEQ ID NO: 65830 - DNA, 75 bp, Artificial Sequence
  Synthetic
aaaaacagagcgcctcttggcttaagaagttcaacgatatggccaacgctgctaagggattggaatggatctcca

SEQ ID NO: 65831 - DNA, 75 bp, Artificial Sequence
  Synthetic
gcgacttatcggcaggagtcatggttaaaccatactccttgcctgttttcgccaattccagacaatcaattggga

SEQ ID NO: 65832 - DNA, 75 bp, Artificial Sequence
  Synthetic
ccccttaaattcagaattcagcggtctcaggcaagccgtgaagcaaggtatccctgttgagatgaaacccggaac

SEQ ID NO: 65833 - DNA, 75 bp, Artificial Sequence
  Synthetic
gcgcaattttcaactcagcgctcaggttctcacgagacgagcaatatagctcgtgatggatcaaccattaacttc

SEQ ID NO: 65834 - DNA, 75 bp, Artificial Sequence
  Synthetic
tatgccaggtggagaccattttggaggtcaacaatgtacccacgaatgccactagcttgatggagagactgcgct

SEQ ID NO: 65835 - DNA, 75 bp, Artificial Sequence
  Synthetic
tcgtgatggatcaaccattaacttcacgaacatcaactactataaggactcttatgcggcctcagcagctaagca

SEQ ID NO: 65836 - DNA, 75 bp, Artificial Sequence
  Synthetic
actctggtatcacggtacctttgttcgcctattttaaaacccccccccccgtaacttagaagaatgaacaaaaca

SEQ ID NO: 65837 - DNA, 75 bp, Artificial Sequence
  Synthetic
taaaccatactccttgcctgttttcgccaattccagacaatcaattgggaaggggtaactagccaacacatcatc

SEQ ID NO: 65838 - DNA, 75 bp, Artificial Sequence
  Synthetic
catccctggggaagttagtagtatacttgaattatgtcaagtggaaactatacttgaagtgaataatgtgactga

SEQ ID NO: 65839 - DNA, 75 bp, Artificial Sequence
  Synthetic
gttattgatcatcgagttgaaaatggaggtgcctgaacaacctgagggcattcccccaagaacacaataagttgt

SEQ ID NO: 65840 - DNA, 75 bp, Artificial Sequence
  Synthetic
tacgcgaggcagtgccaccgttacagtcaccgagtgctgaggcatgtggttacagtgacagagtggcgcagttga

SEQ ID NO: 65841 - DNA, 75 bp, Artificial Sequence
  Synthetic
gtcaccgagtgctgaggcatgtggttacagtgacagagtggcgcagttgacagttggcaactcgactatcactac

SEQ ID NO: 65842 - DNA, 75 bp, Artificial Sequence
  Synthetic
ccgttatccggtatggtactgcgagaagtctagtaccgtcatgaaagttgctaagcgttacgctccccagtaacc

SEQ ID NO: 65843 - DNA, 75 bp, Artificial Sequence
  Synthetic
gaccctcaacacagttaaacatgggctcacaagtgtccactcaacggtccggctcccatgagaattccaactcag

SEQ ID NO: 65844 - DNA, 75 bp, Artificial Sequence
  Synthetic
cttgaattatgtcaagtggaaactatacttgaagtgaataatgtgactgatgtgcaaggcgtaagccggttgctt

SEQ ID NO: 65845 - DNA, 75 bp, Artificial Sequence
  Synthetic
cacactgggctaagactagcgtcatatcctgagtagtcgaacgcaaaaagcgatcctggaagtagaattggtaac

SEQ ID NO: 65846 - DNA, 75 bp, Artificial Sequence
  Synthetic
gaggtgcctgaacaacctgagggcattcccccaagaacacaataagttgtgttgcggtacacatggtgggtgtga

SEQ ID NO: 65847 - DNA, 75 bp, Artificial Sequence
  Synthetic
cgacaaaccaacccgcccagatgtgtcagtgaacagattctacaccatgccagcaaccttgtgggagacagaatc

SEQ ID NO: 65848 - DNA, 75 bp, Artificial Sequence
  Synthetic
tttacaggctcattcatggcaacaggtaagatgcttatagcatacacccctccaggcagtgcacaacccacaaca

SEQ ID NO: 65849 - DNA, 75 bp, Artificial Sequence
  Synthetic
ttaaatacagacatggtgagaagaacctattgcgctaccatatagtcctccggcccctgaatgcggctaatccca

SEQ ID NO: 65850 - DNA, 75 bp, Artificial Sequence
  Synthetic
atcctgagtagtcgaacgcaaaaagcgatcctggaagtagaattggtaacttactccagaacacatctgggttgc

SEQ ID NO: 65851 - DNA, 75 bp, Artificial Sequence
  Synthetic
ccagagatgccatgggcggtatgaaatccactgtggagaccatctggcaaaatagtgacatgtctttcccgtctg

SEQ ID NO: 65852 - DNA, 75 bp, Artificial Sequence
  Synthetic
agtacactgaatcatttagactgctcgcttctatgagacgagactttcctttcttgatcttgtcgattgccctaa

SEQ ID NO: 65853 - DNA, 75 bp, Artificial Sequence
  Synthetic
cttgtatagatcagggttttgcattcacgtacagtgtaatgccagtaagttccatcaaggggctttgcttgtagc

SEQ ID NO: 65854 - DNA, 75 bp, Artificial Sequence
  Synthetic
cacgtacagtgtaatgccagtaagttccatcaaggggctttgcttgtagcggtaattcctgagtttgttgtggct

SEQ ID NO: 65855 - DNA, 75 bp, Artificial Sequence
  Synthetic
tggataagtaacacacactttagaactgtgaaaacagggggatacttagattattatgctacaggtgtggttacc

SEQ ID NO: 65856 - DNA, 75 bp, Artificial Sequence
  Synthetic
ttttgatggctgtttatggtgacaatttagagtattcagattgtcatcataaactactaggtcttgccaaccggt

SEQ ID NO: 65857 - DNA, 75 bp, Artificial Sequence
  Synthetic
ctgtgaaaacagggggatacttagattattatgctacaggtgtggttaccatatggtaccagacaaacttcgtag

SEQ ID NO: 65858 - DNA, 75 bp, Artificial Sequence
  Synthetic
cgcttctatgagacgagactttcctttcttgatcttgtcgattgccctaagttcatctttaacataagtagagta

SEQ ID NO: 65859 - DNA, 75 bp, Artificial Sequence
  Synthetic
ccttttcttgatgcctagtgcactgtatgggtatcccgcacttgtatggagatctatagcttccaggttctctgt

SEQ ID NO: 65860 - DNA, 75 bp, Artificial Sequence
  Synthetic
aaggcgttcagacacccttacgttcttgattgtggcgtgccattaagccaagcccttgtcttcccccaccagtgg

SEQ ID NO: 65861 - DNA, 75 bp, Artificial Sequence
  Synthetic
ccgattggacactggtaaggttccagcactccaagctgctgaaattggagcatcatcaaatgctagtgatgagag

SEQ ID NO: 65862 - DNA, 75 bp, Artificial Sequence
  Synthetic
gcacaagtttctacacaacaatctggaactcatgaaaacactaatgttgcaacaggaggatcagccatacactac

SEQ ID NO: 65863 - DNA, 75 bp, Artificial Sequence
  Synthetic
ggcaggttcagacagatcaagggcacttcaccatgttgggcgtcagggatcgcttagcagttctcccgcgccact

SEQ ID NO: 65864 - DNA, 75 bp, Artificial Sequence
  Synthetic
tatgggtatcccgcacttgtatggagatctatagcttccaggttctctgtaccgtaacaagcatcctccatactc

SEQ ID NO: 65865 - DNA, 75 bp, Artificial Sequence
  Synthetic
gaactcatgaaaacactaatgttgcaacaggaggatcagccatacactacaccaccatcaactactacaaagact

SEQ ID NO: 65866 - DNA, 75 bp, Artificial Sequence
  Synthetic
aaccattccaatttctcactggcagtgataccggtttgcccattgaaatataacacgggtgctaccccctcaata

SEQ ID NO: 65867 - DNA, 75 bp, Artificial Sequence
  Synthetic
ggctcatgaagtgtgtttcccacgtatttagagaaaagagcctgctcaaagtcaacttccaatctcgggtctttg

SEQ ID NO: 65868 - DNA, 75 bp, Artificial Sequence
  Synthetic
gaggagaagcccgcacctgatgctattagtgacctgttagctagtgtcgatagtgaagaggttcgccaatactgt

SEQ ID NO: 65869 - DNA, 75 bp, Artificial Sequence
  Synthetic
tgataccggtttgcccattgaaatataacacgggtgctaccccctcaatacccatcacgattacagttgcaccct

SEQ ID NO: 65870 - DNA, 75 bp, Artificial Sequence
  Synthetic
agcttaatggagagactgcgcttcccggtctcagcccaggccggaaaaggtgagttatgtgcagtgttcagagct

SEQ ID NO: 65871 - DNA, 75 bp, Artificial Sequence
  Synthetic
taaaagagggcgtgccagtcctgaaatcaccatcggctgaggcatgtggatacagtgatagattagctcaattga

SEQ ID NO: 65872 - DNA, 75 bp, Artificial Sequence
  Synthetic
acccatattgaacatttcttctctaggtcaggactagtgggtgttatggaggtggatgatacaggcactgctgga

SEQ ID NO: 65873 - DNA, 75 bp, Artificial Sequence
  Synthetic
aattcttaacaactgatgacgggacctcagcaccaatactacccggcttccaccccacaccaaccatacacatcc

SEQ ID NO: 65874 - DNA, 75 bp, Artificial Sequence
  Synthetic
tctctttgttgggtttcatccattggatctcaccttgttcactgcaaaagtatcccctcttcagggcggcacaga

SEQ ID NO: 65875 - DNA, 75 bp, Artificial Sequence
  Synthetic
ctcagcaccaatactacccggcttccaccccacaccaaccatacacatccccggtgaagtccatagcctgctaga

SEQ ID NO: 65876 - DNA, 75 bp, Artificial Sequence
  Synthetic
ggataagccaacaagaccagatgtatcagttaatagattttacaccctgtccgccaagttgtggcaaaagaattc

SEQ ID NO: 65877 - DNA, 75 bp, Artificial Sequence
  Synthetic
tatcccctcttcagggcggcacagaaaccttgcctaccgttgccaccaatgtggatcccgattaccttgcccaca

SEQ ID NO: 65878 - DNA, 75 bp, Artificial Sequence
  Synthetic
atcaccatcggctgaggcatgtggatacagtgatagattagctcaattgacagtggggaattcaacaatcaccac

SEQ ID NO: 65879 - DNA, 75 bp, Artificial Sequence
  Synthetic
tcagttaatagattttacaccctgtccgccaagttgtggcaaaagaattcaaatggttggtactggaaattccct

SEQ ID NO: 65880 - DNA, 75 bp, Artificial Sequence
  Synthetic
tgtgtctgcacagagcgccgtggacaccctgtgcgcagcttttagagtggaccccggtagggacggcccctggca

SEQ ID NO: 65881 - DNA, 75 bp, Artificial Sequence
  Synthetic
ctaagattcaaaaatccatactggaccacgtctccaactggcacaaacatactgggcatatgttcagtatttata

SEQ ID NO: 65882 - DNA, 75 bp, Artificial Sequence
  Synthetic
catgtacagtgtaatgctagtaaattccaccaaggaaccctactagtagctgccctaccagaatatgtgaatgca

SEQ ID NO: 65883 - DNA, 75 bp, Artificial Sequence
  Synthetic
cgccagtcacaccgtgatcaagcacttctgttaccccggtctgagtaccaataagctgctaacgcggctgaaggg

SEQ ID NO: 65884 - DNA, 75 bp, Artificial Sequence
  Synthetic
ggtcttacacagcaaagaccctcgcctcgaggtagattttgagcaggcattgttctctaagtatgtgggaaacac

SEQ ID NO: 65885 - DNA, 75 bp, Artificial Sequence
  Synthetic
ccctgaagattacattcatgttcactggttcattcatggccactgggaagatgctggttgcctacacaccaccag

SEQ ID NO: 65886 - DNA, 75 bp, Artificial Sequence
  Synthetic
gtcaccagctagtacctaccaatggttctatgatggttatcccacttttgggcctcactcagagacatctaacct

SEQ ID NO: 65887 - DNA, 75 bp, Artificial Sequence
  Synthetic
ccacgtctccaactggcacaaacatactgggcatatgttcagtatttataactaaagtggcatcactagcaggac

SEQ ID NO: 65888 - DNA, 75 bp, Artificial Sequence
  Synthetic
ggttaaccccttgttcatctactagctccacggcatctacgatctttactaacttgtgttcaacccagatggttt

SEQ ID NO: 65889 - DNA, 75 bp, Artificial Sequence
  Synthetic
tggatgctggtatcccattgagccaattgaccattgcacctcaccaatggattaaccttaggacaaacaattgtg

SEQ ID NO: 65890 - DNA, 75 bp, Artificial Sequence
  Synthetic
ggatgccagtgatatcctgcagacaggcactattcagggagatagggtggcagatgtgattgagagttctatagg

SEQ ID NO: 65891 - DNA, 75 bp, Artificial Sequence
  Synthetic
cggttacacttgtggtcccatggataagcaacactcactatagggctgtggagactgggggtgtgtttgattact

SEQ ID NO: 65892 - DNA, 75 bp, Artificial Sequence
  Synthetic
caactcaatgattaacaacattatcatcagagcactgctcattaaaacatttaagggaattgatttggatgaact

SEQ ID NO: 65893 - DNA, 75 bp, Artificial Sequence
  Synthetic
cggcttaagagagtgagggcatgggtccctaggcccttgagatcgcaaccatacatctacagaaattaccctact

SEQ ID NO: 65894 - DNA, 75 bp, Artificial Sequence
  Synthetic
gaagtttcagattcgcatttatttgcggcttaagagagtgagggcatgggtccctaggcccttgagatcgcaacc

SEQ ID NO: 65895 - DNA, 75 bp, Artificial Sequence
  Synthetic
gtaccagactaattttgtagtacctcctgacacccctaccagtgcttacatcctagcatttggggccggccaaaa

SEQ ID NO: 65896 - DNA, 75 bp, Artificial Sequence
  Synthetic
aagtagagatagggcgaagtccaaactcggcccctgcacagttgccgtgcgcagcactggtttcttgagtgtttg

SEQ ID NO: 65897 - DNA, 75 bp, Artificial Sequence
  Synthetic
gggccacagcaatgttgggtacacacgtcatctgggatttcgggttacaatcatctgttacccttgtgataccat

SEQ ID NO: 65898 - DNA, 75 bp, Artificial Sequence
  Synthetic
aactgactacaacgctgagcaacgcacgcacgggaaattcggtcaacaatctggagctgtttatgtaggaaattt

SEQ ID NO: 65899 - DNA, 75 bp, Artificial Sequence
  Synthetic
tatgacaggtgctacaaccgctataccaatcacggtcactatagccccattatgttcagagtttgctgggttgag

SEQ ID NO: 65900 - DNA, 75 bp, Artificial Sequence
  Synthetic
tctacgtagaggctagcgagtactacccagccagataccagtcacatctcatgctcgcacaaggtcactcagaac

SEQ ID NO: 65901 - DNA, 75 bp, Artificial Sequence
  Synthetic
agatgctataaccaacacagtgaatgctacgatagacagggtgttgagtcggccagtgtctcattcaccaacagc

SEQ ID NO: 65902 - DNA, 75 bp, Artificial Sequence
  Synthetic
atcaagacagctccatttaagtggcgctcaacgttggtgggagagtcaggtacaatccatccctggtctctacag

SEQ ID NO: 65903 - DNA, 75 bp, Artificial Sequence
  Synthetic
caagctacacctgaaatgcacattcctggtgaggtcaccaaccttttagagctttgtcaagtggaaagcattctg

SEQ ID NO: 65904 - DNA, 75 bp, Artificial Sequence
  Synthetic
tgctaacacccaagtgagccagcactccattgagactgggcgtgtacctgcactacaagctgctgaaacgggtgc

SEQ ID NO: 65905 - DNA, 75 bp, Artificial Sequence
  Synthetic
agcacaagtctcgacacaaaggacagggtcacacgagactagcaacatcgccacagaaggttccactataaactt

SEQ ID NO: 65906 - DNA, 75 bp, Artificial Sequence
  Synthetic
tattataccacaggactggttagtatatggtatcagacaaactacgtagttccaattggagcacccaacacagct

SEQ ID NO: 65907 - DNA, 75 bp, Artificial Sequence
  Synthetic
acaattgaagaattgttaccatatagctattggattggccatccggtgtgcaacagagcaattatttacctattt

SEQ ID NO: 65908 - DNA, 75 bp, Artificial Sequence
  Synthetic
ctgatagaaacaagatgtgtggttaacaaaaacagtgtggaagaggctagtataaaccacttcttctcccgagca

SEQ ID NO: 65909 - DNA, 75 bp, Artificial Sequence
  Synthetic
ggagcccctggaagagagcttcaatggtgttcccaataacggatctgttgttatactccctgacaagctcactca

SEQ ID NO: 65910 - DNA, 75 bp, Artificial Sequence
  Synthetic
ccctgccaggtatcaatcacacctgatgcttgcggaaggccactctgaaccaggggactgtgggggtatcctcag

SEQ ID NO: 65911 - DNA, 75 bp, Artificial Sequence
  Synthetic
ccacccacagggcccactgggcgctagcactcttattctacggaatatttgtgcgcctgttttatagccctcccc

SEQ ID NO: 65912 - DNA, 75 bp, Artificial Sequence
  Synthetic
atgacacaggtacgaatgccacagggttcaccaactgggatatagatataatggggtatgctcaactgcgtagaa

SEQ ID NO: 65913 - DNA, 75 bp, Artificial Sequence
  Synthetic
ttgcgggaagtggccccaccattgaaatcgccaagtgctgaagcgtgcgggtatagcgatcgtgtggctcaacta

SEQ ID NO: 65914 - DNA, 75 bp, Artificial Sequence
  Synthetic
accctgggagaaacggtccatgggagtccaccataattggccaaatatgcagatattatagccagtggtcaggtt

SEQ ID NO: 65915 - DNA, 75 bp, Artificial Sequence
  Synthetic
aactggagatgttcacctacatgcgcttcaatgctgagttcacgtttgtggctaccaccagagctggacaagtac

SEQ ID NO: 65916 - DNA, 75 bp, Artificial Sequence
  Synthetic
gttctcagaacataacctagctgctctccctgcatcgagcctgcccagttctgtcttataggaatcagttacctc

SEQ ID NO: 65917 - DNA, 75 bp, Artificial Sequence
  Synthetic
gagcaaggggtgtccgattacataaagggacttggggacgctttcggaacaggtttcactgacgcggtctccagg

SEQ ID NO: 65918 - DNA, 75 bp, Artificial Sequence
  Synthetic
tattgacctggatgaactcaacatggttgcttatggggacgatgtacttgctagttacccttttcccattgactg

SEQ ID NO: 65919 - DNA, 75 bp, Artificial Sequence
  Synthetic
cttcaatgctgagttcacgtttgtggctaccaccagagctggacaagtaccatctagagtgctccagtatatgta

SEQ ID NO: 65920 - DNA, 75 bp, Artificial Sequence
  Synthetic
tggataaacccactcgtccggatgtgtcagtaaaccgcttctacaccttatcagcaaagatgtgggataaaaatt

SEQ ID NO: 65921 - DNA, 75 bp, Artificial Sequence
  Synthetic
gagtatggtttgaccatgacccctgcagataagtctccttgcttcaatgaagttaattgggaaaatgcaaccttt

SEQ ID NO: 65922 - DNA, 75 bp, Artificial Sequence
  Synthetic
cagcaaaatgacggaccctccaccacaggtctcagtcccattcatgtcgcctgctagtgcgtaccaatggttcta

SEQ ID NO: 65923 - DNA, 75 bp, Artificial Sequence
  Synthetic
gaggtgaatgagactcccttctcttccagagatgccatgggcggtatgaaatccactgtggagaccatctggcaa

SEQ ID NO: 65924 - DNA, 75 bp, Artificial Sequence
  Synthetic
caggtctcagtcccattcatgtcgcctgctagtgcgtaccaatggttctatgacggataccccacctttggagag

SEQ ID NO: 65925 - DNA, 75 bp, Artificial Sequence
  Synthetic
tactgccatgctagggacacatgttatttgggacttcgggttacaatcgtcagtgactctagttgtgccttggat

SEQ ID NO: 65926 - DNA, 75 bp, Artificial Sequence
  Synthetic
acatgtgcagtgcaatgctagtaagtttcaccaaggtgccctactggtagccgccctaccagaacacgtggtggc

SEQ ID NO: 65927 - DNA, 75 bp, Artificial Sequence
  Synthetic
gaatccattcggtggactaaggatgcacgcaacactcaagatcacgtgcgatccttgtgtctattggcgtggcac

SEQ ID NO: 65928 - DNA, 75 bp, Artificial Sequence
  Synthetic
gaaggggcacccacgtctgcgcacatcattgcactggctgctgcccaacccaattttagtttgaagctggccaaa

SEQ ID NO: 65929 - DNA, 75 bp, Artificial Sequence
  Synthetic
atcagttccaattggaaaagcattggctataccgaattttgagaatctgagaagaaattggctcgaattgtttta

SEQ ID NO: 65930 - DNA, 75 bp, Artificial Sequence
  Synthetic
agtgaagagataactaacgagcgaatcaccatcaggatatatatgaggcttaaacacgtgcgggcttgggtcccg

SEQ ID NO: 65931 - DNA, 75 bp, Artificial Sequence
  Synthetic
aggaatacacactggagtgatacttatctgctatagctctagcaataatccctgttgccaaggactttccagtgc

SEQ ID NO: 65932 - DNA, 75 bp, Artificial Sequence
  Synthetic
tcaccatcaggatatatatgaggcttaaacacgtgcgggcttgggtcccgcgcccactcaggtttgagccttatg

SEQ ID NO: 65933 - DNA, 75 bp, Artificial Sequence
  Synthetic
ctggactgtggtgtccccattagccagttattggtctgcccgcaccaatggattaatttgcggactaataactgt

SEQ ID NO: 65934 - DNA, 75 bp, Artificial Sequence
  Synthetic
ctcacatgcttgaaactggcaacaccccagcactacaagctgcagagaccggtgctacgtccacagcaagtgatg

SEQ ID NO: 65935 - DNA, 75 bp, Artificial Sequence
  Synthetic
ggagaaggttgagttcctaaacaacttgaaacagttgcctttactagagaaccaaatctcaaacctagagcaatc

SEQ ID NO: 65936 - DNA, 75 bp, Artificial Sequence
  Synthetic
agtttggtcagcaatcgggtgctatttacgtggggaattttagagtggtgaatcgtcatcttgccactcacaacg

SEQ ID NO: 65937 - DNA, 75 bp, Artificial Sequence
  Synthetic
cgcttccgtggcatagaggggttggaatttgcggcagaagtgggccagataagacacgttgccaaacatcgcttc

SEQ ID NO: 65938 - DNA, 75 bp, Artificial Sequence
  Synthetic
ttacgtggggaattttagagtggtgaatcgtcatcttgccactcacaacgattgggcgaaccttgtttgggaaga

SEQ ID NO: 65939 - DNA, 75 bp, Artificial Sequence
  Synthetic
attgttgacatcagaaactacagcaaatgggttcacaaattgggacatagatataatgggttacatacaacaaag

SEQ ID NO: 65940 - DNA, 75 bp, Artificial Sequence
  Synthetic
aacatgggagctcaagtatcaacacagcggacgggttcacacgagaccaccaacaccgtccgtgatgggtccacc

SEQ ID NO: 65941 - DNA, 75 bp, Artificial Sequence
  Synthetic
acgacacaggagccacgacagccattcccatcactattacggtcgctcctttgtgtgcggaattcgggggcttga

SEQ ID NO: 65942 - DNA, 75 bp, Artificial Sequence
  Synthetic
agcggacgggttcacacgagaccaccaacaccgtccgtgatgggtccaccctgaacttcaccaacattaactatt

SEQ ID NO: 65943 - DNA, 75 bp, Artificial Sequence
  Synthetic
aggagtgtactactgtaactcccgaaggaagcactacccagttagtttttcaaagcccagccttgtcttcgtgga

SEQ ID NO: 65944 - DNA, 75 bp, Artificial Sequence
  Synthetic
gcagccggaacaattttctccttgagccactcgataaatttgctgattttgttagatatccactcaagcccctta

SEQ ID NO: 65945 - DNA, 75 bp, Artificial Sequence
  Synthetic
caaagcccagccttgtcttcgtggaggccagtgaatactaccctgctaggtaccaatcccatctcatgcttgcag

SEQ ID NO: 65946 - DNA, 75 bp, Artificial Sequence
  Synthetic
atgtatgtaccacctggttcaaaagtacctacagctcgtgactcatttgtatggcaaactgcaacaaacccatct

SEQ ID NO: 65947 - DNA, 75 bp, Artificial Sequence
  Synthetic
tggacatactcacagaagcagcagccccccttcaatcgcctactgccgaagcgtgtggttatagcgatagagtgg

SEQ ID NO: 65948 - DNA, 75 bp, Artificial Sequence
  Synthetic
caccagatcctgatcactttgatggctacaagcagcaagtggtcactgtcatggatgacctatgtcaaaaccctg

SEQ ID NO: 65949 - DNA, 75 bp, Artificial Sequence
  Synthetic
taatgcaacacccatgatccacattcctggggaggtgaccaacctgcttgagttatgtcagatagaaaccatatt

SEQ ID NO: 65950 - DNA, 75 bp, Artificial Sequence
  Synthetic
ggtgttgttggaattgtgtctactgggggcaacggacttgttggctttgcagatgtcagagaccttctgtggcta

SEQ ID NO: 65951 - DNA, 75 bp, Artificial Sequence
  Synthetic
cccagggactcccgtggcacccgattaaggcaagtgtcgctgtcaatgtgaccatgtcataatcactcctgatga

SEQ ID NO: 65952 - DNA, 75 bp, Artificial Sequence
  Synthetic
ccaaatggtgtccactgtcgacttcatcccaccaatggcttccctcgaggagaaaggggtctctttcacatccaa

SEQ ID NO: 65953 - DNA, 75 bp, Artificial Sequence
  Synthetic
ggggcaacggacttgttggctttgcagatgtcagagaccttctgtggctagatgaagaagcaatggagcaggggg

SEQ ID NO: 65954 - DNA, 75 bp, Artificial Sequence
  Synthetic
tactgcagttgataaacctacaagaccagatgtgtcagtaaatagattctacactttagatactaaagattggga

SEQ ID NO: 65955 - DNA, 75 bp, Artificial Sequence
  Synthetic
tcattggaagtcaccttcatgtttactggatccttcatggctaccggtaagatgctcatagcctatacaccacca

SEQ ID NO: 65956 - DNA, 75 bp, Artificial Sequence
  Synthetic
gacccggggagagatggaccgtgggaatcaactaccgttgggcagatatgccgttactatacccagtggtctggg

SEQ ID NO: 65957 - DNA, 75 bp, Artificial Sequence
  Synthetic
ctctcaagaattatcttattggatctgaaggagccgttgaaaagatccttaagaacttaatcaaattgatctctg

SEQ ID NO: 65958 - DNA, 75 bp, Artificial Sequence
  Synthetic
tgacaccgcttctgtaaaccccatgccaaaagcgtctccaagccctttgatgtaatcagacacgccctgctccat

SEQ ID NO: 65959 - DNA, 75 bp, Artificial Sequence
  Synthetic
gcagtcaccccgcttctacagatggatggtatgggatctgtccaaacaacctgatgggtactttctgtttgagag

SEQ ID NO: 65960 - DNA, 75 bp, Artificial Sequence
  Synthetic
atacatgctgaagaactaccccaattttgatgggaataacatcaaacatgtcacaaatagaaatagcataaaaac

SEQ ID NO: 65961 - DNA, 75 bp, Artificial Sequence
  Synthetic
ttttgcattcacgtgcaatgcaatgctagtaaatttcaccaaggcgcacttctcgtggccatagtgccggagtat

SEQ ID NO: 65962 - DNA, 75 bp, Artificial Sequence
  Synthetic
actctagctttgattgggtgtcacggtagcccctgggcatggatcaaagcaaagacagcatctattctgggcatc

SEQ ID NO: 65963 - DNA, 75 bp, Artificial Sequence
  Synthetic
atatcgccatgttagggactcacgttatttgggattttggtctacagtcttctgtcacactggttattccatgga

SEQ ID NO: 65964 - DNA, 75 bp, Artificial Sequence
  Synthetic
gcaacggactcgttggttttgctgatgtgagggatctcttatggttagatgaagaagccatggagcaaggtgtct

SEQ ID NO: 65965 - DNA, 75 bp, Artificial Sequence
  Synthetic
agaataccgccgcaatcccctggttccgagtgacccactgcaagcatgaggtgcgactggtatctagccgggtaa

SEQ ID NO: 65966 - DNA, 75 bp, Artificial Sequence
  Synthetic
tggagatcatatgaaagggacttgattgtgtcaaccaccaccgcatcaggttgtgacaacattgcacgatgtaat

SEQ ID NO: 65967 - DNA, 75 bp, Artificial Sequence
  Synthetic
taggtagattggatgctgggcgggccgccaaactatgctctgaaaataacaccgcaaacttcaaacgttgcagcc

SEQ ID NO: 65968 - DNA, 75 bp, Artificial Sequence
  Synthetic
atgtgttggatgctggtatacccattagtcagctattgatatgcccccaccagtggatcaatcttaggaccaaca

SEQ ID NO: 65969 - DNA, 75 bp, Artificial Sequence
  Synthetic
aaatggagcccctactagtgcatatatcatcgccatgggtgcagcacagaagaacttcacactaaaattgtgccg

SEQ ID NO: 65970 - DNA, 75 bp, Artificial Sequence
  Synthetic
ctagtaaatttcaccaaggcgcacttctcgtggccatagtgccggagtatgttactggcacagttgctggtaaca

SEQ ID NO: 65971 - DNA, 75 bp, Artificial Sequence
  Synthetic
attagcgacctcctagctagtgtggatagtgaagaagtgcgccagtactgcagagaccaagggtggataatccca

SEQ ID NO: 65972 - DNA, 75 bp, Artificial Sequence
  Synthetic
aacgagcaatcgtgtcacaaccttgggcagtagtagatgatacaagtaaatcgcgggagctatcctcccaaacaa

SEQ ID NO: 65973 - DNA, 75 bp, Artificial Sequence
  Synthetic
cagacagataccaatcacacgtcctactcggtgttggaccagcagaagccggagattgtggtggcatccttaggt

SEQ ID NO: 65974 - DNA, 75 bp, Artificial Sequence
  Synthetic
caggaagaccttgaagccatgttcgggaatgtgtcgtacctagcccatttctgtcgcaaataccaaccactgtat

SEQ ID NO: 65975 - DNA, 75 bp, Artificial Sequence
  Synthetic
ggcctatgcatcttcagcaaccaccacaataccgataactattacagtggcgccaatgtgctcagaatttgcagg

SEQ ID NO: 65976 - DNA, 75 bp, Artificial Sequence
  Synthetic
acccagacacaccagacagcagctgacactagagttagtacacacaggttaggcacgggggaggtgccagcttta

SEQ ID NO: 65977 - DNA, 75 bp, Artificial Sequence
  Synthetic
tagtcagctattgatatgcccccaccagtggatcaatcttaggaccaacaattgtgccaccctcattgtgcccta

SEQ ID NO: 65978 - DNA, 75 bp, Artificial Sequence
  Synthetic
agggagtctcattcacctccaagtttgtgatcgcctccactaacgccagtaatatcatagtgccaacagtctcgg

SEQ ID NO: 65979 - DNA, 75 bp, Artificial Sequence
  Synthetic
gattgctgtacgactggcgccagttggtttgatggagttgccagcataatttgggttggctttgaatagataatt

SEQ ID NO: 65980 - DNA, 75 bp, Artificial Sequence
  Synthetic
acaaggaatcacagactatgtacaacaactagggagtgcatttggtgctggttttaccaatgaaatagctgaaaa

SEQ ID NO: 65981 - DNA, 75 bp, Artificial Sequence
  Synthetic
catgcagttcaagagcaaacaccgtattgaacctgtatgtctcatcatcagaggctcaccgggcaccgggaagtc

SEQ ID NO: 65982 - DNA, 75 bp, Artificial Sequence
  Synthetic
gggtttcacccaactcaggttatccatataccaggagaagttagaaatcttctcgaattatgtcaagtagagaca

SEQ ID NO: 65983 - DNA, 75 bp, Artificial Sequence
  Synthetic
aatacttcttctctcgctctggtttggcaggaatagtcatcgtggaggatgcaactgccactaataagggttatg

SEQ ID NO: 65984 - DNA, 75 bp, Artificial Sequence
  Synthetic
acaataccgataactattacagtggcgccaatgtgctcagaatttgcaggcctcaggcaggccgtgcaacagggc

SEQ ID NO: 65985 - DNA, 75 bp, Artificial Sequence
  Synthetic
agatcactttgatgggtataaacagcaggtggttacagttatggatgacttatgccagaaccctgacggtaagga

SEQ ID NO: 65986 - DNA, 75 bp, Artificial Sequence
  Synthetic
cgcactgagaacgtacccatcatgttgtttgggcatgccccatattcaaggtctttctcctgcttgtgttcacca

SEQ ID NO: 65987 - DNA, 75 bp, Artificial Sequence
  Synthetic
aggaatagtgatgatattgttacagtgacagcaaccttagcgctgattgggtgctccacaagcccctggcaatgg

SEQ ID NO: 65988 - DNA, 75 bp, Artificial Sequence
  Synthetic
atataccaggagaagttagaaatcttctcgaattatgtcaagtagagacaatgttagaagttaacaacttaaagt

SEQ ID NO: 65989 - DNA, 75 bp, Artificial Sequence
  Synthetic
tcttccgagcagacccgggacttgatggaccatggcagtcaacattattagggcagctgtgcaggtactacacac

SEQ ID NO: 65990 - DNA, 75 bp, Artificial Sequence
  Synthetic
agaacgcaatgggagcaccagcccggtcatgatgcagtacatgttcgtgccccctggcgcccctgttccaacagg

SEQ ID NO: 65991 - DNA, 75 bp, Artificial Sequence
  Synthetic
tggaccatggcagtcaacattattagggcagctgtgcaggtactacacacaatggtccggctcgttgaaactcac

SEQ ID NO: 65992 - DNA, 75 bp, Artificial Sequence
  Synthetic
taaggcaagtgtcgctgtcaatgtgaccatgtcataatcactcctgatgacaatgacgagcgcagaaatgagttt

SEQ ID NO: 65993 - DNA, 75 bp, Artificial Sequence
  Synthetic
aaggattagtggcagtttgccatgcgagagattccctggagtctggcttgggggctccgggtggtacaaacatat

SEQ ID NO: 65994 - DNA, 75 bp, Artificial Sequence
  Synthetic
gaatggaatggttggccaacaaaatatcaaagtttattgactgggttaagtccaaagtggttccacaagtgaaag

SEQ ID NO: 65995 - DNA, 75 bp, Artificial Sequence
  Synthetic
tgtttgggcatgccccatattcaaggtctttctcctgcttgtgttcaccaaatgtgggatacccgtcataaaacc

SEQ ID NO: 65996 - DNA, 75 bp, Artificial Sequence
  Synthetic
agcctctaggatggatgcaatgttgggcactcacatcatatgggactttgggttacaatcctcggtttcattagt

SEQ ID NO: 65997 - DNA, 75 bp, Artificial Sequence
  Synthetic
aaaaccaactcaccgcaccatgatgtacaattttcccacaaaggcaggtcagtgtggaggagtagtcacatcagt

SEQ ID NO: 65998 - DNA, 75 bp, Artificial Sequence
  Synthetic
agtgcataccaatggttctatgatggatatcctacctttggagaaagaccagttacaaccaacatgaattatgga

SEQ ID NO: 65999 - DNA, 75 bp, Artificial Sequence
  Synthetic
ggcactcacatcatatgggactttgggttacaatcctcggtttcattagtcataccttggatcagtaatacacac

SEQ ID NO: 66000 - DNA, 75 bp, Artificial Sequence
  Synthetic
catttgcgcgtaacctgttatgtctatgtcccagtttgcatacccattcgggttggttgtaccttcaagagggag

SEQ ID NO: 66001 - DNA, 75 bp, Artificial Sequence
  Synthetic
gctgcatggaaatgtacagtaccttgcacattactgtaggaaatttgccccattgtacgcagctgaggctaagcg

SEQ ID NO: 66002 - DNA, 75 bp, Artificial Sequence
  Synthetic
gagagattccctggagtctggcttgggggctccgggtggtacaaacatatactggagcaattgcgggacaacttc

SEQ ID NO: 66003 - DNA, 75 bp, Artificial Sequence
  Synthetic
tttgttgtaccagctgagacacccaccacagccaatataatagttctgggagcagctcaacccaacttcactatg

SEQ ID NO: 66004 - DNA, 75 bp, Artificial Sequence
  Synthetic
atgtaagagcgtgggtgcctcgcccaattagaagccagctatatctgcttaaaaattaccccaactttgataaca

SEQ ID NO: 66005 - DNA, 75 bp, Artificial Sequence
  Synthetic
ccacagccaatataatagttctgggagcagctcaacccaacttcactatgcggttgtgcagggatgcagattcat

SEQ ID NO: 66006 - DNA, 75 bp, Artificial Sequence
  Synthetic
tcgtctgtcacccttgtaataccatggatcagcaacactcattatagagcacatgcccgagatggagtgtttgac

SEQ ID NO: 66007 - DNA, 75 bp, Artificial Sequence
  Synthetic
tcatcactagcatttgatgatgctccaatttcagcggcttggagcgctggaactttaccagtgtccaatcgatgg

SEQ ID NO: 66008 - DNA, 75 bp, Artificial Sequence
  Synthetic
ggaaaatctgtggcttccagtttgataggaagatcaattgctgacaaattgaatagctccgtgtactcactgccg

SEQ ID NO: 66009 - DNA, 75 bp, Artificial Sequence
  Synthetic
atgtcccagtttgcatacccattcgggttggttgtaccttcaagagggaggtctatctctccaactaaccctgct

SEQ ID NO: 66010 - DNA, 75 bp, Artificial Sequence
  Synthetic
cgctaacctctcccacccaaattcccacagctgccaacactagtgtgagcaaccaccgaattggccttggggaag

SEQ ID NO: 66011 - DNA, 75 bp, Artificial Sequence
  Synthetic
agtgaaccggcatctcgcaacacacaacgattgggcgaacttgatatgggaagacagtgctagggacctactggt

SEQ ID NO: 66012 - DNA, 75 bp, Artificial Sequence
  Synthetic
actcacagggcccactgggcgctagcacactgatttcccggaatccttgtgcgcctgttttatatcccctccccc

SEQ ID NO: 66013 - DNA, 75 bp, Artificial Sequence
  Synthetic
tggggaacacactccatgagcctgatgagtacatcagagaggcggccctccactatgcaaatcagttgaaacagc

SEQ ID NO: 66014 - DNA, 75 bp, Artificial Sequence
  Synthetic
tatctccctgaatagtgcctgtctgtaggatatcactagcatccttacacaacttcatggtgaaattcttctgag

SEQ ID NO: 66015 - DNA, 75 bp, Artificial Sequence
  Synthetic
aaatggtatccacagtggacttcatacctccaatggcttctctcgaggagaaaggtattctgtacacctcccctt

SEQ ID NO: 66016 - DNA, 75 bp, Artificial Sequence
  Synthetic
cacagctgccaacactagtgtgagcaaccaccgaattggccttggggaagttcctgcattgcaagctgctgagac

SEQ ID NO: 66017 - DNA, 75 bp, Artificial Sequence
  Synthetic
gaccacagtagggcacttcttttcaagagctggattggtgggggtcatcgacctcccgctgcaggggacagccaa

SEQ ID NO: 66018 - DNA, 75 bp, Artificial Sequence
  Synthetic
ttttccaaacccagcctggtgttcgtcgaagccagcgagtactatccagccagatatcagtcacacctcatgtta

SEQ ID NO: 66019 - DNA, 75 bp, Artificial Sequence
  Synthetic
agagctggattggtgggggtcatcgacctcccgctgcaggggacagccaacacagggggctttgcttcatgggat

SEQ ID NO: 66020 - DNA, 75 bp, Artificial Sequence
  Synthetic
taggatatcactagcatccttacacaacttcatggtgaaattcttctgagctgccgccaatgctattatataggc

SEQ ID NO: 66021 - DNA, 75 bp, Artificial Sequence
  Synthetic
aaacacaccatctcgagcgtgcgctctgtagtgagtgttgctgatccatggtatcacaagggtgacagacgattg

SEQ ID NO: 66022 - DNA, 75 bp, Artificial Sequence
  Synthetic
aatggaagattacaaaacagaaactggtaaagtcaacatggctgccgcctgtcaacactgttccaactgtgaccc

SEQ ID NO: 66023 - DNA, 75 bp, Artificial Sequence
  Synthetic
actggagggaatggtctcgtagggtttgctgatgtcagagacctgctgtggcttgatgaggaagctatggagcaa

SEQ ID NO: 66024 - DNA, 75 bp, Artificial Sequence
  Synthetic
actttcatagcttccactccagatggtgaggtgaaaccattgttcttgcaatacatgtttgtcccacctggcgcg

SEQ ID NO: 66025 - DNA, 75 bp, Artificial Sequence
  Synthetic
gtgaggtgaaaccattgttcttgcaatacatgtttgtcccacctggcgcgccaaagccaacagggcgcaacactt

SEQ ID NO: 66026 - DNA, 75 bp, Artificial Sequence
  Synthetic
ccaaaagcgtctccaagccctttgatgtaatcagacacgccctgctccatagcttcatcatccaaccacagaagg

SEQ ID NO: 66027 - DNA, 75 bp, Artificial Sequence
  Synthetic
ctgtagtgagtgttgctgatccatggtatcacaagggtgacagacgattgcagcccaaagtcccagatgacgtgc

SEQ ID NO: 66028 - DNA, 75 bp, Artificial Sequence
  Synthetic
gtagccataaaggacccagtaaacatgaaggtaacttccagtgaccctgaccattgggtgtagtacccacataat

SEQ ID NO: 66029 - DNA, 75 bp, Artificial Sequence
  Synthetic
gaaatgtttagagagtactcacacagaaattcaattggcaacgtcttggaggcactatttcaaggacctcctata

SEQ ID NO: 66030 - DNA, 75 bp, Artificial Sequence
  Synthetic
tgaaggtaacttccagtgaccctgaccattgggtgtagtacccacataattggcccaacaaggtggactgccatg

SEQ ID NO: 66031 - DNA, 75 bp, Artificial Sequence
  Synthetic
tcatgtctccagccagtgcataccagtggttttacgatggttatccaacctttgggaaacatctccctgctgatg

SEQ ID NO: 66032 - DNA, 75 bp, Artificial Sequence
  Synthetic
gtggttttacgatggttatccaacctttgggaaacatctccctgctgatgacttccagtatgggatgacgccaaa

SEQ ID NO: 66033 - DNA, 75 bp, Artificial Sequence
  Synthetic
caattgaaagattgttaccatatagctattggattggccatccggtgaataacagagccttgatatacctttttg

SEQ ID NO: 66034 - DNA, 75 bp, Artificial Sequence
  Synthetic
gaaattcaattggcaacgtcttggaggcactatttcaaggacctcctatattcaaagatatcaagatatcggtag

SEQ ID NO: 66035 - DNA, 75 bp, Artificial Sequence
  Synthetic
gcagtctctccattaagctagtggcatttgtgggcacattgttgacttctaagatggtctccacctggcatagct

SEQ ID NO: 66036 - DNA, 75 bp, Artificial Sequence
  Synthetic
catgggagtccatgggcatggatcaagtcgaagacagcttccatcctaggtattcccatggcgcagaaacagagc

SEQ ID NO: 66037 - DNA, 75 bp, Artificial Sequence
  Synthetic
tgatgggcacattctcagtgcggactgtagggacctccaagtccaagtaccctttagtggttaggatttacatga

SEQ ID NO: 66038 - DNA, 75 bp, Artificial Sequence
  Synthetic
catgcgaatgaaacacgtgcgagtgtggatcccgcgaccgatgcgcagtcaaccatatgtcgcaaagaactatcc

SEQ ID NO: 66039 - DNA, 75 bp, Artificial Sequence
  Synthetic
tgcacaagtttcagcacaaaagtccgggacacacgagacaggaaatatagcgaccgaagggtccactattaactt

SEQ ID NO: 66040 - DNA, 75 bp, Artificial Sequence
  Synthetic
gagcaaacaccgaattgaacctgtatgtctcattattaggggctcaccaggcactgggaagtctctggccactgg

SEQ ID NO: 66041 - DNA, 75 bp, Artificial Sequence
  Synthetic
gcacccataaaggctggatagttccggtgcaagtcactgacatagaaaaacacctgaatagggccatgacaatcc

SEQ ID NO: 66042 - DNA, 75 bp, Artificial Sequence
  Synthetic
gtttgtaccaggttttagctcagtgggaaacccttgcgtaactgcttgtctaaggccggcaaactcagagcacat

SEQ ID NO: 66043 - DNA, 75 bp, Artificial Sequence
  Synthetic
ctcgagcccagcgtgttccatgacgtctttaagggcaacaaagagccagcagtcttacacagtaaagacccccgc

SEQ ID NO: 66044 - DNA, 75 bp, Artificial Sequence
  Synthetic
agattattccagccgccaaggagaaagtcgagttcctcaacaacctaaaacagctccccttgttagagaaccaga

SEQ ID NO: 66045 - DNA, 75 bp, Artificial Sequence
  Synthetic
agctatagggtggtgaatagacaccttgccacccacaatgactgggctaacttagtgtgggaagacagttcaagg

SEQ ID NO: 66046 - DNA, 75 bp, Artificial Sequence
  Synthetic
agctatagggtggtgaatagactccttgccacccacaatgactgggctaacttagtgtgggaagacagttcaagg

SEQ ID NO: 66047 - DNA, 75 bp, Artificial Sequence
  Synthetic
agctatagggtggtgaatagaccccttgccacccacaatgactgggctaacttagtgtgggaagacagttcaagg

SEQ ID NO: 66048 - DNA, 75 bp, Artificial Sequence
  Synthetic
agctatagggtggtgaatagacgccttgccacccacaatgactgggctaacttagtgtgggaagacagttcaagg

SEQ ID NO: 66049 - DNA, 75 bp, Artificial Sequence
  Synthetic
ctaaatgattcagtgtacttgagaatgacatttgggcacctttatgaagcttttcacgccaacccaggcacagtc

SEQ ID NO: 66050 - DNA, 75 bp, Artificial Sequence
  Synthetic
attaaggaggctgccgcgccattgcaatctccatccgttgaggcgtgtggctatagtgaccgtgtcgcccagcta

SEQ ID NO: 66051 - DNA, 75 bp, Artificial Sequence
  Synthetic
caaacccaaagtgcctacaattagacaagcaaaggtacaggggccaaattttgaatttgcagtggcaatgatgaa

SEQ ID NO: 66052 - DNA, 75 bp, Artificial Sequence
  Synthetic
aaggcagaatcaaaaggtagcgcgtttatgtacggcactattattgtggcacaattgttggtcctcaaattaatc

SEQ ID NO: 66053 - DNA, 75 bp, Artificial Sequence
  Synthetic
actgtcattgtggatgatgtggaagtgaaagttctcgatgccaaagaactcgtggacaaagatgggacaaatctt

SEQ ID NO: 66054 - DNA, 75 bp, Artificial Sequence
  Synthetic
cttagtgtgggaagacagttcaagggatctcctcgtttcgtccacgactgctcaaggatgtgatgttatcgctcg

SEQ ID NO: 66055 - DNA, 75 bp, Artificial Sequence
  Synthetic
tggataagcccacacggcccgatgtgtcagtgaataggttttacactttatcaaccaagagttggaaaacagagt

SEQ ID NO: 66056 - DNA, 75 bp, Artificial Sequence
  Synthetic
cgtagaagcaatgcgcaacactgatcaatagcaggcgtaacgcgccagttacgtcatgatcaagcatatctgttc

SEQ ID NO: 66057 - DNA, 75 bp, Artificial Sequence
  Synthetic
caccacccagatgagcatggaagaagcgtgctatggcacagacaaccttgaggccattgacctccacaccagcgc

SEQ ID NO: 66058 - DNA, 75 bp, Artificial Sequence
  Synthetic
ccccggactgagtatcaatagactgcttacgcggttgaaggagaaaacgttcgttatccggctaactacttcgag

SEQ ID NO: 66059 - DNA, 75 bp, Artificial Sequence
  Synthetic
tgtatgggggatggctatcttccgtccctgtgccacctgctattgtcccgatgacatactctgggaggacagcga

SEQ ID NO: 66060 - DNA, 75 bp, Artificial Sequence
  Synthetic
tctagtgtttattcactccctcctgacccggatcacttcgacgggtacaagcagcaggtggtcacagttatggat

SEQ ID NO: 66061 - DNA, 75 bp, Artificial Sequence
  Synthetic
tcaatacctccaaattcccaaacatgtacattcctgttggtaaggtggttgagtacggtttcctaaatctaagcg

SEQ ID NO: 66062 - DNA, 75 bp, Artificial Sequence
  Synthetic
gcatgttcaatgtaacgcgagcaaatttcaccaaggggctctcttagtggttgtgattcctgagttcgtggttgc

SEQ ID NO: 66063 - DNA, 75 bp, Artificial Sequence
  Synthetic
tatgaaaaatttgtgagtacaattaggtccgtcccagtaggaaaagcattggcaattcccaattacgaaaatctg

SEQ ID NO: 66064 - DNA, 75 bp, Artificial Sequence
  Synthetic
acctcatgctcgcacaaggacattcagaacccggtgattgtggtggtatcctcaggtgccaacacggtgttgttg

SEQ ID NO: 66065 - DNA, 75 bp, Artificial Sequence
  Synthetic
ccgagtgacccactgcaagcatgaggtgcgactggtatctagccgggtaatactcactggcctctacaaagatca

SEQ ID NO: 66066 - DNA, 75 bp, Artificial Sequence
  Synthetic
cccggtttcagttaacacatccgggaatttccagtaccaccccttggatgatttctcccacagtttagtgtccaa

SEQ ID NO: 66067 - DNA, 75 bp, Artificial Sequence
  Synthetic
tagcaagatgagcatggaggaagcgtgctatggcactgagaacctggaagcaatagacctctgtactagtgccgg

SEQ ID NO: 66068 - DNA, 75 bp, Artificial Sequence
  Synthetic
gagtgtccttcacctccaaattcgtcatcgcatctaccaacgctagtaacatcatagtccccacggtctcagact

SEQ ID NO: 66069 - DNA, 75 bp, Artificial Sequence
  Synthetic
gtcctggatgccgggattccgctcagtcaagcactagttttcccccatcaatggatcaatttgcgcaccaataac

SEQ ID NO: 66070 - DNA, 75 bp, Artificial Sequence
  Synthetic
tgggggtaatggtcaccaagggttcgccgctacattactcagaagttattttactgaagagcagggacaaataga

SEQ ID NO: 66071 - DNA, 75 bp, Artificial Sequence
  Synthetic
aatttccagtaccaccccttggatgatttctcccacagtttagtgtccaatgtgtagaacctattcaccgaaaca

SEQ ID NO: 66072 - DNA, 75 bp, Artificial Sequence
  Synthetic
catcgcatctaccaacgctagtaacatcatagtccccacggtctcagactcagatgcaatccgcaggaggtttta

SEQ ID NO: 66073 - DNA, 75 bp, Artificial Sequence
  Synthetic
atgatgtttgctgcttcttgtgtggtgatggtagagttgccaatagttagttgtgctacccgatcgctgtaaccg

SEQ ID NO: 66074 - DNA, 75 bp, Artificial Sequence
  Synthetic
gctttgttcagagaacaacactgctaatttcaaaaggtgcagcccattagtgtgtggtaaagccatccaattgag

SEQ ID NO: 66075 - DNA, 75 bp, Artificial Sequence
  Synthetic
aaagaacctgctgtcctcaataagaaagaccccagactgaaagtagactttgaggaggccatattttcaaagtat

SEQ ID NO: 66076 - DNA, 75 bp, Artificial Sequence
  Synthetic
aatattgtaatggagctaccacagaggtgccaatcacactgaccattgcaccacttaattcggaattcagcggcc

SEQ ID NO: 66077 - DNA, 75 bp, Artificial Sequence
  Synthetic
tgatggtagagttgccaatagttagttgtgctacccgatcgctgtaaccgcatgcctcagcggatggggatttta

SEQ ID NO: 66078 - DNA, 75 bp, Artificial Sequence
  Synthetic
cgcaattggctcgagttattttagaggctatacacacctcaaccccaccagaaatctggtcgtgaatgtgactgg

SEQ ID NO: 66079 - DNA, 75 bp, Artificial Sequence
  Synthetic
aatttcaaaaggtgcagcccattagtgtgtggtaaagccatccaattgagggacaggaagtccaaagtcaggtat

SEQ ID NO: 66080 - DNA, 75 bp, Artificial Sequence
  Synthetic
tacctgctgtggcggcataggagtctttatagtaattaatggtagtgtaatttatggtggagccctcagtagctg

SEQ ID NO: 66081 - DNA, 75 bp, Artificial Sequence
  Synthetic
ctctttcaagggccccccaagttcagacccataagaattagccttgaagagaagccagcaccagatgccattagt

SEQ ID NO: 66082 - DNA, 75 bp, Artificial Sequence
  Synthetic
acaacttgaaacagttaccgctgttagagaaccaaatctcaaatctggaacaatctgctgcttcacaagaggatc

SEQ ID NO: 66083 - DNA, 75 bp, Artificial Sequence
  Synthetic
ccccaccagtaatctggtcgcgttaatgactggtgggggtaaatttgttataaccagaatagcaaaaaaaaaaaa

SEQ ID NO: 66084 - DNA, 75 bp, Artificial Sequence
  Synthetic
tctagaactagcaagaacaggtaaggaatatggtctaaccatgacccctgctgataaatccccttgcttcaatga

SEQ ID NO: 66085 - DNA, 75 bp, Artificial Sequence
  Synthetic
cttcgaaccaacaccattgattcacatccctggggagttcacttctctactagatctatgccggatagagactat

SEQ ID NO: 66086 - DNA, 75 bp, Artificial Sequence
  Synthetic
gtttggaggacgctgtgtatggcactgaaggattagaggcattggatttaactactagtgcagggtacccatatg

SEQ ID NO: 66087 - DNA, 75 bp, Artificial Sequence
  Synthetic
tcagtgataatggtacaaaaccaacaaataggtagacgattgctctgttgcacaccggatggccaatccaatagc

SEQ ID NO: 66088 - DNA, 75 bp, Artificial Sequence
  Synthetic
ggtgacctatgtcaaggatgagttaagggcaaagaagaaagttgaggctggcaaatccagattgattgaagcttc

SEQ ID NO: 66089 - DNA, 75 bp, Artificial Sequence
  Synthetic
tctcttgtctatgtcatttacaagttgtttgccggattccaaggtgcttactctggagcacccaagcaaacactc

SEQ ID NO: 66090 - DNA, 75 bp, Artificial Sequence
  Synthetic
cccccagtgtagatcaggtcgatgagtcaccgcattccccacgggcgaccgtggcggtggctgcgttggcggcct

SEQ ID NO: 66091 - DNA, 75 bp, Artificial Sequence
  Synthetic
gtggatcctgggcgtaatggcccatggcaatctacaatggttgggcagatctgcagatattacactcaatggtct

SEQ ID NO: 66092 - DNA, 75 bp, Artificial Sequence
  Synthetic
gatttgctcgctagtgttgacagtgaagaggtccggcagtactgcagggaacagggttggataattccagaaaca

SEQ ID NO: 66093 - DNA, 75 bp, Artificial Sequence
  Synthetic
ggcatcattgctcgagcgatagctgataagtatcattccagtgtctattcactcccaccagatccagatcacttt

SEQ ID NO: 66094 - DNA, 75 bp, Artificial Sequence
  Synthetic
gttacgacacaccacccactggtttgtgagcatgtgctccgcagttgggattagccgcattcaggggccggagga

SEQ ID NO: 66095 - DNA, 75 bp, Artificial Sequence
  Synthetic
aatcctgatcaattctggagcaaaattcctgtaatgctggatggggagatttttgcatttgattatacagggtat

SEQ ID NO: 66096 - DNA, 75 bp, Artificial Sequence
  Synthetic
ggcacttcaccatgctaggcgtgcgagaccgcttagcgatcctaccgcgccactcacaaccagggaaaaccatct

SEQ ID NO: 66097 - DNA, 75 bp, Artificial Sequence
  Synthetic
gggaggcagcgatgctcggcacacatatagtgtgggactttggtttgcagtcttcggtgactctggtaataccat

SEQ ID NO: 66098 - DNA, 75 bp, Artificial Sequence
  Synthetic
cactcacaaccagggaaaaccatctgggtagagcacaaattggtcaacgtgctagatgcagttgaattggtggat

SEQ ID NO: 66099 - DNA, 75 bp, Artificial Sequence
  Synthetic
ggcagtagtagatgatacaagtaaatcgcgggagctatcctcccaaacaagatttgcccagtcattatgagtggc

SEQ ID NO: 66100 - DNA, 75 bp, Artificial Sequence
  Synthetic
gtgagcatgtgctccgcagttgggattagccgcattcaggggccggaggactaccagctagctcaataggctctt

SEQ ID NO: 66101 - DNA, 75 bp, Artificial Sequence
  Synthetic
cccatgggggttgcagtgactcatcagcctgatctacactggggttgtgctgaacgaaacactctgcctcgttca

SEQ ID NO: 66102 - DNA, 75 bp, Artificial Sequence
  Synthetic
actcatatcacttatacaaagacaagcactattttgttagagggggcatgccttctggatgttcaggaacatcaa

SEQ ID NO: 66103 - DNA, 75 bp, Artificial Sequence
  Synthetic
agcctgatctacactggggttgtgctgaacgaaacactctgcctcgttcatggtggtactaagcttctcgaagta

SEQ ID NO: 66104 - DNA, 75 bp, Artificial Sequence
  Synthetic
atcccagagacaatcactggagcgagtgatgcaaccctagttatcaacactgagcacatgccctcaatgtttgtg

SEQ ID NO: 66105 - DNA, 75 bp, Artificial Sequence
  Synthetic
tccaccagacaccccttctgaggccaacatcatagctctcggagcggcacaagagaattttaccctcaaactgtg

SEQ ID NO: 66106 - DNA, 75 bp, Artificial Sequence
  Synthetic
gtgatgcaaccctagttatcaacactgagcacatgccctcaatgtttgtgccagtgggtgatgttgtgcagtatg

SEQ ID NO: 66107 - DNA, 75 bp, Artificial Sequence
  Synthetic
agacttgggcagattggatgccggtcgggccgccaagctgtgctctgaaaataacactgccaacttcaaacgctg

SEQ ID NO: 66108 - DNA, 75 bp, Artificial Sequence
  Synthetic
tgcttgatcaagatgtgactggtgcgtcacacccactattgatcgttagttcacagcttctaagttacttcgggg

SEQ ID NO: 66109 - DNA, 75 bp, Artificial Sequence
  Synthetic
tgatgtcatagcctcataccctttcaaaattgatgcaggcctactcgctcaggcgggaaaggagtacggcctaac

SEQ ID NO: 66110 - DNA, 75 bp, Artificial Sequence
  Synthetic
aacatcatagctctcggagcggcacaagagaattttaccctcaaactgtgcaaagacactgacgagattcggcaa

SEQ ID NO: 66111 - DNA, 75 bp, Artificial Sequence
  Synthetic
gaggggtagttacctcagttggcaagatcattgggatccacattggcggaaacggacgccagggcttctgcgccg

SEQ ID NO: 66112 - DNA, 75 bp, Artificial Sequence
  Synthetic
aggttagatatagcgtggacacagtggtgtctgagctcattagggagtacaacaatagatctgccattggaaaca

SEQ ID NO: 66113 - DNA, 75 bp, Artificial Sequence
  Synthetic
tcacgtgttacagcggccaacactgctgctagctcccattcccttggtactggacgcgtgccggcgttgcaggct

SEQ ID NO: 66114 - DNA, 75 bp, Artificial Sequence
  Synthetic
acatggtgcgaagagcctattgagctagttagtagtcctccggcccctgaatgcggctaatcctaactgcggagc

SEQ ID NO: 66115 - DNA, 75 bp, Artificial Sequence
  Synthetic
acgtgcaatgcaacgcaagtaaattccatcaaggggcacttctagttgctgttctcccggagtacgttattggaa

SEQ ID NO: 66116 - DNA, 75 bp, Artificial Sequence
  Synthetic
ctggtgcacccagtgatgccaatgaaagaaattcatgagtccattagatggacaaaggacgcccgatgtacccaa

SEQ ID NO: 66117 - DNA, 75 bp, Artificial Sequence
  Synthetic
aagggaaataaaacaggcgcacaaaggtacctcagtgccagagtgctagcgcccagtaggccctgtgggtgggtg

SEQ ID NO: 66118 - DNA, 75 bp, Artificial Sequence
  Synthetic
tctactcccgtgcagggctagtaggagttgtggaggtgaaagactcaggcactagtcaggacgggtacacggtgt

SEQ ID NO: 66119 - DNA, 75 bp, Artificial Sequence
  Synthetic
tgaacagggagagatccagtgggtgaaacctaacaaagaaaccgggagattaaatatcaatggtccgactcgaac

SEQ ID NO: 66120 - DNA, 75 bp, Artificial Sequence
  Synthetic
ctgctagctcccattcccttggtactggacgcgtgccggcgttgcaggctgcggagacaggggcaagttccaacg

SEQ ID NO: 66121 - DNA, 75 bp, Artificial Sequence
  Synthetic
tgcgtattctggtgctcctaagcaagtgcttaagaaacctgctcttcgcacagcaacagtacagggcccgagcct

SEQ ID NO: 66122 - DNA, 75 bp, Artificial Sequence
  Synthetic
taggctagaggttgattttgagcaagctctgttctctaagtacgtgggcaacactctacacgaacctgatgagta

SEQ ID NO: 66123 - DNA, 75 bp, Artificial Sequence
  Synthetic
tactgctcccagcttattcaacattgagaaggaagtggctggattctttttaaattttatttttggttaattaga

SEQ ID NO: 66124 - DNA, 75 bp, Artificial Sequence
  Synthetic
tagcagttgtctctttggtgtatgttatctacaagctctttgctggattccagggtgcttactctggtgccccta

SEQ ID NO: 66125 - DNA, 75 bp, Artificial Sequence
  Synthetic
tgacagcacaacacccggcatgctattgcagtacatgtacgtgccgccgggtgcgcccaaaccagacggtaggaa

SEQ ID NO: 66126 - DNA, 75 bp, Artificial Sequence
  Synthetic
taaacaccagcaagatgagcatggaggaggcgtgttatggtacagattatttggaagcaatagacctgcatacta

SEQ ID NO: 66127 - DNA, 75 bp, Artificial Sequence
  Synthetic
taaattttatttttggttaattagatacttaattaggctaattggcaaccctactgaacaatctggactggctaa

SEQ ID NO: 66128 - DNA, 75 bp, Artificial Sequence
  Synthetic
agttgtggaggtgaaagactcaggcactagtcaggacgggtacacggtgtggcccatagatgtgatgggctttgt

SEQ ID NO: 66129 - DNA, 75 bp, Artificial Sequence
  Synthetic
ttgcagtacatgtacgtgccgccgggtgcgcccaaaccagacggtaggaagtcatatcaatggcaaacagccacc

SEQ ID NO: 66130 - DNA, 75 bp, Artificial Sequence
  Synthetic
ggtttgatggagttgccagcataatttgggttggctttgaatagataattttggttgcgcattgggcgaggtatc

SEQ ID NO: 66131 - DNA, 75 bp, Artificial Sequence
  Synthetic
gatccagttaccagggacacctccaagatgaagttgtacatggacaagtatggattggatttgccctactccact

SEQ ID NO: 66132 - DNA, 75 bp, Artificial Sequence
  Synthetic
taccagtggttctacgatggttaccccacgtttggcgaacacaagcaagctactaatttacaatacggtcagtgc

SEQ ID NO: 66133 - DNA, 75 bp, Artificial Sequence
  Synthetic
tgccctcaggctgttcaggaacatccatcttcaactcaatgatcaacaacattattatcagagcactgctcataa

SEQ ID NO: 66134 - DNA, 75 bp, Artificial Sequence
  Synthetic
ccacgtttggcgaacacaagcaagctactaatttacaatacggtcagtgccctaacaacatgatggggcattttg

SEQ ID NO: 66135 - DNA, 75 bp, Artificial Sequence
  Synthetic
cttgtgaacgttctggacgctgtcgaactagtggatgaacagggggtcaatttggagctaaccttagtcacccta

SEQ ID NO: 66136 - DNA, 75 bp, Artificial Sequence
  Synthetic
agtgacagactcgtacaaaacagatctaggtagactggatgcagggcgagccgctaaactgtgctctgaaaataa

SEQ ID NO: 66137 - DNA, 75 bp, Artificial Sequence
  Synthetic
aatgactctgtctaccttagaatgacttttggccatctttatgaggtgtttcacgccaacccaggaaccataact

SEQ ID NO: 66138 - DNA, 75 bp, Artificial Sequence
  Synthetic
gagcatgggtgcccagacctttcagatcccaagcttacatggtcaaaaactacccgacatacagccaaacaatat

SEQ ID NO: 66139 - DNA, 75 bp, Artificial Sequence
  Synthetic
atcccaagcttacatggtcaaaaactacccgacatacagccaaacaatatccaatactgcagccgatcgtgcgag

SEQ ID NO: 66140 - DNA, 75 bp, Artificial Sequence
  Synthetic
gcgagttgtgtgcagtgttcagagccgaccctgggcgaaatggaccatggcagtctaccttgttgggccagttgt

SEQ ID NO: 66141 - DNA, 75 bp, Artificial Sequence
  Synthetic
agtggaaagccaactcaccgcactatgatgtacaattttcccactaaggcaggtcagtgtggaggagtggtcaca

SEQ ID NO: 66142 - DNA, 75 bp, Artificial Sequence
  Synthetic
cccagcactacaagctgcagagaccggtgctacgtccacagcaagtgatgaaaacatgattgaaaccaggtgtgt

SEQ ID NO: 66143 - DNA, 75 bp, Artificial Sequence
  Synthetic
tggcgccatctatgtgggtaacttcagagtagtaaacagacacctagccactcataatgactgggccaacttggt

SEQ ID NO: 66144 - DNA, 75 bp, Artificial Sequence
  Synthetic
agatgcttatagcctacacaccaccaggaggccctctgcccaaagaccgagcgaccgccatgctgggcacgcatg

SEQ ID NO: 66145 - DNA, 75 bp, Artificial Sequence
  Synthetic
tctattcagggggatagggtggcagatgtgatcgagagctctataggagatagtgtgagtagagcacttacccag

SEQ ID NO: 66146 - DNA, 75 bp, Artificial Sequence
  Synthetic
tgtgttcttggtgggatgccctctggttgctctggtacttctattttcaattccatgattaacaatataatcatc

SEQ ID NO: 66147 - DNA, 75 bp, Artificial Sequence
  Synthetic
agagtagtaaacagacacctagccactcataatgactgggccaacttggtatgggaagacagctctagagacctt

SEQ ID NO: 66148 - DNA, 75 bp, Artificial Sequence
  Synthetic
ttccatgattaacaatataatcatcagaaccctcttgatcaagacgttcaaaggtatagacttggatgaactgaa

SEQ ID NO: 66149 - DNA, 75 bp, Artificial Sequence
  Synthetic
aactcccgtagaaagcactacccggtcagcttctcaaaacctagcctggtattcgttgaagccagcgagtattac

SEQ ID NO: 66150 - DNA, 75 bp, Artificial Sequence
  Synthetic
gccagtcgcacagcgatcaccactctcgggaaatttgggcaacagtccggggccatttatgtgggtaattttaga

SEQ ID NO: 66151 - DNA, 75 bp, Artificial Sequence
  Synthetic
caaggagtacggattgaccatgactcctgccgataaatcaccctgtttcaatgaagtcacctgggagaatgcaac

SEQ ID NO: 66152 - DNA, 75 bp, Artificial Sequence
  Synthetic
tgccaacacggtgtcgtagggatcgtgtccactggggggaacggccttgtagggtttgccaatgtcagggatctg

SEQ ID NO: 66153 - DNA, 75 bp, Artificial Sequence
  Synthetic
cccttcactatgcgaatcagttgaagcagctagacatagacaccacccagatgagcatggaggaagcgtgctacg

SEQ ID NO: 66154 - DNA, 75 bp, Artificial Sequence
  Synthetic
tgtccactggggggaacggccttgtagggtttgccaatgtcagggatctgctttggcttgatgaggaagctatgg

SEQ ID NO: 66155 - DNA, 75 bp, Artificial Sequence
  Synthetic
ccatgagtctatccgttggaccaaggatgcacgcaatactcaagaccatgtgcgttccctttgcttgttggcatg

SEQ ID NO: 66156 - DNA, 75 bp, Artificial Sequence
  Synthetic
cctccacactagcgcaggttacccctacagtgctctgggaataaaaaagagagatatcctagaccctaccactag

SEQ ID NO: 66157 - DNA, 75 bp, Artificial Sequence
  Synthetic
gtttctcaaaacccggcctaatctacgtagaggctagcgagtattacccagccagatatcagtcacatctcatgc

SEQ ID NO: 66158 - DNA, 75 bp, Artificial Sequence
  Synthetic
aagtggaagcattaaaaaatcacttgatcggttctgagggggctgttgagaagatcttgaagaacctggtgaagc

SEQ ID NO: 66159 - DNA, 75 bp, Artificial Sequence
  Synthetic
ccacaattactccagtatatgtttgttccccctggtgctcccaaaccagaatccagggaatcactcgcttggcag

SEQ ID NO: 66160 - DNA, 75 bp, Artificial Sequence
  Synthetic
agggacaaatcaatttttgaccaccgatgacggcgtctcggcgcccattttaccaaacttccaccccactccgtg

SEQ ID NO: 66161 - DNA, 75 bp, Artificial Sequence
  Synthetic
gatcggttctgagggggctgttgagaagatcttgaagaacctggtgaagctaatctcagccctagtcatagtcat

SEQ ID NO: 66162 - DNA, 75 bp, Artificial Sequence
  Synthetic
gggacacacgagacaggaaatatagcgaccgaagggtccactattaacttcactaacattaactactacaaagat

SEQ ID NO: 66163 - DNA, 75 bp, Artificial Sequence
  Synthetic
cctcagaatggcctttgggcacctctatgaaaccttccatgcaaaccctggaactgtgactggttcagctgtggg

SEQ ID NO: 66164 - DNA, 75 bp, Artificial Sequence
  Synthetic
gatcaaatcaaagacagcctccatcctaggtatccctatggcacaaaagcagagcgcctcatggctaaagaagtt

SEQ ID NO: 66165 - DNA, 75 bp, Artificial Sequence
  Synthetic
ctaggtatccctatggcacaaaagcagagcgcctcatggctaaagaagtttaatgatatggcaaatgctgcaaaa

SEQ ID NO: 66166 - DNA, 75 bp, Artificial Sequence
  Synthetic
aagctaccaatcttgctccctggttccctctttgcctttgactactcaggttatgatgctagtctcagcccagtt

SEQ ID NO: 66167 - DNA, 75 bp, Artificial Sequence
  Synthetic
ttatgatgctagtctcagcccagtttggttcagggcactggagctagtcctcagggagataggctatagtgagga

SEQ ID NO: 66168 - DNA, 75 bp, Artificial Sequence
  Synthetic
gagaaagttgagtttttaaacaacttaaaacaactccccttgttagaaaaccaaatctctaaccttgaacaatct

SEQ ID NO: 66169 - DNA, 75 bp, Artificial Sequence
  Synthetic
actccaagctgctgaaattggagcatcatcaaatgctagtgacgagagcatgattgagacacgctgtgttcttaa

SEQ ID NO: 66170 - DNA, 75 bp, Artificial Sequence
  Synthetic
actcaacatggtcgcttatggagacgatgtgctcgctagctatcccttcccaattgattgcttggaactagcaaa

SEQ ID NO: 66171 - DNA, 75 bp, Artificial Sequence
  Synthetic
cacaggtctcagttccattcatgtcacctgcgagtgcctatcaatggttctatgacggatatcccacgttcggtg

SEQ ID NO: 66172 - DNA, 75 bp, Artificial Sequence
  Synthetic
aatgggttcacaaattgggacatagatataatgggttacatacaacaaaggagaaagttggaaatgttcacctac

SEQ ID NO: 66173 - DNA, 75 bp, Artificial Sequence
  Synthetic
atatggggcatgtccaaacaacatgatgggcacgttctcagtgcggaccgtgggaacctcgaagtccaagtaccc

SEQ ID NO: 66174 - DNA, 75 bp, Artificial Sequence
  Synthetic
gtcgtctaccaccgcccagggctgtgacacaattgcacgttgcgattgtcaaacaggagtgtactattgcaactc

SEQ ID NO: 66175 - DNA, 75 bp, Artificial Sequence
  Synthetic
gcaagaacaggtaaggagtatggtctaaccatgacccctgctgataagtccccttgcttcaatgaagttaattgg

SEQ ID NO: 66176 - DNA, 75 bp, Artificial Sequence
  Synthetic
tgggaagacagctctcgcgatttgctcgtgtcatccaccaccgcccagggttgtgacacaattgcccgctgtaat

SEQ ID NO: 66177 - DNA, 75 bp, Artificial Sequence
  Synthetic
gttggatgaagaagccatggagcaaggcgtgtccgactacatcaaggggctcggcgatgcgttcgggacaggctt

SEQ ID NO: 66178 - DNA, 75 bp, Artificial Sequence
  Synthetic
aatctccatccgttgaggcgtgtggctatagtgaccgtgtcgcccagctaactgttggcaattcgaccattacca

SEQ ID NO: 66179 - DNA, 75 bp, Artificial Sequence
  Synthetic
agagctaatcagagagtacaacaacagatccgctattgggaacaccatagaagcactcttccaagggccccccaa

SEQ ID NO: 66180 - DNA, 75 bp, Artificial Sequence
  Synthetic
acagggtgtgtctgattacattaaagggcttggcgatgcttttggcatggggttcacagacgcagtatcaagaga

SEQ ID NO: 66181 - DNA, 75 bp, Artificial Sequence
  Synthetic
tacctacagctcgtgactcatttgtatggcaaactgcaacaaacccatctatatttgttaagatgagtgatccac

SEQ ID NO: 66182 - DNA, 75 bp, Artificial Sequence
  Synthetic
ttgattcaccctactatgccaatgagggagatccatgagtccattcgatggaccaaggacgcacgaaacactcaa

SEQ ID NO: 66183 - DNA, 75 bp, Artificial Sequence
  Synthetic
gcttattccggagcacccaagcaagcactcaagaagcctgtgctaagaacagctacagtccaaggacctagcttg

SEQ ID NO: 66184 - DNA, 75 bp, Artificial Sequence
  Synthetic
gtacgggaccgcttagctatcctgccacgccactcgcaaccagggaaaaccatctggatagaacacaaattggtc

SEQ ID NO: 66185 - DNA, 75 bp, Artificial Sequence
  Synthetic
gcgcctgttttacaacccccccccaatttgcaacttagaagcaatacacaacactgatcaacagcaggcatggcg

SEQ ID NO: 66186 - DNA, 75 bp, Artificial Sequence
  Synthetic
ttgtaccagtaggtgacgttgtacagtatgggttcttgaatctcagtggtaaacctactcacagaaccatgatgt

SEQ ID NO: 66187 - DNA, 75 bp, Artificial Sequence
  Synthetic
cccaccgggccactgggccgctagcactctggtactgaggtacctttgtgcgcctgtttttactccccttccccc

SEQ ID NO: 66188 - DNA, 75 bp, Artificial Sequence
  Synthetic
gtatgggttcttgaatctcagtggtaaacctactcacagaaccatgatgtacaatttccctacaaaggcaggaca

SEQ ID NO: 66189 - DNA, 75 bp, Artificial Sequence
  Synthetic
gtcagtgaataggttttacactttatcaaccaagagttggaaaacagagtccactggctggtactggaaattccc

SEQ ID NO: 66190 - DNA, 75 bp, Artificial Sequence
  Synthetic
ggggcatcttaaggtgccagcacggtgtagttggtatagtgtccacgggtggcaacgggctcgtcggttttgctg

SEQ ID NO: 66191 - DNA, 75 bp, Artificial Sequence
  Synthetic
cgccggcttaaagaggagctacttcgccagtgaacaaggagaaatccagtggataaaacctaacaaagaaactgg

SEQ ID NO: 66192 - DNA, 75 bp, Artificial Sequence
  Synthetic
tgtcggttttgctaacgtgagggacctcttgtggttggatgaagaagccatggaacagggagtgtctgactatat

SEQ ID NO: 66193 - DNA, 75 bp, Artificial Sequence
  Synthetic
actctgcagcggaaccgactactttgggtgtccgtgtttccttttattcttatattggctgcttatggtgacaat

SEQ ID NO: 66194 - DNA, 75 bp, Artificial Sequence
  Synthetic
gggaaagacatgtcactattttgccagatggtctccacagtggactttataccgcctatggcatctctggaggag

SEQ ID NO: 66195 - DNA, 75 bp, Artificial Sequence
  Synthetic
gccagtgaacaaggagaaatccagtggataaaacctaacaaagaaactgggaggctgaatattaatggtccaact

SEQ ID NO: 66196 - DNA, 75 bp, Artificial Sequence
  Synthetic
atggtatgggatctgtccaaacaacctgatgggtactttctgtttgagagtagtaggatcaggatccatcaaaga

SEQ ID NO: 66197 - DNA, 75 bp, Artificial Sequence
  Synthetic
tatgtgctcggcactatcgcaggagggaccgggaacgagaattctcatcctccctacgccaccacacagcctggc

SEQ ID NO: 66198 - DNA, 75 bp, Artificial Sequence
  Synthetic
gcaagcactctggtacctcggtacctttgtgcgcctgttttataccccccccccagtgaaacttagaagcagcaa

SEQ ID NO: 66199 - DNA, 75 bp, Artificial Sequence
  Synthetic
acaagcaacaggtggttacagtgatggatgatttgtgtcaaaaccccgatggtaaggatatgtctttattctgtc

SEQ ID NO: 66200 - DNA, 75 bp, Artificial Sequence
  Synthetic
ttctcgatccagctaccagagacacttccaagatgaaattatacatggacaagtatggactggatttgccctact

SEQ ID NO: 66201 - DNA, 75 bp, Artificial Sequence
  Synthetic
caatttcagcggcttggagcgctggaactttaccagtgtccaatcgatggctgcttacctgcgtgttttggcctg

SEQ ID NO: 66202 - DNA, 75 bp, Artificial Sequence
  Synthetic
ttgcatttgactactcaggatatgatgcaagccttagtcctgtatggtttagagctctagagttggttctgcggg

SEQ ID NO: 66203 - DNA, 75 bp, Artificial Sequence
  Synthetic
tttcaccaaggggctctcttagtggttgtgattcctgagttcgtggttgctgcgagcagccctgctacgaagccc

SEQ ID NO: 66204 - DNA, 75 bp, Artificial Sequence
  Synthetic
ctcaggttgctctggtacttccattttcaattccatgattaacaacataatcatcagaaccctcttgattaaaac

SEQ ID NO: 66205 - DNA, 75 bp, Artificial Sequence
  Synthetic
ttcaattccatgattaacaacataatcatcagaaccctcttgattaaaacgttcaaaggtatagacttagatgaa

SEQ ID NO: 66206 - DNA, 75 bp, Artificial Sequence
  Synthetic
tttgatgggaataacatcaaacatgtcacaaatagaaatagcataaaaacagcaggtgcttttggccaacaaagt

SEQ ID NO: 66207 - DNA, 75 bp, Artificial Sequence
  Synthetic
gatccatcccaccatgcccatgagggaaatccacgagtccattcgctggaccaaggatgctcgtaatactcagga

SEQ ID NO: 66208 - DNA, 75 bp, Artificial Sequence
  Synthetic
tagattggaggttgactttgaacaagccctattctccaagtatgtaggtaatgtactgcatgaacctgatgaata

SEQ ID NO: 66209 - DNA, 75 bp, Artificial Sequence
  Synthetic
aggttgaacattaatgggcctactcgcaccaagcttgagccaagtgtctttcatgatgtgttcgagggtaccaaa

SEQ ID NO: 66210 - DNA, 75 bp, Artificial Sequence
  Synthetic
ctggatcatccctgaaactcccaccaatgttgaacgacacctcaatagagcagtgctagtcatgcaatccatcgc

SEQ ID NO: 66211 - DNA, 75 bp, Artificial Sequence
  Synthetic
acccaaggttggaagttgattttgagcaggctttgttttcaaagtacgtgggaaacacgctccacgagcccgacg

SEQ ID NO: 66212 - DNA, 75 bp, Artificial Sequence
  Synthetic
gcagcctgaatgattcagtgtacctcagaatgacttttggccatctgtatgaagcattccatgcaaatccaggga

SEQ ID NO: 66213 - DNA, 75 bp, Artificial Sequence
  Synthetic
gtcaagcactagttttcccccatcaatggatcaatttgcgcaccaataactgtgcaaccattatcatgccatatg

SEQ ID NO: 66214 - DNA, 75 bp, Artificial Sequence
  Synthetic
ggttaagcctaataaagaaactggaagattcaacatcaatggaccaacccgcaccaagttagaacctagtgtgtt

SEQ ID NO: 66215 - DNA, 75 bp, Artificial Sequence
  Synthetic
ttgtgtcaaccaccaccgcatcaggttgtgacaacattgcacgatgtaattgtaactcgggtgtgtacttttgta

SEQ ID NO: 66216 - DNA, 75 bp, Artificial Sequence
  Synthetic
ttgcttcaatgaagtgacgtgggaaaacgccacctttctgaagagagggtttctaccagaccatcaattcccatt

SEQ ID NO: 66217 - DNA, 75 bp, Artificial Sequence
  Synthetic
aggagtgactatgacatggtcacattgacggcaacacttgccctgattgggtgccacgggagcccttgggcctgg

SEQ ID NO: 66218 - DNA, 75 bp, Artificial Sequence
  Synthetic
tgaaccttagtggtaaaccaacccataggaccatgatgtacaattttcctacaaaagctggacagtgcgggggcg

SEQ ID NO: 66219 - DNA, 75 bp, Artificial Sequence
  Synthetic
ccggatctcatgaaaactccaattcagccacagaaggctccactattaattacaccactattaactactacaaag

SEQ ID NO: 66220 - DNA, 75 bp, Artificial Sequence
  Synthetic
atcaaatgcactagcactagtagagataagataacaacactgggaaagtttgggcagcagcctggtgccatatat

SEQ ID NO: 66221 - DNA, 75 bp, Artificial Sequence
  Synthetic
ttctccaagtatgtgggcaatgtattgcatgaacctgacgagtacgtacatcaagctgctctccactatgcaaac

SEQ ID NO: 66222 - DNA, 75 bp, Artificial Sequence
  Synthetic
gacccctgctgacaaatcaccctgctttaatgaagtcacgtgggagaatgccaccttcctaaagagaggattctt

SEQ ID NO: 66223 - DNA, 75 bp, Artificial Sequence
  Synthetic
attcaccctacgatgccaatgaaggagattcacgagtctattcgctggaccaaagacgcacgaaacactcaagac

SEQ ID NO: 66224 - DNA, 75 bp, Artificial Sequence
  Synthetic
ggtgccaatcacactgaccattgcaccacttaattcggaattcagcggcctccgtcaggcaataaaacaaggact

SEQ ID NO: 66225 - DNA, 75 bp, Artificial Sequence
  Synthetic
caagaaaagagacatcctcgatccattgaccagagacgtctctaagatgaaattttacatggataaatatgggtt

SEQ ID NO: 66226 - DNA, 75 bp, Artificial Sequence
  Synthetic
agctattcaacttagagacaggaagtccaaggtcaggtacagcgtggacacagtggtctctgaacttattagaga

SEQ ID NO: 66227 - DNA, 75 bp, Artificial Sequence
  Synthetic
catgttatctgggattttgggctacaatcatctgtcacccttgtgataccatggatcagtaacacccactacagg

SEQ ID NO: 66228 - DNA, 75 bp, Artificial Sequence
  Synthetic
actcggtgttggaccagcagaagccggagattgtggtggcatccttaggtgtcaacatggagtgattggtattct

SEQ ID NO: 66229 - DNA, 75 bp, Artificial Sequence
  Synthetic
aatcagtcttgaggagaagccagccccagatgccattagtgatctcctcgctagtgtagacagtgaggaagtgcg

SEQ ID NO: 66230 - DNA, 75 bp, Artificial Sequence
  Synthetic
ctagtgtagacagtgaggaagtgcgccaatactgtagggagcaaggctggatcatccctgaaactcctaccaatg

SEQ ID NO: 66231 - DNA, 75 bp, Artificial Sequence
  Synthetic
atccctggggagttcacttctctactagatctatgccggatagagactatactggaagtcaacaacactactggt

SEQ ID NO: 66232 - DNA, 75 bp, Artificial Sequence
  Synthetic
cagtggcaggcggtacagggacggaagacagtcaccccccctacaagcagactcaacccggcgccgatggcttcg

SEQ ID NO: 66233 - DNA, 75 bp, Artificial Sequence
  Synthetic
caactagggagtgcatttggtgctggttttaccaatgaaatagctgaaaagacacaacaaatcaaagagatgctc

SEQ ID NO: 66234 - DNA, 75 bp, Artificial Sequence
  Synthetic
gctagtgatgccaccttagttataaatactgaacatatgcccagtatgtttgtgccagttggagatgtggtccag

SEQ ID NO: 66235 - DNA, 75 bp, Artificial Sequence
  Synthetic
gcaatctggggccatctatgtgggcaacttcagagtggttaatcgtcaccttgctactcataatgactgggcaaa

SEQ ID NO: 66236 - DNA, 75 bp, Artificial Sequence
  Synthetic
ttcttgaccactgacgacggcgtttcagcgcccattttaccaaacttccaccccaccccgtgtattcacataccc

SEQ ID NO: 66237 - DNA, 75 bp, Artificial Sequence
  Synthetic
ccatatagctattggattggccatccggtgtgcaacagagcaattatttaccaatttattggttttgtaccatta

SEQ ID NO: 66238 - DNA, 75 bp, Artificial Sequence
  Synthetic
agaaaacgtccgttacccggctaactacttcgagaaacttagtaacaccattgaagctgcagagtgtttcgctca

SEQ ID NO: 66239 - DNA, 75 bp, Artificial Sequence
  Synthetic
aagtctctagccactggtatcattgctcgagcaatcgctgataagtaccactccagcgtgtactcgcttccacca

SEQ ID NO: 66240 - DNA, 75 bp, Artificial Sequence
  Synthetic
tattggcaactccaccatcaccacacaagaagcggcaaacatcatagtcggctatggtgagtggccttcctactg

SEQ ID NO: 66241 - DNA, 75 bp, Artificial Sequence
  Synthetic
tcaaactcagccactgagggttctaccataaactacaccaccatcaattactacaaagactcttatgctgccaca

SEQ ID NO: 66242 - DNA, 75 bp, Artificial Sequence
  Synthetic
gcaggcaaacagagtctcaagcaggatccagacaagtttgcaaatcctgttaaagacatcttcactgaaatggca

SEQ ID NO: 66243 - DNA, 75 bp, Artificial Sequence
  Synthetic
tggtatccaccgtagacttcattccaccaatggcttcccttgaggagaagggagtttccttcacctctaagtttg

SEQ ID NO: 66244 - DNA, 75 bp, Artificial Sequence
  Synthetic
ggaaacacgcttcacgatcccgacgagtttgtcagggaggcggctttgcattatgccaaccaactcaaacagtta

SEQ ID NO: 66245 - DNA, 75 bp, Artificial Sequence
  Synthetic
atttgtgggcacattgttgacttctaagatggtctccacctggcatagctctagtaagtttctaacttcaccggg

SEQ ID NO: 66246 - DNA, 75 bp, Artificial Sequence
  Synthetic
atacaaacaacagatcgtcactgttatggacgacctatgccaaaacccagacgggaaagacatgtcactattttg

SEQ ID NO: 66247 - DNA, 75 bp, Artificial Sequence
  Synthetic
ggcaatctacaatggttgggcagatctgcagatattacactcaatggtctggctctctcaaagtaaccttcatgt

SEQ ID NO: 66248 - DNA, 75 bp, Artificial Sequence
  Synthetic
acttccaccagaccctgaccattttgacgggtacaaacagcaagtggttacagttatggatgatctgtgtcagaa

SEQ ID NO: 66249 - DNA, 75 bp, Artificial Sequence
  Synthetic
agttcacacgtcctgtcttggataccatcagggaggttgcagccccgttgcaatccccttctgttgaggcgtgcg

SEQ ID NO: 66250 - DNA, 75 bp, Artificial Sequence
  Synthetic
gcagttacccagggttttcccactgaattgaaacctggcaccaatcagttcttaaccactgacgacggcgtttct

SEQ ID NO: 66251 - DNA, 75 bp, Artificial Sequence
  Synthetic
ccttataagcagacccaacccggtgccgatggcttcgagctgcaacacccgtacgtgcttgatgctggcatccca

SEQ ID NO: 66252 - DNA, 75 bp, Artificial Sequence
  Synthetic
tgagaagaaattggctcgaattattttaacagtacagcttaaagctgaacccttgcatgagccgtgacacaagct

SEQ ID NO: 66253 - DNA, 75 bp, Artificial Sequence
  Synthetic
tgacagcaaccttagcgctgattgggtgctccacaagcccctggcaatggttgaaatccaaggtttgctcttatt

SEQ ID NO: 66254 - DNA, 75 bp, Artificial Sequence
  Synthetic
cacggcaacagtacagggtccaagtctcgatttcgctctgtctctactgaggaggaatatcaggcaagtgcaaac

SEQ ID NO: 66255 - DNA, 75 bp, Artificial Sequence
  Synthetic
tttgtcaagctgtcagaccctccagcacaggtttcagtaccattcatgtcacctgcgagtgcttaccaatggttt

SEQ ID NO: 66256 - DNA, 75 bp, Artificial Sequence
  Synthetic
cttgatgctggcatcccaatatcacagttaacagtgtgcccacaccagtggattaatttgaggaccaacaattgt

SEQ ID NO: 66257 - DNA, 75 bp, Artificial Sequence
  Synthetic
gcggttattacacccaatggtccggctccttggaagtcaccttcatgttcactgggtcctttatggcaaccggca

SEQ ID NO: 66258 - DNA, 75 bp, Artificial Sequence
  Synthetic
ctccttggaagtcaccttcatgttcactgggtcctttatggcaaccggcaagatgctcatagcatacacaccccc

SEQ ID NO: 66259 - DNA, 75 bp, Artificial Sequence
  Synthetic
aactatttgggttgagcacaaactcgtgaacgtccttgatgcagttgaactggtggatgagcaaggagtcaacct

SEQ ID NO: 66260 - DNA, 75 bp, Artificial Sequence
  Synthetic
ggaaacccttgcgtaactgcttgtctaaggccggcaaactcagagcacataggggccagggtaatagtaatgggg

SEQ ID NO: 66261 - DNA, 75 bp, Artificial Sequence
  Synthetic
tttaatgaagttacatgggagaatgccaccttcttgaagagaggattcttgcctgatcatcaattcccgttcctc

SEQ ID NO: 66262 - DNA, 75 bp, Artificial Sequence
  Synthetic
tatagtgtgggactttggtttgcagtcttcggtgactctggtaataccatggatcagtaacactcatttcagggc

SEQ ID NO: 66263 - DNA, 75 bp, Artificial Sequence
  Synthetic
tgggcacgcacgtcatctgggattttgggctgcaatcgtctgttacccttgtaataccatggatcagcaacactc

SEQ ID NO: 66264 - DNA, 75 bp, Artificial Sequence
  Synthetic
atcaaagtttattgactgggttaagtccaaagtggttccacaagtgaaagaaaaactggagttcctgtcgaaatt

SEQ ID NO: 66265 - DNA, 75 bp, Artificial Sequence
  Synthetic
tggaccagttatgtgcatcattccaagtggatcctgggcgcaatggtccgtggcaatccacaatggttggtcaga

SEQ ID NO: 66266 - DNA, 75 bp, Artificial Sequence
  Synthetic
agtgccctggggataaagaaaagagacatcttagaccctaccaccagggacgtgagtaaaatgaagttctacatg

SEQ ID NO: 66267 - DNA, 75 bp, Artificial Sequence
  Synthetic
ttcacaggctctttcatggctacagggaaaatgctgatagcctacacaccacccggtagtgcccagcccgccaca

SEQ ID NO: 66268 - DNA, 75 bp, Artificial Sequence
  Synthetic
ttatgtacggcactattattgtggcacaattgttggtcctcaaattaatccactgatgtgggcacactgttaatt

SEQ ID NO: 66269 - DNA, 75 bp, Artificial Sequence
  Synthetic
aacagcagagtaccaaaatgaccccattgcaaatgcagtggaaagtgctgttagcgcgcttgctgacaccacaat

SEQ ID NO: 66270 - DNA, 75 bp, Artificial Sequence
  Synthetic
gagtacaattagatcagttcctattgggaaagccttggctataccaaattttgagaacttgagaagaaattggct

SEQ ID NO: 66271 - DNA, 75 bp, Artificial Sequence
  Synthetic
aatccttgtgcgcctgttttatatcccctttcccaagttgaaacatagaagtaatgcgcaccattgatcaatagc

SEQ ID NO: 66272 - DNA, 75 bp, Artificial Sequence
  Synthetic
gcacattactgtaggaaatttgccccattgtacgcagctgaggctaagcgtgtgtttcaattagagaagaaaatg

SEQ ID NO: 66273 - DNA, 75 bp, Artificial Sequence
  Synthetic
tgacatggccaatgctgctaagggattggaatggatttctaacaaaattagtaaattcatcgattggctcaaaga

SEQ ID NO: 66274 - DNA, 75 bp, Artificial Sequence
  Synthetic
caagcaaaggtacaggggccaaattttgaatttgcagtggcaatgatgaaaagaaactcagcaattatcaagaca

SEQ ID NO: 66275 - DNA, 75 bp, Artificial Sequence
  Synthetic
aaggttgagttcctaaacaacttgaaacagttacctctactagagaaccagatctcaaacctagagcaatctgct

SEQ ID NO: 66276 - DNA, 75 bp, Artificial Sequence
  Synthetic
taccgatcagggttctgcattcacgtgcagtgcaatgccagtaaattccaccaaggagcactcctagtcgctgtc

SEQ ID NO: 66277 - DNA, 75 bp, Artificial Sequence
  Synthetic
ctaccagagtatgtcattgggacagtggcaggcggtacagggacggaagatacccaccccccttacaagcagact

SEQ ID NO: 66278 - DNA, 75 bp, Artificial Sequence
  Synthetic
cactgatcaatagcaggcatggcgcaccagctatgtcttgatcaagcacttctgtttccccggaccgagtatcaa

SEQ ID NO: 66279 - DNA, 75 bp, Artificial Sequence
  Synthetic
gatctcagccttggttatggttattagaagcgactatgatatggtcaccctcacagctacgctagctctgatcgg

SEQ ID NO: 66280 - DNA, 75 bp, Artificial Sequence
  Synthetic
ccctgtgccacctgctattgtcccgatgacatactctgggaggacagcgactaggagtgctccttggtggaactt

SEQ ID NO: 66281 - DNA, 75 bp, Artificial Sequence
  Synthetic
gcaactttggcctgttagttgtgcctattagtccactagactatgaccaaggagcgacgccagtaatccctataa

SEQ ID NO: 66282 - DNA, 75 bp, Artificial Sequence
  Synthetic
tagggatccccatcgctcataagcaaagcgattcctggctaaagaagttcaatgacatggcaaacgttgttaagg

SEQ ID NO: 66283 - DNA, 75 bp, Artificial Sequence
  Synthetic
taaggacatgtcactgttctgccaaatggtgtccaccgtcgacttcatcccaccaatggcttccctcgaggagaa

SEQ ID NO: 66284 - DNA, 75 bp, Artificial Sequence
  Synthetic
caccaatggcttccctcgaggagaaaggggtctctttcacatccaaatttgttatcgcatccaccaatgctagta

SEQ ID NO: 66285 - DNA, 75 bp, Artificial Sequence
  Synthetic
acccacagggcccactgggcgctagcactctggtactgaggtacctttgtgcgcctgtttttactccccttcccc

SEQ ID NO: 66286 - DNA, 75 bp, Artificial Sequence
  Synthetic
cgaagtaacttagaagctgtaaatcaacgatcaatagcaggtgtggcacaccagtcataccttgatcaagcactt

SEQ ID NO: 66287 - DNA, 75 bp, Artificial Sequence
  Synthetic
taggaagatcaattgctgacaaattgaatagctccgtgtactcactgccgcctgatccagatcattttgatgggt

SEQ ID NO: 66288 - DNA, 75 bp, Artificial Sequence
  Synthetic
caaacttcaaacgttgcagccccctagtatgtggaaaggctatccagctcagggacaggaaatctaaagttaggt

SEQ ID NO: 66289 - DNA, 75 bp, Artificial Sequence
  Synthetic
tttgtaccattaaccttgaagtctgtgaccacccttaattatatcttgacccttaacacagctaaacatgggttc

SEQ ID NO: 66290 - DNA, 75 bp, Artificial Sequence
  Synthetic
gttgattagggagtacaataacaggtctgccattggtaacacgattgaagctttgtttcaaggtccacctaagtt

SEQ ID NO: 66291 - DNA, 75 bp, Artificial Sequence
  Synthetic
acaattgtgccacaataatagtgccatacatgaacacactgccttttgactctgccttgaaccactgcaattttg

SEQ ID NO: 66292 - DNA, 75 bp, Artificial Sequence
  Synthetic
cattcgacgcaggttttacatggactgcgacattgaggtgacggattcatacaaaacagacttgggtagactaga

SEQ ID NO: 66293 - DNA, 75 bp, Artificial Sequence
  Synthetic
cttaggtattcctattgctcaaaaacagagcgcctcttggcttaagaaattcaatgatatggccagtgctgctaa

SEQ ID NO: 66294 - DNA, 75 bp, Artificial Sequence
  Synthetic
acattagacaagttcagacggatcaggggcatttcaccatgctgggcgtcagagaccgcttggctgttctcccac

SEQ ID NO: 66295 - DNA, 75 bp, Artificial Sequence
  Synthetic
gacactcgcagcccggaaagacaatctgggtggagcacaagcttgtgaacgtgctggatgctgttgagttagtgg

SEQ ID NO: 66296 - DNA, 75 bp, Artificial Sequence
  Synthetic
ccaccaacccaaatggttatgccaactgggatatagacataactggttatgcgcaaatgcgcaggaaagtggagc

SEQ ID NO: 66297 - DNA, 75 bp, Artificial Sequence
  Synthetic
cctgcttgagctgtgccaagtagaaaccatccttgaagttaacaacgtgcccaccaacgctaccagcttgatgga

SEQ ID NO: 66298 - DNA, 75 bp, Artificial Sequence
  Synthetic
agagccttaagcaggacccagacaagtttgcaaatcctgtcaaagacatcttcactgaaatggcagcgccattaa

SEQ ID NO: 66299 - DNA, 75 bp, Artificial Sequence
  Synthetic
gaaaagttcagagacatcaccaaattcatcccagaaagtatcagtgctgctagcgacgccactttagtgatcaac

SEQ ID NO: 66300 - DNA, 75 bp, Artificial Sequence
  Synthetic
gtttgcaaatcctgtcaaagacatcttcactgaaatggcagcgccattaaaatctccatctgctgaggcatgtgg

SEQ ID NO: 66301 - DNA, 75 bp, Artificial Sequence
  Synthetic
aactttgattactcttgacaccaatgaaaagttcagagacatcaccaaattcatcccagaaagtatcagtgctgc

SEQ ID NO: 66302 - DNA, 75 bp, Artificial Sequence
  Synthetic
gccactgtacgctacagaagctaagagagtttacgccctagagaagagaatgaacaattacatgcagttcaagag

SEQ ID NO: 66303 - DNA, 75 bp, Artificial Sequence
  Synthetic
tctggggccatctacgtgggcaacttcagagtggttaatcgtcacctcgctactcataatgactgggcaaacctc

SEQ ID NO: 66304 - DNA, 75 bp, Artificial Sequence
  Synthetic
agagtttacgccctagagaagagaatgaacaattacatgcagttcaagagcaaacaccgtattgaacctgtatgc

SEQ ID NO: 66305 - DNA, 75 bp, Artificial Sequence
  Synthetic
ccaactcaccgcactatgatgtacaatttccccacaaaggcaggtcagtgtggaggagtagtcacatcagttgga

SEQ ID NO: 66306 - DNA, 75 bp, Artificial Sequence
  Synthetic
acctccaatggcttctctcgaggagaaaggtattctgtacacctcccctttcatgattgcctccacaaatcacgg

SEQ ID NO: 66307 - DNA, 75 bp, Artificial Sequence
  Synthetic
cccagacgctattagcgatctccttgctagcgtagatagtgaagaagtgcgccagtactgcagggatcaaggctg

SEQ ID NO: 66308 - DNA, 75 bp, Artificial Sequence
  Synthetic
gcttaacatcaatgggccaacccgcactaagcttgaacctagtgtgttccatgacgtctttgagggcaacaagga

SEQ ID NO: 66309 - DNA, 75 bp, Artificial Sequence
  Synthetic
tgtcatccaccaccgcccaaggttgtgacacgattgcccgttgcgattgccagacaggggtgtactactgtaact

SEQ ID NO: 66310 - DNA, 75 bp, Artificial Sequence
  Synthetic
tgctcgtcatgcaatccatcgccacagtagtggcagttgtctcattggtgtatgtcatctacaagctctttgcag

SEQ ID NO: 66311 - DNA, 75 bp, Artificial Sequence
  Synthetic
agactcaacccggtgctgatggcttcgaattgcaacacccgtacgtgcttgatgctggcattccaatatcacaat

SEQ ID NO: 66312 - DNA, 75 bp, Artificial Sequence
  Synthetic
tacatcagagaggcagccctccactatgcaaatcagttgaaacagctggacatagacaccacccagatgagcatg

SEQ ID NO: 66313 - DNA, 75 bp, Artificial Sequence
  Synthetic
gagagttctataggggacagtgtgagtagagcactcacccaggccctgccagcacccacaggccagaacacacag

SEQ ID NO: 66314 - DNA, 75 bp, Artificial Sequence
  Synthetic
ggccaaattgtgttctgagaacaacacagcaaatttcaagcgttgcagcccgctagtatgtggaaaggccattca

SEQ ID NO: 66315 - DNA, 75 bp, Artificial Sequence
  Synthetic
accttgaagctatcgaccttcacactagcgcaggttatccttacagtgctctgggaataaagaagagagatattt

SEQ ID NO: 66316 - DNA, 75 bp, Artificial Sequence
  Synthetic
acaataatagtgccgtacataaacgcactaccctttgattctgccttgaaccattgtaactttggtctgctggtt

SEQ ID NO: 66317 - DNA, 75 bp, Artificial Sequence
  Synthetic
taacagtgtgcccacatcagtggattaatttgaggaccaacaattgtgccacaataatagtgccgtacataaacg

SEQ ID NO: 66318 - DNA, 75 bp, Artificial Sequence
  Synthetic
ctgtttccccggactgagtatcaataactgctcgcgcggttgaaggaaaaacgttcgttatccggctagctactt

SEQ ID NO: 66319 - DNA, 75 bp, Artificial Sequence
  Synthetic
cagatccgccattggcaatacaattgaagctttgtttcagggcccacccaagtttagacccattagaatcagtct

SEQ ID NO: 66320 - DNA, 75 bp, Artificial Sequence
  Synthetic
gaagctttgtttcagggcccacccaagtttagacccattagaatcagtcttgaggaaacaccagctcctgatgcc

SEQ ID NO: 66321 - DNA, 75 bp, Artificial Sequence
  Synthetic
caatcgcacctgatgcttgcagcgggccactccgagcccggcgactgcgggggcatcttaaggtgccaacatggt

SEQ ID NO: 66322 - DNA, 75 bp, Artificial Sequence
  Synthetic
ccctagtgatcaacacggagcacatgccatcaatgtttgtcccggtgggtgacgttgtgcagtatggctttttga

SEQ ID NO: 66323 - DNA, 75 bp, Artificial Sequence
  Synthetic
ctggctcggctgtggggtgcaacccagatgtgttttggagcaagctaccaattctgctccctggttccctctttg

SEQ ID NO: 66324 - DNA, 75 bp, Artificial Sequence
  Synthetic
gcaatccatcgccacggtagtggcggtagtctcattggtgtatgtcatctataagctctttgctgggttccaggg

SEQ ID NO: 66325 - DNA, 75 bp, Artificial Sequence
  Synthetic
ggtaaagtcaacatggctgccgcctgtcaacactgttccaactgtgaccctgctaatttcaaaaaatgttgcccc

SEQ ID NO: 66326 - DNA, 75 bp, Artificial Sequence
  Synthetic
taggctatagtgaggaggcggtctcgctcattgaagggatcaaccacacgcaccatgtatatcgcaacaaaactt

SEQ ID NO: 66327 - DNA, 75 bp, Artificial Sequence
  Synthetic
attgcgtgcttggtgggatgccctcgggttgttcaggaacatccatcttcaattcaatgatcaataatattatca

SEQ ID NO: 66328 - DNA, 75 bp, Artificial Sequence
  Synthetic
gggttgttcaggaacatccatcttcaattcaatgatcaataatattatcatcagagcactactcatcaagacatt

SEQ ID NO: 66329 - DNA, 75 bp, Artificial Sequence
  Synthetic
tgctcgctagttaccctttcccaattgactgcctagaactagcaagaacaggtaaggagtatggtctgaccatga

SEQ ID NO: 66330 - DNA, 75 bp, Artificial Sequence
  Synthetic
tttggagaacacaaacaagagaaagatcttgaatacggagcgtgccctaacaacatgatgggcactttctcggtg

SEQ ID NO: 66331 - DNA, 75 bp, Artificial Sequence
  Synthetic
agctgactttaattacccttgacactaatgagaaattcagggatatcaccaaatttattccggaaagcatcagtg

SEQ ID NO: 66332 - DNA, 75 bp, Artificial Sequence
  Synthetic
tatggtaccagacgaattatgtggttccaattggggcacccaatacagcctatataatagcattggcggcagccc

SEQ ID NO: 66333 - DNA, 75 bp, Artificial Sequence
  Synthetic
ctcaaatgagcatggaggaggcctgctacggtactgagaatcttgaggctattgatcttcacactagtgcaggtt

SEQ ID NO: 66334 - DNA, 75 bp, Artificial Sequence
  Synthetic
ctgatgatcaatttccattcttgattcaccctaccatgccaatgaaggagattcatgagtccattcgatggacca

SEQ ID NO: 66335 - DNA, 75 bp, Artificial Sequence
  Synthetic
atctctgcactggtgattgtgatcagaagtgattacgacatggttacccttactgcaaccttagcgctgataggt

SEQ ID NO: 66336 - DNA, 75 bp, Artificial Sequence
  Synthetic
agtatggcttcttgaatctcagtggaaaaccgactcaccgtactatgatgtataactttcctaccaaggcaggac

SEQ ID NO: 66337 - DNA, 75 bp, Artificial Sequence
  Synthetic
tttatagtaattaatggtagtgtaatttatggtggagccctcagtagctgagttggagttctcatgagagccgga

SEQ ID NO: 66338 - DNA, 75 bp, Artificial Sequence
  Synthetic
tgcctttgactactcaggttatgatgctagccttagccctgtttggttcagggctttagagttggtcctgaggga

SEQ ID NO: 66339 - DNA, 75 bp, Artificial Sequence
  Synthetic
tcttccttactccacttatgtcaaggacgagctgcgctcgattgataaaattaagaaagggaagtcccgtctgat

SEQ ID NO: 66340 - DNA, 75 bp, Artificial Sequence
  Synthetic
gtgcgggactcaagaggagctactttgctagtgaacagggagagatccaatgggttaaacccaacaaagaaacag

SEQ ID NO: 66341 - DNA, 75 bp, Artificial Sequence
  Synthetic
tgtcccagtaggaaaagcattggcaattcccaattacgaaaatctgagacgcaattggctcgaattattttagag

SEQ ID NO: 66342 - DNA, 75 bp, Artificial Sequence
  Synthetic
ctattgtttacttggtggaatgccctcaggctgctccggaacatccattttcaactcaatgatcaacaacattat

SEQ ID NO: 66343 - DNA, 75 bp, Artificial Sequence
  Synthetic
tcaggctgctccggaacatccattttcaactcaatgatcaacaacattattatcagaaccatactgattaaaata

SEQ ID NO: 66344 - DNA, 75 bp, Artificial Sequence
  Synthetic
aggaaccagcagttttgcataataaagaccctcgccttgaggtggatttcgagcaagcattgttctctaagtacg

SEQ ID NO: 66345 - DNA, 75 bp, Artificial Sequence
  Synthetic
tcgcaagaggatcttgaagccatgtttgggaacgtgtcataccttgctcatttctgtcgcaaattccaaccatta

SEQ ID NO: 66346 - DNA, 75 bp, Artificial Sequence
  Synthetic
ggcatccttaggtgccaacatggtgttgttggcatagtgtccactggtggtaatggactcgtcggttttgcagat

SEQ ID NO: 66347 - DNA, 75 bp, Artificial Sequence
  Synthetic
atgctcagttccactacctgtatcgatctggattttgcgtgcatgtccagtgcaatgcaagcaaattccaccagg

SEQ ID NO: 66348 - DNA, 75 bp, Artificial Sequence
  Synthetic
attgattgcttggagttaggaaatacagggaaggaatatggtctaaccatgactcctgcagataagtctccttgc

SEQ ID NO: 66349 - DNA, 75 bp, Artificial Sequence
  Synthetic
tggggaacacactacacgaggtttatgagtacatcaaagaggcagccctccactacgcaaatcagttaaaacagt

SEQ ID NO: 66350 - DNA, 75 bp, Artificial Sequence
  Synthetic
ttgttggcatagtgtccactggtggtaatggactcgtcggttttgcagatgtgagagacctcctgtggttagatg

SEQ ID NO: 66351 - DNA, 75 bp, Artificial Sequence
  Synthetic
cggtttccagggaggttgaggctctcaagaatcacctcatagggtctgaaggggcagttgagaaaattctgaaaa

SEQ ID NO: 66352 - DNA, 75 bp, Artificial Sequence
  Synthetic
ctaaagcaactccccttattggagaaccaaatttctaatctcgaacagtcagcagcttcgcaggaggaccttgag

SEQ ID NO: 66353 - DNA, 75 bp, Artificial Sequence
  Synthetic
acaccagtgcgggatatccctacagtgcgttaggaataaagaagagggatatcttagaccccactaccagagatg

SEQ ID NO: 66354 - DNA, 75 bp, Artificial Sequence
  Synthetic
ggggcagttgagaaaattctgaaaaatcttattaagctgatctctgcactagtgattgtgatcaggagtgattat

SEQ ID NO: 66355 - DNA, 75 bp, Artificial Sequence
  Synthetic
gttgtcccgcaattgctccaatacatgtttgtaccacccggagcccccaagccagactccagagaatctctcgca

SEQ ID NO: 66356 - DNA, 75 bp, Artificial Sequence
  Synthetic
cagggaaggaatatggtctaaccatgactcctgcagataagtctccttgctttaatgaggttacttgggagaatg

SEQ ID NO: 66357 - DNA, 75 bp, Artificial Sequence
  Synthetic
acagcatccgtactaggtatccccattgctcagaaacagagcgcatcgtggcttaagaaattcaatgacatggct

SEQ ID NO: 66358 - DNA, 75 bp, Artificial Sequence
  Synthetic
ttgctcagaaacagagcgcatcgtggcttaagaaattcaatgacatggctaacgctgccaagggattagaatgga

SEQ ID NO: 66359 - DNA, 75 bp, Artificial Sequence
  Synthetic
acgcaattggctcgagttattttagactggctatacacacctcgaccccaccagaaatctggtcgcgaatatgaa

SEQ ID NO: 66360 - DNA, 75 bp, Artificial Sequence
  Synthetic
tcctaaacaatctgaaacagctaccattactagagaaccaaatctcaaacttggagcaatctgctgcctcgcagg

SEQ ID NO: 66361 - DNA, 75 bp, Artificial Sequence
  Synthetic
gcgcaccagctatgtcttggtcaagcacttctgtttccccggacagagtatcaataagctgcttgcgcggctgaa

SEQ ID NO: 66362 - DNA, 75 bp, Artificial Sequence
  Synthetic
aaataggtagacgattgctctgttgcacaccggatggccaatccaatagctatatggtaacaattctttgattgt

SEQ ID NO: 66363 - DNA, 75 bp, Artificial Sequence
  Synthetic
cagaggccaagagagtctacaccctggagaagaggatgaacaactacatgcagttcaagagcaaacaccgtattg

SEQ ID NO: 66364 - DNA, 75 bp, Artificial Sequence
  Synthetic
ggagaagaggatgaacaactacatgcagttcaagagcaaacaccgtattgaacctgtatgcctcatcattagagg

SEQ ID NO: 66365 - DNA, 75 bp, Artificial Sequence
  Synthetic
cagttcaagagcaaacaccgtattgaacctgtatgcctcatcattagaggctctccaggtactgggaagtctctg

SEQ ID NO: 66366 - DNA, 75 bp, Artificial Sequence
  Synthetic
actcacagggcccactgggcgctagtacactggtatctcggtacctttgtacgcctgttttataccccctccctg

SEQ ID NO: 66367 - DNA, 75 bp, Artificial Sequence
  Synthetic
ggttgtgacacgattgctcgttgcaattgccagacaggagtgtattattgtaactcaatgagaaaacactatccg

SEQ ID NO: 66368 - DNA, 75 bp, Artificial Sequence
  Synthetic
acgcctgttttataccccctccctgatttgcaacttagaagcaacgcaaaccagatcaatagtaggtgtgacata

SEQ ID NO: 66369 - DNA, 75 bp, Artificial Sequence
  Synthetic
actcaacatggttgcctacggggacgatgtgctcgctagttacccctttccaattgactgcctggagctagcgaa

SEQ ID NO: 66370 - DNA, 75 bp, Artificial Sequence
  Synthetic
cacttcgatgggtacaagcagcaagtagtcacagtcatggatgacctgtgtcagaatcctgatggaaaagacatg

SEQ ID NO: 66371 - DNA, 75 bp, Artificial Sequence
  Synthetic
ccagtcgcatcttgatcaagcacttctgtatccccggaccgagtatcaatagactgtgcacacggttgaaggaga

SEQ ID NO: 66372 - DNA, 75 bp, Artificial Sequence
  Synthetic
tagtcacagtcatggatgacctgtgtcagaatcctgatggaaaagacatgtcactattctgtcaaatggtgtcta

SEQ ID NO: 66373 - DNA, 75 bp, Artificial Sequence
  Synthetic
gcttcaatgaggttaattgggaaaacgcaaccttccttaagagaggctttttgcctgatgaacaattcccgtttt

SEQ ID NO: 66374 - DNA, 75 bp, Artificial Sequence
  Synthetic
atgccaacatggcgtcgtagggatagtttccaccgggggaaacggcctggtggggttcgccgatgtgagggatct

SEQ ID NO: 66375 - DNA, 75 bp, Artificial Sequence
  Synthetic
ggtgcaagtcactgacatagaaaaacacctgaatagggccatgacaatcctacaagcagtgtcaacctttgtcgc

SEQ ID NO: 66376 - DNA, 75 bp, Artificial Sequence
  Synthetic
ctactaacgctagcaacatcattgtgccaacggtatctgactctgacgctattcgccgcagattttatatggatt

SEQ ID NO: 66377 - DNA, 75 bp, Artificial Sequence
  Synthetic
ttatacttatactggctgcttatggtgacaattgaagaattgttaccatatagctattggattggccatccggtg

SEQ ID NO: 66378 - DNA, 75 bp, Artificial Sequence
  Synthetic
gctctatccctgctgagaagaaacattaggcaagtccaaacagatcaggggcattttaccatgttaggtgtcagg

SEQ ID NO: 66379 - DNA, 75 bp, Artificial Sequence
  Synthetic
gccaacggtatctgactctgacgctattcgccgcagattttatatggattgtgacatcgaagtgacagattcata

SEQ ID NO: 66380 - DNA, 75 bp, Artificial Sequence
  Synthetic
tgaataattacatgcagttcaagagcaaacaccgtattgaacctgtatgcctaatcatcagaggctcgcctggta

SEQ ID NO: 66381 - DNA, 75 bp, Artificial Sequence
  Synthetic
cacatctttcagcactttacacctcattttacaatacaatacaagaaaatgggagcacaggtttctacgcagaag

SEQ ID NO: 66382 - DNA, 75 bp, Artificial Sequence
  Synthetic
attttacaatacaatacaagaaaatgggagcacaggtttctacgcagaagtccggaagtcatgagactggcgtcg

SEQ ID NO: 66383 - DNA, 75 bp, Artificial Sequence
  Synthetic
acgctgcagtccactagtgtgcgggaaagctattcaacttagggacagaaagtccaaggtcagatatagtgtgga

SEQ ID NO: 66384 - DNA, 75 bp, Artificial Sequence
  Synthetic
aaagctattcaacttagggacagaaagtccaaggtcagatatagtgtggacacggtagtttctgaactcatcagg

SEQ ID NO: 66385 - DNA, 75 bp, Artificial Sequence
  Synthetic
tgaaagttctcgatgccaaagaactcgtggacaaagatgggacaaatcttgagttaacaatgataaagctagata

SEQ ID NO: 66386 - DNA, 75 bp, Artificial Sequence
  Synthetic
tgatcggctcagagggtgccgtggagaagattctaaagaacttagttaaactcatctctgcgctcgtcatcgtca

SEQ ID NO: 66387 - DNA, 75 bp, Artificial Sequence
  Synthetic
actggtgttgtaccagcactacaagctgcggagacaggggcgtcgtcaaatgctagtgacaagaatctcattgag

SEQ ID NO: 66388 - DNA, 75 bp, Artificial Sequence
  Synthetic
aacaggacttcactcaagacccgaagaaattcacgagccccgtgctagatgtgttgactgaaatggctgcaccac

SEQ ID NO: 66389 - DNA, 75 bp, Artificial Sequence
  Synthetic
attaaagaattgttaccatatagctattggattggccatccagtgtcaaacagagctattgtatatctctttgtt

SEQ ID NO: 66390 - DNA, 75 bp, Artificial Sequence
  Synthetic
aggattagtcttgaagagaaaccagccccagacgctatcagtgatcttctcgctagtgtggatagtgaggaagtg

SEQ ID NO: 66391 - DNA, 75 bp, Artificial Sequence
  Synthetic
ccccagacgctatcagtgatcttctcgctagtgtggatagtgaggaagtgcgtcaatattgtagagaccaaggtt

SEQ ID NO: 66392 - DNA, 75 bp, Artificial Sequence
  Synthetic
caattgaagcactattccaaggcccgcccaagttcagaccaattagaatcagtcttgaggagaagccagccccag

SEQ ID NO: 66393 - DNA, 75 bp, Artificial Sequence
  Synthetic
cccaggtctccacacagcgatccggctcgcatgagaattccaactcagccacggaaggctccactataaattaca

SEQ ID NO: 66394 - DNA, 75 bp, Artificial Sequence
  Synthetic
agagaaagtcgagtttctaaacaatctaaagcaactccccttattggagaaccaaatttctaatctcgaacagtc

SEQ ID NO: 66395 - DNA, 75 bp, Artificial Sequence
  Synthetic
ggtgtcctatggtgaatggccagattactgcccggacgttgacgccactgcggtggataaaccgactagaccaga

SEQ ID NO: 66396 - DNA, 75 bp, Artificial Sequence
  Synthetic
ctcgcatgagaattccaactcagccacggaaggctccactataaattacacaaccattaattactacaaagattc

SEQ ID NO: 66397 - DNA, 75 bp, Artificial Sequence
  Synthetic
ctgtagtggcagttgtttcactggtttatgttatctacaagttgtttgcaggatttcaaggtgcatactctggtg

SEQ ID NO: 66398 - DNA, 75 bp, Artificial Sequence
  Synthetic
gaagctgcagagtgtttcgctccacacttcccccgtgtagatcaggtcgatgagtcactgcaatccccacgggcg

SEQ ID NO: 66399 - DNA, 75 bp, Artificial Sequence
  Synthetic
ttatgttatctacaagttgtttgcaggatttcaaggtgcatactctggtgcccccaagcaaactctcaagaaacc

SEQ ID NO: 66400 - DNA, 75 bp, Artificial Sequence
  Synthetic
tactgaaatggcagcgcccttaaagtctccctctgctgaagcatgtggctatagcgaccgagtggcacagcttac

SEQ ID NO: 66401 - DNA, 75 bp, Artificial Sequence
  Synthetic
ctcaacccggtgccgatggcttcgagttgcaacacccgtacgtgcttgatgctggcatcccaatatcacagttaa

SEQ ID NO: 66402 - DNA, 75 bp, Artificial Sequence
  Synthetic
gtattcggacaaaacgcacaatttcactacttataccgatctggattctgcatacacgttcagtgtaacgcaagt

SEQ ID NO: 66403 - DNA, 75 bp, Artificial Sequence
  Synthetic
tctccctctgctgaagcatgtggctatagcgaccgagtggcacagcttaccattggaaattccaccattactaca

SEQ ID NO: 66404 - DNA, 75 bp, Artificial Sequence
  Synthetic
agttcaaacagaccaagggcacttcaccatgctgggtatcagagatcgcttggctgtcctcccgcgacatgcaca

SEQ ID NO: 66405 - DNA, 75 bp, Artificial Sequence
  Synthetic
accatgctgggtatcagagatcgcttggctgtcctcccgcgacatgcacagcctgggaagacaatctgggtggaa

SEQ ID NO: 66406 - DNA, 75 bp, Artificial Sequence
  Synthetic
actacttataccgatctggattctgcatacacgttcagtgtaacgcaagtaaattccaccagggcgccctgctgg

SEQ ID NO: 66407 - DNA, 75 bp, Artificial Sequence
  Synthetic
gacaaacctacacggcctgatgtctcagtaaatagattttacacgctagacaccaagctatgggagaaatcatcc

SEQ ID NO: 66408 - DNA, 75 bp, Artificial Sequence
  Synthetic
cagtaaatagattttacacgctagacaccaagctatgggagaaatcatccaaggggtggtactggaagttcccag

SEQ ID NO: 66409 - DNA, 75 bp, Artificial Sequence
  Synthetic
ccaccacccagccaggtccaaatggttttcaactacaacatccatacatccttgatgctggaattccacttagtc

SEQ ID NO: 66410 - DNA, 75 bp, Artificial Sequence
  Synthetic
ttttcaactacaacatccatacatccttgatgctggaattccacttagtcaactattggtatgtccacatcagtg

SEQ ID NO: 66411 - DNA, 75 bp, Artificial Sequence
  Synthetic
actcttgataccaatgagaagtttagggatgttaccaaattcataccagaaagcattagtgccgctagtgacgcc

SEQ ID NO: 66412 - DNA, 75 bp, Artificial Sequence
  Synthetic
cactctggtacctcggtacctttgtgcgcctgttttatacccccccccccaatgaaacttagaagcagcaaacca

SEQ ID NO: 66413 - DNA, 75 bp, Artificial Sequence
  Synthetic
ataccgcctatggcatctctggaggagaagggagtctcattcacctccaagtttgtgattgcctccactaacgcc

SEQ ID NO: 66414 - DNA, 75 bp, Artificial Sequence
  Synthetic
acgttcaatgtaacgctagcaaatttcaccaaggggcgctactcgttgcggtattgcccgagtatgtcattggaa

SEQ ID NO: 66415 - DNA, 75 bp, Artificial Sequence
  Synthetic
tcaccaaggggcgctactcgttgcggtattgcccgagtatgtcattggaacagtggcaggcggcacaggcacaga

SEQ ID NO: 66416 - DNA, 75 bp, Artificial Sequence
  Synthetic
aaaccattgcaactttggccttttggtggttccagtatcccccttagattacatgacaggcgcaacgcccaccat

SEQ ID NO: 66417 - DNA, 75 bp, Artificial Sequence
  Synthetic
ttggctgcttatggtgacaattgaaaagttgttaccatatagctattggattggccatccggtgaccaacagagc

SEQ ID NO: 66418 - DNA, 75 bp, Artificial Sequence
  Synthetic
aagcattagtgccgctagtgacgccacccttgtgattaacacagagcacatgccttccatgtttgtaccagtagg

SEQ ID NO: 66419 - DNA, 75 bp, Artificial Sequence
  Synthetic
caaggcaggccagtgcggtggtgtggtcacctcggtaggtaagattattggcattcatatcggtgggaatggacg

SEQ ID NO: 66420 - DNA, 75 bp, Artificial Sequence
  Synthetic
gatgaaattctatatggacaaatacgggctagacctgccatactccacctacgttaaggatgagcttagatctct

SEQ ID NO: 66421 - DNA, 75 bp, Artificial Sequence
  Synthetic
tgctggaattccaatatctcagttgacagtgtgccctcaccagtggatcaatttacgaaccaacaattgtgccac

SEQ ID NO: 66422 - DNA, 75 bp, Artificial Sequence
  Synthetic
acagtgtgccctcaccagtggatcaatttacgaaccaacaattgtgccaccataatagtgccatacatgaacaca

SEQ ID NO: 66423 - DNA, 75 bp, Artificial Sequence
  Synthetic
cagttcctaaccacgagtgataggagtgcccccccaattttacctggctttcaccccactccacaaatacacatc

SEQ ID NO: 66424 - DNA, 75 bp, Artificial Sequence
  Synthetic
gtcacctcggtaggtaagattattggcattcatatcggtgggaatggacgccaagggttctgcgctggcctgaaa

SEQ ID NO: 66425 - DNA, 75 bp, Artificial Sequence
  Synthetic
ctttggccaaaacgcacagtttcactatttatatagatcagggttttgcattcatgtgcaatgtaacgctagcaa

SEQ ID NO: 66426 - DNA, 75 bp, Artificial Sequence
  Synthetic
agcggtcctacccgcacgaaacttgagcctagtgtgttttatgatgtgtttgaaggtaacaaagagccagctgtc

SEQ ID NO: 66427 - DNA, 75 bp, Artificial Sequence
  Synthetic
agcctagtgtgttttatgatgtgtttgaaggtaacaaagagccagctgtccttactagtagagatcctaggttgg

SEQ ID NO: 66428 - DNA, 75 bp, Artificial Sequence
  Synthetic
caaggggcgacaccggtaattcctatcactatcacgttggctccgatgtgttctgagtttgcgggtctcaggcag

SEQ ID NO: 66429 - DNA, 75 bp, Artificial Sequence
  Synthetic
aactggtaggctgaacatcaatggaccaactcgcactaagttggagcctagtgtgtttcatgatgtgtttgaagg

SEQ ID NO: 66430 - DNA, 75 bp, Artificial Sequence
  Synthetic
taattccagtcaaagtgcaaacgtccaatggggccctgtgtgcagcattcagaacagatcctggattggatggcc

SEQ ID NO: 66431 - DNA, 75 bp, Artificial Sequence
  Synthetic
tcactatcacgttggctccgatgtgttctgagtttgcgggtctcaggcaggcagttacgcagggtttccccactg

SEQ ID NO: 66432 - DNA, 75 bp, Artificial Sequence
  Synthetic
gtgcccccccaattttacctggctttcaccccactccacaaatacacatccccggggaagtacacaacttgttgg

SEQ ID NO: 66433 - DNA, 75 bp, Artificial Sequence
  Synthetic
aggctgcactacactatgccaatcaattaaagcagctagacattaataccagtaagatgagcatggaagaagcat

SEQ ID NO: 66434 - DNA, 75 bp, Artificial Sequence
  Synthetic
attaaagcagctagacattaataccagtaagatgagcatggaagaagcatgttacggtacagataaccttgaggc

SEQ ID NO: 66435 - DNA, 75 bp, Artificial Sequence
  Synthetic
ccaccccgtgcattcacatacctggcgaggttagaaacttactagaactgtgccaggtagaaaccattttagaag

SEQ ID NO: 66436 - DNA, 75 bp, Artificial Sequence
  Synthetic
cgaggttagaaacttactagaactgtgccaggtagaaaccattttagaagtcaacaatgtgcccaccaacgcaac

SEQ ID NO: 66437 - DNA, 75 bp, Artificial Sequence
  Synthetic
tgggaaaatgctaatagcatacactccccccggcggtggattgccaaaagacagaatgacagcgatgcttggtac

SEQ ID NO: 66438 - DNA, 75 bp, Artificial Sequence
  Synthetic
caatggggccctgtgtgcagcattcagaacagatcctggattggatggcccttggcaagctactattttagggca

SEQ ID NO: 66439 - DNA, 75 bp, Artificial Sequence
  Synthetic
ccccccggcggtggattgccaaaagacagaatgacagcgatgcttggtacacacgtcatttgggattttggatta

SEQ ID NO: 66440 - DNA, 75 bp, Artificial Sequence
  Synthetic
tactagagatgtcactaagatgaagttctacatggacaaatatggtttagatctaccctactctacttatgtaaa

SEQ ID NO: 66441 - DNA, 75 bp, Artificial Sequence
  Synthetic
ttctacatggacaaatatggtttagatctaccctactctacttatgtaaaagatgagcttaggtcactagacaag

SEQ ID NO: 66442 - DNA, 75 bp, Artificial Sequence
  Synthetic
cgaccctgggagggatggtccttggcaatccaccatgctaggccagttgtgtggatattacacccaatggtcagg

SEQ ID NO: 66443 - DNA, 75 bp, Artificial Sequence
  Synthetic
caatccaccatgctaggccagttgtgtggatattacacccaatggtcagggtctttggaagtcacttttatgttc

SEQ ID NO: 66444 - DNA, 75 bp, Artificial Sequence
  Synthetic
cgatctgggttttgcgtgcatgtccagtgcaatgcaagtaaattccaccagggtgctttactggtggccgtgctg

SEQ ID NO: 66445 - DNA, 75 bp, Artificial Sequence
  Synthetic
gattattactcgaccggtgttgtcacgttgtggtatcagacaaattttgttgtaccagatggtgcccctaccaca

SEQ ID NO: 66446 - DNA, 75 bp, Artificial Sequence
  Synthetic
cccagacactcccaaccaggaaagaccatctgggttgaacacaaattagtgaagatcgtagatgctgtggagtta

SEQ ID NO: 66447 - DNA, 75 bp, Artificial Sequence
  Synthetic
cacctgtatgaagtgtttcatgcaaacccggggacagtaaccggctcagcagtgggctgcaatccggacgtgttc

SEQ ID NO: 66448 - DNA, 75 bp, Artificial Sequence
  Synthetic
acccggggacagtaaccggctcagcagtgggctgcaatccggacgtgttctggagtaaactcccaatcctactcc

SEQ ID NO: 66449 - DNA, 75 bp, Artificial Sequence
  Synthetic
gccacagctatgctggggacgcacgtcatctgggactttggcttgcaatcgtccgtcaccctcgtcataccatgg

SEQ ID NO: 66450 - DNA, 75 bp, Artificial Sequence
  Synthetic
atcatctgtcacccttgtgataccatggatcagtaatacccactacagggcgcatgcccgggatggggtgtttga

SEQ ID NO: 66451 - DNA, 75 bp, Artificial Sequence
  Synthetic
ctatagcagacatggtagaaacccatgtatccaccacaatgggcgacattctcaacccccaccagcagcctacgg

SEQ ID NO: 66452 - DNA, 75 bp, Artificial Sequence
  Synthetic
tcatctgggactttggcttgcaatcgtccgtcaccctcgtcataccatggatcagtaacactcactatagggcgc

SEQ ID NO: 66453 - DNA, 75 bp, Artificial Sequence
  Synthetic
ccatctgggttgaacacaaattagtgaagatcgtagatgctgtggagttagtagacgaacaaggggttaacttag

SEQ ID NO: 66454 - DNA, 75 bp, Artificial Sequence
  Synthetic
tggtcctgcgggaaattggttactcagaggaagcagtgtccctcatagaaggaattaatcacactcatcatgtgt

SEQ ID NO: 66455 - DNA, 75 bp, Artificial Sequence
  Synthetic
agaggaagcagtgtccctcatagaaggaattaatcacactcatcatgtgtatcgcaacaagacctattgcgttct

SEQ ID NO: 66456 - DNA, 75 bp, Artificial Sequence
  Synthetic
ctattggagcacctaatactgcctatataatagcgttggcagcagcccaaaagaatttcactatgaaattgtgca

SEQ ID NO: 66457 - DNA, 75 bp, Artificial Sequence
  Synthetic
tataatagcgttggcagcagcccaaaagaatttcactatgaaattgtgcaaggacaccagtgacattttgcaaac

SEQ ID NO: 66458 - DNA, 75 bp, Artificial Sequence
  Synthetic
tatgatagagaccaggtgtgtggtcaacagacatagcacagcagagactaccttgacacacttctattccagatc

SEQ ID NO: 66459 - DNA, 75 bp, Artificial Sequence
  Synthetic
taagcccactcacaggactatgatgtacaatttcccaacaaaagcaggacagtgtggtggtgttgtgactgccgt

SEQ ID NO: 66460 - DNA, 75 bp, Artificial Sequence
  Synthetic
tgtatccaccacaatgggcgacattctcaacccccaccagcagcctacggctagcgatgtcgaggccagctcaca

SEQ ID NO: 66461 - DNA, 75 bp, Artificial Sequence
  Synthetic
attgatcaaaacattcagagggatagacctagatgagctgaatatggtggcttacggggatgatgtgttggccag

SEQ ID NO: 66462 - DNA, 75 bp, Artificial Sequence
  Synthetic
gacctagatgagctgaatatggtggcttacggggatgatgtgttggccagttacccttttcccattgattgtctt

SEQ ID NO: 66463 - DNA, 75 bp, Artificial Sequence
  Synthetic
ccaagctttacctgcacccacaggccaaaacacccaagtgagcagtcatcgcttagacactggaaaagtaccagc

SEQ ID NO: 66464 - DNA, 75 bp, Artificial Sequence
  Synthetic
caaaacacccaagtgagcagtcatcgcttagacactggaaaagtaccagcacttcaagccgccgaaatcggagct

SEQ ID NO: 66465 - DNA, 75 bp, Artificial Sequence
  Synthetic
aagcttgagctgcttacctacatgcgttttgacgctgagttcacctttgtagccacaaccccaaatggagcatcg

SEQ ID NO: 66466 - DNA, 75 bp, Artificial Sequence
  Synthetic
ttgcagtgaacaaggtgagatccaatggatgaagcccaacaaagaaactggcaggttgaacatcaacggacctac

SEQ ID NO: 66467 - DNA, 75 bp, Artificial Sequence
  Synthetic
aacagacatagcacagcagagactaccttgacacacttctattccagatcgggactggtaggagtaattgatcta

SEQ ID NO: 66468 - DNA, 75 bp, Artificial Sequence
  Synthetic
acttgggaaaatgccaccttcctaaagagagggttcttgcccgatcatcagttccctttcctcattcatcccacg

SEQ ID NO: 66469 - DNA, 75 bp, Artificial Sequence
  Synthetic
agagagggttcttgcccgatcatcagttccctttcctcattcatcccacgatgcctatgaaggaaatccacgagt

SEQ ID NO: 66470 - DNA, 75 bp, Artificial Sequence
  Synthetic
cttgatagtttcttcagcagagcaggcttagttggggagatagatcttcctctaaagggcaccaccaatccgaac

SEQ ID NO: 66471 - DNA, 75 bp, Artificial Sequence
  Synthetic
gcttagttggggagatagatcttcctctaaagggcaccaccaatccgaacgggtatgccaactgggacatagaca

SEQ ID NO: 66472 - DNA, 75 bp, Artificial Sequence
  Synthetic
tatgtgctgcctttagagcagaccctggaagagatggtccgtggcagtccacaatactgggccaactctgcaggt

SEQ ID NO: 66473 - DNA, 75 bp, Artificial Sequence
  Synthetic
tcgttaaaagtagtgacccaccagctcaagtatcagtgccttttatgtcacctgctagtgcctaccaatggtttt

SEQ ID NO: 66474 - DNA, 75 bp, Artificial Sequence
  Synthetic
tggaagagatggtccgtggcagtccacaatactgggccaactctgcaggtactacacccagtggtcgggttcatt

SEQ ID NO: 66475 - DNA, 75 bp, Artificial Sequence
  Synthetic
ggaaggatgaatatgaaaagtttgtaagtgcaatcagatcagtcccgattgggaaagcactagcaataccaaatt

SEQ ID NO: 66476 - DNA, 75 bp, Artificial Sequence
  Synthetic
tcaagtatcagtgccttttatgtcacctgctagtgcctaccaatggttttacgatgggtatccctcattcggaga

SEQ ID NO: 66477 - DNA, 75 bp, Artificial Sequence
  Synthetic
tcgcgtgcacacctaccggagaggtcgttccacagctgcttcaatacatgtttgttccacccggggcccccaaac

SEQ ID NO: 66478 - DNA, 75 bp, Artificial Sequence
  Synthetic
ttgagaacctgagaaggaattggcttgaattattttaaactacagctttagctgaaccccaccgggaatttggtt

SEQ ID NO: 66479 - DNA, 75 bp, Artificial Sequence
  Synthetic
ggggagtggaacgccaccgacatcgctaaccatcaggatctatatgcgattaaagcacatcagagggtggatacc

SEQ ID NO: 66480 - DNA, 75 bp, Artificial Sequence
  Synthetic
cgttccacagctgcttcaatacatgtttgttccacccggggcccccaaaccagactccagagactctttggcttg

SEQ ID NO: 66481 - DNA, 75 bp, Artificial Sequence
  Synthetic
ctaaccatcaggatctatatgcgattaaagcacatcagagggtggatacccaggcccatgcgtagtcaggattac

SEQ ID NO: 66482 - DNA, 75 bp, Artificial Sequence
  Synthetic
gtacattcctgttggtaaggtggttgagtacggtttcctaaatctaagcggcacaccaacacacaggatgttaat

SEQ ID NO: 66483 - DNA, 75 bp, Artificial Sequence
  Synthetic
acctgcaagcgcataccaatggttttatgacggataccctacatttggagagcacaagcaagagaaggatctcga

SEQ ID NO: 66484 - DNA, 75 bp, Artificial Sequence
  Synthetic
tatgacggataccctacatttggagagcacaagcaagagaaggatctcgagtatggggcatgcccgaataacatg

SEQ ID NO: 66485 - DNA, 75 bp, Artificial Sequence
  Synthetic
ttaggtaagtttggccaacagtctggagccatctatgtgggcaacttcagggtggtgaatcgtcatcttgccact

SEQ ID NO: 66486 - DNA, 75 bp, Artificial Sequence
  Synthetic
gtccgccattggcaacacaatcgaggctcttttccaaggcccacccaagttcaggccaattaggattagccttga

SEQ ID NO: 66487 - DNA, 75 bp, Artificial Sequence
  Synthetic
cacttctgtttccccggaccgagtatcaatagactgctcacgcggttgagggagaaaacgtccgttacccggcta

SEQ ID NO: 66488 - DNA, 75 bp, Artificial Sequence
  Synthetic
gagccatctatgtgggcaacttcagggtggtgaatcgtcatcttgccactcacaatgattgggcaaacttagtgt

SEQ ID NO: 66489 - DNA, 75 bp, Artificial Sequence
  Synthetic
atgaagcacgtcagagcgtggatacctcggccgatgcgcaatcagaactatttgttcaaatccaacccaaactat

SEQ ID NO: 66490 - DNA, 75 bp, Artificial Sequence
  Synthetic
ctcggccgatgcgcaatcagaactatttgttcaaatccaacccaaactatgctggtaattccattaaaccaactg

SEQ ID NO: 66491 - DNA, 75 bp, Artificial Sequence
  Synthetic
gccagactggagtgtattattgcaactcccgaagaaaacactacccagttagtttctctaagcctagtttaattt

SEQ ID NO: 66492 - DNA, 75 bp, Artificial Sequence
  Synthetic
gaaattggatactccgaagacgcagtgtctctcatagaagggatcaatcacacccatcatgtgtaccgcaataaa

SEQ ID NO: 66493 - DNA, 75 bp, Artificial Sequence
  Synthetic
ctcccgaagaaaacactacccagttagtttctctaagcctagtttaatttttgtggaagctagtgagtactaccc

SEQ ID NO: 66494 - DNA, 75 bp, Artificial Sequence
  Synthetic
tcattgcactggctgctgcccaacccaattttagtttgaagctggccaaagacacagactatctagcccagagtg

SEQ ID NO: 66495 - DNA, 75 bp, Artificial Sequence
  Synthetic
gggtagtaaacagacacctagccacccatactgactgggccaacttggtgtgggaagacagctctagagacctcc

SEQ ID NO: 66496 - DNA, 75 bp, Artificial Sequence
  Synthetic
ccatactgactgggccaacttggtgtgggaagacagctctagagacctcctagtttcttcaactaccgctcaagg

SEQ ID NO: 66497 - DNA, 75 bp, Artificial Sequence
  Synthetic
tcaacatggggttgtgggcattgtctccactgggggtaatggcttggtcggattcgctgacgtcagggatctctt

SEQ ID NO: 66498 - DNA, 75 bp, Artificial Sequence
  Synthetic
cattcaaagggatagatctagatgaactgaacatggtggcctacggggatgatgtgttggctagttaccccttcc

SEQ ID NO: 66499 - DNA, 75 bp, Artificial Sequence
  Synthetic
tccactgggggtaatggcttggtcggattcgctgacgtcagggatctcttatggttagatgaagaggccatggag

SEQ ID NO: 66500 - DNA, 75 bp, Artificial Sequence
  Synthetic
cagtttttcgaaacctagtttggtgtttgtagaagctagtgagtattatccagctagatatcagtcccatcttat

SEQ ID NO: 66501 - DNA, 75 bp, Artificial Sequence
  Synthetic
tttgtagaagctagtgagtattatccagctagatatcagtcccatcttatgcttgctgagggccattcagaacct

SEQ ID NO: 66502 - DNA, 75 bp, Artificial Sequence
  Synthetic
gtggaagccctgaaaaatcacttagtcggctcggagggagcagtggagaagatcttgaagaacctggtgaaactc

SEQ ID NO: 66503 - DNA, 75 bp, Artificial Sequence
  Synthetic
cgcaaccaggaaaaactatttgggtggagcacaaattagttaatgtgttggatgctgttgaattagtggatgagc

SEQ ID NO: 66504 - DNA, 75 bp, Artificial Sequence
  Synthetic
tcggctcggagggagcagtggagaagatcttgaagaacctggtgaaactcatttcagccttggtcatagtcatta

SEQ ID NO: 66505 - DNA, 75 bp, Artificial Sequence
  Synthetic
ggatttgctgacgttagagatcttctgtggctagatgaggaagcgatggagcagggggtatctgattacatcaaa

SEQ ID NO: 66506 - DNA, 75 bp, Artificial Sequence
  Synthetic
tgtggctagatgaggaagcgatggagcagggggtatctgattacatcaaaggtctcggtgatgccttcggcacag

SEQ ID NO: 66507 - DNA, 75 bp, Artificial Sequence
  Synthetic
tcaagtcaaaaactgctgccatattgggcattccgatggcccagaaacagagtgcgtcttggttgaagaaattca

SEQ ID NO: 66508 - DNA, 75 bp, Artificial Sequence
  Synthetic
tctgaatctcagcggtaagcccacacaccgaaccatgatgtacaatttccctacaaaggcaggacagtgtggagg

SEQ ID NO: 66509 - DNA, 75 bp, Artificial Sequence
  Synthetic
gggcattccgatggcccagaaacagagtgcgtcttggttgaagaaattcaatgacatggcaaatgctgcaaaggg

SEQ ID NO: 66510 - DNA, 75 bp, Artificial Sequence
  Synthetic
gccgctacattactcagaagttattttactgaagagcagggacaaatagagtggatggaaaccaacaaagagtca

SEQ ID NO: 66511 - DNA, 75 bp, Artificial Sequence
  Synthetic
agatcttgaagaacttggtgaagctaatttcagccttagttatagtcatcagaagtgattatgatatggtcaccc

SEQ ID NO: 66512 - DNA, 75 bp, Artificial Sequence
  Synthetic
aatttcagccttagttatagtcatcagaagtgattatgatatggtcaccctcacagccacactagctctgatcgg

SEQ ID NO: 66513 - DNA, 75 bp, Artificial Sequence
  Synthetic
gtggaggagtggtgacatctgttgggaaggttatcggtattcacattggtggcaatggcagacagggtttttgcg

SEQ ID NO: 66514 - DNA, 75 bp, Artificial Sequence
  Synthetic
aaaggttgagtttctaaataacctcaagcagttgcctttattggagaatcaaatatctaacttagagcagtctgc

SEQ ID NO: 66515 - DNA, 75 bp, Artificial Sequence
  Synthetic
caccagtaatctggtcgcgttaatgactggtgggggtaaatttgttataaccagaatagcaaaaaaaaaaaaaaa

SEQ ID NO: 66516 - DNA, 75 bp, Artificial Sequence
  Synthetic
tgcctctcaggaggaccttgaagctatgtttggtaacgtatcatacctggctcacttttgtcgcaaattccagcc

SEQ ID NO: 66517 - DNA, 75 bp, Artificial Sequence
  Synthetic
gagtgcctcatggctaaagaagttcaatgacatggcaaatgctgcaaaagggcttgagtggatttccaacaagat

SEQ ID NO: 66518 - DNA, 75 bp, Artificial Sequence
  Synthetic
tacacaggaagcggcaaacatcatagtcggttatggtgagtggccctcatactgctctgatgacgacgctacagc

SEQ ID NO: 66519 - DNA, 75 bp, Artificial Sequence
  Synthetic
caatagactgctcacgcggttgaaggagaaaacgttcgttacccggctaactacttcgagaaacctagtagcacc

SEQ ID NO: 66520 - DNA, 75 bp, Artificial Sequence
  Synthetic
aaaacagctccccttgttggagaaccaggtctccaatcttgaacagtctgctgcctcacaagaagacttagaagc

SEQ ID NO: 66521 - DNA, 75 bp, Artificial Sequence
  Synthetic
attatcagaggctcaccagggacaggcaaatcacttgccacaggcattattgccagagctatcgctgataaatat

SEQ ID NO: 66522 - DNA, 75 bp, Artificial Sequence
  Synthetic
gacgacctgtgtcaaaatcccgatggtaaagacatgtcgttgttctgccaaatggtgtccactgttgacttcatc

SEQ ID NO: 66523 - DNA, 75 bp, Artificial Sequence
  Synthetic
gtaaagacatgtcgttgttctgccaaatggtgtccactgttgacttcatccctccgatggcatccctagaagaga

SEQ ID NO: 66524 - DNA, 75 bp, Artificial Sequence
  Synthetic
agtctacgctttagagaaaaggatgaataactacatgcagttcaagagcaaacaccgtattgaacctgtatgctt

SEQ ID NO: 66525 - DNA, 75 bp, Artificial Sequence
  Synthetic
gggacagtggcaggcggcacaggaacagaggacagccaccctccttacaaacaaacacaaccaggtgccgacggt

SEQ ID NO: 66526 - DNA, 75 bp, Artificial Sequence
  Synthetic
tagctagagccattgctgacaagtatcgctctagtgtatactcactccccccagacccagatcactttgatgggt

SEQ ID NO: 66527 - DNA, 75 bp, Artificial Sequence
  Synthetic
attctgatgctatccgcaggaggtttttcatggactgtgatattgaagtaactgactcttacaagacagatctcg

SEQ ID NO: 66528 - DNA, 75 bp, Artificial Sequence
  Synthetic
tttcatggactgtgatattgaagtaactgactcttacaagacagatctcgggcgcttggatgcgggtagggccgc

SEQ ID NO: 66529 - DNA, 75 bp, Artificial Sequence
  Synthetic
ataagcaacaggtggtcacggtcatggatgatctctgccagaacccggacggaaaagacatgtccctattttgtc

SEQ ID NO: 66530 - DNA, 75 bp, Artificial Sequence
  Synthetic
aaatggtttctacagtagattttataccacccatggcatcactagaggagaaaggagtgtccttcacctctaagt

SEQ ID NO: 66531 - DNA, 75 bp, Artificial Sequence
  Synthetic
accacccatggcatcactagaggagaaaggagtgtccttcacctctaagtttgtcattgcatcgaccaatgctag

SEQ ID NO: 66532 - DNA, 75 bp, Artificial Sequence
  Synthetic
gagagataggaagtccaaggttaggtatagtgttgatactgtggtgtcagaactggtcagagagtataataatag

SEQ ID NO: 66533 - DNA, 75 bp, Artificial Sequence
  Synthetic
tatagtgttgatactgtggtgtcagaactggtcagagagtataataatagatcagccatagggaacaccatagaa

SEQ ID NO: 66534 - DNA, 75 bp, Artificial Sequence
  Synthetic
aagaccccagactgaaagtagactttgaggaggccatattttcaaagtatgtgggtaatgtcaatgtacacatgg

SEQ ID NO: 66535 - DNA, 75 bp, Artificial Sequence
  Synthetic
gacagattcttacaagacagacctcggtcggctggacgcaggtagagctgccaagctttgtacagaaaataacac

SEQ ID NO: 66536 - DNA, 75 bp, Artificial Sequence
  Synthetic
ggtcggctggacgcaggtagagctgccaagctttgtacagaaaataacactgctaatttcaagagatgcagccca

SEQ ID NO: 66537 - DNA, 75 bp, Artificial Sequence
  Synthetic
agtgatttgcttgctagtgttgacagtgaagaggtgcggcagtactgcagagatcaagggtggataatacctgag

SEQ ID NO: 66538 - DNA, 75 bp, Artificial Sequence
  Synthetic
gtgaagaggtgcggcagtactgcagagatcaagggtggataatacctgagacaccaactaatatagagcgacacc

SEQ ID NO: 66539 - DNA, 75 bp, Artificial Sequence
  Synthetic
acaagttgttcgccggttttcaaggagcatattccggcgcccccaagcaaacactcaagaaaccagtgctgcgca

SEQ ID NO: 66540 - DNA, 75 bp, Artificial Sequence
  Synthetic
gaactgatcagagagtacaacaatagatctgctattgggaatactatagaagcactctttcaaggaccccctaaa

SEQ ID NO: 66541 - DNA, 75 bp, Artificial Sequence
  Synthetic
ctacctattcaaagccaacccaaattatgctggcaactccattaagccaactggtgccagtcgcacagcgatcac

SEQ ID NO: 66542 - DNA, 75 bp, Artificial Sequence
  Synthetic
agttgtttgctggtttccaaggtgcatactccggagcgcccaagcaaaccctcaagaaacctgtgttgaggacag

SEQ ID NO: 66543 - DNA, 75 bp, Artificial Sequence
  Synthetic
atactccggagcgcccaagcaaaccctcaagaaacctgtgttgaggacagctactgttcaagggcctagcctaga

SEQ ID NO: 66544 - DNA, 75 bp, Artificial Sequence
  Synthetic
gatctgctattgggaatactatagaagcactctttcaaggaccccctaaattcaggcctataagaattagtctcg

SEQ ID NO: 66545 - DNA, 75 bp, Artificial Sequence
  Synthetic
acgcgatcgccttgctatcttgccccgtcattcacaaccaggcaaaaccatctggattgagcataagctggtcaa

SEQ ID NO: 66546 - DNA, 75 bp, Artificial Sequence
  Synthetic
ctcaatagagcagtattggtaatgcagtccatcgccactgtggttgcagttgtgtctcttgtttatgtcatttat

SEQ ID NO: 66547 - DNA, 75 bp, Artificial Sequence
  Synthetic
cgtcattcacaaccaggcaaaaccatctggattgagcataagctggtcaatgtacttgatgctgttgagctagtg

SEQ ID NO: 66548 - DNA, 75 bp, Artificial Sequence
  Synthetic
cttactctggagcgcccaagcaaattctcaagaagcccgtgttaagaacagccacggtccaagggcccagcttag

SEQ ID NO: 66549 - DNA, 75 bp, Artificial Sequence
  Synthetic
ggctcgaattattttaatatacagttcaaagctgaaccccaccagaaatctggtcgtgttaatgactggtggggg

SEQ ID NO: 66550 - DNA, 75 bp, Artificial Sequence
  Synthetic
ttcattccagagagcatcagcggtgctagcgatgccacattggtgatcaacaccgaacacatgccgtcgatgttt

SEQ ID NO: 66551 - DNA, 75 bp, Artificial Sequence
  Synthetic
agacgcagggatccctttgagccaattgactgtgtgcccacatcagtggattaacttaagaactaacaattgtgc

SEQ ID NO: 66552 - DNA, 75 bp, Artificial Sequence
  Synthetic
gtcccagtaggggatgttgtacaatatgggtttctaaatctcagtggtaaaccaacccacaggaccatgatgtac

SEQ ID NO: 66553 - DNA, 75 bp, Artificial Sequence
  Synthetic
gcgccactcgcaaccagggaagaccatctgggtagagcataaattaatcaatgtactagatgcagttgagttggt

SEQ ID NO: 66554 - DNA, 75 bp, Artificial Sequence
  Synthetic
aaccattatagttccatatatgaacacagttccttttgactcagctctcaaccactgcaactttggtctactggt

SEQ ID NO: 66555 - DNA, 75 bp, Artificial Sequence
  Synthetic
atctgggtagagcataaattaatcaatgtactagatgcagttgagttggtggatgagcaaggtgtaaacttggaa

SEQ ID NO: 66556 - DNA, 75 bp, Artificial Sequence
  Synthetic
tgaaggattagaggcattggatttaactactagtgcagggtacccatatgtaacattagggattaagaaaaggga

SEQ ID NO: 66557 - DNA, 75 bp, Artificial Sequence
  Synthetic
ggcaatgggcggcaagggttctgtgctggtctgaagaggagttattttgcaagtgaacaaggtgagatccagtgg

SEQ ID NO: 66558 - DNA, 75 bp, Artificial Sequence
  Synthetic
gcgagtgacgcaactctagtcatcaacactgagcacatgccctcaatgtttgtgccggtgggtgacgttgtgcag

SEQ ID NO: 66559 - DNA, 75 bp, Artificial Sequence
  Synthetic
tgtgccggtgggtgacgttgtgcagtacgggtttctgaaccttagtggtaaacccacacacagaaccatgatgta

SEQ ID NO: 66560 - DNA, 75 bp, Artificial Sequence
  Synthetic
catgacgtgtttgagggcaataaggaaccagcggtcttgacaagcaaggatcccagactggaggttgattttgaa

SEQ ID NO: 66561 - DNA, 75 bp, Artificial Sequence
  Synthetic
aaccagcggtcttgacaagcaaggatcccagactggaggttgattttgaacaagccctcttctccaagtacgtgg

SEQ ID NO: 66562 - DNA, 75 bp, Artificial Sequence
  Synthetic
gtaagatcattggaatccacattggcgggaatggacgccagggcttttgcgctggcctaaagaggagttattttg

SEQ ID NO: 66563 - DNA, 75 bp, Artificial Sequence
  Synthetic
gatgaagcctaacagagaaaccgggaggttgaatattaatggtccaacccgaactaagctggaacccagtgtatt

SEQ ID NO: 66564 - DNA, 75 bp, Artificial Sequence
  Synthetic
acataaacaccaacaaaatgagcatggaggaagcatgctatggcacagaaaacttagaagctattgacctccata

SEQ ID NO: 66565 - DNA, 75 bp, Artificial Sequence
  Synthetic
ggaggaagcatgctatggcacagaaaacttagaagctattgacctccatactagcgctgggtacccatacagtgc

SEQ ID NO: 66566 - DNA, 75 bp, Artificial Sequence
  Synthetic
tggccattcctaattttgagaatttgagaagaaattggctcgaattattttaacagtacagcttaaagctgaacc

SEQ ID NO: 66567 - DNA, 75 bp, Artificial Sequence
  Synthetic
atacggcctggacttgccctactccacctatgtgaaagatgagcttaggtctctagacaagatcaagaaagggaa

SEQ ID NO: 66568 - DNA, 75 bp, Artificial Sequence
  Synthetic
ggtaacaccctgcatgaacctgatgagtacgtgacacaggctgctctccactacgcaaatcagctgaagcaactg

SEQ ID NO: 66569 - DNA, 75 bp, Artificial Sequence
  Synthetic
tagtgtccacgggtggcaacgggctcgttggttttgctgatgtgagggatctcttgtggttagatgaagaagcca

SEQ ID NO: 66570 - DNA, 75 bp, Artificial Sequence
  Synthetic
acctatgtgaaagatgagcttaggtctctagacaagatcaagaaagggaaatctcgcttaatagaagctagcagt

SEQ ID NO: 66571 - DNA, 75 bp, Artificial Sequence
  Synthetic
tctgactctgacgctattcgccgcaggttctacatggactgtgacattgaagtgacagactcgtacaaaacagat

SEQ ID NO: 66572 - DNA, 75 bp, Artificial Sequence
  Synthetic
ctattacaccactggcatcataaccatatggtatcaaactaactatgtcgtacccattggtgctcccactacagc

SEQ ID NO: 66573 - DNA, 75 bp, Artificial Sequence
  Synthetic
taaggggcttggtgacgcgtttgggacaggcttcaccgatgctgtatccagggaagttgaagcccttagaaacca

SEQ ID NO: 66574 - DNA, 75 bp, Artificial Sequence
  Synthetic
accagtgctggatacccttatagtgctttgggcatcaagaaaagagacatcctcgacccagttaccagagacacc

SEQ ID NO: 66575 - DNA, 75 bp, Artificial Sequence
  Synthetic
acagggtcagcagttgggtgtaacccagatgtgttctggagtaagctcccgattctactgcctggatcattgttt

SEQ ID NO: 66576 - DNA, 75 bp, Artificial Sequence
  Synthetic
ctttgggcatcaagaaaagagacatcctcgacccagttaccagagacacctccaggatgaagttatatatggata

SEQ ID NO: 66577 - DNA, 75 bp, Artificial Sequence
  Synthetic
agggcaaagaagaaagttgaggctggcaaatccagattgattgaagcttccagtttaaatgattcggttgcaatg

SEQ ID NO: 66578 - DNA, 75 bp, Artificial Sequence
  Synthetic
agtctcgcctgattgaggctagcagcttaaatgattctgtctaccttagaatgacttttggacacctttatgaag

SEQ ID NO: 66579 - DNA, 75 bp, Artificial Sequence
  Synthetic
attggttattcggaagaagcagtgtcactcatagagggaataaaccacacccaccatgtgtaccgaaataaaaca

SEQ ID NO: 66580 - DNA, 75 bp, Artificial Sequence
  Synthetic
aaggggtggtattggaagtttcctgatgtactgactgagaccggggtctttggccaaaacgcacagtttcactat

SEQ ID NO: 66581 - DNA, 75 bp, Artificial Sequence
  Synthetic
cttaaatgattctgtctaccttagaatgacttttggacacctttatgaagtgtttcacgccaacccagggactgt

SEQ ID NO: 66582 - DNA, 75 bp, Artificial Sequence
  Synthetic
tgcatttgactactcaggatatgatgcaagccttagtcctgtgtggttcagagctctagagttggttctgagaga

SEQ ID NO: 66583 - DNA, 75 bp, Artificial Sequence
  Synthetic
gcaagccttagtcctgtgtggttcagagctctagagttggttctgagagagatcggttactcggaggaggctgtg

SEQ ID NO: 66584 - DNA, 75 bp, Artificial Sequence
  Synthetic
tcaaagggatagatctggatgagttaaacatggtggcttatggagatgatgtactagctagttaccctttcccca

SEQ ID NO: 66585 - DNA, 75 bp, Artificial Sequence
  Synthetic
ttaatgaggtaacgtgggagaatgctacgttcctgaagagagggttccttccagaccatcaatttccatttttaa

SEQ ID NO: 66586 - DNA, 75 bp, Artificial Sequence
  Synthetic
acgtgcgttctctgtgcctattagcttggcacaatggtaaggatgagtatgaaaaatttgtgagtacaatcagat

SEQ ID NO: 66587 - DNA, 75 bp, Artificial Sequence
  Synthetic
ttggcagactgccaccaacccatctgtgtttgtgaaaatgacggacccgccagctcaagtgtcagtccccttcat

SEQ ID NO: 66588 - DNA, 75 bp, Artificial Sequence
  Synthetic
caggcaaagaatatgggctgactatgactcctgctgataaatcaccttgtttcaatgaggttacctgggagaatg

SEQ ID NO: 66589 - DNA, 75 bp, Artificial Sequence
  Synthetic
ttattcttatattggctgcttatggtgacaattgagagattgttaccatatagctattggattggccatccagtg

SEQ ID NO: 66590 - DNA, 75 bp, Artificial Sequence
  Synthetic
aaatccatgagtccatccgctggaccaaggacgcgcgcaatactcaagatcatgtgcgctccctttgtctcctgg

SEQ ID NO: 66591 - DNA, 75 bp, Artificial Sequence
  Synthetic
tagagaaccagatctcaaacctagaacaatctgctgcttcacaagaggaccttgaagcaatgtttggaaatgtgt

SEQ ID NO: 66592 - DNA, 75 bp, Artificial Sequence
  Synthetic
caataccaaattttgagaacttgagaagaaattggctcgagttattttaaacttacagctcaatgctgaacccca

SEQ ID NO: 66593 - DNA, 75 bp, Artificial Sequence
  Synthetic
gcactctggtaccacggtacctttgtgcgcctgttttatctccccaaacccccgtaacgctacactagaagatag

SEQ ID NO: 66594 - DNA, 75 bp, Artificial Sequence
  Synthetic
ttcctgtaatgctggatggggagatttttgcatttgattatacagggtatgatgcctccctgagcccagtctggt

SEQ ID NO: 66595 - DNA, 75 bp, Artificial Sequence
  Synthetic
atagaagggatcaaccacacccaccatgtgtatcggaacaagacatattgtgtccttggtggaatgccctcaggc

SEQ ID NO: 66596 - DNA, 75 bp, Artificial Sequence
  Synthetic
ggctagctatccattccctgttgactgctcggaattggccaagaccggtaaggagtatggactaacaatgacacc

SEQ ID NO: 66597 - DNA, 75 bp, Artificial Sequence
  Synthetic
ttaaccctcaatacaatcaaacatgggctcacaggtgtccactcaacgatccggctcccatgaaaactctaattc

SEQ ID NO: 66598 - DNA, 75 bp, Artificial Sequence
  Synthetic
gacaattgagagattgttaccatatagctattggattggccatccggtgtgtaatagagctatcatatattcttt

SEQ ID NO: 66599 - DNA, 75 bp, Artificial Sequence
  Synthetic
ggaagtagaggcattgaagaaccatttaactggctcggaaggagctgttgagaagatcttgaagaacttggtgaa

SEQ ID NO: 66600 - DNA, 75 bp, Artificial Sequence
  Synthetic
tcaagcatgggctcacaggtgtccacgcaacgctccggctcgcatgaaaactctaactcagctactgagggctcc

SEQ ID NO: 66601 - DNA, 75 bp, Artificial Sequence
  Synthetic
cgcaacgctccggctcgcatgaaaactctaactcagctactgagggctccaccataaactacactaccattaatt

SEQ ID NO: 66602 - DNA, 75 bp, Artificial Sequence
  Synthetic
ggagcgcaggtgtcaacaaccaaaaccgggtctcatgaaaatggaaatattgcgacagggggctctacaataaat

SEQ ID NO: 66603 - DNA, 75 bp, Artificial Sequence
  Synthetic
ccgggtctcatgaaaatggaaatattgcgacagggggctctacaataaattacaccaacatcaactattataggg

SEQ ID NO: 66604 - DNA, 75 bp, Artificial Sequence
  Synthetic
gttcaaagctgaaccccaccagaaatctggtcgtgttaatgactggtgggggtaaatttgttataaccagaatag

SEQ ID NO: 66605 - DNA, 75 bp, Artificial Sequence
  Synthetic
cattaagggaagttgcacctccactgaaatccccttctgcagaagcgtgcggttacagtgacagggttgctcaac

SEQ ID NO: 66606 - DNA, 75 bp, Artificial Sequence
  Synthetic
tgatgccagcctcagccctgtctggttcagagcattagaattggttctcagggagatagggtatagtgaagaggc

SEQ ID NO: 66607 - DNA, 75 bp, Artificial Sequence
  Synthetic
gcactattttgttagagggggcatgccttctggatgttcaggaacatcaatttttaactccatgatcaataacat

SEQ ID NO: 66608 - DNA, 75 bp, Artificial Sequence
  Synthetic
gtgggatatggtgagtggccagaatactgccctgatgttgatgcaactgccgttgacaagcccacgagaccagac

SEQ ID NO: 66609 - DNA, 75 bp, Artificial Sequence
  Synthetic
tgtgtctaagatgaaattctatatggataaatacgggctagatctgccatactccacctacgtgaaggatgagct

SEQ ID NO: 66610 - DNA, 75 bp, Artificial Sequence
  Synthetic
cctgatatcctcactgaaaagggagtatttggacaaaatgcccagtttcattatttatatagatcgggattctgt

SEQ ID NO: 66611 - DNA, 75 bp, Artificial Sequence
  Synthetic
cctcaacagctccgcatcctgactataaagccacgcaacccggacctgacggtgctgagctgcaatacccctatg

SEQ ID NO: 66612 - DNA, 75 bp, Artificial Sequence
  Synthetic
ctcagcacccattctgccaaatttccatcccactccatgtattcacatacccggtgaagtcagaaacctgctcga

SEQ ID NO: 66613 - DNA, 75 bp, Artificial Sequence
  Synthetic
gtttcgctcggcacaaccccagtgtagatcaggctgatgagtcactgcaacccccatgggcgaccatggcagtgg

SEQ ID NO: 66614 - DNA, 75 bp, Artificial Sequence
  Synthetic
gtgctacaatcataatgccttacatcaacagcgtgccctacgattcggccattaatcattgcaacttcacattgt

SEQ ID NO: 66615 - DNA, 75 bp, Artificial Sequence
  Synthetic
cattaagggaagttgcacctccactgaaatccccttcagcagaagcgtgcggttacagcgatagggtggcacaac

SEQ ID NO: 66616 - DNA, 75 bp, Artificial Sequence
  Synthetic
tcatcattagaacccttttaatcaaaacctttaagggaatagacctggatgagttgaacatggtggcctatgggg

SEQ ID NO: 66617 - DNA, 75 bp, Artificial Sequence
  Synthetic
ttacagttggcaactccaccatcaccacccaggaggctgccaacataattgtgggatatggtgagtggccggaat

SEQ ID NO: 66618 - DNA, 75 bp, Artificial Sequence
  Synthetic
tgtgagcgcgcttgctgacaccacaatatcccgggtgaccgcagccaacactgcagctagcacccactccctggg

SEQ ID NO: 66619 - DNA, 75 bp, Artificial Sequence
  Synthetic
cactgtgcgcggagtttgggggtttgcgtcaagcagtctctcaaggcttgccagtggagataaagcctgggtctt

SEQ ID NO: 66620 - DNA, 75 bp, Artificial Sequence
  Synthetic
ttggtgatcaggatttacatgaggatgaagcacgtcagggcgtggatacctcgcccaatgcgcaaccaaaattat

SEQ ID NO: 66621 - DNA, 75 bp, Artificial Sequence
  Synthetic
ccaaactttcaccccaccccatgtatccatatacctggtgaagtcaggaatttgctagagctgtgccaggtggag

SEQ ID NO: 66622 - DNA, 75 bp, Artificial Sequence
  Synthetic
ccggtctcagcacaagcagggaaaggtgagctgtgtgcggtgtttagagccgatcctgggcgaaatggaccatgg

SEQ ID NO: 66623 - DNA, 75 bp, Artificial Sequence
  Synthetic
atcaattcctgactacagacgatgaggtctctgccccaatactgccaggattccaacctaccccggaaatccaca

SEQ ID NO: 66624 - DNA, 75 bp, Artificial Sequence
  Synthetic
tgtttggacaaaatgcccagtttcattacttgtatagatcgggtttctgtgtccatgtccagtgcaatgctagca

SEQ ID NO: 66625 - DNA, 75 bp, Artificial Sequence
  Synthetic
ccagaagaatttcaccatgaaactgtgcaaagacactagtcacatattacagacagcctctattcagggagatag

SEQ ID NO: 66626 - DNA, 75 bp, Artificial Sequence
  Synthetic
ctcatggtatgtctaggttactgatccctgtgtctgcacaaacagccgctgataaactgtgtgcatcattcagag

SEQ ID NO: 66627 - DNA, 75 bp, Artificial Sequence
  Synthetic
agagttgtgccaagttgagacaatcctagaggttaacaacactactgacactcatggtatgtctaggttactgat

SEQ ID NO: 66628 - DNA, 75 bp, Artificial Sequence
  Synthetic
gataaactgtgtgcatcattcagagttgaccccgggcgaagcggcccgtgggaatctacactcctgggccagatc

SEQ ID NO: 66629 - DNA, 75 bp, Artificial Sequence
  Synthetic
gctggtatgggtgctggagataaaccctcaacagctccgcatcccgactataaagccacgcaacccggacctgat

SEQ ID NO: 66630 - DNA, 75 bp, Artificial Sequence
  Synthetic
cctcaacagctccgcatcccgactataaagccacgcaacccggacctgatggtgctgagctacaatacccctatg

SEQ ID NO: 66631 - DNA, 75 bp, Artificial Sequence
  Synthetic
aaaattgatgcaggcctactcgctcaggcgggaaaggagtacggcctaacaatgactccagctgacaagtctgac

SEQ ID NO: 66632 - DNA, 75 bp, Artificial Sequence
  Synthetic
ttaactcacacagtacagcagagactaccctggacagtttcttcagcagagcaggtttggtaggagagatagatc

SEQ ID NO: 66633 - DNA, 75 bp, Artificial Sequence
  Synthetic
cctcggtcaccttggtcatcccttggatcagcaattcacactatagaacagtggagactggcggcatactcgatt

SEQ ID NO: 66634 - DNA, 75 bp, Artificial Sequence
  Synthetic
cgaacattatagttggctatggtgagtggccctcctactgctcggattctgacgctacagcagtggacaaaccaa

SEQ ID NO: 66635 - DNA, 75 bp, Artificial Sequence
  Synthetic
ccagtagaaataaagcctgggtcttatcaattcctgactacagacgacgaggtctctgccccaatattgccagga

SEQ ID NO: 66636 - DNA, 75 bp, Artificial Sequence
  Synthetic
tgtcacccgcgagcgcttaccagtggttttacgacgggtaccccacgtttggagaacacaaacaggagaaagatc

SEQ ID NO: 66637 - DNA, 75 bp, Artificial Sequence
  Synthetic
atgacatggccaacgccgctaaggggttagagtgggtttccaacaagatcagcaaatttattgattggcttaagg

SEQ ID NO: 66638 - DNA, 75 bp, Artificial Sequence
  Synthetic
gtggatcgattcaaccagtgacagctgctaacactcagcccagttcacatcggcttgggacagggcaggtaccag

SEQ ID NO: 66639 - DNA, 75 bp, Artificial Sequence
  Synthetic
cactgcaagcggcggagacaggagcaacttcaaacgccaccgatgagagcatgattgaaaccaggtgtgtggtca

SEQ ID NO: 66640 - DNA, 75 bp, Artificial Sequence
  Synthetic
gcgccgatggttttgagttacaacacccgtacgtgcttgatgctggcattccaatatcacaattaacagtgtgcc

SEQ ID NO: 66641 - DNA, 75 bp, Artificial Sequence
  Synthetic
aagatgctcatagcctacacaccacccggtggagaacagcccaagacacgtgatgtggccatgctgggcacccat

SEQ ID NO: 66642 - DNA, 75 bp, Artificial Sequence
  Synthetic
aggattctggaacctctacaaaggggtatgccacttgggaaattgatgtgatgggatttgtccaattgagacgca

SEQ ID NO: 66643 - DNA, 75 bp, Artificial Sequence
  Synthetic
taccctgctagataccaatcgcacctgatgcttgcagcgggccactctgagcccggcgactgcggaggcatctta

SEQ ID NO: 66644 - DNA, 75 bp, Artificial Sequence
  Synthetic
atgggatttgtccaattgagacgcaagctggaaatgttcacatacatgcgatttgacgcagagttcacctttatc

SEQ ID NO: 66645 - DNA, 75 bp, Artificial Sequence
  Synthetic
aagaaattcatgagtccattagatggacaaaggacgcccgatgtacccaagaacatgtgaggtcattgtgtgaat

SEQ ID NO: 66646 - DNA, 75 bp, Artificial Sequence
  Synthetic
gatcagcaattcacattatagaacagtggagactggtggcatactcgattactactccacagggatagtgaccat

SEQ ID NO: 66647 - DNA, 75 bp, Artificial Sequence
  Synthetic
caccagtgatccctattaccatcacattagccccaatgtgctctgaatttgcaggtcttaggcaagctgtcacgc

SEQ ID NO: 66648 - DNA, 75 bp, Artificial Sequence
  Synthetic
aatctgagacgcaattggctcgaattattttagaggtcagatatacctcaaccccaccagggatctggtcgtgaa

SEQ ID NO: 66649 - DNA, 75 bp, Artificial Sequence
  Synthetic
acgggcagtgccccaacaataaaatgggtactttctgcattcgcatggtgtcaggagtatcaacgggcaaagatg

SEQ ID NO: 66650 - DNA, 75 bp, Artificial Sequence
  Synthetic
agagagaaagcagaattcttaaccaacttgaagcaattgccactgttagagaaccagatcacaaatttagaacag

SEQ ID NO: 66651 - DNA, 75 bp, Artificial Sequence
  Synthetic
agacccatcaggagtcagccctacttgttgaagaactacccaaactttgataaggcaaatattgcggacgcttca

SEQ ID NO: 66652 - DNA, 75 bp, Artificial Sequence
  Synthetic
gaaccagatcacaaatttagaacagtccgctgcctcacaagaggaccttgaagccatgtttgggaatgtgtcata

SEQ ID NO: 66653 - DNA, 75 bp, Artificial Sequence
  Synthetic
taccgatcctgctgccaggatcgctctttgcatttgactattcaggatatgatgcaagtctcagcccagtgtggt

SEQ ID NO: 66654 - DNA, 75 bp, Artificial Sequence
  Synthetic
acaatgattggaccaacttggtgtgggaagacagttcgagagaccttctagtctcctccaccactgcacaggggt

SEQ ID NO: 66655 - DNA, 75 bp, Artificial Sequence
  Synthetic
gtttctcaaaacccagcctcattttcgtggaggccaacgagtattaccctgccaggtatcaatcccacctcatgc

SEQ ID NO: 66656 - DNA, 75 bp, Artificial Sequence
  Synthetic
aaacagcaacaaacccatcagtgatttcgaagatgacagacccgccagctcaggtgtcagtaccatttatgagcc

SEQ ID NO: 66657 - DNA, 75 bp, Artificial Sequence
  Synthetic
ctatgaaattatgtaaggatgccagtgatatcttacagacaggcactattcaaggagatagggtggcagatgtga

SEQ ID NO: 66658 - DNA, 75 bp, Artificial Sequence
  Synthetic
aggtaagcagccaccgattggatactggtaaagttccagcactccaagccgctgagattggagcatcatcaaatg

SEQ ID NO: 66659 - DNA, 75 bp, Artificial Sequence
  Synthetic
tggttagatgaggaagccatggaacaaggcgtgtccgattacatcaagggactaggcgatgccttcggcacgggc

SEQ ID NO: 66660 - DNA, 75 bp, Artificial Sequence
  Synthetic
gaagcacgtgcgcgcttgggtacctagacccatcaggagtcagccctacttgttgaagaactacccaaattttga

SEQ ID NO: 66661 - DNA, 75 bp, Artificial Sequence
  Synthetic
gtggtcaatcgccacttggccacacacaatgattggaccaatttggtgtgggaagacagttcaagagaccttcta

SEQ ID NO: 66662 - DNA, 75 bp, Artificial Sequence
  Synthetic
tagcgtggcataatgggaaggaggaatatgaaaaatttgtgagcacaattagatcagttcccattggaaaagcct

SEQ ID NO: 66663 - DNA, 75 bp, Artificial Sequence
  Synthetic
ggcattcccatggcacagaaacagagtgcatcttggttgaagaagttcaatgacatggcaaacgctgcaaaagga

SEQ ID NO: 66664 - DNA, 75 bp, Artificial Sequence
  Synthetic
gcccaccggggaggttgtcccacaattgctccaatacatgtttgtgccacctggggcccccaagccagactccag

SEQ ID NO: 66665 - DNA, 75 bp, Artificial Sequence
  Synthetic
taatatacagtttaaaactgaaccccaccagaagtctggtcgtgttaatgactggtgggggtaaatttgttataa

SEQ ID NO: 66666 - DNA, 75 bp, Artificial Sequence
  Synthetic
cactctggtatcttggtacctttgtgcgcctgttttatacccccccccagtgaaacttagaagcagcaaaccacg

SEQ ID NO: 66667 - DNA, 75 bp, Artificial Sequence
  Synthetic
caactggtggcaatggcctagtagggtttgccagtgttagagatctcctatggttagatgaggaagccatggaac

SEQ ID NO: 66668 - DNA, 75 bp, Artificial Sequence
  Synthetic
atcaatagcaggcataacgctccagttatgtcttgatcaagcacttctgtttccccggactgagtatcaatagac

SEQ ID NO: 66669 - DNA, 75 bp, Artificial Sequence
  Synthetic
tggttagatgaggaagccatggaacagggcgtgtccgattacattaaggggctaggcgatgccttcggcacgggc

SEQ ID NO: 66670 - DNA, 75 bp, Artificial Sequence
  Synthetic
gtgcccacaccagtggattaatttgaggaccaacaattgtgctacaataatagtgccatacattaacgcactgcc

SEQ ID NO: 66671 - DNA, 75 bp, Artificial Sequence
  Synthetic
gcaacagggattatcgctagagctatagcagacaagtatcactctagtgtgtattctttacctccagatccagat

SEQ ID NO: 66672 - DNA, 75 bp, Artificial Sequence
  Synthetic
ggaacctagtgtgttccatgacgtgtttgagggcaataaggaaccagcagtcctaacaagcaaagatcctagatt

SEQ ID NO: 66673 - DNA, 75 bp, Artificial Sequence
  Synthetic
atcctaaagaatttggtaaagctcatctcagctctagtcatagttattaggagcgactatgatatggtcactctt

SEQ ID NO: 66674 - DNA, 75 bp, Artificial Sequence
  Synthetic
atacagtgtggatacggtggtttcagaacttattagggaatacagcaataggtccgccattggcaacacaatcga

SEQ ID NO: 66675 - DNA, 75 bp, Artificial Sequence
  Synthetic
ggcatccccatggcgcagaaacagagcgcatcttggttaaagaagttcaatgacatggcaaacgctgcaaaagga

SEQ ID NO: 66676 - DNA, 75 bp, Artificial Sequence
  Synthetic
tgtctcgttggtgtatgtcatctacaagctctttgcagggtttcagggtgcgtattctggtgctcctaagcaagt

SEQ ID NO: 66677 - DNA, 75 bp, Artificial Sequence
  Synthetic
acattattgttccgacggtctcagattctgatgcaattcgcagaagattctttatggactgcgacattgaggtga

SEQ ID NO: 66678 - DNA, 75 bp, Artificial Sequence
  Synthetic
aacctttaagggaatagacctggatgagttgaacatggtggcctatggggacgatgtgttggctagttatccctt

SEQ ID NO: 66679 - DNA, 75 bp, Artificial Sequence
  Synthetic
atgtgagggatcttctatggttggatgatgaagccatggaacagggtgtgtctgattacatcaaagggcttggtg

SEQ ID NO: 66680 - DNA, 75 bp, Artificial Sequence
  Synthetic
cgttgagcgccacttgagtagagctgttttgattatgcaatccgtagccaccgtggtagcagttgtgtccctcgt

SEQ ID NO: 66681 - DNA, 75 bp, Artificial Sequence
  Synthetic
ttacccttgtaataccatggatcagcaacactcattatagagcacatgcccgagatggagtgtttgattactaca

SEQ ID NO: 66682 - DNA, 75 bp, Artificial Sequence
  Synthetic
tcaagctgcactccactatgcaaatcagcttaagcaactggacatcaatactaaaaagatgagcatggaggaagc

SEQ ID NO: 66683 - DNA, 75 bp, Artificial Sequence
  Synthetic
agcaggccgtgttgcagggtgatgcaatagccgacgctatacaaaacacggtcacatccaccatacagagggtca

SEQ ID NO: 66684 - DNA, 75 bp, Artificial Sequence
  Synthetic
cgaagaggttcgacagtattgcagggaaccaaggtggataattccggaagcaccaactaatgtggagcgacaccc

SEQ ID NO: 66685 - DNA, 75 bp, Artificial Sequence
  Synthetic
tgtgagtaagatgaagttctacatggacaagtatggtcttgacctcccttactctacctatgttaaggatgagct

SEQ ID NO: 66686 - DNA, 75 bp, Artificial Sequence
  Synthetic
acttgccctgattgggtgccacgggagcccttgggcctggatcaagtcgaaaacagcttcaattttgggcatacc

SEQ ID NO: 66687 - DNA, 75 bp, Artificial Sequence
  Synthetic
ctccgatgcaattcgcaggagattctttatggactgcgacattgaggtgaccgactcttacaaaacagaccttgg

SEQ ID NO: 66688 - DNA, 75 bp, Artificial Sequence
  Synthetic
gatttccaacaagatcagtaaatttatcgattggctcaaggagaaaatcatcccggctgctaaagaaaaagtcga

SEQ ID NO: 66689 - DNA, 75 bp, Artificial Sequence
  Synthetic
cacacaggtgagcagtcatcgactggatacaggcaaggttccagcactccaagctgctgaaattggagcatcatc

SEQ ID NO: 66690 - DNA, 75 bp, Artificial Sequence
  Synthetic
atatcaggcaggcgcaaactgaccagggacacttcaccatgctcggagtgcgtgaccgtctcgccatcctgcccc

SEQ ID NO: 66691 - DNA, 75 bp, Artificial Sequence
  Synthetic
tctgccatagggaacaccatagaagcactatttcaggggccacccaagtttaggccaataagaatcagtcttgaa

SEQ ID NO: 66692 - DNA, 75 bp, Artificial Sequence
  Synthetic
tagaagcaatacacaacactgatcaacagcaggcatggcgcaccagccatgtcttgatcaagcacttctgtttcc

SEQ ID NO: 66693 - DNA, 75 bp, Artificial Sequence
  Synthetic
gtaggcgtggcgcaccagccacgtcttggtcaagcacttctgtttccccggactgagtatcaatagactgctcac

SEQ ID NO: 66694 - DNA, 75 bp, Artificial Sequence
  Synthetic
tatgcggtttgatgcagaattcaccttcgtcaccaatctagaaaatgggctcacgaacaacagtgtgatccaata

SEQ ID NO: 66695 - DNA, 75 bp, Artificial Sequence
  Synthetic
cggaaatgcgagttgtttacctacatgcgctttgatgctgaattcacatttgtcgtagccaaacccaatggtgag

SEQ ID NO: 66696 - DNA, 75 bp, Artificial Sequence
  Synthetic
agggcacaactaacccaaatggttatgccaactgggacatagatataacaggttacgcgcaaatgcgtagaaagg

SEQ ID NO: 66697 - DNA, 75 bp, Artificial Sequence
  Synthetic
atttctaaataacttaaagcaacttcccttattggagaaccaaatctctaaccttgaacagtcagcagcttcaca

SEQ ID NO: 66698 - DNA, 75 bp, Artificial Sequence
  Synthetic
atgagcagggtgttaacttggaacttacgctggtgaccctagacaccaacgagaagtttagagacatcaccaaat

SEQ ID NO: 66699 - DNA, 75 bp, Artificial Sequence
  Synthetic
ttaaaacagcctgtgggttgtacccacccgcagggcccactgggcgctagtacactgatatcacggtacctttgt

SEQ ID NO: 66700 - DNA, 75 bp, Artificial Sequence
  Synthetic
caaagaaactggtaggttgaacattaatgggcctactcgtaccaagcttgagccaagtgtctttcatgatgtgtt

SEQ ID NO: 66701 - DNA, 75 bp, Artificial Sequence
  Synthetic
tatagcagataagtatcactctagtgtgtattctttgcctccagatccagatcattttgatggatataaacaaca

SEQ ID NO: 66702 - DNA, 75 bp, Artificial Sequence
  Synthetic
tgccaaaacccggatgggaaagacatgtcactattttgtcagatggtttccacagtggactttataccgcctatg

SEQ ID NO: 66703 - DNA, 75 bp, Artificial Sequence
  Synthetic
gcaatggacgccaaggtttctgtgctggtctgaagaggagctactttgctagtgagcaaggcgagatccagtggg

SEQ ID NO: 66704 - DNA, 75 bp, Artificial Sequence
  Synthetic
atgatgtgtttgagggcagcaaagaaccagcagttttaacaaataaagatcctagactagaagtcgactttgagc

SEQ ID NO: 66705 - DNA, 75 bp, Artificial Sequence
  Synthetic
atgcaaaccagctcaaacaactggatataaataccaacaaaatgagtatggaggaggcgtgttacggcacggaga

SEQ ID NO: 66706 - DNA, 75 bp, Artificial Sequence
  Synthetic
tagtgctgggtacccttacagtgctctgggtataaagaagagggacatcttggatcctaccactagagatgtatc

SEQ ID NO: 66707 - DNA, 75 bp, Artificial Sequence
  Synthetic
agtgagcaaggtgagatccagtgggtgaaacccaacaaggagactggtagattgaacatcaatggaccaacacgc

SEQ ID NO: 66708 - DNA, 75 bp, Artificial Sequence
  Synthetic
atttttcacgttagacactaaatcttgggccaaggattcaaagggttggtattggaaattccctgatgttttgac

SEQ ID NO: 66709 - DNA, 75 bp, Artificial Sequence
  Synthetic
tgaatgactcggtgtacctcagaatgacttttggccacctttatgaagtgttccatgccaacccagggacagtga

SEQ ID NO: 66710 - DNA, 75 bp, Artificial Sequence
  Synthetic
cctatggggacgatgtgttagctagttatcccttcccaattgactgtctagaattggcaaaaacaggtaaggagt

SEQ ID NO: 66711 - DNA, 75 bp, Artificial Sequence
  Synthetic
cctttgactactcaggatatgatgctagccttagtcccgtctggtttagagctttggagatggtcttgcgggaca

SEQ ID NO: 66712 - DNA, 75 bp, Artificial Sequence
  Synthetic
actgacgcagtctcaagggaggttgaagctctcaagaactatcttatagggtctgaaggagcagttgagaaaatt

SEQ ID NO: 66713 - DNA, 75 bp, Artificial Sequence
  Synthetic
actgatctctgcactagtaattgtaatcaggagtgattacgatatggtcacccttacagcaaccctagctctaat

SEQ ID NO: 66714 - DNA, 75 bp, Artificial Sequence
  Synthetic
tggaccctaccactagagatgtatcaaagatgaagttttacatggacaagtacggtttggacctaccctactcca

SEQ ID NO: 66715 - DNA, 75 bp, Artificial Sequence
  Synthetic
agggtgctcaggcacttccatctttaattcaatgattaacaacattataatcagaaccctcttgatcaaaacttt

SEQ ID NO: 66716 - DNA, 75 bp, Artificial Sequence
  Synthetic
ggaccaataactgtgccacgataatagtgccatatatgaacacactgcctttcgactctgccctgaaccattgca

SEQ ID NO: 66717 - DNA, 75 bp, Artificial Sequence
  Synthetic
ccaccttagttataaatactgaacatatgcccagcatgtttgtgccagttggagatgtggtccagtatggattct

SEQ ID NO: 66718 - DNA, 75 bp, Artificial Sequence
  Synthetic
cgactgtctagaactagccaagactggtaaagagtatggcctgaccatgacacctgcagacaaatcaccttgctt

SEQ ID NO: 66719 - DNA, 75 bp, Artificial Sequence
  Synthetic
ggtaaagagtatggcctgaccatgacacctgcagacaaatcaccttgcttcaacgaagtgacgtgggaaaacgcc

SEQ ID NO: 66720 - DNA, 75 bp, Artificial Sequence
  Synthetic
ggcgctagcactctggcactaaggtacctttgtgcgcctgttttacttcccttccccaaagtaacttagaagttg

SEQ ID NO: 66721 - DNA, 75 bp, Artificial Sequence
  Synthetic
tcaggactctcttgatcaaaactttcaaagggatagatttggatgagttaaatatggtggcttatggagatgatg

SEQ ID NO: 66722 - DNA, 75 bp, Artificial Sequence
  Synthetic
cagagctaatcagagagtataataataggtctgccattgggaacactatagaagccctcttccaaggacccccta

SEQ ID NO: 66723 - DNA, 75 bp, Artificial Sequence
  Synthetic
tatccactgtggatttcatccctccaatggcttcccttgaggagaaaggggtgtctttcacctctaaatttgtca

SEQ ID NO: 66724 - DNA, 75 bp, Artificial Sequence
  Synthetic
tggattgcgacattgaggtgacggactcatataaaacagacctgggcagattggatgccggtcgggccgccaagc

SEQ ID NO: 66725 - DNA, 75 bp, Artificial Sequence
  Synthetic
ggcaaacagagcctcaaacaagaccctgataagtttgctaaccctgtcaaggacattttcactgaaatggctgcc

SEQ ID NO: 66726 - DNA, 75 bp, Artificial Sequence
  Synthetic
ttgttacggcacagagaatctggaagctatagatcttcacactagtgcgggatacccgtacagtgcactaggaat

SEQ ID NO: 66727 - DNA, 75 bp, Artificial Sequence
  Synthetic
atgagtcactgcaatccccacgggcgaccgtggcagtggctgcgctggcggcctgcctatggggcaacccatagg

SEQ ID NO: 66728 - DNA, 75 bp, Artificial Sequence
  Synthetic
gcctgcggacagaatcacagcaatgctagggacgcatgtgatctgggacttcggattacaatcctctgtgacgtt

SEQ ID NO: 66729 - DNA, 75 bp, Artificial Sequence
  Synthetic
cctctaaagtcaccatccgctgaagcttgtggttacagtgatcgcgtggcacaactcaccatcggaaactccacc

SEQ ID NO: 66730 - DNA, 75 bp, Artificial Sequence
  Synthetic
gtgtcatctaccaccgcccaaggttgtgacacgattgcccgttgcaattgccagacaggggtgtactattgtaat

SEQ ID NO: 66731 - DNA, 75 bp, Artificial Sequence
  Synthetic
ccttcttgccagcgtggatagcgaagaggtacgtcagtactgcagagaccaaggctggatcatcccagagactcc

SEQ ID NO: 66732 - DNA, 75 bp, Artificial Sequence
  Synthetic
aaccagctccagatgctattagtgaccttcttgccagcgtggatagcgaagaggtacgtcagtactgcagagacc

SEQ ID NO: 66733 - DNA, 75 bp, Artificial Sequence
  Synthetic
cgaccgtggcagtggctgcgttggcggcctgcctatggggcaacccataggacgctctaatacagacatggtgcg

SEQ ID NO: 66734 - DNA, 75 bp, Artificial Sequence
  Synthetic
atgaaactatgcaaggacacggaggatattgagcaaacagctaatatacaaggggatcccattgcagacatgatc

SEQ ID NO: 66735 - DNA, 75 bp, Artificial Sequence
  Synthetic
ctggtgcccctaagcaggtgctcaagaaacctattctccgcacggcaacagtgcagggcccaagtctcgactttg

SEQ ID NO: 66736 - DNA, 75 bp, Artificial Sequence
  Synthetic
gaaacctattctccgcacggcaacagtgcagggcccaagtctcgactttgctctatcactactgagaaggaatat

SEQ ID NO: 66737 - DNA, 75 bp, Artificial Sequence
  Synthetic
tacaagctctttgcaggattccagggtgcatattctggtgctcctaagcaggcactcaagaagcctgtcctgcgc

SEQ ID NO: 66738 - DNA, 75 bp, Artificial Sequence
  Synthetic
attgggacattgacttgatgggatatgctcagctgcggcggaaatgcgagttgtttacctacatgcgctttgatg

SEQ ID NO: 66739 - DNA, 75 bp, Artificial Sequence
  Synthetic
gggcactactaatccgaatggttatgccaactgggatatagacataactggttacgcacagatgcgcaggaaagt

SEQ ID NO: 66740 - DNA, 75 bp, Artificial Sequence
  Synthetic
tacacaggaggcggcaaacatcatagtcggttatggtgagtggccctcatactgctctgatgacgatgctacagc

SEQ ID NO: 66741 - DNA, 75 bp, Artificial Sequence
  Synthetic
tagaattggcaaaaacaggtaaggagtatggattgactatgacccctgctgacaaatcaccctgctttaatgaag

SEQ ID NO: 66742 - DNA, 75 bp, Artificial Sequence
  Synthetic
tcatccccattacaatcactttagctccaatgtgctctgagtttgctggcctcaggcaggcggtcacccagggct

SEQ ID NO: 66743 - DNA, 75 bp, Artificial Sequence
  Synthetic
atccaaggggtggtattggaagtttcctgatgtgttgactgagaccggagtctttggccagaacgcacagtttca

SEQ ID NO: 66744 - DNA, 75 bp, Artificial Sequence
  Synthetic
tttgggtgtccgtgtttcctgtttcacttaccttggctgcttatggtgacaattgtatagttgtcatcatatagc

SEQ ID NO: 66745 - DNA, 75 bp, Artificial Sequence
  Synthetic
agcaaggagtcaacctggaattaaccctcattactcttgacaccaacgaaaagtttagggatatcaccaaattca

SEQ ID NO: 66746 - DNA, 75 bp, Artificial Sequence
  Synthetic
gtgcttgatgctggcattccaatatcacaattgacagtgtgcccacatcagtggattaatttgaggaccaacaat

SEQ ID NO: 66747 - DNA, 75 bp, Artificial Sequence
  Synthetic
aagtttagggatatcaccaaattcatcccagaaaatattagcactgctagtgatgccaccctagtgatcaacacg

SEQ ID NO: 66748 - DNA, 75 bp, Artificial Sequence
  Synthetic
atggcagacaaggtttttgcgcaggcctcaaaaggagttactttgctagtgaacaaggagagatccagtgggtta

SEQ ID NO: 66749 - DNA, 75 bp, Artificial Sequence
  Synthetic
aggaccctcgccttgaggtggatttcgagcaggcgttgttctctaagtatgtggggaacacactccatgagcctg

SEQ ID NO: 66750 - DNA, 75 bp, Artificial Sequence
  Synthetic
ctagtgagtattacccagctagatatcaatcccatctcatgcttgctgtgggtcactcggaacctggtgactgtg

SEQ ID NO: 66751 - DNA, 75 bp, Artificial Sequence
  Synthetic
gtcagtatctggtatcaaacaaactacgtggtccccattggagcacccaacacagcttacataattgcactggca

SEQ ID NO: 66752 - DNA, 75 bp, Artificial Sequence
  Synthetic
agctgtcttgcacagtaaagacccccgacttgaggtagattttgaacaggccctgttctctaagtatgtgggaaa

SEQ ID NO: 66753 - DNA, 75 bp, Artificial Sequence
  Synthetic
acaggaaatctaaggttagatatagcgtggacacagtggtgtctgagcttattagggagtacaacaataggtctg

SEQ ID NO: 66754 - DNA, 75 bp, Artificial Sequence
  Synthetic
cacactagtgcaggttatccttacagtgccctgggaataaagaagagagatattttagaccctaccaccagagac

SEQ ID NO: 66755 - DNA, 75 bp, Artificial Sequence
  Synthetic
atggcaatcaacaatgctgggccagttgtgtggatattacacccagtggtcagggtcactggaggtcacttttat

SEQ ID NO: 66756 - DNA, 75 bp, Artificial Sequence
  Synthetic
gacgccactttagtgatcaacacagagcatatgccttcaatgtttgtgccagtaggtgacgtcgtgcagtatggc

SEQ ID NO: 66757 - DNA, 75 bp, Artificial Sequence
  Synthetic
agcatatgccttcaatgtttgtgccagtaggtgacgtcgtgcagtatggcttcctaaatctcagtggaaaaccaa

SEQ ID NO: 66758 - DNA, 75 bp, Artificial Sequence
  Synthetic
aacactccttattaagacattcaagggtattgacttggatgaactcaatatggttgcctacggggacgatgtgct

SEQ ID NO: 66759 - DNA, 75 bp, Artificial Sequence
  Synthetic
gatgctagcctcagtccagtttggtttagagcactggaattagtccttagagagataggctatagtgaggaggcg

SEQ ID NO: 66760 - DNA, 75 bp, Artificial Sequence
  Synthetic
cctaccatgccaatgaaggagatccatgaatccattcgatggaccaaggatgcacgcaatactcaagatcacgtg

SEQ ID NO: 66761 - DNA, 75 bp, Artificial Sequence
  Synthetic
gttgccgttgttggagaatcagatctcaaatctagagcagtctgctgcttcacaagaagatcttgaagccatgtt

SEQ ID NO: 66762 - DNA, 75 bp, Artificial Sequence
  Synthetic
cagcgctccaagctgctgaaattggggcatcgtcaaatactagtgatgagagtatgattgaaacacgatgcgttc

SEQ ID NO: 66763 - DNA, 75 bp, Artificial Sequence
  Synthetic
acccgaatgggtatgcaaactgggacatagatataacaggttacgcgcaaatgcgtagaaaggtggagttgttca

SEQ ID NO: 66764 - DNA, 75 bp, Artificial Sequence
  Synthetic
atgacggatatcccacattcggtgaacacaagcaggagaaagaccttgaatacggggcatgcccaaacaacatga

SEQ ID NO: 66765 - DNA, 75 bp, Artificial Sequence
  Synthetic
caccttggacagcttcttcagtagggcaggtttggtaggagagatagatctccctcttgagggtaccactaatcc

SEQ ID NO: 66766 - DNA, 75 bp, Artificial Sequence
  Synthetic
tccctcttgagggtaccactaatccaaatggttatgccaactgggacatagacataactggttacgcacaaatgc

SEQ ID NO: 66767 - DNA, 75 bp, Artificial Sequence
  Synthetic
gttttacctcccttcccccgaagtaacttagaagctgtgaaccaacgatcaatagtaggtgtgacataccagtca

SEQ ID NO: 66768 - DNA, 75 bp, Artificial Sequence
  Synthetic
caatttccattcttaattcaccccacaatgcctatgaaggaaattcatgagtccattagatggacaaaagacgca

SEQ ID NO: 66769 - DNA, 75 bp, Artificial Sequence
  Synthetic
gagacgcaattggctcgaattattttagaggttaaacacacctcaaccccaccagaaatctggtcgtgaacataa

SEQ ID NO: 66770 - DNA, 75 bp, Artificial Sequence
  Synthetic
tagaggttaaacacacctcaaccccaccagaaatctggtcgtgaacataactggtgggggtaaatttgttataac

SEQ ID NO: 66771 - DNA, 75 bp, Artificial Sequence
  Synthetic
cagttaacagtgtgcccacaccagtggattaatttgaggaccaacaattgtgctacaataatagtgccatacatt

SEQ ID NO: 66772 - DNA, 75 bp, Artificial Sequence
  Synthetic
cccggactgagtatcaataggctgctcgcgcggctgaaagagaaaacgttcgttacccggccaactacttcgaga

SEQ ID NO: 66773 - DNA, 75 bp, Artificial Sequence
  Synthetic
tagggatcgtttagcagtcctcccacgtcactcacaacctggcaaaactatttggattgagcacaaactcgtgaa

SEQ ID NO: 66774 - DNA, 75 bp, Artificial Sequence
  Synthetic
tgcaatccccatgggcgaccatggcagtggctgcgttggcggcctgcccatggagaaatccatgggacgctctaa

SEQ ID NO: 66775 - DNA, 75 bp, Artificial Sequence
  Synthetic
caacttcagagtggtcaaccgccatcttgccactcataatgactgggcaaaccttgtttgggaagacagctcccg

SEQ ID NO: 66776 - DNA, 75 bp, Artificial Sequence
  Synthetic
ccctaacagcaaccctagctctaataggttgccatggtagtccttgggcttggatcaaagctaaaacagcatcta

SEQ ID NO: 66777 - DNA, 75 bp, Artificial Sequence
  Synthetic
tggccgtccggtgtgcaacagagcaattgtttacttatttattggttttgtaccattgacactgaagtctgtagt

SEQ ID NO: 66778 - DNA, 75 bp, Artificial Sequence
  Synthetic
aaggaccgagcttagactttgccttatccctcctaaggcgcaacatcagacaggtgcaaactgaccaaggacatt

SEQ ID NO: 66779 - DNA, 75 bp, Artificial Sequence
  Synthetic
ttggaaaggcattagcgattccgaactttgagaacttgaggagaaattggctcgaattattttaaatttgcagct

SEQ ID NO: 66780 - DNA, 75 bp, Artificial Sequence
  Synthetic
aaccagatctcaaacctagagcaatctgctgcctcacaagaagatcttgaagtcatgtttgggaatgtgtcgtac

SEQ ID NO: 66781 - DNA, 75 bp, Artificial Sequence
  Synthetic
aagaagttcaatgatatggcgagtgccgccaagggcttagagtggatatccaacaaaattagtaagttcattgac

SEQ ID NO: 66782 - DNA, 75 bp, Artificial Sequence
  Synthetic
tagggtatagtgaagaggcaatctcactcattgagggaatcaaccacacacatcatgtgtatcgtaataagacct

SEQ ID NO: 66783 - DNA, 75 bp, Artificial Sequence
  Synthetic
accaacgcgcccagatgtttcggtgaataggttttacacattggacactaaattgtgggagaaatcgtccaaggg

SEQ ID NO: 66784 - DNA, 75 bp, Artificial Sequence
  Synthetic
acagggaagtctctagcgacaggcatcattgcccgcgcgatagctgataaatatcactctagtgtgtactcactc

SEQ ID NO: 66785 - DNA, 75 bp, Artificial Sequence
  Synthetic
tcggtcagggttctgcattcacgtgcaatgcaatgctagtaagttccatcaaggggcactcctagtcgctgtcct

SEQ ID NO: 66786 - DNA, 75 bp, Artificial Sequence
  Synthetic
ttggttgtcatggaagtccttgggcttggattaaagccaaaacagcatccattttaggtatccccatcgcccaga

SEQ ID NO: 66787 - DNA, 75 bp, Artificial Sequence
  Synthetic
caacatggtcgcttatggagatgatgtgctcgccagctaccccttcccaattgattgcttggagttagcaaagac

SEQ ID NO: 66788 - DNA, 75 bp, Artificial Sequence
  Synthetic
caacacccgtacgtgcttgatgctggcattccaatatcacaattaacagtgtgcccacatcagtggattaatttg

SEQ ID NO: 66789 - DNA, 75 bp, Artificial Sequence
  Synthetic
aagggtttagaatggatatccaacaaaattagtaagttcattgactggctcagggagaagattgttccagcagct

SEQ ID NO: 66790 - DNA, 75 bp, Artificial Sequence
  Synthetic
ttaaaacagcctgtgggttgcacccactcccagggcatactgggcgcaagcactctggtatctcggtaccgttgt

SEQ ID NO: 66791 - DNA, 75 bp, Artificial Sequence
  Synthetic
tccgctgcctcacaagaggaccttgaagctatgtttgggaatgtgtcatacctcgcccatttctgtcgcaagttc

SEQ ID NO: 66792 - DNA, 75 bp, Artificial Sequence
  Synthetic
ggaagttgtcccacaattgctccaatatatgtttgtgccacctggagcccctaagccagattctagggaatccct

SEQ ID NO: 66793 - DNA, 75 bp, Artificial Sequence
  Synthetic
actcacagggcccacgtggcgctagcactctgattctacggaatctttgtgcgcctgttttacaaccccccccaa

SEQ ID NO: 66794 - DNA, 75 bp, Artificial Sequence
  Synthetic
gattgaagccagtagtttgaatgactcagtctatcttaggatgactttcgggcacctctatgaaactttccatgc

SEQ ID NO: 66795 - DNA, 75 bp, Artificial Sequence
  Synthetic
taccttgttgggccagttgtgcgggtactacactcaatggtcaggatcactggaagtcaccttcatgttcactgg

SEQ ID NO: 66796 - DNA, 75 bp, Artificial Sequence
  Synthetic
agtatcaatagactgctcgtgcgattgaaggagaaaacgttccttatcaggctagatacttcgggaaacctatca

SEQ ID NO: 66797 - DNA, 75 bp, Artificial Sequence
  Synthetic
gtctgactctgacgccattcgtcgcaggttttacatggattgcgacattgaggtgacagactcatacaaaacaga

SEQ ID NO: 66798 - DNA, 75 bp, Artificial Sequence
  Synthetic
cttatagcctacacaccgccaggaggccctttgcccaaggatcgagcaaccgccatgttgggcacgcatgtcatc

SEQ ID NO: 66799 - DNA, 75 bp, Artificial Sequence
  Synthetic
aggtgacagactcatacaaaacagacttgggtagactagacgctggacgggctgctaagttatgctctgaaaaca

SEQ ID NO: 66800 - DNA, 75 bp, Artificial Sequence
  Synthetic
gtaagtttcaccaaggaactctgcttgtggtcgcaatcccagagttcactgtggccagatcagacacctcaacta

SEQ ID NO: 66801 - DNA, 75 bp, Artificial Sequence
  Synthetic
cccagagggtagtgtgtcgtaacgggcaactctgcagcggaaccgactactttgggtgtccgtgtttccttttat

SEQ ID NO: 66802 - DNA, 75 bp, Artificial Sequence
  Synthetic
cgagatggagtgttcgactattacactacaggcttggttagtatatggtatcagacgaattatgtggttccaatt

SEQ ID NO: 66803 - DNA, 75 bp, Artificial Sequence
  Synthetic
agcagatccgctattggtaacacaattgaagcactattccaaggcccacccaagttcaggccaattagaatcagt

SEQ ID NO: 66804 - DNA, 75 bp, Artificial Sequence
  Synthetic
ctattagcgatctcctcgctagtgtagacagcgaggaagtgcgccaatactgtagggagcaaggctggatcatcc

SEQ ID NO: 66805 - DNA, 75 bp, Artificial Sequence
  Synthetic
ccacacacaacgactggacaaaccttgtgtgggaggacagctctagggacttgttagtctcttccaccactgccc

SEQ ID NO: 66806 - DNA, 75 bp, Artificial Sequence
  Synthetic
ctcctatgctgcaacagcaggcaaacagagcctcaaacaagaccctgataagtttgctaaccctgtcaaggatat

SEQ ID NO: 66807 - DNA, 75 bp, Artificial Sequence
  Synthetic
cagaagctaagagggtctacgcactggagaagagaatgaacaattacatgcagttcaagagcaaacaccgtattg

SEQ ID NO: 66808 - DNA, 75 bp, Artificial Sequence
  Synthetic
gatactggtaaagttccagcactccaagccgctgaaattggagcatcatcaaatgctagtgatgagagtatgatt

SEQ ID NO: 66809 - DNA, 75 bp, Artificial Sequence
  Synthetic
aaatgctagtgatgagagtatgattgagacacggtgtgttcttaattcgcacagcacagctgagaccactctcga

SEQ ID NO: 66810 - DNA, 75 bp, Artificial Sequence
  Synthetic
catcagtcggtaagattgttggcattcacattggcggcaacgggcgccaagggttctgtgctggtttgaagagga

SEQ ID NO: 66811 - DNA, 75 bp, Artificial Sequence
  Synthetic
aaaccgatcagggtcactttacgatgttaggagtgcgagaccacttggctgtgctccccaggcactcccaacctg

SEQ ID NO: 66812 - DNA, 75 bp, Artificial Sequence
  Synthetic
cagttcaagagcaaacaccgtattgaacctgtatgtctcatcatcagaggctccccaggcactggtaaatccttg

SEQ ID NO: 66813 - DNA, 75 bp, Artificial Sequence
  Synthetic
tggaacaaggagtgtctgactatatcaaaggcctcggtgacgcttttggtatgggcttcactgatgcagtgtcta

SEQ ID NO: 66814 - DNA, 75 bp, Artificial Sequence
  Synthetic
taagttatcagatcccccagcacaggtttcagttccattcatgtcacctgcgagtgcttatcaatggttctatga

SEQ ID NO: 66815 - DNA, 75 bp, Artificial Sequence
  Synthetic
ggaagtctcgtctgattgaagccagcagtttgaatgactcggtttaccttagaatggcctttggacacctctatg

SEQ ID NO: 66816 - DNA, 75 bp, Artificial Sequence
  Synthetic
agatccgttatccgctttggtacttcgagaaacctagtatcatcttggaatcttcgatgcgttgcgttcagcact

SEQ ID NO: 66817 - DNA, 75 bp, Artificial Sequence
  Synthetic
gtacttttgcagtgagcaaggtgagatccaatggatgaagcccaacaaagaaactggcaggttgaacatcaacgg

SEQ ID NO: 66818 - DNA, 75 bp, Artificial Sequence
  Synthetic
acctcgaagtccaagtaccctttggtgattaggatttacatgaggatgaagcacgtcagggcgtggatacctcgc

SEQ ID NO: 66819 - DNA, 75 bp, Artificial Sequence
  Synthetic
aatgggtgaagcctaacaaggaaactggtagactgaacatcaatggaccaactcgcactaagttggagcctagcg

SEQ ID NO: 66820 - DNA, 75 bp, Artificial Sequence
  Synthetic
atttttgaccaccgatgacggcgtctcagcacccattctaccaaatttccaccccactccatgtattcacatacc

SEQ ID NO: 66821 - DNA, 75 bp, Artificial Sequence
  Synthetic
aaagaccctagattggaggtcgactttgagcaagccctgttttccaagtatgtgggcaatgttttacacgagccc

SEQ ID NO: 66822 - DNA, 75 bp, Artificial Sequence
  Synthetic
cattggctgcttatggtgacaattgaaagattgttgccatatagctattggattggccatccggtatcgaataga

SEQ ID NO: 66823 - DNA, 75 bp, Artificial Sequence
  Synthetic
agaggccagcgagtattacccagccaggtatcagtcacacctcatgcttgcagtgggtcactcagaaccaggaga

SEQ ID NO: 66824 - DNA, 75 bp, Artificial Sequence
  Synthetic
acattctcgaccccacaaccagggatgtgtctaagatgaaattctatatggataaatacgggctagatctgccat

SEQ ID NO: 66825 - DNA, 75 bp, Artificial Sequence
  Synthetic
ctgaatagtataaaatgggcgctcaggtatcaacacaaaaatctgggtcccacgagacaagtacttttgcatcag

SEQ ID NO: 66826 - DNA, 75 bp, Artificial Sequence
  Synthetic
tgggagctcaagtctcaacccagaaaactggatctcacgagaaccagaacatagctgcgagtgggtctaccataa

SEQ ID NO: 66827 - DNA, 75 bp, Artificial Sequence
  Synthetic
ggtatcaacacaaaaatctgggtcccacgagacaagtacttttgcatcagaaggctctactataaattttaccaa

SEQ ID NO: 66828 - DNA, 75 bp, Artificial Sequence
  Synthetic
ggaaagtcacgcctgatagaggctagtagcttgaatgactctgtctacctcagaatgacttttgggcacctttac

SEQ ID NO: 66829 - DNA, 75 bp, Artificial Sequence
  Synthetic
cagccccatactagatgcattgagagagacagctccccccttgaagtcacctagtgcggaggcatgtggttacag

SEQ ID NO: 66830 - DNA, 75 bp, Artificial Sequence
  Synthetic
ctaagttcactcaacctgtcgtagatgctctcaaagaggcagctccaccacttaaatcgccatcagctgaagcat

SEQ ID NO: 66831 - DNA, 75 bp, Artificial Sequence
  Synthetic
cttaaatcgccatcagctgaagcatgtggttatagtgatagagtcgctcagctaacactaggcaattctaccatc

SEQ ID NO: 66832 - DNA, 75 bp, Artificial Sequence
  Synthetic
tgatcgcgtggcacaactgactgttggcaactcgaccatcactactcaggaggctgctaacattgtgatggggta

SEQ ID NO: 66833 - DNA, 75 bp, Artificial Sequence
  Synthetic
gggagattgggtattcagaggaggccgtgtccctaatagaaggaatcaaccacacccaccatgtgtaccggaaca

SEQ ID NO: 66834 - DNA, 75 bp, Artificial Sequence
  Synthetic
ttaaaacagcctgtgggttgcacccactcacagggcccactgggcgcaagcactctggtatctcggtacctttgt

SEQ ID NO: 66835 - DNA, 75 bp, Artificial Sequence
  Synthetic
atattctaaggacactgaggctactgcagtggataagcctactagaccagatgtatcagtcaacaggttctacac

SEQ ID NO: 66836 - DNA, 75 bp, Artificial Sequence
  Synthetic
gaatcgcttttacaccctatctgctaagatgtgggacaaaagttccaaaggatggtactggaagttcccagatct

SEQ ID NO: 66837 - DNA, 75 bp, Artificial Sequence
  Synthetic
actcccagcaaaattatgggctagtaactctaaagggtggtattggaaattcccagatgttctctgtgaactggg

SEQ ID NO: 66838 - DNA, 75 bp, Artificial Sequence
  Synthetic
aagatgtgggacaaaagttccaaaggatggtactggaagttcccagatctactaacgcaaaagggagtgtttggc

SEQ ID NO: 66839 - DNA, 75 bp, Artificial Sequence
  Synthetic
gtttgttggcgtggcacaacggtaaggatgaatatgagaaatttgtgagtacaattagatcagtcccagttggaa

SEQ ID NO: 66840 - DNA, 75 bp, Artificial Sequence
  Synthetic
taagttccatcagggtacactcttagtggctgctataccagaattgatgcttgctaggtcaagtgctgacactaa

SEQ ID NO: 66841 - DNA, 75 bp, Artificial Sequence
  Synthetic
caaggagctctgctggttgcagctttgccagagcacgtagtggctggaatgggaccgggagataagccgcaaaat

SEQ ID NO: 66842 - DNA, 75 bp, Artificial Sequence
  Synthetic
gcatcgtcaaatactagtgatgagagtatgattgaaacacggtgcgttcttaactcacacagcacagcagaaacc

SEQ ID NO: 66843 - DNA, 75 bp, Artificial Sequence
  Synthetic
ccatgacacctgcagacaaatcaccctgtttcaatgaagtaacatgggaaaatgctaccttcctgaagagagggt

SEQ ID NO: 66844 - DNA, 75 bp, Artificial Sequence
  Synthetic
tgccagagcacgtagtggctggaatgggaccgggagataagccgcaaaatgcaccgcatccaacctaccaggtca

SEQ ID NO: 66845 - DNA, 75 bp, Artificial Sequence
  Synthetic
tatgccacagaagcaaagagagtgtacgccctagaaaagagaatgaacaattacatgcagttcaagagcaaacac

SEQ ID NO: 66846 - DNA, 75 bp, Artificial Sequence
  Synthetic
gtggctgctataccagaattgatgcttgctaggtcaagtgctgacactaaccctgtcactgccccccatccacca

SEQ ID NO: 66847 - DNA, 75 bp, Artificial Sequence
  Synthetic
tctcaagctctaatcttccctcatcagtggatcaacttgcgcactaacaactgtgctaccatagttatgccctat

SEQ ID NO: 66848 - DNA, 75 bp, Artificial Sequence
  Synthetic
tggtgtgcccccatcagtggatcaacctgcggacaaataattgtgccaccatcataatgccatatactaattcgg

SEQ ID NO: 66849 - DNA, 75 bp, Artificial Sequence
  Synthetic
agtggatcaacttgcgcactaacaactgtgctaccatagttatgccctatattaattgcttgccctttgactcag

SEQ ID NO: 66850 - DNA, 75 bp, Artificial Sequence
  Synthetic
cctgcggacaaataattgtgccaccatcataatgccatatactaattcggtgccatatgactcggccattcacca

SEQ ID NO: 66851 - DNA, 75 bp, Artificial Sequence
  Synthetic
ctattacagtcaccatagctcccatgtgtgcagaatttgcgggtctgcgccaagcagtaaagcaaggcataccaa

SEQ ID NO: 66852 - DNA, 75 bp, Artificial Sequence
  Synthetic
gtgtgcagaatttgcgggtctgcgccaagcagtaaagcaaggcataccaacagagctcaaacctggtaccaatca

SEQ ID NO: 66853 - DNA, 75 bp, Artificial Sequence
  Synthetic
ggtggtcataccagttgcaccactcgcttataatgaaggagctactacagctatacccattactataactgttgc

SEQ ID NO: 66854 - DNA, 75 bp, Artificial Sequence
  Synthetic
cactatcacagtcgctccattatgtgctgaattcggaggcctaaggcaagctgtgcaacagggggtaccgatgga

SEQ ID NO: 66855 - DNA, 75 bp, Artificial Sequence
  Synthetic
gctgaattcggaggcctaaggcaagctgtgcaacagggggtaccgatggagttaaaacccgggtcgaaccaattc

SEQ ID NO: 66856 - DNA, 75 bp, Artificial Sequence
  Synthetic
ctgtgctaccatagttatgccctatattaattgcttgccctttgactcagccctgaatcactgcaacttttctct

SEQ ID NO: 66857 - DNA, 75 bp, Artificial Sequence
  Synthetic
tagatcagttccagttggaaaagcgttggccattcctaactttgagaatctgagaagaaattggctcgaattgtt

SEQ ID NO: 66858 - DNA, 75 bp, Artificial Sequence
  Synthetic
taaccaattcttaactacagatgatggtgtctcagcaccaattctacctggtttccacccaaccccagagatgca

SEQ ID NO: 66859 - DNA, 75 bp, Artificial Sequence
  Synthetic
gagaacataaacaggagaaagaccttgaatatggagcgtgtcctaataatatgatgggcactttctcggtgcgaa

SEQ ID NO: 66860 - DNA, 75 bp, Artificial Sequence
  Synthetic
cactcacagggcctactgggcgcaagcactctggtacctcggtacctttgtgcgcctgttttatacccccccccc

SEQ ID NO: 66861 - DNA, 75 bp, Artificial Sequence
  Synthetic
gaggtgaccaacttacttgaattgtgccaaattgaaactatgctagaggtgaataatgtcaccgatgtagatggc

SEQ ID NO: 66862 - DNA, 75 bp, Artificial Sequence
  Synthetic
gccaaattgaaactatgctagaggtgaataatgtcaccgatgtagatggcatgcagaggctcctaataccagtgt

SEQ ID NO: 66863 - DNA, 75 bp, Artificial Sequence
  Synthetic
gtttccacccaaccccagagatgcatatcccaggcgaagtgaagaacctcttagaaatttgccaggtagagtcta

SEQ ID NO: 66864 - DNA, 75 bp, Artificial Sequence
  Synthetic
attcctataagacagatttgggtaggcttgatgcagggagagcggccaggctgtgctctgagaataacaccgcaa

SEQ ID NO: 66865 - DNA, 75 bp, Artificial Sequence
  Synthetic
gtcacccgcgagcgcttaccagtggttttacgacgggtaccctacgtttggagaacataaacaggagaaagacct

SEQ ID NO: 66866 - DNA, 75 bp, Artificial Sequence
  Synthetic
cgcaaactgcagtggacacactttgcgcggctttcaaagttgatcctggtcgtgatgggccttggcaatcaacat

SEQ ID NO: 66867 - DNA, 75 bp, Artificial Sequence
  Synthetic
acttcaaacggtgcagtccattagtctgtgggaaagcaatccagcttagggataggaagtccaaggtgagataca

SEQ ID NO: 66868 - DNA, 75 bp, Artificial Sequence
  Synthetic
ctacagttgggcaaatatgtcgatattacacccagtggtctggctctttggaggtgacatttatgttcactgggt

SEQ ID NO: 66869 - DNA, 75 bp, Artificial Sequence
  Synthetic
ttacacccagtggtctggctctttggaggtgacatttatgttcactgggtcattcatggcaactggcaaaatgct

SEQ ID NO: 66870 - DNA, 75 bp, Artificial Sequence
  Synthetic
tcaggttatgatgccagccttagccctgtctggttcagagcattagaattggttcttagggagatagggtatagt

SEQ ID NO: 66871 - DNA, 75 bp, Artificial Sequence
  Synthetic
ctataatagtgccatacataaacgcactgccttttgattctgctttgaaccattgcaactttggtctactggttg

SEQ ID NO: 66872 - DNA, 75 bp, Artificial Sequence
  Synthetic
gctattgggaataccattgaagctcttttccaggggccccctaagtttagaccgataaagattagtctggaggag

SEQ ID NO: 66873 - DNA, 75 bp, Artificial Sequence
  Synthetic
tcatggcaacaggaaaaatgcttattgcctacaccccaccaggtgcgccacagcctgccaacagaagaactgcaa

SEQ ID NO: 66874 - DNA, 75 bp, Artificial Sequence
  Synthetic
ctcccacgagaattccaattcagctacagaaggctccaccattaattacactaccatcaactattacaaggactc

SEQ ID NO: 66875 - DNA, 75 bp, Artificial Sequence
  Synthetic
catcttgccactcacaatgattgggcaaatcttgtttgggaagacagctctcgcgacttgctcgtgtcatccacc

SEQ ID NO: 66876 - DNA, 75 bp, Artificial Sequence
  Synthetic
ggattttggcctgcagtcctctgtcacactagtgatcccatggataagcaacacccactatagaacagtagagac

SEQ ID NO: 66877 - DNA, 75 bp, Artificial Sequence
  Synthetic
acactagtgatcccatggataagcaacacccactatagaacagtagagactggagggatcctagactattattct

SEQ ID NO: 66878 - DNA, 75 bp, Artificial Sequence
  Synthetic
atttatgtggaagctagcgagtattaccctgctagataccagtctcatctcatgcttgcggcgggccattctgaa

SEQ ID NO: 66879 - DNA, 75 bp, Artificial Sequence
  Synthetic
caaggatggattgtacctgatactcccaccaacgttgagcgccacttgaatagagctgttttgattatgcaatcc

SEQ ID NO: 66880 - DNA, 75 bp, Artificial Sequence
  Synthetic
ggtattgtaacaatctggtaccagaccaactttgtggtgccatcaggagctccaacatcagcttacatcattgcc

SEQ ID NO: 66881 - DNA, 75 bp, Artificial Sequence
  Synthetic
gcaatgggggcagctcaaaagaatttcactcttaaattgtgccgggacacagaatctatatcccaaacagctatc

SEQ ID NO: 66882 - DNA, 75 bp, Artificial Sequence
  Synthetic
ccaccaaggagcactcctagtcgctgtcctaccagagtatgtcattgggacagtagcaggcggcacagggacgga

SEQ ID NO: 66883 - DNA, 75 bp, Artificial Sequence
  Synthetic
taccctgctagatatcaatctcacctaatgctcgccgcaggccactctgagcctggggactgcgggggtatttta

SEQ ID NO: 66884 - DNA, 75 bp, Artificial Sequence
  Synthetic
gtttgccggttttcagggagcatattccggtgcccccaagcaaacactcaagaaaccggtgctacgcacagcaac

SEQ ID NO: 66885 - DNA, 75 bp, Artificial Sequence
  Synthetic
ggagcagggtgtgtccgactatattaagggacttggtgatgcgtttggaactggcttcaccgatgcagtttccag

SEQ ID NO: 66886 - DNA, 75 bp, Artificial Sequence
  Synthetic
caaggtgaccccattgaagaggctatcaacaacacagtcgctggaacactaaatcgagcattaggaggtgcaact

SEQ ID NO: 66887 - DNA, 75 bp, Artificial Sequence
  Synthetic
tcactcttaaattgtgccgggacacagaatctatatcccaaacagctatcttgcaaggggacaccgtgagtgaca

SEQ ID NO: 66888 - DNA, 75 bp, Artificial Sequence
  Synthetic
gagttagtaatcacagactgggcacgggtgaggtgccggccttacaagcagcagaaacaggcgctacctctaacg

SEQ ID NO: 66889 - DNA, 75 bp, Artificial Sequence
  Synthetic
gggtgaggtgccggccttacaagcagcagaaacaggcgctacctctaacgcaactgatgagagcatgattgaaac

SEQ ID NO: 66890 - DNA, 75 bp, Artificial Sequence
  Synthetic
agaagatcctaaagaatttgatcaaattaatctctgctttagtcatcgtgattaggagtgattatgacatggtca

SEQ ID NO: 66891 - DNA, 75 bp, Artificial Sequence
  Synthetic
attaatctctgctttagtcatcgtgattaggagtgattatgacatggtcactctcacagcaactttagctctgat

SEQ ID NO: 66892 - DNA, 75 bp, Artificial Sequence
  Synthetic
gagactggagctacatctaatacctcagacgagaacatgttggaaactcgttgtgtggttaactcccatagtgtg

SEQ ID NO: 66893 - DNA, 75 bp, Artificial Sequence
  Synthetic
ggttgagcacaaactagtgaagatcgtagacgctgtggagttagtagatgaacaaggggttaacttagaactcac

SEQ ID NO: 66894 - DNA, 75 bp, Artificial Sequence
  Synthetic
cagacgagaacatgttggaaactcgttgtgtggttaactcccatagtgtggctgagactagtatctcgcatttct

SEQ ID NO: 66895 - DNA, 75 bp, Artificial Sequence
  Synthetic
tgtcgttgtggtagaggatgcgacagctaccaacaaagggtatgccacatggaagatcgatgttatgggctttgc

SEQ ID NO: 66896 - DNA, 75 bp, Artificial Sequence
  Synthetic
ttaagaactaataattgtgcaaccattatagttccatatatgaacacagttccttttgactcagctctcaaccac

SEQ ID NO: 66897 - DNA, 75 bp, Artificial Sequence
  Synthetic
gcaaagtgcgtcctggcttaaaaaatttaacgatatggccaacgccgccaaggggttagagtggatctccagtaa

SEQ ID NO: 66898 - DNA, 75 bp, Artificial Sequence
  Synthetic
acattgacatcatgggatttgttcaacagcgtaggaagctggaaatgttcacatacatgagatttgatgcagagt

SEQ ID NO: 66899 - DNA, 75 bp, Artificial Sequence
  Synthetic
ccagctgcgccgcaagctagagatcttcacatacatgcgctttgacgcagagttcacttttgtggcgacagagcg

SEQ ID NO: 66900 - DNA, 75 bp, Artificial Sequence
  Synthetic
tttaacgatatggccaacgccgccaaggggttagagtggatctccagtaagattagtaaattcatcgattggctc

SEQ ID NO: 66901 - DNA, 75 bp, Artificial Sequence
  Synthetic
acatacatgagatttgatgcagagtttaccttcttaaccgtgggagcgactggtgctgcaccagccactgttatc

SEQ ID NO: 66902 - DNA, 75 bp, Artificial Sequence
  Synthetic
acagtcaccatagctcccatgtgtgcggaatttgcgggtctgcgccaggcggtaaagcaaggtataccaacagag

SEQ ID NO: 66903 - DNA, 75 bp, Artificial Sequence
  Synthetic
cactttccaatggcagtcagcgacaaatccctcaatactggtgaagatgacagacccccctgctcaagtggcaat

SEQ ID NO: 66904 - DNA, 75 bp, Artificial Sequence
  Synthetic
ccttccatctttgtcaagattagtgatcccccagcccaggtctcggtaccttttatgtcacctgcagcagcatat

SEQ ID NO: 66905 - DNA, 75 bp, Artificial Sequence
  Synthetic
ccctttcatgtcaccagcaagtgcataccaatggttttatgatggctaccccaccttcggtgagaggccagtcac

SEQ ID NO: 66906 - DNA, 75 bp, Artificial Sequence
  Synthetic
aagggtctatgctttggagaaaagaatgaacaactacatgcagttcaagagcaaacaccgaattgaacctgtgtg

SEQ ID NO: 66907 - DNA, 75 bp, Artificial Sequence
  Synthetic
catttggcaatcacccaaccaatcaagacttcagatatggaatctgtcccaacaatctcatggggactttctgcg

SEQ ID NO: 66908 - DNA, 75 bp, Artificial Sequence
  Synthetic
aataacctaaagaccaatgagaccacccccatgcagcgcttgtgctttccagtgtcggtacagagcaaaacgggc

SEQ ID NO: 66909 - DNA, 75 bp, Artificial Sequence
  Synthetic
tcactagccctgtgcttgatgcgctgagggaagtggcacctccattgaagtcaccctcagtggaggcgtgcggat

SEQ ID NO: 66910 - DNA, 75 bp, Artificial Sequence
  Synthetic
gtcaggaaagaacatcaccgttcgcattttcatgaggttgaagcacgtgagagcttgggttccacgaccaatccg

SEQ ID NO: 66911 - DNA, 75 bp, Artificial Sequence
  Synthetic
atgaacaactacatgcagttcaagagcaaacaccgaattgaacctgtgtgtcttattattaggggttctccgggc

SEQ ID NO: 66912 - DNA, 75 bp, Artificial Sequence
  Synthetic
agacttcagatatggaatctgtcccaacaatctcatggggactttctgcgtgcgggttcttggttcagagaaact

SEQ ID NO: 66913 - DNA, 75 bp, Artificial Sequence
  Synthetic
ccaccagacccggatcactttgatggatacaaacagcaggtggtcacggtcatggatgacttatgtcagaaccct

SEQ ID NO: 66914 - DNA, 75 bp, Artificial Sequence
  Synthetic
gatacaaacagcaggtggtcacggtcatggatgacttatgtcagaaccctgacggcaaagatatgtcattgttct

SEQ ID NO: 66915 - DNA, 75 bp, Artificial Sequence
  Synthetic
tatccaaattttgataataccaagattctaaatgcttctcacaacagaacttctattacggcaaatacgggcaaa

SEQ ID NO: 66916 - DNA, 75 bp, Artificial Sequence
  Synthetic
caacgatgcggcgagtgccgctaaagggcttgaatggatttccaacaagatcagtaaatttatcgattggctcaa

SEQ ID NO: 66917 - DNA, 75 bp, Artificial Sequence
  Synthetic
gcagcttcacaggaggaccttgaagcattgtttggcaatgtgtcttatctggctcatttctgccgcaaattccaa

SEQ ID NO: 66918 - DNA, 75 bp, Artificial Sequence
  Synthetic
ttctattacggcaaatacgggcaaatttgggcaacagtccggtgctatatatgtgggaaattacagagtggtgaa

SEQ ID NO: 66919 - DNA, 75 bp, Artificial Sequence
  Synthetic
taccgaagctctcagagtgcgtatctacatgcgcatcaagcacgtcagagcatgggtccctagaccactcaggtc

SEQ ID NO: 66920 - DNA, 75 bp, Artificial Sequence
  Synthetic
aatttgtcattgcatctaccaattccagcaacatcatagtaccaacagtgtctgattctgatgcaattcgccgta

SEQ ID NO: 66921 - DNA, 75 bp, Artificial Sequence
  Synthetic
acgttcaatgcaacgctagtaaatttcatcaaggagcactgttagtggctgctatcccggagatggtgttgggag

SEQ ID NO: 66922 - DNA, 75 bp, Artificial Sequence
  Synthetic
cacgacagctcaaggatgtgacgtcatcgcccgttgcaaatgccagactggagtgtactattgtaattctcggag

SEQ ID NO: 66923 - DNA, 75 bp, Artificial Sequence
  Synthetic
cagcaacatcatagtaccaacagtgtctgattctgatgcaattcgccgtaggttctatatggattgtgatatcga

SEQ ID NO: 66924 - DNA, 75 bp, Artificial Sequence
  Synthetic
tctggcaactcaagaagactggagcaatttagtctgggaaaactacaacagggatctcttggtgaccagtgtaaa

SEQ ID NO: 66925 - DNA, 75 bp, Artificial Sequence
  Synthetic
atcgcccgttgcaaatgccagactggagtgtactattgtaattctcggaggaagcactatccagttagcttctca

SEQ ID NO: 66926 - DNA, 75 bp, Artificial Sequence
  Synthetic
ttaccccgtcagtttccaaggacctggaattgttgaggtccaagccaatgaattctatccacacagataccaaac

SEQ ID NO: 66927 - DNA, 75 bp, Artificial Sequence
  Synthetic
cacagcaaatttcaagcgttgtagcccactagtgtgtgggaaggccattcagctgagagatagaaagtccaaggt

SEQ ID NO: 66928 - DNA, 75 bp, Artificial Sequence
  Synthetic
cacgccaatccaggtacagtcaccggttcagctgttggatgcaacccagatgtgttttggagtaagttaccaatt

SEQ ID NO: 66929 - DNA, 75 bp, Artificial Sequence
  Synthetic
taacttcactatgaaactgtgcaaggatacggaggacattgagcaaacggctaacatacaaggggatcccattgc

SEQ ID NO: 66930 - DNA, 75 bp, Artificial Sequence
  Synthetic
ggtcactcggaaccaggggattgtggaggtattctcaggtgccaacatggtgttgttggcatagtgtccactggt

SEQ ID NO: 66931 - DNA, 75 bp, Artificial Sequence
  Synthetic
ccactagtgtgtgggaaggccattcagctgagagatagaaagtccaaggtcaggtacagtgtggacacggtggtt

SEQ ID NO: 66932 - DNA, 75 bp, Artificial Sequence
  Synthetic
gaggtattctcaggtgccaacatggtgttgttggcatagtgtccactggtggcaatggactcgttggctttgctg

SEQ ID NO: 66933 - DNA, 75 bp, Artificial Sequence
  Synthetic
ggcctggttggttttgcagacctcagggacttgttctggctcgatgatgaagcgatggagcagggggtcacagat

SEQ ID NO: 66934 - DNA, 75 bp, Artificial Sequence
  Synthetic
aagtttagacccataaggatcagtcttgaagaaaagccagccccagacgccattagtgaccttcttgctagtgtg

SEQ ID NO: 66935 - DNA, 75 bp, Artificial Sequence
  Synthetic
ttgaagaaaagccagccccagacgccattagtgaccttcttgctagtgtggatagcgaggaggtacgccagtact

SEQ ID NO: 66936 - DNA, 75 bp, Artificial Sequence
  Synthetic
atgcattcggaatgggtttcactgatgcagtatccagagaagtggaggccctaaagaatcacctcatagggtctg

SEQ ID NO: 66937 - DNA, 75 bp, Artificial Sequence
  Synthetic
aaattctgagttttgtggattgaggcaggccacaacacagggaataccagtggagctaaaacctggcaccaatca

SEQ ID NO: 66938 - DNA, 75 bp, Artificial Sequence
  Synthetic
tgcagtatccagagaagtggaggccctaaagaatcacctcatagggtctgaaggggctgttgagaagattttgaa

SEQ ID NO: 66939 - DNA, 75 bp, Artificial Sequence
  Synthetic
gggacttgttctggctcgatgatgaagcgatggagcagggggtcacagattacatcaagggacttggcgatgcct

SEQ ID NO: 66940 - DNA, 75 bp, Artificial Sequence
  Synthetic
tgcaatccatcgctacagttgtggcagtcgtttcactggtgtatgtcatctacaagctcttcgctggattccaag

SEQ ID NO: 66941 - DNA, 75 bp, Artificial Sequence
  Synthetic
actcacactggtaacacttgacactaatgaaaaattcagagacatcacgaagtttataccagaaacaattagtcc

SEQ ID NO: 66942 - DNA, 75 bp, Artificial Sequence
  Synthetic
tttggccctaattgggtgtcatggaagcccttgggcctggatcaaagccaaaacggcatctattttaggcatccc

SEQ ID NO: 66943 - DNA, 75 bp, Artificial Sequence
  Synthetic
atagttgttaggagtgattatgacctggtcactttgaccgcgacccttgctttgactgggtgccatggaagccct

SEQ ID NO: 66944 - DNA, 75 bp, Artificial Sequence
  Synthetic
agcccttgggcctggatcaaagccaaaacggcatctattttaggcatccccattgctcagaagcaaagcgcatcc

SEQ ID NO: 66945 - DNA, 75 bp, Artificial Sequence
  Synthetic
aagaaatttacagaaatggctaatgctgccagaggccttgaatggattgcaaacaaaattagtaagtttatagac

SEQ ID NO: 66946 - DNA, 75 bp, Artificial Sequence
  Synthetic
ctgccagaggccttgaatggattgcaaacaaaattagtaagtttatagactgggtgaaagagaagatcgtcccag

SEQ ID NO: 66947 - DNA, 75 bp, Artificial Sequence
  Synthetic
attgattggctcagggaaaagattgtaccagcagccaaggagaaagtggagtttctaaacaacctgaaacagttg

SEQ ID NO: 66948 - DNA, 75 bp, Artificial Sequence
  Synthetic
tccacgccactcccagcccggcaaaacaatctgggtagagcacaaactcgtaaacattctggacgctgttgaact

SEQ ID NO: 66949 - DNA, 75 bp, Artificial Sequence
  Synthetic
ccactattggaaaaccaaatttcgaatctagagcaatccgcagcctcacaggaagaccttgaagtaatgtttggg

SEQ ID NO: 66950 - DNA, 75 bp, Artificial Sequence
  Synthetic
acgcacgaaacacccaagatcacgtgcgctccctctgcttgttagcatggcacaacgggaaagaggagtatgaaa

SEQ ID NO: 66951 - DNA, 75 bp, Artificial Sequence
  Synthetic
atggccaatgcccgaataatatgatgggcacttttagcattaggacagtagggactgagaagtcaccacactcca

SEQ ID NO: 66952 - DNA, 75 bp, Artificial Sequence
  Synthetic
caatatggttttctcaacctcagtggaaagccaacccaccgtaccatgatgtacaactttcccaccaaggcaggg

SEQ ID NO: 66953 - DNA, 75 bp, Artificial Sequence
  Synthetic
tgaacctgtatgtctcatcatcagaggctctccaggtactggcaaatctttggcgactggaatcattgcccgagc

SEQ ID NO: 66954 - DNA, 75 bp, Artificial Sequence
  Synthetic
tcaagagcaaacaccgaattgaacctgtatgcttaataattagaggaccccctggcactggcaaatcactagcaa

SEQ ID NO: 66955 - DNA, 75 bp, Artificial Sequence
  Synthetic
cagtgtggaggggtggtgacatcagttggaaaggtcattggtatacacataggtggtaacggcagacaaggtttc

SEQ ID NO: 66956 - DNA, 75 bp, Artificial Sequence
  Synthetic
agaaaagtaccattctagtgtgtattccctacctccagatccggaccattttgatggctacaaacaacaagtggt

SEQ ID NO: 66957 - DNA, 75 bp, Artificial Sequence
  Synthetic
agtggtcacagtcatggatgacttgtgccaaaaccctgacggtaaggatatgtcgttattctgccagatggtgtc

SEQ ID NO: 66958 - DNA, 75 bp, Artificial Sequence
  Synthetic
gtggcagtcaaccatgctgggccagctgtgtggatactacactcagtggtcaggatcactggaggttacttttat

SEQ ID NO: 66959 - DNA, 75 bp, Artificial Sequence
  Synthetic
caccgccaattttaagagatgcagcccactagtgtgtggcaaagctattcaattaagagacagaaaatctaaagt

SEQ ID NO: 66960 - DNA, 75 bp, Artificial Sequence
  Synthetic
ttccaccaaggagcactcctagtcgctgtcctaccagagtatgtcattgggacagtggcaggcggtacagggacg

SEQ ID NO: 66961 - DNA, 75 bp, Artificial Sequence
  Synthetic
ggaatttattccacccatggctagtttagaggaaaaaggcgtttcatttacttcaaaatttgtgattgcctccac

SEQ ID NO: 66962 - DNA, 75 bp, Artificial Sequence
  Synthetic
tgccaaaaccctgacggtaaggatatgtcgttattctgccagatggtgtccactgtagatttcatcccaccgatg

SEQ ID NO: 66963 - DNA, 75 bp, Artificial Sequence
  Synthetic
ttagaggaaaaaggcgtttcatttacttcaaaatttgtgattgcctccactaattcatctaacattatagtccca

SEQ ID NO: 66964 - DNA, 75 bp, Artificial Sequence
  Synthetic
gtgccaacagtgtccgactccgatgccatccgtcgcaggttttacatggactgtgacatagaagtgacggactca

SEQ ID NO: 66965 - DNA, 75 bp, Artificial Sequence
  Synthetic
ccatccgtcgcaggttttacatggactgtgacatagaagtgacggactcatataaaacagatctgggcagattgg

SEQ ID NO: 66966 - DNA, 75 bp, Artificial Sequence
  Synthetic
aacctttaaagggatagatctagacgagttgaatatggtggcttatggagatgatgtgctagctagttatccttt

SEQ ID NO: 66967 - DNA, 75 bp, Artificial Sequence
  Synthetic
gtcccgttcatgtcgccagcaacagcttatcagtggttttatgatggttaccctacatttggtgagcacaaacaa

SEQ ID NO: 66968 - DNA, 75 bp, Artificial Sequence
  Synthetic
acaccccagggaagattagatgccgctagagctgccaagctttgttcagaaaacaacactgctaatttcaaaaag

SEQ ID NO: 66969 - DNA, 75 bp, Artificial Sequence
  Synthetic
ttgctgtgggtcactcggaacctggtgactgcggtggcatcctcaggtgccagcatggtgtggtaggaattgtct

SEQ ID NO: 66970 - DNA, 75 bp, Artificial Sequence
  Synthetic
ctagagctgccaagctttgttcagaaaacaacactgctaatttcaaaaagtgtagtcctctggtttgtggtaaag

SEQ ID NO: 66971 - DNA, 75 bp, Artificial Sequence
  Synthetic
ccactggtggaaatggtcttgtggggtttgccgatgtcagagaccttctatggctggatgaagaagcaatggaac

SEQ ID NO: 66972 - DNA, 75 bp, Artificial Sequence
  Synthetic
gaaaggctatccaactaagagataggaagtccaaggttaggtatagtgtggacacagtggtttctgagctcatga

SEQ ID NO: 66973 - DNA, 75 bp, Artificial Sequence
  Synthetic
accaccgggaaaaacgtccacgttcgggtgtacatgagaattaagcacgtgagagcttgggtacctagacccctt

SEQ ID NO: 66974 - DNA, 75 bp, Artificial Sequence
  Synthetic
catcctagattctactactagggatgtgagcaagatgaaattttatatggacaagtatggcttggaccttcccta

SEQ ID NO: 66975 - DNA, 75 bp, Artificial Sequence
  Synthetic
agacagcttccattcagggggatagagtggcagatgtgattgagagttctataggggacagtgtgagtagagcac

SEQ ID NO: 66976 - DNA, 75 bp, Artificial Sequence
  Synthetic
gaacatcaggcaagtccaaacagaccaggggcatttcaccatgttgggtgttagggatcgcttagcagtcctccc

SEQ ID NO: 66977 - DNA, 75 bp, Artificial Sequence
  Synthetic
gtgagcaagatgaaattttatatggacaagtatggcttggaccttccctactccacctatgtcaaggatgagcta

SEQ ID NO: 66978 - DNA, 75 bp, Artificial Sequence
  Synthetic
agctccggatgccatcagcgatctccttgctagcgtggacagcgaggaggtacgccaatattgtagagatcgggg

SEQ ID NO: 66979 - DNA, 75 bp, Artificial Sequence
  Synthetic
acaacaaccgctcggcagttggcaacaccattgaggcacttttccaaggcccaccccagtttaaaccaattagga

SEQ ID NO: 66980 - DNA, 75 bp, Artificial Sequence
  Synthetic
gaagtccaaggttaggtatagtgtggacacagtggtttctgagctcatgagagagtataacaatagatctgccat

SEQ ID NO: 66981 - DNA, 75 bp, Artificial Sequence
  Synthetic
atcacaattgacgatatgcccccatcaatggatcaatctgcggaccaataactgtgccacaataatagtgccata

SEQ ID NO: 66982 - DNA, 75 bp, Artificial Sequence
  Synthetic
cggtcagcagtccggtgccatttatgttggcaattacagagtagttaacagacaccttgccacacacaatgactg

SEQ ID NO: 66983 - DNA, 75 bp, Artificial Sequence
  Synthetic
tccagagaaacccaccaacattgagaggcatgtgaacagggctctaatgattctacaatcagtcactactgtagt

SEQ ID NO: 66984 - DNA, 75 bp, Artificial Sequence
  Synthetic
aatccggatacattctggagtaaactacccatcttactccctggctcactctttgctttcgactattcaggatat

SEQ ID NO: 66985 - DNA, 75 bp, Artificial Sequence
  Synthetic
gcaactctagaaggaaacactacccggttagtttttataagcctagcctcgtcttcgtggaagctagtgagtatt

SEQ ID NO: 66986 - DNA, 75 bp, Artificial Sequence
  Synthetic
tggggtgtaaccctgacacattctggagcaagctgccaattttgctccctggttcactctttgcctttgactact

SEQ ID NO: 66987 - DNA, 75 bp, Artificial Sequence
  Synthetic
gatttcagcgttagtaattgtaattaggagtgattatgatatggtcaccctcacagcaactttagccctgattgg

SEQ ID NO: 66988 - DNA, 75 bp, Artificial Sequence
  Synthetic
cttgagtggatttctagtaaaatcagcaagttcattgattggcttaaggaaaagattattccggccgctaaagag

SEQ ID NO: 66989 - DNA, 75 bp, Artificial Sequence
  Synthetic
aacagcggtcaagaaaccggtgctgagaaccgctgtggcccagggacctggtttagactttgctctctctctact

SEQ ID NO: 66990 - DNA, 75 bp, Artificial Sequence
  Synthetic
cacagtggtggcagttgtctcactagtgtacgttatctataagctctttgctgggttccaaggtgcgtactctgg

SEQ ID NO: 66991 - DNA, 75 bp, Artificial Sequence
  Synthetic
tttgttgcgtgcacccctactggtcaggttgttccacaattactccagtatatgtttgttccccctggcgctccc

SEQ ID NO: 66992 - DNA, 75 bp, Artificial Sequence
  Synthetic
aacagcttcccctgttggagaaccaaatctcaaatcttgaacagtctgctgcctcgcaagaggatctagaagcta

SEQ ID NO: 66993 - DNA, 75 bp, Artificial Sequence
  Synthetic
agaaccgctgtggcccagggacctggtttagactttgctctctctctactgaagaagaacatcagaaaatgccaa

SEQ ID NO: 66994 - DNA, 75 bp, Artificial Sequence
  Synthetic
ttaccatgctgggtgttagggaccgtttggctgttctcccacgccactcccaacccggcagagcaatctgggtag

SEQ ID NO: 66995 - DNA, 75 bp, Artificial Sequence
  Synthetic
ccagcacaggtttcagttccattcatgtcacccgcgagtgcttaccagtggttttacgacgggtatcccacattt

SEQ ID NO: 66996 - DNA, 75 bp, Artificial Sequence
  Synthetic
gattcaatctggattgagcacaaacagattaagattctggatgctgttgaattggtggacgaacaacaggtcaac

SEQ ID NO: 66997 - DNA, 75 bp, Artificial Sequence
  Synthetic
agctcaacatggttgcctacggggatgatgtgcttgccagttacccttttccaattgactgtttggagttggcaa

SEQ ID NO: 66998 - DNA, 75 bp, Artificial Sequence
  Synthetic
tgatgtgcttgccagttacccttttccaattgactgtttggagttggcaagaacaggcaaggagtacggtttaac

SEQ ID NO: 66999 - DNA, 75 bp, Artificial Sequence
  Synthetic
tttatgccctagagaaaaggatgaataactacatgcagttcaagagcaaacaccgtattgaacctgtatgcttaa

SEQ ID NO: 67000 - DNA, 75 bp, Artificial Sequence
  Synthetic
aaccaaatctcaaacttggagcagtccgccgcttcgcaagaagaccttgaggcaatgtttgggaatgtatcgtat

SEQ ID NO: 67001 - DNA, 75 bp, Artificial Sequence
  Synthetic
gaaggaactgctgacgccactctcgtcatcaacactgaagccatgccatcaatgtttgtcccagttggtgatgtt

SEQ ID NO: 67002 - DNA, 75 bp, Artificial Sequence
  Synthetic
gagagcatcagtgctgcaagcgatgctaccctagtaatcaacacagaacacatgccctctatgttcgtaccggtg

SEQ ID NO: 67003 - DNA, 75 bp, Artificial Sequence
  Synthetic
gagaatgaagcatgtcagggcatggatacctcgtccaatgcgtaaccaaaattacttgttcaaagccaatccaaa

SEQ ID NO: 67004 - DNA, 75 bp, Artificial Sequence
  Synthetic
cttgcccgatgaacaatttccattccttatccaccctaccatgccaatgaaagaaatccacgagtccatacggtg

SEQ ID NO: 67005 - DNA, 75 bp, Artificial Sequence
  Synthetic
tcatcaacactgaagccatgccatcaatgtttgtcccagttggtgatgttcaacagtacggtttcctcaatctca

SEQ ID NO: 67006 - DNA, 75 bp, Artificial Sequence
  Synthetic
cagtaggaaagattgtaggcatccacatagggggcaacggccgccaaggcttctgtgctgcactcaaacgcagct

SEQ ID NO: 67007 - DNA, 75 bp, Artificial Sequence
  Synthetic
cgcaattggctcgagttattttagaggttatacacacctcaaccccaccagaaatctggtcgtgaatgtgactgg

SEQ ID NO: 67008 - DNA, 75 bp, Artificial Sequence
  Synthetic
aggagagatccagtgggttaagcccaataaagaaactgggagactcaatatcaatgggccaacacgcaccaagct

SEQ ID NO: 67009 - DNA, 75 bp, Artificial Sequence
  Synthetic
gtcatcgcatcaaccaatgctagcaatattgtagttcccacagtttcagattctgatgcgattcgcaggcggttt

SEQ ID NO: 67010 - DNA, 75 bp, Artificial Sequence
  Synthetic
tcctaaataacctgaaacagctgccactgctagagaaccaaatttcaaacctagaacaatctgccgcctcacaag

SEQ ID NO: 67011 - DNA, 75 bp, Artificial Sequence
  Synthetic
caaccaagaccaaacttgaacctagtgttttccatgatgtttttgaaggagtcaaagaaccagcagtcctccact

SEQ ID NO: 67012 - DNA, 75 bp, Artificial Sequence
  Synthetic
gatagtgaagaggtgcgtcaatactgtagagaccaaggttggatcataccagaaacccctaccaacgttgagcga

SEQ ID NO: 67013 - DNA, 75 bp, Artificial Sequence
  Synthetic
gtcaaagaaccagcagtcctccactctaaggataagagacttgaggttgactttgaaactgccctcttctccaaa

SEQ ID NO: 67014 - DNA, 75 bp, Artificial Sequence
  Synthetic
gagacgcaattggctcgaactattctagaggttaagtatatacctcaaccccaccaggaatctggtcgtgaacat

SEQ ID NO: 67015 - DNA, 75 bp, Artificial Sequence
  Synthetic
acccacagggcccactgggcgctagcacactgattctgcgggatctttgtgcgcctgttttatatcccctccccc

SEQ ID NO: 67016 - DNA, 75 bp, Artificial Sequence
  Synthetic
ctaactttaagagatgcagcccactagtgtgtggcaaggccattcaattaagagacaggaagtctaaagtgagat

SEQ ID NO: 67017 - DNA, 75 bp, Artificial Sequence
  Synthetic
tttgaggggaacaaggagccagcagttctacatagtaaagatccccgtcttgaagtggactttgagcaggctctg

SEQ ID NO: 67018 - DNA, 75 bp, Artificial Sequence
  Synthetic
agagacaggaagtctaaagtgagatatagtattgacactgtggtgtcagagctaatcagagagtataataatagg

SEQ ID NO: 67019 - DNA, 75 bp, Artificial Sequence
  Synthetic
caattagacattgacacatcaaaaatgagcatggaggatgcttgctatggaacagaattcctagaaggaattgat

SEQ ID NO: 67020 - DNA, 75 bp, Artificial Sequence
  Synthetic
tgagcatggaggatgcttgctatggaacagaattcctagaaggaattgatttggcaacgagtgcagggtacccct

SEQ ID NO: 67021 - DNA, 75 bp, Artificial Sequence
  Synthetic
aactacttcgagaaacctagtaacaccatgaaagttgcggagtgtttcgctcagcacttcccccgtgtagatcag

SEQ ID NO: 67022 - DNA, 75 bp, Artificial Sequence
  Synthetic
gaaaagccggccccagatgccatcagtgacttacttgctagtgtggatagtgaggaggttcgacaatactgcagg

SEQ ID NO: 67023 - DNA, 75 bp, Artificial Sequence
  Synthetic
ggacatcttgaacccccaaactagggatgtgaccaaaatgaaaatgtacttggataaatacggcattgacctccc

SEQ ID NO: 67024 - DNA, 75 bp, Artificial Sequence
  Synthetic
gatgtgaccaaaatgaaaatgtacttggataaatacggcattgacctcccctactctacttatgtcaaggatgag

SEQ ID NO: 67025 - DNA, 75 bp, Artificial Sequence
  Synthetic
tagcgatctccttgctagtgtggacagtgaggaagtgcgccaatactgtagggaacaaggctggattattcctga

SEQ ID NO: 67026 - DNA, 75 bp, Artificial Sequence
  Synthetic
tctggagcaaactacccatcctactccctggctcactctttgcttttgattactcagggtatgacgctagtctta

SEQ ID NO: 67027 - DNA, 75 bp, Artificial Sequence
  Synthetic
cacagtccaaggaccgagcttagactttgccttatccctcctaaggcgcaacatcagacaggtgcaaactgacca

SEQ ID NO: 67028 - DNA, 75 bp, Artificial Sequence
  Synthetic
tttgccttatccctcctaaggcgcaacatcagacaggtgcaaactgaccaaggacatttcactatgttaggagtg

SEQ ID NO: 67029 - DNA, 75 bp, Artificial Sequence
  Synthetic
tcgagacctgcttgtttcgtctaccactgcccagggttgcgatacgattgcccgttgtgagtgtcagacaggggt

SEQ ID NO: 67030 - DNA, 75 bp, Artificial Sequence
  Synthetic
gtgacaattgaagaattgttactatatagctattggattggccatccggtgtgtaacagagcgataatctactcc

SEQ ID NO: 67031 - DNA, 75 bp, Artificial Sequence
  Synthetic
taaaagattaggttatgatcaagatgctatttctttaattgagggaatcaatcactcccaccacatttacagaaa

SEQ ID NO: 67032 - DNA, 75 bp, Artificial Sequence
  Synthetic
tctctttgcttttgattatactgggtatgatgctagtctttctcctgcttggtttagggctttggaaattgttct

SEQ ID NO: 67033 - DNA, 75 bp, Artificial Sequence
  Synthetic
ttgggtggagcacaaattaatcaatgtgttagatgctgttgaattggtggatgagcaaggtgtaaatttggaact

SEQ ID NO: 67034 - DNA, 75 bp, Artificial Sequence
  Synthetic
cgaacatgggagctcaagtgtcaacgcagcggacaggctcacacgaaaccatcaacaccgttcgtgacgggtcca

SEQ ID NO: 67035 - DNA, 75 bp, Artificial Sequence
  Synthetic
gcatttttaattccatgattaataatataataatcagaactctcttaatcaagacttttaaagggattgatctag

SEQ ID NO: 67036 - DNA, 75 bp, Artificial Sequence
  Synthetic
ttgctcattaaaacattcaagggcattgatctggacgagctcaacatggttgcctatggggatgatgtgcttgct

SEQ ID NO: 67037 - DNA, 75 bp, Artificial Sequence
  Synthetic
gatgaacaactacatgcagttcaagagcaaacaccgtattgaacctgtatgtctcatcattaggggctcaccagg

SEQ ID NO: 67038 - DNA, 75 bp, Artificial Sequence
  Synthetic
atttgggtggaacacaaacttgtgaacatccttgacgcggtcgagctggtggacgagcaaggcgttaatttggaa

SEQ ID NO: 67039 - DNA, 75 bp, Artificial Sequence
  Synthetic
atgctcgcacagggtcactcagaacctggtgattgcggtggtatccttagatgccaacatggcgtcgtcggcata

SEQ ID NO: 67040 - DNA, 75 bp, Artificial Sequence
  Synthetic
agatgatgtccttgctagctaccccttccctatcgactgtgctgaacttgcaaagacaggattggaatatggctt

SEQ ID NO: 67041 - DNA, 75 bp, Artificial Sequence
  Synthetic
tagagctagcaaggacaggcaaggagtatggtttgaccatgactcctgcagacaaatccccttgctttaatgaag

SEQ ID NO: 67042 - DNA, 75 bp, Artificial Sequence
  Synthetic
tttagatatacttacagaaatggctgctccccttcaatcaccgactgccgaggcgtgtgggtatagtgatagagt

SEQ ID NO: 67043 - DNA, 75 bp, Artificial Sequence
  Synthetic
tcaattgggaaaatgcaacttttctcaagagaggtttcttgcctgatgagcaatttccatttttgattcatccta

SEQ ID NO: 67044 - DNA, 75 bp, Artificial Sequence
  Synthetic
ttccagtgggtgatgttgtacagtatgggtttctaaatctcagcggtaagcccacacaccgaaccatgatgtaca

SEQ ID NO: 67045 - DNA, 75 bp, Artificial Sequence
  Synthetic
gctccccttcaatcaccgactgccgaggcgtgtgggtatagtgatagagtagcacaacttaccatcggcaactct

SEQ ID NO: 67046 - DNA, 75 bp, Artificial Sequence
  Synthetic
tggactgaagagaggttactttgccagtgaacaaggagagatccaatggatgaagtccaataaagaaactgggag

SEQ ID NO: 67047 - DNA, 75 bp, Artificial Sequence
  Synthetic
gccactgcagttgacaagcccacgaggcccgatgtgtcagtgaacagattttacactttggatactaaagactgg

SEQ ID NO: 67048 - DNA, 75 bp, Artificial Sequence
  Synthetic
ggcccgatgtgtcagtgaacagattttacactttggatactaaagactggcaagccagttcaaaagggtggtact

SEQ ID NO: 67049 - DNA, 75 bp, Artificial Sequence
  Synthetic
attgaacattaatggtccaacacgtaccaagttggagcccagtgcattctatgatgtgtttgagggcagcaaaga

SEQ ID NO: 67050 - DNA, 75 bp, Artificial Sequence
  Synthetic
gggcgcagcacactgattctatggaatctttgtgcgcctgttttataaccccttcccaaaactgtaacttagaag

SEQ ID NO: 67051 - DNA, 75 bp, Artificial Sequence
  Synthetic
ttttaaatgacaaattgaattgatgttaattggcaaaacctttggtgtaccctgggcttgacaaagtcaccaaag

SEQ ID NO: 67052 - DNA, 75 bp, Artificial Sequence
  Synthetic
ggttttgcattcatgtacaatgcaatgccagcaaatttcatcaaggcgcgcttctcgtagctatagtgccagagt

SEQ ID NO: 67053 - DNA, 75 bp, Artificial Sequence
  Synthetic
tgccagcaaatttcatcaaggcgcgcttctcgtagctatagtgccagagtatgtaactggtacgatagccggcaa

SEQ ID NO: 67054 - DNA, 75 bp, Artificial Sequence
  Synthetic
cctggaggaaatgtgcctgcggacagaatcacagcaatgctagggacgcatgtgatctgggacttcggattacaa

SEQ ID NO: 67055 - DNA, 75 bp, Artificial Sequence
  Synthetic
ttatgtgttagatgctggtatacccatcagccaattattgatatgtccacaccagtggatcaatcttaggactaa

SEQ ID NO: 67056 - DNA, 75 bp, Artificial Sequence
  Synthetic
atcagccaattattgatatgtccacaccagtggatcaatcttaggactaacaattgcgccactctcatagtgcct

SEQ ID NO: 67057 - DNA, 75 bp, Artificial Sequence
  Synthetic
ttgtcctacgcatcaacagcaaccaccactatcccgataacaatcactgtagcaccaatgtgttctgaatttgct

SEQ ID NO: 67058 - DNA, 75 bp, Artificial Sequence
  Synthetic
tcccgcttgattgaagccagtagtctaaatgactcagtctacctcaggatgactttcgggcatttctacgaaact

SEQ ID NO: 67059 - DNA, 75 bp, Artificial Sequence
  Synthetic
ccactatcccgataacaatcactgtagcaccaatgtgttctgaatttgctggcctcagacaggccgtgcagcaag

SEQ ID NO: 67060 - DNA, 75 bp, Artificial Sequence
  Synthetic
ccaggtggagaccattttggaggtcaacaatgtacccacgaatgccaccagcttaatggagagactgcgctttcc

SEQ ID NO: 67061 - DNA, 75 bp, Artificial Sequence
  Synthetic
ctccaagtacgtggggaatacattacatgagcctgatgagtacattagagaagcagctcttcactatgcaaacca

SEQ ID NO: 67062 - DNA, 75 bp, Artificial Sequence
  Synthetic
ccgggttccacccgactcaggttatacacataccgggcgaggttagaaaccttctcgaattgtgccaagtagaga

SEQ ID NO: 67063 - DNA, 75 bp, Artificial Sequence
  Synthetic
acacataccgggcgaggttagaaaccttctcgaattgtgccaagtagagacaatgctagaagtcaacaacttaga

SEQ ID NO: 67064 - DNA, 75 bp, Artificial Sequence
  Synthetic
catcatgtgtatcggaacaggacatattgtgtccttggtggaatgccttcaggttgttccggtacttccatcttc

SEQ ID NO: 67065 - DNA, 75 bp, Artificial Sequence
  Synthetic
tgtcttccgagcggacccaggtctcgacgggccatggcaatcaaccttattagggcagctgtgcaggtattacac

SEQ ID NO: 67066 - DNA, 75 bp, Artificial Sequence
  Synthetic
gacgggccatggcaatcaaccttattagggcagctgtgcaggtattacacacagtggtccggatcactgaaactt

SEQ ID NO: 67067 - DNA, 75 bp, Artificial Sequence
  Synthetic
ctagtagacaggattttgcacaagatcctgcaaagttcacacgtcctgtcttggataccatcagggaggttgcag

SEQ ID NO: 67068 - DNA, 75 bp, Artificial Sequence
  Synthetic
ccagcctctagaatggatgcaatgctaggcactcacatcatatgggattttgggttgcaatcttcagtttcgtta

SEQ ID NO: 67069 - DNA, 75 bp, Artificial Sequence
  Synthetic
taggcactcacatcatatgggattttgggttgcaatcttcagtttcgttagtcataccctggatcagcaacacac

SEQ ID NO: 67070 - DNA, 75 bp, Artificial Sequence
  Synthetic
aactaatctctgcactggtgattgtgatcagaagtgattatgatatggttaccctcactgcgaccttggcgttga

SEQ ID NO: 67071 - DNA, 75 bp, Artificial Sequence
  Synthetic
tgaagcttgtggttacagtgatcgcgtggcacaactcaccattggaaactccaccattaccacacaggaagcggc

SEQ ID NO: 67072 - DNA, 75 bp, Artificial Sequence
  Synthetic
actttgttgtaccggctgagacacccaccacagccaacataatagtcttgggagcagctcaacccaactttacta

SEQ ID NO: 67073 - DNA, 75 bp, Artificial Sequence
  Synthetic
caccacagccaacataatagtcttgggagcagctcaacccaactttactatgcgtctatgcagagacgctgactc

SEQ ID NO: 67074 - DNA, 75 bp, Artificial Sequence
  Synthetic
ctcactaacttcccctactcaaacccccacagccgccaacacaaacgtgagtaatcatcgaattgagctggggga

SEQ ID NO: 67075 - DNA, 75 bp, Artificial Sequence
  Synthetic
ccccccccccagtgaaacttagaagcagcaaaccacgatcaatagcaggcataacgctccagttatgtcttgatc

SEQ ID NO: 67076 - DNA, 75 bp, Artificial Sequence
  Synthetic
cccacagccgccaacacaaacgtgagtaatcatcgaattgagctgggggaagtcccggctttgcaagctgctgaa

SEQ ID NO: 67077 - DNA, 75 bp, Artificial Sequence
  Synthetic
agggaggttgaagctctcaagaactatctcatagggtctgaaggggcagttgagaaaattttgaaaaatttaatc

SEQ ID NO: 67078 - DNA, 75 bp, Artificial Sequence
  Synthetic
attaactgtgtgccctcaccagtggatcaacctgagaaccaataattgtgcaaccattatagtcccatatatgaa

SEQ ID NO: 67079 - DNA, 75 bp, Artificial Sequence
  Synthetic
gaaactacagtggggcacttcttttcaagagcggggttggtgggagtgattgacctcccattacagggaacagtc

SEQ ID NO: 67080 - DNA, 75 bp, Artificial Sequence
  Synthetic
caagagcggggttggtgggagtgattgacctcccattacagggaacagtcaacacaggaggattcgcctcgtggg

SEQ ID NO: 67081 - DNA, 75 bp, Artificial Sequence
  Synthetic
ttaccttcatagcttccaccccagatggcgaggtgaagccagtgttcttacagtacatgttcgtcccccctggtg

SEQ ID NO: 67082 - DNA, 75 bp, Artificial Sequence
  Synthetic
ttagcggcctccgacaagcaataaaacaagggtttcccacagagctcaagcctgggactaatcaatttcttacaa

SEQ ID NO: 67083 - DNA, 75 bp, Artificial Sequence
  Synthetic
tggcgaggtgaagccagtgttcttacagtacatgttcgtcccccctggtgcaccaaaaccaacagggcgcaacac

SEQ ID NO: 67084 - DNA, 75 bp, Artificial Sequence
  Synthetic
cgaattattctagaggttaaacatacgactcaactccaccagcaatctggtcgtgtaaataactggtggaggtaa

SEQ ID NO: 67085 - DNA, 75 bp, Artificial Sequence
  Synthetic
tctgtttccccggaccgagtatcaatagactgttcacgcggttgaaggagaaagcgtccgttatccggctaacta

SEQ ID NO: 67086 - DNA, 75 bp, Artificial Sequence
  Synthetic
gttcatgtcaccagccagcgcatatcagtggttctatgacgggtacccaacctttggaaagcacctgcctgctga

SEQ ID NO: 67087 - DNA, 75 bp, Artificial Sequence
  Synthetic
cagtggttctatgacgggtacccaacctttggaaagcacctgcctgctgatgactttcagtacggtatgacccca

SEQ ID NO: 67088 - DNA, 75 bp, Artificial Sequence
  Synthetic
aacatgggttcgcaagtgtctacacagcgctccggttctcacgaaaactcaaactcagccactgagggttctacc

SEQ ID NO: 67089 - DNA, 75 bp, Artificial Sequence
  Synthetic
tacatgcgcatgaaacacgtgcgggtgtggattccacgacctatgcgcagccagccatacgttgcgaagaattac

SEQ ID NO: 67090 - DNA, 75 bp, Artificial Sequence
  Synthetic
tgtggattccacgacctatgcgcagccagccatacgttgcgaagaattaccctaactacaagggttctgagatca

SEQ ID NO: 67091 - DNA, 75 bp, Artificial Sequence
  Synthetic
cctttatgttcacaggctcttttatggccacagggaaaatgctgatagcctacacaccacctggtagtgctcagc

SEQ ID NO: 67092 - DNA, 75 bp, Artificial Sequence
  Synthetic
tacaaactttttgctggattccaaggcgcgtactctggtgctcccaagcaagtacttaagaagcccgttctccgt

SEQ ID NO: 67093 - DNA, 75 bp, Artificial Sequence
  Synthetic
gccactgaagtccccatccgctgaggcatgtgggtacagtgatcgagtggcgcaattaactattggcaactccac

SEQ ID NO: 67094 - DNA, 75 bp, Artificial Sequence
  Synthetic
gtaacttcagagtggtaaatcggcaccttgccactcacaatgactgggctaatctagtgtgggaagatagctcac

SEQ ID NO: 67095 - DNA, 75 bp, Artificial Sequence
  Synthetic
ccttgccactcacaatgactgggctaatctagtgtgggaagatagctcacgggacctcctcgtgtcatccactac

SEQ ID NO: 67096 - DNA, 75 bp, Artificial Sequence
  Synthetic
ctacccggtcagtttctcaaaacccagccttgtctttgtggaagccagtgagtactaccctgctagatatcaatc

SEQ ID NO: 67097 - DNA, 75 bp, Artificial Sequence
  Synthetic
agccttgtctttgtggaagccagtgagtactaccctgctagatatcaatcacaccttatgctcgcagaaggtcac

SEQ ID NO: 67098 - DNA, 75 bp, Artificial Sequence
  Synthetic
gggctcgtcggttttgccgatgtgagagatctactgtggctggatgaagaagccatggagcaaggagtgtctgat

SEQ ID NO: 67099 - DNA, 75 bp, Artificial Sequence
  Synthetic
gagatctactgtggctggatgaagaagccatggagcaaggagtgtctgattatatcaagggacttggtgatgcat

SEQ ID NO: 67100 - DNA, 75 bp, Artificial Sequence
  Synthetic
aaggttgaattcctaaataacttgaaacagttgccactgctagagaatcagatctcaaacttggaacaatctgct

SEQ ID NO: 67101 - DNA, 75 bp, Artificial Sequence
  Synthetic
cagttgaaaagattctcaaaaacctcatcaagctaatttcagcactggtgatagtaattaggagtgattatgaca

SEQ ID NO: 67102 - DNA, 75 bp, Artificial Sequence
  Synthetic
catcaagctaatttcagcactggtgatagtaattaggagtgattatgacatggttactctcacagcaaccttagc

SEQ ID NO: 67103 - DNA, 75 bp, Artificial Sequence
  Synthetic
gagtgtacgccctagaaaaaagaatgaacaattacatgcagttcaagagcaaacaccgtattgaacctgtatgcc

SEQ ID NO: 67104 - DNA, 75 bp, Artificial Sequence
  Synthetic
tctcactcattgagggaatcaaccacacacatcatgtgtatcgtaataagacctattgtgtgcttggtgggatgc

SEQ ID NO: 67105 - DNA, 75 bp, Artificial Sequence
  Synthetic
cgcatgcccgggatggagtgttcgactactataccacaggactggtcagtatctggtatcaaacaaactacgtag

SEQ ID NO: 67106 - DNA, 75 bp, Artificial Sequence
  Synthetic
ccagaagcagagcgcgtcttggctaaaaaaattcaatgacatggccaatgctgccaaagggttagagtggatatc

SEQ ID NO: 67107 - DNA, 75 bp, Artificial Sequence
  Synthetic
gaataacctgaaacagctaccactgttggagaatcaaatctcaaacctagaacaatctgctgcttcacaagagga

SEQ ID NO: 67108 - DNA, 75 bp, Artificial Sequence
  Synthetic
ggtcaaaacacacaggtgagcagtcatcgactagacactggcgaagttccagcgctccaagctgctgaaattggg

SEQ ID NO: 67109 - DNA, 75 bp, Artificial Sequence
  Synthetic
aaagactcctatgctgccacagcaggcaaacagagtctcaagcaggatccagacaagtttgcaaatcctgttaaa

SEQ ID NO: 67110 - DNA, 75 bp, Artificial Sequence
  Synthetic
ttggagaatcaaatctcaaacctagaacaatctgctgcttcacaagaggaccttgaagcaatgttcgggaatgtg

SEQ ID NO: 67111 - DNA, 75 bp, Artificial Sequence
  Synthetic
ttataaagggaatgatattaagtgcactagcactagtagagacaagataacaacactgggaaagtttggacagca

SEQ ID NO: 67112 - DNA, 75 bp, Artificial Sequence
  Synthetic
tcactcccaccagacccagatcacttcgatgggtacaaacagcaagcggtcacagttatggatgacctatgtcaa

SEQ ID NO: 67113 - DNA, 75 bp, Artificial Sequence
  Synthetic
aaatttagtatgggaaagtagctcacgagatcttctggtgtcctccactactgctcaaggatgtgataccattgc

SEQ ID NO: 67114 - DNA, 75 bp, Artificial Sequence
  Synthetic
cttgaagaaaaaggagtttctttcacatccaaatttgtcattgcgtccaccaatgccagtaacatcatagtgcca

SEQ ID NO: 67115 - DNA, 75 bp, Artificial Sequence
  Synthetic
acggtatccgattctgatgccatccgtcgcagattttatatggattgtgacattgaagtgacggattcatacaaa

SEQ ID NO: 67116 - DNA, 75 bp, Artificial Sequence
  Synthetic
gcggaatttgcgggtctgcgccaggcagtaaagcaaggcataccaacagagctcaaacctggtaccaatcagttt

SEQ ID NO: 67117 - DNA, 75 bp, Artificial Sequence
  Synthetic
tgaagcacgtcagggcgtggatacctcgcccgatgcgtaaccaaaactatctattcaaagccaacccaaattatg

SEQ ID NO: 67118 - DNA, 75 bp, Artificial Sequence
  Synthetic
ccaaatggtttctacagtggactttataccacccatggcatcactggaagagaaaggagtgtctttcacctctaa

SEQ ID NO: 67119 - DNA, 75 bp, Artificial Sequence
  Synthetic
attcttaggtgccaacatggcgtgattggtatcgtgtccactggtggtgatggacttgtcggatttgcagatgtc

SEQ ID NO: 67120 - DNA, 75 bp, Artificial Sequence
  Synthetic
atgagcaaggagtcaacctggaactaaccctcatcactcttgacactaatgaaaagtttagggatatcaccaaat

SEQ ID NO: 67121 - DNA, 75 bp, Artificial Sequence
  Synthetic
tgcagcccactagtgtgtgggaaggctatccaacttagagacaggaaatccaaggtcagatatagtgtggacaca

SEQ ID NO: 67122 - DNA, 75 bp, Artificial Sequence
  Synthetic
gaagtacacaacttattggaaatatgcagagtggagaccatcttggaggttaacaacctgaagaccaatgagacc

SEQ ID NO: 67123 - DNA, 75 bp, Artificial Sequence
  Synthetic
ttgtctccactggtggaaatggtcttgtggggttcgctgatgtcagagatcttctatggctggatgaagaagcaa

SEQ ID NO: 67124 - DNA, 75 bp, Artificial Sequence
  Synthetic
gaaaagatcctgaagaacttggtgaagctaatttcagctttagtcatagtcgttaggagtgattatgacatggtc

SEQ ID NO: 67125 - DNA, 75 bp, Artificial Sequence
  Synthetic
aggttccagcactccaagctgctgaaattggagcatcatcaaatgctagtgacgagagcatgattgagacacgct

SEQ ID NO: 67126 - DNA, 75 bp, Artificial Sequence
  Synthetic
tcagccttgaggagaagccagccccagatgccatcagcgacctccttgctagcgtggacagtgaagaagtgcgcc

SEQ ID NO: 67127 - DNA, 75 bp, Artificial Sequence
  Synthetic
ctatccaacttagagacaggaaatccaaggtcagatatagtgtggacacagtagtctctgaactcattagagagt

SEQ ID NO: 67128 - DNA, 75 bp, Artificial Sequence
  Synthetic
catcccagaaacccccaccaatgtcgagcgccatcttaatagggcagtgctggtcatgcaatccattgctactgt

SEQ ID NO: 67129 - DNA, 75 bp, Artificial Sequence
  Synthetic
tgaggaggcagtcttactcattgaggggattaaccatacacaccatgtgtaccgcaacaaaacttattgtgtgct

SEQ ID NO: 67130 - DNA, 75 bp, Artificial Sequence
  Synthetic
taagcaagcactcaagaaacctgttctccgcacggcaacagtgcagggcccaagtctcgactttgctctctctct

SEQ ID NO: 67131 - DNA, 75 bp, Artificial Sequence
  Synthetic
gaaccaaatttcaaatcttgaacagtctgctgcctcgcaggaggatttagaagctatgtttggtaatgtgtcata

SEQ ID NO: 67132 - DNA, 75 bp, Artificial Sequence
  Synthetic
tgtcctcccgcgacattcacagcccggaaaaacaatctgggtggagcacaaacttgtgaacattctggacgctgt

SEQ ID NO: 67133 - DNA, 75 bp, Artificial Sequence
  Synthetic
ggaaaaacaatctgggtggagcacaaacttgtgaacattctggacgctgttgaattggtggatgaacaaggagtt

SEQ ID NO: 67134 - DNA, 75 bp, Artificial Sequence
  Synthetic
gtgcggactgtggggacctccaagtccaagtaccctttagtggttaggatctacatgagaatgaagcacgtcagg

SEQ ID NO: 67135 - DNA, 75 bp, Artificial Sequence
  Synthetic
cgcaacatcagacaggtgcaaaccgaccaaggacatttcactatgttaggagtgcgagatcgcctagccattttg

SEQ ID NO: 67136 - DNA, 75 bp, Artificial Sequence
  Synthetic
atcagtgctgctagtgacgccactctagtgatcaacacagaacacatgccctcaatgtttgtgccagtgggtgac

SEQ ID NO: 67137 - DNA, 75 bp, Artificial Sequence
  Synthetic
tagtgatcaacacagaacacatgccctcaatgtttgtgccagtgggtgacgtcgtgcagtacggtttcctgaacc

SEQ ID NO: 67138 - DNA, 75 bp, Artificial Sequence
  Synthetic
taatgtgctggatgctgtcgaattggtggatgagcaaggtgtaaacttggaactcacactagtaaccttagacac

SEQ ID NO: 67139 - DNA, 75 bp, Artificial Sequence
  Synthetic
catctgttggaaaggtcattggtattcacatcggtggcaacggtaggcaaggtttctgtgcaggacttaaaagaa

SEQ ID NO: 67140 - DNA, 75 bp, Artificial Sequence
  Synthetic
tcacatcggtggcaacggtaggcaaggtttctgtgcaggacttaaaagaagttacttcgccagtgagcaagggga

SEQ ID NO: 67141 - DNA, 75 bp, Artificial Sequence
  Synthetic
tagtgtgttccatgacgtcttcgagggaaacaaagagccagctgttttacacagcaaggatccacgtcttgaagt

SEQ ID NO: 67142 - DNA, 75 bp, Artificial Sequence
  Synthetic
ggaaacaaagagccagctgttttacacagcaaggatccacgtcttgaagtggactttgaacaggcactattctcc

SEQ ID NO: 67143 - DNA, 75 bp, Artificial Sequence
  Synthetic
atagaggctagtagcttgaatgactctgtctacctcagaatgacttttgggcacctttacgaggtgtttcatgct

SEQ ID NO: 67144 - DNA, 75 bp, Artificial Sequence
  Synthetic
ccaaagttagatatagtgtggatacggtggtttcagagctcataagggaatacaataacaggtctgctatcggaa

SEQ ID NO: 67145 - DNA, 75 bp, Artificial Sequence
  Synthetic
aagcaactggatattgatacttctcaaatgagtatggaggaggcttgctatggaactgagaacctagaggccatt

SEQ ID NO: 67146 - DNA, 75 bp, Artificial Sequence
  Synthetic
aaatgagtatggaggaggcttgctatggaactgagaacctagaggccattgaccttcataccagtgcaggctatc

SEQ ID NO: 67147 - DNA, 75 bp, Artificial Sequence
  Synthetic
ttaagaaacctgctcttcgcacagcaacagtgcagggtccgagccttgattttgctctctccttgctgaggagga

SEQ ID NO: 67148 - DNA, 75 bp, Artificial Sequence
  Synthetic
gccacccaagtttagacctattaggattagtcttgaggagatgccagcaccagatgttattagtgatcttcttgc

SEQ ID NO: 67149 - DNA, 75 bp, Artificial Sequence
  Synthetic
cagatgttattagtgatcttcttgccagtgtggatagtgaggaggtgcgccaatactgtagagaccaaggttgga

SEQ ID NO: 67150 - DNA, 75 bp, Artificial Sequence
  Synthetic
agcgatcgggtagcacaactaactattggcaactctaccatcaccacacaagaagcagcaaacatcatagttggc

SEQ ID NO: 67151 - DNA, 75 bp, Artificial Sequence
  Synthetic
acatggacaagtacggccttgaccttccttattccacctatgttaaagatgagctccgctcaattgaaaagatca

SEQ ID NO: 67152 - DNA, 75 bp, Artificial Sequence
  Synthetic
tccttattccacctatgttaaagatgagctccgctcaattgaaaagatcaagaaagggaaatcccgtctaatcga

SEQ ID NO: 67153 - DNA, 75 bp, Artificial Sequence
  Synthetic
cggggcaagcgacgcaaccttggtcatcaacactgagcacatgccctcaatgttcgttccagtgggtgatgttgt

SEQ ID NO: 67154 - DNA, 75 bp, Artificial Sequence
  Synthetic
tccactgtagatttcatccctccgatgtcttatcttgacgagaacaggatgtctttcacctgtagatatgtcatt

SEQ ID NO: 67155 - DNA, 75 bp, Artificial Sequence
  Synthetic
tgggactgtgactggctctgccgtggggtgtaacccggatactttctggagcaagctaccaatcttgctccctgg

SEQ ID NO: 67156 - DNA, 75 bp, Artificial Sequence
  Synthetic
tgccacgccactcgcaaccaggaaaaactatttgggtggagcacaaattaattaatgtgttagatgctgttgaat

SEQ ID NO: 67157 - DNA, 75 bp, Artificial Sequence
  Synthetic
ggttatgatgctagtctcagtcctgtttggtttagagcactggagctagttcttagggagataggctatagtgag

SEQ ID NO: 67158 - DNA, 75 bp, Artificial Sequence
  Synthetic
acacacaacgactgggcaaaccttgtgtgggaggacagctctagggacctgttagtctcttccaccaccgcccag

SEQ ID NO: 67159 - DNA, 75 bp, Artificial Sequence
  Synthetic
aagttccaaccgctatacgccacggaagctaaaagagtctatgccctggagaagagaatgaataactatatgcag

SEQ ID NO: 67160 - DNA, 75 bp, Artificial Sequence
  Synthetic
attggaaatacaattgaagccctgttccagggaccacccaagtttagaccaatcaggatcagccttgaggagaaa

SEQ ID NO: 67161 - DNA, 75 bp, Artificial Sequence
  Synthetic
ggaatgccctcaggctgctcgggaacatccattttcaattcaatgattaacaacatcatcattagggcgctactc

SEQ ID NO: 67162 - DNA, 75 bp, Artificial Sequence
  Synthetic
cctttcccaattgactgtctggaattggcgagaacaggtaaggagtatggcttgactatgactcctgcagacaag

SEQ ID NO: 67163 - DNA, 75 bp, Artificial Sequence
  Synthetic
ccattcttgatccatcccaccatgccaatgaaggagatccatgagtctattcgatggaccaaggatgcacggaac

SEQ ID NO: 67164 - DNA, 75 bp, Artificial Sequence
  Synthetic
caatgaaggagatccatgagtctattcgatggaccaaggatgcacggaacactcaagatcacgtgcgatccctgt

SEQ ID NO: 67165 - DNA, 75 bp, Artificial Sequence
  Synthetic
tcttggtattcctatagtgcaaaaacagagcgcttcatggctaaagaagtttaatgacatggctaacgctgcaaa

SEQ ID NO: 67166 - DNA, 75 bp, Artificial Sequence
  Synthetic
atcagcaagttcattgattggcttaaggaaaagattattccagccgctaaggagaaagttgaattcttgaacaac

SEQ ID NO: 67167 - DNA, 75 bp, Artificial Sequence
  Synthetic
aagcattggccattccaaattatgaaaatctgagacgtaattggctcgaattattttagaggttagacatacctc

SEQ ID NO: 67168 - DNA, 75 bp, Artificial Sequence
  Synthetic
aaatctgagacgtaattggctcgaattattttagaggttagacatacctcaaccccaccagagatctggtcgtgt

SEQ ID NO: 67169 - DNA, 75 bp, Artificial Sequence
  Synthetic
cggagaacacaaacaggagaaagatcttgaatatggggcatgtcctaataacatgatgggcacgttctcagtgcg

SEQ ID NO: 67170 - DNA, 75 bp, Artificial Sequence
  Synthetic
ccctagaggcccacgtggcggctagcactctggtatcacggtacctttgtgcgcctgttttatatccctttcccc

SEQ ID NO: 67171 - DNA, 75 bp, Artificial Sequence
  Synthetic
cttagaagcttcacactatcatgaccaatagtaggcgtggtgcaccagtcacgtcttggtcaagcacttctgttt

SEQ ID NO: 67172 - DNA, 75 bp, Artificial Sequence
  Synthetic
gtctatgccctagagaaaaggatgaacaactacatgcagttcaagagcaaacaccgtattgaacctgtatgtctg

SEQ ID NO: 67173 - DNA, 75 bp, Artificial Sequence
  Synthetic
atctgggactttgggctgcaatcgtctgtcacccttgtgataccatggatcagcaacactcactacagagcgcac

SEQ ID NO: 67174 - DNA, 75 bp, Artificial Sequence
  Synthetic
atgtaacttagaagttattaaacaaagttcaatagaagggggtacaaaccagtgccaccacgaacaagcacttct

SEQ ID NO: 67175 - DNA, 75 bp, Artificial Sequence
  Synthetic
gggaaatcccgtctgattgaagccagcagcctgaatgactcagtttacctcaggatgacttttggacatctctat

SEQ ID NO: 67176 - DNA, 75 bp, Artificial Sequence
  Synthetic
ttgtacccacccacagggcccactgggcgctagcactctgattctgcggaatctttgtgcgcctgttttataacc

SEQ ID NO: 67177 - DNA, 75 bp, Artificial Sequence
  Synthetic
agcccattggattttgaccaaggggcaactccggttatccctattacaatcactctagctccaatgtgctctgag

SEQ ID NO: 67178 - DNA, 75 bp, Artificial Sequence
  Synthetic
tggccatccggtaaccaacagagctattgtttacctgtttattggatacgtccctctcaatctcaaggccattca

SEQ ID NO: 67179 - DNA, 75 bp, Artificial Sequence
  Synthetic
ttagttggagagatagacctccctcttgaaggtacaaccaacccgaatgggtatgcaaactgggacatagacata

SEQ ID NO: 67180 - DNA, 75 bp, Artificial Sequence
  Synthetic
gattggccatccggtgactaacagagatctcatatacctttttgttggttttactaaattaaatattaccacgtt

SEQ ID NO: 67181 - DNA, 75 bp, Artificial Sequence
  Synthetic
ggatcgcatgagaatcaaaacatcgctgcaagtggatccactataaactataccaccattaattactacaaggat

SEQ ID NO: 67182 - DNA, 75 bp, Artificial Sequence
  Synthetic
ctgcaagtggatccactataaactataccaccattaattactacaaggattcatatgctgcatctgcagccaagc

SEQ ID NO: 67183 - DNA, 75 bp, Artificial Sequence
  Synthetic
aattctaccatcacgacgcaagaagcagctaacatagttatagcctatggggagtggcctgaatattgcccagac

SEQ ID NO: 67184 - DNA, 75 bp, Artificial Sequence
  Synthetic
aatcaccatcggcagaagcatgtgggtatagtgacagagtggctcagttaaccgtgggcaactccactattacca

SEQ ID NO: 67185 - DNA, 75 bp, Artificial Sequence
  Synthetic
gtatagtgacagagtggctcagttaaccgtgggcaactccactattaccacccaagaagcggccaacatcactgt

SEQ ID NO: 67186 - DNA, 75 bp, Artificial Sequence
  Synthetic
tagatttttcacgctagacaccaaatcttgggccaaggattcaaagggatggtattggaaattccctgatgtttt

SEQ ID NO: 67187 - DNA, 75 bp, Artificial Sequence
  Synthetic
ctccgtcaataggttttacacacttagtgctaagctgtgggaaaagactggcgagaattccaaggggtggtactg

SEQ ID NO: 67188 - DNA, 75 bp, Artificial Sequence
  Synthetic
agtgctaagctgtgggaaaagactggcgagaattccaaggggtggtactggaaattcccagatgtgttgacagaa

SEQ ID NO: 67189 - DNA, 75 bp, Artificial Sequence
  Synthetic
gctagtaaattccatcaaggaacactactggttgtagtgatcccggagtttgttaattctagatcctctaatagt

SEQ ID NO: 67190 - DNA, 75 bp, Artificial Sequence
  Synthetic
tactggttgtagtgatcccggagtttgttaattctagatcctctaatagtactgaccctaccacagctccacacc

SEQ ID NO: 67191 - DNA, 75 bp, Artificial Sequence
  Synthetic
cgagctgcgctcgattgataaaatcaagaaagggaagtcccgtctgatcgaggccagtagtctaaatgattcagt

SEQ ID NO: 67192 - DNA, 75 bp, Artificial Sequence
  Synthetic
cactctcccaagcattaatctggccgcatcaatggattaacctcaggactaacaattgtgccaccatagttatcc

SEQ ID NO: 67193 - DNA, 75 bp, Artificial Sequence
  Synthetic
gcatcaatggattaacctcaggactaacaattgtgccaccatagttatcccctatgctaacaccgtgccctttga

SEQ ID NO: 67194 - DNA, 75 bp, Artificial Sequence
  Synthetic
gacagctataccaataacagttaccatagctcccttgtgctctgaatttgcaggtctgaggcaggctgtacagca

SEQ ID NO: 67195 - DNA, 75 bp, Artificial Sequence
  Synthetic
tggctttgtaccactaaccttaaaatctataaccaccctcgactttatattaaccctcaatacagtcaaacatgg

SEQ ID NO: 67196 - DNA, 75 bp, Artificial Sequence
  Synthetic
ttcatcccagaaaacattagcactgccagtgatgccaccctagtgatcaacacggagcacatgccctcaatgttc

SEQ ID NO: 67197 - DNA, 75 bp, Artificial Sequence
  Synthetic
atagctcccttgtgctctgaatttgcaggtctgaggcaggctgtacagcaaggtttgcctacagaatcaaagcct

SEQ ID NO: 67198 - DNA, 75 bp, Artificial Sequence
  Synthetic
atacacataccaggtgaggttaaaaacctcttggagatttgtagagtggagagtatccttgaagtcaacaactta

SEQ ID NO: 67199 - DNA, 75 bp, Artificial Sequence
  Synthetic
acctcttggagatttgtagagtggagagtatccttgaagtcaacaacttaacaaccaatgaagctaacccaatgg

SEQ ID NO: 67200 - DNA, 75 bp, Artificial Sequence
  Synthetic
acaaatttgccggtattacacacaatggtccgggtctttgaaggttacctttatgttcacaggatccttcatggc

SEQ ID NO: 67201 - DNA, 75 bp, Artificial Sequence
  Synthetic
tggggtaatgcgaccttcctcaaaaggggctttttgcccgatgaacagtttccatttttgattcaccctactatg

SEQ ID NO: 67202 - DNA, 75 bp, Artificial Sequence
  Synthetic
gagatggcccctggcaatccacgttgttagggcagctctgcagatattacacacaatggtctggatcattagaaa

SEQ ID NO: 67203 - DNA, 75 bp, Artificial Sequence
  Synthetic
gccttcctactgctcggattctgacgctacagcagtggacaaaccaacgcgcccagatgtttcggtgaataggtt

SEQ ID NO: 67204 - DNA, 75 bp, Artificial Sequence
  Synthetic
gttagggcagctctgcagatattacacacaatggtctggatcattagaaatcactttcatgttcactggttcatt

SEQ ID NO: 67205 - DNA, 75 bp, Artificial Sequence
  Synthetic
gctaggcacacatgttatttgggattttggccttcaatcttcagtcactttagttataccatggataagcaacac

SEQ ID NO: 67206 - DNA, 75 bp, Artificial Sequence
  Synthetic
tttggccttcaatcttcagtcactttagttataccatggataagcaacacccactacagagctcatggggatgga

SEQ ID NO: 67207 - DNA, 75 bp, Artificial Sequence
  Synthetic
cctcccctaattcgaaacatagaagtaatgcgcaccactgatcaatagcaggcgtaacgcgccagttacgtctcg

SEQ ID NO: 67208 - DNA, 75 bp, Artificial Sequence
  Synthetic
cccacctcagcttacatcatagcattaggtgctgcccaacccaattttaccatgagattgtgcaaagactcacca

SEQ ID NO: 67209 - DNA, 75 bp, Artificial Sequence
  Synthetic
atacaaggggatcccattgcagacatgatcgaccaaaccgtgaatagccaagtgaaccgctccttaactgcactg

SEQ ID NO: 67210 - DNA, 75 bp, Artificial Sequence
  Synthetic
taggtgctgcccaacccaattttaccatgagattgtgcaaagactcaccagaaatatctcaaactgccatattgc

SEQ ID NO: 67211 - DNA, 75 bp, Artificial Sequence
  Synthetic
ttgagctgcagcacccgtacgtgctcgatgctgggattcctatatcacaattgacagtgtgcccccatcaatgga

SEQ ID NO: 67212 - DNA, 75 bp, Artificial Sequence
  Synthetic
gttgaaggagaaagtgttcgttatccggctaactacttcgagaagcccagtaacaccatggaagctgcagggtgt

SEQ ID NO: 67213 - DNA, 75 bp, Artificial Sequence
  Synthetic
cccagactacggctgagaacacaagacctagcacccaccagattggtactggtgaggtaccagcactacaagcag

SEQ ID NO: 67214 - DNA, 75 bp, Artificial Sequence
  Synthetic
acctagcacccaccagattggtactggtgaggtaccagcactacaagcagcagagacaggagcaacgtccacaac

SEQ ID NO: 67215 - DNA, 75 bp, Artificial Sequence
  Synthetic
cccacgggtgaccgtggcagtggctgcgttggcggcctgcctatggggagacccataggacgctctaatgtggac

SEQ ID NO: 67216 - DNA, 75 bp, Artificial Sequence
  Synthetic
accccactccatgtattcacatacccggtgaagtcagaaacctgctcgagttgtgtcaagtggagactattcttg

SEQ ID NO: 67217 - DNA, 75 bp, Artificial Sequence
  Synthetic
ctatggtaaagccggtttagtcggttggatacaactattgacttcaacaaaaaacaaccacggtttcaaaaactg

SEQ ID NO: 67218 - DNA, 75 bp, Artificial Sequence
  Synthetic
tcaactgggacattgacttgatgggatatgctcaattacggcgcaaatgcgagttgttcacatatatgcgctttg

SEQ ID NO: 67219 - DNA, 75 bp, Artificial Sequence
  Synthetic
tggatacaactattgacttcaacaaaaaacaaccacggtttcaaaaactgggatgtggatgtgatggggtttgtg

SEQ ID NO: 67220 - DNA, 75 bp, Artificial Sequence
  Synthetic
accatatagctattggattggccatccggtgtgtaatagagctattatatacctgtttgttggttttgtgccact

SEQ ID NO: 67221 - DNA, 75 bp, Artificial Sequence
  Synthetic
aacggcactgcacctaattcattgcttcagtacatgtatgttcctcctggagcacccaaacccaccactagagat

SEQ ID NO: 67222 - DNA, 75 bp, Artificial Sequence
  Synthetic
ttcagtacatgtatgttcctcctggagcacccaaacccaccactagagattcctttgaatggcaaaccgcctcta

SEQ ID NO: 67223 - DNA, 75 bp, Artificial Sequence
  Synthetic
ccggtgtgtaatagagctattatatacctgtttgttggttttgtgccactaactttaaaatctatagttactctc

SEQ ID NO: 67224 - DNA, 75 bp, Artificial Sequence
  Synthetic
accaatggttttatgacggttatccatcttttggaccacatcccacatctaaagacttccagtatggcatttgcc

SEQ ID NO: 67225 - DNA, 75 bp, Artificial Sequence
  Synthetic
atcttttggaccacatcccacatctaaagacttccagtatggcatttgcccaaacaacttaatgggcactttctg

SEQ ID NO: 67226 - DNA, 75 bp, Artificial Sequence
  Synthetic
atctggtatcagacaaactacgtagttccaattggggcgcccaacacagcttacataatagcactagcggcagcc

SEQ ID NO: 67227 - DNA, 75 bp, Artificial Sequence
  Synthetic
ggcatggttaccccgtccactcagatcccaaccctacatgctcaaaaattacccaaactttgatggaaccaaatt

SEQ ID NO: 67228 - DNA, 75 bp, Artificial Sequence
  Synthetic
tggcacaactcaccattgggaactccaccatcaccacacaggaagcagcaaatatcatagttggttatggtgagt

SEQ ID NO: 67229 - DNA, 75 bp, Artificial Sequence
  Synthetic
tcccaaccctacatgctcaaaaattacccaaactttgatggaaccaaattgaagtgcacctccaaatctagaacc

SEQ ID NO: 67230 - DNA, 75 bp, Artificial Sequence
  Synthetic
acagctctagggacctgttagtctcttccaccaccgcccaggggtgcgacactatcgctagatgcaattgtcaaa

SEQ ID NO: 67231 - DNA, 75 bp, Artificial Sequence
  Synthetic
ctagcctcgtcttcgtagaggccagtgagtattaccctgctagatatcaatctcacttaatgctcgctgcaggcc

SEQ ID NO: 67232 - DNA, 75 bp, Artificial Sequence
  Synthetic
caccttgctacccagaaagattgggacaacctggtgtgggagtcctatgagagagatcttctagtttccactacg

SEQ ID NO: 67233 - DNA, 75 bp, Artificial Sequence
  Synthetic
acaacctggtgtgggagtcctatgagagagatcttctagtttccactacgacagcccagggatgtgacataattg

SEQ ID NO: 67234 - DNA, 75 bp, Artificial Sequence
  Synthetic
accaagcccagcctgatatttgtggaggctagtgagtattacccagctagataccaatcccacctcatgcttgct

SEQ ID NO: 67235 - DNA, 75 bp, Artificial Sequence
  Synthetic
gggttttgcattcatgtgcaatgcaacgctagtaagttccatcaaggggcactgctagtcgctatccttccagag

SEQ ID NO: 67236 - DNA, 75 bp, Artificial Sequence
  Synthetic
gaagccatggaacagggagtgtctgactatatcaagggactcggcgacgctttcggtactggttttactgacgca

SEQ ID NO: 67237 - DNA, 75 bp, Artificial Sequence
  Synthetic
tcataccagaaacaattagtcctgctagtgatgccactttagttataaatactgaacatatgcccagtatgtttg

SEQ ID NO: 67238 - DNA, 75 bp, Artificial Sequence
  Synthetic
cagcttttatttatgtggatgaaaatgaattttaccctgctaggtatcaatctcatgtaatatcttcagcaggta

SEQ ID NO: 67239 - DNA, 75 bp, Artificial Sequence
  Synthetic
gtgtctagggaagtggaagctcttaagaactaccttataggatctgaaggggctgttgaaaagatcttgaagaat

SEQ ID NO: 67240 - DNA, 75 bp, Artificial Sequence
  Synthetic
gtacaggaacagaggatagtcaccctccttacaaacaaacacaacctggtgctgacggttttgagctgcaacacc

SEQ ID NO: 67241 - DNA, 75 bp, Artificial Sequence
  Synthetic
tgaattttaccctgctaggtatcaatctcatgtaatatcttcagcaggtattgcagttccaggcgactgcggtgg

SEQ ID NO: 67242 - DNA, 75 bp, Artificial Sequence
  Synthetic
tagagatcttctctggttagatgatgaggttatggagcaaggtgtgactgattacattaagggccttggtgatgc

SEQ ID NO: 67243 - DNA, 75 bp, Artificial Sequence
  Synthetic
attctcataatggctgcttatggtgacaattgaggaattgttaccatatagctattggattggccatccggtgtg

SEQ ID NO: 67244 - DNA, 75 bp, Artificial Sequence
  Synthetic
gtcatttgggactttggactacaatcgtcagtctctttggtgataccgtggatcagtaacactcacttccgcact

SEQ ID NO: 67245 - DNA, 75 bp, Artificial Sequence
  Synthetic
ggttgttccacaattactccagtatatgtttgttccccctggtgctcccaaaccagagtctagagaatcacttgc

SEQ ID NO: 67246 - DNA, 75 bp, Artificial Sequence
  Synthetic
gaggttatggagcaaggtgtgactgattacattaagggccttggtgatgcctttggcacaggttttactgattcc

SEQ ID NO: 67247 - DNA, 75 bp, Artificial Sequence
  Synthetic
tactagaggttaacaaccttaatacccaggccactgctgctcagttgatggagcgtctacttatcccagtccaag

SEQ ID NO: 67248 - DNA, 75 bp, Artificial Sequence
  Synthetic
tagctccaatgtgctctgagtttgcaggtcttaggcaagcagtcactcaaggctttcctacagagttgaaaccag

SEQ ID NO: 67249 - DNA, 75 bp, Artificial Sequence
  Synthetic
ctgatcaaagtagtttcagcactagtgatagttgttaggagtgattatgacctagtcaccttgactgcaactctt

SEQ ID NO: 67250 - DNA, 75 bp, Artificial Sequence
  Synthetic
tgatagttgttaggagtgattatgacctagtcaccttgactgcaactcttgccttaattggttgccacgggagcc

SEQ ID NO: 67251 - DNA, 75 bp, Artificial Sequence
  Synthetic
attagattttgaccaaggggcgaccccagttatccctatcactatcactctagctccaatgtgctctgagtttgc

SEQ ID NO: 67252 - DNA, 75 bp, Artificial Sequence
  Synthetic
cgacggcgtttcagcgcccattttaccaaacttccaccccaccccgtgtattcacatacccggcgaggttagaaa

SEQ ID NO: 67253 - DNA, 75 bp, Artificial Sequence
  Synthetic
ttcattgattggcttaaggaaaagattattccagccgctaaagagaaagttgaattcttgaacaatctgaagcag

SEQ ID NO: 67254 - DNA, 75 bp, Artificial Sequence
  Synthetic
tcaagaaattcacagaaatggctaacgctgctagaggccttgaatggattgccaataaaatcagtaaattcatag

SEQ ID NO: 67255 - DNA, 75 bp, Artificial Sequence
  Synthetic
ctaccaatgctaccagtttgatggaaaggctacggttcccggtgtctgctcaagcggggaagggtgaattgtgcg

SEQ ID NO: 67256 - DNA, 75 bp, Artificial Sequence
  Synthetic
cttcccttactggagaaccaaatttcaaatcttgaacagtctgctgcctcgcaagaggacttggaagctatgttt

SEQ ID NO: 67257 - DNA, 75 bp, Artificial Sequence
  Synthetic
ggacggcccgtggcagtcaaccatgctgggccagctgtgtggatactacactcagtggtcaggatcactggagat

SEQ ID NO: 67258 - DNA, 75 bp, Artificial Sequence
  Synthetic
ttttagagtcccagattgccaacattgagcagtcagcagctagtcaggaggatttagaaaatttgttcagcaacg

SEQ ID NO: 67259 - DNA, 75 bp, Artificial Sequence
  Synthetic
ctgacgtgctgaacaagacgggggtgttcggacagaatgcccagtttcattacttgtaccggtcaggtttctgct

SEQ ID NO: 67260 - DNA, 75 bp, Artificial Sequence
  Synthetic
ttttgacggttataagcaacaagtagtcacagtaatggatgatctttgccaaaacccagacgggaaagacatgtc

SEQ ID NO: 67261 - DNA, 75 bp, Artificial Sequence
  Synthetic
gtcacagtaatggatgatctttgccaaaacccagacgggaaagacatgtcactcttttgccagatggtatctacg

SEQ ID NO: 67262 - DNA, 75 bp, Artificial Sequence
  Synthetic
tcttgtggttagatgaagaggccatggagcaaggtgtgtccgactacattaaggggctcggtgacgcgtttggaa

SEQ ID NO: 67263 - DNA, 75 bp, Artificial Sequence
  Synthetic
caggctctaatatacccccatcaatggatcaatctccgcactaacaactgtgcaactgttatagttccatacatc

SEQ ID NO: 67264 - DNA, 75 bp, Artificial Sequence
  Synthetic
accaattcatccaacatcatagtcccgactgtctcagatagtgatgccatcaggagaagattctatatggattgt

SEQ ID NO: 67265 - DNA, 75 bp, Artificial Sequence
  Synthetic
cgactgtctcagatagtgatgccatcaggagaagattctatatggattgtgatattgaggttcccgagtcattta

SEQ ID NO: 67266 - DNA, 75 bp, Artificial Sequence
  Synthetic
gcccgagatggagtgtttgactactacaccacagggttagtcagtatatggtatcagacaaattatgtggttcca

SEQ ID NO: 67267 - DNA, 75 bp, Artificial Sequence
  Synthetic
gcgaagttccagcgctccaagctgctgaaattggggcatcgtcaaacactagtgacgagagtatgattgaaacac

SEQ ID NO: 67268 - DNA, 75 bp, Artificial Sequence
  Synthetic
agtgacgagagtatgattgaaacacgatgcgttcttaactcacatagcacagcagaaaccactttggacagcttc

SEQ ID NO: 67269 - DNA, 75 bp, Artificial Sequence
  Synthetic
aatgtagccccctggtttgtggtaaagccattcaacttagggataggaaatcaggagttagatatggcctggatt

SEQ ID NO: 67270 - DNA, 75 bp, Artificial Sequence
  Synthetic
ggaagacagctctcgcgacttgctcgtgtcatccaccaccgcccaaggttgcgacacgattgcccgttgcaattg

SEQ ID NO: 67271 - DNA, 75 bp, Artificial Sequence
  Synthetic
ggggtggataattccagaaacaccggccaatgtggagcgtcaccttaacagagcagtgctagtgatgcagtccat

SEQ ID NO: 67272 - DNA, 75 bp, Artificial Sequence
  Synthetic
gagcagtgctagtgatgcagtccatcgccaccgtggttgcagttgtgtctcttgtctatgttatttacaaattgt

SEQ ID NO: 67273 - DNA, 75 bp, Artificial Sequence
  Synthetic
gattctacaatcagttactactgtggttgcagtgatctcacttgtgtatgtcatctataaactctttgccgggtt

SEQ ID NO: 67274 - DNA, 75 bp, Artificial Sequence
  Synthetic
gttgcagtgatctcacttgtgtatgtcatctataaactctttgccgggttccaaggtgcctattcagggatgccc

SEQ ID NO: 67275 - DNA, 75 bp, Artificial Sequence
  Synthetic
ttgaagaagaacatcagaaaatgccaaacagatcaaggacacttcaccttattaggaattagagatagactggct

SEQ ID NO: 67276 - DNA, 75 bp, Artificial Sequence
  Synthetic
aaacagatcaaggacacttcaccttattaggaattagagatagactggctgtactcccaagacatgcttcaccag

SEQ ID NO: 67277 - DNA, 75 bp, Artificial Sequence
  Synthetic
gtttagggacgtcaccaagtttattccagagacaatcaccggggcaagcgacgcaaccttggtcatcaacactga

SEQ ID NO: 67278 - DNA, 75 bp, Artificial Sequence
  Synthetic
atcttgaactcacattgatcacccttgacaccaatgaaaaattcagagacattacaaaattcatccctgagcaaa

SEQ ID NO: 67279 - DNA, 75 bp, Artificial Sequence
  Synthetic
tgtcatcaatacagaagccatgccatcaatgtttgtcccagttggtgacgttcaacagtatggctttctcaatat

SEQ ID NO: 67280 - DNA, 75 bp, Artificial Sequence
  Synthetic
cgcacgttgcaattgtcaaacaggagtgtactattgcaactcaaagaggaagcactacccagtcagcttttcaaa

SEQ ID NO: 67281 - DNA, 75 bp, Artificial Sequence
  Synthetic
ggtgggaatggacgccaaggcttctgtgctggactgaagagaggctactttgccagtgaacaaggagagatccaa

SEQ ID NO: 67282 - DNA, 75 bp, Artificial Sequence
  Synthetic
gtgtactattgcaactcaaagaggaagcactacccagtcagcttttcaaaacccagcctcatctacgtggaagct

SEQ ID NO: 67283 - DNA, 75 bp, Artificial Sequence
  Synthetic
ccaccgctcagggctgtgacacaatcgcacgttgcaattgtcaaacaggagtgtactattgcaactcaaagagga

SEQ ID NO: 67284 - DNA, 75 bp, Artificial Sequence
  Synthetic
tgaagagaagctattttgccagtgaacagggagagatccagtggatgaagcctaataaagagactgggagactga

SEQ ID NO: 67285 - DNA, 75 bp, Artificial Sequence
  Synthetic
gcttctgtgctgcactcaaacgcagttactttgcctctgagcagggtgagatccaatggatgaaacctaataagg

SEQ ID NO: 67286 - DNA, 75 bp, Artificial Sequence
  Synthetic
tgagtccattcgatggactaaagacgcacgcaatacccaagaccacgtgcgctccctgtgtctgttggcatggca

SEQ ID NO: 67287 - DNA, 75 bp, Artificial Sequence
  Synthetic
actcgaggttgattttgagcaagctttgttttccaagtatgtgggaaacaccctgcacgaacctgatgagtacgt

SEQ ID NO: 67288 - DNA, 75 bp, Artificial Sequence
  Synthetic
caatggtaaggatgaatatgagaaatttgtgagtacaattagatcagttccagttggaaaagcgttggccattcc

SEQ ID NO: 67289 - DNA, 75 bp, Artificial Sequence
  Synthetic
agtcgtctcactggtgtacgtcatttacaagctctttgcggggtttcaaggtgcgtattctggagctcccaagca

SEQ ID NO: 67290 - DNA, 75 bp, Artificial Sequence
  Synthetic
ggatgacttttgggcatctctatgaaacttttcatgccaacccggggactgtgactgggtctgcagtagggtgta

SEQ ID NO: 67291 - DNA, 75 bp, Artificial Sequence
  Synthetic
gactcagtctaccttaggatgacttttgggcatctctatgagacttttcatgccaacccggggactgtgaccgga

SEQ ID NO: 67292 - DNA, 75 bp, Artificial Sequence
  Synthetic
ctaatgaaaaatttagagatatcaccaagttcattccagagaccattagcggcgctagtgatgcaactttagtga

SEQ ID NO: 67293 - DNA, 75 bp, Artificial Sequence
  Synthetic
accttagaatgtgctttggccacttgtatgagaaattccatgcaaatccggggacaatcactggatcagcagttg

SEQ ID NO: 67294 - DNA, 75 bp, Artificial Sequence
  Synthetic
taaaatccctataatgcttcctggttctctctttgcttttgattacactgggtatgatgctagtctttctcctgc

SEQ ID NO: 67295 - DNA, 75 bp, Artificial Sequence
  Synthetic
tagaagggatcaaccacacccatcatgtgtatcggaacaagacatattgtgtccttggtggaatgccctcaggct

SEQ ID NO: 67296 - DNA, 75 bp, Artificial Sequence
  Synthetic
tgtgtatcggaacaagacatattgtgtccttggtggaatgccctcaggctgttccggcacttccatcttcaattc

SEQ ID NO: 67297 - DNA, 75 bp, Artificial Sequence
  Synthetic
cagttcaagagcaaacaccgtattgaacctgtatgtctcatcattaggggctcaccaggcactggaaagtccctt

SEQ ID NO: 67298 - DNA, 75 bp, Artificial Sequence
  Synthetic
aatcaaacgtactgtgtgatgggtgggatgccatctggatgttctggcactagtatttttaattccatgattaat

SEQ ID NO: 67299 - DNA, 75 bp, Artificial Sequence
  Synthetic
tcaaaatcctgatggcaaggatatgtcattgttttgtcaaatggtgtccactgtggatttcatcccaccaatggc

SEQ ID NO: 67300 - DNA, 75 bp, Artificial Sequence
  Synthetic
gctgacaaatcaccctgctttaacgaagtcacctgggaaaatgctacattcttaaagagaggcttcctgccagat

SEQ ID NO: 67301 - DNA, 75 bp, Artificial Sequence
  Synthetic
cattcctcatccacccaaccatgccaatgaaggagatacatgagtccattcgttggactaaggacccacgtaata

SEQ ID NO: 67302 - DNA, 75 bp, Artificial Sequence
  Synthetic
ccaagttcattccagagaatatcagtggagccagtgatgccacattagtaatcaacactgaacacatgccatcaa

SEQ ID NO: 67303 - DNA, 75 bp, Artificial Sequence
  Synthetic
gctccttgtgccttttagcatggcataatgggaaggaggagtatgaaaaatttgtgagtacaattagatcagttc

SEQ ID NO: 67304 - DNA, 75 bp, Artificial Sequence
  Synthetic
aaattagaactgtaccaattggcaaagttttagctcttccaaattatgataacttgagaagaaattggcttgaac

SEQ ID NO: 67305 - DNA, 75 bp, Artificial Sequence
  Synthetic
gagtacaacaacagatccgctattggtaacacaattgaagcactgttccaaggcccacccaagttcagaccaatt

SEQ ID NO: 67306 - DNA, 75 bp, Artificial Sequence
  Synthetic
taaaacaagcctgtgggttgcacccacttacagggcccactgggggcaagccctttggcacctcggtacctttgg

SEQ ID NO: 67307 - DNA, 75 bp, Artificial Sequence
  Synthetic
ggaagtcccagcactacaagctgctgaaactggtgccacctccaatacttcagatgaaaacatgctcgagacacg

SEQ ID NO: 67308 - DNA, 75 bp, Artificial Sequence
  Synthetic
ctcaaagctgaaccccaccagaaatctggtcgtgttaatgactggtgggggtaaatttgttataaccagaatagc

SEQ ID NO: 67309 - DNA, 75 bp, Artificial Sequence
  Synthetic
cgtcaatactgcagggaacaaggctggatcatccctgaaactcccaccaatgttgaacgacacctcaatagagca

SEQ ID NO: 67310 - DNA, 75 bp, Artificial Sequence
  Synthetic
caaggagccagcagttctaacaagcaaggatcccagattagaggttgactttgagcaagccctcttctccaagta

SEQ ID NO: 67311 - DNA, 75 bp, Artificial Sequence
  Synthetic
gaaatctggtcgtgaatgtgactggtgggggtaaatttgtatacaaaaaaaaaaaaaaaaaattaaacggggacc

SEQ ID NO: 67312 - DNA, 75 bp, Artificial Sequence
  Synthetic
ggaccatgatgtacaattttcccacaaaagctggacagtgcgggggcgtggtcacatcagtcggtaagatcattg

SEQ ID NO: 67313 - DNA, 75 bp, Artificial Sequence
  Synthetic
catgagcctgatgagtacgtacatcaagctgctcttcactatgcaaaccaacttaagcaactggatataaacact

SEQ ID NO: 67314 - DNA, 75 bp, Artificial Sequence
  Synthetic
atgctggtaattctattaaaccaactggtgccagtcgcacagcaattaccactctcgggaaatttggacagcagt

SEQ ID NO: 67315 - DNA, 75 bp, Artificial Sequence
  Synthetic
agaccatgtgcgctctctgtgtttattagcttggcacaatggtaaggatgaatatgaaaaatttgtgagcacaat

SEQ ID NO: 67316 - DNA, 75 bp, Artificial Sequence
  Synthetic
ttatatatggacaaatatgggttggatctgccatactccacttatgttaaagatgaactcagatctttagataag

SEQ ID NO: 67317 - DNA, 75 bp, Artificial Sequence
  Synthetic
atcaagaaagggaagtcacgcctgatagaggctagtagcttgaatgattctgtttaccttagaatgacctttgga

SEQ ID NO: 67318 - DNA, 75 bp, Artificial Sequence
  Synthetic
tgtttaccttagaatgacctttggacacctttacgaagcgtttcatgccaatcccggcactgtgactggctcagc

SEQ ID NO: 67319 - DNA, 75 bp, Artificial Sequence
  Synthetic
tcaatgtgcttgatgctgttgagctagtggatgaacaaggtgttaatttggagcttacactagtaaccctagata

SEQ ID NO: 67320 - DNA, 75 bp, Artificial Sequence
  Synthetic
acgtgcaatgcaacgcaagcaaattccatcagggagcactcctagttgctgtcctcccggagtacgttattggaa

SEQ ID NO: 67321 - DNA, 75 bp, Artificial Sequence
  Synthetic
ttcagggtatgatgctagcctcagtccggtgtggtttagagctttggagacagtgctacgggagattggttattc

SEQ ID NO: 67322 - DNA, 75 bp, Artificial Sequence
  Synthetic
accgaaacaaaacatactgtgttctcggtggaatgccctcggggtgttctggcacttctatcttcaattcaatga

SEQ ID NO: 67323 - DNA, 75 bp, Artificial Sequence
  Synthetic
cttatggggatgatgtgctagctagttatcctttccctattgactgccttgaactagctaggactggtaaggagt

SEQ ID NO: 67324 - DNA, 75 bp, Artificial Sequence
  Synthetic
ccaaggagcgacgccagtaatccctataaccatcacattggccccaatgtgttccgaattggcaggccttagaca

SEQ ID NO: 67325 - DNA, 75 bp, Artificial Sequence
  Synthetic
aaccggtgccagtcgcacagcgatcaccactcttgggaaatttggacaacagtctggggctatttatgtgggcaa

SEQ ID NO: 67326 - DNA, 75 bp, Artificial Sequence
  Synthetic
gagtacaattagatcagttccagttggaaaggcattggcgattccaaactttgagaatttgaggagaaattggct

SEQ ID NO: 67327 - DNA, 75 bp, Artificial Sequence
  Synthetic
aactttgagaatttgaggagaaattggctcgaattgttttaaatttgcagcttaaagctgaaccccaccagaaat

SEQ ID NO: 67328 - DNA, 75 bp, Artificial Sequence
  Synthetic
ttaaaacagcctgtgggttgcacccactcacagggcccacgtggcgctagcactctggttctacggaacctttgt

SEQ ID NO: 67329 - DNA, 75 bp, Artificial Sequence
  Synthetic
gcaccagccatgtcttgatcaagcacttctgtttccccggaccgagtatcaatagactgctcacgcggttgaagg

SEQ ID NO: 67330 - DNA, 75 bp, Artificial Sequence
  Synthetic
cagggcgtgtccgactacatcaagggtctcggagatgctttcgggacaggcttcactgatgcagtctcaagggag

SEQ ID NO: 67331 - DNA, 75 bp, Artificial Sequence
  Synthetic
atgggctcacaagtgtctactcagcgatccggctcccacgagaactccaattcagctacggaaggctctaccatt

SEQ ID NO: 67332 - DNA, 75 bp, Artificial Sequence
  Synthetic
attcttatattggctgcttatggtgacaattacagaattgttaccatatagctattggattggccatccggtgtg

SEQ ID NO: 67333 - DNA, 75 bp, Artificial Sequence
  Synthetic
tgggtttccaataagatcagcaaatttatcgattggcttaaggagaaaattataccagcagccaaggagaaggtt

SEQ ID NO: 67334 - DNA, 75 bp, Artificial Sequence
  Synthetic
taattctgaataatagaaaatgggcgcccaagtttcaacacaaaaatctgggtcgcacgagacaaggaatgtagc

SEQ ID NO: 67335 - DNA, 75 bp, Artificial Sequence
  Synthetic
ggtcgcacgagacaaggaatgtagcaactgaagggtctaccatcaacttcaccaatatcaattactacaaggatt

SEQ ID NO: 67336 - DNA, 75 bp, Artificial Sequence
  Synthetic
gctgcttatggtgacaattaaagaattgttaccatatagctattggattggccatccggtgtgcaacagagcaat

SEQ ID NO: 67337 - DNA, 75 bp, Artificial Sequence
  Synthetic
cacccactcacagggcccactgggcgcaagcactctggtacctcggtacctttgtgcgcctgttttatacccccc

SEQ ID NO: 67338 - DNA, 75 bp, Artificial Sequence
  Synthetic
attaactattggcaactccaccatcaccacgcaagaagcggctaacatcatagtcggttatggtgagtggccttc

SEQ ID NO: 67339 - DNA, 75 bp, Artificial Sequence
  Synthetic
cctgtaccgctcgggtttctgcatgcacgttcaatgtaatgcaagcaaattccatcagggggccctcttagtagc

SEQ ID NO: 67340 - DNA, 75 bp, Artificial Sequence
  Synthetic
gtgtggtggtgttgtgactgctgtgggtaaagtgattgggattcacattggtggtaatggtaggcaaggtttctg

SEQ ID NO: 67341 - DNA, 75 bp, Artificial Sequence
  Synthetic
taaccctaatcaccctcgacactaatgagaagttcagagatatcactaagttcattccagagagcatcagtgctg

SEQ ID NO: 67342 - DNA, 75 bp, Artificial Sequence
  Synthetic
aacaaacacaacctggcgctgacggttttgagctgcagcacccgtacgtgctcgatgctgggattcctatatcac

SEQ ID NO: 67343 - DNA, 75 bp, Artificial Sequence
  Synthetic
tgcccatactaacccaggtaaggatggtcaagagtttcgggatccttatgtcttggacgctggaatccccctaag

SEQ ID NO: 67344 - DNA, 75 bp, Artificial Sequence
  Synthetic
aattttcccaccaaggcagggcaatgcggaggagtggttacatcagttggaaaggtcatcggtatacacataggt

SEQ ID NO: 67345 - DNA, 75 bp, Artificial Sequence
  Synthetic
cttaaccactcgaattttggattagttgtgatccctattagtcctttaaaatattgtaatggagccaccacagag

SEQ ID NO: 67346 - DNA, 75 bp, Artificial Sequence
  Synthetic
gaatttcaatacaacaaaatgggcgctcaagtatcaacgcaaaaatctggctcccatgaaacgggcaatatcgcg

SEQ ID NO: 67347 - DNA, 75 bp, Artificial Sequence
  Synthetic
tgaggttaacaacgtacccaccaatgctactagtttgatggaaaggctacgattcccggtgtccgcgcaagcggg

SEQ ID NO: 67348 - DNA, 75 bp, Artificial Sequence
  Synthetic
ttcctggagagttcacctccttgttagatttgtgtcaaatagagaccatactagaagttaataatactaccggca

SEQ ID NO: 67349 - DNA, 75 bp, Artificial Sequence
  Synthetic
tatgcaaatcagttgaaacagctagatattgacacctcccagatgagtatggaggaagcttgttacggcactgag

SEQ ID NO: 67350 - DNA, 75 bp, Artificial Sequence
  Synthetic
ccagtgatgccaccctagtgatcaacacggagcacatgccctcaatgtttgtcccggtgggtgacgttgtgcagt

SEQ ID NO: 67351 - DNA, 75 bp, Artificial Sequence
  Synthetic
ggaagcagcgatgcttgggacgcacatagtgtgggattttggtttgcaatcatctgtcactttagtcataccctg

SEQ ID NO: 67352 - DNA, 75 bp, Artificial Sequence
  Synthetic
ttggtaccagaccaacttcgtagtaccaccagatacccccaccgaggctaacatcatagctcttggagcagcaca

SEQ ID NO: 67353 - DNA, 75 bp, Artificial Sequence
  Synthetic
caggccctgttctctaagtatgtggggaatacactatatgagcctgacgagtacatcaaagaggcagctcttcat

SEQ ID NO: 67354 - DNA, 75 bp, Artificial Sequence
  Synthetic
gggcatcatcaaatactagtgatgagagtatgattgagacacgatgcgttcttaactcacacagtacagcagaga

SEQ ID NO: 67355 - DNA, 75 bp, Artificial Sequence
  Synthetic
cgcaaatgcggtagaaagtgctgtaagcgcactcgctgacaccacaatatcccgagtgaccgcagccaacactac

SEQ ID NO: 67356 - DNA, 75 bp, Artificial Sequence
  Synthetic
agcgcactcgctgacaccacaatatcccgagtgaccgcagccaacactacagctagcactcactccctgggtacg

SEQ ID NO: 67357 - DNA, 75 bp, Artificial Sequence
  Synthetic
ttaccagtccggtgctggacgtcctgtcagagatgtctgcaccattgcagtcaccgacggcggaggcgtgtggtt

SEQ ID NO: 67358 - DNA, 75 bp, Artificial Sequence
  Synthetic
acttatgtcaaggacgagctgcgctcaattgataaaattaagaaagggaagtcccgtctgattgaggccagtagt

SEQ ID NO: 67359 - DNA, 75 bp, Artificial Sequence
  Synthetic
gttgtagaggtgaaggactcgggcactagcctagatggatatacagtgtggcccatagacgtgatgggttttgtg

SEQ ID NO: 67360 - DNA, 75 bp, Artificial Sequence
  Synthetic
agcattagaattggtccttagggagatagggtatagtgaaggggcagtctcactcattgagggaatcaaccacac

SEQ ID NO: 67361 - DNA, 75 bp, Artificial Sequence
  Synthetic
tacctctaccgatcaaggttctgcatccacgtgcagtgtaatgtcagtaatttccaccaactgccactcctagtc

SEQ ID NO: 67362 - DNA, 75 bp, Artificial Sequence
  Synthetic
gttcacttttgtatccaacctcagtaacagcacgacgcccggaatgctgttgcagtatatgtatgtgccaccagg

SEQ ID NO: 67363 - DNA, 75 bp, Artificial Sequence
  Synthetic
acgtgcgatccctatgcttgttggcgtggcacaacggcaagcaagaatatgacaactttgtgagcacaattaggt

SEQ ID NO: 67364 - DNA, 75 bp, Artificial Sequence
  Synthetic
taccctttggttgtcagaatatatatgagaatgaagcatgtcagggcgtggatacctcgcccgatgcgcaaccaa

SEQ ID NO: 67365 - DNA, 75 bp, Artificial Sequence
  Synthetic
ggaacaatctgctgcctcacaagaggaccttgaagtcatgtttgggaatgtgtcgtacctagctcacttctgtcg

SEQ ID NO: 67366 - DNA, 75 bp, Artificial Sequence
  Synthetic
actaatttacaatatgggcagtgccctaacaacatgatgggccattttgccatccgaacagtcagtgagtctact

SEQ ID NO: 67367 - DNA, 75 bp, Artificial Sequence
  Synthetic
cgtgaacgtccttgatgcagttgaattggtggatgagcaaggagtcaacctggaattaaccctcattactcttga

SEQ ID NO: 67368 - DNA, 75 bp, Artificial Sequence
  Synthetic
gccaatggttttaccaactggccaattgacataatgggatatgtgcaacagcggaggaagttggaaatctttact

SEQ ID NO: 67369 - DNA, 75 bp, Artificial Sequence
  Synthetic
taatactgcaactgaccgtgcaagcataactaccacagactatgaaggtggggtaccagcaagcccacaaagaac

SEQ ID NO: 67370 - DNA, 75 bp, Artificial Sequence
  Synthetic
tcctgacactgacgccacagctgtggataaacccactcgtcctgatgtctcggttaacaggttttacacactaga

SEQ ID NO: 67371 - DNA, 75 bp, Artificial Sequence
  Synthetic
gacattgaagtgacagactcgtacaaaacagatctaggtagactggatgcagggcgagccgctaaactgtgctct

SEQ ID NO: 67372 - DNA, 75 bp, Artificial Sequence
  Synthetic
actctagaaggaagcactacccagtcagtttctccaagcctagccttgtcttcgtggaagctagtgagtactatc

SEQ ID NO: 67373 - DNA, 75 bp, Artificial Sequence
  Synthetic
atcaagggcacttcactatgctgggtgtcagagatcgcttggctgtcctcccgcgacattctcaacctggaaaga

SEQ ID NO: 67374 - DNA, 75 bp, Artificial Sequence
  Synthetic
gccagcacggcgtgattggtatcgtgtccactggaggtaacgggcttgtcggatttgcagatgtcagagatcttc

SEQ ID NO: 67375 - DNA, 75 bp, Artificial Sequence
  Synthetic
tacttcccttccccaaagtaacttagaagttgcgcaccaacgatcaatagcaggtgtgacacaccagtcatatct

SEQ ID NO: 67376 - DNA, 75 bp, Artificial Sequence
  Synthetic
gggctcggtgatgccttcggaactggttttactgacgcagtatctagggaagtggaggctctaaaaaactacctt

SEQ ID NO: 67377 - DNA, 75 bp, Artificial Sequence
  Synthetic
gtaactcgatgagaaaacactacccagtcagtttttcaaaacccagcctgatctatgtagaggctagcgagtatt

SEQ ID NO: 67378 - DNA, 75 bp, Artificial Sequence
  Synthetic
atgtcatggcagtccctgggcgtggatcaaggctaagacagcatccattttgggcatcccgatcgcccagaagca

SEQ ID NO: 67379 - DNA, 75 bp, Artificial Sequence
  Synthetic
ccgcaccaactgccagagactcatttgcatggcagtccgccacaaatccgtccgtgtttgtcaaagcatctgatc

SEQ ID NO: 67380 - DNA, 75 bp, Artificial Sequence
  Synthetic
cagtaaatttattgattggattaaggagaaaattgtaccagcagctaaggagaaggtcgaatttttgagtaatct

SEQ ID NO: 67381 - DNA, 75 bp, Artificial Sequence
  Synthetic
gcttatggtgacaatcaaagaattgttaccatatagctattggattggccatccggtgtgcaacagagcaattgt

SEQ ID NO: 67382 - DNA, 75 bp, Artificial Sequence
  Synthetic
aaaacaactgccattattggagaatcaaatctcaaacttggaacagtccgccgcttcacaggaagatcttgaggc

SEQ ID NO: 67383 - DNA, 75 bp, Artificial Sequence
  Synthetic
ttgtataggtcagggttctgcattcatgtccagtgcaatgccagtaaattccatccaggggcactattagttgcg

SEQ ID NO: 67384 - DNA, 75 bp, Artificial Sequence
  Synthetic
aacaattacatgcagttcaagagcaaacaccgtattgaacctgtatgtctcatcatcagaggttctccaggtact

SEQ ID NO: 67385 - DNA, 75 bp, Artificial Sequence
  Synthetic
accaaggatgcgcgtaatactcaagatcacgtgcgatccttatgcctgttggcgtggcacaacggcaaacaagag

SEQ ID NO: 67386 - DNA, 75 bp, Artificial Sequence
  Synthetic
cccaccaatggcttccttagaggagaaaggagtctcgtttacatccaaattcgtcattgcgtccactaatgccag

SEQ ID NO: 67387 - DNA, 75 bp, Artificial Sequence
  Synthetic
aaaggagtctcgtttacatccaaattcgtcattgcgtccactaatgccagcaacatcattgtaccgacagtgtcc

SEQ ID NO: 67388 - DNA, 75 bp, Artificial Sequence
  Synthetic
tgggagaaatcatccaaggggtggtactggaaattcccggatgtgttaactgaaaccggggtctttggtcaaaac

SEQ ID NO: 67389 - DNA, 75 bp, Artificial Sequence
  Synthetic
ttaaaacagcctgtgggttgtacccacctacagggcccattgggcgcaagcactctggcacctcggtacctttgt

SEQ ID NO: 67390 - DNA, 75 bp, Artificial Sequence
  Synthetic
ggcagattggatgctgggcgggccgctaaactgtgctcggagaacaacacagcaaactttaagcgatgtagccca

SEQ ID NO: 67391 - DNA, 75 bp, Artificial Sequence
  Synthetic
ctaaactgtgctcggagaacaacacagcaaactttaagcgatgtagcccactggtgtgcgggaaagctatccagc

SEQ ID NO: 67392 - DNA, 75 bp, Artificial Sequence
  Synthetic
ggtctgccattggaaacacaattgaagccttgttccagggaccacccaaatttagacccataaggattaatcttg

SEQ ID NO: 67393 - DNA, 75 bp, Artificial Sequence
  Synthetic
agccttgttccagggaccacccaaatttagacccataaggattaatcttgaggaaaggtcagcccctgatgccat

SEQ ID NO: 67394 - DNA, 75 bp, Artificial Sequence
  Synthetic
tgtacctcagaatggctttcggacatttgtatgaggctttccacgcaaatcctgggacgataactggatcagccg

SEQ ID NO: 67395 - DNA, 75 bp, Artificial Sequence
  Synthetic
tttggagctaaccctaatcacccttgacactaatgagaaattcagagacattactaagttcatcccagagagcat

SEQ ID NO: 67396 - DNA, 75 bp, Artificial Sequence
  Synthetic
tacccccacaaatgttgaacggcacctcaacagagctgtactggtcatgcagtccatcgccacagtggtggcagt

SEQ ID NO: 67397 - DNA, 75 bp, Artificial Sequence
  Synthetic
tcaacctgagaaccaataattgtgcaaccattatagttccatacatgaacacagttccatttgattcagctctca

SEQ ID NO: 67398 - DNA, 75 bp, Artificial Sequence
  Synthetic
tgtctcattagtgtatgtcatctataagctcttcgccggattccaaggtgcatactctggcgctcccaagcaagc

SEQ ID NO: 67399 - DNA, 75 bp, Artificial Sequence
  Synthetic
gacgatggcgtttcagcacccatcctgccaaacttccaccccaccccgtgtatccatatacctggtgaagttaga

SEQ ID NO: 67400 - DNA, 75 bp, Artificial Sequence
  Synthetic
acgttgtggatgctgccgaactagtggatgaacagggggtcaacttagagctgactttaatcaccctcgacacta

SEQ ID NO: 67401 - DNA, 75 bp, Artificial Sequence
  Synthetic
atttattccagagaatatcagcgctgccagtgatgccactctagtgattaatacagagcacatgccttctatgtt

SEQ ID NO: 67402 - DNA, 75 bp, Artificial Sequence
  Synthetic
acagctagacattgacacctcccagatgagcatggaggaagcctgttacggcactgagaaccttgaggccattga

SEQ ID NO: 67403 - DNA, 75 bp, Artificial Sequence
  Synthetic
taacttccctaccaaggcaggacagtgtggaggggtagtcacatcagttggaaaggtcattggtatccacatagg

SEQ ID NO: 67404 - DNA, 75 bp, Artificial Sequence
  Synthetic
tcttcgtggaagctagtgagtattaccctgccaggtatcagtcgcacctcatgcttgcgaagggacattctgaac

SEQ ID NO: 67405 - DNA, 75 bp, Artificial Sequence
  Synthetic
ttatagttccatacatgaacacagttccatttgattcagctcttaaccactgcaattttggtttgctggtcatcc

SEQ ID NO: 67406 - DNA, 75 bp, Artificial Sequence
  Synthetic
gattaaacctaacaaggaaacaggaagacttaacatcaatggaccaactcgcaccaagcttgaacccagtgtgtt

SEQ ID NO: 67407 - DNA, 75 bp, Artificial Sequence
  Synthetic
agacttaacatcaatggaccaactcgcaccaagcttgaacccagtgtgtttcatgatgtctttgagggcaataag

SEQ ID NO: 67408 - DNA, 75 bp, Artificial Sequence
  Synthetic
acccacagggcccactgggcgctagcacactggttctgcgggacctttgtgcgcctgttttataacccttcccta

SEQ ID NO: 67409 - DNA, 75 bp, Artificial Sequence
  Synthetic
ggaaacacactacatgagcctgatgaatatatcagagaggcagccctccactatgcaaatcaactgaagcagcta

SEQ ID NO: 67410 - DNA, 75 bp, Artificial Sequence
  Synthetic
gctgaaattggagcatcatcaaatgctagtgatgagagtatgatcgagacacgatgtgttcttaattcacatagc

SEQ ID NO: 67411 - DNA, 75 bp, Artificial Sequence
  Synthetic
aatatatcagagaggcagccctccactatgcaaatcaactgaagcagctagacatagacacctcccaaatgagca

SEQ ID NO: 67412 - DNA, 75 bp, Artificial Sequence
  Synthetic
aacagctaatatacaaggggatcccattgcagacatgatcgaccagaccgtgaataaccaagtgaaccgctccct

SEQ ID NO: 67413 - DNA, 75 bp, Artificial Sequence
  Synthetic
cactgggaataaagaagagggacattttggaccccgctaccagggatgtaaacaagatgaagttctatatggata

SEQ ID NO: 67414 - DNA, 75 bp, Artificial Sequence
  Synthetic
tatgtttgtaccacccggagcccccaagccagactccagggaatctctcgcatggcaaactgccactaatccttc

SEQ ID NO: 67415 - DNA, 75 bp, Artificial Sequence
  Synthetic
aatcccgtttgatagaagccagcagtttgaatgattcggtttatctcaggatgacttttgggcacctctatgaaa

SEQ ID NO: 67416 - DNA, 75 bp, Artificial Sequence
  Synthetic
agcaacatcatagtgccaacagtatccgattctgatgccatccgccgcagattttatatggattgtgacattgaa

SEQ ID NO: 67417 - DNA, 75 bp, Artificial Sequence
  Synthetic
tgaagttctacatggacaagtatggtcttgatcttccttactccacttatgtcaaggacgagctgcgctcgattg

SEQ ID NO: 67418 - DNA, 75 bp, Artificial Sequence
  Synthetic
tagcaacacacactacagggcgcacgcccgtgctgggtactttgactattacaccaccggcattataactatatg

SEQ ID NO: 67419 - DNA, 75 bp, Artificial Sequence
  Synthetic
tgcttttgactattcaggctacgatgctagcctcagtccagtttggtttagagctctggagctagtccttagaga

SEQ ID NO: 67420 - DNA, 75 bp, Artificial Sequence
  Synthetic
ctattgcgtacttggcgggatgccttcaggctgttcaggaacgtccatcttcaactcaatgattaacaacattat

SEQ ID NO: 67421 - DNA, 75 bp, Artificial Sequence
  Synthetic
tgactttgccctatcactattgagaagaaacatcaggcaagtgcagacagatcaagggcacttcactatgctggg

SEQ ID NO: 67422 - DNA, 75 bp, Artificial Sequence
  Synthetic
ttcaagggcattgatttggacgaactcaacatggttgcctacggggacgacgtgctcgccagttacccctttcca

SEQ ID NO: 67423 - DNA, 75 bp, Artificial Sequence
  Synthetic
tattttggctgcttatggtgacaatttacggattgttaccatatagctattggattggccatccggattattgca

SEQ ID NO: 67424 - DNA, 75 bp, Artificial Sequence
  Synthetic
acactatgggtgcacaagtatcaactcagaagtcaggctcccacgagaacaccaactttgctgcaggtggttcca

SEQ ID NO: 67425 - DNA, 75 bp, Artificial Sequence
  Synthetic
cacacataacgattgggcaaaccttgtgtgggaggacagttctagggacttgttagtctcttccaccaccgccca

SEQ ID NO: 67426 - DNA, 75 bp, Artificial Sequence
  Synthetic
tcagaagtcaggctcccacgagaacaccaactttgctgcaggtggttccaccataaattacaccaccatcaacta

SEQ ID NO: 67427 - DNA, 75 bp, Artificial Sequence
  Synthetic
tgaaaaatttgtgagcacaattagatctgtcccaatagggaaagcattggcaattcccaattatgaaaatttgag

SEQ ID NO: 67428 - DNA, 75 bp, Artificial Sequence
  Synthetic
cctacctgtggcgaaagccacaggacgctagttgtgaacaaggtgtgaagagtctattgagctaccaaagagtcc

SEQ ID NO: 67429 - DNA, 75 bp, Artificial Sequence
  Synthetic
agtagatgctttgaaggagggcgcacctgtgctcaagtctccatcagctgaggcttgcggatacagcgacagagt

SEQ ID NO: 67430 - DNA, 75 bp, Artificial Sequence
  Synthetic
tctgtcccaatagggaaagcattggcaattcccaattatgaaaatttgagacgcaattggctcgaattgttctag

SEQ ID NO: 67431 - DNA, 75 bp, Artificial Sequence
  Synthetic
cctgtgctcaagtctccatcagctgaggcttgcggatacagcgacagagttgcacaactcacggtgggtaattca

SEQ ID NO: 67432 - DNA, 75 bp, Artificial Sequence
  Synthetic
gcaactgccgttgacaaacccaccaggccagatgtgtctgttaacaggttttacacgttgtcagccaagctttgg

SEQ ID NO: 67433 - DNA, 75 bp, Artificial Sequence
  Synthetic
ggccagatgtgtctgttaacaggttttacacgttgtcagccaagctttggcagactgactccaagggatggtact

SEQ ID NO: 67434 - DNA, 75 bp, Artificial Sequence
  Synthetic
gggactgagaagtcaccacactccattaccctgagggtatatatgaggattaaacacgtcagagcatggatccca

SEQ ID NO: 67435 - DNA, 75 bp, Artificial Sequence
  Synthetic
gggagctcaagtttcaacccaaaagactggatctcatgagaaccagaacatagctgctagcggctccactataaa

SEQ ID NO: 67436 - DNA, 75 bp, Artificial Sequence
  Synthetic
ggttttgcatacatgtgcagtgcaatgccagtaaattccaccagggcaccctcctagttgcagctataccagagt

SEQ ID NO: 67437 - DNA, 75 bp, Artificial Sequence
  Synthetic
tgccagtaaattccaccagggcaccctcctagttgcagctataccagagtatgtggttgcgagagccagtaatga

SEQ ID NO: 67438 - DNA, 75 bp, Artificial Sequence
  Synthetic
tcagtgaacagatttttcacgctagacactaaatcttgggccaaggattcaaagggatggtattggaaattccct

SEQ ID NO: 67439 - DNA, 75 bp, Artificial Sequence
  Synthetic
acactaaatcttgggccaaggattcaaagggatggtattggaaattccctgatgttttgacagaagtaggtgtct

SEQ ID NO: 67440 - DNA, 75 bp, Artificial Sequence
  Synthetic
cccctatttattagacaatggcactgccctttcccaggctttgatctaccctcatcaatggataaacctgcgcac

SEQ ID NO: 67441 - DNA, 75 bp, Artificial Sequence
  Synthetic
gccctttcccaggctttgatctaccctcatcaatggataaacctgcgcactaacaactgcgcaaccatagttatg

SEQ ID NO: 67442 - DNA, 75 bp, Artificial Sequence
  Synthetic
tattccaaggatactgaggccactgcagtggacaagcctactagaccagatgtgtcagtcaataggttctacaca

SEQ ID NO: 67443 - DNA, 75 bp, Artificial Sequence
  Synthetic
ccacttgcttacagcgcaggtgccaccacagccataccaatcacactctcaattgccccattgaattctgagttt

SEQ ID NO: 67444 - DNA, 75 bp, Artificial Sequence
  Synthetic
tgtgtcagtcaataggttctacacactcccggcaaaattatgggccaacaactctaaaggatggtattggaagtt

SEQ ID NO: 67445 - DNA, 75 bp, Artificial Sequence
  Synthetic
ccacagccataccaatcacactctcaattgccccattgaattctgagtttgctggattgcgtcaagctatcactc

SEQ ID NO: 67446 - DNA, 75 bp, Artificial Sequence
  Synthetic
taccagggttccatcctactccagagatgtttattccaggtgaggtgaaaaacttgttggaacttgctcaggtgg

SEQ ID NO: 67447 - DNA, 75 bp, Artificial Sequence
  Synthetic
gcaaacaccgtattgaacccgtatgtctgatcatcagaggctccccaggaacaggcaagtcacttgctacgggca

SEQ ID NO: 67448 - DNA, 75 bp, Artificial Sequence
  Synthetic
tggctgctataccagaattaatgcttgccagatcgagtaatgacactaacccagccactgccccccacccaccat

SEQ ID NO: 67449 - DNA, 75 bp, Artificial Sequence
  Synthetic
gatgtttattccaggtgaggtgaaaaacttgttggaacttgctcaggtggagtctatattagaggtgaataatct

SEQ ID NO: 67450 - DNA, 75 bp, Artificial Sequence
  Synthetic
aagtttgtgatcgcctccactaacgccagcaacatcatagtgccaacagtctcggattcagatgccattcgtcgt

SEQ ID NO: 67451 - DNA, 75 bp, Artificial Sequence
  Synthetic
tgcatcattcagaacagacccagggagagatgggccttggcagtccacacttgtaggccaactgtgcagatatta

SEQ ID NO: 67452 - DNA, 75 bp, Artificial Sequence
  Synthetic
agagatgggccttggcagtccacacttgtaggccaactgtgcagatattacactcaatggtcaggatcattagag

SEQ ID NO: 67453 - DNA, 75 bp, Artificial Sequence
  Synthetic
atgcaggaagagcagctaggctgtgttctgagaacaacactgcaaactttaaacggtgcagtccattggtctgcg

SEQ ID NO: 67454 - DNA, 75 bp, Artificial Sequence
  Synthetic
caacctacaactagaacacaagccatgttagggacccacatagtgtgggattttggtttgcagtcttctgccacc

SEQ ID NO: 67455 - DNA, 75 bp, Artificial Sequence
  Synthetic
tgttagggacccacatagtgtgggattttggtttgcagtcttctgccaccctagttattccttggattagtaaca

SEQ ID NO: 67456 - DNA, 75 bp, Artificial Sequence
  Synthetic
cttggtcgacttgacgcaggtagggccgctaagctttgcacggagaacaacaccgccaactttaagagatgcagc

SEQ ID NO: 67457 - DNA, 75 bp, Artificial Sequence
  Synthetic
cattgggaatttctttagccgtgccggtcttgtcagcatcatcacaatgcccaccacgggtacacagaatacaga

SEQ ID NO: 67458 - DNA, 75 bp, Artificial Sequence
  Synthetic
tgatagtgaagaggttcgccaatactgtagagaccagggatggattgtacctgactctcccaccaacgttgagcg

SEQ ID NO: 67459 - DNA, 75 bp, Artificial Sequence
  Synthetic
aactaagagacagaaaatctaaagtgagatatagcattgacactgtggtgtcagagctaatcagagagtataata

SEQ ID NO: 67460 - DNA, 75 bp, Artificial Sequence
  Synthetic
ccaactttgtagtccctgatggtgcaccaacaagcgcgtatatcattgcgctggctgctgctcaacccaatttca

SEQ ID NO: 67461 - DNA, 75 bp, Artificial Sequence
  Synthetic
accaacaagcgcgtatatcattgcgctggctgctgctcaacccaatttcaccatgaggttatgcaaggatacaga

SEQ ID NO: 67462 - DNA, 75 bp, Artificial Sequence
  Synthetic
gggctcgttggctttgcagacgtcagagacctcttgtggttagatgaagaagctatggaacagggcgtgtccgac

SEQ ID NO: 67463 - DNA, 75 bp, Artificial Sequence
  Synthetic
ctgtcttgattatgcaatctgtggccaccgtggtagcagttgtgtcccttgtttacgttatctacaagttgttcg

SEQ ID NO: 67464 - DNA, 75 bp, Artificial Sequence
  Synthetic
gcaaactgcagtggatgcactctgtgcagctttcaaagttgatcctgggcgcgatgggccttggcaatctacatt

SEQ ID NO: 67465 - DNA, 75 bp, Artificial Sequence
  Synthetic
acaatctgctggcacacacaccaccgcagccaacaccagtgaaagtacccacaccatagccaccggcaacactcc

SEQ ID NO: 67466 - DNA, 75 bp, Artificial Sequence
  Synthetic
ccggctttcaaggagcatattccggcgcccccaagcaaacactcaagaaaccagtgctgcgcacggcaactgtgc

SEQ ID NO: 67467 - DNA, 75 bp, Artificial Sequence
  Synthetic
gcagccaacaccagtgaaagtacccacaccatagccaccggcaacactccagctctccaggctgctgagacgggt

SEQ ID NO: 67468 - DNA, 75 bp, Artificial Sequence
  Synthetic
cagacccagaccattttgatggatacaaacagcaggtggttacagtaatggatgacttgtgtcagaatcctgatg

SEQ ID NO: 67469 - DNA, 75 bp, Artificial Sequence
  Synthetic
tatggcaacggggaaaatgctcattgcctacaccccaccaggtgcgccgcaacccgctaacagaagaattgcaat

SEQ ID NO: 67470 - DNA, 75 bp, Artificial Sequence
  Synthetic
tccataaccaacttctatgcccgtgctggattagtaggctacttaacactactcaccagtggttctacggctaat

SEQ ID NO: 67471 - DNA, 75 bp, Artificial Sequence
  Synthetic
ctggattagtaggctacttaacactactcaccagtggttctacggctaatggattcaccaactgggacattgata

SEQ ID NO: 67472 - DNA, 75 bp, Artificial Sequence
  Synthetic
tagcaaccagtgaggatggaagcactcctaacacaatgctgcagtacatgtatgtgcctccgggtgcccccaaac

SEQ ID NO: 67473 - DNA, 75 bp, Artificial Sequence
  Synthetic
ttgctgctgctcagaagaactttacattgaggttgcccaaggacactggcgatatctcacaaaccgccatcctgc

SEQ ID NO: 67474 - DNA, 75 bp, Artificial Sequence
  Synthetic
tcctaacacaatgctgcagtacatgtatgtgcctccgggtgcccccaaaccaactggaagagaaacttttgagtg

SEQ ID NO: 67475 - DNA, 75 bp, Artificial Sequence
  Synthetic
ctaacgaaaaatttagggacgtcaccaagtttatcccagagacaatcaccggggcaagtgacgcaaccttgatca

SEQ ID NO: 67476 - DNA, 75 bp, Artificial Sequence
  Synthetic
agcagctagtgcctaccaatggttctatgatggatacccaacatttggtaaccaccctgtaagtgacaacattaa

SEQ ID NO: 67477 - DNA, 75 bp, Artificial Sequence
  Synthetic
tatgatggatacccaacatttggtaaccaccctgtaagtgacaacattaattacggtatttgcccaaacaatatg

SEQ ID NO: 67478 - DNA, 75 bp, Artificial Sequence
  Synthetic
agatgagaacatgttggaaacccgttgtgtgatcaactcccatagtgtggctgagactagtatctcgcatttctt

SEQ ID NO: 67479 - DNA, 75 bp, Artificial Sequence
  Synthetic
tgccagtcgcacagctatcaccactcttgggaaatttgggcaacagtctggggccatttatgtgggcaactttag

SEQ ID NO: 67480 - DNA, 75 bp, Artificial Sequence
  Synthetic
atgaaacatgtgagagcatgggtaccacgtccacttagaagtcaacagtatttaatcaggaactatcccaacttc

SEQ ID NO: 67481 - DNA, 75 bp, Artificial Sequence
  Synthetic
cacgtccacttagaagtcaacagtatttaatcaggaactatcccaacttccccaccacagttagatgcttagcag

SEQ ID NO: 67482 - DNA, 75 bp, Artificial Sequence
  Synthetic
tggtaccagaccaacttcgttgttcccatcggtgctcctaccactgcttatatagtggttctgggtagtgctcag

SEQ ID NO: 67483 - DNA, 75 bp, Artificial Sequence
  Synthetic
ggaagttgactttgaacaggctcttttctctaaatacgtgggaaacacgctccatgagcccgacgagtttgtcaa

SEQ ID NO: 67484 - DNA, 75 bp, Artificial Sequence
  Synthetic
catacatgaggtttgatgcagagttcactttcttaactgtgggagcgactggtgctgcgccagccactgttatcc

SEQ ID NO: 67485 - DNA, 75 bp, Artificial Sequence
  Synthetic
tcgtgaacaggcatctggcaacccaacaagactgggacaatctcgtgtgggaggactacaaccgtgatctcttgg

SEQ ID NO: 67486 - DNA, 75 bp, Artificial Sequence
  Synthetic
acaagactgggacaatctcgtgtgggaggactacaaccgtgatctcttggttagtcaaaccacagcacacgggtg

SEQ ID NO: 67487 - DNA, 75 bp, Artificial Sequence
  Synthetic
cacggttcaaggaccgagcttagactttgccttatcccttttaaggcgtaacattagacaggtgcaaactgatca

SEQ ID NO: 67488 - DNA, 75 bp, Artificial Sequence
  Synthetic
atgagtatgtgacacaagccgctctccactatgcaacccagttaaagcaattgggcatcaacactaataagatga

SEQ ID NO: 67489 - DNA, 75 bp, Artificial Sequence
  Synthetic
tttccaggggcccggtctagttcatgtcaagaaaaatgagtactacccagagagatatcaatcacatgtgctctt

SEQ ID NO: 67490 - DNA, 75 bp, Artificial Sequence
  Synthetic
gtcaagaaaaatgagtactacccagagagatatcaatcacatgtgctcttagctacaggacactctgaaccaggg

SEQ ID NO: 67491 - DNA, 75 bp, Artificial Sequence
  Synthetic
attaagcctaataaagaaactggaagactcaacatcaatgggccaatccgcaccaaactagagcccagcgtgttc

SEQ ID NO: 67492 - DNA, 75 bp, Artificial Sequence
  Synthetic
accgaggccctcagagtgcgcatctacatgcgcatcaagcacgtcagagcatggattcctagaccacttaggtcg

SEQ ID NO: 67493 - DNA, 75 bp, Artificial Sequence
  Synthetic
tttgctgacattcgtgatcttttctggttagatgatgaagtgatggaacagggggtcaccgattacatcaagact

SEQ ID NO: 67494 - DNA, 75 bp, Artificial Sequence
  Synthetic
ggttagatgatgaagtgatggaacagggggtcaccgattacatcaagactcttggtgacgctttcggaaccggtt

SEQ ID NO: 67495 - DNA, 75 bp, Artificial Sequence
  Synthetic
atcacaacagctggcgtgtttggtcaacagtcaggggcagtctatgttgggaattataaaatagttaacagacat

SEQ ID NO: 67496 - DNA, 75 bp, Artificial Sequence
  Synthetic
aaagactggcaaggagtatggtctgaccatgactcctgctgataaatctccttgctttaatgaggttaattgggg

SEQ ID NO: 67497 - DNA, 75 bp, Artificial Sequence
  Synthetic
tcctaaagaatttggtcaaattgatctcagctctggtcataattgtgagaagtgagtatgatctggtcacagtca

SEQ ID NO: 67498 - DNA, 75 bp, Artificial Sequence
  Synthetic
ctggcaactgaagcagactggaatagtttagtctgggaaagctacaacagggacctcttagtgaccagtgtgaat

SEQ ID NO: 67499 - DNA, 75 bp, Artificial Sequence
  Synthetic
ctcagctctggtcataattgtgagaagtgagtatgatctggtcacagtcacagcaacacttgtactgattggttg

SEQ ID NO: 67500 - DNA, 75 bp, Artificial Sequence
  Synthetic
cagacggcacgactcccagggtgatgttacagtacatgtatgttccacctggtgcccccaaacctcaagagaggg

SEQ ID NO: 67501 - DNA, 75 bp, Artificial Sequence
  Synthetic
accagcagtcttaaccagtaaggatcccagactcgaggttgattttgagcaagctttgttttccaagtatgtggg

SEQ ID NO: 67502 - DNA, 75 bp, Artificial Sequence
  Synthetic
agactcttggttgaagaagttcaatgatatggccaatgcagctcgtggtcttgaatggatagcaaacaaaattag

SEQ ID NO: 67503 - DNA, 75 bp, Artificial Sequence
  Synthetic
caggtgtctacacagcgctccggttctcacgaaaactcaaactcagccactgagggttccaccataaactacacc

SEQ ID NO: 67504 - DNA, 75 bp, Artificial Sequence
  Synthetic
gtcccgtctgattgaggctagtagtctgaatgattcagtgtgcctcagaatggctttcggtcacttgtatgagac

SEQ ID NO: 67505 - DNA, 75 bp, Artificial Sequence
  Synthetic
gaattgtcgaggtccaagccaatgaattctatccacacagataccaaacccacgttctactcgggcatggtacat

SEQ ID NO: 67506 - DNA, 75 bp, Artificial Sequence
  Synthetic
acagctccccttgctagaaaaccaaatcaacaacctagaacaggctgctgctagtcaagaaagtcttgaacaatt

SEQ ID NO: 67507 - DNA, 75 bp, Artificial Sequence
  Synthetic
gaagagaggattcttgcccgatcatcaattcccattcctcatccaccccacgatgccaatgagggagattcacga

SEQ ID NO: 67508 - DNA, 75 bp, Artificial Sequence
  Synthetic
tctagggagatccagcaacttaaaaactacctcctaggttcagaaaatgtggtagagaagatccttaaagcacta

SEQ ID NO: 67509 - DNA, 75 bp, Artificial Sequence
  Synthetic
aacgtattgaacctgtatgtttgatcattagaggctccccaggtacgggaaaatccttagcaactagcataattg

SEQ ID NO: 67510 - DNA, 75 bp, Artificial Sequence
  Synthetic
gagaaagttgaattcttaaacaacctgaagcagcttcccttgttggagaaccaaatctcaaaccttgaacagtct

SEQ ID NO: 67511 - DNA, 75 bp, Artificial Sequence
  Synthetic
agcaacaagttgttacagtcatggatgatttgtgccaaaatcctgatggaaaggatatttcacttttctgccaaa

SEQ ID NO: 67512 - DNA, 75 bp, Artificial Sequence
  Synthetic
tggctataccaaattttgagaacctgagaagaaattggctcgaattattttaatatacagcttaaagctgaaccc

SEQ ID NO: 67513 - DNA, 75 bp, Artificial Sequence
  Synthetic
gagaagaaattggctcgaattattttaatatacagcttaaagctgaaccccaccagaaatctggtcgtgtcgatg

SEQ ID NO: 67514 - DNA, 75 bp, Artificial Sequence
  Synthetic
gaacaactacatgcagttcaagagcaaacaccgtattgaacctgtatgtttgatcattagaggctccccaggaac

SEQ ID NO: 67515 - DNA, 75 bp, Artificial Sequence
  Synthetic
tcatcgcgtccacaaacgcgggcaacatcattgtaccaactgtatctgattctgaagccattagaaggagatttt

SEQ ID NO: 67516 - DNA, 75 bp, Artificial Sequence
  Synthetic
tagagtcccagatcgccaacattgaacagtcagcagctagtcaggaagatttagaaaatctattcagtaatgttg

SEQ ID NO: 67517 - DNA, 75 bp, Artificial Sequence
  Synthetic
catcattgtaccaactgtatctgattctgaagccattagaaggagattttacatggattgtgacattgaggttcc

SEQ ID NO: 67518 - DNA, 75 bp, Artificial Sequence
  Synthetic
caacttcaaaagatgcagtccattagtctgtggtaaagccatccagctgagagataggaaatcaaaagtgagata

SEQ ID NO: 67519 - DNA, 75 bp, Artificial Sequence
  Synthetic
aagcaactagaaattaatacctctcaaatgagcatggaggaggcctgctacggtactgagaatcttgaggctatt

SEQ ID NO: 67520 - DNA, 75 bp, Artificial Sequence
  Synthetic
cgcaattggctcgaactattttagaggctatacacacctcgaccccaccagaaatctggtcgtgaatatcgactg

SEQ ID NO: 67521 - DNA, 75 bp, Artificial Sequence
  Synthetic
acagcatctattttaggcatccctatcgctcaaaagcagagcgcctcatggcttaaaaagttcaacgatatggcc

SEQ ID NO: 67522 - DNA, 75 bp, Artificial Sequence
  Synthetic
acagcatctattttaggcatccctatcgctcaaaagcagagcgcctcttggcttaaaaagttcaacgatatggcc

SEQ ID NO: 67523 - DNA, 75 bp, Artificial Sequence
  Synthetic
acagcatctattttaggcatccctatcgctcaaaagcagagcgcctcctggcttaaaaagttcaacgatatggcc

SEQ ID NO: 67524 - DNA, 75 bp, Artificial Sequence
  Synthetic
acagcatctattttaggcatccctatcgctcaaaagcagagcgcctcgtggcttaaaaagttcaacgatatggcc

SEQ ID NO: 67525 - DNA, 75 bp, Artificial Sequence
  Synthetic
gtatgtttaataattagaggaccccctggcaccggaaagtcactggcaacaggcattattggtagagctattgca

SEQ ID NO: 67526 - DNA, 75 bp, Artificial Sequence
  Synthetic
gtctgtggtaaagccatccagctgagagataggaaatcaaaagtgagatacagtttagattcagtaatctcagaa

SEQ ID NO: 67527 - DNA, 75 bp, Artificial Sequence
  Synthetic
aagcctctcacaatctcactagatacaccagctccagatgccattgcagaccttttgagaagtgtagataatgaa

SEQ ID NO: 67528 - DNA, 75 bp, Artificial Sequence
  Synthetic
acccagacgggaaagacatgtcactcttttgccagatggtttctacagtagagtttataccacccatggctagcc

SEQ ID NO: 67529 - DNA, 75 bp, Artificial Sequence
  Synthetic
agggctattgcattgattcaatccatcaccaccattttggctgtgatatctatggtgtatgttatctatagatta

SEQ ID NO: 67530 - DNA, 75 bp, Artificial Sequence
  Synthetic
ctgtctcagacagtgacgccattagaagaaggttctacatggattgtgacatcgaggttcctgaatcgtttagga

SEQ ID NO: 67531 - DNA, 75 bp, Artificial Sequence
  Synthetic
aagaaggttctacatggattgtgacatcgaggttcctgaatcgtttaggacaccccagggaaggctagatgctgc

SEQ ID NO: 67532 - DNA, 75 bp, Artificial Sequence
  Synthetic
catttcaccatgcttggtgtcagagacagacttgcagtgcttccaaggcatgcaaagccaggcaaaaccatttgg

SEQ ID NO: 67533 - DNA, 75 bp, Artificial Sequence
  Synthetic
cattcaacttagggataggaaatcaggagtcaggtacggtttggattctgtcgtctcagagctaatcagagagta

SEQ ID NO: 67534 - DNA, 75 bp, Artificial Sequence
  Synthetic
ggagtcaggtacggtttggattctgtcgtctcagagctaatcagagagtacaacaaccgctcggcagttggtaac

SEQ ID NO: 67535 - DNA, 75 bp, Artificial Sequence
  Synthetic
ttagttacattggacatgaacgagaaattcagagacatcaccaaattcattcctgaatcatttgagcattgcatg

SEQ ID NO: 67536 - DNA, 75 bp, Artificial Sequence
  Synthetic
agaaccagcagtcttaaccagtaaggatcccagacttgaggttgattttgagcaagctttgttttccaaatatgt

SEQ ID NO: 67537 - DNA, 75 bp, Artificial Sequence
  Synthetic
gcaattagtgatcttttagcaagtgtggatagtgaggaggttagacaatattgtaggcaccaggggtggattatt

SEQ ID NO: 67538 - DNA, 75 bp, Artificial Sequence
  Synthetic
tggatagtgaggaggttagacaatattgtaggcaccaggggtggattattccagagaagcctaccaacattgaaa

SEQ ID NO: 67539 - DNA, 75 bp, Artificial Sequence
  Synthetic
aattcagagacatcaccaaattcattcctgaatcatttgagcattgcatggatgctactcttatcattaacacag

SEQ ID NO: 67540 - DNA, 75 bp, Artificial Sequence
  Synthetic
cacgccactcgcaaccaggaaaaactatctgggtggagcacaagttaattaatgtactggatgctgtcgaattag

SEQ ID NO: 67541 - DNA, 75 bp, Artificial Sequence
  Synthetic
tctacaaactctttgccggtttccaaggtgcctactcggggatgcccaagacagcggtcaagaaaccagtactga

SEQ ID NO: 67542 - DNA, 75 bp, Artificial Sequence
  Synthetic
aggtgcctactcggggatgcccaagacagcggtcaagaaaccagtactgagaactgctgtagctcagggacctgg

SEQ ID NO: 67543 - DNA, 75 bp, Artificial Sequence
  Synthetic
tggaaagcaagggttctgtgcggcattaaagagaagttactttgctactgagcaaggtgagattcagtggatgaa

SEQ ID NO: 67544 - DNA, 75 bp, Artificial Sequence
  Synthetic
ttaaagagaagttactttgctactgagcaaggtgagattcagtggatgaaatctaacaaagagactggccgctac

SEQ ID NO: 67545 - DNA, 75 bp, Artificial Sequence
  Synthetic
aggaattagggatagattagctgtgctcccaagacatgcttcaccaggagactcaatttggattgaacacaagca

SEQ ID NO: 67546 - DNA, 75 bp, Artificial Sequence
  Synthetic
ctcccaagacatgcttcaccaggagactcaatttggattgaacacaagcaaattaaaattctggacgccgttgag

SEQ ID NO: 67547 - DNA, 75 bp, Artificial Sequence
  Synthetic
gcagcactcagtgcgaaggacccaaggttggaagttgactttgaggaagctctgttcagcaagtacattggcaac

SEQ ID NO: 67548 - DNA, 75 bp, Artificial Sequence
  Synthetic
ggttggaagttgactttgaggaagctctgttcagcaagtacattggcaacgccattcatgagccagatgaataca

SEQ ID NO: 67549 - DNA, 75 bp, Artificial Sequence
  Synthetic
acaaagtttattcctgagcaaattgaagggactgcagatgccacccttgtcatcaacacagaggctatgccatca

SEQ ID NO: 67550 - DNA, 75 bp, Artificial Sequence
  Synthetic
aagggactgcagatgccacccttgtcatcaacacagaggctatgccatcaatgtttgttccagtcggtgatgtcc

SEQ ID NO: 67551 - DNA, 75 bp, Artificial Sequence
  Synthetic
atgcttgctatggaacagagaatttggaagcaattgaccttagcaccagtgcaggatacccttacaatgctttag

SEQ ID NO: 67552 - DNA, 75 bp, Artificial Sequence
  Synthetic
agatcggctactcagaggaagctgtatcactaatagaagggatcaaccacacccatcatgtgtatcggaacagga

SEQ ID NO: 67553 - DNA, 75 bp, Artificial Sequence
  Synthetic
gcactatgatgtataacttccctactaaggcaggacaatgtggaggggtagtcacatcagttggaaagatcattg

SEQ ID NO: 67554 - DNA, 75 bp, Artificial Sequence
  Synthetic
gacagtgtggaggagtggtcacctcagtgggaagaattgtgggcatccacattggaggcaatggccgccagggct

SEQ ID NO: 67555 - DNA, 75 bp, Artificial Sequence
  Synthetic
ggctagatctaccattttccacctacatcaaggatgaactgagaagcaaagaaaaggtgaagaagggaaaatcca

SEQ ID NO: 67556 - DNA, 75 bp, Artificial Sequence
  Synthetic
tctgcgctgcactcaaacgcagttattttgcttctgaacaaggtgagattcaatggatgaaatccaataaagaga

SEQ ID NO: 67557 - DNA, 75 bp, Artificial Sequence
  Synthetic
caaagacaagagacttgaggttgattttgagactgctcttttctccaaatacatagggaacaagatgcatgagcc

SEQ ID NO: 67558 - DNA, 75 bp, Artificial Sequence
  Synthetic
atcagttcctattggaaaagccttggctataccaaattttgagaacttgagaagaaattggctcgagttatttta

SEQ ID NO: 67559 - DNA, 75 bp, Artificial Sequence
  Synthetic
gacattctgaacccccaaaccagggatgtgactaaaatgaagatgtacttggacaaatatggtattgacctccct

SEQ ID NO: 67560 - DNA, 75 bp, Artificial Sequence
  Synthetic
agtagcattaatgactcagtctaccttagaatgtgctttggccacttgtatgagaaattccatgcaaatccaggg

SEQ ID NO: 67561 - DNA, 75 bp, Artificial Sequence
  Synthetic
tcactcccatcacatttacagaaaccaaacgtactgtgtaatgggtgggatgccatctgggtgttctggtactag

SEQ ID NO: 67562 - DNA, 75 bp, Artificial Sequence
  Synthetic
caagtccccttgcttcaatgaagttaattgggaaaatgcaaccttcctcaagagaggcttcttgcctgatgagca

SEQ ID NO: 67563 - DNA, 75 bp, Artificial Sequence
  Synthetic
aaatgcaacgttcctcaagaggggattcaaaccagatgagcaatatccgttcctcatccacccaaccatgccgat

SEQ ID NO: 67564 - DNA, 75 bp, Artificial Sequence
  Synthetic
cctagcatggcataatggtagggaaacctatgaggaatttgttgacaaaattagaactgtaccaattggcaaagt

SEQ ID NO: 67565 - DNA, 75 bp, Artificial Sequence
  Synthetic
acaaaaccaaatgaagcgccccacccagggtttaccacaactttccctggtaccaccggtgctacatttcatgat

SEQ ID NO: 67566 - DNA, 75 bp, Artificial Sequence
  Synthetic
ccaaggagcgacgccagtaatccctataactatcacattggccccaatgtgttctgaattcgcaggtcttaggca

SEQ ID NO: 67567 - DNA, 75 bp, Artificial Sequence
  Synthetic
tttaaataatgatctaaaatagtttcaattggcaacatctttggtgccccctgggcttgacaaagtcaccaaagc

SEQ ID NO: 67568 - DNA, 75 bp, Artificial Sequence
  Synthetic
atttagagaaaagagcctgctcaaagtcaacttccaatctcgggtctttgctagtaagcactgctggctctttgg

SEQ ID NO: 67569 - DNA, 75 bp, Artificial Sequence
  Synthetic
ctacatggattgtgacattgaagtgacagactcatacaaaacagatctaggtagactggatgcagggcgagccgc

SEQ ID NO: 67570 - DNA, 75 bp, Artificial Sequence
  Synthetic
aactttgaacacaagaaaatgggagcacaagtttcgacacaaaagtctggtagccacgagactggcaacatagcc

SEQ ID NO: 67571 - DNA, 75 bp, Artificial Sequence
  Synthetic
cacaagtttcgacacaaaagtctggtagccacgagactggcaacatagccactgaagggtccaccattaacttta

SEQ ID NO: 67572 - DNA, 75 bp, Artificial Sequence
  Synthetic
acagtgatagagtagcacagttgactgtcggtaattcaacaatcaccacacaagaggctgctaacatagtccttg

SEQ ID NO: 67573 - DNA, 75 bp, Artificial Sequence
  Synthetic
cacggtccaagggcccagcttagacttcgccttgtctcttttgaggcgcaacattaggcaagcgcaaactgacca

SEQ ID NO: 67574 - DNA, 75 bp, Artificial Sequence
  Synthetic
agggatcgcttagccatcctcccgcgccactcgcaaccagggaagaccatttggattgagcataaactcatcaat

SEQ ID NO: 67575 - DNA, 75 bp, Artificial Sequence
  Synthetic
atgtccaatgcaacgctagtaaattccatcaaggagcactgttagtggctaccatcccagagatggtgttaggag

SEQ ID NO: 67576 - DNA, 75 bp, Artificial Sequence
  Synthetic
accatcccagagatggtgttaggagccaatagctcagatcccaagcccaacactgcaaagcaccctgaattcact

SEQ ID NO: 67577 - DNA, 75 bp, Artificial Sequence
  Synthetic
acggagcacatgccctcaatgtttgtcccggtgggtgacgttgtgcagtatggcttcttgaatctcagtggtaag

SEQ ID NO: 67578 - DNA, 75 bp, Artificial Sequence
  Synthetic
aaccatcatagtaccttatattaatgctgttccatttgattcagccattaaccacaacaacttcacgctagtcgt

SEQ ID NO: 67579 - DNA, 75 bp, Artificial Sequence
  Synthetic
tcagcgcccattctaccaaacttccaccccaccccgtgtattcacatacccggcgaagttaggaacttgcttgag

SEQ ID NO: 67580 - DNA, 75 bp, Artificial Sequence
  Synthetic
cattacaacagagccattgcgctaatccagtccattactaccattttagctgtggtgtcaatggtgtatgtcatc

SEQ ID NO: 67581 - DNA, 75 bp, Artificial Sequence
  Synthetic
cttgaagcaattgccactgttagagaaccagatcacaaatttggaacagtccgctgcctcacaagaggaccttga

SEQ ID NO: 67582 - DNA, 75 bp, Artificial Sequence
  Synthetic
acacaagaagctgcaaatatagtagtgggttatggcgagtggccaaattactgtcctgacacagatgccactgca

SEQ ID NO: 67583 - DNA, 75 bp, Artificial Sequence
  Synthetic
aggggaggtgaacaacctcctggagctctgccaggttgaatctatcttggaggtcaataatgtgactggacaaga

SEQ ID NO: 67584 - DNA, 75 bp, Artificial Sequence
  Synthetic
aaccttgaggctattgatcttcatactagtgcaggctacccctacagtgccctgggaataaagaagagagacatt

SEQ ID NO: 67585 - DNA, 75 bp, Artificial Sequence
  Synthetic
gtagataaacccaccagacctgatgtttccgtgaataggttttacacattatctactaagtcttggacccaaaac

SEQ ID NO: 67586 - DNA, 75 bp, Artificial Sequence
  Synthetic
ttcacgtgcaatgtaatgccagtaaatttcatcagggagcactcttagtcgccatggtccccgaattcgtcatcg

SEQ ID NO: 67587 - DNA, 75 bp, Artificial Sequence
  Synthetic
tggcttttggacacctctatgaaactttccatgcaaaccctgggactgtgactggctcagctgtggggtgtaacc

SEQ ID NO: 67588 - DNA, 75 bp, Artificial Sequence
  Synthetic
tgctgatagcttactccccgcctgggagtgcgcagccaacaacaagagacctggcaatgctcggcacgcacgtag

SEQ ID NO: 67589 - DNA, 75 bp, Artificial Sequence
  Synthetic
tgttttggatgcagggataccattgagccaagcattgatcttcccacatcaatggatcaaccttagaaccaacaa

SEQ ID NO: 67590 - DNA, 75 bp, Artificial Sequence
  Synthetic
tgccaatcctgctccctggttccctctttgcttttgactactcgggttatgatgctagtctcagcccagtttggt

SEQ ID NO: 67591 - DNA, 75 bp, Artificial Sequence
  Synthetic
atactgatgaggttacacaacaagcagtgttgcagggggaccccattgaagacataataactagcacagtctccc

SEQ ID NO: 67592 - DNA, 75 bp, Artificial Sequence
  Synthetic
tggcaatcaactttgattggacaattatgtagatattacactcagtggtcaggttccttagagatcacttttatg

SEQ ID NO: 67593 - DNA, 75 bp, Artificial Sequence
  Synthetic
tgggggtgatcaatgtacaagatggtggtacacagaagggatttgaggtgtgggatgtggatgtgatggggtttg

SEQ ID NO: 67594 - DNA, 75 bp, Artificial Sequence
  Synthetic
gcaaagacacacctgagataacccagcaggccgtgttgcagggtgatgcaatagccgacgctatacaaaacacgg

SEQ ID NO: 67595 - DNA, 75 bp, Artificial Sequence
  Synthetic
gtgtcagagacagacttgcagtgcttccaagacatgcaaagccaggcaaaactatttggatggagggtaagcaag

SEQ ID NO: 67596 - DNA, 75 bp, Artificial Sequence
  Synthetic
tatacacctcaaccccaccagaaatctggtcgtgaatatgactggtgggggtaaatttgttataaccagaatagc

SEQ ID NO: 67597 - DNA, 75 bp, Artificial Sequence
  Synthetic
tccctttcatgtcgccagccagcgcgtaccaatggttctatgatggatatcccacatttgatgatcgacctgcca

SEQ ID NO: 67598 - DNA, 75 bp, Artificial Sequence
  Synthetic
cactctggcactaaggtacctttgtgcgcctgtttttacttcccttccccaaagtaacttagaagttgtgcacca

SEQ ID NO: 67599 - DNA, 75 bp, Artificial Sequence
  Synthetic
tcctgccctccaggctgcggagacaggagcttcatctacagctacagatggcaacttgatagagacaagatgtgt

SEQ ID NO: 67600 - DNA, 75 bp, Artificial Sequence
  Synthetic
ccctaataacatgatgggcacatttgcagtgcgatttgtcagcaagacccctgctacacgagacttgcgtgttag

SEQ ID NO: 67601 - DNA, 75 bp, Artificial Sequence
  Synthetic
ctatcctaactatgacgggacaaatataacaccaacatccaaggacaggcaaagcattaaaacgactgggaaatt

SEQ ID NO: 67602 - DNA, 75 bp, Artificial Sequence
  Synthetic
accccgctaggtaccagtcgcacctgatgcttgctgcgggtcactctgagtctggtgattgtgggggcatcttaa

SEQ ID NO: 67603 - DNA, 75 bp, Artificial Sequence
  Synthetic
ggccaacttagtatgggaagacagctccagggatctccttgtgtcatccacgactgctcaaggatgtgacatcat

SEQ ID NO: 67604 - DNA, 75 bp, Artificial Sequence
  Synthetic
gtttttcagaaaatggacagcccaccaccgcaagtgtcggtgccctttatgtcaccagctagtgcctaccaatgg

SEQ ID NO: 67605 - DNA, 75 bp, Artificial Sequence
  Synthetic
gttttgtaccactatcactgaagtctgtgaccactctcaaattcattttgaccctcaactcaatcaaacatgggc

SEQ ID NO: 67606 - DNA, 75 bp, Artificial Sequence
  Synthetic
acagatttgccggtattatacacaatggtccgggtctttgaaggtgacctttatgttcacaggatcctttatggc

SEQ ID NO: 67607 - DNA, 75 bp, Artificial Sequence
  Synthetic
gtgtctaggatgaaattctatatggacaaatacgggctagacctgccatactccacctacgtgaaggatgagctt

SEQ ID NO: 67608 - DNA, 75 bp, Artificial Sequence
  Synthetic
gcctagcctgatctatgtggaagctagtgagtattacccagctaggtatcaatctcaccttatgctcgcacaagg

SEQ ID NO: 67609 - DNA, 75 bp, Artificial Sequence
  Synthetic
aatctcaccttatgctcgcacaaggacactcagaacctggcgattgtggtggcatcctcaggtgccagcacggcg

SEQ ID NO: 67610 - DNA, 75 bp, Artificial Sequence
  Synthetic
gaagagaaaccagccccagacgctattagcgatctccttgctagcgtagatagtgaagaagtgcgccagtactgc

SEQ ID NO: 67611 - DNA, 75 bp, Artificial Sequence
  Synthetic
acacataacgactgggccaacctggtgtgggaagatagctcgagggatctcctcgtgtcgtccacaacagcccaa

SEQ ID NO: 67612 - DNA, 75 bp, Artificial Sequence
  Synthetic
atttgatcaagttaatctctgctcttgtcattgtgattaggagtgattatgacatggtcacccttacagcaactc

SEQ ID NO: 67613 - DNA, 75 bp, Artificial Sequence
  Synthetic
acagcatctattttaggcatccctattgctcaaaaacagagcgcctcctggcttaaaaagttcaatgatatggcc

SEQ ID NO: 67614 - DNA, 75 bp, Artificial Sequence
  Synthetic
ccagcagccaaggagaaagttgagtttttaaataacttgaagcagttaccactgctagagaaccaaatctctaat

SEQ ID NO: 67615 - DNA, 75 bp, Artificial Sequence
  Synthetic
actaccctttgattctgccttgaaccattgtaattttggcctgctggttgtgcctattagcccattagattatga

SEQ ID NO: 67616 - DNA, 75 bp, Artificial Sequence
  Synthetic
cgaaacttgcaacttagaagttatgtacgttactgatcaacagcaggcgtggcacaccagccatgtcttgatcaa

SEQ ID NO: 67617 - DNA, 75 bp, Artificial Sequence
  Synthetic
ccaaggtgcgacgccagtgattcccattactatcaccctggccccgatgtgctccgagtttgcaggccttaggca

SEQ ID NO: 67618 - DNA, 75 bp, Artificial Sequence
  Synthetic
agagaagaggatgaacaactacatgcagttcaagagcaaacaccgtattgaacctgtatgtcttatcatcagggg

SEQ ID NO: 67619 - DNA, 75 bp, Artificial Sequence
  Synthetic
tcaatagactgctcacgtggtcgaaggagaaaacgttcgttatccggctaactacttcgagaaacctagtagcac

SEQ ID NO: 67620 - DNA, 75 bp, Artificial Sequence
  Synthetic
aatggatgacctgtgtcagaatcctgacggcaaggacatgtcattgttttaccaaatggtgtctactgtggatat

SEQ ID NO: 67621 - DNA, 75 bp, Artificial Sequence
  Synthetic
ccagccacatcttgatcaagcacttctgtttacccggaccgagtatcaataagctgcgcaagcggctgaaggaga

SEQ ID NO: 67622 - DNA, 75 bp, Artificial Sequence
  Synthetic
tagctgataagtatcactccagtgtctattcactcccaccagacccagaccactttgatgggtacaagcagcaag

SEQ ID NO: 67623 - DNA, 75 bp, Artificial Sequence
  Synthetic
tgagacgcaattggctcgaattattctagaggtcgaatacacctcaaccccaccaggaatctggtcgtgaatatg

SEQ ID NO: 67624 - DNA, 75 bp, Artificial Sequence
  Synthetic
ccgtggacttcattcctccaatggcttccttagaagagaagggggtctctttcacatctaagttcgtcattgcat

SEQ ID NO: 67625 - DNA, 75 bp, Artificial Sequence
  Synthetic
ttcacatctaagttcgtcattgcatccactaatgctagtaatatcatagtgccaacagtatctgatgcagatgcc

SEQ ID NO: 67626 - DNA, 75 bp, Artificial Sequence
  Synthetic
atcagaaccctcttgattaaaacttttaaggggatcgatttagatgagttgaatatggtagcttatggagatgat

SEQ ID NO: 67627 - DNA, 75 bp, Artificial Sequence
  Synthetic
gccgggcgagcagccaaattgtgttctgagaacaacacagcaaatttcaagcgttgcagcccattagtgtgtgga

SEQ ID NO: 67628 - DNA, 75 bp, Artificial Sequence
  Synthetic
cttgaggagaagccagccccagacgctattagcgatctcctcgctagtgtagacagcgaggaagtgcgccaatac

SEQ ID NO: 67629 - DNA, 75 bp, Artificial Sequence
  Synthetic
tgaaactcccaccaatgttgagcgacacctcaacagagcggtgctagtcatgcaatccatcgctactgtggttgc

SEQ ID NO: 67630 - DNA, 75 bp, Artificial Sequence
  Synthetic
gagcacaataacagatccgccattggtaacacaattgaggctttgttccagggcccacccaaatttagacccata

SEQ ID NO: 67631 - DNA, 75 bp, Artificial Sequence
  Synthetic
gtcttctgtgacgttggtcgtgccatggattagtaatacacactacagggcacacgcccgcgctgggtactttga

SEQ ID NO: 67632 - DNA, 75 bp, Artificial Sequence
  Synthetic
cacaagtttcaacacagaaatctggcagccatgaaactggcaatatagccactgaggggtctactatcaatttta

SEQ ID NO: 67633 - DNA, 75 bp, Artificial Sequence
  Synthetic
cagccatgaaactggcaatatagccactgaggggtctactatcaattttaccaacatcaattattacaaggactc

SEQ ID NO: 67634 - DNA, 75 bp, Artificial Sequence
  Synthetic
cgtcaatactgtagggatcaaggttggattattccggaaactcctacaaatgttgaacgacacctcaacagagct

SEQ ID NO: 67635 - DNA, 75 bp, Artificial Sequence
  Synthetic
ggattattccggaaactcctacaaatgttgaacgacacctcaacagagctgtgttagttatgcaatccatcgcca

SEQ ID NO: 67636 - DNA, 75 bp, Artificial Sequence
  Synthetic
actgccctgacacagacgcaactgccgtggataaaccaactcgcccggacgtgtctgtcaacaggttctacactt

SEQ ID NO: 67637 - DNA, 75 bp, Artificial Sequence
  Synthetic
cggtagtggcggttgtctcattggtgtacgtcatctataaactctttgcagggttccagggcgcatattctggtg

SEQ ID NO: 67638 - DNA, 75 bp, Artificial Sequence
  Synthetic
gagagaagtggcaccccctttgaaatcaccttcagtggaagcgtgcgggtacagtgacagagtggcacaactaac

SEQ ID NO: 67639 - DNA, 75 bp, Artificial Sequence
  Synthetic
actatcacgaccaatagcaggcgtggcgcaccagtcacgtcttggtcaagcacttctgtttccccggactgagta

SEQ ID NO: 67640 - DNA, 75 bp, Artificial Sequence
  Synthetic
tcaccttcagtggaagcgtgcgggtacagtgacagagtggcacaactaactgtggggaattcgacaatcacaaca

SEQ ID NO: 67641 - DNA, 75 bp, Artificial Sequence
  Synthetic
gacaaacccacacgtcctgatgtatcagttaacaggttttacaccatgtccacacaaatgtggcaggatacctca

SEQ ID NO: 67642 - DNA, 75 bp, Artificial Sequence
  Synthetic
accatgctgggtgtcagagatcgcttggctgtcctcccgcgacattctcaacctggaaggactatctgggtggaa

SEQ ID NO: 67643 - DNA, 75 bp, Artificial Sequence
  Synthetic
ctcaacatggttgcttatggagacgatgtgctcgctagctatcccttcccaattgattgcttggaactagcaaag

SEQ ID NO: 67644 - DNA, 75 bp, Artificial Sequence
  Synthetic
cagttaacaggttttacaccatgtccacacaaatgtggcaggatacctcaaagggatggtattggaagtttcctg

SEQ ID NO: 67645 - DNA, 75 bp, Artificial Sequence
  Synthetic
accctcgacaccaatgagaaattcagggatgtcaccaagttcattccagaaaccatcagtggtgccagcgatgcc

SEQ ID NO: 67646 - DNA, 75 bp, Artificial Sequence
  Synthetic
acgtccagtgtaatgccagcaaattccatcaaggagcgctgctggtggcagctgtacctgagatggtgttgggag

SEQ ID NO: 67647 - DNA, 75 bp, Artificial Sequence
  Synthetic
gggatgtcaccaagttcattccagaaaccatcagtggtgccagcgatgccaccttagtgatcaatacagagcaca

SEQ ID NO: 67648 - DNA, 75 bp, Artificial Sequence
  Synthetic
atgcgctttgatgctgaattcacatttgtcgtagccaaacccaatggtgagctagtcccccaattactgcagtac

SEQ ID NO: 67649 - DNA, 75 bp, Artificial Sequence
  Synthetic
tcgcaagcgaacaaggcgagatccaatgggtgaagtctaacaaagaaactggtagactgaatatcaatggaccga

SEQ ID NO: 67650 - DNA, 75 bp, Artificial Sequence
  Synthetic
ctacttgtaccgctcgggttactgcatgcacgttcagtgcaatgcgagcaagttccatcaggaggccctcttagt

SEQ ID NO: 67651 - DNA, 75 bp, Artificial Sequence
  Synthetic
ccatcaaggagcgctgctggtggcagctgtacctgagatggtgttgggagccaacagttcggaccctaagcccaa

SEQ ID NO: 67652 - DNA, 75 bp, Artificial Sequence
  Synthetic
tttcgctcacactaacctaggtaaaaatagaccagagtttcgagatccttatgtcttggatgctggggttccctt

SEQ ID NO: 67653 - DNA, 75 bp, Artificial Sequence
  Synthetic
gtggatgagcaaggggttaatttggagttaactttgattactcttgacaccaatgaaaagttcagagacatcacc

SEQ ID NO: 67654 - DNA, 75 bp, Artificial Sequence
  Synthetic
ggatatgggagtccccttaagtcaagccctcgtgttcccccatcagtggatcaacttgcggactaacaattgtgc

SEQ ID NO: 67655 - DNA, 75 bp, Artificial Sequence
  Synthetic
ggatacaagcaacaagtagttactgttatggatgatctttgtcaaaacccagatggaaaggacatgtcactattt

SEQ ID NO: 67656 - DNA, 75 bp, Artificial Sequence
  Synthetic
aatagaccagagtttcgagatccttatgtcttggatgctggggttcccttaagtcaagcagcggtttacccccat

SEQ ID NO: 67657 - DNA, 75 bp, Artificial Sequence
  Synthetic
agaagctactttgctagtgagcagggagagatccaatgggttaaacctaacaaggaaacaggaagactcaacatc

SEQ ID NO: 67658 - DNA, 75 bp, Artificial Sequence
  Synthetic
ttttacgatggttatcccaccttcggagagcacctccaagcaaatgacttggattatggccaatgcccgaacaat

SEQ ID NO: 67659 - DNA, 75 bp, Artificial Sequence
  Synthetic
gaaattcacgagccccgtgctagatgtgttgactgaaatggctgcaccacttcaatccccaagcgcagaagcgtg

SEQ ID NO: 67660 - DNA, 75 bp, Artificial Sequence
  Synthetic
tgcactggtgcaacaacagccatccctataacagtaacaatagccccgctgaactcagagttttgtggtttaagg

SEQ ID NO: 67661 - DNA, 75 bp, Artificial Sequence
  Synthetic
gccctcgtgttcccccatcagtggatcaacttgcggactaacaattgtgccaccattatagtgccctatatcaat

SEQ ID NO: 67662 - DNA, 75 bp, Artificial Sequence
  Synthetic
tagaagccctcttccaaggaccccctaagttcaagcctataagaattagccttgaagagaagccagccccagatg

SEQ ID NO: 67663 - DNA, 75 bp, Artificial Sequence
  Synthetic
ttgcataataaggaccctcgccttgaggtggacttcgagcaagcattgttctccaagtacgtggggaacacacta

SEQ ID NO: 67664 - DNA, 75 bp, Artificial Sequence
  Synthetic
ctataacagtaacaatagccccgctgaactcagagttttgtggtttaaggcaagctaccacgcaagggataccag

SEQ ID NO: 67665 - DNA, 75 bp, Artificial Sequence
  Synthetic
tgccggtattacacacaatggtccgggtctttgaaggtgacctttatgttcacaggatcctttatggcaacaggc

SEQ ID NO: 67666 - DNA, 75 bp, Artificial Sequence
  Synthetic
gtctatgttatttacaagctgtttgccggattccaaggtgcttactctggagcacccaagcaagcactcaagaag

SEQ ID NO: 67667 - DNA, 75 bp, Artificial Sequence
  Synthetic
aaccaacgccgactatacatataccgggcgaggtcaataatctcctagagctctgccaagtggagtccatccttg

SEQ ID NO: 67668 - DNA, 75 bp, Artificial Sequence
  Synthetic
gggcgaggtcaataatctcctagagctctgccaagtggagtccatccttgaggtcaacaatgtaaccggacaaga

SEQ ID NO: 67669 - DNA, 75 bp, Artificial Sequence
  Synthetic
tctcagatgagcatggaggaggcctgctatggcacagaaaaccttgaggctattgaccttcacactagcgcggga

SEQ ID NO: 67670 - DNA, 75 bp, Artificial Sequence
  Synthetic
tttgagcaggccctgttctctaagtatgtgggaaacacactacatgagcctgacgagtacatcaaagaggcagct

SEQ ID NO: 67671 - DNA, 75 bp, Artificial Sequence
  Synthetic
tgggagactgaacattaatggcccaacccgcaccaaattggagcccagtgtattctatgatgtgtttgagggcag

SEQ ID NO: 67672 - DNA, 75 bp, Artificial Sequence
  Synthetic
taccagagatgtgagcaagatgaagttctacatggataagtacggtcttgacctcccttactccacctatgtcaa

SEQ ID NO: 67673 - DNA, 75 bp, Artificial Sequence
  Synthetic
cccgggtagggacgggccatggcaatccaccttggttggtcagatatgtaggtactacactcagtggtcaggctc

SEQ ID NO: 67674 - DNA, 75 bp, Artificial Sequence
  Synthetic
aatccccgttcgagcacagaacaatgtggaccagttgtgcgcatcattccaagtagaccctgggcgcaatggccc

SEQ ID NO: 67675 - DNA, 75 bp, Artificial Sequence
  Synthetic
tccaccttggttggtcagatatgtaggtactacactcagtggtcaggctcactggagattacgttcatgtttact

SEQ ID NO: 67676 - DNA, 75 bp, Artificial Sequence
  Synthetic
tagaagctagcagcttgaatgactcggtctaccttagaatggcttttgggcacctctatgaaactttccatgcga

SEQ ID NO: 67677 - DNA, 75 bp, Artificial Sequence
  Synthetic
ctggccatgcttggcacccatgttgtgtgggatttcgggctacaatcatccattactcttgtcatcccatggatc

SEQ ID NO: 67678 - DNA, 75 bp, Artificial Sequence
  Synthetic
tgtgggatttcgggctacaatcatccattactcttgtcatcccatggatcagcaacacacacttcagaacaggca

SEQ ID NO: 67679 - DNA, 75 bp, Artificial Sequence
  Synthetic
tggagcaaactaccaatcctgcttcctggttccctcttcgcttttgactactcaggttacgacgctagcctcagc

SEQ ID NO: 67680 - DNA, 75 bp, Artificial Sequence
  Synthetic
ctgatacaccgagtcaagcacacataatagctctgggtgctgcacagaagaattttacactcaaactgtgcaagg

SEQ ID NO: 67681 - DNA, 75 bp, Artificial Sequence
  Synthetic
tactgcccggacgttgacgccactgcggtggataaaccgactagaccagatgtggctgtgaacagattttacact

SEQ ID NO: 67682 - DNA, 75 bp, Artificial Sequence
  Synthetic
ggaatcaaccatacgcaccatgtgtaccgtaacaaaacctattgtgtacttggtggaatgccctcaggttgctca

SEQ ID NO: 67683 - DNA, 75 bp, Artificial Sequence
  Synthetic
aatagctctgggtgctgcacagaagaattttacactcaaactgtgcaaggacacagatgaggtcacgcagcaagc

SEQ ID NO: 67684 - DNA, 75 bp, Artificial Sequence
  Synthetic
cacaactataaactactacaaggatgcatacgctgcaagtgcggggcgccaggatatgtcccaagacccgaagaa

SEQ ID NO: 67685 - DNA, 75 bp, Artificial Sequence
  Synthetic
tgggtgtcatggaagcccttgggcatggatcaaagcgaagacagcctctattcttggtattcccatagtgcaaaa

SEQ ID NO: 67686 - DNA, 75 bp, Artificial Sequence
  Synthetic
atgggctttgtccaactccgcagaaaatgcgagatgttcacatacatgaggttcaacgcagaattcacatttgtt

SEQ ID NO: 67687 - DNA, 75 bp, Artificial Sequence
  Synthetic
tgagaagaaattggctcgaattattttaacattacagcttaaagctgaaccccactagaaatctggtcgtgttaa

SEQ ID NO: 67688 - DNA, 75 bp, Artificial Sequence
  Synthetic
ttaattcaccccacaatgcctatgaaagaaattcatgaatccattagatggacaaaagacgcacgtaacactcaa

SEQ ID NO: 67689 - DNA, 75 bp, Artificial Sequence
  Synthetic
ttacccctttccgattgactgcctggagctagcaaagacaggaaaggagtatggtctaaccatgacccctgcaga

SEQ ID NO: 67690 - DNA, 75 bp, Artificial Sequence
  Synthetic
atcacacgacactacagcagccaacacctcagtgagtaatcataaaattggtacgggggatgtcccagctctcca

SEQ ID NO: 67691 - DNA, 75 bp, Artificial Sequence
  Synthetic
tgcctattagcccgttagattatgaccaaggtgcgacgccagtgatccccattactatcaccctggccccaatgt

SEQ ID NO: 67692 - DNA, 75 bp, Artificial Sequence
  Synthetic
catttcttttcaagagcaggccttgtgggagtgatcaatgtgcaagatggcggcactcagaagggttttgaagtg

SEQ ID NO: 67693 - DNA, 75 bp, Artificial Sequence
  Synthetic
acctcagtgagtaatcataaaattggtacgggggatgtcccagctctccaagctgcagagactggcgctacttcc

SEQ ID NO: 67694 - DNA, 75 bp, Artificial Sequence
  Synthetic
aactaagagataggaagtccaaggttaggtacagtgtggacacagtggtttcggaactcataagggagtataaca

SEQ ID NO: 67695 - DNA, 75 bp, Artificial Sequence
  Synthetic
tgggagtgatcaatgtgcaagatggcggcactcagaagggttttgaagtgtgggacatagatgtcatggggtttg

SEQ ID NO: 67696 - DNA, 75 bp, Artificial Sequence
  Synthetic
gacatatggtaggtttggccaacagtccggggctatctatgtaggtaacttcagagtggtaacccgacatctcgc

SEQ ID NO: 67697 - DNA, 75 bp, Artificial Sequence
  Synthetic
cacaggaagcagctaacatagttatagcctatggggagtggcctgagtactgcccagacacagatgcaacggcag

SEQ ID NO: 67698 - DNA, 75 bp, Artificial Sequence
  Synthetic
cggatggcacaactcccagagtgatgttgcagtacatgtacgttccacctggtgcccccaaacctcaggagagag

SEQ ID NO: 67699 - DNA, 75 bp, Artificial Sequence
  Synthetic
gttgcagtacatgtacgttccacctggtgcccccaaacctcaggagagagattcgtttcagtggcaaactgcaac

SEQ ID NO: 67700 - DNA, 75 bp, Artificial Sequence
  Synthetic
taaacgactcaaccccaccagaaatctggtcgtgaatatgactggtgggggtaaatttgttataaccagaatagc

SEQ ID NO: 67701 - DNA, 75 bp, Artificial Sequence
  Synthetic
ctaccaatggttctacgatgggtacccaacattcgatgatcgaccggccacctcaaaccacccgtacggtcagtg

SEQ ID NO: 67702 - DNA, 75 bp, Artificial Sequence
  Synthetic
ccaacattcgatgatcgaccggccacctcaaaccacccgtacggtcagtgccccaataacatgatgggcacattc

SEQ ID NO: 67703 - DNA, 75 bp, Artificial Sequence
  Synthetic
cccctagtatgtggaaaggctatccagctcagagataggaaatctaaagttagatatagtgtggacactgtggtc

SEQ ID NO: 67704 - DNA, 75 bp, Artificial Sequence
  Synthetic
cgcgcatgggtaccgagacctatccgatctcaaccctatattttgaaaaactacccaaattatgatggcacaaag

SEQ ID NO: 67705 - DNA, 75 bp, Artificial Sequence
  Synthetic
aaatttagacccgtaagaatcagcctggaagagagaccagccccagacgccattagcgaccttctagctagtgtg

SEQ ID NO: 67706 - DNA, 75 bp, Artificial Sequence
  Synthetic
gatctcaaccctatattttgaaaaactacccaaattatgatggcacaaagataacgtcgacatctaaggataggc

SEQ ID NO: 67707 - DNA, 75 bp, Artificial Sequence
  Synthetic
tcagattctgatgcgattcgcaggcggttttatatggactgcgatatagaggtgacagactcctacaagacggac

SEQ ID NO: 67708 - DNA, 75 bp, Artificial Sequence
  Synthetic
acaatctgggtggaacataaactcgtaaacatcctggatgctgtcgagttagtagacgagcaaggggtcaaccta

SEQ ID NO: 67709 - DNA, 75 bp, Artificial Sequence
  Synthetic
cattagcgaccttctagctagtgtggatagtgaagaggtgcgccagtactgcagagatcaagggtggataattcc

SEQ ID NO: 67710 - DNA, 75 bp, Artificial Sequence
  Synthetic
agtagacgagcaaggggtcaacctagagcttactctaatcactcttgacactaatgagaagttcagagatatcac

SEQ ID NO: 67711 - DNA, 75 bp, Artificial Sequence
  Synthetic
ggcatcttgccacccacaatgattgggccaacctggtctgggaggacagctccagagatcttttggtgtcttcaa

SEQ ID NO: 67712 - DNA, 75 bp, Artificial Sequence
  Synthetic
ggccaacctggtctgggaggacagctccagagatcttttggtgtcttcaactactgctcaagggtgcgacaccat

SEQ ID NO: 67713 - DNA, 75 bp, Artificial Sequence
  Synthetic
aattaagagacaggaagtctaaagtaagatatagtattgataccgtagtgtcagagttaatcagagagtataata

SEQ ID NO: 67714 - DNA, 75 bp, Artificial Sequence
  Synthetic
acctagctttgtctttgtggaagcgagcgagtactacccagctagataccaatctcaccttatgctcgcacaagg

SEQ ID NO: 67715 - DNA, 75 bp, Artificial Sequence
  Synthetic
agcgagtactacccagctagataccaatctcaccttatgctcgcacaaggtcattcagagcctggagattgtggt

SEQ ID NO: 67716 - DNA, 75 bp, Artificial Sequence
  Synthetic
ctgcaggtactacacccagtggtcaggttcactggaggtgacattcatgtttgcaggctcattcatggccacagg

SEQ ID NO: 67717 - DNA, 75 bp, Artificial Sequence
  Synthetic
agcagggcgtgtctgattacatcaaagggcttggagatgcttttggcatggggtttacagacgcagtgtcaagag

SEQ ID NO: 67718 - DNA, 75 bp, Artificial Sequence
  Synthetic
gtgagggatctcttgtggttggatgatgaagccatggaacaaggcgtgtctgattacatcaagggacttggtgac

SEQ ID NO: 67719 - DNA, 75 bp, Artificial Sequence
  Synthetic
atgaagccatggaacaaggcgtgtctgattacatcaagggacttggtgacgcttttggtacggggttcactgacg

SEQ ID NO: 67720 - DNA, 75 bp, Artificial Sequence
  Synthetic
tcaacacagaacacatgccctcaatgtttgtgccggtgggtgatgtcgtgcagtatggtttcctaaatctcagtg

SEQ ID NO: 67721 - DNA, 75 bp, Artificial Sequence
  Synthetic
acctggtaaagctcatctctgcacttgttatcgtcgtcaggagtgactatgatatggtcacgttaacagcaacac

SEQ ID NO: 67722 - DNA, 75 bp, Artificial Sequence
  Synthetic
tgttatcgtcgtcaggagtgactatgatatggtcacgttaacagcaacacttgccctgattggatgccacgggag

SEQ ID NO: 67723 - DNA, 75 bp, Artificial Sequence
  Synthetic
tgggaagtccttggcaacagggattattgctagagctatagcagacaagtaccactccagtgtgtattccttacc

SEQ ID NO: 67724 - DNA, 75 bp, Artificial Sequence
  Synthetic
gctgaagaaattcaacgacatggcgaacgccgctaaagggctcgaatggatctccaacaaaatcagtaaattcat

SEQ ID NO: 67725 - DNA, 75 bp, Artificial Sequence
  Synthetic
attattgtaactccaagagaaagcactatccagttagcttttctaaacccagcctcatatacgtggatgctagcg

SEQ ID NO: 67726 - DNA, 75 bp, Artificial Sequence
  Synthetic
actgcgttgcaagtactacctacagctgccaacactgaggcaagtagtcacagattaggcactggtgttgtacca

SEQ ID NO: 67727 - DNA, 75 bp, Artificial Sequence
  Synthetic
tttgttggagaaccaaatctctaacctcgagcaatcagccgcgtcgcaggaagatcttgaagcgatgtttggcaa

SEQ ID NO: 67728 - DNA, 75 bp, Artificial Sequence
  Synthetic
atcacgtgcgatccttgtgtctattgtcatggtacaacgggaaagcagagtacgaagaatttgtgagcacaatta

SEQ ID NO: 67729 - DNA, 75 bp, Artificial Sequence
  Synthetic
cagtgtggaggtgtggtcacctcagtcggcaagattattggaattcatatcggtgggaatggtcgccaaggtttc

SEQ ID NO: 67730 - DNA, 75 bp, Artificial Sequence
  Synthetic
tagtcacttcagttggcaaggtcattggaatccacattggcggaaatggacgccagggcttttgcgccggcttaa

SEQ ID NO: 67731 - DNA, 75 bp, Artificial Sequence
  Synthetic
ttatacccccaatggcttcactggaagagaaaggcgtatccttcacatctaaatttgttattgcttcaactaatg

SEQ ID NO: 67732 - DNA, 75 bp, Artificial Sequence
  Synthetic
aacttattgtgtacttggtgggatgccctcaggctgttcaggaacatccattttcaactcaatgattaacaacat

SEQ ID NO: 67733 - DNA, 75 bp, Artificial Sequence
  Synthetic
gtactccctacccccagacccagatcacttcgatgggtacaagcaacaggtcgtcactgtcatggacgacctctg

SEQ ID NO: 67734 - DNA, 75 bp, Artificial Sequence
  Synthetic
aagtgactgactcttataagacagacttaggccgcttagatgcaggtagggccgcaaagctctgctcagagaaca

SEQ ID NO: 67735 - DNA, 75 bp, Artificial Sequence
  Synthetic
cacttcgatgggtacaagcaacaggtcgtcactgtcatggacgacctctgccagaacccagatgggaaggacatg

SEQ ID NO: 67736 - DNA, 75 bp, Artificial Sequence
  Synthetic
caactgagagataggaagtccaaagtcaggtatagcgtagacactgtggtatcagaattggttagggagtataat

SEQ ID NO: 67737 - DNA, 75 bp, Artificial Sequence
  Synthetic
tcaggtatagcgtagacactgtggtatcagaattggttagggagtataataacaggtccgctataggaaacacta

SEQ ID NO: 67738 - DNA, 75 bp, Artificial Sequence
  Synthetic
tttacatccaagtttgtgattgcttccactaatgcgagtaacatcatagtaccaacggtctcagactcagatgcc

SEQ ID NO: 67739 - DNA, 75 bp, Artificial Sequence
  Synthetic
ccactaatgcgagtaacatcatagtaccaacggtctcagactcagatgccattcgtcgccggttctttatggact

SEQ ID NO: 67740 - DNA, 75 bp, Artificial Sequence
  Synthetic
ctattagtgacctgcttgctagtgttgacagtgaagaggtgcggcagtactgcagagatcaaggatggataattc

SEQ ID NO: 67741 - DNA, 75 bp, Artificial Sequence
  Synthetic
ctgataataacactgcgaacttcaagcgatgcagtccattagtttgtgggaaagccatccaactcagagacagaa

SEQ ID NO: 67742 - DNA, 75 bp, Artificial Sequence
  Synthetic
gcgatgcagtccattagtttgtgggaaagccatccaactcagagacagaaaatccaaggtgaggtacagcgtgga

SEQ ID NO: 67743 - DNA, 75 bp, Artificial Sequence
  Synthetic
gtggttccagtatcccccttagattacatgacaggcgcaacgcccaccatcccaatcaccctcacagtagctcct

SEQ ID NO: 67744 - DNA, 75 bp, Artificial Sequence
  Synthetic
ttcaactcgatgatcaacaacatcattattaggacactcctgattaaaacattcaaagggatagatctggatgaa

SEQ ID NO: 67745 - DNA, 75 bp, Artificial Sequence
  Synthetic
ggggccccctaagtttagaccgataagaattagtctggaggagaagcccgcgcctgacgctattagtgatttact

SEQ ID NO: 67746 - DNA, 75 bp, Artificial Sequence
  Synthetic
agaattagtctggaggagaagcccgcgcctgacgctattagtgatttactagctagtgttgacagcgaggaggtt

SEQ ID NO: 67747 - DNA, 75 bp, Artificial Sequence
  Synthetic
aattgactgtctggaattggcgaaaacaggcaaggagtatggtttaaccatgacccctgccgacaagtcaccctg

SEQ ID NO: 67748 - DNA, 75 bp, Artificial Sequence
  Synthetic
gttttgattatgcaatccatagctactgtggtagcagttgtgtcccttgtttacgtcatctacaaactgttcgct

SEQ ID NO: 67749 - DNA, 75 bp, Artificial Sequence
  Synthetic
agaacccagtgtgtttcatgatgtgtttgagggcaataaggagccggcagttctgaccagcaaagatcccaggtt

SEQ ID NO: 67750 - DNA, 75 bp, Artificial Sequence
  Synthetic
ctgtggtagcagttgtgtcccttgtttacgtcatctacaaactgttcgctggtttccaaggagcatactccggtg

SEQ ID NO: 67751 - DNA, 75 bp, Artificial Sequence
  Synthetic
cacccacagggcccactgggcgttagcactctggtattacggtacctttgtgcgcctgttttataacccctcccc

SEQ ID NO: 67752 - DNA, 75 bp, Artificial Sequence
  Synthetic
ccctacttagaaggaatatcagacaggttcaaactgatcagggccactttaccatgctaggagtgcgagaccacc

SEQ ID NO: 67753 - DNA, 75 bp, Artificial Sequence
  Synthetic
ggttcaaactgatcagggccactttaccatgctaggagtgcgagaccacctagctgtactccctagacactccca

SEQ ID NO: 67754 - DNA, 75 bp, Artificial Sequence
  Synthetic
gcactctggtattacggtacctttgtgcgcctgttttataacccctccccaactgtaaattagaagcaacacacg

SEQ ID NO: 67755 - DNA, 75 bp, Artificial Sequence
  Synthetic
cacccactcacaggacccacgcggtgctagcactctggttctacggaacccttgtgcgcctgttttacgccccac

SEQ ID NO: 67756 - DNA, 75 bp, Artificial Sequence
  Synthetic
cttatccaccctaccatgcccatgagggagatccacgagtccattcgttggactaaagacgcacgcaacactcag

SEQ ID NO: 67757 - DNA, 75 bp, Artificial Sequence
  Synthetic
agtcaacttagagctcacactagtgacactggacaccaatgaaaagttcagagacatcacaaagtttataccaga

SEQ ID NO: 67758 - DNA, 75 bp, Artificial Sequence
  Synthetic
ttgcgctggcctgaagaggaattattttgcaagtgaacaaggtgagatccaatgggtgaaacctaacacggagac

SEQ ID NO: 67759 - DNA, 75 bp, Artificial Sequence
  Synthetic
acactggacaccaatgaaaagttcagagacatcacaaagtttataccagagactattagccctgctagtgatgcc

SEQ ID NO: 67760 - DNA, 75 bp, Artificial Sequence
  Synthetic
aaccttagtggtaagcccacccaccgaactatgatgtacaacttcccaacaaaagcagggcagtgtggtggtgtc

SEQ ID NO: 67761 - DNA, 75 bp, Artificial Sequence
  Synthetic
gagaagaaattggctcgaattgttttaatatacagtttaaactgaaccccaccagaagtctggtcgtgttaatga

SEQ ID NO: 67762 - DNA, 75 bp, Artificial Sequence
  Synthetic
acttctgtctccccggaccgagtatcaatagactgctagcgcggttgaaggagaaaacgtccgttacccggctaa

SEQ ID NO: 67763 - DNA, 75 bp, Artificial Sequence
  Synthetic
tgggtgtccgtgtttccttttatctttattctggctgcttatggtgacaattgacagattgttaccatatagcta

SEQ ID NO: 67764 - DNA, 75 bp, Artificial Sequence
  Synthetic
cagagaacctggaagcaattgacctccacactagtgcagggtacccatacagtgctctgggcataaagaagaggg

SEQ ID NO: 67765 - DNA, 75 bp, Artificial Sequence
  Synthetic
gtgagattcaatggatgaagcccaacaaagaaactggcaggttgaacattaatgggccaacccgcactaagcttg

SEQ ID NO: 67766 - DNA, 75 bp, Artificial Sequence
  Synthetic
atataacacattactgctgatactgagtttggacaaagcaaaatgggcgctcaaatatcaacacaaaaatctggc

SEQ ID NO: 67767 - DNA, 75 bp, Artificial Sequence
  Synthetic
aagtagactttgagcaagccttgttttcaaagtatgtggggaacacgctccatgagcctgatgaatttgttagag

SEQ ID NO: 67768 - DNA, 75 bp, Artificial Sequence
  Synthetic
agtttggacaaagcaaaatgggcgctcaaatatcaacacaaaaatctggctcccatgagacgggtaacatcgcta

SEQ ID NO: 67769 - DNA, 75 bp, Artificial Sequence
  Synthetic
ttcaaagtatgtggggaacacgctccatgagcctgatgaatttgttagagaagcagctctgcattatgctaacca

SEQ ID NO: 67770 - DNA, 75 bp, Artificial Sequence
  Synthetic
actttactcaagatccggggaaattcaccagcccggtcctagatgttttatcagagatggcagcaccactgcaat

SEQ ID NO: 67771 - DNA, 75 bp, Artificial Sequence
  Synthetic
catagaccttcacacaagtgcagggtacccatatagtgcattgggcatcaagaagagagacatcttggacccaac

SEQ ID NO: 67772 - DNA, 75 bp, Artificial Sequence
  Synthetic
caccagcccggtcctagatgttttatcagagatggcagcaccactgcaatcaccgacagcagaagcatgtggata

SEQ ID NO: 67773 - DNA, 75 bp, Artificial Sequence
  Synthetic
tacccatatagtgcattgggcatcaagaagagagacatcttggacccaacaactcgtgatgttagcaagatgaag

SEQ ID NO: 67774 - DNA, 75 bp, Artificial Sequence
  Synthetic
ttatggggagtggccacaatattgtcctgacactgacgctacagcggtggacaagcccactcgtcctgacgtctc

SEQ ID NO: 67775 - DNA, 75 bp, Artificial Sequence
  Synthetic
atcaagaaagggaagtctcgcctcatagaggcaagtagcctaaatgactcagtatacttgaggatgacatttggg

SEQ ID NO: 67776 - DNA, 75 bp, Artificial Sequence
  Synthetic
aaacatattgtgtccttggtgggatgccgtcaggatgttctggcacctccattttcaactcgatgatcaacaaca

SEQ ID NO: 67777 - DNA, 75 bp, Artificial Sequence
  Synthetic
cctgacactgacgctacagcggtggacaagcccactcgtcctgacgtctcagtcaatagattttatacactagac

SEQ ID NO: 67778 - DNA, 75 bp, Artificial Sequence
  Synthetic
tagaggcaagtagcctaaatgactcagtatacttgaggatgacatttgggcacctttatgaagctttccatgcta

SEQ ID NO: 67779 - DNA, 75 bp, Artificial Sequence
  Synthetic
atgatgtgctagctagttatcctttccccattgattgccttgagctagctaagactggtaaagaatatgggctga

SEQ ID NO: 67780 - DNA, 75 bp, Artificial Sequence
  Synthetic
ggtcaaaatgcacagttccactttttgtataggtcagggttttgcattcacgttcaatgcaatgccagcaagttt

SEQ ID NO: 67781 - DNA, 75 bp, Artificial Sequence
  Synthetic
cgggatcgctttttgcatttgactactcagggtatgatgctagtctcagtcctgtatggtttagggcactagaaa

SEQ ID NO: 67782 - DNA, 75 bp, Artificial Sequence
  Synthetic
tgtataggtcagggttttgcattcacgttcaatgcaatgccagcaagtttcatcagggagcactattggttgcag

SEQ ID NO: 67783 - DNA, 75 bp, Artificial Sequence
  Synthetic
gaagccctcttccaaggaccccctaagttcaggcctataagaattagccttgaagaaaagccggccccagatgcc

SEQ ID NO: 67784 - DNA, 75 bp, Artificial Sequence
  Synthetic
ctcagggtatgatgctagtctcagtcctgtatggtttagggcactagaaatagtcctgcgggaaattggctactc

SEQ ID NO: 67785 - DNA, 75 bp, Artificial Sequence
  Synthetic
gtattcgtccggggcaaccactgcaatcccaatcactatcactatagcccccctgaattcagagttcggaggact

SEQ ID NO: 67786 - DNA, 75 bp, Artificial Sequence
  Synthetic
ctcagcctggtgctacagggtttgagttgaccaacccgtacattctagacgctgggatcccgttgagccagttgt

SEQ ID NO: 67787 - DNA, 75 bp, Artificial Sequence
  Synthetic
gtaaggatatgtctttattctgtcaaatggtatccaccgtagacttcatcccaccaatggcttctcttgaggaga

SEQ ID NO: 67788 - DNA, 75 bp, Artificial Sequence
  Synthetic
cggagggatgccctcaggctgctcaggtacttccattttcaactcaatgattaacaacatcattatcaggacact

SEQ ID NO: 67789 - DNA, 75 bp, Artificial Sequence
  Synthetic
gttgaccaacccgtacattctagacgctgggatcccgttgagccagttgttagtgtgccctcaccagtggattaa

SEQ ID NO: 67790 - DNA, 75 bp, Artificial Sequence
  Synthetic
gcagtccattgccaccgtggttgcggttgtgtccctcgtctatgtcatttataaattgtttgctggatttcaagg

SEQ ID NO: 67791 - DNA, 75 bp, Artificial Sequence
  Synthetic
ttaaaacagcctgtgggttgtacccacccacagggcccactgggcgctagcactctgattctacggaatccttgt

SEQ ID NO: 67792 - DNA, 75 bp, Artificial Sequence
  Synthetic
acccacagggcccactgggcgctagcactctgattctacggaatccttgtgcgcctgttttatgtcccttccccc

SEQ ID NO: 67793 - DNA, 75 bp, Artificial Sequence
  Synthetic
ttgcaatttcggtttagtagtgattccagtctcaccccttgggttcctgcaaggggccacaccaacaattcccat

SEQ ID NO: 67794 - DNA, 75 bp, Artificial Sequence
  Synthetic
gagctggcgaaaacaggcaaggagtatggtttgactatgacccctgccgacaagtcaccctgcttcaatgaggtc

SEQ ID NO: 67795 - DNA, 75 bp, Artificial Sequence
  Synthetic
ccagtctcaccccttgggttcctgcaaggggccacaccaacaattcccataaccatcacagtggcccctatgaac

SEQ ID NO: 67796 - DNA, 75 bp, Artificial Sequence
  Synthetic
ggtacttccattttcaactcaatgattaacaacatcattatcaggacactcttgattaagacgtttaaggggata

SEQ ID NO: 67797 - DNA, 75 bp, Artificial Sequence
  Synthetic
atggtttgactatgacccctgccgacaagtcaccctgcttcaatgaggtcacttgggagaatgccaccttcttga

SEQ ID NO: 67798 - DNA, 75 bp, Artificial Sequence
  Synthetic
ctcaccaccgacgatggtgtatcagcccctatactgcctgggttccacccaacaccagtaatacatattcctggg

SEQ ID NO: 67799 - DNA, 75 bp, Artificial Sequence
  Synthetic
ccattcgttggaccaaggacgcgcgcaacacccaagatcacgtgcgttccctctgcttgttagcatggcataatg

SEQ ID NO: 67800 - DNA, 75 bp, Artificial Sequence
  Synthetic
cccctatactgcctgggttccacccaacaccagtaatacatattcctggggaagttagaaacctcttagagctgt

SEQ ID NO: 67801 - DNA, 75 bp, Artificial Sequence
  Synthetic
ctctgcttgttagcatggcataatggaaaggaggaatatgaaaattttgtgagcacaattagatcagttccgatt

SEQ ID NO: 67802 - DNA, 75 bp, Artificial Sequence
  Synthetic
gccaagacaggtgggaattacgattactacacggcaggtgtagtgaccttatggtatcaaaccaattacgtggtt

SEQ ID NO: 67803 - DNA, 75 bp, Artificial Sequence
  Synthetic
ccgtacaagtccaaacacagtcgggtgaattgtgcgcagcattcaaagctgatcctgggcttgatggcccatggc

SEQ ID NO: 67804 - DNA, 75 bp, Artificial Sequence
  Synthetic
ccaccagaaactcctggagaagcatatattattgcaatgggggcggcacaagacaacttcactttgaagatttgc

SEQ ID NO: 67805 - DNA, 75 bp, Artificial Sequence
  Synthetic
tgaattgtgcgcagcattcaaagctgatcctgggcttgatggcccatggcaatccactatggttgggcagctttg

SEQ ID NO: 67806 - DNA, 75 bp, Artificial Sequence
  Synthetic
aaggatactgatgaagtgacacaacaggctgtgttgcaaggtgaccctgtggaggatataatccatgacgctctg

SEQ ID NO: 67807 - DNA, 75 bp, Artificial Sequence
  Synthetic
aatgctgatagcctacactcctcctggtggctctctgcccgccaacagaatgcaggcaatgctgggcacccacgt

SEQ ID NO: 67808 - DNA, 75 bp, Artificial Sequence
  Synthetic
ggtggctctctgcccgccaacagaatgcaggcaatgctgggcacccacgtcatctgggattttggtttgcaatca

SEQ ID NO: 67809 - DNA, 75 bp, Artificial Sequence
  Synthetic
cacccggagacctcaaacacaacatacggattgtgcccaaacaatatgatgggcacttttgcagtaagagttgtt

SEQ ID NO: 67810 - DNA, 75 bp, Artificial Sequence
  Synthetic
atggggtcacaagtctcaacccaacgatcgggttcccacgaaaattcgaactcagcatcagaaggatctactata

SEQ ID NO: 67811 - DNA, 75 bp, Artificial Sequence
  Synthetic
gatcgggttcccacgaaaattcgaactcagcatcagaaggatctactataaactacaccaccatcaactattaca

SEQ ID NO: 67812 - DNA, 75 bp, Artificial Sequence
  Synthetic
tatgccactggcatagtatctctatggtaccagacaaatttcgtcgtccctataggtgcgccaactactgcttat

SEQ ID NO: 67813 - DNA, 75 bp, Artificial Sequence
  Synthetic
ggtaccagacaaatttcgtcgtccctataggtgcgccaactactgcttatatagtggttctgggtagcgctcaaa

SEQ ID NO: 67814 - DNA, 75 bp, Artificial Sequence
  Synthetic
gttttatgacgggtatcccacgtttggagaacacaaacaagagaaagatcttgaatatggagcgtgtcctaacaa

SEQ ID NO: 67815 - DNA, 75 bp, Artificial Sequence
  Synthetic
atgtcatacacgagatggctcctcccttgaaatcacccagtgctgaagcttgtggttatagtgatcgagttgccc

SEQ ID NO: 67816 - DNA, 75 bp, Artificial Sequence
  Synthetic
cgagtatgtgacacaggctgctctccactatgcaaaccagctaaagcaattagatataaacattaataagatgag

SEQ ID NO: 67817 - DNA, 75 bp, Artificial Sequence
  Synthetic
tcgacctaatcgagagtgctgtacagaataccactaaagccattaccagctcaatcgacaccaaaactggtgcta

SEQ ID NO: 67818 - DNA, 75 bp, Artificial Sequence
  Synthetic
gaataccactaaagccattaccagctcaatcgacaccaaaactggtgctaacactcaagctagccaacatcgtat

SEQ ID NO: 67819 - DNA, 75 bp, Artificial Sequence
  Synthetic
cttgaaatcacccagtgctgaagcttgtggttatagtgatcgagttgcccaactcacaattggaaactccacaat

SEQ ID NO: 67820 - DNA, 75 bp, Artificial Sequence
  Synthetic
caatccgggaactataactggatctgcggtggggtgtaatcctgacgtgttttggagcaagctgccaatcctact

SEQ ID NO: 67821 - DNA, 75 bp, Artificial Sequence
  Synthetic
agctgttgacaagcccaccagacccgatgtgtcggtaaataggttcttcacccttgatactaaatcgtgggctaa

SEQ ID NO: 67822 - DNA, 75 bp, Artificial Sequence
  Synthetic
gatgtgtcggtaaataggttcttcacccttgatactaaatcgtgggctaaagactcgaagggatggtactggaaa

SEQ ID NO: 67823 - DNA, 75 bp, Artificial Sequence
  Synthetic
agaaacaagatgtgtcgtaaacaaacacagcacagaggaaaccagcattacaaacttctactccagggcgggcct

SEQ ID NO: 67824 - DNA, 75 bp, Artificial Sequence
  Synthetic
tacagactagagtgtacatgaagcttaagcacgtaagggcctgggtcccaagaccgatcaggtcccagccatatt

SEQ ID NO: 67825 - DNA, 75 bp, Artificial Sequence
  Synthetic
cacagcacagaggaaaccagcattacaaacttctactccagggcgggcctagtgggggttgtgaacatgccagta

SEQ ID NO: 67826 - DNA, 75 bp, Artificial Sequence
  Synthetic
tgtgtgcacgtgcagtgcaatgccagcaaattccaccagggtgctctcttggttgccatactgcctgagtacgtg

SEQ ID NO: 67827 - DNA, 75 bp, Artificial Sequence
  Synthetic
gcaaattccaccagggtgctctcttggttgccatactgcctgagtacgtgctgggcaccattgccgggggcgatg

SEQ ID NO: 67828 - DNA, 75 bp, Artificial Sequence
  Synthetic
cttgagctcatgacatacatgagattctccgccgagtttacgttcgtagccagcactcctgggggagagactact

SEQ ID NO: 67829 - DNA, 75 bp, Artificial Sequence
  Synthetic
tctccgccgagtttacgttcgtagccagcactcctgggggagagactactaaccttatactgcaatacatgtatg

SEQ ID NO: 67830 - DNA, 75 bp, Artificial Sequence
  Synthetic
ttttggatgctggggtaccccttagtcaattgacggtgtgtccgcatcagtggattaacctacgaaccaacaact

SEQ ID NO: 67831 - DNA, 75 bp, Artificial Sequence
  Synthetic
tagagctttggaggtggttctccgagagatcggctactcagaggaggctgtatcactaatagaagggatcaacca

SEQ ID NO: 67832 - DNA, 75 bp, Artificial Sequence
  Synthetic
gcaagatggcggacccacccgctcaggtatcggttccattcctttctcctgcatcagcatatcagtggttctatg

SEQ ID NO: 67833 - DNA, 75 bp, Artificial Sequence
  Synthetic
ggtatcggttccattcctttctcctgcatcagcatatcagtggttctatgatggctaccccacatttgggaaaca

SEQ ID NO: 67834 - DNA, 75 bp, Artificial Sequence
  Synthetic
tcaattgacggtgtgtccgcatcagtggattaacctacgaaccaacaactgtgcgaccatcatagtaccatacat

SEQ ID NO: 67835 - DNA, 75 bp, Artificial Sequence
  Synthetic
tcctaaaccagattctagagaatcacttgcttggcagacagccacaaacccttcagtttttgtcaagttaactga

SEQ ID NO: 67836 - DNA, 75 bp, Artificial Sequence
  Synthetic
ctttaacgctggagctacatcagaaataccaataactgtcaccatcgcacccatgtgcgctgaatttgcaggttt

SEQ ID NO: 67837 - DNA, 75 bp, Artificial Sequence
  Synthetic
ataccaataactgtcaccatcgcacccatgtgcgctgaatttgcaggtttgcgacaggcaatcaaacaggggata

SEQ ID NO: 67838 - DNA, 75 bp, Artificial Sequence
  Synthetic
tgggggcaaaccgacccaatcagttaccatacgtatatacatgagattaaagcatatccgtgcatgggtgccccg

SEQ ID NO: 67839 - DNA, 75 bp, Artificial Sequence
  Synthetic
accatacgtatatacatgagattaaagcatatccgtgcatgggtgccccggccactgaggagtcagaattacact

SEQ ID NO: 67840 - DNA, 75 bp, Artificial Sequence
  Synthetic
cgttgtggtatcagacaaattttgttgtaccagatggtgcccctaccacagcaaacatcatagttttggggtccg

SEQ ID NO: 67841 - DNA, 75 bp, Artificial Sequence
  Synthetic
ggctacctctgatttaccaatccttgtgtgcctgttttaatcccttccctaattccaaacatagaagtaatgcgc

SEQ ID NO: 67842 - DNA, 75 bp, Artificial Sequence
  Synthetic
ttccaccctactccagccatacacatacctggtgaagtgcgcaatctgttggagatttgcagggtagagaccata

SEQ ID NO: 67843 - DNA, 75 bp, Artificial Sequence
  Synthetic
gacatggccaacgctgctaaggggttagagtgggtttccaataagatcagcaaatttattgattggcttaaggag

SEQ ID NO: 67844 - DNA, 75 bp, Artificial Sequence
  Synthetic
ggaaaatttggccaacaatccggagcaatttatgtggggagctacagagtggtaaacaggcatttggcaacccac

SEQ ID NO: 67845 - DNA, 75 bp, Artificial Sequence
  Synthetic
caatttatgtggggagctacagagtggtaaacaggcatttggcaacccacaatgactggaaaaacctggtgtggg

SEQ ID NO: 67846 - DNA, 75 bp, Artificial Sequence
  Synthetic
tacctggtgaagtgcgcaatctgttggagatttgcagggtagagaccatattggaggtgaacaatctacagagta

SEQ ID NO: 67847 - DNA, 75 bp, Artificial Sequence
  Synthetic
tcggaggaggctgtgtcactcatagaagggattaatcacacccaccatgtgtatcggaacaagacatactgcgtt

SEQ ID NO: 67848 - DNA, 75 bp, Artificial Sequence
  Synthetic
ttagggccgaccctggtaggaatggaccgtggcagtcgactattttaggacagttgtgtaggtactatactcaat

SEQ ID NO: 67849 - DNA, 75 bp, Artificial Sequence
  Synthetic
accgtggcagtcgactattttaggacagttgtgtaggtactatactcaatggtctggatctctggaagtcacttt

SEQ ID NO: 67850 - DNA, 75 bp, Artificial Sequence
  Synthetic
aaacgggggtgtattattgcaattcccgtagaaaacattatccagtcagtttctctaagcccagtttcgttttcg

SEQ ID NO: 67851 - DNA, 75 bp, Artificial Sequence
  Synthetic
ccgtagaaaacattatccagtcagtttctctaagcccagtttcgttttcgtggaagctagtgagtactacccggc

SEQ ID NO: 67852 - DNA, 75 bp, Artificial Sequence
  Synthetic
agatcggctcactgcaatgctgggaacccatgtgatatgggattttggcctccaatcctcagtcacgctagttat

SEQ ID NO: 67853 - DNA, 75 bp, Artificial Sequence
  Synthetic
acccatgtgatatgggattttggcctccaatcctcagtcacgctagttataccatggataagcaacacacactat

SEQ ID NO: 67854 - DNA, 75 bp, Artificial Sequence
  Synthetic
gcacggcgtggttggtatagtctccacgggcgggaatggtctagtgggttttgctgatgtgagagaccttttgtg

SEQ ID NO: 67855 - DNA, 75 bp, Artificial Sequence
  Synthetic
acgggcgggaatggtctagtgggttttgctgatgtgagagaccttttgtggctagatgaggaagccatggagcaa

SEQ ID NO: 67856 - DNA, 75 bp, Artificial Sequence
  Synthetic
gtcgtacctattggagcccccacaacagcctatattgtggccctcgcagccgctcaggacaactttaccatgaaa

SEQ ID NO: 67857 - DNA, 75 bp, Artificial Sequence
  Synthetic
cagcctatattgtggccctcgcagccgctcaggacaactttaccatgaaactgtgcaaagacactgaggatattg

SEQ ID NO: 67858 - DNA, 75 bp, Artificial Sequence
  Synthetic
gcgcttaaccactcaaattttggattggttgtgattcctattagccctttaaaatattgtaatggagctaccaca

SEQ ID NO: 67859 - DNA, 75 bp, Artificial Sequence
  Synthetic
gaggccttgaagaaccacttaatcgggtctgagggtgctgtggagaagatcctcaaaaacctggtgaagcttatt

SEQ ID NO: 67860 - DNA, 75 bp, Artificial Sequence
  Synthetic
ggtctgagggtgctgtggagaagatcctcaaaaacctggtgaagcttatttccgcacttgtcatcgtcattagga

SEQ ID NO: 67861 - DNA, 75 bp, Artificial Sequence
  Synthetic
attgtccctctacggacgctacagctgtggacaagcctactcgccctgacgtgtcagtgaataggttctacacac

SEQ ID NO: 67862 - DNA, 75 bp, Artificial Sequence
  Synthetic
accagtgagtggcttgtcgtaacgcgcaagtctgtggcggaaccgactactttgggtgtccgtgtttccttttat

SEQ ID NO: 67863 - DNA, 75 bp, Artificial Sequence
  Synthetic
cgctgacatccttacaggtagaacctaccgccgccaacaccaatgctagtgagcacagattgggcaccgggctcg

SEQ ID NO: 67864 - DNA, 75 bp, Artificial Sequence
  Synthetic
gtcatggcagtccttgggcttggattaaagccaaaacagcttctatcttaggtatccctatcgctcaaaagcaaa

SEQ ID NO: 67865 - DNA, 75 bp, Artificial Sequence
  Synthetic
tgaagtctccatccgctgaggcgtgtggttatagcgatcgcgtggcacaactcaccattggaaactccaccatca

SEQ ID NO: 67866 - DNA, 75 bp, Artificial Sequence
  Synthetic
aatcaaaaacagcatccatcctgggcattccaatggcccagaagcagggtgctacttggttgaagaagttcaacg

SEQ ID NO: 67867 - DNA, 75 bp, Artificial Sequence
  Synthetic
aatctaagattgttatcatatagctattggattggccatccggtgactaacagagatatcatatatctatttgtt

SEQ ID NO: 67868 - DNA, 75 bp, Artificial Sequence
  Synthetic
cattccaatggcccagaagcagggtgctacttggttgaagaagttcaacgacatggcaaatgctgcaaaagggct

SEQ ID NO: 67869 - DNA, 75 bp, Artificial Sequence
  Synthetic
taccgccgccaacaccaatgctagtgagcacagattgggcaccgggctcgtccccgccttgcaggctgcagagac

SEQ ID NO: 67870 - DNA, 75 bp, Artificial Sequence
  Synthetic
gaccacgattggcaactttttcagtcgagcaggactagtgagtattattaccatgcccaccacaggtacccaaaa

SEQ ID NO: 67871 - DNA, 75 bp, Artificial Sequence
  Synthetic
ttagattttgccctgtccctcctacgacgtaacgtcaggcaggtgcaaaccgaccaagggcactttaccatgctt

SEQ ID NO: 67872 - DNA, 75 bp, Artificial Sequence
  Synthetic
ggttgagtttttgaacaatttgaagcaacttcccttactggaaaaccaaatctccaacctggaacaatcagctgc

SEQ ID NO: 67873 - DNA, 75 bp, Artificial Sequence
  Synthetic
cgagcaggactagtgagtattattaccatgcccaccacaggtacccaaaacaccgatgggtatgtgaactgggat

SEQ ID NO: 67874 - DNA, 75 bp, Artificial Sequence
  Synthetic
tctccaacctggaacaatcagctgcctcgcaagaagaccttgaggcaatgtttggtaatgtgtcgtatcttgccc

SEQ ID NO: 67875 - DNA, 75 bp, Artificial Sequence
  Synthetic
gagtttttggccaaaatgcacagtttcactacttatataggtcagggttttgcatccatgtgcaatgcaacgcta

SEQ ID NO: 67876 - DNA, 75 bp, Artificial Sequence
  Synthetic
acatttgtagctgccaaaccaaacggtgagctagtaccacaattgttgcagtacatgtatgtgcctcccggagct

SEQ ID NO: 67877 - DNA, 75 bp, Artificial Sequence
  Synthetic
gtgagctagtaccacaattgttgcagtacatgtatgtgcctcccggagctccaaaacctacgtcccgggattcct

SEQ ID NO: 67878 - DNA, 75 bp, Artificial Sequence
  Synthetic
tcgctatccttccagagtatgttatagggacagtagcaggcggtacaggaacagaggatagtcaccctccttaca

SEQ ID NO: 67879 - DNA, 75 bp, Artificial Sequence
  Synthetic
ttgaaccattgcaattttgggttgttggtagtacccatcagcccattggattttgaccaaggggcaactccagtt

SEQ ID NO: 67880 - DNA, 75 bp, Artificial Sequence
  Synthetic
tcatgtctcccgccagcgcctaccagtggttttacgatggctatccaacgtttggagcccatccacaatcgaatg

SEQ ID NO: 67881 - DNA, 75 bp, Artificial Sequence
  Synthetic
gtggttttacgatggctatccaacgtttggagcccatccacaatcgaatgacgcagactatggccaatgtccaaa

SEQ ID NO: 67882 - DNA, 75 bp, Artificial Sequence
  Synthetic
atccagatcactttgacgggtacaaacagcaagttgtcactgtcatggatgatctctgccaaaatccagatggga

SEQ ID NO: 67883 - DNA, 75 bp, Artificial Sequence
  Synthetic
acagcaagttgtcactgtcatggatgatctctgccaaaatccagatgggaaagacatgtctctgttctgtcaaat

SEQ ID NO: 67884 - DNA, 75 bp, Artificial Sequence
  Synthetic
actcccagcaaaattatgggctaacaattctaaaggatggtattggaaattcccagatgttctctgtgaactggg

SEQ ID NO: 67885 - DNA, 75 bp, Artificial Sequence
  Synthetic
tatgagaatcaagcatgtcagggcctggataccccggccactcagaaaccaaccgtacctttttaagacaaatcc

SEQ ID NO: 67886 - DNA, 75 bp, Artificial Sequence
  Synthetic
tggataccccggccactcagaaaccaaccgtacctttttaagacaaatccaaattataaaggcaacgacatcaaa

SEQ ID NO: 67887 - DNA, 75 bp, Artificial Sequence
  Synthetic
tatagcatcaactaatgccagcaacatcatagttccaacagtgtcagactccgacgccatccgtaggcgattctt

SEQ ID NO: 67888 - DNA, 75 bp, Artificial Sequence
  Synthetic
atcatagttccaacagtgtcagactccgacgccatccgtaggcgattctttatggactgtgacatcgaagtgact

SEQ ID NO: 67889 - DNA, 75 bp, Artificial Sequence
  Synthetic
ctgcagaaacgggagcaagttctaatgctagtgatgagaaccttattgagactcgctgtgtgatgaatcgaaacg

SEQ ID NO: 67890 - DNA, 75 bp, Artificial Sequence
  Synthetic
ttgctaggtcaagtgctgaaactaatccagctactgccccccatccaccatatagtgcaacacaacctggagagg

SEQ ID NO: 67891 - DNA, 75 bp, Artificial Sequence
  Synthetic
aactatagagtggtcaatcgtcacttggccacgcacaatgactgggccaatttagtatgggaagacagctcaagg

SEQ ID NO: 67892 - DNA, 75 bp, Artificial Sequence
  Synthetic
tggccacgcacaatgactgggccaatttagtatgggaagacagctcaagggatcttttagtctcctccaccactg

SEQ ID NO: 67893 - DNA, 75 bp, Artificial Sequence
  Synthetic
aactttaaaagatgtagtccactagtatgtgggaaagctatccaattgagagataggaaatccaaagttcggtat

SEQ ID NO: 67894 - DNA, 75 bp, Artificial Sequence
  Synthetic
tatgtgggaaagctatccaattgagagataggaaatccaaagttcggtatagtgtggacacagtaatttcagagc

SEQ ID NO: 67895 - DNA, 75 bp, Artificial Sequence
  Synthetic
tggggaacacactacacgagcctgatgagtacatcagagaggcagccctccactacgcaaatcagttgaaacagc

SEQ ID NO: 67896 - DNA, 75 bp, Artificial Sequence
  Synthetic
acccagtcagtttctcaaagcccagtctaatctttgtggaagctagtgagtactacccagccaggtaccaatcgc

SEQ ID NO: 67897 - DNA, 75 bp, Artificial Sequence
  Synthetic
tctaatctttgtggaagctagtgagtactacccagccaggtaccaatcgcacctcatgctcgctgtagggcattc

SEQ ID NO: 67898 - DNA, 75 bp, Artificial Sequence
  Synthetic
aaatcataccaatggcagactgctaccaacccgtcggtattcgcaaaattgagtgatccacccccccaggtgtct

SEQ ID NO: 67899 - DNA, 75 bp, Artificial Sequence
  Synthetic
gacctattagaattagcctcgaggaaaagcccgcacctgatgccattagtgacttacttgctagtgttgatagtg

SEQ ID NO: 67900 - DNA, 75 bp, Artificial Sequence
  Synthetic
accgatgtgttcagagttttctgggctcagacaggctgtcacacaaggactaccagcggagctaaaaccaggcac

SEQ ID NO: 67901 - DNA, 75 bp, Artificial Sequence
  Synthetic
aaagcccgcacctgatgccattagtgacttacttgctagtgttgatagtgaggaagttcggcaatattgcaggga

SEQ ID NO: 67902 - DNA, 75 bp, Artificial Sequence
  Synthetic
ctcagacaggctgtcacacaaggactaccagcggagctaaaaccaggcactaaccaattcttgactacagatgat

SEQ ID NO: 67903 - DNA, 75 bp, Artificial Sequence
  Synthetic
gcttgttggttttgctgatgttagagacctcctgtggctggatgaagaggctatggaacaaggagtgtctgatta

SEQ ID NO: 67904 - DNA, 75 bp, Artificial Sequence
  Synthetic
gacctcctgtggctggatgaagaggctatggaacaaggagtgtctgattacatcaaagggcttggtgatgcgttt

SEQ ID NO: 67905 - DNA, 75 bp, Artificial Sequence
  Synthetic
aattgctacggttgtggcagtagtgtctcttgtctatgttatctacaagctctttgcaggcttccagggtgctta

SEQ ID NO: 67906 - DNA, 75 bp, Artificial Sequence
  Synthetic
ttagatttacagttgaaaactgaaccccaccagaaatctggtcgtgttaatgactggtgggggtaaatttgttat

SEQ ID NO: 67907 - DNA, 75 bp, Artificial Sequence
  Synthetic
ttagaaatctgccaagttgagtctatactagaggttaacaaccttaatacccaggccactgctgctcagttgatg

SEQ ID NO: 67908 - DNA, 75 bp, Artificial Sequence
  Synthetic
tctcttgtctatgttatctacaagctctttgcaggcttccagggtgcttattctggcgcacccaagcaggtgttg

SEQ ID NO: 67909 - DNA, 75 bp, Artificial Sequence
  Synthetic
ctcccaatcctgctcccaggctcgctatttgcctttgactattcaggctatgatgctagtcttagccccgtctgg

SEQ ID NO: 67910 - DNA, 75 bp, Artificial Sequence
  Synthetic
gttgagaagattcttaaaaacttaattaagctcatttctgcactagtgattgtgatcaggagtgattacgatatg

SEQ ID NO: 67911 - DNA, 75 bp, Artificial Sequence
  Synthetic
ttaagctcatttctgcactagtgattgtgatcaggagtgattacgatatggtcactctcacagcaactctggctc

SEQ ID NO: 67912 - DNA, 75 bp, Artificial Sequence
  Synthetic
atcaaacaagctcagactgatcaaggtcatttcactatgttgggtattcgcgatcgactggccatcttgccgcgt

SEQ ID NO: 67913 - DNA, 75 bp, Artificial Sequence
  Synthetic
tggttggtcaaatctgtagatactacacccaatggtcagggtcattagaggtgacattcatgttcactgggagtt

SEQ ID NO: 67914 - DNA, 75 bp, Artificial Sequence
  Synthetic
gtcatttcactatgttgggtattcgcgatcgactggccatcttgccgcgtcatgcacaaccaggaaagaccattt

SEQ ID NO: 67915 - DNA, 75 bp, Artificial Sequence
  Synthetic
accacccccatgcagcgcttgtgctttccagtgtcggtgcagagcaaaacgggcgaattatgtgctgcctttaga

SEQ ID NO: 67916 - DNA, 75 bp, Artificial Sequence
  Synthetic
agtcaacaacctgaagaccaatgagaccacccccatgcagcgcttgtgctttccagtgtcggtgcagagcaaaac

SEQ ID NO: 67917 - DNA, 75 bp, Artificial Sequence
  Synthetic
agaaacagagcgcatcatggctaaaaaaattcaacgacatggctaatgctgccaaagggctagaatggatatcta

SEQ ID NO: 67918 - DNA, 75 bp, Artificial Sequence
  Synthetic
aaaattcaacgacatggctaatgctgccaaagggctagaatggatatctaacaaaattagtaagttcattgattg

SEQ ID NO: 67919 - DNA, 75 bp, Artificial Sequence
  Synthetic
ccttagtcaccttggataccaatgagaaatttagagatatcactaagttcatcccagaggtaataagcggagcta

SEQ ID NO: 67920 - DNA, 75 bp, Artificial Sequence
  Synthetic
ctttgggctacagtcttcagttacattggtcataccttggattagtaatacacattatagagccatggggacaaa

SEQ ID NO: 67921 - DNA, 75 bp, Artificial Sequence
  Synthetic
gaaatttagagatatcactaagttcatcccagaggtaataagcggagctagtgatgcaaccttagtgatcaatac

SEQ ID NO: 67922 - DNA, 75 bp, Artificial Sequence
  Synthetic
cacccaatggtcagggtcattagaggtgacattcatgttcactgggagttttatggctactggaaagatgctcat

SEQ ID NO: 67923 - DNA, 75 bp, Artificial Sequence
  Synthetic
ttggtcataccttggattagtaatacacattatagagccatggggacaaatgattactttgactactattcagca

SEQ ID NO: 67924 - DNA, 75 bp, Artificial Sequence
  Synthetic
ttccagtgtcggtgcagagcaaaacgggcgaattatgtgctgcctttagagcagaccctggaagagatggtccgt

SEQ ID NO: 67925 - DNA, 75 bp, Artificial Sequence
  Synthetic
gttttgacgctgagttcacctttgtagccacaaccccaaatggagcatcgaaggatctggttctacaatacatgt

SEQ ID NO: 67926 - DNA, 75 bp, Artificial Sequence
  Synthetic
tacccacagaaccatgatgtacaacttccccacaaaagcgggccagtgtggtggtgtggttacctcagtagggaa

SEQ ID NO: 67927 - DNA, 75 bp, Artificial Sequence
  Synthetic
ttggcagctgcccagaagaatttcactctaagactaccaaaggacaccggggacatctcacaaacagccatcctg

SEQ ID NO: 67928 - DNA, 75 bp, Artificial Sequence
  Synthetic
ttccccacaaaagcgggccagtgtggtggtgtggttacctcagtagggaaaattattggaatccacattggtggg

SEQ ID NO: 67929 - DNA, 75 bp, Artificial Sequence
  Synthetic
ctctaagactaccaaaggacaccggggacatctcacaaacagccatcctgcaaggggacccaatagaagacacca

SEQ ID NO: 67930 - DNA, 75 bp, Artificial Sequence
  Synthetic
aagcccaataaggagactggcaggttgaacatcaatgggcccacccgcacaaaacttgaacccagtgtgttctat

SEQ ID NO: 67931 - DNA, 75 bp, Artificial Sequence
  Synthetic
ctagcacacaccaaattggaacaggggaagtcccagcactacaagctgctgaaactggtgccacctccaatactt

SEQ ID NO: 67932 - DNA, 75 bp, Artificial Sequence
  Synthetic
tgaacatcaatgggcccacccgcacaaaacttgaacccagtgtgttctatgatgtatttgagggtaacaaggagc

SEQ ID NO: 67933 - DNA, 75 bp, Artificial Sequence
  Synthetic
ccacctatgtgaaagatgagcttagatccttagataagattaagaaggggaaatcccgtttgattgaagccagca

SEQ ID NO: 67934 - DNA, 75 bp, Artificial Sequence
  Synthetic
acttcccccagacccagatcactttgatgggtacaaacaacaagtagttacagttatggatgatttgtgtcaaaa

SEQ ID NO: 67935 - DNA, 75 bp, Artificial Sequence
  Synthetic
ccctcacagcaaccttagcactcatagggtgtcatggcagtccctgggcgtggatcaaggctaagacagcatcca

SEQ ID NO: 67936 - DNA, 75 bp, Artificial Sequence
  Synthetic
caacatgatgggcactttctcggtgcggaccgtggggtcttcaaagtccaagtaccctttggttgtcagaatata

SEQ ID NO: 67937 - DNA, 75 bp, Artificial Sequence
  Synthetic
atgtactgcacgaacctgatgagtacgtgacccaggcagcactacattatgctaatcaattgaagcagctggaca

SEQ ID NO: 67938 - DNA, 75 bp, Artificial Sequence
  Synthetic
gttagatctgctcacctcagataagaccaccatgggctttactacttgggacatagatatcatgggctttgtaca

SEQ ID NO: 67939 - DNA, 75 bp, Artificial Sequence
  Synthetic
cgtgacccaggcagcactacattatgctaatcaattgaagcagctggacatcaataccaacaagatgagcatgga

SEQ ID NO: 67940 - DNA, 75 bp, Artificial Sequence
  Synthetic
tccaaattcgtcattgcgtccaccaatgccagcaacatcatagtgccaacggtgtccgactctgatgccatccgc

SEQ ID NO: 67941 - DNA, 75 bp, Artificial Sequence
  Synthetic
cctaaaacaactgccgttgttggaaaaccaaatctcaaacttggaacagtccgccgcttcacaagaagaccttga

SEQ ID NO: 67942 - DNA, 75 bp, Artificial Sequence
  Synthetic
accaccatgggctttactacttgggacatagatatcatgggctttgtacaacaacgtagaaagctagagatgttc

SEQ ID NO: 67943 - DNA, 75 bp, Artificial Sequence
  Synthetic
gggtatcaagaagagggacatccttgatccaactactagagatgtttctaaaatgaagctttacctggacaaata

SEQ ID NO: 67944 - DNA, 75 bp, Artificial Sequence
  Synthetic
ctgcaagcagccctgctacgaagcctaatggacaagggttgtacccagattttgctcatactaacccaggtaaaa

SEQ ID NO: 67945 - DNA, 75 bp, Artificial Sequence
  Synthetic
cgggccgccagattatgttctgaaaacaacactgcaaacttcaagcgctgcagcccactggtgtgtgggaaagcc

SEQ ID NO: 67946 - DNA, 75 bp, Artificial Sequence
  Synthetic
caatatatgtttgtcccacctggtgctccaaaacccactcagagagactcatttgaatggcagacagccacaaat

SEQ ID NO: 67947 - DNA, 75 bp, Artificial Sequence
  Synthetic
gatccaactactagagatgtttctaaaatgaagctttacctggacaaatatggcctagatctaccttactccact

SEQ ID NO: 67948 - DNA, 75 bp, Artificial Sequence
  Synthetic
attcaactcagagataggaaatccaaggtcagatacagtgtggacacggtggtctccgaactcattagagagtac

SEQ ID NO: 67949 - DNA, 75 bp, Artificial Sequence
  Synthetic
ctccaaaacccactcagagagactcatttgaatggcagacagccacaaatccatcaatatttgtgaagatatcag

SEQ ID NO: 67950 - DNA, 75 bp, Artificial Sequence
  Synthetic
aatgattctgtttaccttagaatgacttttggccatctgtatgaggtgtttcatgccaacccagggacggtaacc

SEQ ID NO: 67951 - DNA, 75 bp, Artificial Sequence
  Synthetic
ccttcggtaatcacccaaccaatcaagatttcaggtacggcatttgccccaataatctcatgggaacgttctgcg

SEQ ID NO: 67952 - DNA, 75 bp, Artificial Sequence
  Synthetic
cttttggccatctgtatgaggtgtttcatgccaacccagggacggtaaccggttcagcagtaggttgtaatccag

SEQ ID NO: 67953 - DNA, 75 bp, Artificial Sequence
  Synthetic
gatggcaaggatatgtcactcttttgccagatggtatctactgtagattttatcccaccaatggcttctttagaa

SEQ ID NO: 67954 - DNA, 75 bp, Artificial Sequence
  Synthetic
agatttcaggtacggcatttgccccaataatctcatgggaacgttctgcgtgagggttctgggatcagagaagct

SEQ ID NO: 67955 - DNA, 75 bp, Artificial Sequence
  Synthetic
atgccattagtgatctcctcgctagtgtggacagtgaggaagtgcgtcaatactgcagagaccaaggctggatca

SEQ ID NO: 67956 - DNA, 75 bp, Artificial Sequence
  Synthetic
gtcttagtcctgtgtggtttagagctttagaaatagtcctgcgggaggtcggttactcagaggaagcagtgtctc

SEQ ID NO: 67957 - DNA, 75 bp, Artificial Sequence
  Synthetic
gcagaaatacatgttaaagaattacccgaactttgacggggcaaatattaccccaacaactgcaaatagagcaca

SEQ ID NO: 67958 - DNA, 75 bp, Artificial Sequence
  Synthetic
tttagaaatagtcctgcgggaggtcggttactcagaggaagcagtgtctcttatagagggaatcaaccacaccca

SEQ ID NO: 67959 - DNA, 75 bp, Artificial Sequence
  Synthetic
ccgaactttgacggggcaaatattaccccaacaactgcaaatagagcacagattacaacagctggtgcatttggt

SEQ ID NO: 67960 - DNA, 75 bp, Artificial Sequence
  Synthetic
tagcagttgtttcactggtgtatgttatctacaaattgtttgcagggttccaaggtgcatactctggtgccccta

SEQ ID NO: 67961 - DNA, 75 bp, Artificial Sequence
  Synthetic
tatctacaaattgtttgcagggttccaaggtgcatactctggtgcccctaagcaaacactcaagaaacctatact

SEQ ID NO: 67962 - DNA, 75 bp, Artificial Sequence
  Synthetic
gattatggtcaatgcccgaataatatgatgggcacttttagcattaggacagtggggactgaaaagtcaccacac

SEQ ID NO: 67963 - DNA, 75 bp, Artificial Sequence
  Synthetic
ttcaatgatcaataatataattattagaaccctcttgatcaagacgtttaaggggatagaccttgatgagttgaa

SEQ ID NO: 67964 - DNA, 75 bp, Artificial Sequence
  Synthetic
aatctagtctgggaatcttatgaaagagacctcttagtttccaccactacagcccagggatgtgatacaattgct

SEQ ID NO: 67965 - DNA, 75 bp, Artificial Sequence
  Synthetic
ctacgggaaattgggtatacagaggaggccgtgtctctaatagaaggaatcaaccacacccaccacgtataccgg

SEQ ID NO: 67966 - DNA, 75 bp, Artificial Sequence
  Synthetic
agaaccctcttgatcaagacgtttaaggggatagaccttgatgagttgaatatggtggcatacggagatgatgta

SEQ ID NO: 67967 - DNA, 75 bp, Artificial Sequence
  Synthetic
gacagaccaaggccacttcactatgctaggtgttagagatcgcttggctgtcctcccgcgacactcgcagcctgg

SEQ ID NO: 67968 - DNA, 75 bp, Artificial Sequence
  Synthetic
gagacctcttagtttccaccactacagcccagggatgtgatacaattgctagatgtaagtgtaggcatggagtgt

SEQ ID NO: 67969 - DNA, 75 bp, Artificial Sequence
  Synthetic
tgagaagatcctaaagaaccttatcaagctgatttcagcgctagtgattgtgatcaggagcgattatgatatggt

SEQ ID NO: 67970 - DNA, 75 bp, Artificial Sequence
  Synthetic
ccagctgataaatcaccctgtttcaatgaagttacctgggaaaatgccaccttcctgaagagggggttccttcct

SEQ ID NO: 67971 - DNA, 75 bp, Artificial Sequence
  Synthetic
acctggtagtgctcagcccgctacaagggaagcagcaatgcttgggacgcatatagtgtgggattttggtttgca

SEQ ID NO: 67972 - DNA, 75 bp, Artificial Sequence
  Synthetic
agttttaccctgctagataccaatcacatgtaatatcttcagccggcatcgcagtgccgggtgattgtggcggta

SEQ ID NO: 67973 - DNA, 75 bp, Artificial Sequence
  Synthetic
gaagacaatatgggtagaacacaagcttataaacatcttagatgctgttgagttggtggatgaacaaggggtcaa

SEQ ID NO: 67974 - DNA, 75 bp, Artificial Sequence
  Synthetic
atgaagttacctgggaaaatgccaccttcctgaagagggggttccttcctgatcatcagttccctttcctcatcc

SEQ ID NO: 67975 - DNA, 75 bp, Artificial Sequence
  Synthetic
gagatctcttttggttggatgatgaagttatggagcaaggtgtgactgactacattaagggacttggtgatgcct

SEQ ID NO: 67976 - DNA, 75 bp, Artificial Sequence
  Synthetic
tacgctctctttgtctgttggcatggcataatgggaaggacgagtacgaaagatttgtaagcacaattagatcag

SEQ ID NO: 67977 - DNA, 75 bp, Artificial Sequence
  Synthetic
caaggggttagagtggatatccaacaaaattagcaagtttattgactggctcagggagaagattgtaccagcggc

SEQ ID NO: 67978 - DNA, 75 bp, Artificial Sequence
  Synthetic
tagcgctgccagtgatgccaccctagtgatcaacacagagcacatgccctccatgttcgtgccagtgggtgacgt

SEQ ID NO: 67979 - DNA, 75 bp, Artificial Sequence
  Synthetic
gagaatgaacaattacatgcagttcaagagcaaacaccgtattgaacctgtatgtcttatcattagaggctcacc

SEQ ID NO: 67980 - DNA, 75 bp, Artificial Sequence
  Synthetic
tggacaatgtggtggagtggtgacatctgttggaaaggttatcggcatacatattggtggcaatggcaggcaggg

SEQ ID NO: 67981 - DNA, 75 bp, Artificial Sequence
  Synthetic
aattggcttgaattattttaaacctacagctttgagctgaaccccaccagaaatctggtcgtgttaatgactggt

SEQ ID NO: 67982 - DNA, 75 bp, Artificial Sequence
  Synthetic
atagttgttaggagtgattatgacctggttactttgactgcaacccttgctttgattgggtgccacggaagcccc

SEQ ID NO: 67983 - DNA, 75 bp, Artificial Sequence
  Synthetic
tctgttggaaaggttatcggcatacatattggtggcaatggcaggcagggcttttgtgcaggactcaagaggagt

SEQ ID NO: 67984 - DNA, 75 bp, Artificial Sequence
  Synthetic
taattggctcagaaggagctgttgagaagatcttgaagaacttggtgaaactaatctcagctttagtcatagtcg

SEQ ID NO: 67985 - DNA, 75 bp, Artificial Sequence
  Synthetic
ccgactcgcactaagctcgaacccagtgtgttccatgatgtctttgaggggaacaaagaaccagcagtcttgcat

SEQ ID NO: 67986 - DNA, 75 bp, Artificial Sequence
  Synthetic
gtgtgttccatgatgtctttgaggggaacaaagaaccagcagtcttgcatagcagagacccacgccttgaagtgg

SEQ ID NO: 67987 - DNA, 75 bp, Artificial Sequence
  Synthetic
ccctccactatgcaaatcagttgaagcaactggacatcaacacttctcaaatgagtatggaggaagcttgctatg

SEQ ID NO: 67988 - DNA, 75 bp, Artificial Sequence
  Synthetic
gcaactggacatcaacacttctcaaatgagtatggaggaagcttgctatggtactgagaaccttgaggccattga

SEQ ID NO: 67989 - DNA, 75 bp, Artificial Sequence
  Synthetic
tcaacaatgtgcccacgaatgccactagcttaatggagaggctgcgctttccggtctcagcacaagcagggaaag

SEQ ID NO: 67990 - DNA, 75 bp, Artificial Sequence
  Synthetic
agatgtgagtaagatgaaattctatatggacaagtatggccttgaccttccttactctacctatgtcaaggatga

SEQ ID NO: 67991 - DNA, 75 bp, Artificial Sequence
  Synthetic
tacagtaatggatgacctttgccaaaacccagatgggaaagatatgtcactcttttgccagatggtttctacagt

SEQ ID NO: 67992 - DNA, 75 bp, Artificial Sequence
  Synthetic
cagacccagaccactttgacgggtataaacaacagatcgtcactgttatggacgacctatgccaaaacccagacg

SEQ ID NO: 67993 - DNA, 75 bp, Artificial Sequence
  Synthetic
tacgagactttccacgcaaatccaggaaccataactggctcagctgtgggatgcaacccggatacattctggagt

SEQ ID NO: 67994 - DNA, 75 bp, Artificial Sequence
  Synthetic
caaacaccgtattgaacctgtatgtttaatcattagaggctctccaggaacaggtaagtcacttgctacgggcat

SEQ ID NO: 67995 - DNA, 75 bp, Artificial Sequence
  Synthetic
ctagtagtctaaatgactcagtgtacctcagaatggcctttggtcacttgtacgagactttccacgcaaatccag

SEQ ID NO: 67996 - DNA, 75 bp, Artificial Sequence
  Synthetic
cactctttgcatttgattactcaggctatgatgctagtctcagtccagtctggtttagagcactggagctggtcc

SEQ ID NO: 67997 - DNA, 75 bp, Artificial Sequence
  Synthetic
caattcatccaacattatagtcccaactgtctcagatagtgatgccattagaagaaggttctacatggattgtga

SEQ ID NO: 67998 - DNA, 75 bp, Artificial Sequence
  Synthetic
ggaaatcccgcttaattgaagctagcagtttgaatgactcagtttacctcagaatggcctttggacatctctatg

SEQ ID NO: 67999 - DNA, 75 bp, Artificial Sequence
  Synthetic
agtttacacgtcctgtcttggataccatcagggaagttgccgctccgttacaatccccctcagttgaggcgtgcg

SEQ ID NO: 68000 - DNA, 75 bp, Artificial Sequence
  Synthetic
aaacaacaccgctaatttcaaaaagtgtagtcctctcgtttgtggtaaagccattcaacttagggacaggaaatc

SEQ ID NO: 68001 - DNA, 75 bp, Artificial Sequence
  Synthetic
cccagtcagtttctcaaaacccagtttgatctttgtagaggccagtgagtattacccagccaggtatcagtcaca

SEQ ID NO: 68002 - DNA, 75 bp, Artificial Sequence
  Synthetic
aatgccctcaggctgttcaggaacatccattttcaactcaatgatcaacaacatcataattaggacattgctcat

SEQ ID NO: 68003 - DNA, 75 bp, Artificial Sequence
  Synthetic
gactgtgggtaactcaaccatcaccacccaagaggcagctaatatagtgttgagctatggagagtggccagaata

SEQ ID NO: 68004 - DNA, 75 bp, Artificial Sequence
  Synthetic
tttcccaatcgattgcctggaattggcaagaacaggcaaagagtatggtttgactatgactcctgcagacaaatc

SEQ ID NO: 68005 - DNA, 75 bp, Artificial Sequence
  Synthetic
caagtgctcaagaaacctgttctccgcacggcgacagtgcagggtccgagtcttgactttgctctctccttgctg

SEQ ID NO: 68006 - DNA, 75 bp, Artificial Sequence
  Synthetic
gtttcactacttatatagatcagggttttgcatccatgtgcagtgtaacgctagcaagttccaccaaggagcgct

SEQ ID NO: 68007 - DNA, 75 bp, Artificial Sequence
  Synthetic
agaaggaatatcaggcaagttcaaacagaccaagggcatttcactatgctaggtgtcagagaccgcttggccgtt

SEQ ID NO: 68008 - DNA, 75 bp, Artificial Sequence
  Synthetic
cactagtgtgtggcaaggccattcaattaagggataggaagtctaaagtgagatatagtattgacactgtagtgt

SEQ ID NO: 68009 - DNA, 75 bp, Artificial Sequence
  Synthetic
gcaagaacaggcaaagagtatggtttgactatgactcctgcagacaaatctccttgcttcaatgaggtaaattgg

SEQ ID NO: 68010 - DNA, 75 bp, Artificial Sequence
  Synthetic
tagtggcgctagtgatgcaactttagtgatcaatacagaacatatgccatcaatgtttgtcccagtgggggacgt

SEQ ID NO: 68011 - DNA, 75 bp, Artificial Sequence
  Synthetic
atgaaggagattcacgaatctattcgatggaccaaggacgcacgaaacactcaagatcacgtacgatccctgtgt

SEQ ID NO: 68012 - DNA, 75 bp, Artificial Sequence
  Synthetic
gatggaccaaggacgcacgaaacactcaagatcacgtacgatccctgtgtcttttggcgtggcacaatggtaagc

SEQ ID NO: 68013 - DNA, 75 bp, Artificial Sequence
  Synthetic
agtggaaagccaacgcacagaaccatgatgtacaattttcccacaagagcaggacaatgtggaggtgtagtcaca

SEQ ID NO: 68014 - DNA, 75 bp, Artificial Sequence
  Synthetic
gtatgggaaagtagctcacgagatcttctggtgtcctccaccactgctcaaggatgtgataccattgcccgatgt

SEQ ID NO: 68015 - DNA, 75 bp, Artificial Sequence
  Synthetic
gattcaatttggattgagcacaaacagattaagattctggatgctgtcgagttggtggacgaacaacaggtcaat

SEQ ID NO: 68016 - DNA, 75 bp, Artificial Sequence
  Synthetic
agattaagattctggatgctgtcgagttggtggacgaacaacaggtcaatcttgaactcacattgatcacccttg

SEQ ID NO: 68017 - DNA, 75 bp, Artificial Sequence
  Synthetic
cttcgcaagtgaacaaggtgagatccaatgggtgaaatctaacaaggaaactggtagactgaacatcaatggacc

SEQ ID NO: 68018 - DNA, 75 bp, Artificial Sequence
  Synthetic
acaattggacataaacactagcaagatgagcatggaggaagcgtgctatggcactgagaacctggaagcaataga

SEQ ID NO: 68019 - DNA, 75 bp, Artificial Sequence
  Synthetic
gcactgagaacctggaagcaatagacctctgtactagtgccggatatccatacagcgcccttggaatcaagaaaa

SEQ ID NO: 68020 - DNA, 75 bp, Artificial Sequence
  Synthetic
agtagatcctgggcgcaatggcccgtggcaatccacaatggtcggtcagatctgtaggtattacactcaatggtc

SEQ ID NO: 68021 - DNA, 75 bp, Artificial Sequence
  Synthetic
taagcccacacaccgaaccatgatgtacaatttccccacaaaggcaggacagtgtggaggtgtggtcacctcagt

SEQ ID NO: 68022 - DNA, 75 bp, Artificial Sequence
  Synthetic
tggattagtaacacccattttagagcagttaagactggaggggtatacgactactacgcaaccgggatcgtcacc

SEQ ID NO: 68023 - DNA, 75 bp, Artificial Sequence
  Synthetic
tgccaccagatacccccactgaggctaacattatagctcttggagcagcacagaaaaactttaccctaaagttgt

SEQ ID NO: 68024 - DNA, 75 bp, Artificial Sequence
  Synthetic
catggaggaagcatgctacggcactgagtatctagaggccatagacttgcacaccagtgctgggtacccctatag

SEQ ID NO: 68025 - DNA, 75 bp, Artificial Sequence
  Synthetic
accaattctgctccctggttctctctttgcttttgactattcaggctatgatgctagcctcagtccagtttggtt

SEQ ID NO: 68026 - DNA, 75 bp, Artificial Sequence
  Synthetic
gccaagactggcagagagtatggtttaactatgacacctgcagacaaatcaccctgttttaatgaagtgacatgg

SEQ ID NO: 68027 - DNA, 75 bp, Artificial Sequence
  Synthetic
ctcgctgtgtgatgaatcgaaacggggtcaatgaggcgagtgtggaacacttttactctcgtgcagggctggtag

SEQ ID NO: 68028 - DNA, 75 bp, Artificial Sequence
  Synthetic
cgccctgggtgtcaagaaaagagacatacttgacccaatcactagagatactaccaaaatgaaattctacatgga

SEQ ID NO: 68029 - DNA, 75 bp, Artificial Sequence
  Synthetic
tgcaacagcggcgcaaactagagctgtcaacatacatgcgctttgatgccgagttcacttttgtgtccaacctca

SEQ ID NO: 68030 - DNA, 75 bp, Artificial Sequence
  Synthetic
actggcttggcacaatggcaaggatgaatacgagaaatttgtgagtacaattagatcagttccagttggaaaggc

SEQ ID NO: 68031 - DNA, 75 bp, Artificial Sequence
  Synthetic
ctgcaactttggtctactggtcatcccggtggtaccattggatttcaacacaggcgctacatctgaaattcccat

SEQ ID NO: 68032 - DNA, 75 bp, Artificial Sequence
  Synthetic
ttatcagtggttttatgatggttaccctacatttggtgagcacaaacaagctaccaatttgcaatatgggcagtg

SEQ ID NO: 68033 - DNA, 75 bp, Artificial Sequence
  Synthetic
tgattcaccccaccatgccaatgaaggagatccatgaatccattcggtggactaaggatgcacgtaacactcaag

SEQ ID NO: 68034 - DNA, 75 bp, Artificial Sequence
  Synthetic
gcgcctgttttgacttcccttccccgaagtaacttagaagctgtaaatcaacgatcaatagtaggtgtgacacac

SEQ ID NO: 68035 - DNA, 75 bp, Artificial Sequence
  Synthetic
tacatcgtggctttggcagcagctcaggacaacttcactatgaaactatgcaaggatacggaggacattgagcaa

SEQ ID NO: 68036 - DNA, 75 bp, Artificial Sequence
  Synthetic
ttagggataggaagtctaaagttagatacagtgtggatacggtagtttcagaacttattagggagtacagcaaca

SEQ ID NO: 68037 - DNA, 75 bp, Artificial Sequence
  Synthetic
cacactgattctgcgggatctttgtgcgcctgttttataaccctttccctaagcagcaacttagaagctttgtac

SEQ ID NO: 68038 - DNA, 75 bp, Artificial Sequence
  Synthetic
gttagtctcttccaccactgcccaggggtgcgacaccatcgctaggtgcaattgtcaaaccggagtgtactattg

SEQ ID NO: 68039 - DNA, 75 bp, Artificial Sequence
  Synthetic
cattgagactagatgtgtgttgaatcatcactccacgcaggagacagccattgggaatttctttagccgtgccgg

SEQ ID NO: 68040 - DNA, 75 bp, Artificial Sequence
  Synthetic
accctcaacacaaccaaatatgggctcacaggtgtccacacaacgctccggttcgcatgaaaactctaactcagc

SEQ ID NO: 68041 - DNA, 75 bp, Artificial Sequence
  Synthetic
ctattggcaactctaccatcactacacaagaagcagcaaacatcatagttggctatggtgagtggccttcctact

SEQ ID NO: 68042 - DNA, 75 bp, Artificial Sequence
  Synthetic
acaagaagcagcaaacatcatagttggctatggtgagtggccttcctactgctcggattctgacgctacagcggt

SEQ ID NO: 68043 - DNA, 75 bp, Artificial Sequence
  Synthetic
cagaaaagtatcactctagtgtgtaatcacttccaccagaccctgaccattttgaagggtacaaacagcaagtgg

SEQ ID NO: 68044 - DNA, 75 bp, Artificial Sequence
  Synthetic
cagaaaagtatcactctagtgtgtaatcacttccaccagaccctgaccattttgatgggtacaaacagcaagtgg

SEQ ID NO: 68045 - DNA, 75 bp, Artificial Sequence
  Synthetic
cagaaaagtatcactctagtgtgtaatcacttccaccagaccctgaccattttgacgggtacaaacagcaagtgg

SEQ ID NO: 68046 - DNA, 75 bp, Artificial Sequence
  Synthetic
cagaaaagtatcactctagtgtgtaatcacttccaccagaccctgaccattttgaggggtacaaacagcaagtgg

SEQ ID NO: 68047 - DNA, 75 bp, Artificial Sequence
  Synthetic
cagaaaagtatcactctagtgtgtattcacttccaccagaccctgaccattttgaagggtacaaacagcaagtgg

SEQ ID NO: 68048 - DNA, 75 bp, Artificial Sequence
  Synthetic
cagaaaagtatcactctagtgtgtattcacttccaccagaccctgaccattttgatgggtacaaacagcaagtgg

SEQ ID NO: 68049 - DNA, 75 bp, Artificial Sequence
  Synthetic
cagaaaagtatcactctagtgtgtattcacttccaccagaccctgaccattttgacgggtacaaacagcaagtgg

SEQ ID NO: 68050 - DNA, 75 bp, Artificial Sequence
  Synthetic
cagaaaagtatcactctagtgtgtattcacttccaccagaccctgaccattttgaggggtacaaacagcaagtgg

SEQ ID NO: 68051 - DNA, 75 bp, Artificial Sequence
  Synthetic
cagaaaagtatcactctagtgtgtactcacttccaccagaccctgaccattttgaagggtacaaacagcaagtgg

SEQ ID NO: 68052 - DNA, 75 bp, Artificial Sequence
  Synthetic
cagaaaagtatcactctagtgtgtactcacttccaccagaccctgaccattttgatgggtacaaacagcaagtgg

SEQ ID NO: 68053 - DNA, 75 bp, Artificial Sequence
  Synthetic
cagaaaagtatcactctagtgtgtactcacttccaccagaccctgaccattttgacgggtacaaacagcaagtgg

SEQ ID NO: 68054 - DNA, 75 bp, Artificial Sequence
  Synthetic
cagaaaagtatcactctagtgtgtactcacttccaccagaccctgaccattttgaggggtacaaacagcaagtgg

SEQ ID NO: 68055 - DNA, 75 bp, Artificial Sequence
  Synthetic
cagaaaagtatcactctagtgtgtagtcacttccaccagaccctgaccattttgaagggtacaaacagcaagtgg

SEQ ID NO: 68056 - DNA, 75 bp, Artificial Sequence
  Synthetic
cagaaaagtatcactctagtgtgtagtcacttccaccagaccctgaccattttgatgggtacaaacagcaagtgg

SEQ ID NO: 68057 - DNA, 75 bp, Artificial Sequence
  Synthetic
cagaaaagtatcactctagtgtgtagtcacttccaccagaccctgaccattttgacgggtacaaacagcaagtgg

SEQ ID NO: 68058 - DNA, 75 bp, Artificial Sequence
  Synthetic
cagaaaagtatcactctagtgtgtagtcacttccaccagaccctgaccattttgaggggtacaaacagcaagtgg

SEQ ID NO: 68059 - DNA, 75 bp, Artificial Sequence
  Synthetic
cagataagtatcactctagtgtgtaatcacttccaccagaccctgaccattttgaagggtacaaacagcaagtgg

SEQ ID NO: 68060 - DNA, 75 bp, Artificial Sequence
  Synthetic
cagataagtatcactctagtgtgtaatcacttccaccagaccctgaccattttgatgggtacaaacagcaagtgg

SEQ ID NO: 68061 - DNA, 75 bp, Artificial Sequence
  Synthetic
cagataagtatcactctagtgtgtaatcacttccaccagaccctgaccattttgacgggtacaaacagcaagtgg

SEQ ID NO: 68062 - DNA, 75 bp, Artificial Sequence
  Synthetic
cagataagtatcactctagtgtgtaatcacttccaccagaccctgaccattttgaggggtacaaacagcaagtgg

SEQ ID NO: 68063 - DNA, 75 bp, Artificial Sequence
  Synthetic
cagataagtatcactctagtgtgtattcacttccaccagaccctgaccattttgaagggtacaaacagcaagtgg

SEQ ID NO: 68064 - DNA, 75 bp, Artificial Sequence
  Synthetic
cagataagtatcactctagtgtgtattcacttccaccagaccctgaccattttgatgggtacaaacagcaagtgg

SEQ ID NO: 68065 - DNA, 75 bp, Artificial Sequence
  Synthetic
cagataagtatcactctagtgtgtattcacttccaccagaccctgaccattttgacgggtacaaacagcaagtgg

SEQ ID NO: 68066 - DNA, 75 bp, Artificial Sequence
  Synthetic
cagataagtatcactctagtgtgtattcacttccaccagaccctgaccattttgaggggtacaaacagcaagtgg

SEQ ID NO: 68067 - DNA, 75 bp, Artificial Sequence
  Synthetic
cagataagtatcactctagtgtgtactcacttccaccagaccctgaccattttgaagggtacaaacagcaagtgg

SEQ ID NO: 68068 - DNA, 75 bp, Artificial Sequence
  Synthetic
cagataagtatcactctagtgtgtactcacttccaccagaccctgaccattttgatgggtacaaacagcaagtgg

SEQ ID NO: 68069 - DNA, 75 bp, Artificial Sequence
  Synthetic
cagataagtatcactctagtgtgtactcacttccaccagaccctgaccattttgacgggtacaaacagcaagtgg

SEQ ID NO: 68070 - DNA, 75 bp, Artificial Sequence
  Synthetic
cagataagtatcactctagtgtgtactcacttccaccagaccctgaccattttgaggggtacaaacagcaagtgg

SEQ ID NO: 68071 - DNA, 75 bp, Artificial Sequence
  Synthetic
cagataagtatcactctagtgtgtagtcacttccaccagaccctgaccattttgaagggtacaaacagcaagtgg

SEQ ID NO: 68072 - DNA, 75 bp, Artificial Sequence
  Synthetic
cagataagtatcactctagtgtgtagtcacttccaccagaccctgaccattttgatgggtacaaacagcaagtgg

SEQ ID NO: 68073 - DNA, 75 bp, Artificial Sequence
  Synthetic
cagataagtatcactctagtgtgtagtcacttccaccagaccctgaccattttgacgggtacaaacagcaagtgg

SEQ ID NO: 68074 - DNA, 75 bp, Artificial Sequence
  Synthetic
cagataagtatcactctagtgtgtagtcacttccaccagaccctgaccattttgaggggtacaaacagcaagtgg

SEQ ID NO: 68075 - DNA, 75 bp, Artificial Sequence
  Synthetic
cagacaagtatcactctagtgtgtaatcacttccaccagaccctgaccattttgaagggtacaaacagcaagtgg

SEQ ID NO: 68076 - DNA, 75 bp, Artificial Sequence
  Synthetic
cagacaagtatcactctagtgtgtaatcacttccaccagaccctgaccattttgatgggtacaaacagcaagtgg

SEQ ID NO: 68077 - DNA, 75 bp, Artificial Sequence
  Synthetic
cagacaagtatcactctagtgtgtaatcacttccaccagaccctgaccattttgacgggtacaaacagcaagtgg

SEQ ID NO: 68078 - DNA, 75 bp, Artificial Sequence
  Synthetic
cagacaagtatcactctagtgtgtaatcacttccaccagaccctgaccattttgaggggtacaaacagcaagtgg

SEQ ID NO: 68079 - DNA, 75 bp, Artificial Sequence
  Synthetic
cagacaagtatcactctagtgtgtattcacttccaccagaccctgaccattttgaagggtacaaacagcaagtgg

SEQ ID NO: 68080 - DNA, 75 bp, Artificial Sequence
  Synthetic
cagacaagtatcactctagtgtgtattcacttccaccagaccctgaccattttgatgggtacaaacagcaagtgg

SEQ ID NO: 68081 - DNA, 75 bp, Artificial Sequence
  Synthetic
cagacaagtatcactctagtgtgtattcacttccaccagaccctgaccattttgacgggtacaaacagcaagtgg

SEQ ID NO: 68082 - DNA, 75 bp, Artificial Sequence
  Synthetic
cagacaagtatcactctagtgtgtattcacttccaccagaccctgaccattttgaggggtacaaacagcaagtgg

SEQ ID NO: 68083 - DNA, 75 bp, Artificial Sequence
  Synthetic
cagacaagtatcactctagtgtgtactcacttccaccagaccctgaccattttgaagggtacaaacagcaagtgg

SEQ ID NO: 68084 - DNA, 75 bp, Artificial Sequence
  Synthetic
cagacaagtatcactctagtgtgtactcacttccaccagaccctgaccattttgatgggtacaaacagcaagtgg

SEQ ID NO: 68085 - DNA, 75 bp, Artificial Sequence
  Synthetic
cagacaagtatcactctagtgtgtactcacttccaccagaccctgaccattttgacgggtacaaacagcaagtgg

SEQ ID NO: 68086 - DNA, 75 bp, Artificial Sequence
  Synthetic
cagacaagtatcactctagtgtgtactcacttccaccagaccctgaccattttgaggggtacaaacagcaagtgg

SEQ ID NO: 68087 - DNA, 75 bp, Artificial Sequence
  Synthetic
cagacaagtatcactctagtgtgtagtcacttccaccagaccctgaccattttgaagggtacaaacagcaagtgg

SEQ ID NO: 68088 - DNA, 75 bp, Artificial Sequence
  Synthetic
cagacaagtatcactctagtgtgtagtcacttccaccagaccctgaccattttgatgggtacaaacagcaagtgg

SEQ ID NO: 68089 - DNA, 75 bp, Artificial Sequence
  Synthetic
cagacaagtatcactctagtgtgtagtcacttccaccagaccctgaccattttgacgggtacaaacagcaagtgg

SEQ ID NO: 68090 - DNA, 75 bp, Artificial Sequence
  Synthetic
cagacaagtatcactctagtgtgtagtcacttccaccagaccctgaccattttgaggggtacaaacagcaagtgg

SEQ ID NO: 68091 - DNA, 75 bp, Artificial Sequence
  Synthetic
cagagaagtatcactctagtgtgtaatcacttccaccagaccctgaccattttgaagggtacaaacagcaagtgg

SEQ ID NO: 68092 - DNA, 75 bp, Artificial Sequence
  Synthetic
cagagaagtatcactctagtgtgtaatcacttccaccagaccctgaccattttgatgggtacaaacagcaagtgg

SEQ ID NO: 68093 - DNA, 75 bp, Artificial Sequence
  Synthetic
cagagaagtatcactctagtgtgtaatcacttccaccagaccctgaccattttgacgggtacaaacagcaagtgg

SEQ ID NO: 68094 - DNA, 75 bp, Artificial Sequence
  Synthetic
cagagaagtatcactctagtgtgtaatcacttccaccagaccctgaccattttgaggggtacaaacagcaagtgg

SEQ ID NO: 68095 - DNA, 75 bp, Artificial Sequence
  Synthetic
cagagaagtatcactctagtgtgtattcacttccaccagaccctgaccattttgaagggtacaaacagcaagtgg

SEQ ID NO: 68096 - DNA, 75 bp, Artificial Sequence
  Synthetic
cagagaagtatcactctagtgtgtattcacttccaccagaccctgaccattttgatgggtacaaacagcaagtgg

SEQ ID NO: 68097 - DNA, 75 bp, Artificial Sequence
  Synthetic
cagagaagtatcactctagtgtgtattcacttccaccagaccctgaccattttgacgggtacaaacagcaagtgg

SEQ ID NO: 68098 - DNA, 75 bp, Artificial Sequence
  Synthetic
cagagaagtatcactctagtgtgtattcacttccaccagaccctgaccattttgaggggtacaaacagcaagtgg

SEQ ID NO: 68099 - DNA, 75 bp, Artificial Sequence
  Synthetic
cagagaagtatcactctagtgtgtactcacttccaccagaccctgaccattttgaagggtacaaacagcaagtgg

SEQ ID NO: 68100 - DNA, 75 bp, Artificial Sequence
  Synthetic
cagagaagtatcactctagtgtgtactcacttccaccagaccctgaccattttgatgggtacaaacagcaagtgg

SEQ ID NO: 68101 - DNA, 75 bp, Artificial Sequence
  Synthetic
cagagaagtatcactctagtgtgtactcacttccaccagaccctgaccattttgacgggtacaaacagcaagtgg

SEQ ID NO: 68102 - DNA, 75 bp, Artificial Sequence
  Synthetic
cagagaagtatcactctagtgtgtactcacttccaccagaccctgaccattttgaggggtacaaacagcaagtgg

SEQ ID NO: 68103 - DNA, 75 bp, Artificial Sequence
  Synthetic
cagagaagtatcactctagtgtgtagtcacttccaccagaccctgaccattttgaagggtacaaacagcaagtgg

SEQ ID NO: 68104 - DNA, 75 bp, Artificial Sequence
  Synthetic
cagagaagtatcactctagtgtgtagtcacttccaccagaccctgaccattttgatgggtacaaacagcaagtgg

SEQ ID NO: 68105 - DNA, 75 bp, Artificial Sequence
  Synthetic
cagagaagtatcactctagtgtgtagtcacttccaccagaccctgaccattttgacgggtacaaacagcaagtgg

SEQ ID NO: 68106 - DNA, 75 bp, Artificial Sequence
  Synthetic
cagagaagtatcactctagtgtgtagtcacttccaccagaccctgaccattttgaggggtacaaacagcaagtgg

SEQ ID NO: 68107 - DNA, 75 bp, Artificial Sequence
  Synthetic
gttctacatggactgcgacatcgaggtaacggactcgtataaaacagatttgggtaggttagatgctggaagagc

SEQ ID NO: 68108 - DNA, 75 bp, Artificial Sequence
  Synthetic
ggttcattggaggtgacattcatgtttgcaggctcatttatggctacaggtaagatgctcatcgcctacacccca

SEQ ID NO: 68109 - DNA, 75 bp, Artificial Sequence
  Synthetic
ttggacactaaattgtgggagaaatcgtccaagggatggtactggaagttcccggatgtgttaactgaaactggg

SEQ ID NO: 68110 - DNA, 75 bp, Artificial Sequence
  Synthetic
actaagagataggaagtccaaagttagatacagtgtggatacggtggtttcagagctcataagggaatacaataa

SEQ ID NO: 68111 - DNA, 75 bp, Artificial Sequence
  Synthetic
ttttaaccactgacgatggcgtctcagcacccattctgccaaacttccaccccaccccgtgtatccatatacccg

SEQ ID NO: 68112 - DNA, 75 bp, Artificial Sequence
  Synthetic
ccttactgggtcagttgtgcgggtactacacccaatggtcaggatcattggaagtcaccttcatgtttactggat

SEQ ID NO: 68113 - DNA, 75 bp, Artificial Sequence
  Synthetic
tacaatttccccacaaaggcaggacagtgtgggggcgtggtcacctcagtcggcaagatcattggaattcatatc

SEQ ID NO: 68114 - DNA, 75 bp, Artificial Sequence
  Synthetic
cgtcagggatcgcttagcagttctcccgcgccactcgcagcccggaaaaacaatctgggtggaacacaaactcgt

SEQ ID NO: 68115 - DNA, 75 bp, Artificial Sequence
  Synthetic
gtttttcaaaacccagcctgatctatgtggaggctagcgagtattacccagccaggtaccaatcacatctcatgc

SEQ ID NO: 68116 - DNA, 75 bp, Artificial Sequence
  Synthetic
atcatcaaatgctagtgatgagagcatgattgagacgcgatgtgttcttaattcacatagcacagctgagaccac

SEQ ID NO: 68117 - DNA, 75 bp, Artificial Sequence
  Synthetic
agagtctatgccctagagaaaaggatgaataactacatgcagttcaagagcaaacaccgtattgaacctgtatgc

SEQ ID NO: 68118 - DNA, 75 bp, Artificial Sequence
  Synthetic
agtgcttatcaatggttttatgacggatatcccacattcggagaacacaaacaggagaaagatcttgaatacggg

SEQ ID NO: 68119 - DNA, 75 bp, Artificial Sequence
  Synthetic
ttccatgatatctttgagggcaacaaggaaccagcggtcttacacagcaaagaccctcgcctcgaggtagatttt

SEQ ID NO: 68120 - DNA, 75 bp, Artificial Sequence
  Synthetic
ctttgtgaagctgttagaccccccagcacaggtttcagttccattcatgtcacctgcgagcgcctatcaatggtt

SEQ ID NO: 68121 - DNA, 75 bp, Artificial Sequence
  Synthetic
cgccttggggatcaagaagagggacatcttagaccccaccaccagggatgtgagtaagatgaagttctacatgga

SEQ ID NO: 68122 - DNA, 75 bp, Artificial Sequence
  Synthetic
cattggtgatcaggatttacatgaggatgaagcatgtcagggcgtggatacctcgcccaatgcgcaaccaaaact

SEQ ID NO: 68123 - DNA, 75 bp, Artificial Sequence
  Synthetic
tgagtaagatgaagttctacatggataagtatggtcttgacctcccttactctacctatgttaaggatgagctac

SEQ ID NO: 68124 - DNA, 75 bp, Artificial Sequence
  Synthetic
atgctagcctcagcccagtttggtttagagcactggagttagttcttagagagataggctacagtaacgaggcag

SEQ ID NO: 68125 - DNA, 75 bp, Artificial Sequence
  Synthetic
cctcaggctgttcaggaacatccattttcaactcaatgattaacaacatcatcattagatcattgcttatcaaaa

SEQ ID NO: 68126 - DNA, 75 bp, Artificial Sequence
  Synthetic
acctgtatcgatctgggttttgcgtgcacgttcagtgcaacgcaagtaaatttcaccaaggcgctttactggtgg

SEQ ID NO: 68127 - DNA, 75 bp, Artificial Sequence
  Synthetic
ctgtggttggatgatgaggctatggagcagggcgtgtctgattacatcaaggggcttggagatgcttttggcatg

SEQ ID NO: 68128 - DNA, 75 bp, Artificial Sequence
  Synthetic
aagattcttaagaacttagtcaaactcatctctgcgctcgtcattgtcatcaggagtgattatgacatggtcaca

SEQ ID NO: 68129 - DNA, 75 bp, Artificial Sequence
  Synthetic
tcatctctgcgctcgtcattgtcatcaggagtgattatgacatggtcacattgacggcaacacttgccctgatcg

SEQ ID NO: 68130 - DNA, 75 bp, Artificial Sequence
  Synthetic
ggagattcacgaatccattcggtggactaaggatgcacgcaacactcaagatcacgtgcgatccttgtgtctatt

SEQ ID NO: 68131 - DNA, 75 bp, Artificial Sequence
  Synthetic
ggttaaatcgaagacagcatcaattttgggcataccgatggctcagaagcagagtgcctcttggttaaagaagtt

SEQ ID NO: 68132 - DNA, 75 bp, Artificial Sequence
  Synthetic
tgatctatgtagaggctagcgagtattacccagccaggtaccaatcacatctcatgctcgcacagggtcactcag

SEQ ID NO: 68133 - DNA, 75 bp, Artificial Sequence
  Synthetic
tagaaagtctaaagtcagatacagtgtggatacggtggtttcagaacttattagggaatacagcaataggtccgc

SEQ ID NO: 68134 - DNA, 75 bp, Artificial Sequence
  Synthetic
tacaccactattaactattacaaagattcctatgctgcgacagcgggcaaacagagcctcaaacaagaccctgat

SEQ ID NO: 68135 - DNA, 75 bp, Artificial Sequence
  Synthetic
catgtatgtcccgccaggggctccgaaacctacttccagagattcgtttgcttggcagactgccaccaacccatc

SEQ ID NO: 68136 - DNA, 75 bp, Artificial Sequence
  Synthetic
agaatcagatctcaaacttggaacaatctgctgcctcacaagaggaccttgaagtcatgtttgggaatgtgtcgt

SEQ ID NO: 68137 - DNA, 75 bp, Artificial Sequence
  Synthetic
tatttgtttaagaccaacccaaattataaaggaaatgatattaagtgcaccagcactagtagagacaagataaca

SEQ ID NO: 68138 - DNA, 75 bp, Artificial Sequence
  Synthetic
tcttgatcaagcacttctgtttccccggaccgagtatcaatagactgctcgcgcggttgaaggagaaaacgttcg

SEQ ID NO: 68139 - DNA, 75 bp, Artificial Sequence
  Synthetic
tgtagatcaggccgatgagtcaccgcattccccacgggcgaccgtggcggtggctgcgttggcggcctgcccatg

SEQ ID NO: 68140 - DNA, 75 bp, Artificial Sequence
  Synthetic
ccaggcactcccaaccaggaaagaccatctgggttgaacacaagttagtgaagatcgtagatgctgtggagctag

SEQ ID NO: 68141 - DNA, 75 bp, Artificial Sequence
  Synthetic
aagatcgtagatgctgtggagctagtagatgaacaaggggttaacctagagctcacactggtaacgcttgacacc

SEQ ID NO: 68142 - DNA, 75 bp, Artificial Sequence
  Synthetic
gctcacactggtaacgcttgacaccaacgaaaaatttagagacatcacaagattcataccagaaacaattagtcc

SEQ ID NO: 68143 - DNA, 75 bp, Artificial Sequence
  Synthetic
gagaagatcttgaagaacttggtgaagctaatctcggctttagtcatagtcgttaggagtgactatgacatggtc

SEQ ID NO: 68144 - DNA, 75 bp, Artificial Sequence
  Synthetic
acaaggagagatccaatgggttaagcccaataaagaaactggaagactcaacattaatggaccaacccgcaccaa

SEQ ID NO: 68145 - DNA, 75 bp, Artificial Sequence
  Synthetic
ttcgagaaacctagtaacaccatgaaagttgcggagtgtttcgctcagcacttcccccgtgtagatcaggtcgat

SEQ ID NO: 68146 - DNA, 75 bp, Artificial Sequence
  Synthetic
catgcaatccatcgccacagtagtggcagttgtctcgttggtgtatgtcatctacaagctctttgcagggttcca

SEQ ID NO: 68147 - DNA, 75 bp, Artificial Sequence
  Synthetic
ccaccgcccagggctgtgatacaattgcacgttgtgactgtcaaacaggagtgtactattgtaactccaagagaa

SEQ ID NO: 68148 - DNA, 75 bp, Artificial Sequence
  Synthetic
ttcacgatgtgttcgagggcactaaagagccagcagtgctgactagtaaagacccaaggctggaagttgactttg

SEQ ID NO: 68149 - DNA, 75 bp, Artificial Sequence
  Synthetic
ttttggacccaacaactcgtgatgtcagcaagatgaaattctacatggacaagtatgggttggatctaccgtact

SEQ ID NO: 68150 - DNA, 75 bp, Artificial Sequence
  Synthetic
aagtctcgtctcatagaagcgagcagtctaaatgactcagtgtacttgagaatgacatttgggcacctttatgaa

SEQ ID NO: 68151 - DNA, 75 bp, Artificial Sequence
  Synthetic
gcctttcacgccaatccaggtacagtcactggttcagctgttggatgcaacccagatgtgttctggagtaagtta

SEQ ID NO: 68152 - DNA, 75 bp, Artificial Sequence
  Synthetic
ccaattctacttccaggatcgctttttgcgtttgactactcggggtatgacgctagtctcagcccagtgtggttc

SEQ ID NO: 68153 - DNA, 75 bp, Artificial Sequence
  Synthetic
ttaaaacagcctgtgggttgtacccacccacagggcccactgggcgctagcacactgattctacggaatctttgt

SEQ ID NO: 68154 - DNA, 75 bp, Artificial Sequence
  Synthetic
cggtgtgttggatgctgttgaattggtggatgagcaaggtgtagacttggagctcacactggtgaccttggacac

SEQ ID NO: 68155 - DNA, 75 bp, Artificial Sequence
  Synthetic
ccttttgattctgccttgaaccattgcaactttggcctattagttgtgcctattagcccactagactacgaccaa

SEQ ID NO: 68156 - DNA, 75 bp, Artificial Sequence
  Synthetic
cttattgtgttcttgggggaatgccctcaggttgctcaggcacctccattttcaactcgatgatcaacaacatca

SEQ ID NO: 68157 - DNA, 75 bp, Artificial Sequence
  Synthetic
ttattaggacactcctgattaaaacattcaaagggatagatctagatgaattgaacatggtggcctacggggatg

SEQ ID NO: 68158 - DNA, 75 bp, Artificial Sequence
  Synthetic
ttaaaacagcctgtgggttgcacccacccacagggcccactgggcgtcagcactctggtactgaggtacctttgt

SEQ ID NO: 68159 - DNA, 75 bp, Artificial Sequence
  Synthetic
gccagttgtgtggatactacacccaatggtcagggtcactagaggtcacttttatgttcaccgggtccttcatgg

SEQ ID NO: 68160 - DNA, 75 bp, Artificial Sequence
  Synthetic
atgtgttggctagttaccccttcccaattgactgtctggaattggcgagaacaggcaaggagtatggtttaacta

SEQ ID NO: 68161 - DNA, 75 bp, Artificial Sequence
  Synthetic
cacagcctggtcaggttggtgcagttctgacgcacccttacgtgctagatgcagggatccctttgagccaattaa

SEQ ID NO: 68162 - DNA, 75 bp, Artificial Sequence
  Synthetic
gggcaggtgacgcaaccttgatcatcgacactgggcatatgccctcaatgttcgttccagtgggcgatgttgtgc

SEQ ID NO: 68163 - DNA, 75 bp, Artificial Sequence
  Synthetic
catccaccccacgatgccaatgagggagattcacgagtccattcgttggaccaaagatgcacgaagtactcaaga

SEQ ID NO: 68164 - DNA, 75 bp, Artificial Sequence
  Synthetic
ctcttgtggttagatgaagaagccatggagcaaggtgtctccgactacattaaggggctcggtgatgcgtttggg

SEQ ID NO: 68165 - DNA, 75 bp, Artificial Sequence
  Synthetic
ggagactgaacgttggtggcccaacccgtaccaagttggagcccagtgcattctatggtgtgtttgagggcagca

SEQ ID NO: 68166 - DNA, 75 bp, Artificial Sequence
  Synthetic
gaaacacattgcatgagccggatgagtacatcatagaggcagcccttcattatgcaaaccaattgaagcagttag

SEQ ID NO: 68167 - DNA, 75 bp, Artificial Sequence
  Synthetic
tttgaaaatttgagaagaaattggcttgaattattttaatattacagctgaagctgaaccccactagaaatctgg

SEQ ID NO: 68168 - DNA, 75 bp, Artificial Sequence
  Synthetic
aatcttgaagctattgaccttcacactagtgcaggttacccctacagtgctttgggaataaagaagagggacatc

SEQ ID NO: 68169 - DNA, 75 bp, Artificial Sequence
  Synthetic
cttgggtagattagatgctggacgggctgctaagttatgctctgaaaacaacaccgcaaacttcaaacgatgcag

SEQ ID NO: 68170 - DNA, 75 bp, Artificial Sequence
  Synthetic
actcttatgcggcgtcggctagtagacaggattttgcacaagatcctgcaaagttcacacgccctgtcttggatg

SEQ ID NO: 68171 - DNA, 75 bp, Artificial Sequence
  Synthetic
tgccctgggtgtcaagaaaggagacatgcttggcccaaccactggagatactaccaaaatgaaattctacatgga

SEQ ID NO: 68172 - DNA, 75 bp, Artificial Sequence
  Synthetic
cagctaagtctcgatcaagcacttctgttaccccggaccgagtatcaataggctgtacccacggctgaaagagaa

SEQ ID NO: 68173 - DNA, 75 bp, Artificial Sequence
  Synthetic
gtctcgcctaattgaagctagcagtctgaacgattcagtttacctcagaatggcttttggacacctctatgaaac

SEQ ID NO: 68174 - DNA, 75 bp, Artificial Sequence
  Synthetic
acaggattttgcacaagatcctgcaaagttcacacgccctgtcttggatgcaatcagggaggccgccgctccgct

SEQ ID NO: 68175 - DNA, 75 bp, Artificial Sequence
  Synthetic
atgcttggcccaaccactggagatactaccaaaatgaaattctacatggatggatatgggttagacttgccctat

SEQ ID NO: 68176 - DNA, 75 bp, Artificial Sequence
  Synthetic
ccagcgggtagtgtgtcgtaacgggcaactctgcagcggaaccgactactttgggtgtccgtgtttccttttatc

SEQ ID NO: 68177 - DNA, 75 bp, Artificial Sequence
  Synthetic
cacccaagaggcagctaacattgtattgagctatggagagtggccagaatactgtccttccacggacgccacagc

SEQ ID NO: 68178 - DNA, 75 bp, Artificial Sequence
  Synthetic
tgtggacaaacctactcgccctgacgtgtcagtgaacagattttatacactgtcaaccaagagctggaagacaga

SEQ ID NO: 68179 - DNA, 75 bp, Artificial Sequence
  Synthetic
gtctactgagctaggtagtagtcctccggcccctgaatgcggctaatcccaaccacggagcaggcgctcacactc

SEQ ID NO: 68180 - DNA, 75 bp, Artificial Sequence
  Synthetic
aagtctgtggcggaaccgactactttgggtgtccgtgtttccttttatttttatcatggctgcttatggtgacaa

SEQ ID NO: 68181 - DNA, 75 bp, Artificial Sequence
  Synthetic
atgcatgttcaatgtaatgcaagcaaattccatcagggggccctcttggtagccgcaatccctgaatttgtggtt

SEQ ID NO: 68182 - DNA, 75 bp, Artificial Sequence
  Synthetic
ttcccttccccagaaataacttagaagctttgagccaacgatcaacagtgggtgcgacataccagtcgcatctcc

SEQ ID NO: 68183 - DNA, 75 bp, Artificial Sequence
  Synthetic
ctaatggacaagggttgtacccagactttgctcatactaacccaggcaaaggtggtcaagagttccgagatcctt

SEQ ID NO: 68184 - DNA, 75 bp, Artificial Sequence
  Synthetic
tctaagattgttatcatatagctattggattggccatccggtgaattctagagatattatttacttgtttgttgg

SEQ ID NO: 68185 - DNA, 75 bp, Artificial Sequence
  Synthetic
ggtggtcaagagttccgagatccttatgtcttggatgctggaatccctctaagccaagcactaatttttccccat

SEQ ID NO: 68186 - DNA, 75 bp, Artificial Sequence
  Synthetic
atcaagcacttctgtttccccggactgagtatcaatacgctgcttacgcggctgaaggagaaaacgttcgttacc

SEQ ID NO: 68187 - DNA, 75 bp, Artificial Sequence
  Synthetic
ggagctcaagtgtccactcaaaagaccggatcgcatgagaatcagaatgttgctgccaatggctctacaataaat

SEQ ID NO: 68188 - DNA, 75 bp, Artificial Sequence
  Synthetic
ccggatcgcatgagaatcagaatgttgctgccaatggctctacaataaattacaccactattaattactacaaag

SEQ ID NO: 68189 - DNA, 75 bp, Artificial Sequence
  Synthetic
tgccacattcttaaagagaggcttcctgccagatcaccaattcccatttcttatccaccctaccatgcccatgag

SEQ ID NO: 68190 - DNA, 75 bp, Artificial Sequence
  Synthetic
cgagttacaacacccatatgtacttgatgctggcattccaatatcacaactaacagtgtgcccacatcagtggat

SEQ ID NO: 68191 - DNA, 75 bp, Artificial Sequence
  Synthetic
cactgaaagaaactgcacctcctttgaaatctccctcagctgaagcgtgcggctacagtgacagagtggcgcaac

SEQ ID NO: 68192 - DNA, 75 bp, Artificial Sequence
  Synthetic
ctgttccagtaggaagagcattggcaattccaaactatgaaaatctgagacgcaattggctcgaattgttttaga

SEQ ID NO: 68193 - DNA, 75 bp, Artificial Sequence
  Synthetic
gaaatctccctcagctgaagcgtgcggctacagtgacagagtggcgcaactcacagttgggaactccactattac

SEQ ID NO: 68194 - DNA, 75 bp, Artificial Sequence
  Synthetic
gatagcgaagaggtacgccagtactgcagagaccaaggctggatcatcccagagactcccacaaatgttgaacga

SEQ ID NO: 68195 - DNA, 75 bp, Artificial Sequence
  Synthetic
ccattgcaactttggtctactggttgtacctattagtccgttggacttcgaccaaggagcgacgccagtgatccc

SEQ ID NO: 68196 - DNA, 75 bp, Artificial Sequence
  Synthetic
agttgacaagccaaccaagcctgatgtgtcagtaaatagattttacacattatcagccaaattatggacaaagaa

SEQ ID NO: 68197 - DNA, 75 bp, Artificial Sequence
  Synthetic
gagttgcaacacccgtacgtgcttgatgctggcattccaatatcacagttaacagtgtgcccacaccagtggatt

SEQ ID NO: 68198 - DNA, 75 bp, Artificial Sequence
  Synthetic
gtaccactggggtcagtaggttactaatccctgttcgagcacagaataatgtcgaccagttatgtgcctcgttcc

SEQ ID NO: 68199 - DNA, 75 bp, Artificial Sequence
  Synthetic
gccatttatgtgggcaactttagagtggtcaaccgacatcttgccactcacaatgattgggcaaatcttgtttgg

SEQ ID NO: 68200 - DNA, 75 bp, Artificial Sequence
  Synthetic
aatccctgttcgagcacagaataatgtcgaccagttatgtgcctcgttccaagtggatcctgggcgcaatggtcc

SEQ ID NO: 68201 - DNA, 75 bp, Artificial Sequence
  Synthetic
gtgtcagtaaatagattttacacattatcagccaaattatggacaaagaactctcctggttggtattggaaattc

SEQ ID NO: 68202 - DNA, 75 bp, Artificial Sequence
  Synthetic
attcacgtccagtgtaatgccagcaagtttcatcaaggcgcactcttagtagtggcaattccagaatatgtgcag

SEQ ID NO: 68203 - DNA, 75 bp, Artificial Sequence
  Synthetic
agtttcatcaaggcgcactcttagtagtggcaattccagaatatgtgcagggtaggtctagtaactcaaccactc

SEQ ID NO: 68204 - DNA, 75 bp, Artificial Sequence
  Synthetic
gtttacaggttcttttatggctacagggaaaatgttgatagcctacacaccacctggcagtgctcagcccgccac

SEQ ID NO: 68205 - DNA, 75 bp, Artificial Sequence
  Synthetic
accataaactacactaccattaattactacaaggactcctatgctgctacagcaggcaaacagagtctcaaacaa

SEQ ID NO: 68206 - DNA, 75 bp, Artificial Sequence
  Synthetic
agtcaacaatgtacccacgaatgccaccagtttaatggagagactgcgctttccggtctcagcccaagcaggaaa

SEQ ID NO: 68207 - DNA, 75 bp, Artificial Sequence
  Synthetic
gagggaagcagcaatgcttggaacgcatatagtgtgggattttgggttacaatcatcagttactctagtcatacc

SEQ ID NO: 68208 - DNA, 75 bp, Artificial Sequence
  Synthetic
agtggatgagcagggggtcaatttggagctaaccctagtcaccctagacaccaatgagaagttcagagatattac

SEQ ID NO: 68209 - DNA, 75 bp, Artificial Sequence
  Synthetic
tcttggatgctggtatcccacttagtgaagcactaatcttccctcaccagtggataaatttgagaactaacaact

SEQ ID NO: 68210 - DNA, 75 bp, Artificial Sequence
  Synthetic
tgaagcactaatcttccctcaccagtggataaatttgagaactaacaactgtgccactatagttatgccctacat

SEQ ID NO: 68211 - DNA, 75 bp, Artificial Sequence
  Synthetic
caaattcattccagaaagtatcagcgccgctagtgacgccactttagtgatcaacacagagcatatgccttcaat

SEQ ID NO: 68212 - DNA, 75 bp, Artificial Sequence
  Synthetic
gtaccaccagatacccccactgaggctaacatcatagctcttggagcagcacaaaagaactttaccctgaagttg

SEQ ID NO: 68213 - DNA, 75 bp, Artificial Sequence
  Synthetic
ctacaatgaaggtgccacctcagcaatacctataacagttactattgcaccgctgaactccgagttcggtggtct

SEQ ID NO: 68214 - DNA, 75 bp, Artificial Sequence
  Synthetic
atacctataacagttactattgcaccgctgaactccgagttcggtggtctgagacaagctgtacaacagggactc

SEQ ID NO: 68215 - DNA, 75 bp, Artificial Sequence
  Synthetic
cactttcgagcacccttacgtgctcgatgcgggtattcccctcagtcaggcgcttatattccctcaccaatggat

SEQ ID NO: 68216 - DNA, 75 bp, Artificial Sequence
  Synthetic
gtaagcgcactcgctgacaccacaatatcccgggtgaccgcggctaacaccgcagccagtacccactccctgggt

SEQ ID NO: 68217 - DNA, 75 bp, Artificial Sequence
  Synthetic
tatcccgggtgaccgcggctaacaccgcagccagtacccactccctgggtacaggacgcgtgcctgcactgcaag

SEQ ID NO: 68218 - DNA, 75 bp, Artificial Sequence
  Synthetic
ttccaccctacccctgaaatacacataccaggtgaagtaacaaatttgctagagatatgccaagtagagtctatt

SEQ ID NO: 68219 - DNA, 75 bp, Artificial Sequence
  Synthetic
taccaggtgaagtaacaaatttgctagagatatgccaagtagagtctattattgaagtgaacaacttgagtaccc

SEQ ID NO: 68220 - DNA, 75 bp, Artificial Sequence
  Synthetic
tttattgattggcttaaggagaaaatagtaccagcagccaaggagaaggttgaattcctaaataacttgaaacag

SEQ ID NO: 68221 - DNA, 75 bp, Artificial Sequence
  Synthetic
acaggcactattcagggagatagggtggcggatgtgattgagagttctataggggatagtgtgagtagagctctc

SEQ ID NO: 68222 - DNA, 75 bp, Artificial Sequence
  Synthetic
ctgcattcagagtggacccaggtagagatggaccatggcaatcaactctagttggccagatttgtaaatactata

SEQ ID NO: 68223 - DNA, 75 bp, Artificial Sequence
  Synthetic
gtggcctatagacgtgatgggttttgtgcaacagcggcgcaagctagaactatcaacatacatgcgctttgacgc

SEQ ID NO: 68224 - DNA, 75 bp, Artificial Sequence
  Synthetic
agatggaccatggcaatcaactctagttggccagatttgtaaatactatacccagtggtcaggttcattggaggt

SEQ ID NO: 68225 - DNA, 75 bp, Artificial Sequence
  Synthetic
tatcaacatacatgcgctttgacgctgagttcacttttgtgtccaacctcaatgatagtacaacccctggaatgc

SEQ ID NO: 68226 - DNA, 75 bp, Artificial Sequence
  Synthetic
acatgcagttcaagagcaaacaccgtattgaacctgtatgccttatcattaggggctcgccaggcacagggaagt

SEQ ID NO: 68227 - DNA, 75 bp, Artificial Sequence
  Synthetic
accagctaaccgtgagacagccatgctaggcacgcacgtcatctgggattttggcctacagtcctccgttacact

SEQ ID NO: 68228 - DNA, 75 bp, Artificial Sequence
  Synthetic
ctaggcacgcacgtcatctgggattttggcctacagtcctccgttacactagtgattccatggattagcaacaca

SEQ ID NO: 68229 - DNA, 75 bp, Artificial Sequence
  Synthetic
ggggctagttggggagatagacctccctcttgaaggcacaaccaacccgaatggttatgctaactgggacataga

SEQ ID NO: 68230 - DNA, 75 bp, Artificial Sequence
  Synthetic
gtgagcaagatgaaattctacatggataaatatggccttgacctcccttactccacctatgtcaaagatgagctc

SEQ ID NO: 68231 - DNA, 75 bp, Artificial Sequence
  Synthetic
ctcgagcaatcgctgataagtaccactccagcgtgtactcgctcccaccagacccagatcattttgacggttaca

SEQ ID NO: 68232 - DNA, 75 bp, Artificial Sequence
  Synthetic
gccactaatctgcagtatggacagtgtcctaataacatgatggggcattttgccatccgaacagtcagtgagtcc

SEQ ID NO: 68233 - DNA, 75 bp, Artificial Sequence
  Synthetic
gggaaagcgttggccattcctaattttgaaaatttgagaagaaattggcttgaattattttaatattacagcttg

SEQ ID NO: 68234 - DNA, 75 bp, Artificial Sequence
  Synthetic
aattttgttgtcccagacggggcgccaacccaagcccgcattatagcacttggtgctgcccaaaagaacttcact

SEQ ID NO: 68235 - DNA, 75 bp, Artificial Sequence
  Synthetic
caacccaagcccgcattatagcacttggtgctgcccaaaagaacttcactctaaggttgtgtaaagatactgcag

SEQ ID NO: 68236 - DNA, 75 bp, Artificial Sequence
  Synthetic
aagagcctgggtgcctaggcccttccgatcccaagcttacatggtcaagaattatccaacatatagtcggacaat

SEQ ID NO: 68237 - DNA, 75 bp, Artificial Sequence
  Synthetic
ggattgtgacattgaagtgacagactcatacaaaacagatctaggtagactggatgctgggcgggccgccaaact

SEQ ID NO: 68238 - DNA, 75 bp, Artificial Sequence
  Synthetic
ccaatgccttttcacgtcccagtacacaatccacagctgagaacactaggcccagctctcacaccattggcactg

SEQ ID NO: 68239 - DNA, 75 bp, Artificial Sequence
  Synthetic
ttgggccagttgtgtgggtattacactcaatggtcaggatcactggaagttacgttcatgttcactgggtccttt

SEQ ID NO: 68240 - DNA, 75 bp, Artificial Sequence
  Synthetic
acaatccacagctgagaacactaggcccagctctcacaccattggcactggtgaagtccctgcattacaagctgc

SEQ ID NO: 68241 - DNA, 75 bp, Artificial Sequence
  Synthetic
tgctgagaccagtgtggaacacttcttttccagagccgctctggtgggcatggtagaattgctcacttctgacac

SEQ ID NO: 68242 - DNA, 75 bp, Artificial Sequence
  Synthetic
ttgggctgcaatcgtctgttacccttgtaataccatggatcagcaacacccactacagagcacatgctcgagatg

SEQ ID NO: 68243 - DNA, 75 bp, Artificial Sequence
  Synthetic
ttttccagagccgctctggtgggcatggtagaattgctcacttctgacactaccacaataggttacacaaattgg

SEQ ID NO: 68244 - DNA, 75 bp, Artificial Sequence
  Synthetic
cggtaccagtcgcacggcgatcaccactcttgggaaatttggacaacaatccggggccatttacgtgggcaactt

SEQ ID NO: 68245 - DNA, 75 bp, Artificial Sequence
  Synthetic
agtcagcttctcaaagcctagccttgtcttcgtggaagctagtgagtattatcctgccaggtaccagtcgcacct

SEQ ID NO: 68246 - DNA, 75 bp, Artificial Sequence
  Synthetic
ttcacttttgtcaccaccaatgccaaaggggaagccccgaataccatgttacagtatatgtacattcctccggga

SEQ ID NO: 68247 - DNA, 75 bp, Artificial Sequence
  Synthetic
aagtgcgccagtactgcagggaccagggctggatcattccagaaacccctaccaacgtagagcggcaccttaata

SEQ ID NO: 68248 - DNA, 75 bp, Artificial Sequence
  Synthetic
aaggggaagccccgaataccatgttacagtatatgtacattcctccgggagcacccaaaccaaccgctagggact

SEQ ID NO: 68249 - DNA, 75 bp, Artificial Sequence
  Synthetic
ttgatccaccctaccatgccaatgaaggaaatccatgaatctattcgatggaccaaggacgcacgcaatactcaa

SEQ ID NO: 68250 - DNA, 75 bp, Artificial Sequence
  Synthetic
ttttatggttggatgaagaagccatggaacagggtgtgtctgattacattaaagggctcggtgatgcttttggaa

SEQ ID NO: 68251 - DNA, 75 bp, Artificial Sequence
  Synthetic
cctttatgtcaccagccagtgcttatcagtggttttatgatgggtatcccacttttggttcacacccagtagcac

SEQ ID NO: 68252 - DNA, 75 bp, Artificial Sequence
  Synthetic
tcagtggttttatgatgggtatcccacttttggttcacacccagtagcacaagatgtgcaatatggaattgcccc

SEQ ID NO: 68253 - DNA, 75 bp, Artificial Sequence
  Synthetic
atgcttgcagtgggtcactcagaaccaggagactgcggtggcatactcagatgtcagcatggtgttgtagggata

SEQ ID NO: 68254 - DNA, 75 bp, Artificial Sequence
  Synthetic
agaagatcttaaaaaatttgattaaattgatctcagcgctagttatagtgatcaggagtgattatgacatggtaa

SEQ ID NO: 68255 - DNA, 75 bp, Artificial Sequence
  Synthetic
attgatctcagcgctagttatagtgatcaggagtgattatgacatggtaactctcacagcaaccttagcactcat

SEQ ID NO: 68256 - DNA, 75 bp, Artificial Sequence
  Synthetic
tcacaacccggcaaaactatttggattgagcacaaactcgtgaacgtccttgatgcagttgaattggtggatgag

SEQ ID NO: 68257 - DNA, 75 bp, Artificial Sequence
  Synthetic
cttcatgagactcaagcatgttaaaacctgggtgccacgcccgctccgctcacaaaagtaccttttgaagaacta

SEQ ID NO: 68258 - DNA, 75 bp, Artificial Sequence
  Synthetic
acctgggtgccacgcccgctccgctcacaaaagtaccttttgaagaactacccaaattttgatggcgcaaacctc

SEQ ID NO: 68259 - DNA, 75 bp, Artificial Sequence
  Synthetic
agatagacctccctctcgaaggcacaaccaacccgaatggttatgctaactgggacatagatataacaggttatg

SEQ ID NO: 68260 - DNA, 75 bp, Artificial Sequence
  Synthetic
ttacagacagcctctattcagggagatagggtggcagatgtgatcgagagctctataggagatagtgtgagtagg

SEQ ID NO: 68261 - DNA, 75 bp, Artificial Sequence
  Synthetic
gcagggcgcatcatggcttaagaagtttaatgacatggccagcgctgctaaggggttagagtggatctctaataa

SEQ ID NO: 68262 - DNA, 75 bp, Artificial Sequence
  Synthetic
ggaaattacagaatagttaacagacacttagctatacctcaggattggacaaatctagtgtgggaagatgcaaat

SEQ ID NO: 68263 - DNA, 75 bp, Artificial Sequence
  Synthetic
cgtttgggaagacagctcccgtgacttgttagtgtcgtccacccccgcccagggctgtgatacaattgcacgttg

SEQ ID NO: 68264 - DNA, 75 bp, Artificial Sequence
  Synthetic
acttagctatacctcaggattggacaaatctagtgtgggaagatgcaaatagggatcttctaatttcaagtacca

SEQ ID NO: 68265 - DNA, 75 bp, Artificial Sequence
  Synthetic
tttaatgacatggccagcgctgctaaggggttagagtggatctctaataagatcagtaaatttatagactggctc

SEQ ID NO: 68266 - DNA, 75 bp, Artificial Sequence
  Synthetic
gttccagcgctccaagctgctgagatcggggcatcatcgaatactagtgatgagagtatgattgagacacgatgc

SEQ ID NO: 68267 - DNA, 75 bp, Artificial Sequence
  Synthetic
aaccaaatctcaaacttggaacagtccgccgcttcacaagaagatcttgaggcgatgtttgggaatgtgtcgtac

SEQ ID NO: 68268 - DNA, 75 bp, Artificial Sequence
  Synthetic
ttccattcatgtcacccgcgagcgcctatcaatggttttatgacggatatcccacgtttggtgagcacaagcaag

SEQ ID NO: 68269 - DNA, 75 bp, Artificial Sequence
  Synthetic
actacccagtcagtttttctaaaccaggccttgtttttgtgaatgagagtatgtattaccctgccagataccaat

SEQ ID NO: 68270 - DNA, 75 bp, Artificial Sequence
  Synthetic
gagcgccacttgaatagagctgtcttgattatgcaatctgtagccaccgtggtagcagttgtgtcccttgtttac

SEQ ID NO: 68271 - DNA, 75 bp, Artificial Sequence
  Synthetic
aggccttgtttttgtgaatgagagtatgtattaccctgccagataccaatcacacgtgctcctagcaccgggaca

SEQ ID NO: 68272 - DNA, 75 bp, Artificial Sequence
  Synthetic
aaggacatttcactatgttaggagtgcgagatcgcctagctattttgccacgccactcgcaaccaggaaaaacta

SEQ ID NO: 68273 - DNA, 75 bp, Artificial Sequence
  Synthetic
aagagtctatgctctggaaaagaggatgaacaactacatgcagttcaagagcaaacaccgtattgaacctgtatg

SEQ ID NO: 68274 - DNA, 75 bp, Artificial Sequence
  Synthetic
acatggtgtgaagagtctattgagctagttagtagtcctccggcccctgaatgcggctaatcctaactgcggagc

SEQ ID NO: 68275 - DNA, 75 bp, Artificial Sequence
  Synthetic
gcaaacaccgtattgaacctgtatgtctcattatcagaggctcaccaggcactggaaaatctttggcaaccggca

SEQ ID NO: 68276 - DNA, 75 bp, Artificial Sequence
  Synthetic
ggcctcaaaaggagttactttgctagtgaacaaggagagatccagtgggttaagcccaataaagaaactggaaga

SEQ ID NO: 68277 - DNA, 75 bp, Artificial Sequence
  Synthetic
tggtttagtgggctttgcggacttgcgggacattctgtggcttgacgatgaggtcatggagcagggtgtcactga

SEQ ID NO: 68278 - DNA, 75 bp, Artificial Sequence
  Synthetic
cgggacattctgtggcttgacgatgaggtcatggagcagggtgtcactgattacatcaagggtctaggggatgcc

SEQ ID NO: 68279 - DNA, 75 bp, Artificial Sequence
  Synthetic
gtagtagagaaaattttgaaggccttaatcaaagttgtttcagcattagtgattgtggttaggagtgactatgat

SEQ ID NO: 68280 - DNA, 75 bp, Artificial Sequence
  Synthetic
atggatttctaaatctcagcggtaagcccacacaccgaaccatgatgtacaatttccccacaaaggcaggacagt

SEQ ID NO: 68281 - DNA, 75 bp, Artificial Sequence
  Synthetic
gaaaaaggggtgtctttcacttctaaatttgtcatcgcatccaccaatgccagcaacatcatagtgccaacagtg

SEQ ID NO: 68282 - DNA, 75 bp, Artificial Sequence
  Synthetic
taatcaaagttgtttcagcattagtgattgtggttaggagtgactatgatcttgtgacattgactgctaccttgg

SEQ ID NO: 68283 - DNA, 75 bp, Artificial Sequence
  Synthetic
gcaggacagtgtggtggtgttgtgactgccgtgggtaaagtgattgggatccacattggtggcaacggtaggcaa

SEQ ID NO: 68284 - DNA, 75 bp, Artificial Sequence
  Synthetic
cagagaagcaaagtgactcctggcttaagaaattcactgaattcgccaatgctgccaggggtttagaatggatct

SEQ ID NO: 68285 - DNA, 75 bp, Artificial Sequence
  Synthetic
ccacattggtggcaacggtaggcaaggtttctgcgctgccctgaagaggggatacttttgcagtgaacaaggtga

SEQ ID NO: 68286 - DNA, 75 bp, Artificial Sequence
  Synthetic
gccgccaaggaaaaagtggaatttctaaataaccttaagcaacttacactccttgagaaccagatttccaacatt

SEQ ID NO: 68287 - DNA, 75 bp, Artificial Sequence
  Synthetic
agaaaagggagtttcttttacatctaaatttgttatcgcatccaccaacgccagcaacattatagtgcctacagt

SEQ ID NO: 68288 - DNA, 75 bp, Artificial Sequence
  Synthetic
aaatttcaaccactgtatgctgctgaagcaaagagggtctttgcactagaaaaacgcatctctaattacatgcag

SEQ ID NO: 68289 - DNA, 75 bp, Artificial Sequence
  Synthetic
aagacaccacttaattggttcagaaggtgccgtggagaagattcttaagaacctagtaaaacttatctctgcact

SEQ ID NO: 68290 - DNA, 75 bp, Artificial Sequence
  Synthetic
actgtgcgcggcgttccgtgtggacccaggtagagatggcccttggcaatcaacccttgttgggcaaatatgcag

SEQ ID NO: 68291 - DNA, 75 bp, Artificial Sequence
  Synthetic
agagactcccacaaatgttgaacgacacctcaacagagccgtactgatcatgcagtctattgccacagtagtagc

SEQ ID NO: 68292 - DNA, 75 bp, Artificial Sequence
  Synthetic
ctgtatgtttgattgttagaggtgctcctggaactgggaagtcgttggcaactggtatcatttctcgagctattg

SEQ ID NO: 68293 - DNA, 75 bp, Artificial Sequence
  Synthetic
gcaatccccttctgtcgaggcgtgtggttatagtgaccgagtcgcacagttgactgtgggcaactcaaccattac

SEQ ID NO: 68294 - DNA, 75 bp, Artificial Sequence
  Synthetic
ttacagttatggatgacttgtgtcaaaatccagatggtaaagatatggccctattttgtcaaatggtttctacag

SEQ ID NO: 68295 - DNA, 75 bp, Artificial Sequence
  Synthetic
aaatccagatggtaaagatatggccctattttgtcaaatggtttctacagttgattttattcctccaatggcatc

SEQ ID NO: 68296 - DNA, 75 bp, Artificial Sequence
  Synthetic
cccgcgacactcacaacctggaaaagcaatctggatagagcataagcttgtgaacattctggatgctgtcgaact

SEQ ID NO: 68297 - DNA, 75 bp, Artificial Sequence
  Synthetic
tacagtgtcagatgctgatgctatcagaaggagattttacatggattgtgacatagaggtcactgactcatacaa

SEQ ID NO: 68298 - DNA, 75 bp, Artificial Sequence
  Synthetic
gtgtagcccgttagtctgtgggaaagcaattcagctcagggatagaaagacaaaagtcagatacagcctagattc

SEQ ID NO: 68299 - DNA, 75 bp, Artificial Sequence
  Synthetic
ccaatcaatttcttacaactgatgacgggacatccccgccaatactgcctggttttgaaccaactccattgattc

SEQ ID NO: 68300 - DNA, 75 bp, Artificial Sequence
  Synthetic
tacaacaatagatcagcaattggtaacaccattgaagccttgttccaaggtcccccagtcttcaaaccagtcagg

SEQ ID NO: 68301 - DNA, 75 bp, Artificial Sequence
  Synthetic
acaccattgaagccttgttccaaggtcccccagtcttcaaaccagtcaggatctccttagaggagaaaccagcac

SEQ ID NO: 68302 - DNA, 75 bp, Artificial Sequence
  Synthetic
aggaggtaatggcaggcaaggtttctgtgcgggactcaagaggagctattttgctagtgaacaaggagagatcca

SEQ ID NO: 68303 - DNA, 75 bp, Artificial Sequence
  Synthetic
caattggctcgagttgttttagaggtaatacacacctcaacccccaccagaaatctggtcgtgaatgtgactggt

SEQ ID NO: 68304 - DNA, 75 bp, Artificial Sequence
  Synthetic
cagtggactttataccgcctatggcatctttggaggagaaaggagtctcattcacctccaagtttgtgattgcct

SEQ ID NO: 68305 - DNA, 75 bp, Artificial Sequence
  Synthetic
tagtgcctgtccaaccaactaatgtggaaaaacaccttggaagagctgtgctaataatgcaatctattgctacag

SEQ ID NO: 68306 - DNA, 75 bp, Artificial Sequence
  Synthetic
ggaaaaacaccttggaagagctgtgctaataatgcaatctattgctacagttgttgcagttgtgagtctagtgta

SEQ ID NO: 68307 - DNA, 75 bp, Artificial Sequence
  Synthetic
agcgcccagcccacctccagggagttcgcaatgcttggcacgcacgtggtttgggattttgggttgcagtcctca

SEQ ID NO: 68308 - DNA, 75 bp, Artificial Sequence
  Synthetic
attccatgatgcctttaagggcaataaggagccagcagtcttgcatagtaaagaccctcgcctcgaggtggattt

SEQ ID NO: 68309 - DNA, 75 bp, Artificial Sequence
  Synthetic
tctcaggacagcaacggtgcagggaccgagtctagactttgccctttccctactcaggagaaacatcaggcgagt

SEQ ID NO: 68310 - DNA, 75 bp, Artificial Sequence
  Synthetic
gtgggaaacacactacatgagcctgatgagtacatcagagaggcagcccttcactatgcaaaccaattgaagcgg

SEQ ID NO: 68311 - DNA, 75 bp, Artificial Sequence
  Synthetic
ccgagtctagactttgccctttccctactcaggagaaacatcaggcgagtgcagacagaccaaggccatttcact

SEQ ID NO: 68312 - DNA, 75 bp, Artificial Sequence
  Synthetic
ttcaccagggggctcttcttgtggcagttatcccggagttcgttctagcaggcagaggttcaaacacgaagccca

SEQ ID NO: 68313 - DNA, 75 bp, Artificial Sequence
  Synthetic
agaaattggctcgagttgttttaatatatacagtttaaagctgaaccccaccagaaatctgtcggaaaggatgac

SEQ ID NO: 68314 - DNA, 75 bp, Artificial Sequence
  Synthetic
aaattagtcaatattttagatgcagtagagttagtggatgaacaacaggttaatttagaactcaccttagtgact

SEQ ID NO: 68315 - DNA, 75 bp, Artificial Sequence
  Synthetic
tagagttagtggatgaacaacaggttaatttagaactcaccttagtgactttggacaccaacgagaaattcagag

SEQ ID NO: 68316 - DNA, 75 bp, Artificial Sequence
  Synthetic
aagactggcaaagagtatggtttgactatgacacctgcagacaaatcaccctgtttcaatgaagtgacatgggaa

SEQ ID NO: 68317 - DNA, 75 bp, Artificial Sequence
  Synthetic
tagacatcaagaccaccaaaatgagcatagaggatgcttgctatggtacagagaacctggaagctatagatcttc

SEQ ID NO: 68318 - DNA, 75 bp, Artificial Sequence
  Synthetic
cttctgtatccccggactgagtatcaatagactgctcacgcggttgaaggagaaaacgttcgttatccggctaac

SEQ ID NO: 68319 - DNA, 75 bp, Artificial Sequence
  Synthetic
catcgatgttcgtccccgtcggggatgttactgaatatggtttccttaatctcagtggtagaccaacccaccgga

SEQ ID NO: 68320 - DNA, 75 bp, Artificial Sequence
  Synthetic
tgttactgaatatggtttccttaatctcagtggtagaccaacccaccggaccatgatgtacaatttcccaaccag

SEQ ID NO: 68321 - DNA, 75 bp, Artificial Sequence
  Synthetic
gttttgattatgcaatccgtagccaccgtggtagcagttgtgtcccttgtttatgtcatttataagttgtttgcc

SEQ ID NO: 68322 - DNA, 75 bp, Artificial Sequence
  Synthetic
aggattctgtgctgccttgaagcgaggctactttacaactgagcaaggtgagatccagtggatgagacctaataa

SEQ ID NO: 68323 - DNA, 75 bp, Artificial Sequence
  Synthetic
ggaccgagcttggacttcgccctatctctacttaggaggaacattaggcaggtccaaaccgatcagggccacttc

SEQ ID NO: 68324 - DNA, 75 bp, Artificial Sequence
  Synthetic
tgctttgggaataaagaagagggacatcttggatcctaccaccagagatgtgagcaaaatgaaattctacatgga

SEQ ID NO: 68325 - DNA, 75 bp, Artificial Sequence
  Synthetic
aggagtcaaagaaccagcagtccttcattccaaggacaaaagacttgaggtcgactttgaaactgcccttttctc

SEQ ID NO: 68326 - DNA, 75 bp, Artificial Sequence
  Synthetic
tttaccacacccttctatacctattacaactgaatagtagaagatggggacgcagttctcaacccaacgctccgg

SEQ ID NO: 68327 - DNA, 75 bp, Artificial Sequence
  Synthetic
accagacgaattttgtggtcccctctggcacaccaacacaagcttacataatagcccttggcgcagcgcaaaaga

SEQ ID NO: 68328 - DNA, 75 bp, Artificial Sequence
  Synthetic
gaaccagatgagtacatgattcaggctgcaaaccattatgcggaccagctcagacaattggatattgacacatca

SEQ ID NO: 68329 - DNA, 75 bp, Artificial Sequence
  Synthetic
acaactgaatagtagaagatggggacgcagttctcaacccaacgctccggttcccacgagacaagcaatatcgcg

SEQ ID NO: 68330 - DNA, 75 bp, Artificial Sequence
  Synthetic
aactcaatatggttgcctacggggacgatgtgctcgccagttaccccttccctattgactgcctagaactggcaa

SEQ ID NO: 68331 - DNA, 75 bp, Artificial Sequence
  Synthetic
cacccaccatgtgtaccgcaataaaacttattgtgtccttggaggaatgccctcaggttgctcaggcacctccat

SEQ ID NO: 68332 - DNA, 75 bp, Artificial Sequence
  Synthetic
aaaatgagcatggaggatgcttgttatggaacagaattcctagaaggaattgatttggcaacaagtgcagggtat

SEQ ID NO: 68333 - DNA, 75 bp, Artificial Sequence
  Synthetic
gatttcacacaagacccgggaaaattcacacaacctgtattagatgctctgcgtgaagcagtgccgcccttacaa

SEQ ID NO: 68334 - DNA, 75 bp, Artificial Sequence
  Synthetic
atgcaacctttctcaagcgaggtttcttgcccgatgatcaattcccgttcttgatccaccctaccatgccaatgg

SEQ ID NO: 68335 - DNA, 75 bp, Artificial Sequence
  Synthetic
ccctacaatgcattgggcatcaagaagagagacatcctgaacccccaaaccagagatgtaaccaaaatgaaaatg

SEQ ID NO: 68336 - DNA, 75 bp, Artificial Sequence
  Synthetic
atccttaatatacccacatcagtggatcaacttaaggaccaacaattgtgcaacaataatagtaccttatatcaa

SEQ ID NO: 68337 - DNA, 75 bp, Artificial Sequence
  Synthetic
tcacacaacctgtattagatgctctgcgtgaagcagtgccgcccttacaatcaccaagtgctgaagcttgtggat

SEQ ID NO: 68338 - DNA, 75 bp, Artificial Sequence
  Synthetic
tagagcgttagagcttgtccttagagaggttggctatagtgaggaagcagtctcgctcattgaaggaatcaacca

SEQ ID NO: 68339 - DNA, 75 bp, Artificial Sequence
  Synthetic
aagaaaggaaaatctaggttgattgaagctagtagcattaatgattcagtttaccttagaatgtgctttggccat

SEQ ID NO: 68340 - DNA, 75 bp, Artificial Sequence
  Synthetic
gagctggtggatgagcagggcgttaatttggaactcacattggtgacactagacaccaatgaaaaatttagagat

SEQ ID NO: 68341 - DNA, 75 bp, Artificial Sequence
  Synthetic
cttatgccgagtggccagagtactgccctgatacagacgccaccgcggttgataaacccacccgcccggacgttt

SEQ ID NO: 68342 - DNA, 75 bp, Artificial Sequence
  Synthetic
cgtgtccactggtggtaatgggcttgtcggatttgcagatgtcagagatcttttgtggttggatgaagaagccat

SEQ ID NO: 68343 - DNA, 75 bp, Artificial Sequence
  Synthetic
gatcacgtgcgatccttatgcttattggcgtggcacaacggcaagcaagagtatgaagagtttgtgagcacaatt

SEQ ID NO: 68344 - DNA, 75 bp, Artificial Sequence
  Synthetic
tcattcaccccacgatgccaatgaaggagattcacgagtctattcgttggaccaaagacgcacgaaacacccaag

SEQ ID NO: 68345 - DNA, 75 bp, Artificial Sequence
  Synthetic
ttgactagcaaagacccaaggttggaggttgattttgaacaggctttgttttcaaagtacgtaggaaacacgctc

SEQ ID NO: 68346 - DNA, 75 bp, Artificial Sequence
  Synthetic
tggtcaaaatgcacaataccattacttgtataggtcaggattttgcatccatgttcagtgcaacgcgagcaaatt

SEQ ID NO: 68347 - DNA, 75 bp, Artificial Sequence
  Synthetic
ccctgatacagacgccaccgcggttgataaacccacccgcccggacgtttcagtgaacaggttttatacaatgcc

SEQ ID NO: 68348 - DNA, 75 bp, Artificial Sequence
  Synthetic
gatgtgcttgccagttacccatttccaattgactgcttagagctagcaaaaacaggcaaagagtatggtctgacc

SEQ ID NO: 68349 - DNA, 75 bp, Artificial Sequence
  Synthetic
ttgtataggtcaggattttgcatccatgttcagtgcaacgcgagcaaatttcatcagggcgctctattggtggca

SEQ ID NO: 68350 - DNA, 75 bp, Artificial Sequence
  Synthetic
atcaaccactcccatcacatttacagaaatcaaacgtactgtgtaatgggcggaatgccatctgggtgctctggt

SEQ ID NO: 68351 - DNA, 75 bp, Artificial Sequence
  Synthetic
cattacagtcaccatagctcccatgtgcgcggaatttgcgggtctgcgccaggcagtaaagcaaggcataccaac

SEQ ID NO: 68352 - DNA, 75 bp, Artificial Sequence
  Synthetic
gttacacaacctgggaagaaaggaaaagccttcaggcacccttatgttcttgattgtggtgtgccattgagtcaa

SEQ ID NO: 68353 - DNA, 75 bp, Artificial Sequence
  Synthetic
ttgcctgatgaacagttcccgttcttgattcacccaatcatgccaatgaaggagatccatgaatctatccggtgg

SEQ ID NO: 68354 - DNA, 75 bp, Artificial Sequence
  Synthetic
tgattcacccaatcatgccaatgaaggagatccatgaatctatccggtggaccaaggacgcacgcaacacacaag

SEQ ID NO: 68355 - DNA, 75 bp, Artificial Sequence
  Synthetic
aagccttcaggcacccttatgttcttgattgtggtgtgccattgagtcaagccctcgtgtttccccaccaatgga

SEQ ID NO: 68356 - DNA, 75 bp, Artificial Sequence
  Synthetic
ttggatgagttaaatatgattgcatatggagatgatgttcttgctagttaccccttccctattgactgtgctgaa

SEQ ID NO: 68357 - DNA, 75 bp, Artificial Sequence
  Synthetic
atggagatgatgttcttgctagttaccccttccctattgactgtgctgaacttgcaaaaacaggattagaatatg

SEQ ID NO: 68358 - DNA, 75 bp, Artificial Sequence
  Synthetic
ccccttccctattgactgtgctgaacttgcaaaaacaggattagaatatggtttagtcatgacaccagctgataa

SEQ ID NO: 68359 - DNA, 75 bp, Artificial Sequence
  Synthetic
atcactccaacttttcgttagcagtaatacctgtgtgccctctaaagtataacaccggcgccaccccttccatac

SEQ ID NO: 68360 - DNA, 75 bp, Artificial Sequence
  Synthetic
gactctagagagaataacctctccaactcataatacaacggcaggcaacaccaccgttagcgagcacagcatcgg

SEQ ID NO: 68361 - DNA, 75 bp, Artificial Sequence
  Synthetic
aatacctgtgtgccctctaaagtataacaccggcgccaccccttccataccaattactatcacagtggcgccact

SEQ ID NO: 68362 - DNA, 75 bp, Artificial Sequence
  Synthetic
cttaggaaccacctcataggatctgatggagcagttgagaaaatcctaaagaaccttattaagctgatttcagcg

SEQ ID NO: 68363 - DNA, 75 bp, Artificial Sequence
  Synthetic
gttcctgaccacagatgatggtacatcagcaccaatactaccaggtttccaccccacccccactatccacattcc

SEQ ID NO: 68364 - DNA, 75 bp, Artificial Sequence
  Synthetic
aagacaagaggcttgaggttgattttgaaactgctcttttctctaaatacataggaaacaagatttatgagccag

SEQ ID NO: 68365 - DNA, 75 bp, Artificial Sequence
  Synthetic
ttaaaacagctgtgggttgcacccacccacagggcccactgggcgctagcactctggtactgaggtacctttgtg

SEQ ID NO: 68366 - DNA, 75 bp, Artificial Sequence
  Synthetic
tcagcaccaatactaccaggtttccaccccacccccactatccacattccaggagaagtacatagtctactcgaa

SEQ ID NO: 68367 - DNA, 75 bp, Artificial Sequence
  Synthetic
gtgtcagcccaaagtgcagtggacacattgtgcgcagcatttagagtagacccaggcagggatggcccttggcaa

SEQ ID NO: 68368 - DNA, 75 bp, Artificial Sequence
  Synthetic
cattgtgcgcagcatttagagtagacccaggcagggatggcccttggcaatctactatggtaggtcagttatgca

SEQ ID NO: 68369 - DNA, 75 bp, Artificial Sequence
  Synthetic
tttgatcaaaacattcaaagggatagatctcgatgaattgaacatggtggcctatggggacgatgtgttagctag

SEQ ID NO: 68370 - DNA, 75 bp, Artificial Sequence
  Synthetic
acccacagggcccactgggcgctagcactctgattttacgaaatccttgtgtgcctgttttatatccctgcccta

SEQ ID NO: 68371 - DNA, 75 bp, Artificial Sequence
  Synthetic
tgttagttgcatatacccccccgggtggcgcccaaccggcctcccgagagcttgctatgcttggtactcatgtaa

SEQ ID NO: 68372 - DNA, 75 bp, Artificial Sequence
  Synthetic
tggcgcccaaccggcctcccgagagcttgctatgcttggtactcatgtaatatgggattttggtctgcagtcgtc

SEQ ID NO: 68373 - DNA, 75 bp, Artificial Sequence
  Synthetic
attcgtaacatagaagtaatgcgcaccactgatcaatagcaggcgtaacgcgccagttacgtctcgatcaagcac

SEQ ID NO: 68374 - DNA, 75 bp, Artificial Sequence
  Synthetic
atgccaatgaaggagattcatgagtctatccgttggaccaaagacgcacgaaacacccaagaccacgtgcgctcc

SEQ ID NO: 68375 - DNA, 75 bp, Artificial Sequence
  Synthetic
caccactggtgttgtgacaatatggtaccagaccaatttcgtggtgcctcctgatacccccactagtgcgtacat

SEQ ID NO: 68376 - DNA, 75 bp, Artificial Sequence
  Synthetic
taccagaccaatttcgtggtgcctcctgatacccccactagtgcgtacattttggcctttggagcggggcagaaa

SEQ ID NO: 68377 - DNA, 75 bp, Artificial Sequence
  Synthetic
gggagagcattagctataccaaatttcgagaacctgagaaggaattggctcgaattattttgaaattacagttca

SEQ ID NO: 68378 - DNA, 75 bp, Artificial Sequence
  Synthetic
gtgcgtattctggcgctcctaagcaagtgctcaagaaacctatcctccgtacggcaacggtgcagggacctagcc

SEQ ID NO: 68379 - DNA, 75 bp, Artificial Sequence
  Synthetic
gataccataactaacacagtcaatgccaccatagatagagtgttaaatcgaccgatcacccattctcctacagcc

SEQ ID NO: 68380 - DNA, 75 bp, Artificial Sequence
  Synthetic
ttaaaacagcctgtgggttgcacccactcacagggcccactgggcgcaagcactctggtacctcggtacctttgt

SEQ ID NO: 68381 - DNA, 75 bp, Artificial Sequence
  Synthetic
ccaccatagatagagtgttaaatcgaccgatcacccattctcctacagccgctgatacccaagtgagccaacact

SEQ ID NO: 68382 - DNA, 75 bp, Artificial Sequence
  Synthetic
tgattgagacgagatgcgtggttaacaagaatagtgtggaagaggccagtattaaccactttttctctcgtgcgg

SEQ ID NO: 68383 - DNA, 75 bp, Artificial Sequence
  Synthetic
caggagaagtacgctcattactagaactgtgtagggtggaaaccatactggaagtgaacaacacgaccgatgcaa

SEQ ID NO: 68384 - DNA, 75 bp, Artificial Sequence
  Synthetic
caagaatagtgtggaagaggccagtattaaccactttttctctcgtgcggcattggtcggcaaggtggaattgaa

SEQ ID NO: 68385 - DNA, 75 bp, Artificial Sequence
  Synthetic
agtgattacgacatggttacccttactgcaaccttagcgctgataggttgtcatggcagtccttgggcttggatc

SEQ ID NO: 68386 - DNA, 75 bp, Artificial Sequence
  Synthetic
aaccagctgtcctgcacagtaaagacccccgactcgaggtagattttgagcaggctctgttctctaaatatgtgg

SEQ ID NO: 68387 - DNA, 75 bp, Artificial Sequence
  Synthetic
attggagatgttcacctacatgcgttttaacgcagagttcaccttcgtagcaaccaccagggccgggcaagtacc

SEQ ID NO: 68388 - DNA, 75 bp, Artificial Sequence
  Synthetic
tttaacgcagagttcaccttcgtagcaaccaccagggccgggcaagtaccatctagagtgctccaatacatgtat

SEQ ID NO: 68389 - DNA, 75 bp, Artificial Sequence
  Synthetic
tgttggctttgcagatgtcagggatctcctatggttggatgaagaagctatggagcagggtgtgtccgactacat

SEQ ID NO: 68390 - DNA, 75 bp, Artificial Sequence
  Synthetic
ggttatagcgatcgtgtggcacaactcaccattggaaactccaccatcaccacacaggaagcagcaaatatcata

SEQ ID NO: 68391 - DNA, 75 bp, Artificial Sequence
  Synthetic
agtaaaatgacagacccgccaccacaagtctccgtgcctttcatgtcacctgctagtgcttatcagtggttctat

SEQ ID NO: 68392 - DNA, 75 bp, Artificial Sequence
  Synthetic
tttgtaccattaaccttgaagtctgtgaccactcttaattatatcttgaccctcaatacagcaaaatatgggttc

SEQ ID NO: 68393 - DNA, 75 bp, Artificial Sequence
  Synthetic
aagtctccgtgcctttcatgtcacctgctagtgcttatcagtggttctatgatggataccccacttttggagaac

SEQ ID NO: 68394 - DNA, 75 bp, Artificial Sequence
  Synthetic
acgtgcagtgcaatgctagtaagttccaccaaggagcactcctagtcgctgtcctcccagagtatgtcattggga

SEQ ID NO: 68395 - DNA, 75 bp, Artificial Sequence
  Synthetic
caccattaattactacaaagactcctatgctgccacagcaggcaagcagagtctcaagcaggatccagacaaatt

SEQ ID NO: 68396 - DNA, 75 bp, Artificial Sequence
  Synthetic
gtgaggagaccaccaatgagcgcatcactatcagaatttacatgaggctcaaacacgtccgtgcctgggtcccgc

SEQ ID NO: 68397 - DNA, 75 bp, Artificial Sequence
  Synthetic
cactatcagaatttacatgaggctcaaacacgtccgtgcctgggtcccgcggccactacggtctgaaccatatgt

SEQ ID NO: 68398 - DNA, 75 bp, Artificial Sequence
  Synthetic
gtttggacaccaatcaggagccatatacgtgggcaattacagggtagtaaatagacacctcgccactcacaatga

SEQ ID NO: 68399 - DNA, 75 bp, Artificial Sequence
  Synthetic
tacgtgggcaattacagggtagtaaatagacacctcgccactcacaatgattgggcaaatttagtatgggagagc

SEQ ID NO: 68400 - DNA, 75 bp, Artificial Sequence
  Synthetic
tttgagctgcaacacccgtacgtgcttgatgctgggatccctatatcacaattgacagtgtgccctcaccagtgg

SEQ ID NO: 68401 - DNA, 75 bp, Artificial Sequence
  Synthetic
actaaattgtgggagaaatcgtccaagggatggtactggaagttcccggatgtgttaactgaaaccggggttttt

SEQ ID NO: 68402 - DNA, 75 bp, Artificial Sequence
  Synthetic
attaatctacgaaccaataattgcgccacgataatagtgccatatatgaacacactgccttttgactctgccttg

SEQ ID NO: 68403 - DNA, 75 bp, Artificial Sequence
  Synthetic
ggggtgtactactgcaactcccggagaaaacactacccagttagcttctccaaacccagcctaattttcgtggaa

SEQ ID NO: 68404 - DNA, 75 bp, Artificial Sequence
  Synthetic
gaaaacactacccagttagcttctccaaacccagcctaattttcgtggaagctagtgagtactatcctgcgcgat

SEQ ID NO: 68405 - DNA, 75 bp, Artificial Sequence
  Synthetic
tctatcgatcagggttctgtatccacgtgcaatgcaatgctagtaaattccaccaaggagcgctcctagtcgctg

SEQ ID NO: 68406 - DNA, 75 bp, Artificial Sequence
  Synthetic
ctaatctcagctttagtcatagtcgttaggagtgactatgacatggtcaccctcacagctacgcttgccttgatt

SEQ ID NO: 68407 - DNA, 75 bp, Artificial Sequence
  Synthetic
gcgtcgtcggtatagtgtccactggtggtagtgggcttgttggcttcgcagacgttagggacctcttttggttgg

SEQ ID NO: 68408 - DNA, 75 bp, Artificial Sequence
  Synthetic
gtctgactacattaagggcctcggggacgcttttgggactggtttcactgatgcagtctctagagaggtcgaggc

SEQ ID NO: 68409 - DNA, 75 bp, Artificial Sequence
  Synthetic
agagtctatgccctagagaaaaggatgaacaactacatgcagttcaagagcaaacaccgtattgaacctgtatgt

SEQ ID NO: 68410 - DNA, 75 bp, Artificial Sequence
  Synthetic
cactccggtactgaggtacctttgtgcgcctgttttacttcccttccccaaaagtaacttagaagctttgaacca

SEQ ID NO: 68411 - DNA, 75 bp, Artificial Sequence
  Synthetic
gtgacctattagtgtcgtccaccaccgctcagggctgtgatacaattgcacgttgtgattgtcaaacaggagtgt

SEQ ID NO: 68412 - DNA, 75 bp, Artificial Sequence
  Synthetic
aatcgtctgtcacccttgtgataccatggattagtaacactcactacagagcgcatgcccgagatggggtgttcg

SEQ ID NO: 68413 - DNA, 75 bp, Artificial Sequence
  Synthetic
tcgagctggacggcgacgtaaacggccacaagttcagcgtgtccggcgagggcgagggcgatgccacctacggca

SEQ ID NO: 68414 - DNA, 75 bp, Artificial Sequence
  Synthetic
ccacaagttcagcgtgtccggcgagggcgagggcgatgccacctacggcaagctgaccctgaagttcatctgcac

SEQ ID NO: 68415 - DNA, 75 bp, Artificial Sequence
  Synthetic
attactataccacaggactggttagtatctggtatcagacaaactacgtggttccaattggggcgcctaacacag

SEQ ID NO: 68416 - DNA, 75 bp, Artificial Sequence
  Synthetic
gttccaattggggcgcctaacacagcttacataatagcactggcggcagcccaaaagaatttcaccatgaagctg

SEQ ID NO: 68417 - DNA, 75 bp, Artificial Sequence
  Synthetic
ccagaagcagagtgcttcttggctaaagaagttcaatgatatggcgagtgccgccaagggtttagagtggatatc

SEQ ID NO: 68418 - DNA, 75 bp, Artificial Sequence
  Synthetic
ccccgaccacatgaagcagcacgacttcttcaagtccgccatgcccgaaggctacgtccaggagcgcaccatctt

SEQ ID NO: 68419 - DNA, 75 bp, Artificial Sequence
  Synthetic
ttcttcaagtccgccatgcccgaaggctacgtccaggagcgcaccatcttcttcaaggacgacggcaactacaag

SEQ ID NO: 68420 - DNA, 75 bp, Artificial Sequence
  Synthetic
atggtgcgaagagtctattgagctagttagtagtcctccggcccctgaatgcggctaatcctaactgcggagcac

SEQ ID NO: 68421 - DNA, 75 bp, Artificial Sequence
  Synthetic
gacggcaacatcctggggcacaagctggagtacaactacaacagccacaacgtctatatcatggccgacaagcag

SEQ ID NO: 68422 - DNA, 75 bp, Artificial Sequence
  Synthetic
gaccactttgatggttataagcagcaagtggtcactgtcatggatgatctatgtcaaaaccccgatggcaaggac

SEQ ID NO: 68423 - DNA, 75 bp, Artificial Sequence
  Synthetic
tggagtacaactacaacagccacaacgtctatatcatggccgacaagcagaagaacggcatcaaggtgaacttca

SEQ ID NO: 68424 - DNA, 75 bp, Artificial Sequence
  Synthetic
tccctcttgagggtactactaacccaaatggttatgctaactgggatatagacataactggctacgcacagatgc

SEQ ID NO: 68425 - DNA, 75 bp, Artificial Sequence
  Synthetic
aaatggttatgctaactgggatatagacataactggctacgcacagatgcgcaggaaagtggagctattcactta

SEQ ID NO: 68426 - DNA, 75 bp, Artificial Sequence
  Synthetic
gccccgtgctgctgcccgacaaccactacctgagcacccagtccgccctgagcaaagaccccaacgagaagcgcg

SEQ ID NO: 68427 - DNA, 75 bp, Artificial Sequence
  Synthetic
agttcaagcctataagaattagccttgaagaaaagccagccccggatgccattagcgacctacttgctagtgtgg

SEQ ID NO: 68428 - DNA, 75 bp, Artificial Sequence
  Synthetic
gacgctgggcgggccgcaaaactgtgctctgagaataacactgcgaacttcaaacgttgcagtcccctagtatgt

SEQ ID NO: 68429 - DNA, 75 bp, Artificial Sequence
  Synthetic
acctcaacagagcagtgttggtgatgcagtccatcgccaccgtggttgcagttgtgtctcttgtctatgtcattt

SEQ ID NO: 68430 - DNA, 75 bp, Artificial Sequence
  Synthetic
cttggcagactgctacaaacccctcagtttttgtcaagttaactgatcccccagcacaggtctcagttccattta

SEQ ID NO: 68431 - DNA, 75 bp, Artificial Sequence
  Synthetic
tacagcgaccgagtagcacagctaactattggcaactctaccatcactacacaagaagcggcaaacattatagtt

SEQ ID NO: 68432 - DNA, 75 bp, Artificial Sequence
  Synthetic
gcctgttttacctcccttccccaaaagtaacttagaagctttgaactaatgatcaatagtaggtgtggcagacca

SEQ ID NO: 68433 - DNA, 75 bp, Artificial Sequence
  Synthetic
gtttacatgaaactgaagcatgtgcgagcatgggtaccgcgacccataaggtcacagccttacgtcttgaagaac

SEQ ID NO: 68434 - DNA, 75 bp, Artificial Sequence
  Synthetic
atcccttagttatcagaatatatatgagaatgaagcatgtcagggcatggatacctcgtccaatgcgcaaccaaa

SEQ ID NO: 68435 - DNA, 75 bp, Artificial Sequence
  Synthetic
ctacagtggtagctgtcgtctcactagtgtatgtcatctacaagctctttgcaggattccagggtgcatattctg

SEQ ID NO: 68436 - DNA, 75 bp, Artificial Sequence
  Synthetic
ttatcgccatgggggctgctcaagacaacttcaccttgaagatatgtaaagacacggatgaggttacccaacaag

SEQ ID NO: 68437 - DNA, 75 bp, Artificial Sequence
  Synthetic
tccatcaaggagcactcctagttgctgtcctcccggagtacgttattggaacagtggcgggtggcacagggacgg

SEQ ID NO: 68438 - DNA, 75 bp, Artificial Sequence
  Synthetic
agggctgtgacacaatcgcgcgttgcaattgtcaaacaggagtgtactattgcaactcaaagaggaagcactacc

SEQ ID NO: 68439 - DNA, 75 bp, Artificial Sequence
  Synthetic
cagtcagcttttcaaaacccagcctcatatatgtggaagctagtgagtattaccctgctagataccaatcacact

SEQ ID NO: 68440 - DNA, 75 bp, Artificial Sequence
  Synthetic
gattgcttggagttagcaaagactggcaaggagtatggtctaaccatgactcctgcagataagtctccttgcttt

SEQ ID NO: 68441 - DNA, 75 bp, Artificial Sequence
  Synthetic
attggcattcacatagggggtaatggcaggcaaggtttctgtgcgggacttaagagaagctattttgctagtgaa

SEQ ID NO: 68442 - DNA, 75 bp, Artificial Sequence
  Synthetic
gttctgagttcgcaggtcttaggcaagcagtcacgcaagggttccctactgaattgaaacctggcacaaaccaat

SEQ ID NO: 68443 - DNA, 75 bp, Artificial Sequence
  Synthetic
ctcctgtggttagatgaagaagccatggagcaaggtgtgtccgactacatcaagggactcggtgacgcattcgga

SEQ ID NO: 68444 - DNA, 75 bp, Artificial Sequence
  Synthetic
tggaggaagcatgctacggcactgaatatctagaggctatagacttgcacaccagtgccgggtacccctatagtg

SEQ ID NO: 68445 - DNA, 75 bp, Artificial Sequence
  Synthetic
cgagtacgtgacacaggctgctctccactatgcaaatcagctaaagcaattagacataaacactaataagatgag

SEQ ID NO: 68446 - DNA, 75 bp, Artificial Sequence
  Synthetic
aagagaagctactttgctagtgaacaaggggagatccaatgggttaaacctaataaagaaacagggaggcttaac

SEQ ID NO: 68447 - DNA, 75 bp, Artificial Sequence
  Synthetic
tgggtaattacagagtggtgaatagacacctcgccacccacaacgattggactaatctagtgtgggaggacagta

SEQ ID NO: 68448 - DNA, 75 bp, Artificial Sequence
  Synthetic
ctaccactagagacgtgagcaagatgaagttttacatggataagtatggccttgacctcccttactccacctatg

SEQ ID NO: 68449 - DNA, 75 bp, Artificial Sequence
  Synthetic
gaagttttacatggataagtatggccttgacctcccttactccacctatgtcaaagacgagctccgctcgataga

SEQ ID NO: 68450 - DNA, 75 bp, Artificial Sequence
  Synthetic
cagggcgtgtccgattacatcaagggtctcggagatgctttcgggacaggcttcactgatgcagtctcgagggaa

SEQ ID NO: 68451 - DNA, 75 bp, Artificial Sequence
  Synthetic
cggtaccgctcctagctctcacaggttggagactggtcgtgttcccgccctacaagcagcagaaactggagccac

SEQ ID NO: 68452 - DNA, 75 bp, Artificial Sequence
  Synthetic
taggatctgaaggagcagttgagaaaattttaaaaaacctcattaaactaatctctgcactggtgattgtaatca

SEQ ID NO: 68453 - DNA, 75 bp, Artificial Sequence
  Synthetic
ccagtggtcagggtcactggaggtcacttttatgtttaccgggtcttttatggccacgggtaaaatgctcatagc

SEQ ID NO: 68454 - DNA, 75 bp, Artificial Sequence
  Synthetic
gaatcagatcacaaatttagaacaatccgctgcctcacaagaggatcttgaagcaatgtttgggaatgtgtcata

SEQ ID NO: 68455 - DNA, 75 bp, Artificial Sequence
  Synthetic
atgcaagtctcagcccagtgtggtttagagctttagaggtggttctccgagagatcggctactcagaggaggctg

SEQ ID NO: 68456 - DNA, 75 bp, Artificial Sequence
  Synthetic
tcagacccagaccactttgacggataccaacaacagatcgtcactgctatggacgacctatgccagaatccagac

SEQ ID NO: 68457 - DNA, 75 bp, Artificial Sequence
  Synthetic
accaacaacagatcgtcactgctatggacgacctatgccagaatccagacggcaaagacatgtcattattttgtc

SEQ ID NO: 68458 - DNA, 75 bp, Artificial Sequence
  Synthetic
tgaaggaatcaaccacacacaccatgtgtaccgcaacaagacttattgtgtgcttggtgggatgccctcgggttg

SEQ ID NO: 68459 - DNA, 75 bp, Artificial Sequence
  Synthetic
ttgtgattgcatcctctaccgccagtaccatcatagtgccaacagtctcggattcagatgccatccgtcgcaggt

SEQ ID NO: 68460 - DNA, 75 bp, Artificial Sequence
  Synthetic
gttaaatatggtagatcatggagatgatgtgttagctagctacccgttccctattgactgctcggagttagctga

SEQ ID NO: 68461 - DNA, 75 bp, Artificial Sequence
  Synthetic
cactccaagccgctgaaattggagcatcatcaaatgctagtgacgagagtatgattgagacacggtgtgttctta

SEQ ID NO: 68462 - DNA, 75 bp, Artificial Sequence
  Synthetic
ctattgactgctcggagttagctgaacagggtaaagagtatcgactgacaatgacacccgatgacaagtcgtcct

SEQ ID NO: 68463 - DNA, 75 bp, Artificial Sequence
  Synthetic
tgggctcacaggtgtccacacaacgctccggctcgcatgaaaactctaactcagctactgagggttctaccataa

SEQ ID NO: 68464 - DNA, 75 bp, Artificial Sequence
  Synthetic
actgaaacctggcacaaaccaattcttgaccactgacgatggtgtctcagcacccattctaccaaacttccaccc

SEQ ID NO: 68465 - DNA, 75 bp, Artificial Sequence
  Synthetic
tcagactgtgctctgaagacagcactgcaaactttaaacggtgcagtccattagtctgtgggaaagcaatccagc

SEQ ID NO: 68466 - DNA, 75 bp, Artificial Sequence
  Synthetic
atgattgagacacggtgtgttcttaattcgcacagcacagctgagaccactctcgatagtttcttcagcagagcg

SEQ ID NO: 68467 - DNA, 75 bp, Artificial Sequence
  Synthetic
ctagcaacattatagtgccaacagtgtctgactctgacgccatccgtcgcaggttttacatggattgtgatattg

SEQ ID NO: 68468 - DNA, 75 bp, Artificial Sequence
  Synthetic
gaaaggtggagttgttcacctacatgcgttttgacgcagagttcacctttgttgcatgcacacccaccggggagg

SEQ ID NO: 68469 - DNA, 75 bp, Artificial Sequence
  Synthetic
aacacacctcaaccccaccagaaatctggtcgtgaatatgactggtgggggtaaatttgttataaccagaatagc

SEQ ID NO: 68470 - DNA, 75 bp, Artificial Sequence
  Synthetic
tagttaccctttcccaattgattgtctggaactagcaagaacgggtaaagagtatggtctgactatgacccctgc

SEQ ID NO: 68471 - DNA, 75 bp, Artificial Sequence
  Synthetic
ggcaaactgccaccaatccctcggtttttgttaagttgtcagatcccccagcacaggtctcagttccattcatgt

SEQ ID NO: 68472 - DNA, 75 bp, Artificial Sequence
  Synthetic
gagttcagggatggattgtagctgattctcccaccaacgttgagcgacacttcaacagagtggtgctagtcatgc

SEQ ID NO: 68473 - DNA, 75 bp, Artificial Sequence
  Synthetic
cacccgcgagcgcctatcaatggttctatgacggataccccacgttcggtgagcacaagcaggagaaagaccttg

SEQ ID NO: 68474 - DNA, 75 bp, Artificial Sequence
  Synthetic
ttggtgggtgttgtcaatctaactgacggaggcaccgatacaacgggatatgcagtgtgggacattgacatcatg

SEQ ID NO: 68475 - DNA, 75 bp, Artificial Sequence
  Synthetic
acagactcatataaaacagatctaggcagactggatgctgggcgggccgccaaattgtgctccgagaacaacacc

SEQ ID NO: 68476 - DNA, 75 bp, Artificial Sequence
  Synthetic
ccaatttttaactactgacgacggtgtttcagcgcccattttgccaaactttcaccccactccatgtattcatat

SEQ ID NO: 68477 - DNA, 75 bp, Artificial Sequence
  Synthetic
cagttgtctcactggtgtacgtcatttataagctctttgcagggttccaaggtgcgtattctggtgcccctaagc

SEQ ID NO: 68478 - DNA, 75 bp, Artificial Sequence
  Synthetic
atatatatgagaatgaagcatgtcagggcatggatacctcgcccgatgcgcaaccaaaactacttgttcaaagcc

SEQ ID NO: 68479 - DNA, 75 bp, Artificial Sequence
  Synthetic
agctcaagtgtcagtccccttcatgtcaccagccagtgcataccaatggttttatgatggttatcccaccttcgg

SEQ ID NO: 68480 - DNA, 75 bp, Artificial Sequence
  Synthetic
gctagtgatgcacctttaggtataaatactgaacatatgcccagtatggttgagacagttggagatgtcgctcag

SEQ ID NO: 68481 - DNA, 75 bp, Artificial Sequence
  Synthetic
gctagtgatgcacctttaggtataaatactgaacatatgcccagtatggttgagtcagttggagatgtcgctcag

SEQ ID NO: 68482 - DNA, 75 bp, Artificial Sequence
  Synthetic
gctagtgatgcacctttaggtataaatactgaacatatgcccagtatggttgagccagttggagatgtcgctcag

SEQ ID NO: 68483 - DNA, 75 bp, Artificial Sequence
  Synthetic
gctagtgatgcacctttaggtataaatactgaacatatgcccagtatggttgaggcagttggagatgtcgctcag

SEQ ID NO: 68484 - DNA, 75 bp, Artificial Sequence
  Synthetic
actcccaccaacgtggaacggcaccttaatagagcagtgcttatcttgcaatccattgccacagtggtggcggtt

SEQ ID NO: 68485 - DNA, 75 bp, Artificial Sequence
  Synthetic
ggtgtcagagaccgcttggccgttctcccacggcactcgcaacctgggaagaccatttgggtggagcacaaactt

SEQ ID NO: 68486 - DNA, 75 bp, Artificial Sequence
  Synthetic
tgagacagttggagatgtcgctcagtatgggtttttggaccataggggtaaggccactcacaggactatgatgta

SEQ ID NO: 68487 - DNA, 75 bp, Artificial Sequence
  Synthetic
tgagtcagttggagatgtcgctcagtatgggtttttggaccataggggtaaggccactcacaggactatgatgta

SEQ ID NO: 68488 - DNA, 75 bp, Artificial Sequence
  Synthetic
tgagccagttggagatgtcgctcagtatgggtttttggaccataggggtaaggccactcacaggactatgatgta

SEQ ID NO: 68489 - DNA, 75 bp, Artificial Sequence
  Synthetic
tgaggcagttggagatgtcgctcagtatgggtttttggaccataggggtaaggccactcacaggactatgatgta

SEQ ID NO: 68490 - DNA, 75 bp, Artificial Sequence
  Synthetic
ctacgtagaggccagtgagtattacccagctaggtatcagtcacacctcatgcttgcagtgggtcactcagaacc

SEQ ID NO: 68491 - DNA, 75 bp, Artificial Sequence
  Synthetic
tgaaaactccaattcagccacagaaggctccactattaattacaccactattaactactacaaagattcctatgc

SEQ ID NO: 68492 - DNA, 75 bp, Artificial Sequence
  Synthetic
tgtttgtcccagtgggggatgtcgtacagtatggattcttgaaccttagtggtaaaccaacccataggaccatga

SEQ ID NO: 68493 - DNA, 75 bp, Artificial Sequence
  Synthetic
ttggcggtaatgggcgtcaaggattctgtgctggtttgaagaggagttacttcgcaagtgaacaaggtgagatcc

SEQ ID NO: 68494 - DNA, 75 bp, Artificial Sequence
  Synthetic
atctgctatagctctagcaataatccctgttgccaaggactttccagtgccgggtgagcctctgatgattaagca

SEQ ID NO: 68495 - DNA, 75 bp, Artificial Sequence
  Synthetic
catttatgttacagtatatgtatgtacctccaggtgcccctaagccaacgggtagagatgcttttcagtggcaaa

SEQ ID NO: 68496 - DNA, 75 bp, Artificial Sequence
  Synthetic
ggtgtcatgggagcccttgggcctggatcaagtcgaaaacagcttcaattttgggtataccaatggcccagaagc

SEQ ID NO: 68497 - DNA, 75 bp, Artificial Sequence
  Synthetic
atagcttatacacctcctggcggccccttacccaaagatcgagctacagcaatgctgggcacacatgttatctgg

SEQ ID NO: 68498 - DNA, 75 bp, Artificial Sequence
  Synthetic
atgcttgctgtgggccactcggaacctggtgactgcggtggcattctcaggtgccaacacggtgtaataggaatt

SEQ ID NO: 68499 - DNA, 75 bp, Artificial Sequence
  Synthetic
aaagatcctagattggaggttgattttgaacaagccctattctccaagtatgtgggcaatgtattgcatgaacct

SEQ ID NO: 68500 - DNA, 75 bp, Artificial Sequence
  Synthetic
gtgcggactgtaggaacctcgaagtccaagtacccactggtgatcaggatttacatgaggatgaagcacgtcagg

SEQ ID NO: 68501 - DNA, 75 bp, Artificial Sequence
  Synthetic
ccaaaagagtctatactttagagaagaggatgaacaattacatgcagttcaagagcaaacaccgtattgaacctg

SEQ ID NO: 68502 - DNA, 75 bp, Artificial Sequence
  Synthetic
agcatggaggaggcatgttatggtacggaaaacctggaagcgatagacctccacaccagtgcagggtacccatat

SEQ ID NO: 68503 - DNA, 75 bp, Artificial Sequence
  Synthetic
gcacccaacacagcttacataatagcactggcggcggcccagaagaattttaccatgaaactgtgcaaggacact

SEQ ID NO: 68504 - DNA, 75 bp, Artificial Sequence
  Synthetic
ccacaccagtgcagggtacccatatagcgctctgggaatcaagaaaagagacatcctcgacccattgaccaggga

SEQ ID NO: 68505 - DNA, 75 bp, Artificial Sequence
  Synthetic
actgttagagaaccagatcacaaatttggaacagtctgctgcctcacaagaagaccttgaagccatgtttgggaa

SEQ ID NO: 68506 - DNA, 75 bp, Artificial Sequence
  Synthetic
caccaagctagagcccagtgtgttccatgatgtcttcgagggaaacaaggaaccggctgtcttgcacagtaaaga

SEQ ID NO: 68507 - DNA, 75 bp, Artificial Sequence
  Synthetic
cactggttcagctgttgggtgcaacccagatgtgttctggagcaagttaccaattctacttccaggatcgctttt

SEQ ID NO: 68508 - DNA, 75 bp, Artificial Sequence
  Synthetic
gggaagacagctcccgcgacttgctcgtgtcatccaccaccgctcagggttgtgacacaattgcccgctgcgatt

SEQ ID NO: 68509 - DNA, 75 bp, Artificial Sequence
  Synthetic
gggaagtcacgcctgatagaggctagtagcttgaatgattctgtttatctcagaatgacctttggacatctttac

SEQ ID NO: 68510 - DNA, 75 bp, Artificial Sequence
  Synthetic
gagaaaagaatgaacaactacatgcagttcaagagcaaacaccgaattgaacctgtatgtcttattattaggggt

SEQ ID NO: 68511 - DNA, 75 bp, Artificial Sequence
  Synthetic
cgcacctcatgcttgcagtgggtcactcagaaccaggggattgcggtggcattcttagatgccaacacggcgtcg

SEQ ID NO: 68512 - DNA, 75 bp, Artificial Sequence
  Synthetic
gggctgtggataaaatattgaagaatttggtgaaacttatttcagccttggttatagtcattaggagcgactatg

SEQ ID NO: 68513 - DNA, 75 bp, Artificial Sequence
  Synthetic
atatggtcttgatctcccttactccacttatgtcaaggatgagcttcgctcaattgataaaattaagaaagggaa

SEQ ID NO: 68514 - DNA, 75 bp, Artificial Sequence
  Synthetic
ctgtggattttatcccaccaatggcttctcttgaagagaagggagtttcttttacatctaaatttgttatcgcat

SEQ ID NO: 68515 - DNA, 75 bp, Artificial Sequence
  Synthetic
atacaagcaacaagtagtcactgttatggatgatctctgtcaaaacccagatggaaaggacatgtcactattttg

SEQ ID NO: 68516 - DNA, 75 bp, Artificial Sequence
  Synthetic
ggattcagatgccatccgtcgtcggttctttatggactgcgatattgaagtgaccgattcctataagacagattt

SEQ ID NO: 68517 - DNA, 75 bp, Artificial Sequence
  Synthetic
gccttggcgatgctttcggcatggggttcacagacgcggtaacgagagaggttgaagccctaaaaaatcacttaa

SEQ ID NO: 68518 - DNA, 75 bp, Artificial Sequence
  Synthetic
actcctactggtgaggttgttccacaattactccagtatatgtttgtcccccctggtgctcctaaaccagattct

SEQ ID NO: 68519 - DNA, 75 bp, Artificial Sequence
  Synthetic
cgggtatccaacatttggacaacacccggaaacatctaatacaacatatggacagtgccctaacaacatgatggg

SEQ ID NO: 68520 - DNA, 75 bp, Artificial Sequence
  Synthetic
tcagttccgttcatgtcacccgcgagcgcctaccagtggttttacgacgggtaccccacgtttggagaacacaaa

SEQ ID NO: 68521 - DNA, 75 bp, Artificial Sequence
  Synthetic
atgatgtgctagctagttatcctttccctattgactgccttgaactagctaggactggtaaggagtatggattga

SEQ ID NO: 68522 - DNA, 75 bp, Artificial Sequence
  Synthetic
gatacagtgtggacacagtggtgagtgagctcatcagggagtacaacagcagatcagccattgggaataccattg

SEQ ID NO: 68523 - DNA, 75 bp, Artificial Sequence
  Synthetic
agatcagccattgggaataccattgaagctctttttcaggggccccccaaatttagaccgataaggattagtctg

SEQ ID NO: 68524 - DNA, 75 bp, Artificial Sequence
  Synthetic
aaaggttgagttcttaaacaatttaaagcaacttcctttactggagaatcagatctccaatcttgaacaatcggc

SEQ ID NO: 68525 - DNA, 75 bp, Artificial Sequence
  Synthetic
tagtgaagaggttcgccaatactgcagagaacaaggatggattgtgcctgacactcctaccaacgttgagcgcca

SEQ ID NO: 68526 - DNA, 75 bp, Artificial Sequence
  Synthetic
gaacagtcagcagcttcgcaggaggaccttgaagcgatgttcggcaacgtgtcttatctggcccacttctgccgc

SEQ ID NO: 68527 - DNA, 75 bp, Artificial Sequence
  Synthetic
ccaaatggttatgccaactgggatatagacataactggttatgcacaaatgcgcaggaaagtggagctgttcacc

SEQ ID NO: 68528 - DNA, 75 bp, Artificial Sequence
  Synthetic
agcaactgtgcagggaccgagcttggacttcgccctatctctacttaggaggaacattaggcaggtccaaaccga

SEQ ID NO: 68529 - DNA, 75 bp, Artificial Sequence
  Synthetic
cctgccggcacccacaggacaaaacacacaggtgagcagccatcgactagacaccggtgaagttccagcgctcca

SEQ ID NO: 68530 - DNA, 75 bp, Artificial Sequence
  Synthetic
aaggacgcgcgaaacactcaagaccatgtgcggtccttgtgtctcttagcatggcacaatggtaagcaagagtat

SEQ ID NO: 68531 - DNA, 75 bp, Artificial Sequence
  Synthetic
tcaccaatttccattccttatccaccccaccatgcccatgagggagatccatgagtccattcgttggactaagga

SEQ ID NO: 68532 - DNA, 75 bp, Artificial Sequence
  Synthetic
ccagacactcccaaccaggaaagaccatctgggttgagcacaaactagtgaagatcgtagatgctgtggagttag

SEQ ID NO: 68533 - DNA, 75 bp, Artificial Sequence
  Synthetic
ggaaagatatgtcactattttgtcagatggtgtccacagtggacttcataccacctatggcatctttggaggaga

SEQ ID NO: 68534 - DNA, 75 bp, Artificial Sequence
  Synthetic
ggcacaaaagcaaagcgcctcctggctaaagaaattcaatgacatggctaacgctgcgaagggcctcgaatggat

SEQ ID NO: 68535 - DNA, 75 bp, Artificial Sequence
  Synthetic
cgccgtcggttctttatggactgtgacattgaggtaactgactcctacaagacagaactgggtaggctcgatgca

SEQ ID NO: 68536 - DNA, 75 bp, Artificial Sequence
  Synthetic
accgactcctacaagacagatttgggcagacttgatgcagggagagcagctaggttgtgctctgagaataacacc

SEQ ID NO: 68537 - DNA, 75 bp, Artificial Sequence
  Synthetic
tcctccggcccctgaatgcggctaatcccaaccacggagcaggcgctcacactccagtgagtagcctgtcgtaat

SEQ ID NO: 68538 - DNA, 75 bp, Artificial Sequence
  Synthetic
gtgcagtccattggtctgcgggaaagcaatccagcttagggataggaagtccaaggtgagatacagtttggacac

SEQ ID NO: 68539 - DNA, 75 bp, Artificial Sequence
  Synthetic
ggcaaagtgattgggatccatattggtggtaatggtaggcaaggcttctgcgctgctctgaagagagggtacttt

SEQ ID NO: 68540 - DNA, 75 bp, Artificial Sequence
  Synthetic
tccaccaaggaaccctactagtagctgccctaccagaatatgtgaatgcacgctctgatgccacgacggacccca

SEQ ID NO: 68541 - DNA, 75 bp, Artificial Sequence
  Synthetic
attcttatcatggctgcttatggtgacaatctaagattgttatcatatagctattggattggccatccggtgaac

SEQ ID NO: 68542 - DNA, 75 bp, Artificial Sequence
  Synthetic
cagtttttgtcaagctgtcagaccctccagcgcaggtttcagtaccattcatgtcacctgcgagtgcttatcaat

SEQ ID NO: 68543 - DNA, 75 bp, Artificial Sequence
  Synthetic
accccctaaatttagaccgataaggattagcctagaggagaagcctgcacctgatgctattagtgacctattagc

SEQ ID NO: 68544 - DNA, 75 bp, Artificial Sequence
  Synthetic
aaagaaactgggagactcaacatcaatgggccaactcgcactaagctcgaacccagtgtatttcatgatgttttt

SEQ ID NO: 68545 - DNA, 75 bp, Artificial Sequence
  Synthetic
aatgggagctcaagtgtctactcaaaagaccgggtctcacgagaatcagaatgttgctgctaatggttccaccat

SEQ ID NO: 68546 - DNA, 75 bp, Artificial Sequence
  Synthetic
aagaccgggtctcacgagaatcagaatgttgctgctaatggttccaccataaattataccactattaattattac

SEQ ID NO: 68547 - DNA, 75 bp, Artificial Sequence
  Synthetic
agaacctggaagctatagatcttcacactagtgcaggatacccatacagtgcgctaggaatcaagaagagggata

SEQ ID NO: 68548 - DNA, 75 bp, Artificial Sequence
  Synthetic
atgagcctgatgagtacattaaggaggcagctcttcactatgcaaatcagttgaaacagctagacattgacacct

SEQ ID NO: 68549 - DNA, 75 bp, Artificial Sequence
  Synthetic
gatgcattgaaggaaaccgcaccacccttgaaatccccgtctgctgaagcatgtggttatagtgatagggtagca

SEQ ID NO: 68550 - DNA, 75 bp, Artificial Sequence
  Synthetic
cagtaaaatgaaattttacatggataagtatgggttggatctcccatattctacttatgttaaagatgaactcag

SEQ ID NO: 68551 - DNA, 75 bp, Artificial Sequence
  Synthetic
ccttgaaatccccgtctgctgaagcatgtggttatagtgatagggtagcacaattgactgtaggaaattccacaa

SEQ ID NO: 68552 - DNA, 75 bp, Artificial Sequence
  Synthetic
ttctaaacccagcctcatatacgtggatgctagcgagtattaccctgctagataccaatcgcacctgatgcttgc

SEQ ID NO: 68553 - DNA, 75 bp, Artificial Sequence
  Synthetic
ctgcagtagataaacccactcgccctgatgtatctgttaacaggttctataccttaccagccaaattatggacca

SEQ ID NO: 68554 - DNA, 75 bp, Artificial Sequence
  Synthetic
gatgacatttgggcacctttatgaaaccttccacgccaatccaggtacagtcaccggttcagctgttggatgtaa

SEQ ID NO: 68555 - DNA, 75 bp, Artificial Sequence
  Synthetic
gatctgccatactccacctatgtgaaggatgagcttaggcctctggataaaattaagaagggaaagtcacgcctg

SEQ ID NO: 68556 - DNA, 75 bp, Artificial Sequence
  Synthetic
tgatgtatctgttaacaggttctataccttaccagccaaattatggaccaaagaaggaacaggctctaagggatg

SEQ ID NO: 68557 - DNA, 75 bp, Artificial Sequence
  Synthetic
gtcaggattctgcattcatgtgcagtgcaatgctagtaagtttcaccaaggtacactattagttgcttgcctccc

SEQ ID NO: 68558 - DNA, 75 bp, Artificial Sequence
  Synthetic
tgcaatgctagtaagtttcaccaaggtacactattagttgcttgcctcccagagtatgttaatgctcgtgcaagt

SEQ ID NO: 68559 - DNA, 75 bp, Artificial Sequence
  Synthetic
actttcccatatgtgttggatgcaggaatacccattaatcagctgttaatcgcaccacaccaatggattaatttg

SEQ ID NO: 68560 - DNA, 75 bp, Artificial Sequence
  Synthetic
gaatacccattaatcagctgttaatcgcaccacaccaatggattaatttgcgcacaaataattgtgccactatag

SEQ ID NO: 68561 - DNA, 75 bp, Artificial Sequence
  Synthetic
gtgaagcccaacaaagaaactggtaggctgaacattaatgggcccactcgcaccaagcttgaaccaagtgtcttt

SEQ ID NO: 68562 - DNA, 75 bp, Artificial Sequence
  Synthetic
agaaactggcaggttgaacatcaacggacctactcgcactaagcttgaaccaagtgtcttccacgatgtgttcga

SEQ ID NO: 68563 - DNA, 75 bp, Artificial Sequence
  Synthetic
aaccagcagtgttgaccaacaaagaccctaggttggaagttgattttgagcaggctttgttctcaaaatacgtgg

SEQ ID NO: 68564 - DNA, 75 bp, Artificial Sequence
  Synthetic
tagcacccctcaattattctgacggtgcgacaacagccatacccatcacagttactattgcccctctttgctcag

SEQ ID NO: 68565 - DNA, 75 bp, Artificial Sequence
  Synthetic
tgcgacaacagccatacccatcacagttactattgcccctctttgctcagagtttggaggccttagacaggctat

SEQ ID NO: 68566 - DNA, 75 bp, Artificial Sequence
  Synthetic
ccccggactgagtatcaatagactgctcacgcggttgaaggagaaaacgttcgttacccggctaactacttcgag

SEQ ID NO: 68567 - DNA, 75 bp, Artificial Sequence
  Synthetic
aatactgcctggtttccaccctactccagcaattcacatccctggcgaggtacataacctgttagagattgcaca

SEQ ID NO: 68568 - DNA, 75 bp, Artificial Sequence
  Synthetic
gcatggcacaatgggaaagaggagtatgaaaaatttgtaagcacaattagatcggttccaattgggaaagcatta

SEQ ID NO: 68569 - DNA, 75 bp, Artificial Sequence
  Synthetic
ccagcaattcacatccctggcgaggtacataacctgttagagattgcacaagttgaaagcatacttgaggttaat

SEQ ID NO: 68570 - DNA, 75 bp, Artificial Sequence
  Synthetic
gatactttatgtgccagctttaaagttgatcctggcagggatggaccatggcaatctacattagtcgggcaaatt

SEQ ID NO: 68571 - DNA, 75 bp, Artificial Sequence
  Synthetic
ttgatcctggcagggatggaccatggcaatctacattagtcgggcaaatttgcaaatattacacacaatggtctg

SEQ ID NO: 68572 - DNA, 75 bp, Artificial Sequence
  Synthetic
gagaagaaacattaggcaagtccaaacagatcaggggcattttaccatgttaggtgtcagggatcgcttagctgt

SEQ ID NO: 68573 - DNA, 75 bp, Artificial Sequence
  Synthetic
acctcaaccccaccaggaatctggtcgtgaacatgactggtgggggtaaatttgttataaccagaatagcaaaaa

SEQ ID NO: 68574 - DNA, 75 bp, Artificial Sequence
  Synthetic
caggaggtgcacaacccactacaagagaccttgcaatgttgggcacacacgttatctgggactttggtttacaat

SEQ ID NO: 68575 - DNA, 75 bp, Artificial Sequence
  Synthetic
agaccttgcaatgttgggcacacacgttatctgggactttggtttacaatcatcaatcaccctagtgataccttg

SEQ ID NO: 68576 - DNA, 75 bp, Artificial Sequence
  Synthetic
aactgtaagaaatggggtcacaagtctccacccagcgatccgggtcacatgagaactcaaactctgcatcggagg

SEQ ID NO: 68577 - DNA, 75 bp, Artificial Sequence
  Synthetic
ttggtaccaaacaaattttgtggtgccatctggagcccctaccagtgcatacatcattgcactaggtgcagcaca

SEQ ID NO: 68578 - DNA, 75 bp, Artificial Sequence
  Synthetic
ccatctggagcccctaccagtgcatacatcattgcactaggtgcagcacagaaaaatttcactctcagattgtgc

SEQ ID NO: 68579 - DNA, 75 bp, Artificial Sequence
  Synthetic
gtcaaaatgctcagttccactacctgtatcgatctgggttttgcgtgcacgttcagtgcaacgctagtaaatttc

SEQ ID NO: 68580 - DNA, 75 bp, Artificial Sequence
  Synthetic
aacaacacactgtcacaatctatagggagacctcaaactcaaataactgctgagaacaccagacccagcacacac

SEQ ID NO: 68581 - DNA, 75 bp, Artificial Sequence
  Synthetic
ggagacctcaaactcaaataactgctgagaacaccagacccagcacacaccaaatcggtactggagaagtccctg

SEQ ID NO: 68582 - DNA, 75 bp, Artificial Sequence
  Synthetic
ttcactaacatcaactattataaagattcttacgccgcgtcagctacccggcaagacttcacacaagatccaaag

SEQ ID NO: 68583 - DNA, 75 bp, Artificial Sequence
  Synthetic
acaagcatagcactgaggagacttgcatcgaacacttcttctccagagcaggccttgtgagcatgatctcccttc

SEQ ID NO: 68584 - DNA, 75 bp, Artificial Sequence
  Synthetic
catcgaacacttcttctccagagcaggccttgtgagcatgatctcccttctagtgtctgagaaaacaacccaagc

SEQ ID NO: 68585 - DNA, 75 bp, Artificial Sequence
  Synthetic
ggataaaccaacgcgcccggatgtttcagtgaataggttttacacattggatactaaattgtgggagaaatcgtc

SEQ ID NO: 68586 - DNA, 75 bp, Artificial Sequence
  Synthetic
ctaatggacaagggttgtacccagattttgctcatactaacccaggtaaaaatggtcaagagtttcgagatcctt

SEQ ID NO: 68587 - DNA, 75 bp, Artificial Sequence
  Synthetic
ggtattggaaattccctgatgttttgacagaggtaggtgtttttggtcaaaatgctcagttccactacctgtatc

SEQ ID NO: 68588 - DNA, 75 bp, Artificial Sequence
  Synthetic
cggttccaatcgggagagcattagccataccaaactttgagaacttaagaagaaattggcttgaattgttttaat

SEQ ID NO: 68589 - DNA, 75 bp, Artificial Sequence
  Synthetic
atttaatgctgaattcacctttgtcgctacaggactcaatggcacagctcctcaaacaatgttacagtatatgta

SEQ ID NO: 68590 - DNA, 75 bp, Artificial Sequence
  Synthetic
tcgtgaacgtccttgatgcagttgaactggtggatgagcaaggagtcaacctggaattaaccctcattactcttg

SEQ ID NO: 68591 - DNA, 75 bp, Artificial Sequence
  Synthetic
agaatttgagaaggaattggctcgaattgttttaaacttgcagtttgtaactggaccccaccagtaatctggtcg

SEQ ID NO: 68592 - DNA, 75 bp, Artificial Sequence
  Synthetic
aatttgcggcagaagtgggccagataagacacgttgccaaacatcgcttcaaggttctcctgcgaagctgctgac

SEQ ID NO: 68593 - DNA, 75 bp, Artificial Sequence
  Synthetic
gctacaggactcaatggcacagctcctcaaacaatgttacagtatatgtatgtcccgcctggtgcaccagtaccg

SEQ ID NO: 68594 - DNA, 75 bp, Artificial Sequence
  Synthetic
caagtgtctgtcccattcatgtcaccagcaagtgcttaccagtggttttatgacgggtatcccacatttggctca

SEQ ID NO: 68595 - DNA, 75 bp, Artificial Sequence
  Synthetic
cagcaagtgcttaccagtggttttatgacgggtatcccacatttggctcacaccctgtatcagaagatctcaggt

SEQ ID NO: 68596 - DNA, 75 bp, Artificial Sequence
  Synthetic
ttgtgatcaggatcttcatgcgcattaagcacgtgcgcgcctgggtcccgagacccatccgttcccagaaatata

SEQ ID NO: 68597 - DNA, 75 bp, Artificial Sequence
  Synthetic
taagcacgtgcgcgcctgggtcccgagacccatccgttcccagaaatatatagtgaagaattaccctaactttga

SEQ ID NO: 68598 - DNA, 75 bp, Artificial Sequence
  Synthetic
aacatatgccatcaatgtttgtcccagtgggggacgttgtgcagtatgggttcctgaaccttagtggaaagccaa

SEQ ID NO: 68599 - DNA, 75 bp, Artificial Sequence
  Synthetic
agcaatctatgttggaaattacagaattgtcaacaggcacctggcaacaaagaaagattgggagaacttggtatg

SEQ ID NO: 68600 - DNA, 75 bp, Artificial Sequence
  Synthetic
attgtcaacaggcacctggcaacaaagaaagattgggagaacttggtatgggaatcatatgaaagagatttactt

SEQ ID NO: 68601 - DNA, 75 bp, Artificial Sequence
  Synthetic
acagaagaactttaccctaaagttgtgcaaggacactgacgagatccaacaaacagcagagtaccaaaatgatcc

SEQ ID NO: 68602 - DNA, 75 bp, Artificial Sequence
  Synthetic
tcaatgaacagacactatcctgtcacttttggtgaaccagccttcttccatgtagatgctaatgagtactaccca

SEQ ID NO: 68603 - DNA, 75 bp, Artificial Sequence
  Synthetic
cttttggtgaaccagccttcttccatgtagatgctaatgagtactacccagaaagataccaatcacatgtgatct

SEQ ID NO: 68604 - DNA, 75 bp, Artificial Sequence
  Synthetic
caattggcggtcctaacttagttggcttcgcagatgttagagatttactgtggttagatgatgaggttatggaac

SEQ ID NO: 68605 - DNA, 75 bp, Artificial Sequence
  Synthetic
tcaatcagctcaaaaattacctattaggctcagaaaatgtggtggagaagattttgaaagctctaatcaaagttg

SEQ ID NO: 68606 - DNA, 75 bp, Artificial Sequence
  Synthetic
gccatggaagcccgtggaaatggctcaagcacaaagtgtcaacactcctagacatccctatggcagagaagcaaa

SEQ ID NO: 68607 - DNA, 75 bp, Artificial Sequence
  Synthetic
tgattgaccaaactgtaaacaatcaagtgaatcgctccttgactgcgatgcaagtactacctacagctgccaaca

SEQ ID NO: 68608 - DNA, 75 bp, Artificial Sequence
  Synthetic
caagcacaaagtgtcaacactcctagacatccctatggcagagaagcaaagtgattcttggcttaaaaagttcac

SEQ ID NO: 68609 - DNA, 75 bp, Artificial Sequence
  Synthetic
caaaatcatcccggccgccaaggaaaaagtggaatttctaaataatctaaagcaactcacactccttgagaatca

SEQ ID NO: 68610 - DNA, 75 bp, Artificial Sequence
  Synthetic
tttgaggaccaacaattgtgctacaataatagtgccatacattaacgcactgccttttgattctgccttgaacca

SEQ ID NO: 68611 - DNA, 75 bp, Artificial Sequence
  Synthetic
aaagtggaatttctaaataatctaaagcaactcacactccttgagaatcagatttccaacattgagcaatctgcc

SEQ ID NO: 68612 - DNA, 75 bp, Artificial Sequence
  Synthetic
ggtacacagaatacagatggttatgttaattgggacattgatttgatgggatatgctcagctgcggcggaaatgc

SEQ ID NO: 68613 - DNA, 75 bp, Artificial Sequence
  Synthetic
aattttgctccccggttcactctttgcctttgactactcaggttatgatgctagccttagccctgtctggttcag

SEQ ID NO: 68614 - DNA, 75 bp, Artificial Sequence
  Synthetic
cattttcaactcaatgatcaacaacattattatcagagcactgctcataaaaacatttaagggcattgatttgga

SEQ ID NO: 68615 - DNA, 75 bp, Artificial Sequence
  Synthetic
ttgttagaggcgctcctgggactggaaaatcattagcaactggcatcatctcccgagccattgccgaaaaatacc

SEQ ID NO: 68616 - DNA, 75 bp, Artificial Sequence
  Synthetic
aggatatgtcccaagacccgaagaaatttactgaccctgtcatggacgttatacatgagatggccccaccgctca

SEQ ID NO: 68617 - DNA, 75 bp, Artificial Sequence
  Synthetic
caagcagttacgcaagggtttcctactgagctgaaacctggcacaaaccaatttttaaccactgacgatggcgtc

SEQ ID NO: 68618 - DNA, 75 bp, Artificial Sequence
  Synthetic
ctcacaggacccacgtggtgctagcactctggttctacggaacctttgtgcgcctgttttacgccccctccccaa

SEQ ID NO: 68619 - DNA, 75 bp, Artificial Sequence
  Synthetic
ccaagcaaatgacctagattatggccaatgcccgaataatatgatgggcacttttagcattaggacagtagggac

SEQ ID NO: 68620 - DNA, 75 bp, Artificial Sequence
  Synthetic
actcctgcagataagtctccttgctttaatgaggtcaattgggataatgcaaccttcctcaagaggggcttctta

SEQ ID NO: 68621 - DNA, 75 bp, Artificial Sequence
  Synthetic
atgctggcattccaatatcacaactaacagtgtgcccacatcagtggattaacttgaggaccaacaattgtgcca

SEQ ID NO: 68622 - DNA, 75 bp, Artificial Sequence
  Synthetic
atatcatagtccccacagtatcggatgctgatgctattagaaggagattctacatggattgtgacatagaagtca

SEQ ID NO: 68623 - DNA, 75 bp, Artificial Sequence
  Synthetic
tgctgatgctattagaaggagattctacatggattgtgacatagaagtcactgattcatacaaattggagtctgg

SEQ ID NO: 68624 - DNA, 75 bp, Artificial Sequence
  Synthetic
agtctgtgggaaagcaattcaactcagagatagaaagacaaaggttagatacagcctagattcagtagtctccga

SEQ ID NO: 68625 - DNA, 75 bp, Artificial Sequence
  Synthetic
agagatagaaagacaaaggttagatacagcctagattcagtagtctccgagctcataagggaacacaataacagg

SEQ ID NO: 68626 - DNA, 75 bp, Artificial Sequence
  Synthetic
attgaccattgcacctcaccaatggattaaccttaggacaaacaattgtgctactatagtaatgccatatgtgaa

SEQ ID NO: 68627 - DNA, 75 bp, Artificial Sequence
  Synthetic
gtcaataatgtacctacgaatgccaccagcttaatggagaggttgcgctttccggtctcagcccaagcaggaaag

SEQ ID NO: 68628 - DNA, 75 bp, Artificial Sequence
  Synthetic
aaacaccatagaagcactctttcaaggacctctcaagttcaggcctataagaattagccttgaagagaagccagc

SEQ ID NO: 68629 - DNA, 75 bp, Artificial Sequence
  Synthetic
aaggaaacactacccggttagtttcaccaagcccagtctgatatttgtggaagctagtgagtattacccagctag

SEQ ID NO: 68630 - DNA, 75 bp, Artificial Sequence
  Synthetic
gaaaagccagcaccagatgctattagtgatcttttgaagagtgtggatagtgaagaggtgagacaatactgcaga

SEQ ID NO: 68631 - DNA, 75 bp, Artificial Sequence
  Synthetic
gtgatcttttgaagagtgtggatagtgaagaggtgagacaatactgcagagatcagggatggatagtgcctatcc

SEQ ID NO: 68632 - DNA, 75 bp, Artificial Sequence
  Synthetic
atagagctattatatacctatttgttggctttataccactaatcttaaaatctgtaaccactctcgagtatatat

SEQ ID NO: 68633 - DNA, 75 bp, Artificial Sequence
  Synthetic
gacaggcactatccagggagatagggtggcagatgtgattgagagttctataggggacagtgtgagcagagccct

SEQ ID NO: 68634 - DNA, 75 bp, Artificial Sequence
  Synthetic
tgagtctagtgtatgtcatctataagctatttgctggattccaaggtgcttactctggcatgcccaagcaaaatg

SEQ ID NO: 68635 - DNA, 75 bp, Artificial Sequence
  Synthetic
gctatttgctggattccaaggtgcttactctggcatgcccaagcaaaatgttaagaaaccagtcctcaggacagc

SEQ ID NO: 68636 - DNA, 75 bp, Artificial Sequence
  Synthetic
tggatgatttgtgtcaaaaccccgatggaaaggatatgtctttattctgtcaaatggtatccaccgtagacttca

SEQ ID NO: 68637 - DNA, 75 bp, Artificial Sequence
  Synthetic
gggccatttcaccatgttaggtatcagagatcagatcgcagtgctaccgcgacacgcccttcctggcaagcaaat

SEQ ID NO: 68638 - DNA, 75 bp, Artificial Sequence
  Synthetic
caaatggtatccaccgtagacttcattccaccaatggcttccctcgaggagaagggagtttccttcacctctaag

SEQ ID NO: 68639 - DNA, 75 bp, Artificial Sequence
  Synthetic
agagatcagatcgcagtgctaccgcgacacgcccttcctggcaagcaaatttggattgaacataaactagtcaat

SEQ ID NO: 68640 - DNA, 75 bp, Artificial Sequence
  Synthetic
ttaaaacagcctgtgggttgtacccacccacagggcccactgggcgctagcactctggtattacggtacctttgt

SEQ ID NO: 68641 - DNA, 75 bp, Artificial Sequence
  Synthetic
gagaaattcagagacattactaaatttataccagagcaaattgagggctctcccgatgctgtcctagtgatcaac

SEQ ID NO: 68642 - DNA, 75 bp, Artificial Sequence
  Synthetic
aaggaaaaagttgagtttcttaataacctcaagcaactgcctttgatggaaaaccaaattgctaacttagaacag

SEQ ID NO: 68643 - DNA, 75 bp, Artificial Sequence
  Synthetic
cccccatgcagcgcttgtgctttccagtgtcggtacagagcaaaacgggcgaattatgtgctgccttcagagcag

SEQ ID NO: 68644 - DNA, 75 bp, Artificial Sequence
  Synthetic
ttataccagagcaaattgagggctctcccgatgctgtcctagtgatcaacactgaaaccatgccatcaatgtttg

SEQ ID NO: 68645 - DNA, 75 bp, Artificial Sequence
  Synthetic
agggtggtgacgatcaagcacttctgtttccccggatctagtatcaatagactgttagcacggttgaaggagaac

SEQ ID NO: 68646 - DNA, 75 bp, Artificial Sequence
  Synthetic
atttcccaactagggcaggacagtgtggaggagtcgttacctctgtcggcaagatagtggggattcacattggag

SEQ ID NO: 68647 - DNA, 75 bp, Artificial Sequence
  Synthetic
gctagtaaatttcaccagggggcccttcttgtagctgtgataccagaatttgtgattgctggcagaggatctaac

SEQ ID NO: 68648 - DNA, 75 bp, Artificial Sequence
  Synthetic
agctcatttttgccgcaagttccaaccactctacgcaactgaggccaagagagtctatgccctggagaaaagagt

SEQ ID NO: 68649 - DNA, 75 bp, Artificial Sequence
  Synthetic
acaatctgggtggaacacaaactcgtgaacatcctggatgctgtcgagttagtggatgagcaaggggtcaaccta

SEQ ID NO: 68650 - DNA, 75 bp, Artificial Sequence
  Synthetic
ccccagtgtagatcaggccgatgagtcactgcattccccacgggcgaccgtggcagtggctgcgttggcggcctg

SEQ ID NO: 68651 - DNA, 75 bp, Artificial Sequence
  Synthetic
cggggtcccatgagaccagcactgtagcgagagaaggctcaacgataaactttactaatattaattactataagg

SEQ ID NO: 68652 - DNA, 75 bp, Artificial Sequence
  Synthetic
tgaagcccaacaaagagacaggcaatttcaacattaacggtccaaccaagaccaagcttgaacccagcgttttcc

SEQ ID NO: 68653 - DNA, 75 bp, Artificial Sequence
  Synthetic
gtcccagtaggaagagcgttggctattccaaattatgaaaatcttagacgcaattggctcgagttattttagagg

SEQ ID NO: 68654 - DNA, 75 bp, Artificial Sequence
  Synthetic
gtggagcgacaccttaatagagcagtcttagtgatgcaatccattgctaccgtggttacagttgtatcccttgtt

SEQ ID NO: 68655 - DNA, 75 bp, Artificial Sequence
  Synthetic
ttgctagtgagcaaggagagatccaatgggtaaagcctaacaaagaaactgggagacttaacatcaatgggccaa

SEQ ID NO: 68656 - DNA, 75 bp, Artificial Sequence
  Synthetic
ctgccctcttctccaaatacatagggaacaagatccatgagccagatgaatacatgattcaagctgcaaaccatt

SEQ ID NO: 68657 - DNA, 75 bp, Artificial Sequence
  Synthetic
actgcgttgcaagtactacctacagctgccaacactgaagcaagtagtcacagattaggcactggtgttgtacca

SEQ ID NO: 68658 - DNA, 75 bp, Artificial Sequence
  Synthetic
ggtgtccgtgtttcctgttttacttactttggctgcttatggtgacaatttacggattgttgccatatagctatt

SEQ ID NO: 68659 - DNA, 75 bp, Artificial Sequence
  Synthetic
actttggctgcttatggtgacaatttacggattgttgccatatagctattggattggccatccggattataaaca

SEQ ID NO: 68660 - DNA, 75 bp, Artificial Sequence
  Synthetic
ttaaagttgaatacattatgggagcccaagtatcaacccagaagtcaggttctcatgagaacaccaactttgctg

SEQ ID NO: 68661 - DNA, 75 bp, Artificial Sequence
  Synthetic
ccaagtatcaacccagaagtcaggttctcatgagaacaccaactttgctgctggaggttctaccataaattatac

SEQ ID NO: 68662 - DNA, 75 bp, Artificial Sequence
  Synthetic
tccagactaattgaagccagtagtattaatgattcagtttaccttagaatgtgttttggccacttgtatgagaaa

SEQ ID NO: 68663 - DNA, 75 bp, Artificial Sequence
  Synthetic
tgtcgtagccaaacccaatggtgagttagtcccccaattactgcagtacatgtatgtcccaccaggggctccgaa

SEQ ID NO: 68664 - DNA, 75 bp, Artificial Sequence
  Synthetic
cactcaaccagtggtgaacgcattgaaggaaggtgcaccagtgctcaaatccccatctgctgaagcatgtggtta

SEQ ID NO: 68665 - DNA, 75 bp, Artificial Sequence
  Synthetic
aaggaaggtgcaccagtgctcaaatccccatctgctgaagcatgtggttatagtgatagggttgcccaacttaca

SEQ ID NO: 68666 - DNA, 75 bp, Artificial Sequence
  Synthetic
ggctgaccctggaagagacggtccatggcagtcaacgatgctgggccagttgtgtggatactacactcaatggtc

SEQ ID NO: 68667 - DNA, 75 bp, Artificial Sequence
  Synthetic
ataatgctccctggttctctctttgcttttgattatactgggtatgatgctagtctttctcctgcttggtttagg

SEQ ID NO: 68668 - DNA, 75 bp, Artificial Sequence
  Synthetic
aaagatacggaggctactgccgttgacaaacccaccaagccagatgtttccgtcaacagattctacacactctca

SEQ ID NO: 68669 - DNA, 75 bp, Artificial Sequence
  Synthetic
acaaacccaccaagccagatgtttccgtcaacagattctacacactctcagctaaactctggcaatccaactcta

SEQ ID NO: 68670 - DNA, 75 bp, Artificial Sequence
  Synthetic
tttatagatcaggtttttgcatacacgtgcagtgtaatgctagcaaatttcatcagggtacactcttagttgcag

SEQ ID NO: 68671 - DNA, 75 bp, Artificial Sequence
  Synthetic
cgtgcagtgtaatgctagcaaatttcatcagggtacactcttagttgcagctataccagaatatgtggtcgctag

SEQ ID NO: 68672 - DNA, 75 bp, Artificial Sequence
  Synthetic
ttttgggcataccgatggctcagaagcagagtgcctcttggttaaagaagttcaacgatgcggcgagtgccgcga

SEQ ID NO: 68673 - DNA, 75 bp, Artificial Sequence
  Synthetic
agaattggctttcccatatttgttagataatggcactgcactctcacaagctccaatataccctcatcaatggat

SEQ ID NO: 68674 - DNA, 75 bp, Artificial Sequence
  Synthetic
acatttctcaagagaggatttaaaccagatgaacaatatccattcctcatccacccaaccatgccaatgaaggag

SEQ ID NO: 68675 - DNA, 75 bp, Artificial Sequence
  Synthetic
gataatggcactgcactctcacaagctccaatataccctcatcaatggataaatttgagaaccaacaactgcgca

SEQ ID NO: 68676 - DNA, 75 bp, Artificial Sequence
  Synthetic
cgtgcggtcactgtgtctcctagcgtggcacaatggtagggaaacctatgaggaatttgttggtaaaattagaac

SEQ ID NO: 68677 - DNA, 75 bp, Artificial Sequence
  Synthetic
atccctgtagcccctcttgcttacagtagcggtgccacctcagccatacctatcacactgtcaattgctccgttg

SEQ ID NO: 68678 - DNA, 75 bp, Artificial Sequence
  Synthetic
acagtgtggaggtgtggtaacgtctgtcggtaagatcattggcatccacattggaggcaacgggcgtcaagggtt

SEQ ID NO: 68679 - DNA, 75 bp, Artificial Sequence
  Synthetic
gtagcggtgccacctcagccatacctatcacactgtcaattgctccgttgaattctgaatttgccgggttgcgtc

SEQ ID NO: 68680 - DNA, 75 bp, Artificial Sequence
  Synthetic
gccactcgataaatttgctgattttgttagatatccactcaagccccttagcggcgctcgccgcatcgttgaact

SEQ ID NO: 68681 - DNA, 75 bp, Artificial Sequence
  Synthetic
tggcacaatggtagggaaacctatgaggaatttgttggtaaaattagaactgtaccgattggcaaaattttagct

SEQ ID NO: 68682 - DNA, 75 bp, Artificial Sequence
  Synthetic
cagcgcccattctcccagggtttcaccccaccccagaaatgttcatcccaggagaagtgaagaatttgttggaga

SEQ ID NO: 68683 - DNA, 75 bp, Artificial Sequence
  Synthetic
ccccaccccagaaatgttcatcccaggagaagtgaagaatttgttggagattgcccaagtagaatcaatattgga

SEQ ID NO: 68684 - DNA, 75 bp, Artificial Sequence
  Synthetic
cacactgattctatggaatctttgtgcgcctgttttataaccccttccccaaaactgtaacttagaagaatatca

SEQ ID NO: 68685 - DNA, 75 bp, Artificial Sequence
  Synthetic
gctgcaatccccgaatttgtggttgctgcaagcagccctgctacgaagcctaatggacaaggattgtacccagat

SEQ ID NO: 68686 - DNA, 75 bp, Artificial Sequence
  Synthetic
tgtgggtaatgtcctccacgaacctgatgaatatgtgaagcaggcagccctccactacgcaaatcagctcaagca

SEQ ID NO: 68687 - DNA, 75 bp, Artificial Sequence
  Synthetic
tgacaaattgtgtgcatcatttagaacggatcctggaagggatggaccatggcaatccacccttgtagggcaact

SEQ ID NO: 68688 - DNA, 75 bp, Artificial Sequence
  Synthetic
acggatcctggaagggatggaccatggcaatccacccttgtagggcaactatgcagatactatacccagtggtca

SEQ ID NO: 68689 - DNA, 75 bp, Artificial Sequence
  Synthetic
actggatataaacaccaataagatgagcatggaggaagcgtgctatggcacagagaacctggaagcaattgacct

SEQ ID NO: 68690 - DNA, 75 bp, Artificial Sequence
  Synthetic
ccaggagcaccacagcctgcaactagagcacaagccatgttaggaacacacatagtgtgggactttggattgcaa

SEQ ID NO: 68691 - DNA, 75 bp, Artificial Sequence
  Synthetic
gagcacaagccatgttaggaacacacatagtgtgggactttggattgcaatcttctgccactctagtcatccctt

SEQ ID NO: 68692 - DNA, 75 bp, Artificial Sequence
  Synthetic
tatggtaccaaaccaactttgtggtgcctgatggagcgcctacaagtgcttacatcatagctctagctgctgccc

SEQ ID NO: 68693 - DNA, 75 bp, Artificial Sequence
  Synthetic
gcctgatggagcgcctacaagtgcttacatcatagctctagctgctgcccaacgcaacttcaccatgagattatg

SEQ ID NO: 68694 - DNA, 75 bp, Artificial Sequence
  Synthetic
acttagtactatagaatctgctggcacacactccactgctgctaacacaagtgagagcacccataacataggcac

SEQ ID NO: 68695 - DNA, 75 bp, Artificial Sequence
  Synthetic
gactgtcaaacaggagtgtactattgtaactccaaaagaaagcactatccagtcagcttttctaaacccagcctc

SEQ ID NO: 68696 - DNA, 75 bp, Artificial Sequence
  Synthetic
acacactccactgctgctaacacaagtgagagcacccataacataggcactggacacactccagctctgcaggct

SEQ ID NO: 68697 - DNA, 75 bp, Artificial Sequence
  Synthetic
ctgggtcgcacgagacaaagaatgtagcgaccgaagggtctactatcaactttaccaacatcaattactataagg

SEQ ID NO: 68698 - DNA, 75 bp, Artificial Sequence
  Synthetic
acggcaactgtgcaggggccgagcttggacttcgccctatctctacttaggaggaacattaggcaggtccaaacc

SEQ ID NO: 68699 - DNA, 75 bp, Artificial Sequence
  Synthetic
gtggcagagacctccataaccaacttctatgctcgtgctgggttggtaggttatttaaaactacttactagtaaa

SEQ ID NO: 68700 - DNA, 75 bp, Artificial Sequence
  Synthetic
tctatgctcgtgctgggttggtaggttatttaaaactacttactagtaaagacacacctaatgggtttactaatt

SEQ ID NO: 68701 - DNA, 75 bp, Artificial Sequence
  Synthetic
ccatcagggaggttgcagccccgttgcaatccccttctgttgaggcgtgcggttatagtgaccgagtcgcacagt

SEQ ID NO: 68702 - DNA, 75 bp, Artificial Sequence
  Synthetic
gtccttggtggaatgccttcaggttgttccggcacttccatcttcaattccatgatcaataacataataatcaga

SEQ ID NO: 68703 - DNA, 75 bp, Artificial Sequence
  Synthetic
gtgacacgattgcccgttgcgattgccagacaggggtgtactactgtaactctatgagaaaacactacccagtta

SEQ ID NO: 68704 - DNA, 75 bp, Artificial Sequence
  Synthetic
aattcacatttgtggcaaccagtgaggacggaagcacaccaaacaccatgctacaatacatgtatgtaccccctg

SEQ ID NO: 68705 - DNA, 75 bp, Artificial Sequence
  Synthetic
ggacggaagcacaccaaacaccatgctacaatacatgtatgtaccccctggtgccccgaaacccactggaagaga

SEQ ID NO: 68706 - DNA, 75 bp, Artificial Sequence
  Synthetic
gctgacaagtcaccttgctttaatgaagttacctgggaaaatgccacattcttaaagagaggcttcctgccagat

SEQ ID NO: 68707 - DNA, 75 bp, Artificial Sequence
  Synthetic
tattcggtcaaaacgcccaattccactacttgtaccgctcgggtttctgcatgcacgttcagtgcaatgcaagca

SEQ ID NO: 68708 - DNA, 75 bp, Artificial Sequence
  Synthetic
accatttatgtcagcagcaagtgcttaccagtggttctatgatgggtacccaacatttggacaacacccagcatc

SEQ ID NO: 68709 - DNA, 75 bp, Artificial Sequence
  Synthetic
taccagtggttctatgatgggtacccaacatttggacaacacccagcatcagacaacatcaattatggcatttgc

SEQ ID NO: 68710 - DNA, 75 bp, Artificial Sequence
  Synthetic
atcttcatgaggataaagcatgttagagcgtggataccacgtccactcagaagtcaacaatacatgatcaggaac

SEQ ID NO: 68711 - DNA, 75 bp, Artificial Sequence
  Synthetic
tgttgaggacagccactgttcaagggcccagcttagattttgccctgtctctcctgcgacgcaacatcaggcagg

SEQ ID NO: 68712 - DNA, 75 bp, Artificial Sequence
  Synthetic
tttgtgagcacaattagatcagttcccattggaaaagccttggctataccaaattttgagaacttgagaagaaat

SEQ ID NO: 68713 - DNA, 75 bp, Artificial Sequence
  Synthetic
aaattttgagaacttgagaagaaattggctcgagttattttaatatacagtttaaagctgaaccccaccagaagt

SEQ ID NO: 68714 - DNA, 75 bp, Artificial Sequence
  Synthetic
caatggatcaatctacgaactaataactgcgcgaccattatcatgccatatgtcaatgcgcttccatttgattca

SEQ ID NO: 68715 - DNA, 75 bp, Artificial Sequence
  Synthetic
aaagagccagcagtgttgactagtaaagacccaaggctggaagttgactttgaacaggctcttttttcaaaatac

SEQ ID NO: 68716 - DNA, 75 bp, Artificial Sequence
  Synthetic
gagcgtggataccacgtccactcagaagtcaacaatacatgatcaggaactaccccaactttcccacaacagtga

SEQ ID NO: 68717 - DNA, 75 bp, Artificial Sequence
  Synthetic
gaaattacaggatagtgaacagacacctggcaacacggaatgactgggacaaccttgtgtgggaggattacaacc

SEQ ID NO: 68718 - DNA, 75 bp, Artificial Sequence
  Synthetic
cctggcaacacggaatgactgggacaaccttgtgtgggaggattacaaccgtgatctcctaattagccaaaccaa

SEQ ID NO: 68719 - DNA, 75 bp, Artificial Sequence
  Synthetic
ttttacgaaatccttgtgtgcctgttttatatcccttccctaacttgaaacgtagaagcaatgcgcaacactgat

SEQ ID NO: 68720 - DNA, 75 bp, Artificial Sequence
  Synthetic
tattaacccttaatacaatcaaacatgggctcacaggtgtctacccaacggtccggctctcatgaaaactccaac

SEQ ID NO: 68721 - DNA, 75 bp, Artificial Sequence
  Synthetic
ctacccagtctcatttcaaggacctggcctagtccatgttaacaagaatgaatactacccagagaggtatcaatc

SEQ ID NO: 68722 - DNA, 75 bp, Artificial Sequence
  Synthetic
atccacattggaggcaatgggcgacaagggttctgcgctggtctgaagaggagttattttgcaagtgaacaaggt

SEQ ID NO: 68723 - DNA, 75 bp, Artificial Sequence
  Synthetic
acccacagggcccactgggcgccagcactctggtatcgcggtacctttgtgcgcctgttttatgacccctcccca

SEQ ID NO: 68724 - DNA, 75 bp, Artificial Sequence
  Synthetic
ggcctagtccatgttaacaagaatgaatactacccagagaggtatcaatcacatgtgcttttagctgtaggacat

SEQ ID NO: 68725 - DNA, 75 bp, Artificial Sequence
  Synthetic
aacctggttggctttgctgatctccgtgatcttctctggttggatgacgaggtcatggaacaaggggttaccgac

SEQ ID NO: 68726 - DNA, 75 bp, Artificial Sequence
  Synthetic
gtgatcttctctggttggatgacgaggtcatggaacaaggggttaccgactacatcaaaacccttggtgatgctt

SEQ ID NO: 68727 - DNA, 75 bp, Artificial Sequence
  Synthetic
ccaatcacggtcactatagccccattatgttcagagtttgctgggttgaggcaagctgtcaaacagggtttgcca

SEQ ID NO: 68728 - DNA, 75 bp, Artificial Sequence
  Synthetic
gttcacgggttcttttatggccacagggaaaatgctgatagcctacacaccacctggtagtgctcagcccgctac

SEQ ID NO: 68729 - DNA, 75 bp, Artificial Sequence
  Synthetic
tggtagaaaaagtgatcaagtacctggtcaaagttgtgtctgcattggtcattgtcgtgaggagtgagtatgatt

SEQ ID NO: 68730 - DNA, 75 bp, Artificial Sequence
  Synthetic
ggtcaaagttgtgtctgcattggtcattgtcgtgaggagtgagtatgatttggtcaccatcactgctaccttggc

SEQ ID NO: 68731 - DNA, 75 bp, Artificial Sequence
  Synthetic
ggagattcatgagtccattcgatggaccaaggatgcgcgcaatactcaagatcacgtgcgatccttatgcctgtt

SEQ ID NO: 68732 - DNA, 75 bp, Artificial Sequence
  Synthetic
tcagaaacaaggtgattcatggttaaagaaatttaatgacatggccaatgctgcaagaggacttgagtggatttc

SEQ ID NO: 68733 - DNA, 75 bp, Artificial Sequence
  Synthetic
aagaaatttaatgacatggccaatgctgcaagaggacttgagtggatttccaacaaaatcagcaagttcattgat

SEQ ID NO: 68734 - DNA, 75 bp, Artificial Sequence
  Synthetic
ctcgaaaaccaaattgcaaccctggaacaagcagcagcgtctcaaaaagatttggaggcgatatttggaaatgtt

SEQ ID NO: 68735 - DNA, 75 bp, Artificial Sequence
  Synthetic
tgcaatccatcgctactgtggtggcagttgtctcactggtgtatgtcatttacaagctctttgcggggtttcaag

SEQ ID NO: 68736 - DNA, 75 bp, Artificial Sequence
  Synthetic
agtttaatacagcaaaatgggagcacaagtgtctactacgaggacagggtcacatgagaatggcaacatagcgac

SEQ ID NO: 68737 - DNA, 75 bp, Artificial Sequence
  Synthetic
aacaagcagcagcgtctcaaaaagatttggaggcgatatttggaaatgttagttatctggcacacttttgtagaa

SEQ ID NO: 68738 - DNA, 75 bp, Artificial Sequence
  Synthetic
caagtgtctactacgaggacagggtcacatgagaatggcaacatagcgacaggaggttccacgataaattacact

SEQ ID NO: 68739 - DNA, 75 bp, Artificial Sequence
  Synthetic
tcaagagcaaacaccggattgaacctgtatgtttgataatcagaggaccaccaggtacagggaagtcacttgcta

SEQ ID NO: 68740 - DNA, 75 bp, Artificial Sequence
  Synthetic
tgtatgtttgataatcagaggaccaccaggtacagggaagtcacttgctactggaataatagctagagcaattgc

SEQ ID NO: 68741 - DNA, 75 bp, Artificial Sequence
  Synthetic
gccagtcctgttttggatgcgcttaaggaagtagcacccccactaaaatccccttcagcggaagcatgtggatac

SEQ ID NO: 68742 - DNA, 75 bp, Artificial Sequence
  Synthetic
gtgtcagggatcgcttagctgttctcccacggcacgcacagcccgggaagactatttgggtggagcacaaacttg

SEQ ID NO: 68743 - DNA, 75 bp, Artificial Sequence
  Synthetic
cttttactctcgtgcagggctggtaggagttgtggaggtgaaggactcgggcactagcctggatgggtacacagt

SEQ ID NO: 68744 - DNA, 75 bp, Artificial Sequence
  Synthetic
aggaagtagcacccccactaaaatccccttcagcggaagcatgtggatacagcgatagggtggcacagctcactg

SEQ ID NO: 68745 - DNA, 75 bp, Artificial Sequence
  Synthetic
tacagctatggatgatttgtgccaaaatccagatggaaaagatatgtccttgttctgccaaatggtgtcaacagt

SEQ ID NO: 68746 - DNA, 75 bp, Artificial Sequence
  Synthetic
aatccagatggaaaagatatgtccttgttctgccaaatggtgtcaacagtagatttcatccctcctatggcatcc

SEQ ID NO: 68747 - DNA, 75 bp, Artificial Sequence
  Synthetic
ccgatgtcgacgcaaccgctgtcgataaaccaacgagacctgacgtgtcagtcaaccgattttacaccctgtcgg

SEQ ID NO: 68748 - DNA, 75 bp, Artificial Sequence
  Synthetic
taaaccaacgagacctgacgtgtcagtcaaccgattttacaccctgtcggccaagatgtggcagaaagagtcaaa

SEQ ID NO: 68749 - DNA, 75 bp, Artificial Sequence
  Synthetic
acagtgtctgacagcgatgccatcagaagaaggttctacatggattgtgacatcgaagtgacagactcttacaaa

SEQ ID NO: 68750 - DNA, 75 bp, Artificial Sequence
  Synthetic
acccacagggcccactgggcgctagcacactgattctgcgggatctttgtgcgcctgttttataacccttcccct

SEQ ID NO: 68751 - DNA, 75 bp, Artificial Sequence
  Synthetic
gtatagatcagggttttgtatccatgttcagtgcaatgctagtaagttccatcaaggcgcgcttttagtcgcact

SEQ ID NO: 68752 - DNA, 75 bp, Artificial Sequence
  Synthetic
gaagaaggttctacatggattgtgacatcgaagtgacagactcttacaaaactgaaaccaacagattggatgcag

SEQ ID NO: 68753 - DNA, 75 bp, Artificial Sequence
  Synthetic
gttcagtgcaatgctagtaagttccatcaaggcgcgcttttagtcgcactaatgccagagcatgtggttgccggt

SEQ ID NO: 68754 - DNA, 75 bp, Artificial Sequence
  Synthetic
aactccacctatacacataccaggagaagtacacaacctattggaaatatgcagagtggagaccattctggaagt

SEQ ID NO: 68755 - DNA, 75 bp, Artificial Sequence
  Synthetic
ccctacatttggtgagcacaaacaagctaccaatttgcaatatgggcagtgtcctaataacatgatgggccattt

SEQ ID NO: 68756 - DNA, 75 bp, Artificial Sequence
  Synthetic
ccattcagttaagggataggcgcactaaggttagatatagtgtggactcagtggtttcggaacttattagagaat

SEQ ID NO: 68757 - DNA, 75 bp, Artificial Sequence
  Synthetic
cttaagaaacctgctcttcgcacagcaacagtacagggcccgagccttgattttgctctctccctgctgaggagg

SEQ ID NO: 68758 - DNA, 75 bp, Artificial Sequence
  Synthetic
gagctccaatttccatatgtgttggactgtggtgttccggtgagtcaacttctaatctgcccgcatcagtggatc

SEQ ID NO: 68759 - DNA, 75 bp, Artificial Sequence
  Synthetic
cacactgattctacggaaactttgtgcgcctgttttatgtccctccccctaatatgtaacttagaaatttagtac

SEQ ID NO: 68760 - DNA, 75 bp, Artificial Sequence
  Synthetic
taaggttagatatagtgtggactcagtggtttcggaacttattagagaatacaacaacaggtcagctgttggcaa

SEQ ID NO: 68761 - DNA, 75 bp, Artificial Sequence
  Synthetic
gaccctggaagagatggtccgtggcagtccacaatactaggccaactctgcaggtactacacccagtggtcaggt

SEQ ID NO: 68762 - DNA, 75 bp, Artificial Sequence
  Synthetic
actgtggtgttccggtgagtcaacttctaatctgcccgcatcagtggatcaacctgaggactaacaactgtgcca

SEQ ID NO: 68763 - DNA, 75 bp, Artificial Sequence
  Synthetic
cgatgccataagtgaccttttggccagtgtggacaatgaggaggttaggcagtactgcagagagaaaggctggat

SEQ ID NO: 68764 - DNA, 75 bp, Artificial Sequence
  Synthetic
agtgtggacaatgaggaggttaggcagtactgcagagagaaaggctggattattcaggacaaacccactaacatt

SEQ ID NO: 68765 - DNA, 75 bp, Artificial Sequence
  Synthetic
tccccataagcccactaaactatgatgcgggtgccacagcagccataccaattacagtgacagttgcaccgttgt

SEQ ID NO: 68766 - DNA, 75 bp, Artificial Sequence
  Synthetic
tgcgggtgccacagcagccataccaattacagtgacagttgcaccgttgtgtgcagaatttggaggcttgcgtca

SEQ ID NO: 68767 - DNA, 75 bp, Artificial Sequence
  Synthetic
gcacttcccccgtgtagatcaggtcgatgagtcactgcaaaccccacgggcgaccgtggcagtggctgcgttggc

SEQ ID NO: 68768 - DNA, 75 bp, Artificial Sequence
  Synthetic
gttatatacaggatctttgcaggctttcaaggagcttattctggagcacctaaacaggcactgaagaaaccacaa

SEQ ID NO: 68769 - DNA, 75 bp, Artificial Sequence
  Synthetic
ttcaaggagcttattctggagcacctaaacaggcactgaagaaaccacaacttagaactgctactgtacaaggcc

SEQ ID NO: 68770 - DNA, 75 bp, Artificial Sequence
  Synthetic
tgccccgatcctgccagggtttcaacctactcccgaaattcacatcccaggagaagtacgaaacctattggagct

SEQ ID NO: 68771 - DNA, 75 bp, Artificial Sequence
  Synthetic
cctactcccgaaattcacatcccaggagaagtacgaaacctattggagctgtgccaagttgagacgattttggaa

SEQ ID NO: 68772 - DNA, 75 bp, Artificial Sequence
  Synthetic
cgctcaagaagcctgtgctaagaacagctactgtccaaggacctagcttggacttcgctttgtctcttctgaggc

SEQ ID NO: 68773 - DNA, 75 bp, Artificial Sequence
  Synthetic
aggatgtgataccattgcccgatgtgattgtcaaacaggagtgtattactgcaactctagaaggaaacactaccc

SEQ ID NO: 68774 - DNA, 75 bp, Artificial Sequence
  Synthetic
tgctggggataagagaccacttagctgtgttgcccagacatgcagaaccaggtaacaccatatgggttgaacaca

SEQ ID NO: 68775 - DNA, 75 bp, Artificial Sequence
  Synthetic
ccaacactgaagcaagtagtcacagattaggcactggtgttgtaccagcactacaagctgcggagacaggggcgt

SEQ ID NO: 68776 - DNA, 75 bp, Artificial Sequence
  Synthetic
ttatgtgcgtctttcagagttgatccaggtaggaacggcccgtgggagtccacgaccctgggtcaaatctgcagg

SEQ ID NO: 68777 - DNA, 75 bp, Artificial Sequence
  Synthetic
catgatgtcttcgagggaaataaggaaccagctgtcttgcacagtaaagacccccgactcgaggtagattttgag

SEQ ID NO: 68778 - DNA, 75 bp, Artificial Sequence
  Synthetic
gctattggattggccatccggtgtttaacagagcaattgtatacctatttgttggatttgtccctttgtcacaca

SEQ ID NO: 68779 - DNA, 75 bp, Artificial Sequence
  Synthetic
tgtgttgcccagacatgcagaaccaggtaacaccatatgggttgaacacaaactagtgaaggttcttgatgcagt

SEQ ID NO: 68780 - DNA, 75 bp, Artificial Sequence
  Synthetic
caggtaggaacggcccgtgggagtccacgaccctgggtcaaatctgcaggtattatacacaatggtcaggctcct

SEQ ID NO: 68781 - DNA, 75 bp, Artificial Sequence
  Synthetic
cattaccaaatttatcccagaaagattggaaggtgggacagatgcaacccttatcattaacactgaacaaatgcc

SEQ ID NO: 68782 - DNA, 75 bp, Artificial Sequence
  Synthetic
ttggaaggtgggacagatgcaacccttatcattaacactgaacaaatgccgtcgatgtttgtgccagttggagat

SEQ ID NO: 68783 - DNA, 75 bp, Artificial Sequence
  Synthetic
cagagcttaaacctggtaccaatcagtttcttactactgatgatggtgtttccgcaccaattctgccaggtttcc

SEQ ID NO: 68784 - DNA, 75 bp, Artificial Sequence
  Synthetic
gcgaacagcccaagacgcgtgatgtggccatgttaggtactcatgtgatttgggattttgggcttcaatcttcag

SEQ ID NO: 68785 - DNA, 75 bp, Artificial Sequence
  Synthetic
attgatctcagcattagtcatagtgatcagaagtgattatgacatggtaaccctcacagcaaccttggcactcat

SEQ ID NO: 68786 - DNA, 75 bp, Artificial Sequence
  Synthetic
ggccatgttaggtactcatgtgatttgggattttgggcttcaatcttcagttactttagttatcccatggatcag

SEQ ID NO: 68787 - DNA, 75 bp, Artificial Sequence
  Synthetic
atagacctgcacactagtgctggatacccttatagtgccctgggcattaagaaaagagatattcttgacccaatc

SEQ ID NO: 68788 - DNA, 75 bp, Artificial Sequence
  Synthetic
gcaggccagtgcggtggtgtaataacatctgtgggtaaaatcttgggaatccacataggggggaatggcagacaa

SEQ ID NO: 68789 - DNA, 75 bp, Artificial Sequence
  Synthetic
catctgtgggtaaaatcttgggaatccacataggggggaatggcagacaaggattctgtgcagctctcaagaggg

SEQ ID NO: 68790 - DNA, 75 bp, Artificial Sequence
  Synthetic
ccaaactaattttgtggtgcctaccggagcgcccaccagtgcttatattatagctcttggagcagcccaaaagaa

SEQ ID NO: 68791 - DNA, 75 bp, Artificial Sequence
  Synthetic
gcagagtgcgtcatggctcaagaagtttaacgacatggccaatgctgccaagggatttgagtggatttccaataa

SEQ ID NO: 68792 - DNA, 75 bp, Artificial Sequence
  Synthetic
tttaacgacatggccaatgctgccaagggatttgagtggatttccaataagattagtaaatttattgattggctc

SEQ ID NO: 68793 - DNA, 75 bp, Artificial Sequence
  Synthetic
ggagcgcccaccagtgcttatattatagctcttggagcagcccaaaagaacttcacgctcaagttgtgcagagac

SEQ ID NO: 68794 - DNA, 75 bp, Artificial Sequence
  Synthetic
gaccaaccaagaccaagctggaacctagtgtctttcatgatgtcttcccagggacgaaagaacctgcagcactta

SEQ ID NO: 68795 - DNA, 75 bp, Artificial Sequence
  Synthetic
tagtgtctttcatgatgtcttcccagggacgaaagaacctgcagcacttagctccagagacccacgtctagaagt

SEQ ID NO: 68796 - DNA, 75 bp, Artificial Sequence
  Synthetic
actaccaccagagcactaagtggaccaattcagccagtgacagcggccaacacctctcccagttcacatcggctt

SEQ ID NO: 68797 - DNA, 75 bp, Artificial Sequence
  Synthetic
tttcggtaaacaggttttatacattggacactaaattgtgggaaaagtcatccaaggggtggtactggaagtttc

SEQ ID NO: 68798 - DNA, 75 bp, Artificial Sequence
  Synthetic
caattcagccagtgacagcggccaacacctctcccagttcacatcggcttggtacggggcaagtgccagctttgc

SEQ ID NO: 68799 - DNA, 75 bp, Artificial Sequence
  Synthetic
agctcaccattacgctaatcaactgaaacaattggacatatccactgagaaaatgacaatggaagaagcatgcta

SEQ ID NO: 68800 - DNA, 75 bp, Artificial Sequence
  Synthetic
aaacaattggacatatccactgagaaaatgacaatggaagaagcatgctatggcactgagaacctggaagccata

SEQ ID NO: 68801 - DNA, 75 bp, Artificial Sequence
  Synthetic
atggagtcatggaaactagcattgaacacttcttttcacgctcaggcttggcaggaattttgataattgaggact

SEQ ID NO: 68802 - DNA, 75 bp, Artificial Sequence
  Synthetic
acacttcttttcacgctcaggcttggcaggaattttgataattgaggactccggtacttccacgaaaggctacgc

SEQ ID NO: 68803 - DNA, 75 bp, Artificial Sequence
  Synthetic
agagatgttagcaagatgaaagcttatatggacaaatatggcctggacctaccttactccacatatgtcaaagat

SEQ ID NO: 68804 - DNA, 75 bp, Artificial Sequence
  Synthetic
aaccccactagaaatctggtcgtgttaatgactagtgggggtaaatttgttataaccggaatagcaaaaaaaaaa

SEQ ID NO: 68805 - DNA, 75 bp, Artificial Sequence
  Synthetic
tgcagagttcacctttatcacagcagaaaggaatggcaacaccagcccaatacccatccagtacatgtatgtccc

SEQ ID NO: 68806 - DNA, 75 bp, Artificial Sequence
  Synthetic
ataccactctagtgtgtactcacttccgccagatccagatcactttgatggttacaaacagcaagtggtcacagt

SEQ ID NO: 68807 - DNA, 75 bp, Artificial Sequence
  Synthetic
atatggacaaatatggcctggacctaccttactccacatatgtcaaagatgagcttagggacatctcaaaggtta

SEQ ID NO: 68808 - DNA, 75 bp, Artificial Sequence
  Synthetic
gaaaggaatggcaacaccagcccaatacccatccagtacatgtatgtcccacccggagccccagtccctactggt

SEQ ID NO: 68809 - DNA, 75 bp, Artificial Sequence
  Synthetic
tttatgagaaatttcatgcaaatccaggcacatgcactggatcagcggttggatgtaacccagacactttttgga

SEQ ID NO: 68810 - DNA, 75 bp, Artificial Sequence
  Synthetic
aggcacatgcactggatcagcggttggatgtaacccagacactttttggagcaaaatcccaatcatgcttcccgg

SEQ ID NO: 68811 - DNA, 75 bp, Artificial Sequence
  Synthetic
tctgtaccatttatgagcccagccagtacttatcaatggttctacgatggctaccccacgttcggagaagttcca

SEQ ID NO: 68812 - DNA, 75 bp, Artificial Sequence
  Synthetic
gtgctctgaatttgcaggccttagacaagcagtcacgcagggatttcctaccgagctgaagcctggcacaaacca

SEQ ID NO: 68813 - DNA, 75 bp, Artificial Sequence
  Synthetic
gtacttatcaatggttctacgatggctaccccacgttcggagaagttccagtgactacgaacttgaactatggac

SEQ ID NO: 68814 - DNA, 75 bp, Artificial Sequence
  Synthetic
ggtaacggactcatataaaacagatttgggtaggttagatgctggaagagctgccaaattatgctctgaaaataa

SEQ ID NO: 68815 - DNA, 75 bp, Artificial Sequence
  Synthetic
gctcaaagatctgggctatgatgatgatgccatcagtatgatagaggggataaaccactcccatcacatatacag

SEQ ID NO: 68816 - DNA, 75 bp, Artificial Sequence
  Synthetic
gatgccatcagtatgatagaggggataaaccactcccatcacatatacagaaacaagacttactgtgtcttggga

SEQ ID NO: 68817 - DNA, 75 bp, Artificial Sequence
  Synthetic
tgcgcattttcatgaagttgaagcatgtgcgcgcctgggtgccaaggcccatcaggagccagccttacttgttaa

SEQ ID NO: 68818 - DNA, 75 bp, Artificial Sequence
  Synthetic
aaggagcaacgccagtgatccctataactatcacattggctccaatgtgttctgaatttgcaggtcttaggcaag

SEQ ID NO: 68819 - DNA, 75 bp, Artificial Sequence
  Synthetic
tgtgcgcgcctgggtgccaaggcccatcaggagccagccttacttgttaaagaattatcccaactttgacaagtc

SEQ ID NO: 68820 - DNA, 75 bp, Artificial Sequence
  Synthetic
tagatacagtgtggatacggtggtttcagagctcataagggaatacaataacaggtctgccattggaaacacaat

SEQ ID NO: 68821 - DNA, 75 bp, Artificial Sequence
  Synthetic
attaaaactttttctggaattgatctggatgcattgaatatgattgcatatggtgatgatgtcctagcaagttac

SEQ ID NO: 68822 - DNA, 75 bp, Artificial Sequence
  Synthetic
tggatgcattgaatatgattgcatatggtgatgatgtcctagcaagttacccattcctaattgattgtgctgaat

SEQ ID NO: 68823 - DNA, 75 bp, Artificial Sequence
  Synthetic
atacgtgggcaactatagggtggtaaacaggcacctcgccactcataacgattgggcaaatttggtgtgggaaga

SEQ ID NO: 68824 - DNA, 75 bp, Artificial Sequence
  Synthetic
tgggtaggttggatgctggacgagcggccaaattgtgttctgagaacaacacagcaaatttcaagcgttgcagcc

SEQ ID NO: 68825 - DNA, 75 bp, Artificial Sequence
  Synthetic
aacaggcacctcgccactcataacgattgggcaaatttggtgtgggaagacagttccagggacctcttggtctct

SEQ ID NO: 68826 - DNA, 75 bp, Artificial Sequence
  Synthetic
gggagaatgcaacattcttgaaaagagggttcaaaccagatgatcaataccctttccttatacatccaaccatgc

SEQ ID NO: 68827 - DNA, 75 bp, Artificial Sequence
  Synthetic
agggttcaaaccagatgatcaataccctttccttatacatccaaccatgccaatgaaggagatacatgaatctat

SEQ ID NO: 68828 - DNA, 75 bp, Artificial Sequence
  Synthetic
agtagtctcactggtgtatgttatctacaaactttttgctggatttcagggtgcgtattctggcgctcctaagca

SEQ ID NO: 68829 - DNA, 75 bp, Artificial Sequence
  Synthetic
aggaaacactacccagttagtttctccaaacccagcctgatttttgtggaagccagcgaatattaccctgcccgg

SEQ ID NO: 68830 - DNA, 75 bp, Artificial Sequence
  Synthetic
ccaaacccagcctgatttttgtggaagccagcgaatattaccctgcccggtatcaatctcatctcatgcttgccg

SEQ ID NO: 68831 - DNA, 75 bp, Artificial Sequence
  Synthetic
ggatgtgtatgatgaatttgtcaacaaaattagatcagtaccaattggcaaggtactgtctatacctgaatatgg

SEQ ID NO: 68832 - DNA, 75 bp, Artificial Sequence
  Synthetic
gcggaaatggacttgtagggtttgctgacgtgagagatcttttgtggctggatgaagaggctatggaacaagggg

SEQ ID NO: 68833 - DNA, 75 bp, Artificial Sequence
  Synthetic
tgacgtgagagatcttttgtggctggatgaagaggctatggaacaaggggtgtctgattacatcaaggggcttgg

SEQ ID NO: 68834 - DNA, 75 bp, Artificial Sequence
  Synthetic
aacttttaacttggaatttcaattcggaacccgctctccactactgggctagagtaaagtggagagtgagcaatt

SEQ ID NO: 68835 - DNA, 75 bp, Artificial Sequence
  Synthetic
tgaacgtcctggatgctgtcgagttggtggatgagcaaggggtcaacctagagctcactctaatcactcttgata

SEQ ID NO: 68836 - DNA, 75 bp, Artificial Sequence
  Synthetic
tgaaggggcagttgagaagatcctcaagaacctcattaaactgatctctgcactggtaattgtgatcaggagtga

SEQ ID NO: 68837 - DNA, 75 bp, Artificial Sequence
  Synthetic
aagaacctcattaaactgatctctgcactggtaattgtgatcaggagtgattatgatatggtcaccctcacagca

SEQ ID NO: 68838 - DNA, 75 bp, Artificial Sequence
  Synthetic
agcactccaagccgctgaaattggggcatcgtcaaatgctagtgatgagagtatgattaagactcgatgtgttct

SEQ ID NO: 68839 - DNA, 75 bp, Artificial Sequence
  Synthetic
gcatcgtcaaatgctagtgatgagagtatgattaagactcgatgtgttctcaattcacacagcacagctgagact

SEQ ID NO: 68840 - DNA, 75 bp, Artificial Sequence
  Synthetic
caatacggtttcctgaatctcagtggaaaacccacccaccgcaccatgatgtacaacttccctactaaggcagga

SEQ ID NO: 68841 - DNA, 75 bp, Artificial Sequence
  Synthetic
acagagcgcttcatggctaaagaagtttaatgatatggccaacgccgcgaaagggcttgagtggatttctagtaa

SEQ ID NO: 68842 - DNA, 75 bp, Artificial Sequence
  Synthetic
ctcacagggcccactgggcgcaagcactctggtaccccggtacctttgtgcgcctgttttataccccccccccaa

SEQ ID NO: 68843 - DNA, 75 bp, Artificial Sequence
  Synthetic
cccattgctcaaaaacagagtgcatcatggctaaaaaaattcaatgatatggccaacgccgccaagggactggaa

SEQ ID NO: 68844 - DNA, 75 bp, Artificial Sequence
  Synthetic
ttggaaaggttattggaattcacataggaggcaatggtaggcaaggtttctgtgcgggacttaagaggagctact

SEQ ID NO: 68845 - DNA, 75 bp, Artificial Sequence
  Synthetic
aggaggcaatggtaggcaaggtttctgtgcgggacttaagaggagctactttgctagtgagcaaggagagatcca

SEQ ID NO: 68846 - DNA, 75 bp, Artificial Sequence
  Synthetic
acagcaggcaaacagagcctcaaacaagaccccgacaagtttgctaatcctgtcaaggacattttcactgaaatg

SEQ ID NO: 68847 - DNA, 75 bp, Artificial Sequence
  Synthetic
catggctaaaaaaattcaatgatatggccaacgccgccaagggactggaatggatatctaataaaatcagtaaat

SEQ ID NO: 68848 - DNA, 75 bp, Artificial Sequence
  Synthetic
tgccattactagagaatcagatctcaaacctggagcaatctgctgcttcacaggaggacctcgaggcaatgtttg

SEQ ID NO: 68849 - DNA, 75 bp, Artificial Sequence
  Synthetic
catgcagttcaagagcaaacaccgtattgaacctgtatgtcttattattaggggctccccaggcactgggaaatc

SEQ ID NO: 68850 - DNA, 75 bp, Artificial Sequence
  Synthetic
acattatgcaaatcagttgaagcagctaaatatagatacttctcaaatgagcatggaagaggcttgctacggcac

SEQ ID NO: 68851 - DNA, 75 bp, Artificial Sequence
  Synthetic
tgaatacggggcttgcccgaacaacatgatgggtacgttctcagtgcgtactgtgggaacttcaaagtccaaata

SEQ ID NO: 68852 - DNA, 75 bp, Artificial Sequence
  Synthetic
ggatcactttgatggatataagcagcaagtggttacggtcatggatgatttgtgtcaaaatccagatggtaagga

SEQ ID NO: 68853 - DNA, 75 bp, Artificial Sequence
  Synthetic
caagtggttacggtcatggatgatttgtgtcaaaatccagatggtaaggacatgtctttattttgccaaatggtc

SEQ ID NO: 68854 - DNA, 75 bp, Artificial Sequence
  Synthetic
ctggtgaggtcaccaaccttttagagctttgtcaagtggaaagcattctggaagtgaacaacacaacaactgcta

SEQ ID NO: 68855 - DNA, 75 bp, Artificial Sequence
  Synthetic
cactctcgggaaattcgggcagcagtccggggctatctacgtgggcaattttagagtggtcaaccgccatcttgc

SEQ ID NO: 68856 - DNA, 75 bp, Artificial Sequence
  Synthetic
gcatcaactaatgccagtaatattatagtaccaacggtgtctgattccgacgctatccggcgcagattctttatg

SEQ ID NO: 68857 - DNA, 75 bp, Artificial Sequence
  Synthetic
tagtaccaacggtgtctgattccgacgctatccggcgcagattctttatggattgtgacatcgaagtgacggact

SEQ ID NO: 68858 - DNA, 75 bp, Artificial Sequence
  Synthetic
ttgtgcgggtactacacccaatggtcaggatcattggaagtcaccttcatgtttactggatccttcatggctacc

SEQ ID NO: 68859 - DNA, 75 bp, Artificial Sequence
  Synthetic
gtaactcaatgagaaagcactatccggtcagtttctcgaaacccagtttggtctttgtagaggccaacgagtact

SEQ ID NO: 68860 - DNA, 75 bp, Artificial Sequence
  Synthetic
ttaaacgctgtagtccgctggtgtgcgggaaagccattcagcttagggataggaaatccaaggtcaggtacagtg

SEQ ID NO: 68861 - DNA, 75 bp, Artificial Sequence
  Synthetic
cgggaaagccattcagcttagggataggaaatccaaggtcaggtacagtgtggacactgtggtttctgaactcat

SEQ ID NO: 68862 - DNA, 75 bp, Artificial Sequence
  Synthetic
aataaggattagtcttgaggagaaaccagctccagatgccattagcgacctacttgctagtgttgacagtgaaga

SEQ ID NO: 68863 - DNA, 75 bp, Artificial Sequence
  Synthetic
tcttgtggttggatgacgaggccatggagcagggcgtgactgattacattaaaggacttggagatgcttttggca

SEQ ID NO: 68864 - DNA, 75 bp, Artificial Sequence
  Synthetic
ccagctccagatgccattagcgacctacttgctagtgttgacagtgaagaagttcgccagtattgcagggaccag

SEQ ID NO: 68865 - DNA, 75 bp, Artificial Sequence
  Synthetic
gtaaagaccctagattggaggtcgactttgagcaagccctgttttccaagtatgtgggcaatgttttacatgagc

SEQ ID NO: 68866 - DNA, 75 bp, Artificial Sequence
  Synthetic
actactgtagtggcggtagtttcactggtgtatgtcatttacaagttgtttgctggatttcaaggtgcgtattct

SEQ ID NO: 68867 - DNA, 75 bp, Artificial Sequence
  Synthetic
tgctttaatgaagttaattgggaaaatgcaacctttcttaagagaggtttcttgcctgatgaacaatttccattt

SEQ ID NO: 68868 - DNA, 75 bp, Artificial Sequence
  Synthetic
tggtgtatgtcatttacaagttgtttgctggatttcaaggtgcgtattctggcgcacccagacaggtactcaaga

SEQ ID NO: 68869 - DNA, 75 bp, Artificial Sequence
  Synthetic
ggcaagttcagacagatcagggacacttcaccatgctcggcgtcagagatcgcctggctgttcttccacgtcact

SEQ ID NO: 68870 - DNA, 75 bp, Artificial Sequence
  Synthetic
gcagggtgcttcctggctcaagaagtttaacgacatggccaatgccgctaagggtttggagtgggtatccaacaa

SEQ ID NO: 68871 - DNA, 75 bp, Artificial Sequence
  Synthetic
tggcgtggcacaacggcaaacaagaatatgaaaaatttgtaagtgcaattaggtctgtcccaataggaaaggcac

SEQ ID NO: 68872 - DNA, 75 bp, Artificial Sequence
  Synthetic
gcgggattagttggagagatagatctccctcttgagggcacaactaacccaaatggttatgccaactgggacata

SEQ ID NO: 68873 - DNA, 75 bp, Artificial Sequence
  Synthetic
cttcaccatgctcggcgtcagagatcgcctggctgttcttccacgtcactcacatcccggtaagacaatctgggt

SEQ ID NO: 68874 - DNA, 75 bp, Artificial Sequence
  Synthetic
cctaaagcagttgccattattggagaatcagatctcgaaccttgaacaatctgcagcatcacaggaagaccttga

SEQ ID NO: 68875 - DNA, 75 bp, Artificial Sequence
  Synthetic
tataactcttgacatcaatgagaagtttagagacattacaaaattcattccagaaagtatcagtgctgctactga

SEQ ID NO: 68876 - DNA, 75 bp, Artificial Sequence
  Synthetic
tagctgtcctcccgcgccactctcaaccaggaaaaacaatctgggtggagcacaaactagtgaacattctggatg

SEQ ID NO: 68877 - DNA, 75 bp, Artificial Sequence
  Synthetic
tttagagacattacaaaattcattccagaaagtatcagtgctgctactgacgccaccctagtgatcaacacagag

SEQ ID NO: 68878 - DNA, 75 bp, Artificial Sequence
  Synthetic
gctcgaattattctagaggtcgaatacacctcaaccccaccaggaatctggtcgtgaatatgactggtgggggta

SEQ ID NO: 68879 - DNA, 75 bp, Artificial Sequence
  Synthetic
catcgcaccatgatgtacaattttcccaccaaggctgggcagtgtggtggtgtagtgacatctgttggaaagatc

SEQ ID NO: 68880 - DNA, 75 bp, Artificial Sequence
  Synthetic
gcaaacaccgtattgaacctgtatgtctcatcattaggggctcaccaggcacaggtaagtctttggcaactggca

SEQ ID NO: 68881 - DNA, 75 bp, Artificial Sequence
  Synthetic
ccaccaaggctgggcagtgtggtggtgtagtgacatctgttggaaagatcattggcattcacattggtggtaatg

SEQ ID NO: 68882 - DNA, 75 bp, Artificial Sequence
  Synthetic
gctacaagcagcaagtggtcacagtcatggacgatctatgccagaatcccgacggcaaggacatgtcactgtttt

SEQ ID NO: 68883 - DNA, 75 bp, Artificial Sequence
  Synthetic
caaacaaggagactgggagactgaacatcaatggcccgacacgtaccaaactggaaccaagtgtgttccatgatg

SEQ ID NO: 68884 - DNA, 75 bp, Artificial Sequence
  Synthetic
catcaatggcccgacacgtaccaaactggaaccaagtgtgttccatgatgtgttcgagggcaacaaagaaccagc

SEQ ID NO: 68885 - DNA, 75 bp, Artificial Sequence
  Synthetic
catggacgatctatgccagaatcccgacggcaaggacatgtcactgttttgtcagatggtgtcgactgtggactt

SEQ ID NO: 68886 - DNA, 75 bp, Artificial Sequence
  Synthetic
tagtgtgtgggaaagctatccagctcagagatagaaaatctaaggttagatatagtgtggatacggtagtttcag

SEQ ID NO: 68887 - DNA, 75 bp, Artificial Sequence
  Synthetic
tatagtgtggatacggtagtttcagagcttattagggaatacaataataggtccgccattggcaacacaatcgag

SEQ ID NO: 68888 - DNA, 75 bp, Artificial Sequence
  Synthetic
cttacacgagcctgacgagtatgtgactcaggctgcccttcattatgcaaatcaactcaagcaactggacataaa

SEQ ID NO: 68889 - DNA, 75 bp, Artificial Sequence
  Synthetic
cagtaacatcatagtgccaacggtgtctgattcagacgccattcgccgtaggttctacatggactgtgacattga

SEQ ID NO: 68890 - DNA, 75 bp, Artificial Sequence
  Synthetic
aagatgcttatagcctacacaccgccgggaggtcccctacccaaggaccgggcgaccgccatgttgggtacgcat

SEQ ID NO: 68891 - DNA, 75 bp, Artificial Sequence
  Synthetic
actcaggctgcccttcattatgcaaatcaactcaagcaactggacataaacaccaccaaaatgagcatggaggaa

SEQ ID NO: 68892 - DNA, 75 bp, Artificial Sequence
  Synthetic
tctgattcagacgccattcgccgtaggttctacatggactgtgacattgaggtgacagactcatataaaacagat

SEQ ID NO: 68893 - DNA, 75 bp, Artificial Sequence
  Synthetic
gtcatctgggatttcgggctacaatcgtctgttactcttgtaataccatggattagcaacacccactacagggcg

SEQ ID NO: 68894 - DNA, 75 bp, Artificial Sequence
  Synthetic
attccactacctctaccgatcagggttctgtattcacgtgcagtgcaatgccagtaaattccaccaaggagcact

SEQ ID NO: 68895 - DNA, 75 bp, Artificial Sequence
  Synthetic
attaagaagagagatatcctcgatccaacaaccagggatacctccagaatgaaattttacatggacaagtacggg

SEQ ID NO: 68896 - DNA, 75 bp, Artificial Sequence
  Synthetic
cccttagtgtgcgggaaagctatccaactaagggacagaaagtccaaggtgaggtatagtgtggatacagtgatc

SEQ ID NO: 68897 - DNA, 75 bp, Artificial Sequence
  Synthetic
caacaaccagggatacctccagaatgaaattttacatggacaagtacgggctggacttaccctattccacctatg

SEQ ID NO: 68898 - DNA, 75 bp, Artificial Sequence
  Synthetic
aactaagggacagaaagtccaaggtgaggtatagtgtggatacagtgatctctgagcttataagggagtataata

SEQ ID NO: 68899 - DNA, 75 bp, Artificial Sequence
  Synthetic
ttgaagaaaagccagccccagatgctattagtgaccttcttgccagtgtggatagtgaagaggtacgccaatact

SEQ ID NO: 68900 - DNA, 75 bp, Artificial Sequence
  Synthetic
attctgtttaccttagaatgacttttggtcacctttatgaggcgtttcatgccaaccccggtactgtaactggtt

SEQ ID NO: 68901 - DNA, 75 bp, Artificial Sequence
  Synthetic
tggtcacctttatgaggcgtttcatgccaaccccggtactgtaactggttcagcggtgggctgcaacccagatat

SEQ ID NO: 68902 - DNA, 75 bp, Artificial Sequence
  Synthetic
tattagtgaccttcttgccagtgtggatagtgaagaggtacgccaatactgtagagaccagggatggatcatccc

SEQ ID NO: 68903 - DNA, 75 bp, Artificial Sequence
  Synthetic
ggttgtctcgctggtgtatgtcatctacaaactttttgctggattccaaggcgcgtactctggtgctcccaagca

SEQ ID NO: 68904 - DNA, 75 bp, Artificial Sequence
  Synthetic
gtaatccctataactatcacattggccccaatgtgttctgaattcgcaggtcttaggcaggcagtcacgcaaggg

SEQ ID NO: 68905 - DNA, 75 bp, Artificial Sequence
  Synthetic
tgctatacttccagaatatgtcatagggacagtggcaggcggcacaggaacagaagacagtcaccctccttacaa

SEQ ID NO: 68906 - DNA, 75 bp, Artificial Sequence
  Synthetic
cagcccagtgtggttcagagccttggaggtagtgctgcgggagatcggttattcagaagaggctgtgtcactaat

SEQ ID NO: 68907 - DNA, 75 bp, Artificial Sequence
  Synthetic
gtacagcttaaacctcaaccccaccagaaatctggtcgtgaatgtgactggtgggggtaaatttgttataacggt

SEQ ID NO: 68908 - DNA, 75 bp, Artificial Sequence
  Synthetic
gtacagcttatacctcaaccccaccagaaatctggtcgtgaatgtgactggtgggggtaaatttgttataacggt

SEQ ID NO: 68909 - DNA, 75 bp, Artificial Sequence
  Synthetic
gtacagcttacacctcaaccccaccagaaatctggtcgtgaatgtgactggtgggggtaaatttgttataacggt

SEQ ID NO: 68910 - DNA, 75 bp, Artificial Sequence
  Synthetic
gtacagcttagacctcaaccccaccagaaatctggtcgtgaatgtgactggtgggggtaaatttgttataacggt

SEQ ID NO: 68911 - DNA, 75 bp, Artificial Sequence
  Synthetic
aactccgcctatacatataccaggggaagtacacaacctattggaaatatgcagagtggagaccattctggaagt

SEQ ID NO: 68912 - DNA, 75 bp, Artificial Sequence
  Synthetic
tgctgtttccagagaagttgaggctctcaggaaccacctcattgggtccgatggagcggttgagaagatcctgaa

SEQ ID NO: 68913 - DNA, 75 bp, Artificial Sequence
  Synthetic
gatcaagggcactttaccatgttgggagttagagatcgcctggccgtccttccccgccactcacaacctggaaaa

SEQ ID NO: 68914 - DNA, 75 bp, Artificial Sequence
  Synthetic
atgatcaataacatcattattaggactctcctaattaaaacttttaaaggaatagatttggatgagttgaacatg

SEQ ID NO: 68915 - DNA, 75 bp, Artificial Sequence
  Synthetic
gaggtagtgctgcgggagatcggttattcagaagaggctgtgtcactaattgaggggataaatcacactcatcat

SEQ ID NO: 68916 - DNA, 75 bp, Artificial Sequence
  Synthetic
ctctcctaattaaaacttttaaaggaatagatttggatgagttgaacatggtggcttatggagatgatgtgctgg

SEQ ID NO: 68917 - DNA, 75 bp, Artificial Sequence
  Synthetic
gagttagagatcgcctggccgtccttccccgccactcacaacctggaaaaacgatctgggtagagcataaactcg

SEQ ID NO: 68918 - DNA, 75 bp, Artificial Sequence
  Synthetic
atgatatggtcaccctcacagcaactttagctctgatcggctgtcatggaagcccttgggcttggattaaagcca

SEQ ID NO: 68919 - DNA, 75 bp, Artificial Sequence
  Synthetic
ccaatgagaaattcagagacatcactaaattcatcccggagagcatcagcgctgctagtgatgctaccctagtga

SEQ ID NO: 68920 - DNA, 75 bp, Artificial Sequence
  Synthetic
gatatccaacaaaattagcaagtttattgactggctcagggagaagattgtgccagcagctaaggaaaaagcgga

SEQ ID NO: 68921 - DNA, 75 bp, Artificial Sequence
  Synthetic
ggcaaactgctaccaatccctcagtttttgttaagttgtcagaccccccagcacaggtttcagtcccattcatgt

SEQ ID NO: 68922 - DNA, 75 bp, Artificial Sequence
  Synthetic
ctgacaagtcaccctgctttaatgaagtcacttgggaaaatgctacttttctgaagagagggttcctgcctgacc

SEQ ID NO: 68923 - DNA, 75 bp, Artificial Sequence
  Synthetic
taaattcatcccggagagcatcagcgctgctagtgatgctaccctagtgatcaatacggaacacatgccctcaat

SEQ ID NO: 68924 - DNA, 75 bp, Artificial Sequence
  Synthetic
gtacaactttcctactaaagctgggcagtgtggaggggtggtgacatcagtcggaaaggtcatcggtattcacat

SEQ ID NO: 68925 - DNA, 75 bp, Artificial Sequence
  Synthetic
ctcgtaatactcaagaccacgtgcgttctctctgcctgttggcgtggcacaacgggaaggatgaatatgaaaagt

SEQ ID NO: 68926 - DNA, 75 bp, Artificial Sequence
  Synthetic
cagtgtggaggggtggtgacatcagtcggaaaggtcatcggtattcacataggtggtaatggtagacagggtttt

SEQ ID NO: 68927 - DNA, 75 bp, Artificial Sequence
  Synthetic
ttctctctgcctgttggcgtggcacaacgggaaggatgaatatgaaaagtttgtgagtacaattagatcagttcc

SEQ ID NO: 68928 - DNA, 75 bp, Artificial Sequence
  Synthetic
gtacatcaaagaggcagcccttcattatgcaaatcaattgaagcagctagaaattaatacctctcaaatgagtat

SEQ ID NO: 68929 - DNA, 75 bp, Artificial Sequence
  Synthetic
aaccttgaggctattgatcttcatactagtgcaggttacccctatagtgccctggggataaagaaaagagacatc

SEQ ID NO: 68930 - DNA, 75 bp, Artificial Sequence
  Synthetic
ggaagactcagcattaatggaccaacccgcactaagcttgagcccagtgttttccatgatgttttcgagggaaac

SEQ ID NO: 68931 - DNA, 75 bp, Artificial Sequence
  Synthetic
cccgcactaagcttgagcccagtgttttccatgatgttttcgagggaaacaaagagccagcagtcttgcatagta

SEQ ID NO: 68932 - DNA, 75 bp, Artificial Sequence
  Synthetic
gttctcacgagaattcaaactcagccactgagggttctaccataaactacaccaccatcaattactacaaagact

SEQ ID NO: 68933 - DNA, 75 bp, Artificial Sequence
  Synthetic
atgagtacatcaaggaggcggccctacactatgcaaatcagttgaaacagctagacatcgacacctctcagatga

SEQ ID NO: 68934 - DNA, 75 bp, Artificial Sequence
  Synthetic
acactatgcaaatcagttgaaacagctagacatcgacacctctcagatgagcatggatgaggcttgttatggtac

SEQ ID NO: 68935 - DNA, 75 bp, Artificial Sequence
  Synthetic
tcactgaaatggcagcaccactgaagtccccatccgctgaggcatgtggatacagtgatcgagtggcgcaattaa

SEQ ID NO: 68936 - DNA, 75 bp, Artificial Sequence
  Synthetic
tattctagatcctaccaccagggatgtgagcaaaatgaaatcttacatggataagtatggtttggatctcccata

SEQ ID NO: 68937 - DNA, 75 bp, Artificial Sequence
  Synthetic
gtgagcaaaatgaaatcttacatggataagtatggtttggatctcccatactccacctatgtcaaggatgagctt

SEQ ID NO: 68938 - DNA, 75 bp, Artificial Sequence
  Synthetic
ttgtggttggatgatgaagccatggagcaaggtgtatctgattacattagggggcttggtgatgccttcggtatg

SEQ ID NO: 68939 - DNA, 75 bp, Artificial Sequence
  Synthetic
aggatgacttttgggcacctttatgaggcctttcacgcaaatcctggaactgtcaccggttcagctgtagggtgc

SEQ ID NO: 68940 - DNA, 75 bp, Artificial Sequence
  Synthetic
aggcctttcacgcaaatcctggaactgtcaccggttcagctgtagggtgcaacccggatgtgttctggagcaaac

SEQ ID NO: 68941 - DNA, 75 bp, Artificial Sequence
  Synthetic
ccaagtaccctttagtggttaggatttacatgagaatgaagcacgtcagggcgtggatacctcgcccgatgcgta

SEQ ID NO: 68942 - DNA, 75 bp, Artificial Sequence
  Synthetic
caggagtgactatgatatggtcacattgacggcaacacttgccctgattgggtgccatgggagcccttgggcctg

SEQ ID NO: 68943 - DNA, 75 bp, Artificial Sequence
  Synthetic
ttagggcattggagctagtcctcagagggataggctatagtgaagaggcaatctcgctcattgaagggatcaatc

SEQ ID NO: 68944 - DNA, 75 bp, Artificial Sequence
  Synthetic
agggataggctatagtgaagaggcaatctcgctcattgaagggatcaatcatacgcaccacgtataccgcaacaa

SEQ ID NO: 68945 - DNA, 75 bp, Artificial Sequence
  Synthetic
gatccatgagtccattcgatggaccaaggacgcacgaaacactcaagaccatgtgcggtccttgtgtctcctagc

SEQ ID NO: 68946 - DNA, 75 bp, Artificial Sequence
  Synthetic
catcattagggcactacttatcaaaacatttaagggtattgatttggatgaactcaacatggttgcctacgggga

SEQ ID NO: 68947 - DNA, 75 bp, Artificial Sequence
  Synthetic
acatttaagggtattgatttggatgaactcaacatggttgcctacggggatgacgtgctagccagttatcctttc

SEQ ID NO: 68948 - DNA, 75 bp, Artificial Sequence
  Synthetic
gagaatgaagcatgtcagagcatggatacctcgcccgatgcgcaaccaaaactacttgttcaaagccaatccaaa

SEQ ID NO: 68949 - DNA, 75 bp, Artificial Sequence
  Synthetic
tgcttcaatgaagtcaactggggtaatgcaacctttcttaaaagaggcttcttgcctgacgatcaattccctttc

SEQ ID NO: 68950 - DNA, 75 bp, Artificial Sequence
  Synthetic
gaaatctggtcgtgaatatgactggtgggggtaaatttgttatacacaaaaaaaacacaaaaaagtaaaccctgg

SEQ ID NO: 68951 - DNA, 75 bp, Artificial Sequence
  Synthetic
gaataattacatgcagttcaagagcaaacaccgtattgaacctgtatgcttgatcatcagaggctcacctggtac

SEQ ID NO: 68952 - DNA, 75 bp, Artificial Sequence
  Synthetic
gatcacgtgcggtccttgtgtctcttggcgtggcacaatggtaagcaagaatatgaaaaattcgtgagcactatt

SEQ ID NO: 68953 - DNA, 75 bp, Artificial Sequence
  Synthetic
atcactctagtgtgtattccttacctccagacccagaccatttcgacgggtacaaacaacagatcgtcacagtaa

SEQ ID NO: 68954 - DNA, 75 bp, Artificial Sequence
  Synthetic
ggtacccatatagcgctctgggaatcaagaaaagagacatcctcgacccattgaccagggacgtctctaagatga

SEQ ID NO: 68955 - DNA, 75 bp, Artificial Sequence
  Synthetic
gtccaccataattggccaaatatgcagatattatagccagtggtcaggttcattagagatcaccttcatgtttac

SEQ ID NO: 68956 - DNA, 75 bp, Artificial Sequence
  Synthetic
cactgctagtgatgccaccctagtgatcaacacggagcacatgccatcaatgtttgtcccggtgggtgacgttgt

SEQ ID NO: 68957 - DNA, 75 bp, Artificial Sequence
  Synthetic
tctgtttatctcagaatgacctttggacatctttacgaagtgtttcatgccaatcccggcactgtgactggttca

SEQ ID NO: 68958 - DNA, 75 bp, Artificial Sequence
  Synthetic
gggcaaaatgcacaattccactacctttaccgatcagggttctgcatccacgtacagtgcaatgccagtaaattc

SEQ ID NO: 68959 - DNA, 75 bp, Artificial Sequence
  Synthetic
acccacagggcccactgggcgctagcactctggtatcacgatacctttgtgcgcctgttttatatccccaccccg

SEQ ID NO: 68960 - DNA, 75 bp, Artificial Sequence
  Synthetic
tatgctgccacagcaggcaagcagagtctcaagcaggatccagacaagtttgcaaatcctgttaaagacattttc

SEQ ID NO: 68961 - DNA, 75 bp, Artificial Sequence
  Synthetic
gactgctaacgcggttgaaggagaaaacgttcgttacccggccaattacttcgagaagcccagtagtgccgtgaa

SEQ ID NO: 68962 - DNA, 75 bp, Artificial Sequence
  Synthetic
ataactacatgcagttcaagagcaaacaccgaattgaacctgtatgtctcattattaggggctcaccaggcactg

SEQ ID NO: 68963 - DNA, 75 bp, Artificial Sequence
  Synthetic
atacgggttcttaaatctaagcggtaagcccactcaccgcactatgatgtataacttccctacgaaagcagggca

SEQ ID NO: 68964 - DNA, 75 bp, Artificial Sequence
  Synthetic
tttgaggaccaacaattgtgctacaataatagtgccatacataaacgcactgccctttgattctgccttgaacca

SEQ ID NO: 68965 - DNA, 75 bp, Artificial Sequence
  Synthetic
ccccctccccaattcgcaacttagaagcaatatacaacactgatcaacagcgggcgtggcgcaccagccatgtct

SEQ ID NO: 68966 - DNA, 75 bp, Artificial Sequence
  Synthetic
cccacagggcctactgggcgctagcactctggcactgaggtacctttgtgcgcctgttttatttcccttccccga

SEQ ID NO: 68967 - DNA, 75 bp, Artificial Sequence
  Synthetic
tcataacaccctcttatatttactacaattgaatagcaagaaatgggggcacaggtctcaactcagcgctccggt

SEQ ID NO: 68968 - DNA, 75 bp, Artificial Sequence
  Synthetic
tgtttcatgatgtgtttgaaggcaataaggaaccagcagtcttaacaagtaaagaccctagattggaggtcgact

SEQ ID NO: 68969 - DNA, 75 bp, Artificial Sequence
  Synthetic
caattgaatagcaagaaatgggggcacaggtctcaactcagcgctccggttcccatgaaacgagcaacgtagcac

SEQ ID NO: 68970 - DNA, 75 bp, Artificial Sequence
  Synthetic
cacctattctaccaaattttcaccccaccccgtgtatccatatacctggtgaagttaggaacttgctagagctat

SEQ ID NO: 68971 - DNA, 75 bp, Artificial Sequence
  Synthetic
atttcacccaggatccgggtaaatttacacagcccgttcttgatgctcttcgcgaggctgtaccaccactacagt

SEQ ID NO: 68972 - DNA, 75 bp, Artificial Sequence
  Synthetic
atgaagcctaataaagagactggggagattgaactttatggcccaacccgtaccaaattggaacccagtgtattt

SEQ ID NO: 68973 - DNA, 75 bp, Artificial Sequence
  Synthetic
tacacagcccgttcttgatgctcttcgcgaggctgtaccaccactacagtcacccagtgcagaggcatgtggcta

SEQ ID NO: 68974 - DNA, 75 bp, Artificial Sequence
  Synthetic
cgttcgttacccggccaactacttcgagaagcttagtaccaccatgaacgaggcagagtgtttcgttcagcacaa

SEQ ID NO: 68975 - DNA, 75 bp, Artificial Sequence
  Synthetic
ttacgctgagtggccagagtactgccctgatacagacgccacagcggtagataagcccactcgccccgatgtgtc

SEQ ID NO: 68976 - DNA, 75 bp, Artificial Sequence
  Synthetic
cctgatacagacgccacagcggtagataagcccactcgccccgatgtgtcagtgaacagattctatactatgccg

SEQ ID NO: 68977 - DNA, 75 bp, Artificial Sequence
  Synthetic
gcgaccatggcagtggctgcgttggcggcctgcccatggagaaatccgtgggacgctctagttctgacatggtgc

SEQ ID NO: 68978 - DNA, 75 bp, Artificial Sequence
  Synthetic
ggacagaacgcacagtaccactacttgtacagatcaggcttttgcattcacgtacaatgtaatgccagcaagttt

SEQ ID NO: 68979 - DNA, 75 bp, Artificial Sequence
  Synthetic
tgtacagatcaggcttttgcattcacgtacaatgtaatgccagcaagtttcaccagggtgctctcctagtagctg

SEQ ID NO: 68980 - DNA, 75 bp, Artificial Sequence
  Synthetic
acttttcatgccaacccaggcacggtcactggctcagctgtcgggtgtaacccagatgtgttctggagtaagctc

SEQ ID NO: 68981 - DNA, 75 bp, Artificial Sequence
  Synthetic
ccacacaacctggaaagaaaggcagggcatttatacatccatacgttcttgattgtggagtaccgatgagtcagg

SEQ ID NO: 68982 - DNA, 75 bp, Artificial Sequence
  Synthetic
ccacacaacctggaaagaaaggcagggcatttatacatccatacgttcttgattgtggagtaccgttgagtcagg

SEQ ID NO: 68983 - DNA, 75 bp, Artificial Sequence
  Synthetic
ccacacaacctggaaagaaaggcagggcatttatacatccatacgttcttgattgtggagtaccgctgagtcagg

SEQ ID NO: 68984 - DNA, 75 bp, Artificial Sequence
  Synthetic
ccacacaacctggaaagaaaggcagggcatttatacatccatacgttcttgattgtggagtaccggtgagtcagg

SEQ ID NO: 68985 - DNA, 75 bp, Artificial Sequence
  Synthetic
ggcatttatacatccatacgttcttgattgtggagtaccgatgagtcaggctctagtgttcccccatcagtggat

SEQ ID NO: 68986 - DNA, 75 bp, Artificial Sequence
  Synthetic
ggcatttatacatccatacgttcttgattgtggagtaccgttgagtcaggctctagtgttcccccatcagtggat

SEQ ID NO: 68987 - DNA, 75 bp, Artificial Sequence
  Synthetic
ggcatttatacatccatacgttcttgattgtggagtaccgctgagtcaggctctagtgttcccccatcagtggat

SEQ ID NO: 68988 - DNA, 75 bp, Artificial Sequence
  Synthetic
ggcatttatacatccatacgttcttgattgtggagtaccggtgagtcaggctctagtgttcccccatcagtggat

SEQ ID NO: 68989 - DNA, 75 bp, Artificial Sequence
  Synthetic
accaaatctcaaatcttgaacagtctgctgcctcgcaagaggatctagaagctatgtttggtaatgtgtcatatt

SEQ ID NO: 68990 - DNA, 75 bp, Artificial Sequence
  Synthetic
taccattaattactataaagactcctatgccgccacagcaggtaaacagagcctcaagcaggacccagacaagtt

SEQ ID NO: 68991 - DNA, 75 bp, Artificial Sequence
  Synthetic
tcactccaatttttcactggctgtcgtaccagtgtgcccgttaaagtataacactggtgccaccccttcgatacc

SEQ ID NO: 68992 - DNA, 75 bp, Artificial Sequence
  Synthetic
ttggattggccatccggtgtgcaacagagcaattatttacctatttattggttttgtaccattaaccttgaattc

SEQ ID NO: 68993 - DNA, 75 bp, Artificial Sequence
  Synthetic
gtaccagtgtgcccgttaaagtataacactggtgccaccccttcgataccgatcacaattacagttgctccactg

SEQ ID NO: 68994 - DNA, 75 bp, Artificial Sequence
  Synthetic
tgcgtgcacacccaccggggaagttgtcccacaattgctccaatatatgtttgtgccacctggggcccccaagcc

SEQ ID NO: 68995 - DNA, 75 bp, Artificial Sequence
  Synthetic
tttctaactactgatgatggaacttcagcgccaatactgccaggttttcaccccacaccagctatccacattcct

SEQ ID NO: 68996 - DNA, 75 bp, Artificial Sequence
  Synthetic
cagcgccaatactgccaggttttcaccccacaccagctatccacattcctggggaagttcacagtttgctggagt

SEQ ID NO: 68997 - DNA, 75 bp, Artificial Sequence
  Synthetic
gtggatacagtgatcgagtagcgcagttaactatcggcaactccaccatcactacgcaagaagcagcaaacatta

SEQ ID NO: 68998 - DNA, 75 bp, Artificial Sequence
  Synthetic
attggacaccaaattgtgggagaaatcgtccaaaggatggtattggaaattcccggatgtgttaacagaaactgg

SEQ ID NO: 68999 - DNA, 75 bp, Artificial Sequence
  Synthetic
tgtccgcccagagcgcagtggacaccttgtgtgcagcgtttagagtggatcccggtagggatggaccatggcagt

SEQ ID NO: 69000 - DNA, 75 bp, Artificial Sequence
  Synthetic
cttgtgtgcagcgtttagagtggatcccggtagggatggaccatggcagtccactatggtcgggcaattatgcag

SEQ ID NO: 69001 - DNA, 75 bp, Artificial Sequence
  Synthetic
taaattccaccaaggggcgctcttagttgctgtcctcccagagtatgtcattgggacggtggccggaggcacagg

SEQ ID NO: 69002 - DNA, 75 bp, Artificial Sequence
  Synthetic
gttgctgtcctcccagagtatgtcattgggacggtggccggaggcacaggaacggaggatagtcaccccccttat

SEQ ID NO: 69003 - DNA, 75 bp, Artificial Sequence
  Synthetic
gctggtcgcttacactcctccaggaggcgcccagccagctactcgagaactcgctatgttgggcacacatgtgat

SEQ ID NO: 69004 - DNA, 75 bp, Artificial Sequence
  Synthetic
ggcgcccagccagctactcgagaactcgctatgttgggcacacatgtgatctgggattttggcttacagtcatca

SEQ ID NO: 69005 - DNA, 75 bp, Artificial Sequence
  Synthetic
caattgacagtgtgcccacatcaatggattaacttgaggactaataattgtgccacaataatagtgccgtacata

SEQ ID NO: 69006 - DNA, 75 bp, Artificial Sequence
  Synthetic
ggattaacttgaggactaataattgtgccacaataatagtgccgtacataaacgcactgcccttcgattctgctt

SEQ ID NO: 69007 - DNA, 75 bp, Artificial Sequence
  Synthetic
acgaccggtgtggtgactatatggtatcaaacaaattttgtggtccctcctgacactcccactagcgcttacatc

SEQ ID NO: 69008 - DNA, 75 bp, Artificial Sequence
  Synthetic
atcaaacaaattttgtggtccctcctgacactcccactagcgcttacatcttggcatttggagcgggtcagaaga

SEQ ID NO: 69009 - DNA, 75 bp, Artificial Sequence
  Synthetic
tctactggtggcaatgggctcgttggctttgcagacgtcagggatctcttgtggttggatgaagaagctatggag

SEQ ID NO: 69010 - DNA, 75 bp, Artificial Sequence
  Synthetic
atgctataaccaacactgtaaatgccactataaacagagtgttggatcgaccgatttctcactcatccacagctg

SEQ ID NO: 69011 - DNA, 75 bp, Artificial Sequence
  Synthetic
cactataaacagagtgttggatcgaccgatttctcactcatccacagctgcaaacacccaggtgagtcaacactc

SEQ ID NO: 69012 - DNA, 75 bp, Artificial Sequence
  Synthetic
acccacagggcccactgggcgccagcactctggtaatacgttacctttgtgcgcctgttttacctccccctaccc

SEQ ID NO: 69013 - DNA, 75 bp, Artificial Sequence
  Synthetic
ggagcgcaggtgtcaacaaccaagaccggatctcatgaaaatggaaacattgcgacagggggctctacaataaat

SEQ ID NO: 69014 - DNA, 75 bp, Artificial Sequence
  Synthetic
ccggatctcatgaaaatggaaacattgcgacagggggctctacaataaattacaccaatatcaattattatagag

SEQ ID NO: 69015 - DNA, 75 bp, Artificial Sequence
  Synthetic
aattgaaactaggtgtgtagtcaacaagaacagtgtggaggaagctagcttaaaccacttcttctcccgtgctgc

SEQ ID NO: 69016 - DNA, 75 bp, Artificial Sequence
  Synthetic
tagaagtcaataatgtgcccacgaatgccaccagcttaatggagagactgcggtttccggtctcagcccaagcgg

SEQ ID NO: 69017 - DNA, 75 bp, Artificial Sequence
  Synthetic
aagaacagtgtggaggaagctagcttaaaccacttcttctcccgtgctgcattagttggcaaagtggagctaaat

SEQ ID NO: 69018 - DNA, 75 bp, Artificial Sequence
  Synthetic
tgggtactacacccaatggtcagggtcactggaagttaccttcatgtttactgggtcctttatggctaccggcaa

SEQ ID NO: 69019 - DNA, 75 bp, Artificial Sequence
  Synthetic
ttacccaaagatcgggccacagcgatgctgggtacacacgtcatctgggattttgggctacaatcatctgtcacc

SEQ ID NO: 69020 - DNA, 75 bp, Artificial Sequence
  Synthetic
agttgtgcgggtactacactcaatggtcaggatcactggaagtcactttcatgtttactgggtcctttatggcca

SEQ ID NO: 69021 - DNA, 75 bp, Artificial Sequence
  Synthetic
ctagagatgttcacatacatgaggttcaatgctgaattcacttttgtggccaccactagggctgggcaggtgccg

SEQ ID NO: 69022 - DNA, 75 bp, Artificial Sequence
  Synthetic
tcaatgctgaattcacttttgtggccaccactagggctgggcaggtgccgtctagggtgcttcagtacatgtacg

SEQ ID NO: 69023 - DNA, 75 bp, Artificial Sequence
  Synthetic
ggactggttagtatctggtatcaaacaaactacgtggttccaattggggcgcccaacacagcttacataatagca

SEQ ID NO: 69024 - DNA, 75 bp, Artificial Sequence
  Synthetic
gaccgggcgaccgccatgttgggtacgcatgtcatttgggatttcggactacaatcgtctgttactcttgtgata

SEQ ID NO: 69025 - DNA, 75 bp, Artificial Sequence
  Synthetic
gtaagatgacagaccctccgccgcaagtgtcagtaccatttatgtctcccgctagcgcttatcaatggttctacg

SEQ ID NO: 69026 - DNA, 75 bp, Artificial Sequence
  Synthetic
tcacatattacagacagcctctattcagggagatagggtggcagatgtgatcgagagctctataggagatagtgt

SEQ ID NO: 69027 - DNA, 75 bp, Artificial Sequence
  Synthetic
ggtaccagacgaattacgtggtcccaattggagcacccaatacagcctatataatagcattggcggcagctcaga

SEQ ID NO: 69028 - DNA, 75 bp, Artificial Sequence
  Synthetic
agtgtcagtaccatttatgtctcccgctagcgcttatcaatggttctacgacgggtatcccactttcggtgaaca

SEQ ID NO: 69029 - DNA, 75 bp, Artificial Sequence
  Synthetic
ttgggtgtccgtgtttctttttattcttacattggctgcttatggtgacaattaaagaattggcaccatatagct

SEQ ID NO: 69030 - DNA, 75 bp, Artificial Sequence
  Synthetic
tgaagagatcaccaacgagcggatcaccatcaggatttacatgaggctcaagcacatacgagcttgggttccacg

SEQ ID NO: 69031 - DNA, 75 bp, Artificial Sequence
  Synthetic
cttataacacactttgttttatattgactctcaattcagcaaaatgggagcacaggtgtcgacgcaaaagtccgg

SEQ ID NO: 69032 - DNA, 75 bp, Artificial Sequence
  Synthetic
gactctcaattcagcaaaatgggagcacaggtgtcgacgcaaaagtccggttcgcatgagacaggaattgcagca

SEQ ID NO: 69033 - DNA, 75 bp, Artificial Sequence
  Synthetic
accatcaggatttacatgaggctcaagcacatacgagcttgggttccacgaccgctcaggtctgaaccttacgtg

SEQ ID NO: 69034 - DNA, 75 bp, Artificial Sequence
  Synthetic
gccaccgactagacaccggtaaagtcccagcacttcaggccgctgagattggagcatcgtcaaatgctagtgatg

SEQ ID NO: 69035 - DNA, 75 bp, Artificial Sequence
  Synthetic
gatttcactcaggaccccaccaggtttacaagcccggtattagatgcacttagggaggtagcgccaccacttaag

SEQ ID NO: 69036 - DNA, 75 bp, Artificial Sequence
  Synthetic
tttgggcaacagtccggggccatatacgttggcagctatagagtagtgaacagacaccttgccactcacaatgat

SEQ ID NO: 69037 - DNA, 75 bp, Artificial Sequence
  Synthetic
ttacaagcccggtattagatgcacttagggaggtagcgccaccacttaagtccccttcagtggaggcttgcgggt

SEQ ID NO: 69038 - DNA, 75 bp, Artificial Sequence
  Synthetic
tcttaattcgcacagcacggctgaaaccactctcgacagcttctttagcagagcggggttggttggagagataga

SEQ ID NO: 69039 - DNA, 75 bp, Artificial Sequence
  Synthetic
acgttggcagctatagagtagtgaacagacaccttgccactcacaatgattgggctaacttagtgtgggaagaca

SEQ ID NO: 69040 - DNA, 75 bp, Artificial Sequence
  Synthetic
gggtgtattattgcaactcccggaggaaacactatccagtcagtttttctaaacctagcctggtgttcgtcgagg

SEQ ID NO: 69041 - DNA, 75 bp, Artificial Sequence
  Synthetic
cctatggagagtggcccgagtattgccccgatagggatgctactgcagtagacaaacccacgcgccctgatgtgt

SEQ ID NO: 69042 - DNA, 75 bp, Artificial Sequence
  Synthetic
ccccgatagggatgctactgcagtagacaaacccacgcgccctgatgtgtcagtgaacagattctatactatgtc

SEQ ID NO: 69043 - DNA, 75 bp, Artificial Sequence
  Synthetic
gcgcaggaaggtggagttgttcacttacatgcgctttgacgcagagttcacttttgtcgcgtgcacgcctaccgg

SEQ ID NO: 69044 - DNA, 75 bp, Artificial Sequence
  Synthetic
agttccattcatgtcacccgcgagcgcttaccagtggttttacgacgggtaccccacgtttggagaacataaaca

SEQ ID NO: 69045 - DNA, 75 bp, Artificial Sequence
  Synthetic
aactggtaaagagtatggattgacaatgacacccgctgacaagtcaccctgctttaatgaagttacctgggaaaa

SEQ ID NO: 69046 - DNA, 75 bp, Artificial Sequence
  Synthetic
ttgagcaagccctcttctccaagtatgtgggcaatgtcctccacgaacctgatgaatatgtgaagcaggcagctc

SEQ ID NO: 69047 - DNA, 75 bp, Artificial Sequence
  Synthetic
tgtcgtgggaattgtatccactggagggaacggtcttgtggggtttgctgatgttagggacctgctttggcttga

SEQ ID NO: 69048 - DNA, 75 bp, Artificial Sequence
  Synthetic
cggacaaaacgctcaatatcattatttgtatagatcgggattctgcatacacgttcaatgcaatgccagtaaatt

SEQ ID NO: 69049 - DNA, 75 bp, Artificial Sequence
  Synthetic
ttgtatagatcgggattctgcatacacgttcaatgcaatgccagtaaattccatcaaggggctctattggtggca

SEQ ID NO: 69050 - DNA, 75 bp, Artificial Sequence
  Synthetic
gaaacactatccagtcagtttttctaaacctagcctggtgttcgtcgaggccagcgagtattacccagccaggta

SEQ ID NO: 69051 - DNA, 75 bp, Artificial Sequence
  Synthetic
aacaatgtacccacgaatgccactagcttgatggagagactgcgctttccggtctcagcacaagcagggaaaggt

SEQ ID NO: 69052 - DNA, 75 bp, Artificial Sequence
  Synthetic
gggaacggtcttgtggggtttgctgatgttagggacctgctttggcttgatgaagaagctatggagcagggagta

SEQ ID NO: 69053 - DNA, 75 bp, Artificial Sequence
  Synthetic
cagcttaaatgattctgtgtaccttaggatgacttttgggcacctttatgaaaccttccatgcaaaccctggaac

SEQ ID NO: 69054 - DNA, 75 bp, Artificial Sequence
  Synthetic
ttaaaaaaccacttgatcggttctgaaggggctgtcgaaaaaatcttgaagaatctggtgaaactaatttcagcc

SEQ ID NO: 69055 - DNA, 75 bp, Artificial Sequence
  Synthetic
accactatgccgggtgctaatggagggacttttgagaatccgtacatcatggatgcgggaatccctctgagtcaa

SEQ ID NO: 69056 - DNA, 75 bp, Artificial Sequence
  Synthetic
ttcggtcagcaatctggggccatctacgtgggcaacttcagagtggtcaatcgtcacctcgctactcacaatgac

SEQ ID NO: 69057 - DNA, 75 bp, Artificial Sequence
  Synthetic
ccttgaatacggggcatgcccaaacaacatgatgggcacgttctcagtgcggaccgtgggaacctcgaagtccaa

SEQ ID NO: 69058 - DNA, 75 bp, Artificial Sequence
  Synthetic
ggacttttgagaatccgtacatcatggatgcgggaatccctctgagtcaagctctcatattcccgcatcagtgga

SEQ ID NO: 69059 - DNA, 75 bp, Artificial Sequence
  Synthetic
aaggggctgtcgaaaaaatcttgaagaatctggtgaaactaatttcagccttagttatagtcatcaggagcgatt

SEQ ID NO: 69060 - DNA, 75 bp, Artificial Sequence
  Synthetic
cttgggaaatttggacaacagtccggggccatctacgtgggcaacttcagagtggtcaaccgtcacctcgccact

SEQ ID NO: 69061 - DNA, 75 bp, Artificial Sequence
  Synthetic
agacagcttccatcctaggtattcccatggcacaaaagcagagtgactcatggttaaagaagtttaatgacatgg

SEQ ID NO: 69062 - DNA, 75 bp, Artificial Sequence
  Synthetic
atatcatagcccttggagcagctcaaaagaatttcacgcttaagttgtgcagggatactgagtctatctctcaga

SEQ ID NO: 69063 - DNA, 75 bp, Artificial Sequence
  Synthetic
atcacaacaatttcaccttaatagtggtcccaattagtccattgaagtattgcactggcgctaccacggccattc

SEQ ID NO: 69064 - DNA, 75 bp, Artificial Sequence
  Synthetic
ggtcccaattagtccattgaagtattgcactggcgctaccacggccattccaataacagtgacaatagctcctct

SEQ ID NO: 69065 - DNA, 75 bp, Artificial Sequence
  Synthetic
catggcacaaaagcagagtgactcatggttaaagaagtttaatgacatggcaaatgctgcaaaagggctcgagtg

SEQ ID NO: 69066 - DNA, 75 bp, Artificial Sequence
  Synthetic
atttgggacttcgggttacaatcgtcagtgactctagttgtgccttggatttcaaatacccacttcagaacgcaa

SEQ ID NO: 69067 - DNA, 75 bp, Artificial Sequence
  Synthetic
caccactcttgggaaatttggacaacaatctggggctatttacgtgggcaacttcagagtggtcaaccgccatct

SEQ ID NO: 69068 - DNA, 75 bp, Artificial Sequence
  Synthetic
gttcttaaacaacctaaagcaacttcctctgttagaaaatcaaatctccaatcttgagcagtctgctgcctcgca

SEQ ID NO: 69069 - DNA, 75 bp, Artificial Sequence
  Synthetic
gtttctaacaacagataatgaggtctcagtaccaatattacctgggttccagccaacgccagcaatacatatacc

SEQ ID NO: 69070 - DNA, 75 bp, Artificial Sequence
  Synthetic
tcagtaccaatattacctgggttccagccaacgccagcaatacatataccaggtgaggtgaacaacttgctggag

SEQ ID NO: 69071 - DNA, 75 bp, Artificial Sequence
  Synthetic
cctctgttagaaaatcaaatctccaatcttgagcagtctgctgcctcgcaagaggacctagaagctatgtttggc

SEQ ID NO: 69072 - DNA, 75 bp, Artificial Sequence
  Synthetic
caggtggttacagttatggatgacttatgccagaaccctgacggtaaggacatgtccttgttctgccaaatggta

SEQ ID NO: 69073 - DNA, 75 bp, Artificial Sequence
  Synthetic
attacccagccaggtatcagtcacatcttatgcttgcagttggtcactcagaaccaggagattgcggtggtatac

SEQ ID NO: 69074 - DNA, 75 bp, Artificial Sequence
  Synthetic
ttggagaaaagaatgaacaactacatgcagttcaagagcaaacaccgtattgaacctgtgtgtttgatcattagg

SEQ ID NO: 69075 - DNA, 75 bp, Artificial Sequence
  Synthetic
gtgtctacacagagtgataaggacactctgtgcgcatctctccgtgttgatcctggtagggatggaccatggcaa

SEQ ID NO: 69076 - DNA, 75 bp, Artificial Sequence
  Synthetic
ctctgtgcgcatctctccgtgttgatcctggtagggatggaccatggcaatccaccctcgttggtcaaatttgca

SEQ ID NO: 69077 - DNA, 75 bp, Artificial Sequence
  Synthetic
tttgcaaatcctgtcaaagatattttcactgaaatggcagcaccactaaaatctccatctgctgaggcgtgtgga

SEQ ID NO: 69078 - DNA, 75 bp, Artificial Sequence
  Synthetic
ttaatgaagttaattgggataatgcgaccttcctcaagaggggctttttacccgatgaacagtttccatttttga

SEQ ID NO: 69079 - DNA, 75 bp, Artificial Sequence
  Synthetic
tgcagttcaagagcaaacaccgtattgaacctgtgtgtttgatcattaggggttctccaggaacagggaagtcac

SEQ ID NO: 69080 - DNA, 75 bp, Artificial Sequence
  Synthetic
atcacttcgatgggtataaacaacaggtggtcacagttatggatgatctctgccagaatccagatgggaaagaca

SEQ ID NO: 69081 - DNA, 75 bp, Artificial Sequence
  Synthetic
tgctgattgcttactctccacctggaagtgcacaaccaaccagcagggacttagctatgcttggcacacatgttg

SEQ ID NO: 69082 - DNA, 75 bp, Artificial Sequence
  Synthetic
aagtgcacaaccaaccagcagggacttagctatgcttggcacacatgttgtctgggacttcggtttacaatcatc

SEQ ID NO: 69083 - DNA, 75 bp, Artificial Sequence
  Synthetic
gcatcgttagaggaaaaaggggtgtccttcacatctaagtttgtcattgcatcaactaacgctagtaacatcata

SEQ ID NO: 69084 - DNA, 75 bp, Artificial Sequence
  Synthetic
acccacagggcccactgggcgctagcacactggtattacggtacctttgtgcgcctgttttataccccccccaac

SEQ ID NO: 69085 - DNA, 75 bp, Artificial Sequence
  Synthetic
tgcatcaggaatagtgactatttggtaccagacaaattttgtggttccgcctgacactcccagccaagcccatat

SEQ ID NO: 69086 - DNA, 75 bp, Artificial Sequence
  Synthetic
taccagacaaattttgtggttccgcctgacactcccagccaagcccatataatagcattgggtgctgcacagaag

SEQ ID NO: 69087 - DNA, 75 bp, Artificial Sequence
  Synthetic
tacaagacagatctcggccggttggacgcaggcagggctgctaagctttgtacagagaacaacactgccaacttc

SEQ ID NO: 69088 - DNA, 75 bp, Artificial Sequence
  Synthetic
caattttgggcataccaatggcccaaaaacagagcgcatcatggttgaagaaattcaacgacgcagcaagcgccg

SEQ ID NO: 69089 - DNA, 75 bp, Artificial Sequence
  Synthetic
acgcaggcagggctgctaagctttgtacagagaacaacactgccaacttcaaaagatgcagtccactagtgtgcg

SEQ ID NO: 69090 - DNA, 75 bp, Artificial Sequence
  Synthetic
ctaagggtcttgagtggatctccaacaaaattagtaagtttatcgattggcttaaagagaaaatcattcccgctg

SEQ ID NO: 69091 - DNA, 75 bp, Artificial Sequence
  Synthetic
gacatcatcaccagcactgtcacccgcaccttgcaacaaatcagtgccccaacacacaacacaacggccgctgac

SEQ ID NO: 69092 - DNA, 75 bp, Artificial Sequence
  Synthetic
actcacagggcccacgtggcgctagcactctggttctacggaacctttgtgcgcctgttttacgcccccccccaa

SEQ ID NO: 69093 - DNA, 75 bp, Artificial Sequence
  Synthetic
gcaccttgcaacaaatcagtgccccaacacacaacacaacggccgctgacaccacagtgagtaatcacaaaattg

SEQ ID NO: 69094 - DNA, 75 bp, Artificial Sequence
  Synthetic
gggagtataacagtagatctaccattggaaacaccatagaggcactctttcaagggccccccaagttcagaccca

SEQ ID NO: 69095 - DNA, 75 bp, Artificial Sequence
  Synthetic
aaacgcggtgtgtcctgaaccgcaatggagtggtggagactagtctagatcacttcttttcgcgtgctgggctag

SEQ ID NO: 69096 - DNA, 75 bp, Artificial Sequence
  Synthetic
tggagtggtggagactagtctagatcacttcttttcgcgtgctgggctagtaggggtaatcaacgtgcaagacgg

SEQ ID NO: 69097 - DNA, 75 bp, Artificial Sequence
  Synthetic
tccgacagtactgcagggaacaagggtggataatcccagagacaccaactaatgtggaacggcacctcaatagag

SEQ ID NO: 69098 - DNA, 75 bp, Artificial Sequence
  Synthetic
ttgggtgtccgtgtttccttttaatttttactggctgcttatggtgacaattgaggaattgttgccatatagcta

SEQ ID NO: 69099 - DNA, 75 bp, Artificial Sequence
  Synthetic
gtttacatacatgaggtttaatgcagaatttacattcgtgtcaactttagctgacggcacaacacccagagtgat

SEQ ID NO: 69100 - DNA, 75 bp, Artificial Sequence
  Synthetic
gaatttacattcgtgtcaactttagctgacggcacaacacccagagtgatgctgcagtacatgtatgtcccgcct

SEQ ID NO: 69101 - DNA, 75 bp, Artificial Sequence
  Synthetic
aagcacttctgtttccccggactgagtatcaatagactgctcacgcggttgaaggagaaaacgttcgttatccgg

SEQ ID NO: 69102 - DNA, 75 bp, Artificial Sequence
  Synthetic
cgtaagaacccttcattacgtgttatttctcaactcaagaaaatgggcgcccaagtgtccacccagaagacagga

SEQ ID NO: 69103 - DNA, 75 bp, Artificial Sequence
  Synthetic
tggttggatgaagaagctatggagcagggcgtgtccgattacatcaagggtctcggagatgctttcgggacaggc

SEQ ID NO: 69104 - DNA, 75 bp, Artificial Sequence
  Synthetic
tttctcaactcaagaaaatgggcgcccaagtgtccacccagaagacaggatctcatgagaccggaaacatagcta

SEQ ID NO: 69105 - DNA, 75 bp, Artificial Sequence
  Synthetic
caggtacagactgaccaggggcacttcaccatgctaggcgtacgagaccgcttagccatcttgccacgccactca

SEQ ID NO: 69106 - DNA, 75 bp, Artificial Sequence
  Synthetic
agcgacccaccgccacaggtctccgtcccgtttatgtcaccagctagtgcataccagtggttttatgatggatac

SEQ ID NO: 69107 - DNA, 75 bp, Artificial Sequence
  Synthetic
ttttataccgcctatggcgtctctagaagaaaagggagtatcgttcacttccaagtttgtaattgcttccactaa

SEQ ID NO: 69108 - DNA, 75 bp, Artificial Sequence
  Synthetic
agttctcacaagaccccacaaaattcacaagcccggtgttagacgttttgagggaagcagccccacccttgaaat

SEQ ID NO: 69109 - DNA, 75 bp, Artificial Sequence
  Synthetic
tgctagcaatatcatagtaccaacagtctcggactcagatgccatccgtcgccgattctttatggattgcgacat

SEQ ID NO: 69110 - DNA, 75 bp, Artificial Sequence
  Synthetic
tcccgtttatgtcaccagctagtgcataccagtggttttatgatggataccccacctttgatgatcggcctgcca

SEQ ID NO: 69111 - DNA, 75 bp, Artificial Sequence
  Synthetic
tcaccatgctaggcgtacgagaccgcttagccatcttgccacgccactcacagccagggaaaaccatctggatag

SEQ ID NO: 69112 - DNA, 75 bp, Artificial Sequence
  Synthetic
tgaggtgaccgactcttacaagacagacctgggtaggcttgatgcgggaagggccgctaggttgtgctctgaaaa

SEQ ID NO: 69113 - DNA, 75 bp, Artificial Sequence
  Synthetic
tgaccttggacactaatgagaagtttagggatatcactaagttcatcccagagacaatcactggagcgagtgatg

SEQ ID NO: 69114 - DNA, 75 bp, Artificial Sequence
  Synthetic
ctacagtgcgagacctgcgggttagggtgtatatgcgcttgaagcacgtgcgcgcctgggtgccaaggcctattc

SEQ ID NO: 69115 - DNA, 75 bp, Artificial Sequence
  Synthetic
atatggtgagtggcccgactactgcccagacacagatgctactgctgttgacaaacccactaggccagatgtttc

SEQ ID NO: 69116 - DNA, 75 bp, Artificial Sequence
  Synthetic
agtccactagtgtgcggaaaggccatccagctcagagataggaaatctaaagtgaggtacagcgtggacacggtg

SEQ ID NO: 69117 - DNA, 75 bp, Artificial Sequence
  Synthetic
ggtgtatatgcgcttgaagcacgtgcgcgcctgggtgccaaggcctattcgatcacagccatacatactaaaaaa

SEQ ID NO: 69118 - DNA, 75 bp, Artificial Sequence
  Synthetic
cacaagcccggtgttagacgttttgagggaagcagccccacccttgaaatcaccatctgttgaggcgtgtggata

SEQ ID NO: 69119 - DNA, 75 bp, Artificial Sequence
  Synthetic
gtgtctgagctcatcagagagtacaacaacagatcaaccattggcaacactattgaagctctcttccaagggccc

SEQ ID NO: 69120 - DNA, 75 bp, Artificial Sequence
  Synthetic
cggacaacaatcaggagcaatatatgttggcaactacagggtagtgaacagacatcttgctactcacactgactg

SEQ ID NO: 69121 - DNA, 75 bp, Artificial Sequence
  Synthetic
gttggcaactacagggtagtgaacagacatcttgctactcacactgactgggcgaatttggtgtgggaagacagc

SEQ ID NO: 69122 - DNA, 75 bp, Artificial Sequence
  Synthetic
atggtatcagacgaattatgtggttccaattggggcacccaacacagcctatataatagcattagcggcagccca

SEQ ID NO: 69123 - DNA, 75 bp, Artificial Sequence
  Synthetic
ggacagaatgcacaatatcattacctgtatagatcgggattctgtatccacgttcaatgcaacgcaagcaaattt

SEQ ID NO: 69124 - DNA, 75 bp, Artificial Sequence
  Synthetic
ccagacacagatgctactgctgttgacaaacccactaggccagatgtttctgtcaatcggttttacaccatgtcg

SEQ ID NO: 69125 - DNA, 75 bp, Artificial Sequence
  Synthetic
gtagacagtgaagaagttcgccagtattgcagggaccaaggatggattgtgccagacactcccaccaatgtggag

SEQ ID NO: 69126 - DNA, 75 bp, Artificial Sequence
  Synthetic
tgtatagatcgggattctgtatccacgttcaatgcaacgcaagcaaatttcaccaaggagctcttctagtggtag

SEQ ID NO: 69127 - DNA, 75 bp, Artificial Sequence
  Synthetic
gtgtactattgtaactcccgaaggaaacattaccccgttagcttctcaaagcccagtctaatttttgtggaagcc

SEQ ID NO: 69128 - DNA, 75 bp, Artificial Sequence
  Synthetic
tcaatggtccaactcgaaccaaattagaacccagtgtgtttcatgatgtgtttgagggcaataaggagccggcag

SEQ ID NO: 69129 - DNA, 75 bp, Artificial Sequence
  Synthetic
agactatgcctgggtcaaatggttccactttcgagcacccttacgtgctcgatgcgggtattcccctcagtcagg

SEQ ID NO: 69130 - DNA, 75 bp, Artificial Sequence
  Synthetic
aacattaccccgttagcttctcaaagcccagtctaatttttgtggaagccagtgaatactatcctgccagatacc

SEQ ID NO: 69131 - DNA, 75 bp, Artificial Sequence
  Synthetic
atttacaaattgtttgctggcttccaaggggcgtattctggtgcccccaagcagacacttaagaagccggtacta

SEQ ID NO: 69132 - DNA, 75 bp, Artificial Sequence
  Synthetic
ggcgttaatttggaactcacattggtgacactagatactaatgaaaaatttagagatatcaccaagttcattcca

SEQ ID NO: 69133 - DNA, 75 bp, Artificial Sequence
  Synthetic
gcaagagcaattgccgataaataccactccagtgtgtactctctaccaccagacccagatcatttcgacgggtac

SEQ ID NO: 69134 - DNA, 75 bp, Artificial Sequence
  Synthetic
ttgttggtatcgtgtccaccggtggcaacgggcttgttggctttgcagatgttagggacctcctgtggctggatg

SEQ ID NO: 69135 - DNA, 75 bp, Artificial Sequence
  Synthetic
acaagctgcccttcactacgcaaatcaactaaaacaactagacataaataccagtaagatgagcatggaggaagc

SEQ ID NO: 69136 - DNA, 75 bp, Artificial Sequence
  Synthetic
tagaaggaacatcagacaggtccagactgatcagggtcactttaccatgctaggagtgcgagaccacctagctgt

SEQ ID NO: 69137 - DNA, 75 bp, Artificial Sequence
  Synthetic
ccataacaacttcactttagcagtgatcccaattagccctctcaagttttgcgatggtgccacgtccgcaatacc

SEQ ID NO: 69138 - DNA, 75 bp, Artificial Sequence
  Synthetic
atggtgtccacggttgacttcattcctccaatggcttcactggaagagaaaggtgtgtccttcacctccaaattt

SEQ ID NO: 69139 - DNA, 75 bp, Artificial Sequence
  Synthetic
caacgggcttgttggctttgcagatgttagggacctcctgtggctggatgaagaggcaatggagcaaggagtgtc

SEQ ID NO: 69140 - DNA, 75 bp, Artificial Sequence
  Synthetic
caactaaaacaactagacataaataccagtaagatgagcatggaggaagcatgctatggcacagagaatttggag

SEQ ID NO: 69141 - DNA, 75 bp, Artificial Sequence
  Synthetic
aaaaaatcacctcatagggtccgagggagctgttgagaaaatcttaaagaacctaatcaagttaatctcagcatt

SEQ ID NO: 69142 - DNA, 75 bp, Artificial Sequence
  Synthetic
gtcactagggacacctccaagatgaaactatatatggataagtatgggttggatttgccctactccacctatgtg

SEQ ID NO: 69143 - DNA, 75 bp, Artificial Sequence
  Synthetic
tttttgaccacagaccagtgtgtgtctgcacctatattaccagggtttgagcccacgccccaaattcacattcct

SEQ ID NO: 69144 - DNA, 75 bp, Artificial Sequence
  Synthetic
ggagctgttgagaaaatcttaaagaacctaatcaagttaatctcagcattggtcatagtgatcagaagtgattat

SEQ ID NO: 69145 - DNA, 75 bp, Artificial Sequence
  Synthetic
aactatatatggataagtatgggttggatttgccctactccacctatgtgaaggatgagcttaggtccctagata

SEQ ID NO: 69146 - DNA, 75 bp, Artificial Sequence
  Synthetic
atcccaattagccctctcaagttttgcgatggtgccacgtccgcaatacctatcactattacattagccccattg

SEQ ID NO: 69147 - DNA, 75 bp, Artificial Sequence
  Synthetic
ctgcacctatattaccagggtttgagcccacgccccaaattcacattcctggagaggtgagtagtcttctagaac

SEQ ID NO: 69148 - DNA, 75 bp, Artificial Sequence
  Synthetic
ccaacttcaagaagtgtagtccgctggtgtgcggtaaagccatccaattaagggacaggaagtccaaggttaggt

SEQ ID NO: 69149 - DNA, 75 bp, Artificial Sequence
  Synthetic
acggcgtccatcctgggcataccaatcgcccaaaaacaaagcgcttcctggcttaaaaagtttaatgatatggct

SEQ ID NO: 69150 - DNA, 75 bp, Artificial Sequence
  Synthetic
gtggcaagcccactcaccgcactatgatgtacaacttccctacgaaagcagggcagtgcggtggtgttgtgacag

SEQ ID NO: 69151 - DNA, 75 bp, Artificial Sequence
  Synthetic
gccatctttatgaggtattccacgccaatccgggaactataactggatctgcggtggggtgtaatcctgacgtgt

SEQ ID NO: 69152 - DNA, 75 bp, Artificial Sequence
  Synthetic
tctctgcacagaaagataaagatacactgtgcgcggcgttccgtgtggacccaggtagagatggcccttggcaat

SEQ ID NO: 69153 - DNA, 75 bp, Artificial Sequence
  Synthetic
ggtaccagtcgcacggcgatcaccactcttgggaaatttggacaacaatccggggccatttacgtgggtaacttt

SEQ ID NO: 69154 - DNA, 75 bp, Artificial Sequence
  Synthetic
tcgcccaaaaacaaagcgcttcctggcttaaaaagtttaatgatatggctaatgctgctaaaggcttggagtgga

SEQ ID NO: 69155 - DNA, 75 bp, Artificial Sequence
  Synthetic
ttttgtgctgccctcaagagaggatacttctgtagtgaacaaggcgaaattcaatgggtgaagcctaataaggag

SEQ ID NO: 69156 - DNA, 75 bp, Artificial Sequence
  Synthetic
tccatcgccacagtagtggcggttgtatcgctagtgtatgtcatctacaagctctttgcagggtttcaaggtgcg

SEQ ID NO: 69157 - DNA, 75 bp, Artificial Sequence
  Synthetic
ttctaaacaatctaaagcaattgccattattggagaatcagatctcaaacctcgagcaatctgcagcatcacaag

SEQ ID NO: 69158 - DNA, 75 bp, Artificial Sequence
  Synthetic
atgctacggcacagataacctggaagctatagacctccacactagtgctgggtacccatacagcgccctaggcat

SEQ ID NO: 69159 - DNA, 75 bp, Artificial Sequence
  Synthetic
actggttctacgagagattggttactcggaggaggctgtgtcactcatagaagggattaatcacacccaccatgt

SEQ ID NO: 69160 - DNA, 75 bp, Artificial Sequence
  Synthetic
cgttttccatgatgtgtttgaaggcaccaaggaaccagcggtattgaccagcaaagatcctagactggaagtgga

SEQ ID NO: 69161 - DNA, 75 bp, Artificial Sequence
  Synthetic
gctcatagcatattccccacctggtagcgcccagcccacctccagggagttcgcaatgcttggcacgcacgtggt

SEQ ID NO: 69162 - DNA, 75 bp, Artificial Sequence
  Synthetic
cttttgattaaaacgttcaaaggaatagacttggatgaactgaacatggtggcttacggagatgatgtactggct

SEQ ID NO: 69163 - DNA, 75 bp, Artificial Sequence
  Synthetic
gctatagacctccacactagtgctgggtacccatacagcgccctaggcatcaagaagagggacatccttgatccg

SEQ ID NO: 69164 - DNA, 75 bp, Artificial Sequence
  Synthetic
gcgtcaggtattgtcaccatctggtaccagacgaattttgtggtcccctctggcacaccaacacaagcttacata

SEQ ID NO: 69165 - DNA, 75 bp, Artificial Sequence
  Synthetic
aaggatgaactcaggtctctggataagatcaagaaagggaaatcgcgtttgatagaggccagtagcttgaatgac

SEQ ID NO: 69166 - DNA, 75 bp, Artificial Sequence
  Synthetic
cctacactatgctaaccaactcaagcaattagacataaagactacaaagatgagcatggaagatgcttgctacgg

SEQ ID NO: 69167 - DNA, 75 bp, Artificial Sequence
  Synthetic
agctacccattccccattgattgctcggaattggcgagaactggtaaggagtacgggctgactatgactcctgct

SEQ ID NO: 69168 - DNA, 75 bp, Artificial Sequence
  Synthetic
tgagcatggaagatgcttgctacggcacagaaaatttagaagccatagatctccatacaagtgcaggatatccgt

SEQ ID NO: 69169 - DNA, 75 bp, Artificial Sequence
  Synthetic
cactttgatggttacaaacagcaagtggtcacagtcatggatgacttatgccaaaaccctgacggtaaggacatg

SEQ ID NO: 69170 - DNA, 75 bp, Artificial Sequence
  Synthetic
agatcaagaaagggaaatcgcgtttgatagaggccagtagcttgaatgactctgtctacctcagaatgacttttg

SEQ ID NO: 69171 - DNA, 75 bp, Artificial Sequence
  Synthetic
acttaatcgccaatacagttgctaggactctagagagaataacctctccaactcataatacaacggcaggcaaca

SEQ ID NO: 69172 - DNA, 75 bp, Artificial Sequence
  Synthetic
tttggagcaaactgccgattttattgcctggttcactctttgcttttgattattcaggatatgatgccagtctta

SEQ ID NO: 69173 - DNA, 75 bp, Artificial Sequence
  Synthetic
gcctggttcactctttgcttttgattattcaggatatgatgccagtcttagcccggtgtggttcagagctctaga

SEQ ID NO: 69174 - DNA, 75 bp, Artificial Sequence
  Synthetic
tggataagtatggtttggacctgccttactccacatatgtcaaagatgagctcagggctttagataaaattaaga

SEQ ID NO: 69175 - DNA, 75 bp, Artificial Sequence
  Synthetic
gagaagtttagagacatcaccaaatttattccagagaacatcagtggtgccagtgatgcaactttggtgattaac

SEQ ID NO: 69176 - DNA, 75 bp, Artificial Sequence
  Synthetic
aggattcttaagaacttagtaaaacttatctctgcactcgtcatcgttatcaggagtgactacgacatggtcaca

SEQ ID NO: 69177 - DNA, 75 bp, Artificial Sequence
  Synthetic
tcactattctgtcagatggtgtccactgtggatttcattccaccaatggcctctttagaggagaaaggagtttct

SEQ ID NO: 69178 - DNA, 75 bp, Artificial Sequence
  Synthetic
aacacggtgtgttgtcaataggaatggagtgattgagactagcatcaaccatttcttctcccgagcggggcttgt

SEQ ID NO: 69179 - DNA, 75 bp, Artificial Sequence
  Synthetic
atatcggaacaaaacgtactgtgttcttggtgggatgccctcagggtgctctggcacctccatcttcaattcaat

SEQ ID NO: 69180 - DNA, 75 bp, Artificial Sequence
  Synthetic
gttagtttttcaaaacctagcttgatctatgtggaggctagtgaatactaccctgccaggtatcaatcacacctg

SEQ ID NO: 69181 - DNA, 75 bp, Artificial Sequence
  Synthetic
cttggtgggatgccctcagggtgctctggcacctccatcttcaattcaatgatcaacaatatcattatcagaacc

SEQ ID NO: 69182 - DNA, 75 bp, Artificial Sequence
  Synthetic
ggagtgattgagactagcatcaaccatttcttctcccgagcggggcttgtgggagtgctgaacatacttgatgga

SEQ ID NO: 69183 - DNA, 75 bp, Artificial Sequence
  Synthetic
attcgccgcaggttctacatggactgtgatattgaagtgacagactcatacaaaacagatttgggcagattggac

SEQ ID NO: 69184 - DNA, 75 bp, Artificial Sequence
  Synthetic
actcagcatcaatgggccaacccgcaccaagctagagcccagtgtgttccatgatgtcttcgagggaaataagga

SEQ ID NO: 69185 - DNA, 75 bp, Artificial Sequence
  Synthetic
aaggctatccaactaagagacagaaaatccaaagtcagatacagtgtggacactgtggtctctgagcttataaga

SEQ ID NO: 69186 - DNA, 75 bp, Artificial Sequence
  Synthetic
agttacccttttcctattgactgccttgaattagccaagactggcaaggaatatgggctgaccatgacacctgca

SEQ ID NO: 69187 - DNA, 75 bp, Artificial Sequence
  Synthetic
ttcacctacatgcggttcaacgctgaattcacctttgtcgcgactttgagtgacggaacaactccccatataatg

SEQ ID NO: 69188 - DNA, 75 bp, Artificial Sequence
  Synthetic
ttgaattagccaagactggcaaggaatatgggctgaccatgacacctgcagacaaatcaccctgcttcaatgaag

SEQ ID NO: 69189 - DNA, 75 bp, Artificial Sequence
  Synthetic
agcccaggacaactttaccatgaaactatgcaaggacacggaggacattgagcaaacagctaatatacaagggga

SEQ ID NO: 69190 - DNA, 75 bp, Artificial Sequence
  Synthetic
taagacctattgcgtccttgggggaatgccctcaggctgctcaggcacttccatctttaactctatgattaacaa

SEQ ID NO: 69191 - DNA, 75 bp, Artificial Sequence
  Synthetic
ctccagacgccattagtgatctcctcgctagcgtggatagtgaagaagtgcgtcagtattgtagagaccaagggt

SEQ ID NO: 69192 - DNA, 75 bp, Artificial Sequence
  Synthetic
gtgaccctcctccgcaagtttcagtacctttcatgtctcctgctagcgcctaccagtggttttatgatgggtacc

SEQ ID NO: 69193 - DNA, 75 bp, Artificial Sequence
  Synthetic
aatccaaagtcagatacagtgtggacactgtggtctctgagcttataagagagtacaataatagatctgctattg

SEQ ID NO: 69194 - DNA, 75 bp, Artificial Sequence
  Synthetic
cgctagcgtggatagtgaagaagtgcgtcagtattgtagagaccaagggtggattattccagagactcctaccaa

SEQ ID NO: 69195 - DNA, 75 bp, Artificial Sequence
  Synthetic
aattcacctttgtcgcgactttgagtgacggaacaactccccatataatgttgcaatacatgtatgtgccccctg

SEQ ID NO: 69196 - DNA, 75 bp, Artificial Sequence
  Synthetic
atctgggactttgggctgcaatcgtctgttacccttgtaataccatggatcagcaacactcactacagagcgcat

SEQ ID NO: 69197 - DNA, 75 bp, Artificial Sequence
  Synthetic
acctttcatgtctcctgctagcgcctaccagtggttttatgatgggtacccaacatttgatgatagaccacagac

SEQ ID NO: 69198 - DNA, 75 bp, Artificial Sequence
  Synthetic
gtatgttatctacaaactctttgctggatttcaaggtgcatattctggcgctcccaaacaagtactcaagaaacc

SEQ ID NO: 69199 - DNA, 75 bp, Artificial Sequence
  Synthetic
tgcggagagagacttgcgcgtccgtgtttacatgaaactgaagcatgtgcgagcatgggtaccgcgacccataag

SEQ ID NO: 69200 - DNA, 75 bp, Artificial Sequence
  Synthetic
ttcaccccacgatgccaatgagggagattcacgagtctattcgttggactaaagacgcacgaagtacacaagatc

SEQ ID NO: 69201 - DNA, 75 bp, Artificial Sequence
  Synthetic
gacagccattgggaatttctttagccgtgctggtttggttagcatcattacaatgcccaccacgggtacacagaa

SEQ ID NO: 69202 - DNA, 75 bp, Artificial Sequence
  Synthetic
atgtgcgctccctctgcttattagcgtggcacaatgggaaagaagagtatgaaaaatttgtgagtacaatcagat

SEQ ID NO: 69203 - DNA, 75 bp, Artificial Sequence
  Synthetic
ggatttcaaggtgcatattctggcgctcccaaacaagtactcaagaaacctatcctccgcacggcgacggtacag

SEQ ID NO: 69204 - DNA, 75 bp, Artificial Sequence
  Synthetic
tgagagagatccacgaatccatccgctggaccaaagatgcgcgaaacacgcaagaccacgtgcgttctctctgct

SEQ ID NO: 69205 - DNA, 75 bp, Artificial Sequence
  Synthetic
cctacgtgaaagatgaactcaggtccctagacaaaatcaagaaggggaaatcccgcctgatagaagctagtagtc

SEQ ID NO: 69206 - DNA, 75 bp, Artificial Sequence
  Synthetic
accatgttaggtgtcagggaccgtctagctgtcctcccgcgccactctcaaccaggaaaaacaatctgggtggag

SEQ ID NO: 69207 - DNA, 75 bp, Artificial Sequence
  Synthetic
tcccgcctgatagaagctagtagtctgaatgactcggtgtacctcagaatgacttttggccacctttatgaagtg

SEQ ID NO: 69208 - DNA, 75 bp, Artificial Sequence
  Synthetic
ggacaacaatcgggtgctatatacgtgggtaattacagagtggtgaatagacacctcgccacccacaacgattgg

SEQ ID NO: 69209 - DNA, 75 bp, Artificial Sequence
  Synthetic
attaggtcagttccagttggaaaagcattggccataccaaactttgagaacctgagaagaaattggctcgaattg

SEQ ID NO: 69210 - DNA, 75 bp, Artificial Sequence
  Synthetic
agaatgaagcatgtcagggcgtggatacctcgcccgatgcgcaaccaaaactacctgtttaaagccaatccaaac

SEQ ID NO: 69211 - DNA, 75 bp, Artificial Sequence
  Synthetic
tgctgggttccagggtgcttactctggtgcccctaagcaggtgctcaagaaacccattctccgcacggcaacagt

SEQ ID NO: 69212 - DNA, 75 bp, Artificial Sequence
  Synthetic
tacactgatatcacggtacctttgtacgcctgttttatctccctacccccatcgtaacttagaagcttaacaata

SEQ ID NO: 69213 - DNA, 75 bp, Artificial Sequence
  Synthetic
gagacatcaccaagtttatcccagagaacatcggcgccgctagcgatgccaccctagtaatcaacactgaacaca

SEQ ID NO: 69214 - DNA, 75 bp, Artificial Sequence
  Synthetic
tatattattgtaactcccgtagaaagcactatccagtcagtttttctaaacctagcctgatatttgtggaggcta

SEQ ID NO: 69215 - DNA, 75 bp, Artificial Sequence
  Synthetic
tcggttttgcagacatcagagatcttttgtggttggatgaagaggccatggagcaaggggtgtccgattacataa

SEQ ID NO: 69216 - DNA, 75 bp, Artificial Sequence
  Synthetic
caggtgtggaatgatcaagcatttctgttaccccggacctagtaccaataggctgtgtcaaacggctgaagggga

SEQ ID NO: 69217 - DNA, 75 bp, Artificial Sequence
  Synthetic
gaacatcggcgccgctagcgatgccaccctagtaatcaacactgaacacatgccctcaatgtttgttccagtggg

SEQ ID NO: 69218 - DNA, 75 bp, Artificial Sequence
  Synthetic
gcactatccagtcagtttttctaaacctagcctgatatttgtggaggctagtgagtactacccagctagatacca

SEQ ID NO: 69219 - DNA, 75 bp, Artificial Sequence
  Synthetic
caaagcaggtcagtgcggaggggtagtgacatcagttggaaaagtcattggtatacacataggtggcaatggtag

SEQ ID NO: 69220 - DNA, 75 bp, Artificial Sequence
  Synthetic
ggtgggaatagtctctactggtgggaatggtcttgtgggattcgccgatgttcgagaccttttgtggttagatga

SEQ ID NO: 69221 - DNA, 75 bp, Artificial Sequence
  Synthetic
ttgtgtcccttgtttacgtcatctacaagttgtttgccggttttcagggagcatattccggcgcccccaagcaaa

SEQ ID NO: 69222 - DNA, 75 bp, Artificial Sequence
  Synthetic
gtgacatcagttggaaaagtcattggtatacacataggtggcaatggtagacaaggtttttgtgcaggacttaag

SEQ ID NO: 69223 - DNA, 75 bp, Artificial Sequence
  Synthetic
aatggtcttgtgggattcgccgatgttcgagaccttttgtggttagatgaagaagcaatggagcagggagtgtct

SEQ ID NO: 69224 - DNA, 75 bp, Artificial Sequence
  Synthetic
tattgagctagttagtagtcctccggcccctgaatgcggctaatcctaactgcggagcgcgcaccctcaacccag

SEQ ID NO: 69225 - DNA, 75 bp, Artificial Sequence
  Synthetic
ctgcccttggtctctgaccaagggacgctttggagtggatatggtgcgaagagcctattgagctaggtggtagtc

SEQ ID NO: 69226 - DNA, 75 bp, Artificial Sequence
  Synthetic
ggagcaaggtgtgtccgactacattaaggggctcggtgacgcatttggaacaggtttcactgatgctgtatccag

SEQ ID NO: 69227 - DNA, 75 bp, Artificial Sequence
  Synthetic
aatgggccaactcacacaaagctcgaacccagtgtgttccatgatgtatttgagggaaacaaggagccagctgtc

SEQ ID NO: 69228 - DNA, 75 bp, Artificial Sequence
  Synthetic
aagaaccacctgattggttctgagggggctgtggataaaatattgaagaatttggtgaaacttatttcagccttg

SEQ ID NO: 69229 - DNA, 75 bp, Artificial Sequence
  Synthetic
agtttataccagaaacaattagtcctgctagtgatgccaccctagttataaacactgaacatatgcccagcatgt

SEQ ID NO: 69230 - DNA, 75 bp, Artificial Sequence
  Synthetic
tgtcccagtaggaagagcattggctattccaaattatgaaaatctcagacgcaattggctcgagttattttagag

SEQ ID NO: 69231 - DNA, 75 bp, Artificial Sequence
  Synthetic
ccttgtgtgggaggacagttctagggacttgttagtctcttctaccaccgcccaggggtgcgacactatcgctag

SEQ ID NO: 69232 - DNA, 75 bp, Artificial Sequence
  Synthetic
cacccacagggcctactgggcgccagcactctggtactatggtacctttgtgcgcctgttttatattcctccccc

SEQ ID NO: 69233 - DNA, 75 bp, Artificial Sequence
  Synthetic
aagcccacccaccggactatgatgtacaacttcccaacaaaggcgggacagtgtggtggtgttgtgaccgctgta

SEQ ID NO: 69234 - DNA, 75 bp, Artificial Sequence
  Synthetic
aggcagcactccactatgcaaaccagttaaaacagttagacattgacacttctcagatgagtatggaggaagctt

SEQ ID NO: 69235 - DNA, 75 bp, Artificial Sequence
  Synthetic
cagcttccatcctaggtattcctatggcacaaaagcaaagcgcctcctggctaaagaaattcaatgacatggcta

SEQ ID NO: 69236 - DNA, 75 bp, Artificial Sequence
  Synthetic
aacccagtgtgttccatgatgtatttgagggaaacaaggagccagctgtcctgcacagcaaagacccccgtctcg

SEQ ID NO: 69237 - DNA, 75 bp, Artificial Sequence
  Synthetic
gttaaaacagttagacattgacacttctcagatgagtatggaggaagcttgttatggtactgagaaccttgaagc

SEQ ID NO: 69238 - DNA, 75 bp, Artificial Sequence
  Synthetic
atgggagctcaagtttcaactcagaggactggctcgcatgaaaacgccaatatggcaatggatggttctaccatt

SEQ ID NO: 69239 - DNA, 75 bp, Artificial Sequence
  Synthetic
ggactggctcgcatgaaaacgccaatatggcaatggatggttctaccattaattacaccaccatcaattactaca

SEQ ID NO: 69240 - DNA, 75 bp, Artificial Sequence
  Synthetic
gaccctgtcatggacgttatacatgagatggctccaccgctcaagtctccaagcgctgaggcatgtggttatagt

SEQ ID NO: 69241 - DNA, 75 bp, Artificial Sequence
  Synthetic
cactagggatgtgagcaagatgaaattttacatggacaagtatggcttggaccttccttactccacctatgtcaa

SEQ ID NO: 69242 - DNA, 75 bp, Artificial Sequence
  Synthetic
tttgaataacctaaagcaacttcccttactggaaaatcaaatctccaatctcgaacaatctgctgcctcgcaaga

SEQ ID NO: 69243 - DNA, 75 bp, Artificial Sequence
  Synthetic
ttttacatggacaagtatggcttggaccttccttactccacctatgtcaaggacgagcttcgctcagtagaaaaa

SEQ ID NO: 69244 - DNA, 75 bp, Artificial Sequence
  Synthetic
agcagctaacatagttatagcctatggggagtggcctgagtactgcccagacacagatgcaacggcagtcgacaa

SEQ ID NO: 69245 - DNA, 75 bp, Artificial Sequence
  Synthetic
atgtaattaaggagagttcagtccctcttaaatcaccatcagcagaggcgtgtggttatagtgacagggttgcgc

SEQ ID NO: 69246 - DNA, 75 bp, Artificial Sequence
  Synthetic
tcttaaatcaccatcagcagaggcgtgtggttatagtgacagggttgcgcaactaactctgggtaattccactat

SEQ ID NO: 69247 - DNA, 75 bp, Artificial Sequence
  Synthetic
catctttatgagaccttccacgcaaaccccgggactgttaccggctcagccgtggggtgtaacccggatgtgttt

SEQ ID NO: 69248 - DNA, 75 bp, Artificial Sequence
  Synthetic
accccgggactgttaccggctcagccgtggggtgtaacccggatgtgttttggagcaagctaccaattttgctgc

SEQ ID NO: 69249 - DNA, 75 bp, Artificial Sequence
  Synthetic
tttgtaccattaaccttgaagtctgtgaccacccttaattatatcttgaccctcaacacagctaaacatgggttc

SEQ ID NO: 69250 - DNA, 75 bp, Artificial Sequence
  Synthetic
agttcaagagcaaacaccgtattgaacctgtgtgtttaatcatcaggggatccccaggaacagggaaatcactcg

SEQ ID NO: 69251 - DNA, 75 bp, Artificial Sequence
  Synthetic
ttactggaaaatcaaatctccaatctcgaacaatctgctgcctcgcaagatgacctcgaagttatgtttggcaac

SEQ ID NO: 69252 - DNA, 75 bp, Artificial Sequence
  Synthetic
agctgtggataaaccatcacggcccgatgtctcagtaaacagattctacacactcagtgctaagttgtgggagaa

SEQ ID NO: 69253 - DNA, 75 bp, Artificial Sequence
  Synthetic
gatgtctcagtaaacagattctacacactcagtgctaagttgtgggagaagacgtccaaggggtggtattggaaa

SEQ ID NO: 69254 - DNA, 75 bp, Artificial Sequence
  Synthetic
tagtccttagagagataggctatagtgaggaggcagtcttactcattgaggggattaaccatacacaccatgtgt

SEQ ID NO: 69255 - DNA, 75 bp, Artificial Sequence
  Synthetic
ctacttatgttaaagatgaactcagggccattgacaagatcaagaaagggaagtcccgtctcatagaagcgagca

SEQ ID NO: 69256 - DNA, 75 bp, Artificial Sequence
  Synthetic
acttcgatgggtacaagcaacaggtggtcacagtaatggatgatctttgccagaatccagatggaaaggacatgt

SEQ ID NO: 69257 - DNA, 75 bp, Artificial Sequence
  Synthetic
ccaccagatcctgaccattttgacgggtacaaacagcaagtggttacagttatggatgacctgtgccagaatcct

SEQ ID NO: 69258 - DNA, 75 bp, Artificial Sequence
  Synthetic
aattcaataccttgctgttggtattgaatttcaatacaacaaaatgggcgctcaagtatcaacgcaaaaatctgg

SEQ ID NO: 69259 - DNA, 75 bp, Artificial Sequence
  Synthetic
tgcattcatgttcagtgtaatgctagtaagtttcaccaaggaactctgcttgtggtcgcaatcccagagttcact

SEQ ID NO: 69260 - DNA, 75 bp, Artificial Sequence
  Synthetic
gacggcaaagacatgtcattattttgccagatggtatccaccgtggattttattccaccaatggcttctctcgaa

SEQ ID NO: 69261 - DNA, 75 bp, Artificial Sequence
  Synthetic
ttgcgttcgactactcagggtatgatgctagtctcagcccagtgtggttcagggcgttagagatagtcctgcggg

SEQ ID NO: 69262 - DNA, 75 bp, Artificial Sequence
  Synthetic
gcttatcaagacatttaagggtattgatttagatgaactcaatatggttgcctacggggatgatgtgcttgccag

SEQ ID NO: 69263 - DNA, 75 bp, Artificial Sequence
  Synthetic
tcgctagaggaaaaaggagtgtccttcatctctaaatttgtcatcgcatcgaccaacgccagcaacatcatagtc

SEQ ID NO: 69264 - DNA, 75 bp, Artificial Sequence
  Synthetic
tttgctctctccctgctgaggaggaacatcaggcaagtccaaacagaccaggggcatttcaccatgttgggtgtt

SEQ ID NO: 69265 - DNA, 75 bp, Artificial Sequence
  Synthetic
gacttcacacaagacccgaagaagtttaccagtccggtgctggacgtcctgtcagagatgtctgcaccattgcag

SEQ ID NO: 69266 - DNA, 75 bp, Artificial Sequence
  Synthetic
cttattgtgtccttggaggaatgccctcaggttgctcaggtacctccattttcaactcgatgatcaataatatca

SEQ ID NO: 69267 - DNA, 75 bp, Artificial Sequence
  Synthetic
tgggaaacaccctgcatgagcctgacgagtacgtgacacaggctgctctccactatgcaaaccagctaaagcaat

SEQ ID NO: 69268 - DNA, 75 bp, Artificial Sequence
  Synthetic
acgtccttgattcaggtgtcccattatctcaagctcttatatacccacatcaatggatcaatctgaggacaaaca

SEQ ID NO: 69269 - DNA, 75 bp, Artificial Sequence
  Synthetic
atggcttgactatgactcctgcagacaagtctccctgcttcaatgagattaactggggtaatgcaacctttctca

SEQ ID NO: 69270 - DNA, 75 bp, Artificial Sequence
  Synthetic
caagcagggctgctaagctttgctcagagaacaacactgccaacttcaaaagatgcagtccattagtgtgtggta

SEQ ID NO: 69271 - DNA, 75 bp, Artificial Sequence
  Synthetic
atctcaagctcttatatacccacatcaatggatcaatctgaggacaaacaactgcgccacgatagtgatgccata

SEQ ID NO: 69272 - DNA, 75 bp, Artificial Sequence
  Synthetic
catatggagagtggccacagtattgtcctgacactgacgccacagctgtggataaacccactcgtcctgatgtct

SEQ ID NO: 69273 - DNA, 75 bp, Artificial Sequence
  Synthetic
caccccgtgtatccatatacctggtgaagttaggaacttgctagagttatgccaggtggagaccattttggaggt

SEQ ID NO: 69274 - DNA, 75 bp, Artificial Sequence
  Synthetic
tgactataacgcaggtgcaactacagctataccaatcacagtcactattgccccaatgaattcggagtttgcagg

SEQ ID NO: 69275 - DNA, 75 bp, Artificial Sequence
  Synthetic
ggtatcagacaaattacgtggttccaattggggcgcccaatacagcctatataatagcactagcggcagcccaga

SEQ ID NO: 69276 - DNA, 75 bp, Artificial Sequence
  Synthetic
agtacaacaataggtctgccgttggaaacaccatagaagcactctttcaaggacctctcaagttcaggcctataa

SEQ ID NO: 69277 - DNA, 75 bp, Artificial Sequence
  Synthetic
ttgtgtctcctagcatggcacaatggcaagcaggaatatgaaaaatttgtgaacacaattagatctgtcccaatt

SEQ ID NO: 69278 - DNA, 75 bp, Artificial Sequence
  Synthetic
gctataccaatcacagtcactattgccccaatgaattcggagtttgcaggcttgcgtaatgctgtgacccaggga

SEQ ID NO: 69279 - DNA, 75 bp, Artificial Sequence
  Synthetic
tggtcaaaatgcacaatttcacttcttgtataggtcagggttctgcattcatgtccagtgcaatgccagtaaatt

SEQ ID NO: 69280 - DNA, 75 bp, Artificial Sequence
  Synthetic
ggattccatccaacaccagaaatacatattccaggtgaagttaagaacctgttggagattgcccaagtggagtca

SEQ ID NO: 69281 - DNA, 75 bp, Artificial Sequence
  Synthetic
gataatcccagaaacaccaactaatgtggagcgacaccttaatagagcagtcttagtgatgcaatccattgctac

SEQ ID NO: 69282 - DNA, 75 bp, Artificial Sequence
  Synthetic
atattccaggtgaagttaagaacctgttggagattgcccaagtggagtcaatattagaagtcaacaacttaaaaa

SEQ ID NO: 69283 - DNA, 75 bp, Artificial Sequence
  Synthetic
tctaagtttgtcgtcgcatcgaccaatgctagcaacatagtagttcctacagtttcagactcagatgcaattcgc

SEQ ID NO: 69284 - DNA, 75 bp, Artificial Sequence
  Synthetic
atgctagcaacatagtagttcctacagtttcagactcagatgcaattcgcagacgattctacatggactgcgaca

SEQ ID NO: 69285 - DNA, 75 bp, Artificial Sequence
  Synthetic
atcggttccaattgggaaagcattagctataccaaatttcgagaatctgagaagaaattggctcgaattgtttta

SEQ ID NO: 69286 - DNA, 75 bp, Artificial Sequence
  Synthetic
acccagcctggtgctgcagggtttgagttaaccaatccatacattttggatgcagggatcccgctaagtcaactg

SEQ ID NO: 69287 - DNA, 75 bp, Artificial Sequence
  Synthetic
gtttccgtgttgatcctggccgcgcaggaccatgggaggcaacactcgtaggtcagttgtgtcgctattacaccc

SEQ ID NO: 69288 - DNA, 75 bp, Artificial Sequence
  Synthetic
gtgttaagaacagccacagttcaaggacctagtttggactttgctttgtctctcttgaggcgcaacatcaggcag

SEQ ID NO: 69289 - DNA, 75 bp, Artificial Sequence
  Synthetic
aggaccatgggaggcaacactcgtaggtcagttgtgtcgctattacacccaatggtctggatcattagaggtgac

SEQ ID NO: 69290 - DNA, 75 bp, Artificial Sequence
  Synthetic
agttaaccaatccatacattttggatgcagggatcccgctaagtcaactgttagtatgccctcaccaatggatca

SEQ ID NO: 69291 - DNA, 75 bp, Artificial Sequence
  Synthetic
gacctagtttggactttgctttgtctctcttgaggcgcaacatcaggcaggtgcagactgaccagggacacttca

SEQ ID NO: 69292 - DNA, 75 bp, Artificial Sequence
  Synthetic
attgcaattttggcttggtagttgttccagtctcacccctcgggttcttgcagggggccacacccacgatcccta

SEQ ID NO: 69293 - DNA, 75 bp, Artificial Sequence
  Synthetic
aacatcgagagaagttgcgatgctcggtacacatgtcatatgggactttggcctacaatcatctgtcaccatgat

SEQ ID NO: 69294 - DNA, 75 bp, Artificial Sequence
  Synthetic
acaaattgaccaacgtgctagacgcagttgaattggtggatgagcagggtgtcaacttagagctcactctggtga

SEQ ID NO: 69295 - DNA, 75 bp, Artificial Sequence
  Synthetic
gtcaacttagagctcactctggtgactttggacaccaacgaaaaatttagggatatcaccaagttcatcccagag

SEQ ID NO: 69296 - DNA, 75 bp, Artificial Sequence
  Synthetic
tctcacgaaaactcaaactcagccactgagggttccaccataaactacaccaccattaattactacaaagactcc

SEQ ID NO: 69297 - DNA, 75 bp, Artificial Sequence
  Synthetic
ggtacacatgtcatatgggactttggcctacaatcatctgtcaccatgattataccgtggattagcaacacacac

SEQ ID NO: 69298 - DNA, 75 bp, Artificial Sequence
  Synthetic
tgatcactctcaaattcattttgaccctcaactcaatcaaacatgggctcacaggtgtccacacaacgctccggt

SEQ ID NO: 69299 - DNA, 75 bp, Artificial Sequence
  Synthetic
tctcacgaccgacgatggtgtatcagcccctatattgcccgggtttcacccaacaccagtgatacacatccctgg

SEQ ID NO: 69300 - DNA, 75 bp, Artificial Sequence
  Synthetic
tatgttgtaccagaaggagcccccaccagtgcttacatcatcgcattgggagctgcccaaccaaatttctcacta

SEQ ID NO: 69301 - DNA, 75 bp, Artificial Sequence
  Synthetic
ccagtgcttacatcatcgcattgggagctgcccaaccaaatttctcactaaaactttgtaaagacactgaatcaa

SEQ ID NO: 69302 - DNA, 75 bp, Artificial Sequence
  Synthetic
tccagtctcacccctcgggttcttgcagggggccacacccacgatccctataaccatcacagtggctcccatgaa

SEQ ID NO: 69303 - DNA, 75 bp, Artificial Sequence
  Synthetic
gcccctatattgcccgggtttcacccaacaccagtgatacacatccctggggaggtgaaaaacctcttggagttg

SEQ ID NO: 69304 - DNA, 75 bp, Artificial Sequence
  Synthetic
tgcttaaaaacttccccaattacgacagtagcaagattaccaacagtgcacgggaccgatccagtatcaagcagg

SEQ ID NO: 69305 - DNA, 75 bp, Artificial Sequence
  Synthetic
gacgttgtacaatatgggttcttgaatctcagtggtaaacctactcatagaaccatgatgtataatttccctacg

SEQ ID NO: 69306 - DNA, 75 bp, Artificial Sequence
  Synthetic
ccagtgcaagttcagacacagtcaggtgaactgtgcgcagcattcaaagctgatcccggccttgatggtccgtgg

SEQ ID NO: 69307 - DNA, 75 bp, Artificial Sequence
  Synthetic
ctctaacagcagctgacactaaacctagcagccacaacatttcaacaggtaatacaccagctttacaagctgcag

SEQ ID NO: 69308 - DNA, 75 bp, Artificial Sequence
  Synthetic
cagggcttttgtgccggcttgaagagaagttactttgccagtgaacaaggagagatccagtgggtgaaacctaac

SEQ ID NO: 69309 - DNA, 75 bp, Artificial Sequence
  Synthetic
tagcagccacaacatttcaacaggtaatacaccagctttacaagctgcagaaactggggcaacatcaaacaccag

SEQ ID NO: 69310 - DNA, 75 bp, Artificial Sequence
  Synthetic
gtgaactgtgcgcagcattcaaagctgatcccggccttgatggtccgtggcagtccaccatggtcgggcagcttt

SEQ ID NO: 69311 - DNA, 75 bp, Artificial Sequence
  Synthetic
gaagttactttgccagtgaacaaggagagatccagtgggtgaaacctaacaaagaaactggaaggttgaacatca

SEQ ID NO: 69312 - DNA, 75 bp, Artificial Sequence
  Synthetic
aaatgctgatagcctataccccccccggaggctccctacctgctaatagaatgcaggcaatgcttggtactcacg

SEQ ID NO: 69313 - DNA, 75 bp, Artificial Sequence
  Synthetic
tggacgtgcagcactagtgggtcttgtgtctatacttacttcagagacatcagcaaatggcttcaccaattggga

SEQ ID NO: 69314 - DNA, 75 bp, Artificial Sequence
  Synthetic
taaccagcaaagaccctaggctagaggttgattttgaacaagctttgttctctaagtatgtgggcaacactctgc

SEQ ID NO: 69315 - DNA, 75 bp, Artificial Sequence
  Synthetic
gtgtctatacttacttcagagacatcagcaaatggcttcaccaattgggatgtagacatcatgggttttgtgcag

SEQ ID NO: 69316 - DNA, 75 bp, Artificial Sequence
  Synthetic
cggaggctccctacctgctaatagaatgcaggcaatgcttggtactcacgtcatatgggactttggtcttcaatc

SEQ ID NO: 69317 - DNA, 75 bp, Artificial Sequence
  Synthetic
ggttgattttgaacaagctttgttctctaagtatgtgggcaacactctgcatgatcctgatgaatacgtgacaca

SEQ ID NO: 69318 - DNA, 75 bp, Artificial Sequence
  Synthetic
acacgtcagggcatggatcccaaggcctctgagaaatcaaccctatttgtttaagaccaacccaaattataaagg

SEQ ID NO: 69319 - DNA, 75 bp, Artificial Sequence
  Synthetic
ggacaagcagattctacaatgatacagtatatgtacataccaccaggtgctcccaaaccaacacagagagattca

SEQ ID NO: 69320 - DNA, 75 bp, Artificial Sequence
  Synthetic
ttatgccactggtatagtgtccctgtggtaccagaccaacttcgttgttcccatcggtgctcctaccactgctta

SEQ ID NO: 69321 - DNA, 75 bp, Artificial Sequence
  Synthetic
ttatggaacagaatacttagaagctatagacctgcacactagtgctggatacccttatagtgccctgggcattaa

SEQ ID NO: 69322 - DNA, 75 bp, Artificial Sequence
  Synthetic
agtatatgtacataccaccaggtgctcccaaaccaacacagagagattcatttgaatggcagtcagccaccaatc

SEQ ID NO: 69323 - DNA, 75 bp, Artificial Sequence
  Synthetic
cctagcatggcataatggtaagcaagaatatgagaagtttgtgagcacaattaggtctgtcccagtaggaagagc

SEQ ID NO: 69324 - DNA, 75 bp, Artificial Sequence
  Synthetic
gtgcccttggtatcaagaaaagagacattctcgaccccataaccagggatgtgtctaagatgaaattctacatgg

SEQ ID NO: 69325 - DNA, 75 bp, Artificial Sequence
  Synthetic
gtcgatctcattgagagtgctgcacagaataccactaaagctattactagctcaattgacaccaagactggcgcc

SEQ ID NO: 69326 - DNA, 75 bp, Artificial Sequence
  Synthetic
agtggttctatgatgggtacccaaccttcgggacccacactgcatccacggacagctggtatggagtgtgcccaa

SEQ ID NO: 69327 - DNA, 75 bp, Artificial Sequence
  Synthetic
gatgagctcagatccctagacaaaatcaaaaagggaaagtctcgcttgattgaagccagcagtctaaatgattcc

SEQ ID NO: 69328 - DNA, 75 bp, Artificial Sequence
  Synthetic
cttcgggacccacactgcatccacggacagctggtatggagtgtgcccaaataacctcatgggaacctttgccgt

SEQ ID NO: 69329 - DNA, 75 bp, Artificial Sequence
  Synthetic
agaataccactaaagctattactagctcaattgacaccaagactggcgccaacactcaagctagtcagcaccgta

SEQ ID NO: 69330 - DNA, 75 bp, Artificial Sequence
  Synthetic
tcaaaaagggaaagtctcgcttgattgaagccagcagtctaaatgattccgtttaccttagaatgacatttggcc

SEQ ID NO: 69331 - DNA, 75 bp, Artificial Sequence
  Synthetic
aacttagaagctttgtacaatcatggccaatagtgggcgtggcgcgccagtcacgtcttggtcaagcacttctgt

SEQ ID NO: 69332 - DNA, 75 bp, Artificial Sequence
  Synthetic
ttgagacgagatgtgtcgtgaataaacacagtacagaggagaccagtatcacaaatttctattctagagcaggct

SEQ ID NO: 69333 - DNA, 75 bp, Artificial Sequence
  Synthetic
ttgggtgccaagaccattcagaagccagccataccttctaaagaattatccaaacatggatggtacaaatttgaa

SEQ ID NO: 69334 - DNA, 75 bp, Artificial Sequence
  Synthetic
ggagtaagttaccaatcctattgccaggctcgctttttgcattcgactactcagggtatgacgcaagccttagtc

SEQ ID NO: 69335 - DNA, 75 bp, Artificial Sequence
  Synthetic
cagccataccttctaaagaattatccaaacatggatggtacaaatttgaagtgcgctagcaccagcagagccaag

SEQ ID NO: 69336 - DNA, 75 bp, Artificial Sequence
  Synthetic
acacagtacagaggagaccagtatcacaaatttctattctagagcaggcttggtggggtttgtgaatatgccggt

SEQ ID NO: 69337 - DNA, 75 bp, Artificial Sequence
  Synthetic
aggctcgctttttgcattcgactactcagggtatgacgcaagccttagtcctgtgtggtttagagctttggagtt

SEQ ID NO: 69338 - DNA, 75 bp, Artificial Sequence
  Synthetic
gctagaactcatgacatacatgaggttttccgctgaatttacgtttgtagcgagcactcctggggggaagactac

SEQ ID NO: 69339 - DNA, 75 bp, Artificial Sequence
  Synthetic
atgagcatggaagaagcatgctatggcactgaatacctggaggccatagacctgcacaccagtgctgggtacccc

SEQ ID NO: 69340 - DNA, 75 bp, Artificial Sequence
  Synthetic
ttagccactgaagaagattggaagaatcttgtgtgggaggattatcaaagagaccttcttgtttccaacaccaga

SEQ ID NO: 69341 - DNA, 75 bp, Artificial Sequence
  Synthetic
tcggaataaaacatactgtgttcttggcgggatgccctcgggttgctctggcacttccattttcaattccatgat

SEQ ID NO: 69342 - DNA, 75 bp, Artificial Sequence
  Synthetic
atcttgtgtgggaggattatcaaagagaccttcttgtttccaacaccagagctcacggctgtgacactattgcta

SEQ ID NO: 69343 - DNA, 75 bp, Artificial Sequence
  Synthetic
ttttccgctgaatttacgtttgtagcgagcactcctggggggaagactaccaacctcatattacaatatatgtat

SEQ ID NO: 69344 - DNA, 75 bp, Artificial Sequence
  Synthetic
ggcgggatgccctcgggttgctctggcacttccattttcaattccatgatcaacaacataatcatcagaaccctt

SEQ ID NO: 69345 - DNA, 75 bp, Artificial Sequence
  Synthetic
agcaagatgacagatccccctgcccaagtgtcggtcccattcctttcccctgcatcagcttaccagtggttttat

SEQ ID NO: 69346 - DNA, 75 bp, Artificial Sequence
  Synthetic
gtctggttcacgtgcaagcaaatgaatactaccctgaacggtatcagtcacatgtgttgttggccaacggcgttt

SEQ ID NO: 69347 - DNA, 75 bp, Artificial Sequence
  Synthetic
tctgcagcggaaccgactactttgggtgtccgtgtttccttttattctttattggctgcttatggtgacaattga

SEQ ID NO: 69348 - DNA, 75 bp, Artificial Sequence
  Synthetic
tacccgttccccattgattgcttggaattggcgagaactggcaaggagtacgggctgactatgactcctgccgat

SEQ ID NO: 69349 - DNA, 75 bp, Artificial Sequence
  Synthetic
atactaccctgaacggtatcagtcacatgtgttgttggccaacggcgtttcaaaagccggtgattgtgggggaat

SEQ ID NO: 69350 - DNA, 75 bp, Artificial Sequence
  Synthetic
tgaacaattacatgcagttcaagagcaaacaccgtattgaacctgtatgtcttatcatcaggggctcaccaggca

SEQ ID NO: 69351 - DNA, 75 bp, Artificial Sequence
  Synthetic
aagtgtcggtcccattcctttcccctgcatcagcttaccagtggttttatgatggttaccctacatttggaaagc

SEQ ID NO: 69352 - DNA, 75 bp, Artificial Sequence
  Synthetic
gtgaaggcaatccaacacaatctgtcaccatacgcgtgtacatgagattgaagcacatccgcgcatggatacccc

SEQ ID NO: 69353 - DNA, 75 bp, Artificial Sequence
  Synthetic
gtgcaatcctgatgtgttctggagcaaactaccgatcctgctgccgggatcgctttttgcatttgattattcagg

SEQ ID NO: 69354 - DNA, 75 bp, Artificial Sequence
  Synthetic
agacctgctgtggttagaagatgatgtgatggaacaaggtgttacagattacatcaaaggtcttggagatgcctt

SEQ ID NO: 69355 - DNA, 75 bp, Artificial Sequence
  Synthetic
tttccttttctaatccatcctacaatgcccatgagggaaatccatgaatccatccgttggactaaggatgcacgc

SEQ ID NO: 69356 - DNA, 75 bp, Artificial Sequence
  Synthetic
gtgatggaacaaggtgttacagattacatcaaaggtcttggagatgccttcggaactggatttacagagtctatc

SEQ ID NO: 69357 - DNA, 75 bp, Artificial Sequence
  Synthetic
caccatacgcgtgtacatgagattgaagcacatccgcgcatggataccccggccactgaggagccaaaactacac

SEQ ID NO: 69358 - DNA, 75 bp, Artificial Sequence
  Synthetic
gggaaagtttgggcagcaatctggagcaatatatgtgggcaactacagggtagtaaatagacacctagccaccca

SEQ ID NO: 69359 - DNA, 75 bp, Artificial Sequence
  Synthetic
gtcaagattgtgtcagcactggtcatagtaatcaggagtgactacgacctagtcacgatgactgcaacacttgct

SEQ ID NO: 69360 - DNA, 75 bp, Artificial Sequence
  Synthetic
tagtaatcaggagtgactacgacctagtcacgatgactgcaacacttgctttgatcggttgccacacaagcccat

SEQ ID NO: 69361 - DNA, 75 bp, Artificial Sequence
  Synthetic
cagggaagtctctagcaacaggcatcatcgcccgtgcgatagctgataaatatcactctagtgtgtactcactcc

SEQ ID NO: 69362 - DNA, 75 bp, Artificial Sequence
  Synthetic
gcaatatatgtgggcaactacagggtagtaaatagacacctagccacccacaatgactgggcgaacttggtgtgg

SEQ ID NO: 69363 - DNA, 75 bp, Artificial Sequence
  Synthetic
cagactgggatatactactgtaattcccgcaggaaacactacgcagttagcttttctaaacccagtttaattttt

SEQ ID NO: 69364 - DNA, 75 bp, Artificial Sequence
  Synthetic
agaaattcaatgacatggcaaatgctgctaagggcttggagtgggttgcgatcaagatttccaagttcatagatt

SEQ ID NO: 69365 - DNA, 75 bp, Artificial Sequence
  Synthetic
actgcatgaacctgatgaatacgtcagagaggcagcccttcactatgcgaatcagttgaagcagctagacataga

SEQ ID NO: 69366 - DNA, 75 bp, Artificial Sequence
  Synthetic
tgctaagggcttggagtgggttgcgatcaagatttccaagttcatagattggttgaagcagaaagtcgtcccagc

SEQ ID NO: 69367 - DNA, 75 bp, Artificial Sequence
  Synthetic
cccgcaggaaacactacgcagttagcttttctaaacccagtttaatttttgtggaagctagtgaatactacccag

SEQ ID NO: 69368 - DNA, 75 bp, Artificial Sequence
  Synthetic
agcatggtgtcgtgggaatagtttccactggagggaacggccttgtaggattcgctgatgtgcgagatctgcttt

SEQ ID NO: 69369 - DNA, 75 bp, Artificial Sequence
  Synthetic
acaagcggctgctagccaggatgatttggaagccctgtttggaaatgtacagtacttggctattcattgcagaaa

SEQ ID NO: 69370 - DNA, 75 bp, Artificial Sequence
  Synthetic
gcagcggacaggctcacacgaaaccatcaacaccgttcgtgacgggtccaccctgaacttcaccaatattaatta

SEQ ID NO: 69371 - DNA, 75 bp, Artificial Sequence
  Synthetic
ttggaagccctgtttggaaatgtacagtacttggctattcattgcagaaaataccaacccttgtatgcttcagag

SEQ ID NO: 69372 - DNA, 75 bp, Artificial Sequence
  Synthetic
cactggagggaacggccttgtaggattcgctgatgtgcgagatctgctttggctagatgaagaagctatggaaca

SEQ ID NO: 69373 - DNA, 75 bp, Artificial Sequence
  Synthetic
actcgacgcaggtagggccgctaagctttgcacagaaaacaacaccgctaactttaagagatgcagcccactagt

SEQ ID NO: 69374 - DNA, 75 bp, Artificial Sequence
  Synthetic
ggaggccttaaagagtcatcttattggatcggagggcgcagtggagaaaatcctgaagaacctagtaaaactcat

SEQ ID NO: 69375 - DNA, 75 bp, Artificial Sequence
  Synthetic
gtatgtttgatcatccgcggcgctccaggcacaggaaagtcactcgccacaggcatcattgctagagctattgca

SEQ ID NO: 69376 - DNA, 75 bp, Artificial Sequence
  Synthetic
caggcacaggaaagtcactcgccacaggcatcattgctagagctattgcagaaaaataccactctagtgtttact

SEQ ID NO: 69377 - DNA, 75 bp, Artificial Sequence
  Synthetic
ggatcggagggcgcagtggagaaaatcctgaagaacctagtaaaactcatttcagccctggtcatagtcatcagg

SEQ ID NO: 69378 - DNA, 75 bp, Artificial Sequence
  Synthetic
gtgcccacatcagtggattaacttaagaactaataattgtgcaaccattatagttccatatatgaacacagttcc

SEQ ID NO: 69379 - DNA, 75 bp, Artificial Sequence
  Synthetic
ccaatacagcctatataatagcactagcggcagcccaaaagaacttcactatgaaattgtgcaaggatgctagtg

SEQ ID NO: 69380 - DNA, 75 bp, Artificial Sequence
  Synthetic
aaatcaaagacagcttccattttgggtattcccatagcacagaaacagagtgcatcatggctgaagaaatttaac

SEQ ID NO: 69381 - DNA, 75 bp, Artificial Sequence
  Synthetic
acccagacgggaaggacatctccttgttctgtcagatggtctctactgtggaattcataccccctatggcatcat

SEQ ID NO: 69382 - DNA, 75 bp, Artificial Sequence
  Synthetic
taaaaaacgcctgtgggttgccccccctcccagggcccactgggggcgagccctttggtaccttggtacctttgt

SEQ ID NO: 69383 - DNA, 75 bp, Artificial Sequence
  Synthetic
gttctgtcagatggtctctactgtggaattcataccccctatggcatcattggaggaaaaaggtctaccttttac

SEQ ID NO: 69384 - DNA, 75 bp, Artificial Sequence
  Synthetic
gtattcccatagcacagaaacagagtgcatcatggctgaagaaatttaacgacatggcaaatgctgcaaaggggt

SEQ ID NO: 69385 - DNA, 75 bp, Artificial Sequence
  Synthetic
gaaacaccggccaacgtggagcgccacctcaacagagcagtgctagtgatgcagtccatcgccaccgtggttgca

SEQ ID NO: 69386 - DNA, 75 bp, Artificial Sequence
  Synthetic
aagttgagttcttaaacaacctcaaacagttacccttgttggaaaaccaaatttccaacttagagcaatctgccg

SEQ ID NO: 69387 - DNA, 75 bp, Artificial Sequence
  Synthetic
gcgccgtttctatatggattgcgacattgaggtccctgaatcttacaggcttgaaaatggaaaactggatgcgtc

SEQ ID NO: 69388 - DNA, 75 bp, Artificial Sequence
  Synthetic
attgaggtccctgaatcttacaggcttgaaaatggaaaactggatgcgtcaagagcggcgaggttgtgctctgaa

SEQ ID NO: 69389 - DNA, 75 bp, Artificial Sequence
  Synthetic
acagttacccttgttggaaaaccaaatttccaacttagagcaatctgccgcttcacaagaagaccttgaggccat

SEQ ID NO: 69390 - DNA, 75 bp, Artificial Sequence
  Synthetic
gtatgccctggagaagagaatgaacaactacatgcagttcaagagcaaacaccgtattgagcctgtgtgtctgat

SEQ ID NO: 69391 - DNA, 75 bp, Artificial Sequence
  Synthetic
aaagtaaggtatagcttggactcagtggtttcagagctcattagagagtataacaacagaaatagtgttgggaac

SEQ ID NO: 69392 - DNA, 75 bp, Artificial Sequence
  Synthetic
tggtttcagagctcattagagagtataacaacagaaatagtgttgggaacactattgaagccctctttcaaggac

SEQ ID NO: 69393 - DNA, 75 bp, Artificial Sequence
  Synthetic
ttatgtgctgccttcagagcagaccctggaagagatggcccgtggcagtctacaatactaggtcaactctgcaga

SEQ ID NO: 69394 - DNA, 75 bp, Artificial Sequence
  Synthetic
aactacatgcagttcaagagcaaacaccgtattgagcctgtgtgtctgatcattagaggatccccaggtactggc

SEQ ID NO: 69395 - DNA, 75 bp, Artificial Sequence
  Synthetic
gacccagatcatttcgacggatacaagcaacaagtggtcacggtcatggatgacctatgtcagaaccctgatggt

SEQ ID NO: 69396 - DNA, 75 bp, Artificial Sequence
  Synthetic
ttgatagtgaagaagtcaggcaatattgtaaggacaaaggctggatcatcccagaagtgcccacaaacattgaga

SEQ ID NO: 69397 - DNA, 75 bp, Artificial Sequence
  Synthetic
ctcatcgcctacaccccacctgggggaaatgtgcctgcggacagaatcacagcaatgctaggaacacatgtgatc

SEQ ID NO: 69398 - DNA, 75 bp, Artificial Sequence
  Synthetic
tggaggtgacattcatgtttgcaggctcattcatggccacaggaaaaatgctcatcgcctacaccccacctgggg

SEQ ID NO: 69399 - DNA, 75 bp, Artificial Sequence
  Synthetic
ttgtaaggacaaaggctggatcatcccagaagtgcccacaaacattgagagacatgtcaacagagctgtggctat

SEQ ID NO: 69400 - DNA, 75 bp, Artificial Sequence
  Synthetic
agcaacaagtggtcacggtcatggatgacctatgtcagaaccctgatggtaaagacatgtccctgttttgccaaa

SEQ ID NO: 69401 - DNA, 75 bp, Artificial Sequence
  Synthetic
tcatcgcatccaccaatgccagcaatatcatcgtccctactgtttcagactccgatgcaattcgcaggagatttt

SEQ ID NO: 69402 - DNA, 75 bp, Artificial Sequence
  Synthetic
gggtgcttattcgggtatgcctaaaactgcactgaagaagccagtgttgagaactgccacagtgcaaggaccctg

SEQ ID NO: 69403 - DNA, 75 bp, Artificial Sequence
  Synthetic
actgcactgaagaagccagtgttgagaactgccacagtgcaaggaccctgccttgactttgccttgtccctactt

SEQ ID NO: 69404 - DNA, 75 bp, Artificial Sequence
  Synthetic
tatcatcgtccctactgtttcagactccgatgcaattcgcaggagatttttcatggactgtgacatagaggtgac

SEQ ID NO: 69405 - DNA, 75 bp, Artificial Sequence
  Synthetic
ttaaaacagcctgtgggttgcacccacccacagggcccactgggcgtcagcacactgattctatggaatctttgt

SEQ ID NO: 69406 - DNA, 75 bp, Artificial Sequence
  Synthetic
ggtgggaacggacgccagggtttctgtgctggactgaagagaggctactttgccagtgaacagggagagatccag

SEQ ID NO: 69407 - DNA, 75 bp, Artificial Sequence
  Synthetic
caattttaaaagatgcagcccgttagtatgtggtaaagctatccaactacgggataggaagtctaaggttagata

SEQ ID NO: 69408 - DNA, 75 bp, Artificial Sequence
  Synthetic
ctgcctcgccatgctgagccaagtggaaccatctggatcgaaggcaagcaggtcaaagtcttagatgctgttgag

SEQ ID NO: 69409 - DNA, 75 bp, Artificial Sequence
  Synthetic
gaaccatctggatcgaaggcaagcaggtcaaagtcttagatgctgttgagttggtagatgaacaacaagtcaatc

SEQ ID NO: 69410 - DNA, 75 bp, Artificial Sequence
  Synthetic
gtatgtggtaaagctatccaactacgggataggaagtctaaggttagatacagcgtcgatactgtagtgtcagaa

SEQ ID NO: 69411 - DNA, 75 bp, Artificial Sequence
  Synthetic
ggcactggtgttgtaccagcactacaagccgcggagacaggggcgtcgtctaatgctagtgacaagaatctcatt

SEQ ID NO: 69412 - DNA, 75 bp, Artificial Sequence
  Synthetic
agaccaattaggataagccttgaggaaaaacccgcccctgacgctattagcgacttgttggctagtgtggacagt

SEQ ID NO: 69413 - DNA, 75 bp, Artificial Sequence
  Synthetic
aatcaatctcagaagccactctagtgattaacacagaacaaatgccctcgatgttcgtccctgtaggaaaagttg

SEQ ID NO: 69414 - DNA, 75 bp, Artificial Sequence
  Synthetic
gattaacacagaacaaatgccctcgatgttcgtccctgtaggaaaagttgagaactatggattcctgaacttgag

SEQ ID NO: 69415 - DNA, 75 bp, Artificial Sequence
  Synthetic
aaaaacccgcccctgacgctattagcgacttgttggctagtgtggacagtgaggaggtgcgacagtattgcagag

SEQ ID NO: 69416 - DNA, 75 bp, Artificial Sequence
  Synthetic
tagacatcaacactaataagatgagcatggaagaagcatgctatggcactgaatacctggaggccatagacctgc

SEQ ID NO: 69417 - DNA, 75 bp, Artificial Sequence
  Synthetic
ctatagcaacagtggtagcggtggtctcattagtttatgtcatctacaaattgtttgctggattccaaggggcgt

SEQ ID NO: 69418 - DNA, 75 bp, Artificial Sequence
  Synthetic
tgttggtaaaattattggaattcatgttggaggaaatgggcgccagggcttttgtgcagccttgaagcggtgtta

SEQ ID NO: 69419 - DNA, 75 bp, Artificial Sequence
  Synthetic
gttggaggaaatgggcgccagggcttttgtgcagccttgaagcggtgttacttcaccactgagcaaggtgagatt

SEQ ID NO: 69420 - DNA, 75 bp, Artificial Sequence
  Synthetic
ctcattagtttatgtcatctacaaattgtttgctggattccaaggggcgtactctggagctccaaagcaggtgct

SEQ ID NO: 69421 - DNA, 75 bp, Artificial Sequence
  Synthetic
cattaggcaagtgcagacagatcagggccacttcaccatgttgggcgttcgtgaccggctggccatattaccacg

SEQ ID NO: 69422 - DNA, 75 bp, Artificial Sequence
  Synthetic
gtcttccatgacgtgtttgaagggaagaaagaaccagcagcattgtcatccaaagacaagagattagaggttgac

SEQ ID NO: 69423 - DNA, 75 bp, Artificial Sequence
  Synthetic
ttgtgcctattagtccactagactacgaccaaggagcgacgccagtaatccctataaccatcacattggccccaa

SEQ ID NO: 69424 - DNA, 75 bp, Artificial Sequence
  Synthetic
agaaagaaccagcagcattgtcatccaaagacaagagattagaggttgactttgaggaagccctctttttaaagt

SEQ ID NO: 69425 - DNA, 75 bp, Artificial Sequence
  Synthetic
gttagatttgtgtcaaatagaaaccatactagaagtcaataataccactagcactaccggggtcagtagattact

SEQ ID NO: 69426 - DNA, 75 bp, Artificial Sequence
  Synthetic
gaaatctggtcgtgaatgtgactggtgggggtaaatttgttatacaaaaatataagcaaaagtaaacagggagcc

SEQ ID NO: 69427 - DNA, 75 bp, Artificial Sequence
  Synthetic
ggccacttcaccatgttgggcgttcgtgaccggctggccatattaccacgccacgcccaaccaggaaagaccata

SEQ ID NO: 69428 - DNA, 75 bp, Artificial Sequence
  Synthetic
accttagtaactttagatgccaatgagaaatttagggacatcaccaaattcatcccagaaacgatcaccggcgct

SEQ ID NO: 69429 - DNA, 75 bp, Artificial Sequence
  Synthetic
agctgaacatagacacatccaaaatgtctatggttgatgcctgttatggaactgaaaacctggaagcaatagacc

SEQ ID NO: 69430 - DNA, 75 bp, Artificial Sequence
  Synthetic
gtctatggttgatgcctgttatggaactgaaaacctggaagcaatagaccttagcactagtgctggttacccata

SEQ ID NO: 69431 - DNA, 75 bp, Artificial Sequence
  Synthetic
agaaatttagggacatcaccaaattcatcccagaaacgatcaccggcgctagtgacgctaccctagtgatcaata

SEQ ID NO: 69432 - DNA, 75 bp, Artificial Sequence
  Synthetic
ctacccacaggactatgatgtacaactttcccacgaaagcgggacaatgtgggggtgttgtcacttcagtgggca

SEQ ID NO: 69433 - DNA, 75 bp, Artificial Sequence
  Synthetic
ggacaaatatgggttggatttaccatattccacctatgtgaaggatgagttaaggagcattgaaaaagtcaagaa

SEQ ID NO: 69434 - DNA, 75 bp, Artificial Sequence
  Synthetic
tattccacctatgtgaaggatgagttaaggagcattgaaaaagtcaagaaagggaaatcacgcctcattgaagca

SEQ ID NO: 69435 - DNA, 75 bp, Artificial Sequence
  Synthetic
ctttcccacgaaagcgggacaatgtgggggtgttgtcacttcagtgggcaagatcatcgggatccacattggtgg

SEQ ID NO: 69436 - DNA, 75 bp, Artificial Sequence
  Synthetic
gaagcccaacaaagaaactgggaggttgaacatcaacggtccaacccggactaaactggagcccagtgtgttcca

SEQ ID NO: 69437 - DNA, 75 bp, Artificial Sequence
  Synthetic
actattactggatctgctgtcggctgcaacccagacactttctggagcaagattcctatactcctaccaggatca

SEQ ID NO: 69438 - DNA, 75 bp, Artificial Sequence
  Synthetic
gcaacccagacactttctggagcaagattcctatactcctaccaggatcactctttgcctttgattacacaggtt

SEQ ID NO: 69439 - DNA, 75 bp, Artificial Sequence
  Synthetic
ttgaacatcaacggtccaacccggactaaactggagcccagtgtgttccatgatgtgttcgagggcaacaaggag

SEQ ID NO: 69440 - DNA, 75 bp, Artificial Sequence
  Synthetic
gaccacccttaattatatcttgacccttaacacagctaaacatgggttcgcaagtgtccacacagcgctccggtt

SEQ ID NO: 69441 - DNA, 75 bp, Artificial Sequence
  Synthetic
gcgctctttgtgcctcttagcatggcataatgggaaggaggaatatgaaaaatttgtgagtacaattagatcagt

SEQ ID NO: 69442 - DNA, 75 bp, Artificial Sequence
  Synthetic
ccatcagtgtgatagaaggtataaaccactcacatcacatatatagaaacaaaacatattgtgtgttgggaggca

SEQ ID NO: 69443 - DNA, 75 bp, Artificial Sequence
  Synthetic
aacacactacatgaacctgatgagtatgtaacccaagccgcccttcattacgcaaaccagttgaagcagctggac

SEQ ID NO: 69444 - DNA, 75 bp, Artificial Sequence
  Synthetic
ccactcacatcacatatatagaaacaaaacatattgtgtgttgggaggcatgccatctggttgctctgggactag

SEQ ID NO: 69445 - DNA, 75 bp, Artificial Sequence
  Synthetic
atgtaacccaagccgcccttcattacgcaaaccagttgaagcagctggacattaacactagcaagatgagtatgg

SEQ ID NO: 69446 - DNA, 75 bp, Artificial Sequence
  Synthetic
cactctggttctacggaacccttgtgcgcctgttttacgccccctccccaatttgtaacttagaagcaatttaca

SEQ ID NO: 69447 - DNA, 75 bp, Artificial Sequence
  Synthetic
taggcattaagaagagggacatccttgatccggttaccagagatactaccaagatgaagttctacatggacaaat

SEQ ID NO: 69448 - DNA, 75 bp, Artificial Sequence
  Synthetic
tgaattgaacatgattgcatatggtgatgatgtcctggcaagttaccctttcccaattgattgtcaagaattagc

SEQ ID NO: 69449 - DNA, 75 bp, Artificial Sequence
  Synthetic
taaagctgaaccccaccagaaatctggtcgtgttaatgactggtgggggtaaatttgttataaccagaatacgca

SEQ ID NO: 69450 - DNA, 75 bp, Artificial Sequence
  Synthetic
gatgatgtcctggcaagttaccctttcccaattgattgtcaagaattagcaaatactggaaaggagtacgggtta

SEQ ID NO: 69451 - DNA, 75 bp, Artificial Sequence
  Synthetic
aatgatagcacgacgcccgggatgctgctgcagtatatgtatgtaccaccaggggcccctaaaccggatagtagg

SEQ ID NO: 69452 - DNA, 75 bp, Artificial Sequence
  Synthetic
tgatccggttaccagagatactaccaagatgaagttctacatggacaaatatggattggatttaccttactccac

SEQ ID NO: 69453 - DNA, 75 bp, Artificial Sequence
  Synthetic
aaatgattctgtttacctcaggatgacctttggacacctttatgaagtgttccacgccaacccaggaactataac

SEQ ID NO: 69454 - DNA, 75 bp, Artificial Sequence
  Synthetic
ttcaagccagatgaacagttccctttcctcatccacccaactatgccgatgtctgaaattcacgagtctatcagg

SEQ ID NO: 69455 - DNA, 75 bp, Artificial Sequence
  Synthetic
tcctcatccacccaactatgccgatgtctgaaattcacgagtctatcaggtggactagagatgcacgaaacactc

SEQ ID NO: 69456 - DNA, 75 bp, Artificial Sequence
  Synthetic
ggaattgttgaggtccaagccaatgaattctatccacacagataccaaacccacgttctacttgggtatggtatg

SEQ ID NO: 69457 - DNA, 75 bp, Artificial Sequence
  Synthetic
acctttggacacctttatgaagtgttccacgccaacccaggaactataactgggtcagctgtggggtgcaaccct

SEQ ID NO: 69458 - DNA, 75 bp, Artificial Sequence
  Synthetic
agtctcagtcctgtgtggtttagagccttggaagtggttttacgagagattggttacccagaggaagctgtgtcc

SEQ ID NO: 69459 - DNA, 75 bp, Artificial Sequence
  Synthetic
tcagatcagtgcctattggcctggcactgtctataccagagtacaacaaccttcggcgactctggttggaacaat

SEQ ID NO: 69460 - DNA, 75 bp, Artificial Sequence
  Synthetic
ccttggaagtggttttacgagagattggttacccagaggaagctgtgtcccttatagaaggaatcaaccacaccc

SEQ ID NO: 69461 - DNA, 75 bp, Artificial Sequence
  Synthetic
aacatctggtaagtttggccaacaatccggggctatctatgtgggtaactttagagtggtaaaccgacatcttgc

SEQ ID NO: 69462 - DNA, 75 bp, Artificial Sequence
  Synthetic
aatgaaaatttgaattaaattcgatttaattcggcctcctcaatggctctgggctagttgtggccattggggatc

SEQ ID NO: 69463 - DNA, 75 bp, Artificial Sequence
  Synthetic
actccatgatcaataacataataatcaggaccctcttgattaagactttcaaaggaatagatctggatgaactaa

SEQ ID NO: 69464 - DNA, 75 bp, Artificial Sequence
  Synthetic
caggaccctcttgattaagactttcaaaggaatagatctggatgaactaaacatggtggcgtatggagacgatgt

SEQ ID NO: 69465 - DNA, 75 bp, Artificial Sequence
  Synthetic
acctgccgacaaatcaccctgttttaatgaagtcacctgggagaatgctactttcttgaagagaggctttttacc

SEQ ID NO: 69466 - DNA, 75 bp, Artificial Sequence
  Synthetic
ctagcgtttactcactccctccagacccagaccattttgatggatacaagcaacaagtagtcactgttatggatg

SEQ ID NO: 69467 - DNA, 75 bp, Artificial Sequence
  Synthetic
tacacaggaagcggcaaacatcatagtcggttatggtgaatggccctcatactgctccgatgacgacgctacagc

SEQ ID NO: 69468 - DNA, 75 bp, Artificial Sequence
  Synthetic
aatgaagtcacctgggagaatgctactttcttgaagagaggctttttaccagatcatcaattcccattcttgatt

SEQ ID NO: 69469 - DNA, 75 bp, Artificial Sequence
  Synthetic
gtgcgttccttgtgcctgctggcgtggcataatgggaaggaagagtatgagaaatttgtgagcacaatcagatca

SEQ ID NO: 69470 - DNA, 75 bp, Artificial Sequence
  Synthetic
atggactgcgatatagaggtgacagactcctacaagacggaccttggccgactcgacgcaggcagggccgctaag

SEQ ID NO: 69471 - DNA, 75 bp, Artificial Sequence
  Synthetic
actggctcagagagaagattgttccagcagctagagagaaagcagaatttttaaccaatttgaagcaattgccac

SEQ ID NO: 69472 - DNA, 75 bp, Artificial Sequence
  Synthetic
ccagatgtttccgtgaataggttttatacattggacactaaattgtgggaaaagtcatccaaggggtggtattgg

SEQ ID NO: 69473 - DNA, 75 bp, Artificial Sequence
  Synthetic
actgagccaaaaccagggacgaaccaattcttgaccaccgatgatggcgtctcagcacccattctgccaaatttc

SEQ ID NO: 69474 - DNA, 75 bp, Artificial Sequence
  Synthetic
gccaatcctgcttcctggttccctcttcgcttttgattactcaggttatgatgctagcctcagcccagtttggtt

SEQ ID NO: 69475 - DNA, 75 bp, Artificial Sequence
  Synthetic
aaaggtgaattgtgtgctgtgtttagggctgaccctggaagagacggtccatggcagtcaacgatgctgggccag

SEQ ID NO: 69476 - DNA, 75 bp, Artificial Sequence
  Synthetic
actcgcaaccaggaaaaactatttgggtggagcacaaattaatcaatgtgttagatgctgttgaattggtggatg

SEQ ID NO: 69477 - DNA, 75 bp, Artificial Sequence
  Synthetic
cacacaccatgtgtatcgcaacaaaacctattgcgtacttggtggaatgccctcaggttgctcaggaacatccat

SEQ ID NO: 69478 - DNA, 75 bp, Artificial Sequence
  Synthetic
cattcaagggtattgatctggatgaactcaacatggttgcctacggggacgatgtgctcgccagttacccctttc

SEQ ID NO: 69479 - DNA, 75 bp, Artificial Sequence
  Synthetic
tacatctaaatttgttatcgcatccaccaacgccagcaacattatagtgcctacagtgtctgactctgacgccat

SEQ ID NO: 69480 - DNA, 75 bp, Artificial Sequence
  Synthetic
atcacgtgcgatccttatgtctgttggcgtggcacaacggcaaacaagagtatgaaaaatgtgtgagtgcaatta

SEQ ID NO: 69481 - DNA, 75 bp, Artificial Sequence
  Synthetic
ccagaagaattttaccatgaaactgtgcaaggacactagtcacatattacagacagcctctattcagggagatag

SEQ ID NO: 69482 - DNA, 75 bp, Artificial Sequence
  Synthetic
aaactcgtaacttagaagaataacacgctatcgatcaatagcaggcatggcgcaccagccatgtctcgatcaagc

SEQ ID NO: 69483 - DNA, 75 bp, Artificial Sequence
  Synthetic
ggtgtcaagaaaagagacatacttgacccaaccactagagatactaccaaaatgaaattctacatggataaatat

SEQ ID NO: 69484 - DNA, 75 bp, Artificial Sequence
  Synthetic
tactaatcctgaatacaagaaaatgggagcacaggtctcaacacaaaagtctggtagtcacgagactagcaatgt

SEQ ID NO: 69485 - DNA, 75 bp, Artificial Sequence
  Synthetic
ggagcacaggtctcaacacaaaagtctggtagtcacgagactagcaatgtagccactgaagggtctaccatcaac

SEQ ID NO: 69486 - DNA, 75 bp, Artificial Sequence
  Synthetic
ccagccatgtctcgatcaagcacttctgtttccccggacagagtatcaatagactactcacgtggtcgaaggaga

SEQ ID NO: 69487 - DNA, 75 bp, Artificial Sequence
  Synthetic
gaggaacatcaggcaagtccaaacagaccaagggcattttaccatgttgggtgtcagggatcgcctggctgttct

SEQ ID NO: 69488 - DNA, 75 bp, Artificial Sequence
  Synthetic
taatgaaaagttcagagacatcaccaagttcatcccagaaagtattagtgctgctagcgacgccactttagtgat

SEQ ID NO: 69489 - DNA, 75 bp, Artificial Sequence
  Synthetic
tgactgtcggtaattcaacaatcaccacgcaagaggctgctaacatagttcttgcttacggggaatggcctgagt

SEQ ID NO: 69490 - DNA, 75 bp, Artificial Sequence
  Synthetic
gaaagccaacacataggaccatgatgtacaatttccctacaaaagcaggacagtgtggaggcgtggtcacatcag

SEQ ID NO: 69491 - DNA, 75 bp, Artificial Sequence
  Synthetic
atggtagcttatggagatgatgtgttagctagctatccattccctattgactgctcggagctagccagaactggt

SEQ ID NO: 69492 - DNA, 75 bp, Artificial Sequence
  Synthetic
gtgtcggttaacagattctacaccatgtctacgcaaatgtggcaggacacctcgaaagggtggtactggaagttc

SEQ ID NO: 69493 - DNA, 75 bp, Artificial Sequence
  Synthetic
gggtcaatgaggcgagtgtggaacacttttactctcgtgcggggctggtaggagttgtggaggtgaaggactcgg

SEQ ID NO: 69494 - DNA, 75 bp, Artificial Sequence
  Synthetic
ccaacactgcaaaacaccctgaattcactacgacgatgccaggcgctaacggtggcactttcgaaaatccctata

SEQ ID NO: 69495 - DNA, 75 bp, Artificial Sequence
  Synthetic
gtgcaaccatcatagtgccttacattaatgctgtcccatttgactctgccattaaccacaacaactttacgctag

SEQ ID NO: 69496 - DNA, 75 bp, Artificial Sequence
  Synthetic
cattaaattctgaattttgtggattgaggcaagccacatcacagggaataccagtggagctaaaacccggcacca

SEQ ID NO: 69497 - DNA, 75 bp, Artificial Sequence
  Synthetic
gagagcttgggtgcctaggcccctccgatcccaagcttacatggtcaagaattatccaacatatagccagacaat

SEQ ID NO: 69498 - DNA, 75 bp, Artificial Sequence
  Synthetic
gcaatccactttggttgggcaaatatgtaggtattacacccagtggtctggctcattagagatcacattcatgtt

SEQ ID NO: 69499 - DNA, 75 bp, Artificial Sequence
  Synthetic
gaacagtccgctgcctcacaagaggaccttgaagccatgtttgggaatgtgtcatacctcgcccatttctgtcgc

SEQ ID NO: 69500 - DNA, 75 bp, Artificial Sequence
  Synthetic
ggatatgggggttcccttgagccaagctttggtgtttccacaccagtggattaacctgcgcactaacaactgtgc

SEQ ID NO: 69501 - DNA, 75 bp, Artificial Sequence
  Synthetic
tgccagatggtgtccaccgtagattttatcccaccaatggcttctcttgaagaaaagggagtttcttttacatct

SEQ ID NO: 69502 - DNA, 75 bp, Artificial Sequence
  Synthetic
ggcaaagtgggtggttactttgattactatgcgtctggcatagtaactatttggtatcagacaaacttcgtcgta

SEQ ID NO: 69503 - DNA, 75 bp, Artificial Sequence
  Synthetic
aaggacacagatgaggtcacacaacaagctgtgttgcagggggaccccattgaagacataataactaacacagtt

SEQ ID NO: 69504 - DNA, 75 bp, Artificial Sequence
  Synthetic
gtcctaataacatgatgggccattttgccatccgaacagtcagtgaatctaccaccgggaaaaacgtccacgttc

SEQ ID NO: 69505 - DNA, 75 bp, Artificial Sequence
  Synthetic
attgatttcagcactagttatagtgatcaggagtgattatgacatggtaaccctcacagcaaccttagctctcat

SEQ ID NO: 69506 - DNA, 75 bp, Artificial Sequence
  Synthetic
ataggtactggggatgttccagctctccaagctgcggagacaggtgctacctctaacgcctcagatgagaacatg

SEQ ID NO: 69507 - DNA, 75 bp, Artificial Sequence
  Synthetic
aggggaggtaaataacctcctggagctctgccagatcgagtctatcttggaggtcaataatgtgactgggcaaga

SEQ ID NO: 69508 - DNA, 75 bp, Artificial Sequence
  Synthetic
tccaagctgcggagacaggtgctacctctaacgcctcagatgagaacatgattgagacacgctgtgtgctaaatc

SEQ ID NO: 69509 - DNA, 75 bp, Artificial Sequence
  Synthetic
gcagagcgcatcatggcttaagaagtttaatgatatggccagcgctgctaagggactcgagtggatctctaataa

SEQ ID NO: 69510 - DNA, 75 bp, Artificial Sequence
  Synthetic
ctttgtgtgcatcactcagagtcgatccaggtagggatggaccttggcaatctactttggttgggcaaatatgta

SEQ ID NO: 69511 - DNA, 75 bp, Artificial Sequence
  Synthetic
atggtggtacacagaagggattcgaggtgtgggacgtggacgtgatgggatttgtgcagctcagaaggaagttgg

SEQ ID NO: 69512 - DNA, 75 bp, Artificial Sequence
  Synthetic
ggtgtgggacgtggacgtgatgggatttgtgcagctcagaaggaagttggagatgtttacatacatgagatttaa

SEQ ID NO: 69513 - DNA, 75 bp, Artificial Sequence
  Synthetic
tttaatgatatggccagcgctgctaagggactcgagtggatctctaataagattagtaaatttatagactggctc

SEQ ID NO: 69514 - DNA, 75 bp, Artificial Sequence
  Synthetic
acctggtgcccccaaacctcaagagagggattcgtttcaatggcaaacagcaactaacccatcagtgttctgcaa

SEQ ID NO: 69515 - DNA, 75 bp, Artificial Sequence
  Synthetic
ctagcaatgctcggcacgcatgtagtgtgggatttcgggttgcaatcatccatcactctagtgatcccatggatc

SEQ ID NO: 69516 - DNA, 75 bp, Artificial Sequence
  Synthetic
aatgagcgatccccccccacaagtctccgtccctttcatgtcgccagccagtgcgtatcagtggttctatgacgg

SEQ ID NO: 69517 - DNA, 75 bp, Artificial Sequence
  Synthetic
atgaacaatcacatgcagttcaagagcaaacaccgtattgagcctgtatgtctcattatcagaggttccccaggt

SEQ ID NO: 69518 - DNA, 75 bp, Artificial Sequence
  Synthetic
tatcagacaaacttcgtcgtacctcccgacacgccgagccaagctcatataatagcgttgggagctgcccagaag

SEQ ID NO: 69519 - DNA, 75 bp, Artificial Sequence
  Synthetic
ccaccggatccagaccactttgatggttacaaacagcaagtggtcacagttatggatgatttatgtcagaatcct

SEQ ID NO: 69520 - DNA, 75 bp, Artificial Sequence
  Synthetic
gttacaaacagcaagtggtcacagttatggatgatttatgtcagaatcctgacggcaaggatatgtctcttttct

SEQ ID NO: 69521 - DNA, 75 bp, Artificial Sequence
  Synthetic
aatttgtcattgcatccaccaacgccagtaatatcattgtaccaacagtgtccgactcagatgccatacgtcgca

SEQ ID NO: 69522 - DNA, 75 bp, Artificial Sequence
  Synthetic
cagtaatatcattgtaccaacagtgtccgactcagatgccatacgtcgcaggttctatatggactgcgatatcga

SEQ ID NO: 69523 - DNA, 75 bp, Artificial Sequence
  Synthetic
tcggtgaataggttctatacattggacaccaaattgtgggagaaatcgtccaagggatggtattggaaattcccg

SEQ ID NO: 69524 - DNA, 75 bp, Artificial Sequence
  Synthetic
cacagcaaactttaaacgatgtagcccactagtatgtgggaaagctatccagttgagagacaggaagtccaaagt

SEQ ID NO: 69525 - DNA, 75 bp, Artificial Sequence
  Synthetic
ccactagtatgtgggaaagctatccagttgagagacaggaagtccaaagttaggtacagtgtggacacagtggtc

SEQ ID NO: 69526 - DNA, 75 bp, Artificial Sequence
  Synthetic
tatcagtctcacctcatgctcgcgcaaggacactcagaacctggcgattgtggtggcatcctcaggtgccagcac

SEQ ID NO: 69527 - DNA, 75 bp, Artificial Sequence
  Synthetic
aaatttaggcccattaggatcaaccttgaggagaagccagctcccgacgccattagcgatcttcttgccagtgtg

SEQ ID NO: 69528 - DNA, 75 bp, Artificial Sequence
  Synthetic
ttgaggagaagccagctcccgacgccattagcgatcttcttgccagtgtggacagcgaggaagtgcgtcagtact

SEQ ID NO: 69529 - DNA, 75 bp, Artificial Sequence
  Synthetic
gatgaggaggcgatggagcaaggtgtgtctgattacattaagggactcggtgatgcatttggaactggcttcacc

SEQ ID NO: 69530 - DNA, 75 bp, Artificial Sequence
  Synthetic
tcctaacaacatgatgggcacatttgcagtgcgatttgtcagcaagacccctgctactcgagacttgcgtgttag

SEQ ID NO: 69531 - DNA, 75 bp, Artificial Sequence
  Synthetic
ctcttaagaaccacctaattggttctgaaggggctgttgagaaaatcctcaagaatctgatcaagttaatctctg

SEQ ID NO: 69532 - DNA, 75 bp, Artificial Sequence
  Synthetic
tgcaatctattgccacagttgtggcagttgtctcattggtgtatgtcatctacaaactctttgctgggttccaag

SEQ ID NO: 69533 - DNA, 75 bp, Artificial Sequence
  Synthetic
agttgtctcattggtgtatgtcatctacaaactctttgctgggttccaaggtgcatactctggtgttcccaaaca

SEQ ID NO: 69534 - DNA, 75 bp, Artificial Sequence
  Synthetic
tgtttccccggactgagtatcaataggctgctcgcgcggctgaaggagaaaacgttcgttacccggccaactact

SEQ ID NO: 69535 - DNA, 75 bp, Artificial Sequence
  Synthetic
ctacccaaactatgacgggacaaaaataacaccaacatccaaggataggcaaagcattaaaacaactgggaaatt

SEQ ID NO: 69536 - DNA, 75 bp, Artificial Sequence
  Synthetic
gagaaatatcagacaagtccagacagaccaaggacacttcacaatgctgggtgtcagggaccgcctagctgtcct

SEQ ID NO: 69537 - DNA, 75 bp, Artificial Sequence
  Synthetic
gttagcactctggtactaaggtacctttgtgcgcctgttttaactcccttcccctgaagtaacttagaagcagta

SEQ ID NO: 69538 - DNA, 75 bp, Artificial Sequence
  Synthetic
cctggcttaagaagtttaacgatatggccaacgctgctaaggggttggagtggatttccaacaagatcagcaaat

SEQ ID NO: 69539 - DNA, 75 bp, Artificial Sequence
  Synthetic
gaccaaggacacttcacaatgctgggtgtcagggaccgcctagctgtcctaccacgacactcgcaacctggaaag

SEQ ID NO: 69540 - DNA, 75 bp, Artificial Sequence
  Synthetic
cgactgcccaaggatgtgacgtcattgctcgttgcaactgccaaactggagtgtactactgtagctcccgaagaa

SEQ ID NO: 69541 - DNA, 75 bp, Artificial Sequence
  Synthetic
tgccactgctagagaaccaaatctcaaacctagaacaatctgctgcctcacaagaagatcttgaggctatgtttg

SEQ ID NO: 69542 - DNA, 75 bp, Artificial Sequence
  Synthetic
gagctaaccttagtcacccttgataccaatgagaaattcagagacatcaccaaatttattccagaaagtatcagc

SEQ ID NO: 69543 - DNA, 75 bp, Artificial Sequence
  Synthetic
ccaatgagaaattcagagacatcaccaaatttattccagaaagtatcagcgccgctagcgatgccactctagtga

SEQ ID NO: 69544 - DNA, 75 bp, Artificial Sequence
  Synthetic
gctatagaggctaaaagagtctacgctttagagaagaggatgaataattacatgcagttcaagagcaaacaccgt

SEQ ID NO: 69545 - DNA, 75 bp, Artificial Sequence
  Synthetic
ggaagcctactcaccgcaccatgatgtataatttccctactaaagcaggacagtgtggaggagtggtgacatcag

SEQ ID NO: 69546 - DNA, 75 bp, Artificial Sequence
  Synthetic
catgcagttcaagagcaaacaccgtattgaacctgtatgcctcatcatcaggggatcgccgggcactggaaaatc

SEQ ID NO: 69547 - DNA, 75 bp, Artificial Sequence
  Synthetic
gtataatttccctactaaagcaggacagtgtggaggagtggtgacatcagttggaaaggttattggcatccacat

SEQ ID NO: 69548 - DNA, 75 bp, Artificial Sequence
  Synthetic
tcttgccagaccaccaattcccattcttaattcaccctacgatgcccatgagagagatccatgagtccattcgat

SEQ ID NO: 69549 - DNA, 75 bp, Artificial Sequence
  Synthetic
gtgggtaaaacctaatagagagactggaagactcaacatcaatgggccaactcgcaccaagctcgagcccagtgt

SEQ ID NO: 69550 - DNA, 75 bp, Artificial Sequence
  Synthetic
ggaagactcaacatcaatgggccaactcgcaccaagctcgagcccagtgtgttccatgacgtctttgagggcaat

SEQ ID NO: 69551 - DNA, 75 bp, Artificial Sequence
  Synthetic
gagtcttaagcaggatccagacaagtttgcaaatcctgtcaaagatattttcactgaaatggcagcgccactaaa

SEQ ID NO: 69552 - DNA, 75 bp, Artificial Sequence
  Synthetic
tccactgtggatttcatccctccaatggcttccctcgaggagaaaggggtgtctttcacctctaaatttgtcatc

SEQ ID NO: 69553 - DNA, 75 bp, Artificial Sequence
  Synthetic
gtaggaaacatgctgcacgagcctgatgaatacattagggaggcagccctccactatgcaaatcagttgaagcag

SEQ ID NO: 69554 - DNA, 75 bp, Artificial Sequence
  Synthetic
tccttgggcgtggatcaaagcaaagacagcatccattttaggcatccctattgctcaaaaacagagcgcctcctg

SEQ ID NO: 69555 - DNA, 75 bp, Artificial Sequence
  Synthetic
ttgctcaaaaacagagcgcctcctggcttaagaagtttaacgatatggccaacgctgctaagggattggagtgga

SEQ ID NO: 69556 - DNA, 75 bp, Artificial Sequence
  Synthetic
catacaaaacagatttgggcagattggatgctggtcgggccgccaagctatgctctgagaacaacactgccaact

SEQ ID NO: 69557 - DNA, 75 bp, Artificial Sequence
  Synthetic
tgatagaaaaccaaattgctaacttagaacagtctgccgcttcacaagaagaccttgaagtcatgtttggtaatg

SEQ ID NO: 69558 - DNA, 75 bp, Artificial Sequence
  Synthetic
agacaacctcgaagctattgaccttcacactagcgcaggctacccctacagtgccttgggaataaagaagagaga

SEQ ID NO: 69559 - DNA, 75 bp, Artificial Sequence
  Synthetic
ttccacctatgtcaaagacgagcttcgctcgatagacaagatcaagaaagggaaatctcgtctgattgaggccag

SEQ ID NO: 69560 - DNA, 75 bp, Artificial Sequence
  Synthetic
ctaatatgggtaaatttgggcaacaatctggcgccatctacgttggtaattacagagtggtcaatagacacctgg

SEQ ID NO: 69561 - DNA, 75 bp, Artificial Sequence
  Synthetic
ggctggatcatcccagagactcccacaaatgttgaacgacacctcaacagagctgtgctgatcatgcagtccatc

SEQ ID NO: 69562 - DNA, 75 bp, Artificial Sequence
  Synthetic
caataatagtgccatacataaacgcactgccctttgattctgccttgaaccattgcaattttggcctattggttg

SEQ ID NO: 69563 - DNA, 75 bp, Artificial Sequence
  Synthetic
cactttgatggatataaacaacaggtggttaccgttatggatgacttatgccagaaccctgacggtaaggacatg

SEQ ID NO: 69564 - DNA, 75 bp, Artificial Sequence
  Synthetic
tccctatcaccatcacattggccccaatgtgttctgaatttgcaggtcttaggcaagcagtcacgcagggatttc

SEQ ID NO: 69565 - DNA, 75 bp, Artificial Sequence
  Synthetic
ggtgcccctaagcaggcactcaagaaacctgttctccgcacggcaacagtgcagggtccaagtctcgactttgcc

SEQ ID NO: 69566 - DNA, 75 bp, Artificial Sequence
  Synthetic
agggggtcaatttggagctgaccttagtcaccttagacaccaatgagaagttcagagatattaccaaattcatcc

SEQ ID NO: 69567 - DNA, 75 bp, Artificial Sequence
  Synthetic
gatcccaagcatatatcttaaagaactacccaaactatgacgggacaaaaataacaccaacgtccaaggataggc

SEQ ID NO: 69568 - DNA, 75 bp, Artificial Sequence
  Synthetic
cgtgtccactggtggtaatggacttgtcggatttgcagatgtcagagatcttttgtggctggatgaagaagctat

SEQ ID NO: 69569 - DNA, 75 bp, Artificial Sequence
  Synthetic
caccgcactatgatgtacaactttcccactaaggcaggtcagtgtgggggagtagtcacatcagttgggaaggtc

SEQ ID NO: 69570 - DNA, 75 bp, Artificial Sequence
  Synthetic
gggaccacccaagtttaggccaattaggatcagccttgaggagaagccagctccagatgctattagtgaccttct

SEQ ID NO: 69571 - DNA, 75 bp, Artificial Sequence
  Synthetic
caaggagagatccaatgggtaaagcccaacaaggagactgggagacttaacatcaatgggccaacccgtactaaa

SEQ ID NO: 69572 - DNA, 75 bp, Artificial Sequence
  Synthetic
ttaaaacagcctgtgggttgttcccacccacagggcccactggggcgctagcacactgattctgcgggatctttg

SEQ ID NO: 69573 - DNA, 75 bp, Artificial Sequence
  Synthetic
tttaatgatatggcgagtgctgccaagggtttagaatggatatccaacaaaattagtaagttcattgactggctc

SEQ ID NO: 69574 - DNA, 75 bp, Artificial Sequence
  Synthetic
ctcgaggtggattttgaacaggcgttgttctccaagtacgtggggaatacgttacatgagcctgatgagtacgtt

SEQ ID NO: 69575 - DNA, 75 bp, Artificial Sequence
  Synthetic
tgttctccaagtacgtggggaatacgttacatgagcctgatgagtacgttagagaagcagcttttcactatgcaa

SEQ ID NO: 69576 - DNA, 75 bp, Artificial Sequence
  Synthetic
actcagcgatccggctcccacgagaattccaactcagctacagaaggctccaccattaattacactaccatcaac

SEQ ID NO: 69577 - DNA, 75 bp, Artificial Sequence
  Synthetic
accatgttgggagtcagggatcgcttagctgtccttccgcgacactcacaacctggaaagacaatctgggtagag

SEQ ID NO: 69578 - DNA, 75 bp, Artificial Sequence
  Synthetic
aggccattgacctgcacactagcgctggctacccctatagtgccctggggataaagaaaagagatatactagacc

SEQ ID NO: 69579 - DNA, 75 bp, Artificial Sequence
  Synthetic
tggccctcatactgctctgatgatgatgctacagcggtggataaaccaacgcgcccagatgtttcagtgaatagg

SEQ ID NO: 69580 - DNA, 75 bp, Artificial Sequence
  Synthetic
ctcttgaaggcacaactaacccgaatggttatgctaactgggacatagacattacaggttatgcgcaaatgcgca

SEQ ID NO: 69581 - DNA, 75 bp, Artificial Sequence
  Synthetic
ttacagtgatcgtgtggctcagcttaccattgggaactccaccatcacgacacaggaagcagctaacatagtcat

SEQ ID NO: 69582 - DNA, 75 bp, Artificial Sequence
  Synthetic
cactcacaggacccacgcggtgctagcactctggttccacgggacctttgtgcgcctgttttatgtcccctcccc

SEQ ID NO: 69583 - DNA, 75 bp, Artificial Sequence
  Synthetic
gtcacatcagttgggaaggtcattggcattcacataggcggtaatggcaggcaaggtttctgtgcgggactcaag

SEQ ID NO: 69584 - DNA, 75 bp, Artificial Sequence
  Synthetic
gggaaaaatcatctaaggggtggtactggaagtttcctgatgtattgactgaaaccggagtctttggccagaatg

SEQ ID NO: 69585 - DNA, 75 bp, Artificial Sequence
  Synthetic
catgatgtcttcgagggaaataaggaaccagctgtcttgcacggcaaagatccccgactcgaggtagattttgag

SEQ ID NO: 69586 - DNA, 75 bp, Artificial Sequence
  Synthetic
actactcgggctatgatgctagccttagtccagtctggttcagagctcttgagttagtccttagagaaataggct

SEQ ID NO: 69587 - DNA, 75 bp, Artificial Sequence
  Synthetic
aaccagctgtcttgcacggcaaagatccccgactcgaggtagattttgagcaggccctgttctctaagtatgtgg

SEQ ID NO: 69588 - DNA, 75 bp, Artificial Sequence
  Synthetic
tgcttggtggaatgccctcagggtgctcaggaacatccattttcaattcaatgattaacaacatcatcattagag

SEQ ID NO: 69589 - DNA, 75 bp, Artificial Sequence
  Synthetic
cttgctcgtgtcatccaccaccgcccaaggttgtgacacgattgcccgttgcaattgccagacaggggtgtacta

SEQ ID NO: 69590 - DNA, 75 bp, Artificial Sequence
  Synthetic
ggcgaccgtgacagtggctgcgttggcggcctgcccatggggtaacccatgggacgctctaatacagacatggtg

SEQ ID NO: 69591 - DNA, 75 bp, Artificial Sequence
  Synthetic
ctagctaccctttcccgattgattgcctggagctggccaaaacaggtatggagtatggtctaactatgactcctg

SEQ ID NO: 69592 - DNA, 75 bp, Artificial Sequence
  Synthetic
aataggtccgccattggcaacacaatcgaggctcttttccaaggtccacccaagttcaggccaattaggattagc

SEQ ID NO: 69593 - DNA, 75 bp, Artificial Sequence
  Synthetic
cggggccatttacgtgggtaactttagagtggttaaccgccaccttgccactcaaaatgattgggcgaaccttgt

SEQ ID NO: 69594 - DNA, 75 bp, Artificial Sequence
  Synthetic
cgtgctggatactttgactattacactaccggcattataaccatatggtatcaaactaattatgtagtacctatt

SEQ ID NO: 69595 - DNA, 75 bp, Artificial Sequence
  Synthetic
aatggtaaacaagaatatgagaaatttgtgagtacaattagatctgtcccagtagggaaagcattggctattccg

SEQ ID NO: 69596 - DNA, 75 bp, Artificial Sequence
  Synthetic
atcttatagggtctgaaggagcagttgagaaaattttgaaaaatcttattaaactaatctctgcactggtgattg

SEQ ID NO: 69597 - DNA, 75 bp, Artificial Sequence
  Synthetic
gaccattcttgaggttaacaacgtacccaccaatgctaccagtttgatggaaaggctacgattcccggtgtctgc

SEQ ID NO: 69598 - DNA, 75 bp, Artificial Sequence
  Synthetic
ggctcgaattattctagaggttaaacacacctcaaccccaccagcattctggtcgtgtaaatagctggtgggggt

SEQ ID NO: 69599 - DNA, 75 bp, Artificial Sequence
  Synthetic
tggagaagatcctcaagaacttagtgaaactcatctctgctcttgttattgtcatcaggagtgactatgatatgg

SEQ ID NO: 69600 - DNA, 75 bp, Artificial Sequence
  Synthetic
gtctcattatcagaggttctccaggcactgggaaatccctggcgactggtattattgcccgagcaatagctgaca

SEQ ID NO: 69601 - DNA, 75 bp, Artificial Sequence
  Synthetic
ggctgtgctgcctgagtatgtactcggcactatcgcaggagggaccgggaacgagaattctcatcctccctacgc

SEQ ID NO: 69602 - DNA, 75 bp, Artificial Sequence
  Synthetic
acgagaattctcatcctccctacgccactacacagcctggtcaggttggtgcagttctgacgcacccttacgtac

SEQ ID NO: 69603 - DNA, 75 bp, Artificial Sequence
  Synthetic
agggcttggtgatgcttttggcatgggattcacagacgcagtatcaagagaggttgaagctctgaaaaaccactt

SEQ ID NO: 69604 - DNA, 75 bp, Artificial Sequence
  Synthetic
actcatcaaaacatttaagggaattgatttggatgaacttaacatggttgcttatggggacgatgttctggctag

SEQ ID NO: 69605 - DNA, 75 bp, Artificial Sequence
  Synthetic
aaagaggtttcctacctgatgagcaattcccattcttgatccaccctactatgccaatgaaggaaattcacgagt

SEQ ID NO: 69606 - DNA, 75 bp, Artificial Sequence
  Synthetic
ctgaaattggggcatcgtcaaatactagtgacgagagtatgattgaaacacgatgcgttcttaactcacacagca

SEQ ID NO: 69607 - DNA, 75 bp, Artificial Sequence
  Synthetic
ccagatgggaaagacatgtcactattttgtcagatggtttccacagtggattttataccgcctatggcgtctcta

SEQ ID NO: 69608 - DNA, 75 bp, Artificial Sequence
  Synthetic
atgaaaacctgagacgcaattggctcgaattattctagaggttaaacacacgactcaaccccaccagcaatctgg

SEQ ID NO: 69609 - DNA, 75 bp, Artificial Sequence
  Synthetic
cgaattattctagaggttaaacacacgactcaaccccaccagcaatctggtcgtgtaaatgactggtgggggtaa

SEQ ID NO: 69610 - DNA, 75 bp, Artificial Sequence
  Synthetic
acgatcaacagtaggtgtgacacaccagtcacatctcgatcaagcacttctgtttccccggactgagtatcaata

SEQ ID NO: 69611 - DNA, 75 bp, Artificial Sequence
  Synthetic
tgattcaccctaccatgccaatgaaggagattcatgagtccattcgatggactaaggatgcgcgcaacactcaag

SEQ ID NO: 69612 - DNA, 75 bp, Artificial Sequence
  Synthetic
caattgaaaagttgttaccatatagctattggattggccatccggtgacaaatagagctattgtatatctttttg

SEQ ID NO: 69613 - DNA, 75 bp, Artificial Sequence
  Synthetic
ccggcccctgaatgcggctaatcccaactgcggagcacacgctcacaagccagtgggtagtgtgtcgtaacgggc

SEQ ID NO: 69614 - DNA, 75 bp, Artificial Sequence
  Synthetic
tatcccaaattatgaaaatcttagacgcaattggctcgaattattttagaggttatacacacctcaaccccacca

SEQ ID NO: 69615 - DNA, 75 bp, Artificial Sequence
  Synthetic
actccccagacattcacaaccagggaaaaccatttggattgaacacaagctggtgaggatcgtggatgccgtgga

SEQ ID NO: 69616 - DNA, 75 bp, Artificial Sequence
  Synthetic
gggcattccgatggctcagaagcagagtgcctcttggttgaagaagttcaatgacgcggcgagtgccgctaaggg

SEQ ID NO: 69617 - DNA, 75 bp, Artificial Sequence
  Synthetic
actctcaacacaattaaacatgggctcacaggtatccacacaacgctccggctcgcatgaaaattctaactcagc

SEQ ID NO: 69618 - DNA, 75 bp, Artificial Sequence
  Synthetic
ggcaattcccaattacgaaaatctgagacgcaattggctcgaactattttagaggttgaacatatctcaacccca

SEQ ID NO: 69619 - DNA, 75 bp, Artificial Sequence
  Synthetic
caccctccttacaaacaaacacaaccaggtgccgacggttttgaattgcagcacccgtatgtgctcgatgccggg

SEQ ID NO: 69620 - DNA, 75 bp, Artificial Sequence
  Synthetic
gggtcacacgagactagcaacatcgccacagaaggttccactataaactttactaacattaactattacaaggac

SEQ ID NO: 69621 - DNA, 75 bp, Artificial Sequence
  Synthetic
tgcagtgaacaaggtgagatccagtggatgaagcccaacaaagaaactggtaggttgaacattaatgggcctact

SEQ ID NO: 69622 - DNA, 75 bp, Artificial Sequence
  Synthetic
cgataatagtaccatacataaacgcgctaccctttgattctgcattgaaccattgcaacttcggcctgctggttg

SEQ ID NO: 69623 - DNA, 75 bp, Artificial Sequence
  Synthetic
tgctgcctcgcaagaagatttagaagctatgtttggcaatgtgtcatatttagcccacttctgccgcaagttcca

SEQ ID NO: 69624 - DNA, 75 bp, Artificial Sequence
  Synthetic
gagctgaaacctggcacaaaccaatttttaaccactgacgatggtgtttcagcacccattctaccaaactttcac

SEQ ID NO: 69625 - DNA, 75 bp, Artificial Sequence
  Synthetic
gaactcacactagtaaccttggacaccaacgaaaagtttagagatgtcaccaagtttattccagagacgatcacc

SEQ ID NO: 69626 - DNA, 75 bp, Artificial Sequence
  Synthetic
tgcgggtactacacccaatggtcaggatcactggaagtcacttttatgttcactgggtccttcatggccaccggc

SEQ ID NO: 69627 - DNA, 75 bp, Artificial Sequence
  Synthetic
caacatggcgtcgtcggcatagtgtctactggtggtaatgggctcgttggctttgcagacgtcagagacctcttg

SEQ ID NO: 69628 - DNA, 75 bp, Artificial Sequence
  Synthetic
aatcgccaagtgctgaagcgtgcgggtatagcgatcgtgtggctcaactaactgttggcaactcaaccatcacca

SEQ ID NO: 69629 - DNA, 75 bp, Artificial Sequence
  Synthetic
actacaccacaggtctggttagcatatggtaccagacgaattatgtggttccaatcggggcacccaatacagctt

SEQ ID NO: 69630 - DNA, 75 bp, Artificial Sequence
  Synthetic
caattcttaaccaccgatgatggcgtctcagcacctattctaccaaacttccaccccaccccgtgtatccacata

SEQ ID NO: 69631 - DNA, 75 bp, Artificial Sequence
  Synthetic
tcaggccaattaggattagccttgaagaaaaaccagccccagacgctattagcgatctccttgctagtgtagata

SEQ ID NO: 69632 - DNA, 75 bp, Artificial Sequence
  Synthetic
atgattgagacgcgctgcgtccttaattcgcacagtacagctgagaccactctcgacagttttttcagcagagcg

SEQ ID NO: 69633 - DNA, 75 bp, Artificial Sequence
  Synthetic
cattcaccctacgatgccaatgaaggagattcacgagtccattcgttggaccaaagacgcacgaaacactcaaga

SEQ ID NO: 69634 - DNA, 75 bp, Artificial Sequence
  Synthetic
gctttgctgacgttagagacctcttgtggttagatgaagaagccatggaacagggtgtgtccgactatatcaagg

SEQ ID NO: 69635 - DNA, 75 bp, Artificial Sequence
  Synthetic
atgtgtttgaaggcagcaaagaaccagcagtcttaaccagtaaggatcccagactcgaggttgattttgagcaag

SEQ ID NO: 69636 - DNA, 75 bp, Artificial Sequence
  Synthetic
gaagaaattggctcgaattgttttaaatttacagtttgtaactgaaccccaccagaaatctggtcgtgttaatga

SEQ ID NO: 69637 - DNA, 75 bp, Artificial Sequence
  Synthetic
ctgccagatggtgtctaccgtggattttatcccaccaatggcttctcttgaagaaaagggggtttcttttacatc

SEQ ID NO: 69638 - DNA, 75 bp, Artificial Sequence
  Synthetic
gtcagtaaaccgcttctacaccttatcagcaaagatgtgggataaaaattcaaagggttggtattggaaattccc

SEQ ID NO: 69639 - DNA, 75 bp, Artificial Sequence
  Synthetic
gatgggcacattctcagtgcgaaccgtagggacctcaaaatccaagtacccattggtgatcaggatttatatgag

SEQ ID NO: 69640 - DNA, 75 bp, Artificial Sequence
  Synthetic
gtagggacctcaaaatccaagtacccattggtgatcaggatttatatgaggatgaagcatgtcagggcgtgggtg

SEQ ID NO: 69641 - DNA, 75 bp, Artificial Sequence
  Synthetic
ttctacgatgtgtttgagggcagcaaagaaccagcagtcttaaccagtaaggatcccagacttgaggttgatttt

SEQ ID NO: 69642 - DNA, 75 bp, Artificial Sequence
  Synthetic
ggtgctagtcgcacagcgatcaccactctcgggaagtttggacaacagtccggggctatctacgtgggtaacttt

SEQ ID NO: 69643 - DNA, 75 bp, Artificial Sequence
  Synthetic
ctctcgggaagtttggacaacagtccggggctatctacgtgggtaactttagagtggtaaaccgtcatcttgcca

SEQ ID NO: 69644 - DNA, 75 bp, Artificial Sequence
  Synthetic
ggagaaaacgttcgttacccgaccaactacttcgagaagcttagtaccaccatgaacgaggcagagtgtttcgct

SEQ ID NO: 69645 - DNA, 75 bp, Artificial Sequence
  Synthetic
gttgtgacacgatcgctcgttgcaattgtcagacaggggtgtactactgtaactcaatgagaaaacactatccgg

SEQ ID NO: 69646 - DNA, 75 bp, Artificial Sequence
  Synthetic
gtcatttacaagctctttgcagggtttcaaggcgcgtattctggagctcccaagcaagtgctcaagaaacccgtc

SEQ ID NO: 69647 - DNA, 75 bp, Artificial Sequence
  Synthetic
tgctcgcagtaggtcactcggaaccaggggattgcggtggcattcttagatgtcaacacggtgttgtggggttag

SEQ ID NO: 69648 - DNA, 75 bp, Artificial Sequence
  Synthetic
tagctagttatccattccctattgactgctcggagttagccaaaactggtaaagagtatggactgacaatgacac

SEQ ID NO: 69649 - DNA, 75 bp, Artificial Sequence
  Synthetic
agggcttggcgatgcttttggcatggggtttacagatgcagtatcaagagaggttgaggccttgaaaagtcactt

SEQ ID NO: 69650 - DNA, 75 bp, Artificial Sequence
  Synthetic
catcagtcggtaagattgttggtattcacattggcggcaacgggcgccaagggttttgtgctggtttgaagagga

SEQ ID NO: 69651 - DNA, 75 bp, Artificial Sequence
  Synthetic
caggagtgactatgacatggtcactttgactgcaacacttgccctgatcgggtgccacggcagtccttgggcctg

SEQ ID NO: 69652 - DNA, 75 bp, Artificial Sequence
  Synthetic
gctccggttcgcatgaaaactctaactcagctaccgagggttccactataaattacactaccattaattactata

SEQ ID NO: 69653 - DNA, 75 bp, Artificial Sequence
  Synthetic
aattaacagggcatccgaccgtgcaagtatatccaccaaggattatgaaggcggggtgccatcaaacccacaaag

SEQ ID NO: 69654 - DNA, 75 bp, Artificial Sequence
  Synthetic
gatcaagtcgaaaacagcatcgattttgggtataccaatggctcagaagcagagtgcctcttggctaaagaagtt

SEQ ID NO: 69655 - DNA, 75 bp, Artificial Sequence
  Synthetic
aagactcctatgccgccacagcaggtaaacagagccttaagcaggacccagacaagtttgcaaatcctgtcaaag

SEQ ID NO: 69656 - DNA, 75 bp, Artificial Sequence
  Synthetic
tttcaccaaggtgccctactggtagccgccctaccagaacacgtggtggctgggatgggaccaggggacaagcca

SEQ ID NO: 69657 - DNA, 75 bp, Artificial Sequence
  Synthetic
ggagaagatcattccggccgctaaagagaaagttgagtttctaaacaatttgaagcaacttcccttattggagaa

SEQ ID NO: 69658 - DNA, 75 bp, Artificial Sequence
  Synthetic
tgaagcaacttcccttattggagaaccaaatttctaatctcgagcagtcagcagcttcacaagaggatcttgaag

SEQ ID NO: 69659 - DNA, 75 bp, Artificial Sequence
  Synthetic
taaaacaagcctgtgggttgcaccccatcccagggccccctgggggcaagccctttggtaccttggtacctttgt

SEQ ID NO: 69660 - DNA, 75 bp, Artificial Sequence
  Synthetic
tgggaagtccttagcaacagggattattgctagagctatagcagataaatatcactccagtgtgtattctctacc

SEQ ID NO: 69661 - DNA, 75 bp, Artificial Sequence
  Synthetic
gccaggtggagaccatcctggaggttaacaatgtgcccacgaatgccactagcttaatggagagactgcgcttcc

SEQ ID NO: 69662 - DNA, 75 bp, Artificial Sequence
  Synthetic
agttattggtctgcccgcaccaatggattaatttgcggactaataactgtgccaccattataatgccatacacta

SEQ ID NO: 69663 - DNA, 75 bp, Artificial Sequence
  Synthetic
gctaggctgtgctctgagaacaacaccgcaaacttcaaacggtgcagtccactagtttgtgggaaagcaatccag

SEQ ID NO: 69664 - DNA, 75 bp, Artificial Sequence
  Synthetic
ccacccaagaggcagctaatatagtgttgagctatggagagtggccagaatactgtccttctacggacgctacag

SEQ ID NO: 69665 - DNA, 75 bp, Artificial Sequence
  Synthetic
caaccccagtgtagatcaggtcgatgagtcactgcattccccacaggcgactgtggcagtggctgcgttggcggc

SEQ ID NO: 69666 - DNA, 75 bp, Artificial Sequence
  Synthetic
ctgtggataagcctacccgccctgacgtgtcagtgaacaggttctacacactgtcaactaagagctggaagacgg

SEQ ID NO: 69667 - DNA, 75 bp, Artificial Sequence
  Synthetic
ttatggtgacaattgaggaattgttaccatatagctattggattggccatccggtgtgcaacagagctattatct

SEQ ID NO: 69668 - DNA, 75 bp, Artificial Sequence
  Synthetic
aggtcagctatcgggaatactatcgaagctcttttccaaggaccccctaaattcagaccgataaggattagtatg

SEQ ID NO: 69669 - DNA, 75 bp, Artificial Sequence
  Synthetic
aagctcttttccaaggaccccctaaattcagaccgataaggattagtatggaggagaagcctgcacctgatgcta

SEQ ID NO: 69670 - DNA, 75 bp, Artificial Sequence
  Synthetic
gtaacgtagccactggaggatctacaataaactttactaacatcaactattataaagattcttacgccgcgtcag

SEQ ID NO: 69671 - DNA, 75 bp, Artificial Sequence
  Synthetic
accatggcagtccaccttgttgggccagttgtgcgggtactacacccaatggtcagggtcactggaagtcacctt

SEQ ID NO: 69672 - DNA, 75 bp, Artificial Sequence
  Synthetic
accggcaagatgctcatagcatacacaccaccaggaggtcccttacccaaggaccgggcgaccgctatgttgggt

SEQ ID NO: 69673 - DNA, 75 bp, Artificial Sequence
  Synthetic
agcttgtggctatagtgatagggtcgcccagctcactgttgggaactcctccattactacccaagaggctgctaa

SEQ ID NO: 69674 - DNA, 75 bp, Artificial Sequence
  Synthetic
aactgtgcaaccattattatgccatatgttaacgcgcttccatttgactcagcgcttaaccactcaaattttgga

SEQ ID NO: 69675 - DNA, 75 bp, Artificial Sequence
  Synthetic
agagcgcacgctcgagatggtgtgtttgactactacactacaggtttggttagcatatggtaccagacgaattac

SEQ ID NO: 69676 - DNA, 75 bp, Artificial Sequence
  Synthetic
caactgccgtggataaaccaactcgcccggacgtgtctgtcaacaggttctacactttggactccaaaatgtggc

SEQ ID NO: 69677 - DNA, 75 bp, Artificial Sequence
  Synthetic
tacactttggactccaaaatgtggcaagaaaactcgactggttggtattggaaattccctgacgtgctgaacaag

SEQ ID NO: 69678 - DNA, 75 bp, Artificial Sequence
  Synthetic
catctgggttgagcacaagttagtaaagatcgtggatgctgtggagctattagatgaacagggagttaacctaga

SEQ ID NO: 69679 - DNA, 75 bp, Artificial Sequence
  Synthetic
agcacgtcagggcgtggatacctcgcccgatgcgtaaccagaactacctatttaaagccaacccaaattatgctg

SEQ ID NO: 69680 - DNA, 75 bp, Artificial Sequence
  Synthetic
tctataggggacagcgtgagtagagccctcacccgagctctaccggcacctacaggccaaaacacgcaggtaagc

SEQ ID NO: 69681 - DNA, 75 bp, Artificial Sequence
  Synthetic
tcccatcactattacggtcgctcctttgtgtgcggaattcgggggcttgaggcaggctgtattgcaaggaatccc

SEQ ID NO: 69682 - DNA, 75 bp, Artificial Sequence
  Synthetic
gtgacattgaggtgacagactcatacaaaacagacttgggcagattggatgccggtcgggccgccaagctatgct

SEQ ID NO: 69683 - DNA, 75 bp, Artificial Sequence
  Synthetic
ggtaaagtgattgggattcacattggtggtaacggtaggcaaggtttctgtgctgccctgaagagaggatacttt

SEQ ID NO: 69684 - DNA, 75 bp, Artificial Sequence
  Synthetic
cactgcaatcccaatcactatcactatagcccccctgaattcagagttcggaggactgcgacaagccgtcagtca

SEQ ID NO: 69685 - DNA, 75 bp, Artificial Sequence
  Synthetic
aggcatcccagctgagctcaggcccgggactaatcagttcctgaccacagatgatgacactgcagcgcccatcct

SEQ ID NO: 69686 - DNA, 75 bp, Artificial Sequence
  Synthetic
attatgccaaccaactcaaacagctagacatcaagaccaccaagatgagcatggaggatgcttgttacggtacag

SEQ ID NO: 69687 - DNA, 75 bp, Artificial Sequence
  Synthetic
gtctcactcattgaagggatcaatcatacacaccatgtatatcgcaacaaaacttattgcgtacttggtgggatg

SEQ ID NO: 69688 - DNA, 75 bp, Artificial Sequence
  Synthetic
ggagctcaagtgtctactcagaaaaccgggtctcacgagaaccaaaatgttgctgctaatggttccaccataaac

SEQ ID NO: 69689 - DNA, 75 bp, Artificial Sequence
  Synthetic
ccgggtctcacgagaaccaaaatgttgctgctaatggttccaccataaactataccaccatcaattattacaaag

SEQ ID NO: 69690 - DNA, 75 bp, Artificial Sequence
  Synthetic
gtgtctcagcaccaattctacctggtttccacccaaccccagagatgcacatcccaggtgaagtgaagaaccttt

SEQ ID NO: 69691 - DNA, 75 bp, Artificial Sequence
  Synthetic
cattgaaagaaactgcaccacccttgaagtctccatccgctgaggcatgtggttatagtgatagagtcgcgcaat

SEQ ID NO: 69692 - DNA, 75 bp, Artificial Sequence
  Synthetic
ccaactggtgccagtcgcacagcaatcaccaccctcgggaaatttggacaacagtccggggccatctacgtgggc

SEQ ID NO: 69693 - DNA, 75 bp, Artificial Sequence
  Synthetic
gaagtctccatccgctgaggcatgtggttatagtgatagagtcgcgcaattgactgtagggaattccacaatcac

SEQ ID NO: 69694 - DNA, 75 bp, Artificial Sequence
  Synthetic
cccagatgtgttctggagcaagttaccaattctactcccaggatcgctttttgcgttcgactactcagggtatga

SEQ ID NO: 69695 - DNA, 75 bp, Artificial Sequence
  Synthetic
cctggggaggtgaccaacctgcttgagttatgtcagatagaaaccatattagaagtgaacaacgttactaacgta

SEQ ID NO: 69696 - DNA, 75 bp, Artificial Sequence
  Synthetic
agaaacatcgaccaatgtggaacgtcacctcaacagagcagtgttggtgatgcagtccattgccaccgtggttgc

SEQ ID NO: 69697 - DNA, 75 bp, Artificial Sequence
  Synthetic
gatttactcgtatcatctaccactgcccaaggttgtgacacgattgctcgttgcaattgccagacaggagtgtat

SEQ ID NO: 69698 - DNA, 75 bp, Artificial Sequence
  Synthetic
agtggacaaacccactcgacctgatgtgtctgtcaataggttctacaccctaccagccaagttgtggaccaaaac

SEQ ID NO: 69699 - DNA, 75 bp, Artificial Sequence
  Synthetic
ggttgtgtctctcgtctatgtcatttataaattgtttgctggatttcaaggtgcctattctggtgcacctaagca

SEQ ID NO: 69700 - DNA, 75 bp, Artificial Sequence
  Synthetic
ggatgaacttcgctcaatagataaaatcaagaaagggaagtcccgtctgattgaagctagcagcttgaatgactc

SEQ ID NO: 69701 - DNA, 75 bp, Artificial Sequence
  Synthetic
ttctctcatagaggggatcaaccacacccaccatgtgtatcgcaataagacctactgtgttcttggagggatgcc

SEQ ID NO: 69702 - DNA, 75 bp, Artificial Sequence
  Synthetic
acccaccatgtgtatcgcaataagacctactgtgttcttggagggatgccctcaggttgttcaggtacttccatc

SEQ ID NO: 69703 - DNA, 75 bp, Artificial Sequence
  Synthetic
acacaacaggctgtgttgcaaggcgaccctgtggaggatataatccatgacgctctgggaaacacagcgcgcaga

SEQ ID NO: 69704 - DNA, 75 bp, Artificial Sequence
  Synthetic
tgttggatgcaatccagatgtgttttggagcaagttgccaatcttgctccctggttccctcttcgcttttgacta

SEQ ID NO: 69705 - DNA, 75 bp, Artificial Sequence
  Synthetic
gggttctgtatccatgtgcagtgcaatgctagcaaattccaccaaggtacactgttagttgcttgtctcccagag

SEQ ID NO: 69706 - DNA, 75 bp, Artificial Sequence
  Synthetic
gtgtctgtcaataggttctacaccctaccagccaagttgtggaccaaaacaggaaccggctccaagggatggtac

SEQ ID NO: 69707 - DNA, 75 bp, Artificial Sequence
  Synthetic
ctgaatatggtggcctacggggatgatgtgttagctagctacccttttcctattgactgtttggagttggcaaag

SEQ ID NO: 69708 - DNA, 75 bp, Artificial Sequence
  Synthetic
atgtgttagctagctacccttttcctattgactgtttggagttggcaaagacaggtaaggagtatggtttaacca

SEQ ID NO: 69709 - DNA, 75 bp, Artificial Sequence
  Synthetic
atgctagcaaattccaccaaggtacactgttagttgcttgtctcccagagtacgttaatgctcgcgcaagtacta

SEQ ID NO: 69710 - DNA, 75 bp, Artificial Sequence
  Synthetic
ccaacatcagcttacattattgcccttgctgctgctcagaagaactttacattgagattgcccaaagacactggc

SEQ ID NO: 69711 - DNA, 75 bp, Artificial Sequence
  Synthetic
tcccatatgtattggatgcaggaatacccattaaccagctattgattgcaccacaccaatggatcaatttgcgca

SEQ ID NO: 69712 - DNA, 75 bp, Artificial Sequence
  Synthetic
tttgtgagcacaattagatcagtcccagttggaaaagcgttggccattcctaactttgagaatttgagaagaaat

SEQ ID NO: 69713 - DNA, 75 bp, Artificial Sequence
  Synthetic
acccattaaccagctattgattgcaccacaccaatggatcaatttgcgcacgaataactgtgctaccatagtcat

SEQ ID NO: 69714 - DNA, 75 bp, Artificial Sequence
  Synthetic
tgcctgattaccaattcccatttttgattcatcccacgatgcctatgagagaaatccatgaatccatccgttgga

SEQ ID NO: 69715 - DNA, 75 bp, Artificial Sequence
  Synthetic
ccaaggacgcacgaaacacccaagatcatgtgcgttccctctgcttgctagcctggcataatgggaaggaagagt

SEQ ID NO: 69716 - DNA, 75 bp, Artificial Sequence
  Synthetic
tcctctcaattactctgatggagcaacaactgccatacccatcacagtcaccattgcccctctttgctcagagtt

SEQ ID NO: 69717 - DNA, 75 bp, Artificial Sequence
  Synthetic
acaactgccatacccatcacagtcaccattgcccctctttgctcagagtttggaggtcttaggcaggccatcaca

SEQ ID NO: 69718 - DNA, 75 bp, Artificial Sequence
  Synthetic
tttagagtggtaaaccggcatctcgccacccacactgactgggcaaatttagtatgggaaagtagctcacgagac

SEQ ID NO: 69719 - DNA, 75 bp, Artificial Sequence
  Synthetic
aacaagggtttcctacagagctcaagcctgggaccaatcaatttcttacaactgatgacgggacatccccgccaa

SEQ ID NO: 69720 - DNA, 75 bp, Artificial Sequence
  Synthetic
gctaaggggcttgagtggatctccaacaaaatcagcaaatttatcgattggctcaaggagaaaatcattccggct

SEQ ID NO: 69721 - DNA, 75 bp, Artificial Sequence
  Synthetic
aatttacagtttgtaactgaaccccaccagaaatctggtcgtgttaatgactggtgggggtaaatttgttataac

SEQ ID NO: 69722 - DNA, 75 bp, Artificial Sequence
  Synthetic
ttacctggttttcaccccactccagcaattcacatccctggagaagtgcacaacctgttagagattgcacaagtt

SEQ ID NO: 69723 - DNA, 75 bp, Artificial Sequence
  Synthetic
caattcacatccctggagaagtgcacaacctgttagagattgcacaagttgaaagtatacttgaggtcaacaacc

SEQ ID NO: 69724 - DNA, 75 bp, Artificial Sequence
  Synthetic
tagatcaggtcgatgagtcaccgcattccccacgggcgaccgtggcggtggctgcgttggcggcctgcccatggg

SEQ ID NO: 69725 - DNA, 75 bp, Artificial Sequence
  Synthetic
aatcaactaccgttgggcagatatgccgttactatacccagtggtctgggtctctggaagtcacattcatgttca

SEQ ID NO: 69726 - DNA, 75 bp, Artificial Sequence
  Synthetic
ctttatgtgctagctttaaggttgacccaggtagagatggtccatggcaatccacgctggtcggacaaatttgca

SEQ ID NO: 69727 - DNA, 75 bp, Artificial Sequence
  Synthetic
cccaggtagagatggtccatggcaatccacgctggtcggacaaatttgcaaatactacacacaatggtctgggtc

SEQ ID NO: 69728 - DNA, 75 bp, Artificial Sequence
  Synthetic
gagaatgaataattacatgcagttcaagagcaaacaccgtattgaacctgtatgcctaatcatcaggggttcgcc

SEQ ID NO: 69729 - DNA, 75 bp, Artificial Sequence
  Synthetic
aggtgcgcagcctaccacgagagaccttgccatgttgggcacacacgtgatctgggactttggtctacaatcatc

SEQ ID NO: 69730 - DNA, 75 bp, Artificial Sequence
  Synthetic
cttgccatgttgggcacacacgtgatctgggactttggtctacaatcatcagtcactttagtaataccttggatc

SEQ ID NO: 69731 - DNA, 75 bp, Artificial Sequence
  Synthetic
gttaccatatagctattggattggccatccggtgtgcaacagagcaattgtttacctatttattggttttgtacc

SEQ ID NO: 69732 - DNA, 75 bp, Artificial Sequence
  Synthetic
gcgggttcttggttcagagaaacttaccgaggctctcagagtgcgcatctatatgcgcatcaagcacgtcagagc

SEQ ID NO: 69733 - DNA, 75 bp, Artificial Sequence
  Synthetic
ccccatccgctgaggcatgtggatacagtgatcgagtggcgcaattaactattggcaactccaccatcactacgc

SEQ ID NO: 69734 - DNA, 75 bp, Artificial Sequence
  Synthetic
attggcaactccaccatcactacgcaagaagcggctaacatcatagtcggttatggtgagtggccttcctactgc

SEQ ID NO: 69735 - DNA, 75 bp, Artificial Sequence
  Synthetic
tatcagacaaactttgtggtgccatcaggagctcctaccagtgcatacattattgctctgggcgcagcccagaag

SEQ ID NO: 69736 - DNA, 75 bp, Artificial Sequence
  Synthetic
caggagctcctaccagtgcatacattattgctctgggcgcagcccagaagaatttcactctcaggttatgtaaag

SEQ ID NO: 69737 - DNA, 75 bp, Artificial Sequence
  Synthetic
acggtcttgtcggttttgctaacgtgagggacctcttatggttggatgaagaagccatggaacagggagtgtctg

SEQ ID NO: 69738 - DNA, 75 bp, Artificial Sequence
  Synthetic
acacactgtcgcagaccatagggaggcctcaaacccagacaactgctgagaacaccagacctagcacgcatcaga

SEQ ID NO: 69739 - DNA, 75 bp, Artificial Sequence
  Synthetic
gcctcaaacccagacaactgctgagaacaccagacctagcacgcatcagattggcacaggggaagttccagctct

SEQ ID NO: 69740 - DNA, 75 bp, Artificial Sequence
  Synthetic
gttctcccggagtacgttattggaacagtggcgggtggtacagggacggaagatagtcaccccccgtacaagcag

SEQ ID NO: 69741 - DNA, 75 bp, Artificial Sequence
  Synthetic
gcatagcactgaagagacttgcattgagcactttttctccagagcaggccttgtgagcatgatctcccttctcgt

SEQ ID NO: 69742 - DNA, 75 bp, Artificial Sequence
  Synthetic
gagcactttttctccagagcaggccttgtgagcatgatctcccttctcgtgtccgaagagacgactcaggcttat

SEQ ID NO: 69743 - DNA, 75 bp, Artificial Sequence
  Synthetic
tcttgaaggcacaactaacccaaatggttatgccaactgggacatagatataacaggttacgcgcaaatgcgtag

SEQ ID NO: 69744 - DNA, 75 bp, Artificial Sequence
  Synthetic
ggcgtccatcttaggtattcctatggcacagaagcagagtgcatcttggcttaagaagttcaacgatatggcgaa

SEQ ID NO: 69745 - DNA, 75 bp, Artificial Sequence
  Synthetic
gcttggttggttttgcagacattagagacctgttttggctcgacgatgaagcgatggaacagggggtcacagatt

SEQ ID NO: 69746 - DNA, 75 bp, Artificial Sequence
  Synthetic
tatttgggattttggtctacagtcttctgtcacactggttattccatggattagcaacacccactatagaactgt

SEQ ID NO: 69747 - DNA, 75 bp, Artificial Sequence
  Synthetic
aatgctgaattcacatttgttgccacaggactcaatggtacagccccccagacaatgctgcagtacatgtatgtt

SEQ ID NO: 69748 - DNA, 75 bp, Artificial Sequence
  Synthetic
caggactcaatggtacagccccccagacaatgctgcagtacatgtatgttccacccggtgcacctgtaccgacgg

SEQ ID NO: 69749 - DNA, 75 bp, Artificial Sequence
  Synthetic
tgtcatacctagctcacttttgtcgcaagttccagccactctatgcaactgaagcgaagagagtgtacgccttag

SEQ ID NO: 69750 - DNA, 75 bp, Artificial Sequence
  Synthetic
agtagagaagatccttaaagcattaatcaaagtagtttcagcattagtgatagttgttaggagtgactatgacct

SEQ ID NO: 69751 - DNA, 75 bp, Artificial Sequence
  Synthetic
ttatcccaccaatggcttctttagaagagaaaggagtttcattcacatctaaatttgttattgcatccaccaatg

SEQ ID NO: 69752 - DNA, 75 bp, Artificial Sequence
  Synthetic
tgtctgtcccatttatgtcaccagcaagtgcttatcagtggttctatgacgggtaccccacattcggttcacacc

SEQ ID NO: 69753 - DNA, 75 bp, Artificial Sequence
  Synthetic
ccggctcccatgagaattccaattcagctacagaaggctccaccattaattacactactatcaactattacaagg

SEQ ID NO: 69754 - DNA, 75 bp, Artificial Sequence
  Synthetic
aagtgcttatcagtggttctatgacgggtaccccacattcggttcacaccctgtgtcagaagatctcagatacgg

SEQ ID NO: 69755 - DNA, 75 bp, Artificial Sequence
  Synthetic
actcccttccaccagacccagatcactttgatggatacaagcaacaggtggtgacagtcatggatgatttgtgtc

SEQ ID NO: 69756 - DNA, 75 bp, Artificial Sequence
  Synthetic
cgccagaggtcttgagtggattgcaaataaaattagcaagtttatagactgggtgaaagagaagattgtcccagc

SEQ ID NO: 69757 - DNA, 75 bp, Artificial Sequence
  Synthetic
aattagaattttcatgcgcattaagcacgtgcgcgcctgggtcccgaggcccattcgatcccagaagtacatagt

SEQ ID NO: 69758 - DNA, 75 bp, Artificial Sequence
  Synthetic
aaaacccagacggcaaagatatgtcattgttttgtcaaatggtatccactgtcgattttatacccccaatggctt

SEQ ID NO: 69759 - DNA, 75 bp, Artificial Sequence
  Synthetic
cacgtgcgcgcctgggtcccgaggcccattcgatcccagaagtacatagtgaaaaattaccccaactttgatcca

SEQ ID NO: 69760 - DNA, 75 bp, Artificial Sequence
  Synthetic
tgatgatggcgtttcagcacccattctaccaaacttccaccccaccccgtgtatccatatacctggtgaagttag

SEQ ID NO: 69761 - DNA, 75 bp, Artificial Sequence
  Synthetic
actaatgctagcaacatcattgtccccacggtctcagactctgacgctattcgtaggagatttttcatggattgt

SEQ ID NO: 69762 - DNA, 75 bp, Artificial Sequence
  Synthetic
atttatgtcggaaattacagaattgtcaacaggcacctggcaacaagaaaagactgggagaacttagtgtgggaa

SEQ ID NO: 69763 - DNA, 75 bp, Artificial Sequence
  Synthetic
tcaacaggcacctggcaacaagaaaagactgggagaacttagtgtgggaatcttatgaaagagatctacttgtct

SEQ ID NO: 69764 - DNA, 75 bp, Artificial Sequence
  Synthetic
tcgcacagcacagctgagaccactcttgatagtttcttcagcagagcgggattagttggagagatagatctccct

SEQ ID NO: 69765 - DNA, 75 bp, Artificial Sequence
  Synthetic
tgaacagacactaccctgtcaccttcggtgaaccagctttcttccatgtagatgctaatgagtactacccagaaa

SEQ ID NO: 69766 - DNA, 75 bp, Artificial Sequence
  Synthetic
cggtgaaccagctttcttccatgtagatgctaatgagtactacccagaaaggtatcaatcacatgtaatctcatc

SEQ ID NO: 69767 - DNA, 75 bp, Artificial Sequence
  Synthetic
atcatcgccatgggtgcagcacagaagaacttcacactaaaattgtgccgtgacacagagtccatatcacagaca

SEQ ID NO: 69768 - DNA, 75 bp, Artificial Sequence
  Synthetic
agatctcaaacttggaacaatctgctgcctcacaagaagaccttgaggtcatgtttgggaatgtgtcgtatctag

SEQ ID NO: 69769 - DNA, 75 bp, Artificial Sequence
  Synthetic
tggcggccctaacctggttggcttcgcagatatcagagacttactgtggctagatgatgaggttatggagcaagg

SEQ ID NO: 69770 - DNA, 75 bp, Artificial Sequence
  Synthetic
gaaggaacatcagacaagttcaaacggaccaagggcacttcaccatgctaggagtcagagatcgcttggccgtcc

SEQ ID NO: 69771 - DNA, 75 bp, Artificial Sequence
  Synthetic
ttcaaaatttgtgattgcctccaccaattcgtccaacatcatagtcccaactgtctcagatagtgatgccattag

SEQ ID NO: 69772 - DNA, 75 bp, Artificial Sequence
  Synthetic
gcagttagatatcaagaccaccaagatgagcatggaggatgcttgttacggtacagagaacctggaagctataga

SEQ ID NO: 69773 - DNA, 75 bp, Artificial Sequence
  Synthetic
aaggctacgattcccggtgtccgcgcaagcggggaaaggtgaattgtgtgccgtgtttagggccgaccctggaag

SEQ ID NO: 69774 - DNA, 75 bp, Artificial Sequence
  Synthetic
tgtcatcgcatccactaatgccagtaatatcatagtaccaacagtgtctgattctgacgccattcgccgcaggtt

SEQ ID NO: 69775 - DNA, 75 bp, Artificial Sequence
  Synthetic
tcaacttaaaaattacctattaggctcagagaatgtagtggagaaaattttgaaagctttaatcaaagttgtctc

SEQ ID NO: 69776 - DNA, 75 bp, Artificial Sequence
  Synthetic
acccaaagatcgggccacagcaatgctgggcacacatgttatctgggattttgggctacaatcatctgtcaccct

SEQ ID NO: 69777 - DNA, 75 bp, Artificial Sequence
  Synthetic
caccccaatttaaaccagttaggataacccttgacaaaccagcgccagatgcaattagtgatcttctggcaagtg

SEQ ID NO: 69778 - DNA, 75 bp, Artificial Sequence
  Synthetic
aacccttgacaaaccagcgccagatgcaattagtgatcttctggcaagtgtggatagtgaagaggtcagacaata

SEQ ID NO: 69779 - DNA, 75 bp, Artificial Sequence
  Synthetic
atcattccagccgccaaggaaaaggtggaatttttaaacaatttaaagcaactcacactccttgagaaccagatc

SEQ ID NO: 69780 - DNA, 75 bp, Artificial Sequence
  Synthetic
tctaacattgaacagtctgctgcaagccagagtgatttggaacagctatttggaaatgtctcatatctagctcat

SEQ ID NO: 69781 - DNA, 75 bp, Artificial Sequence
  Synthetic
ccatcaatgtttgtcccggtaggagatgttgttcaatacgggttcctaaatcttagtggtaagccaacccacagg

SEQ ID NO: 69782 - DNA, 75 bp, Artificial Sequence
  Synthetic
tggttcagggcgctggagatagtcctgcgggaaattggatactctgaggacgcagtgtctctcatagaagggatc

SEQ ID NO: 69783 - DNA, 75 bp, Artificial Sequence
  Synthetic
cttaatagagcggtgcttgtcatgcaatccatcgccacagtagtggcggttgtctcgttggtgtacgtcatctac

SEQ ID NO: 69784 - DNA, 75 bp, Artificial Sequence
  Synthetic
tacatgcagttcaagagcaaacaccgtattgaacctgtatgcttaattgttagaggtgctcctggaactgggaag

SEQ ID NO: 69785 - DNA, 75 bp, Artificial Sequence
  Synthetic
aggagaccggcagattaaatatcaatggcccaacacgcaccaagttagagcccagtgtgttccatgatgtgtttg

SEQ ID NO: 69786 - DNA, 75 bp, Artificial Sequence
  Synthetic
tagaggtgctcctggaactgggaagtcactagcaactggtattatctctcgagccattgctgaaaaataccactc

SEQ ID NO: 69787 - DNA, 75 bp, Artificial Sequence
  Synthetic
acactagagttagtacacacaggttaggcacgggggaggtgccagctttacaagcagcagagacaggtgccacct

SEQ ID NO: 69788 - DNA, 75 bp, Artificial Sequence
  Synthetic
aagagggacatactagatcctaccactagggacacaacaaaaatgaagttctacatggataagtatggcttggac

SEQ ID NO: 69789 - DNA, 75 bp, Artificial Sequence
  Synthetic
tccattaagccaactggtaccagtcgcacagcgatcaccactcttgggaaatttgggcaacagtctggggccatt

SEQ ID NO: 69790 - DNA, 75 bp, Artificial Sequence
  Synthetic
ttaccttactccacctacgttaaagatgaacttaggtctctggataagatcaagaaagggaagtcccgcttgata

SEQ ID NO: 69791 - DNA, 75 bp, Artificial Sequence
  Synthetic
tcaaagaaccagcagtccttcattccaaggataagaggcttgaggtcgactttgaaactgctctcttctccaagt

SEQ ID NO: 69792 - DNA, 75 bp, Artificial Sequence
  Synthetic
caaggataagaggcttgaggtcgactttgaaactgctctcttctccaagtatacaggaaacaaaattcatgaacc

SEQ ID NO: 69793 - DNA, 75 bp, Artificial Sequence
  Synthetic
agggatggattgtacccgttcaaccaaccaatgtggaaaagcaccttggaagagctgtactaataatgcagtcta

SEQ ID NO: 69794 - DNA, 75 bp, Artificial Sequence
  Synthetic
aaccaatgtggaaaagcaccttggaagagctgtactaataatgcagtctattgccacagttgttgcagttgtaag

SEQ ID NO: 69795 - DNA, 75 bp, Artificial Sequence
  Synthetic
gaaaccagtccttagaacagctacagtgcagggaccgagtctagacttcgctctctccctgctcagaagaaacat

SEQ ID NO: 69796 - DNA, 75 bp, Artificial Sequence
  Synthetic
caatgcactgggcatcaagaagagagacattctgaacccccaaaccagagacgtgactaaaatgaaaatgtactt

SEQ ID NO: 69797 - DNA, 75 bp, Artificial Sequence
  Synthetic
acccactcacagggcctactgggcgcaagcactctggtatctcggtacctttgtgcgcctgttttataccccccc

SEQ ID NO: 69798 - DNA, 75 bp, Artificial Sequence
  Synthetic
ggcaggaatagtcatcgtggaggatgcaactgccactaataagggttatgccacatgggagattgatgtcatggg

SEQ ID NO: 69799 - DNA, 75 bp, Artificial Sequence
  Synthetic
gtgcagggaccgagtctagacttcgctctctccctgctcagaagaaacatcagacaagtgcagacagaccagggt

SEQ ID NO: 69800 - DNA, 75 bp, Artificial Sequence
  Synthetic
atcgagcataaattagtcaatgttttagatgcagtagagctagtagatgagcaacaggtcaatttggaactcact

SEQ ID NO: 69801 - DNA, 75 bp, Artificial Sequence
  Synthetic
tagatgcagtagagctagtagatgagcaacaggtcaatttggaactcactttagtgaccctagatactaatgaga

SEQ ID NO: 69802 - DNA, 75 bp, Artificial Sequence
  Synthetic
cgcaaatgcgagttgttcacatatatgcgctttgatgctgaattcacatttgtcgtagccaaacccaatggcgag

SEQ ID NO: 69803 - DNA, 75 bp, Artificial Sequence
  Synthetic
acatcagcgctgctagtgacgccaccctagtgattaatacagaacacatgccctcaatgtttgtacctgtgggtg

SEQ ID NO: 69804 - DNA, 75 bp, Artificial Sequence
  Synthetic
aaaccatgccatcgatgtttgtcccagttggggacgtcaccgaatatggcttccttaaccttagtggcagaccaa

SEQ ID NO: 69805 - DNA, 75 bp, Artificial Sequence
  Synthetic
ccctcaatgtttgtacctgtgggtgatgtcgtacaatacggtttcctgaatctcagtggaaaacccacccaccgc

SEQ ID NO: 69806 - DNA, 75 bp, Artificial Sequence
  Synthetic
agttggggacgtcaccgaatatggcttccttaaccttagtggcagaccaactcatcggaccatgatgtacaattt

SEQ ID NO: 69807 - DNA, 75 bp, Artificial Sequence
  Synthetic
caaacatactgcgtaatgggcgggatgccatctggatgctcaggtaccagcatcttcaattctatgattaacaac

SEQ ID NO: 69808 - DNA, 75 bp, Artificial Sequence
  Synthetic
tggtaggcagggattctgtgccgcccttaagcggggttactttacaactgagcagggtgaaatccagtggatgag

SEQ ID NO: 69809 - DNA, 75 bp, Artificial Sequence
  Synthetic
aaccagctgtcttgcacagtaaagacccccgactcgaggtagattttgaacaggccctgttctctaagtatgtgg

SEQ ID NO: 69810 - DNA, 75 bp, Artificial Sequence
  Synthetic
tgtgttcaagggagtcaaagaaccggcagtcctccattctaaagataagaggcttgaagttgactttgaaaccgc

SEQ ID NO: 69811 - DNA, 75 bp, Artificial Sequence
  Synthetic
agaccaactcaagcaattagacattgatacatcaaaaatgagcatggaggatgcttgttatggaacagagtttct

SEQ ID NO: 69812 - DNA, 75 bp, Artificial Sequence
  Synthetic
gtcatgatgcagtacatgttcgtgccccctggcgcccctgttccaacagggagagataccttccaatggcaatct

SEQ ID NO: 69813 - DNA, 75 bp, Artificial Sequence
  Synthetic
tcctcaaactagggatgtgaccaaaatgaaaatgtacttggacaagtacggtattgacctcccttattctactta

SEQ ID NO: 69814 - DNA, 75 bp, Artificial Sequence
  Synthetic
ctggtgactgtggtggcatcctcaggtgccaacacggtgtggtaggaattgtctccactggtggaaatggtcttg

SEQ ID NO: 69815 - DNA, 75 bp, Artificial Sequence
  Synthetic
cacaccatgtgtatcgtaataagacctattgtgtgcttggtgggatgccctcaggttgttcgggaacatccattt

SEQ ID NO: 69816 - DNA, 75 bp, Artificial Sequence
  Synthetic
ttctattacggcgaatacgggcaagtttgggcaacagtccggtgccatatatgtgggaaattacagagtggtgaa

SEQ ID NO: 69817 - DNA, 75 bp, Artificial Sequence
  Synthetic
tgattcagtttacctcagaatgtgttttggccacttgtatgagaaatttcatgccaacccagggacaatcaccgg

SEQ ID NO: 69818 - DNA, 75 bp, Artificial Sequence
  Synthetic
cccggatgtgttaactgaaaccggggtttttgggcaaaatgcacaattccactacctctaccgatcagggttctg

SEQ ID NO: 69819 - DNA, 75 bp, Artificial Sequence
  Synthetic
gtgcgccagtactgcagggatcaaggctggatcattcctgaaactcccaccaacgtagagcggcaccttaataga

SEQ ID NO: 69820 - DNA, 75 bp, Artificial Sequence
  Synthetic
atatttacagaaatcaaacgtactgtgtaatgggtgggatgccatctgggtgctccggtactagtatctttaatt

SEQ ID NO: 69821 - DNA, 75 bp, Artificial Sequence
  Synthetic
cactgcagcgcccatcctcccaggattcacccccacgcccacaattcatataccaggggaagtgcactccttgct

SEQ ID NO: 69822 - DNA, 75 bp, Artificial Sequence
  Synthetic
tgattgcatatggagatgatgttcttgctagctaccccttccccatcgactgtgctgaacttgcaaaaacaggac

SEQ ID NO: 69823 - DNA, 75 bp, Artificial Sequence
  Synthetic
tgctagctaccccttccccatcgactgtgctgaacttgcaaaaacaggactggaatatggtctagttatgacacc

SEQ ID NO: 69824 - DNA, 75 bp, Artificial Sequence
  Synthetic
gagcacaaactcgtgaacgtccttgatgcagttgaattggtagatgagcaaggagtcaacctggaattaaccctc

SEQ ID NO: 69825 - DNA, 75 bp, Artificial Sequence
  Synthetic
gatatcctacctttggagaaagaccagttacaaccaacatgaattatggacagtgtcccaacaacaaaatgggaa

SEQ ID NO: 69826 - DNA, 75 bp, Artificial Sequence
  Synthetic
acaatggtagggagacctatgaggaatttgttgataaaatcagaactataccaattggcaaagtcttagctcttc

SEQ ID NO: 69827 - DNA, 75 bp, Artificial Sequence
  Synthetic
atgccaggtggagaccattttagaggtcaacaatgtacccacgaatgccactagcttaatggagagactgcgctt

SEQ ID NO: 69828 - DNA, 75 bp, Artificial Sequence
  Synthetic
ccttactgagaaggaacatcaggcaagtccaaacagatcaagggcattttaccatgttaggtgtcagagatcgct

SEQ ID NO: 69829 - DNA, 75 bp, Artificial Sequence
  Synthetic
ttaattggcaacatctttggtgcaccctgggcttgacaaagtcaccaaagatcaattaccctaacccagtggggt

SEQ ID NO: 69830 - DNA, 75 bp, Artificial Sequence
  Synthetic
ggttttgcatccatgtgcaatgcaacgctagcaagttccaccaaggagcgctgttagtcgccatacttccagagt

SEQ ID NO: 69831 - DNA, 75 bp, Artificial Sequence
  Synthetic
agccaacaccactcccagttcacaccgattagagactggacgcgtgccagcgctacaggctgcagagacgggtgc

SEQ ID NO: 69832 - DNA, 75 bp, Artificial Sequence
  Synthetic
tgccatcaatgtttgtcccagtgggggacgtcgtgcagtacgggttcttgaaccttagtggaaagccaactcata

SEQ ID NO: 69833 - DNA, 75 bp, Artificial Sequence
  Synthetic
acagaaatggggtgttggaaaccactatcaaccacttcttctcccgctctggattagtgggagtagttaacctca

SEQ ID NO: 69834 - DNA, 75 bp, Artificial Sequence
  Synthetic
ttaaaacagcctgtgggttgcacccactcacgggcccactgggcgcaagcactctggtacctcggtacctttgtg

SEQ ID NO: 69835 - DNA, 75 bp, Artificial Sequence
  Synthetic
taactgtgccacaataatagtgccatatatgaatacactgccttttgactccgccctgaaccattgcaattttgg

SEQ ID NO: 69836 - DNA, 75 bp, Artificial Sequence
  Synthetic
aaactgtgctctgaaaacaacactgcaaatttcaaacgctgcagcccattagtgtgtgggaaagctatccaactt

SEQ ID NO: 69837 - DNA, 75 bp, Artificial Sequence
  Synthetic
ccaagggttctgtgctggtttgaagaggagttacttcgcaagtgtgcagggtgagatccaatgggtgaagcctaa

SEQ ID NO: 69838 - DNA, 75 bp, Artificial Sequence
  Synthetic
atgggctttgtccaactccgcagaaaatgcgagatgttcacatacatgaggttcaatgcagaattcacatttgtc

SEQ ID NO: 69839 - DNA, 75 bp, Artificial Sequence
  Synthetic
aactcacactagtaactttagacaccaacgaaaagtttagggacgtcaccaagtttattccagagacaatcaccg

SEQ ID NO: 69840 - DNA, 75 bp, Artificial Sequence
  Synthetic
ctgcagggatcaaggctggattattcctgaagctcccaccaatgtagagcggcaccttaatagagcggtgcttgt

SEQ ID NO: 69841 - DNA, 75 bp, Artificial Sequence
  Synthetic
cagctagtgcatatcagtggttttatgatggttaccccactttcggccagcacccggagacctcaaacacaacat

SEQ ID NO: 69842 - DNA, 75 bp, Artificial Sequence
  Synthetic
ggtcatttgtatgagactttccacgcaaatcctgggacgataactggatcagccgtggggtgtaaccctgacaca

SEQ ID NO: 69843 - DNA, 75 bp, Artificial Sequence
  Synthetic
ctgctcgagttgtgtcaagtggagactattcttgaggttaacaacgtacccaccaatgctactagtttgatggaa

SEQ ID NO: 69844 - DNA, 75 bp, Artificial Sequence
  Synthetic
aattagaagccagctatatctgcttaaaaattaccccaactttgataacactaagatcctcaacgcctcccacaa

SEQ ID NO: 69845 - DNA, 75 bp, Artificial Sequence
  Synthetic
caagtgcaaacagatcaaggacatttcaccatgctgggtgtcagggaccgtttggctgttctcccacgccactcc

SEQ ID NO: 69846 - DNA, 75 bp, Artificial Sequence
  Synthetic
tcaccatgctgggtgtcagggaccgtttggctgttctcccacgccactcccaacccggtaaaacaatctgggtag

SEQ ID NO: 69847 - DNA, 75 bp, Artificial Sequence
  Synthetic
tcaatggtcaggatcactggaagttacgttcatgttcactgggtcctttatggccactggcaagatgcttatagc

SEQ ID NO: 69848 - DNA, 75 bp, Artificial Sequence
  Synthetic
ggtggcagaggatctaacacaaaaccaaatgaagcgccccacccagggtttaccacaactttccctggtaccacc

SEQ ID NO: 69849 - DNA, 75 bp, Artificial Sequence
  Synthetic
gaaatctggtcgtgaatgtgactggtgggggtaaatttgttataccaaaaaaaaaaaaaaaagtaaaccaggaac

SEQ ID NO: 69850 - DNA, 75 bp, Artificial Sequence
  Synthetic
ggtaaaatgcttatagcttatacaccccctgggggccccctacccaaggatcgggccacagcgatgctgggcaca

SEQ ID NO: 69851 - DNA, 75 bp, Artificial Sequence
  Synthetic
atgtggatacagcgatcgagtagcgcagttaactatcggcaactccaccatcactacgcaagaagcagcaaacat

SEQ ID NO: 69852 - DNA, 75 bp, Artificial Sequence
  Synthetic
ttaaaacagcctgtgggttgttcccacccacagggcccactgggcgctagtactctggtattacggtacctttgt

SEQ ID NO: 69853 - DNA, 75 bp, Artificial Sequence
  Synthetic
tactctggtattacggtacctttgtacgcctgttttacaacccttcccccatgtaacttagaagcaacaaataaa

SEQ ID NO: 69854 - DNA, 75 bp, Artificial Sequence
  Synthetic
cgaacccagtgtatttcatgatgtttttgagggaaacaaggagccagcagttctacatagtaaagatccccgtct

SEQ ID NO: 69855 - DNA, 75 bp, Artificial Sequence
  Synthetic
acccacagggcccaatgggcgccagcactctggtattacggtacctttgtgcgcctgttttatatcccctccccc

SEQ ID NO: 69856 - DNA, 75 bp, Artificial Sequence
  Synthetic
ttatactggctgcttatggtgacaattgagagattgttgccatatagctattggattggccatccggtgacaaac

SEQ ID NO: 69857 - DNA, 75 bp, Artificial Sequence
  Synthetic
ttgagagattgttgccatatagctattggattggccatccggtgacaaacagagcaattgtttatctatttgttg

SEQ ID NO: 69858 - DNA, 75 bp, Artificial Sequence
  Synthetic
tcaggtatcaacacaaaagactggtgcgcatgagacgggtctaaatgcgagcggcaattcggttatacattacac

SEQ ID NO: 69859 - DNA, 75 bp, Artificial Sequence
  Synthetic
gcgcatgagacgggtctaaatgcgagcggcaattcggttatacattacactaacatcaatttttacaaagactct

SEQ ID NO: 69860 - DNA, 75 bp, Artificial Sequence
  Synthetic
atcaagacactgcccgccttaaactccccatctgctgaggagtgtggatatagcgaccgggtgcggagcatcact

SEQ ID NO: 69861 - DNA, 75 bp, Artificial Sequence
  Synthetic
tgttcacctcccctttcgtcctggcgtccacaaacgctggctccattaatgcaccaaccgtctctgacagtcggg

SEQ ID NO: 69862 - DNA, 75 bp, Artificial Sequence
  Synthetic
ccccatctgctgaggagtgtggatatagcgaccgggtgcggagcatcactttaggaaactccactataacaaccc

SEQ ID NO: 69863 - DNA, 75 bp, Artificial Sequence
  Synthetic
accaaccgactcaaccggatgtagcaacctgcagattttatactttggattcggtggactggcagaagaactccg

SEQ ID NO: 69864 - DNA, 75 bp, Artificial Sequence
  Synthetic
aacctgcagattttatactttggattcggtggactggcagaagaactccgccgggtggtggtggaagttccctaa

SEQ ID NO: 69865 - DNA, 75 bp, Artificial Sequence
  Synthetic
cgttcaatgcaacgcctcaaagttccaccaagggtgtctcctggtagtgtgcgtgcccgaagccgaaatggggtg

SEQ ID NO: 69866 - DNA, 75 bp, Artificial Sequence
  Synthetic
caccaagggtgtctcctggtagtgtgcgtgcccgaagccgaaatggggtgtgccacagttgataggacggttact

SEQ ID NO: 69867 - DNA, 75 bp, Artificial Sequence
  Synthetic
accgctgtccacaatgctggtatggcagtggccgtgggcaaccttacaatcttccctcaccagtggatcaatctg

SEQ ID NO: 69868 - DNA, 75 bp, Artificial Sequence
  Synthetic
cagtggccgtgggcaaccttacaatcttccctcaccagtggatcaatctgaggactaataatagtgccaccatag

SEQ ID NO: 69869 - DNA, 75 bp, Artificial Sequence
  Synthetic
gggaatggtcaccaaggtttctcagcagctctcctcaagcactactttaatgacgagcaaggtgagatagagttc

SEQ ID NO: 69870 - DNA, 75 bp, Artificial Sequence
  Synthetic
ttgtacctctggatatgagtactggggcttcctccgtcgttccaataacggtcacagtggccccaatgagcgccg

SEQ ID NO: 69871 - DNA, 75 bp, Artificial Sequence
  Synthetic
ggcttcctccgtcgttccaataacggtcacagtggccccaatgagcgccgaatattatggtctacgattggccag

SEQ ID NO: 69872 - DNA, 75 bp, Artificial Sequence
  Synthetic
tgcaatgccgcagttcgacgcaaccccccaaatgcacataccaggacaagtgagaaatctaatggaaatcgctga

SEQ ID NO: 69873 - DNA, 75 bp, Artificial Sequence
  Synthetic
ccccaaatgcacataccaggacaagtgagaaatctaatggaaatcgctgaggtggattcagtagtgccagtgaat

SEQ ID NO: 69874 - DNA, 75 bp, Artificial Sequence
  Synthetic
ccagcgcagggtacccgtatgttgcactaggcattaaaaagagagacattttgtccaagaagaccaaagatctaa

SEQ ID NO: 69875 - DNA, 75 bp, Artificial Sequence
  Synthetic
gcaatatttagcttccaacttgacccaggtaactcatctgtcatgtcgcgtacactgctaggggagatactgaac

SEQ ID NO: 69876 - DNA, 75 bp, Artificial Sequence
  Synthetic
acctatgtgaaggacgagctcagatcagcagaaaaggtagcaaaagggaaatccagacttattgaagcatctagc

SEQ ID NO: 69877 - DNA, 75 bp, Artificial Sequence
  Synthetic
caggtaactcatctgtcatgtcgcgtacactgctaggggagatactgaactactatgctcattggtccgggagct

SEQ ID NO: 69878 - DNA, 75 bp, Artificial Sequence
  Synthetic
cttctgtaccaaccgacaggaaacaagcaatgctggggactcatgtgatatgggatgtgggtttacagtcaagtt

SEQ ID NO: 69879 - DNA, 75 bp, Artificial Sequence
  Synthetic
agcaatgctggggactcatgtgatatgggatgtgggtttacagtcaagttgtgtcctgtgtgtgccctggataag

SEQ ID NO: 69880 - DNA, 75 bp, Artificial Sequence
  Synthetic
catagttgtccccccaaaaactccgacagattgcaagctgatgtgtttcgtgtcggcctgcaatgacttctcggt

SEQ ID NO: 69881 - DNA, 75 bp, Artificial Sequence
  Synthetic
acagattgcaagctgatgtgtttcgtgtcggcctgcaatgacttctcggtgcgtatgttgagagacacccctcac

SEQ ID NO: 69882 - DNA, 75 bp, Artificial Sequence
  Synthetic
gcccgcaacacggaacaagttccagcactaacagcagtggaaacaggacacacgtcgcaagtggaacctagtgat

SEQ ID NO: 69883 - DNA, 75 bp, Artificial Sequence
  Synthetic
cactaacagcagtggaaacaggacacacgtcgcaagtggaacctagtgatacggtgcaaacacgtcacgtttgta

SEQ ID NO: 69884 - DNA, 75 bp, Artificial Sequence
  Synthetic
acattggacccaacattaaagaagaagatcgatacagcgattggacactgtcggtccgtgacatggtgcaaatac

SEQ ID NO: 69885 - DNA, 75 bp, Artificial Sequence
  Synthetic
agatcgatacagcgattggacactgtcggtccgtgacatggtgcaaatacgacgcaaatttgagatgtttactta

SEQ ID NO: 69886 - DNA, 75 bp, Artificial Sequence
  Synthetic
gccggtgttaacacatcagtttatgtatgtgccaccgggaggcccaattccaactagcgcctctagcttcgcctg

SEQ ID NO: 69887 - DNA, 75 bp, Artificial Sequence
  Synthetic
tatgtgccaccgggaggcccaattccaactagcgcctctagcttcgcctggcaaacatcaacaaaccctagtgta

SEQ ID NO: 69888 - DNA, 75 bp, Artificial Sequence
  Synthetic
ccgtggcggtggctgcgctggcggcctgcccatggggcaacccatgggacgcttcaattccgacatggtgcgaag

SEQ ID NO: 69889 - DNA, 75 bp, Artificial Sequence
  Synthetic
tatgacgggtggtcacatttcaatcaatcaggcgtttatgggttcaataccctgaacaacatgggcagactgttt

SEQ ID NO: 69890 - DNA, 75 bp, Artificial Sequence
  Synthetic
aatcaggcgtttatgggttcaataccctgaacaacatgggcagactgtttatgaggcatgtgaacaagttgtgtc

SEQ ID NO: 69891 - DNA, 75 bp, Artificial Sequence
  Synthetic
gactatgcccatatataaacagggcaaatgtcaacttccaccctacagcggtggcagacgtgagagccgacataa

SEQ ID NO: 69892 - DNA, 75 bp, Artificial Sequence
  Synthetic
aaatgtcaacttccaccctacagcggtggcagacgtgagagccgacataaacgctgtgccatcactggaacacga

SEQ ID NO: 69893 - DNA, 75 bp, Artificial Sequence
  Synthetic
acacttggccacgcataatgattggcaaaattgcgtgtgggaagactacaacagagaccttctcgtgagcacaac

SEQ ID NO: 69894 - DNA, 75 bp, Artificial Sequence
  Synthetic
caaaattgcgtgtgggaagactacaacagagaccttctcgtgagcacaacgactgcccatggttgtgataccatt

SEQ ID NO: 69895 - DNA, 75 bp, Artificial Sequence
  Synthetic
ccaggtttagtggaagttcaggagagtgagtattatcctaagagatatcaatcacacgtactgctagctgcaggc

SEQ ID NO: 69896 - DNA, 75 bp, Artificial Sequence
  Synthetic
gtgagtattatcctaagagatatcaatcacacgtactgctagctgcaggcttctcggtaccaggtgactgtggag

SEQ ID NO: 69897 - DNA, 75 bp, Artificial Sequence
  Synthetic
gatcaaatccatgcctgctctcaactctccgtcagcagaggagtgcggttacagtgatagggtaaggtccattac

SEQ ID NO: 69898 - DNA, 75 bp, Artificial Sequence
  Synthetic
ttcgcgacctcttgtggttggaagacgacgcaatggaacagggcgtcagagattatgtggaacagcttgggaacg

SEQ ID NO: 69899 - DNA, 75 bp, Artificial Sequence
  Synthetic
cgacgcaatggaacagggcgtcagagattatgtggaacagcttgggaacgcctttggctctggcttcaccaatca

SEQ ID NO: 69900 - DNA, 75 bp, Artificial Sequence
  Synthetic
ccgggatggtggtggaaatttcccgacgcactgtccaacatgggtttgttcgggcaaaacatgcaataccattac

SEQ ID NO: 69901 - DNA, 75 bp, Artificial Sequence
  Synthetic
cctggtcaaaattatatcagccttggttatagttgtaaggaatcacgacgacctcgtaacagtgacagccaccct

SEQ ID NO: 69902 - DNA, 75 bp, Artificial Sequence
  Synthetic
gttatagttgtaaggaatcacgacgacctcgtaacagtgacagccaccctagcactcattgggtgctctgcatcg

SEQ ID NO: 69903 - DNA, 75 bp, Artificial Sequence
  Synthetic
cttaagaaattcacagaaatgaccaacgcatgcaagggcatggagtggatagccatcaaaattcagaagttcata

SEQ ID NO: 69904 - DNA, 75 bp, Artificial Sequence
  Synthetic
ggggttggagttggcaatctgaccatattcccgcaccagtggatcaatctgcgcactaacaatagtgcgacgatt

SEQ ID NO: 69905 - DNA, 75 bp, Artificial Sequence
  Synthetic
gcgcactaacaatagtgcgacgattgtcatgccatacataaatagtgtgcccatggataacatgttcaggcacaa

SEQ ID NO: 69906 - DNA, 75 bp, Artificial Sequence
  Synthetic
ctactggagagtcagattgccaccatcgagcagagtgcgccctcacaaagtgaccaggagcaactattttctaat

SEQ ID NO: 69907 - DNA, 75 bp, Artificial Sequence
  Synthetic
gaaaagaaaatgagcaactacatacagttcaagtccaaatgccgtattgaacctgtatgtctcctgcttcacggg

SEQ ID NO: 69908 - DNA, 75 bp, Artificial Sequence
  Synthetic
agttcaagtccaaatgccgtattgaacctgtatgtctcctgcttcacgggagccctggtgctggaaaatcagtgg

SEQ ID NO: 69909 - DNA, 75 bp, Artificial Sequence
  Synthetic
attttgatggctacaagcagcaggctgttgtaatcatggatgatttatgccaaaatccagacgggaaagatgtgt

SEQ ID NO: 69910 - DNA, 75 bp, Artificial Sequence
  Synthetic
tgttgtaatcatggatgatttatgccaaaatccagacgggaaagatgtgtccctattctgccagatggtgtccag

SEQ ID NO: 69911 - DNA, 75 bp, Artificial Sequence
  Synthetic
caccaatgcaggatctatcaacgcccctactgtgtcagatagcagggctcttgccagaaggtttcattttgacat

SEQ ID NO: 69912 - DNA, 75 bp, Artificial Sequence
  Synthetic
cctactgtgtcagatagcagggctcttgccagaaggtttcattttgacatgaacatagaagtcatctcaatgtac

SEQ ID NO: 69913 - DNA, 75 bp, Artificial Sequence
  Synthetic
aagtgctgcccactagtgtgtggtaaagccatccagtttatcgacagaagaacacaaatgaggtattcgttggac

SEQ ID NO: 69914 - DNA, 75 bp, Artificial Sequence
  Synthetic
aagccatccagtttatcgacagaagaacacaaatgaggtattcgttggacatgcttgtgaccgagatgttcagag

SEQ ID NO: 69915 - DNA, 75 bp, Artificial Sequence
  Synthetic
aaaacaggataatttctaccaagggcccccaggtgaggcagtggagagggccattgcacgcgtcgctgataccat

SEQ ID NO: 69916 - DNA, 75 bp, Artificial Sequence
  Synthetic
aaatcagtgttgcaccagaaaccccccccccgccagcaatcgccgacctgttgaaatcagtggacagtgaggccg

SEQ ID NO: 69917 - DNA, 75 bp, Artificial Sequence
  Synthetic
ccccccgccagcaatcgccgacctgttgaaatcagtggacagtgaggccgtcagagagtactgtaaggaaaaagg

SEQ ID NO: 69918 - DNA, 75 bp, Artificial Sequence
  Synthetic
acttactacctttgtgtcagtagcaggaatcatatacatcatatacaagctgtttgcaggcttccaaggggccta

SEQ ID NO: 69919 - DNA, 75 bp, Artificial Sequence
  Synthetic
ggaatcatatacatcatatacaagctgtttgcaggcttccaaggggcctactctggaatgcccaaccaaaagccc

SEQ ID NO: 69920 - DNA, 75 bp, Artificial Sequence
  Synthetic
gtgtaggtcagcatgcgtcttttacaccacgtataaaaatcatggtactgatggtgacaactttggttattgggt

SEQ ID NO: 69921 - DNA, 75 bp, Artificial Sequence
  Synthetic
accacgtataaaaatcatggtactgatggtgacaactttggttattgggtgatcagcacgcgccaggtggcccaa

SEQ ID NO: 69922 - DNA, 75 bp, Artificial Sequence
  Synthetic
gccagtaccgtgaaaaccgaatacggtgagttcacaatgcttggtatctatgacagatgggcagtgttaccccga

SEQ ID NO: 69923 - DNA, 75 bp, Artificial Sequence
  Synthetic
gtgagttcacaatgcttggtatctatgacagatgggcagtgttaccccgacacgccaagcctggacctaccattc

SEQ ID NO: 69924 - DNA, 75 bp, Artificial Sequence
  Synthetic
cactcttgaaacttaacagaaatgagaagttcagggacatccgaggcttcttggcacgagaagaggctgaggtca

SEQ ID NO: 69925 - DNA, 75 bp, Artificial Sequence
  Synthetic
gaagttcagggacatccgaggcttcttggcacgagaagaggctgaggtcaatgaagctgtgcttgctatcaatac

SEQ ID NO: 69926 - DNA, 75 bp, Artificial Sequence
  Synthetic
gttctatgatgggtgggctaggtttgacaagcaagggacgtatggcataaatacactgaataacatggggacgct

SEQ ID NO: 69927 - DNA, 75 bp, Artificial Sequence
  Synthetic
caccaagcgcatgctaatgtacaacttccccacgcgtgcagggcagtgtggtggtgtcctgatgtcaacgggtaa

SEQ ID NO: 69928 - DNA, 75 bp, Artificial Sequence
  Synthetic
ttccccacgcgtgcagggcagtgtggtggtgtcctgatgtcaacgggtaaagtccttgggatacacgtcggcgga

SEQ ID NO: 69929 - DNA, 75 bp, Artificial Sequence
  Synthetic
gagagctccaaggaagctggtttcccaatcattaacactcccagtaagacgaagcttgaacccagcgttttccat

SEQ ID NO: 69930 - DNA, 75 bp, Artificial Sequence
  Synthetic
attggcaaaactgcgtgtgggaggattacaacagggacttactagtcagcacaaccacagcccatggctgtgaca

SEQ ID NO: 69931 - DNA, 75 bp, Artificial Sequence
  Synthetic
gccatcttttctaaatacattggcaacgtgaacacccatgtggatgaatacatgctggaggctgtcgaccactat

SEQ ID NO: 69932 - DNA, 75 bp, Artificial Sequence
  Synthetic
ctagaagcactagatttaaccacaagtgcaggttatccttatgttgcccttggtatcaagaagagagatatttta

SEQ ID NO: 69933 - DNA, 75 bp, Artificial Sequence
  Synthetic
gtgcaggttatccttatgttgcccttggtatcaagaagagagatattttatctaagaagaccaaggatctgacaa

SEQ ID NO: 69934 - DNA, 75 bp, Artificial Sequence
  Synthetic
cagaaaaggtggctaaaggtaagtccaggttaattgaggcatcaagtctaaatgattcagtagctatgaggcaaa

SEQ ID NO: 69935 - DNA, 75 bp, Artificial Sequence
  Synthetic
caggttaattgaggcatcaagtctaaatgattcagtagctatgaggcaaaccttcgggaacttgtacaaaacatt

SEQ ID NO: 69936 - DNA, 75 bp, Artificial Sequence
  Synthetic
catgcttgacggtcatctcattgccttttattatagtgggtattatgccagcttgagtccggtgtggttcgcttg

SEQ ID NO: 69937 - DNA, 75 bp, Artificial Sequence
  Synthetic
ttttattatagtgggtattatgccagcttgagtccggtgtggttcgcttgtctaaaactgttactagagaagcta

SEQ ID NO: 69938 - DNA, 75 bp, Artificial Sequence
  Synthetic
tttgtgagaggtggaatgccatctgggtgttcgggaaccagcattttcaattcaatgatcaacaacataattatc

SEQ ID NO: 69939 - DNA, 75 bp, Artificial Sequence
  Synthetic
ggtgttcgggaaccagcattttcaattcaatgatcaacaacataattatcagaacactaatgttgaaagtgtaca

SEQ ID NO: 69940 - DNA, 75 bp, Artificial Sequence
  Synthetic
acgcgtcactgctagctgaggcaggtaaagggtatggtctaattattacaccagctgataagggagagtgcttta

SEQ ID NO: 69941 - DNA, 75 bp, Artificial Sequence
  Synthetic
taaagggtatggtctaattattacaccagctgataagggagagtgctttaatgaagtgacatgggccaatgtcac

SEQ ID NO: 69942 - DNA, 75 bp, Artificial Sequence
  Synthetic
acgtgaatcaattaggtggaccaaagaccccaaaaacacccaggatcatgtgcgatccttatgcctattggcttg

SEQ ID NO: 69943 - DNA, 75 bp, Artificial Sequence
  Synthetic
gcataatggggagcaagaatatgaagagtttgtgtccaaaatcaggagcgttccagtgggacgctgcctgaccct

SEQ ID NO: 69944 - DNA, 75 bp, Artificial Sequence
  Synthetic
acccacagggcccactgggcgctggtacactggtattaaggtacccttgtacgcctgttttatatccctcccccg

SEQ ID NO: 69945 - DNA, 75 bp, Artificial Sequence
  Synthetic
ttttattggctgcttatggtgacaatcacggaattgttaccatatagctattggattggccatccagtgactaac

SEQ ID NO: 69946 - DNA, 75 bp, Artificial Sequence
  Synthetic
tcacggaattgttaccatatagctattggattggccatccagtgactaacagagcagtaatattcctttttgttg

SEQ ID NO: 69947 - DNA, 75 bp, Artificial Sequence
  Synthetic
acaagtatcaacacaaaagaccggagcgcatgagacgctgctcgaggccgctcatggagcgacaataaattacac

SEQ ID NO: 69948 - DNA, 75 bp, Artificial Sequence
  Synthetic
gcgcatgagacgctgctcgaggccgctcatggagcgacaataaattacaccaacatcaactactataaagatgct

SEQ ID NO: 69949 - DNA, 75 bp, Artificial Sequence
  Synthetic
atcaaatccatgccagccttaaactccccgtctgcagaggaatgtgggttcagtgacagggtgagatcccttacc

SEQ ID NO: 69950 - DNA, 75 bp, Artificial Sequence
  Synthetic
ccccgtctgcagaggaatgtgggttcagtgacagggtgagatcccttaccctgggtaactctaccatcacaacac

SEQ ID NO: 69951 - DNA, 75 bp, Artificial Sequence
  Synthetic
atcaaccaacacaaccagacgttgccacgtgtaggttctatacactggagtcagtgtcatggcagagtgggtcag

SEQ ID NO: 69952 - DNA, 75 bp, Artificial Sequence
  Synthetic
cacgtgtaggttctatacactggagtcagtgtcatggcagagtgggtcagcagggtggtggtggaagtttccaga

SEQ ID NO: 69953 - DNA, 75 bp, Artificial Sequence
  Synthetic
cgtgcagtgcaacgcatctaagttccatcagggctgcctcctggtggtgtgtgtgcctgaagccgagatgggctg

SEQ ID NO: 69954 - DNA, 75 bp, Artificial Sequence
  Synthetic
ggagccagcagtgttgaggaacggagaccccagactgaaggccaactttgaagaggccatcttttcaaagtacat

SEQ ID NO: 69955 - DNA, 75 bp, Artificial Sequence
  Synthetic
catcagggctgcctcctggtggtgtgtgtgcctgaagccgagatgggctgtgcagatgtgacgagtgtggtgaca

SEQ ID NO: 69956 - DNA, 75 bp, Artificial Sequence
  Synthetic
caaaccgctgtctgcaacgcagggatgggggttgccgtagggaacctcacaatatttccgcatcaatggattaac

SEQ ID NO: 69957 - DNA, 75 bp, Artificial Sequence
  Synthetic
tgggggttgccgtagggaacctcacaatatttccgcatcaatggattaacctccgtaccaacaattgtgccacca

SEQ ID NO: 69958 - DNA, 75 bp, Artificial Sequence
  Synthetic
ccttcgccccgctagctagccaaggtgggtcaacatacgtgcctatcacgatcaccatcgcacccatgtgtgcag

SEQ ID NO: 69959 - DNA, 75 bp, Artificial Sequence
  Synthetic
tgggtcaacatacgtgcctatcacgatcaccatcgcacccatgtgtgcagagtacaacgggttaaggctctccac

SEQ ID NO: 69960 - DNA, 75 bp, Artificial Sequence
  Synthetic
atgtgccatgcctgagtttgatgtaaccccaccaatggacataccaggagaagttcgaaacatcatggagattgc

SEQ ID NO: 69961 - DNA, 75 bp, Artificial Sequence
  Synthetic
accccaccaatggacataccaggagaagttcgaaacatcatggagattgctgaggtggactctgtggtccctgtg

SEQ ID NO: 69962 - DNA, 75 bp, Artificial Sequence
  Synthetic
gatgctatattttcattccagttaaacccgggaaacagccccgtgctgaaccgcacactgcttggtgagatcata

SEQ ID NO: 69963 - DNA, 75 bp, Artificial Sequence
  Synthetic
acccgggaaacagccccgtgctgaaccgcacactgcttggtgagatcataaattattacgcacattggtctggaa

SEQ ID NO: 69964 - DNA, 75 bp, Artificial Sequence
  Synthetic
gtgcctcggtgcccaccagtcgcaaagatgccatgctaggcacgcacataatatgggacctaggtttgcagtcca

SEQ ID NO: 69965 - DNA, 75 bp, Artificial Sequence
  Synthetic
agatgccatgctaggcacgcacataatatgggacctaggtttgcagtccagttgcgtgttatgcgtcccatggat

SEQ ID NO: 69966 - DNA, 75 bp, Artificial Sequence
  Synthetic
caacatcatagtaccaccagacaccccaactgattgtattgtgctttgcttcgtttcggcctgtaatgacttctc

SEQ ID NO: 69967 - DNA, 75 bp, Artificial Sequence
  Synthetic
cgttcatccagtaatgccaatgaaggatatccacgagtcaatcaggtggaccaaagatcccaaaaacactcaaga

SEQ ID NO: 69968 - DNA, 75 bp, Artificial Sequence
  Synthetic
ccaactgattgtattgtgctttgcttcgtttcggcctgtaatgacttctcagtgcggatgttgaaagatacaccc

SEQ ID NO: 69969 - DNA, 75 bp, Artificial Sequence
  Synthetic
acaattatgagtggcccgtcaaactcccaacaggtccccgctcttactgcagttgaaactggacacacatcgcaa

SEQ ID NO: 69970 - DNA, 75 bp, Artificial Sequence
  Synthetic
cccaacaggtccccgctcttactgcagttgaaactggacacacatcgcaagttgttccaagtgataccatccaaa

SEQ ID NO: 69971 - DNA, 75 bp, Artificial Sequence
  Synthetic
cccacccacagggcccactgggcgctagcactctggtatcacggtacctttgtgcgcctgttttattttcccacc

SEQ ID NO: 69972 - DNA, 75 bp, Artificial Sequence
  Synthetic
atatcgccaattacaacgcgaagggcgataagacggatgtgaacaggtttgacaggtgggagatcaacattcgtg

SEQ ID NO: 69973 - DNA, 75 bp, Artificial Sequence
  Synthetic
cgataagacggatgtgaacaggtttgacaggtgggagatcaacattcgtgaaatggtgcaactacgtagaaagtg

SEQ ID NO: 69974 - DNA, 75 bp, Artificial Sequence
  Synthetic
acttctgttaccccggaccgagtatcaataagctgcttgcgcggctgaaggagaaaacgttcgttacccggccaa

SEQ ID NO: 69975 - DNA, 75 bp, Artificial Sequence
  Synthetic
actaaaccaggatatgcctgttcttacccaccaaattatgtacgtacccccaggaggttcagtacctagcaccgt

SEQ ID NO: 69976 - DNA, 75 bp, Artificial Sequence
  Synthetic
acccaccaaattatgtacgtacccccaggaggttcagtacctagcaccgttgagagctatgcgtggcaaacatca

SEQ ID NO: 69977 - DNA, 75 bp, Artificial Sequence
  Synthetic
gcttatagtagcttctatgatggatggtcacactttactcaaaaaggggtctacggatacaacacattaaacaag

SEQ ID NO: 69978 - DNA, 75 bp, Artificial Sequence
  Synthetic
ggtcacactttactcaaaaaggggtctacggatacaacacattaaacaagatggggcagctatttgtcagacatg

SEQ ID NO: 69979 - DNA, 75 bp, Artificial Sequence
  Synthetic
tccctaggcccccgcggttatgcccctatgtgaacaagacaaatgtaaacttcatcaccacacaggtaacagaac

SEQ ID NO: 69980 - DNA, 75 bp, Artificial Sequence
  Synthetic
ctatgtgaacaagacaaatgtaaacttcatcaccacacaggtaacagaacctagaaatgacctcaatgacgtgcc

SEQ ID NO: 69981 - DNA, 75 bp, Artificial Sequence
  Synthetic
gacaattgagagattgttaccatatagctattggattggccatccggtgacaaacagggcaattatttatttgtt

SEQ ID NO: 69982 - DNA, 75 bp, Artificial Sequence
  Synthetic
ggtagtgaacaggcacctagcgactcacaacgactggcaaaattgtgtatgggaggattacaatagggacctcct

SEQ ID NO: 69983 - DNA, 75 bp, Artificial Sequence
  Synthetic
ggcgcacaagtttcgacgcagaagactggcgcacacgagacaggactaaatgctagtggcaattccgttattcac

SEQ ID NO: 69984 - DNA, 75 bp, Artificial Sequence
  Synthetic
cacaacgactggcaaaattgtgtatgggaggattacaatagggacctcctggtgagtacaactaccgcacaaggg

SEQ ID NO: 69985 - DNA, 75 bp, Artificial Sequence
  Synthetic
ctggcgcacacgagacaggactaaatgctagtggcaattccgttattcactacactaacatcaactactacaaag

SEQ ID NO: 69986 - DNA, 75 bp, Artificial Sequence
  Synthetic
tcttttgaaggtccaggcctagtggaagttcaggagagcgaatattatccaaaaagataccaatctcatgtactg

SEQ ID NO: 69987 - DNA, 75 bp, Artificial Sequence
  Synthetic
tcatgataaagtcactccctgcattaaactcccccacagttgaagagtgtggatatagtgatagagtgaggtcta

SEQ ID NO: 69988 - DNA, 75 bp, Artificial Sequence
  Synthetic
aaactcccccacagttgaagagtgtggatatagtgatagagtgaggtctattactctgggtaactccaccatcac

SEQ ID NO: 69989 - DNA, 75 bp, Artificial Sequence
  Synthetic
gtgactgtggtggaatacttaggtgtgaacatggtgttatcggcatcgtcaccatgggtggtgaaggtgtcgttg

SEQ ID NO: 69990 - DNA, 75 bp, Artificial Sequence
  Synthetic
tgaagatcaaccaacacaaccagacgtggccacgtgtaggttctacacacttgattcagtgcaatggcaaaagac

SEQ ID NO: 69991 - DNA, 75 bp, Artificial Sequence
  Synthetic
gtggccacgtgtaggttctacacacttgattcagtgcaatggcaaaagacttcaccaggatggtggtggaagctg

SEQ ID NO: 69992 - DNA, 75 bp, Artificial Sequence
  Synthetic
cttcaccaatcaaatatgtgaacaagttaacctcttgaaagagtcactggtgggtcaagactccatcctagagaa

SEQ ID NO: 69993 - DNA, 75 bp, Artificial Sequence
  Synthetic
atacatgtgcaatgcaatgcatccaaattccaccaggggtgtttactggttgtgtgtgttccggaagccgagatg

SEQ ID NO: 69994 - DNA, 75 bp, Artificial Sequence
  Synthetic
aattccaccaggggtgtttactggttgtgtgtgttccggaagccgagatgggctgtgcaactctggacaacacac

SEQ ID NO: 69995 - DNA, 75 bp, Artificial Sequence
  Synthetic
tgtacctcgtccccatggcggtggctcaaacagaaggtgtcacaatactatgggatacccatggctgaacgccag

SEQ ID NO: 69996 - DNA, 75 bp, Artificial Sequence
  Synthetic
tcaaacagaaggtgtcacaatactatgggatacccatggctgaacgccagaataacgggtggcttaagaagttca

SEQ ID NO: 69997 - DNA, 75 bp, Artificial Sequence
  Synthetic
agctggtgcaaagagtggtatacaatgcgggaatggggatcggtgtaggaaacctaacgatctttccacatcaat

SEQ ID NO: 69998 - DNA, 75 bp, Artificial Sequence
  Synthetic
tgcgggaatggggatcggtgtaggaaacctaacgatctttccacatcaatggatcaacctgcgtaccaacaatag

SEQ ID NO: 69999 - DNA, 75 bp, Artificial Sequence
  Synthetic
aaacaactgccgcttttagagagccaaatagccactattgaacagagtgctccttcccaaagtgatcaggaacag

SEQ ID NO: 70000 - DNA, 75 bp, Artificial Sequence
  Synthetic
ggtaattccattcgtgcctctagattactgtcccgggtccaccacgtatgttccaattaccgtcaccatagcacc

SEQ ID NO: 70001 - DNA, 75 bp, Artificial Sequence
  Synthetic
tactgtcccgggtccaccacgtatgttccaattaccgtcaccatagcacccatgtgtgcagagtacaatggacta

SEQ ID NO: 70002 - DNA, 75 bp, Artificial Sequence
  Synthetic
gtgttctccctggagaagaagatgagtaattacatacagttcaagtccaaatgccgtattgagcctgtatgtttg

SEQ ID NO: 70003 - DNA, 75 bp, Artificial Sequence
  Synthetic
gtaattacatacagttcaagtccaaatgccgtattgagcctgtatgtttgctcctacacgggagtcctggcgccg

SEQ ID NO: 70004 - DNA, 75 bp, Artificial Sequence
  Synthetic
cagtccccgtctgccatgccgcaatatgatgttactcctgaaatgaagatacccggtgaggtgaagaacttgatg

SEQ ID NO: 70005 - DNA, 75 bp, Artificial Sequence
  Synthetic
atgatgttactcctgaaatgaagatacccggtgaggtgaagaacttgatggagatagctgaagttgactcagtgg

SEQ ID NO: 70006 - DNA, 75 bp, Artificial Sequence
  Synthetic
cagacccagatcacttcgatggctataagcaacaggccgtggtgatcatggatgatctgtgtcagaatcctgatg

SEQ ID NO: 70007 - DNA, 75 bp, Artificial Sequence
  Synthetic
taagcaacaggccgtggtgatcatggatgatctgtgtcagaatcctgatgggaaggatgtttccttgttctgcca

SEQ ID NO: 70008 - DNA, 75 bp, Artificial Sequence
  Synthetic
ccggtacccaagtcttcggtttcccattgcaaccaggctactcgagtgtcttcagccgtacgctactaggtgaga

SEQ ID NO: 70009 - DNA, 75 bp, Artificial Sequence
  Synthetic
attgcaaccaggctactcgagtgtcttcagccgtacgctactaggtgagatcctcaactattacacccactggtc

SEQ ID NO: 70010 - DNA, 75 bp, Artificial Sequence
  Synthetic
ccacctatggctgccctggaggagaaaggtatcctattcacctcaccattcgttctggcatcaactaatgcagga

SEQ ID NO: 70011 - DNA, 75 bp, Artificial Sequence
  Synthetic
acccggcgctggagccccaaccaaaagagtggacgcaatgcttggcacacatgttgtatgggacgttggcctaca

SEQ ID NO: 70012 - DNA, 75 bp, Artificial Sequence
  Synthetic
agagtggacgcaatgcttggcacacatgttgtatgggacgttggcctacaatccagttgtgtcttgtgtatacca

SEQ ID NO: 70013 - DNA, 75 bp, Artificial Sequence
  Synthetic
atctccatgtacagccaaaacggcaaaataaatatgccgatgtcagtaaagacgtgtgatgaagagtgttgtcca

SEQ ID NO: 70014 - DNA, 75 bp, Artificial Sequence
  Synthetic
tagtgtgcgggaaggccatccaattcatagacagaagaactcaagtcagatattctctagacatgttggttactg

SEQ ID NO: 70015 - DNA, 75 bp, Artificial Sequence
  Synthetic
caaaccaacatcgtggtcccagcagatgcacaaagctcatgttacatcatgtgcttcgtgtcagcttgcaacgac

SEQ ID NO: 70016 - DNA, 75 bp, Artificial Sequence
  Synthetic
atgcacaaagctcatgttacatcatgtgcttcgtgtcagcttgcaacgacttttctgtgagattgctgaaagata

SEQ ID NO: 70017 - DNA, 75 bp, Artificial Sequence
  Synthetic
acagggagatcaaaattagtgttgcaccagagacaccgccaccacccgctattgcggacctgcttaagtcagtag

SEQ ID NO: 70018 - DNA, 75 bp, Artificial Sequence
  Synthetic
accagagacaccgccaccacccgctattgcggacctgcttaagtcagtagacagtgaagctgtgagggagtactg

SEQ ID NO: 70019 - DNA, 75 bp, Artificial Sequence
  Synthetic
ccgacacaatgggtgctggaccaacgaattctgaagcaataccagcgctcacagcagctgagacaggtcacacat

SEQ ID NO: 70020 - DNA, 75 bp, Artificial Sequence
  Synthetic
gaattctgaagcaataccagcgctcacagcagctgagacaggtcacacatctcaagtggtcccaggggacaccat

SEQ ID NO: 70021 - DNA, 75 bp, Artificial Sequence
  Synthetic
ctgcttgcaggcactgactacatttgtgtcagtagctggaatcatctatataatatacaagctatttgcaggctt

SEQ ID NO: 70022 - DNA, 75 bp, Artificial Sequence
  Synthetic
gtgtcagtagctggaatcatctatataatatacaagctatttgcaggctttcagggagcatacacaggaatgccc

SEQ ID NO: 70023 - DNA, 75 bp, Artificial Sequence
  Synthetic
tgtttatttcaccgagtataagaactcggggtccaaacgctatgctgaatgggtaatatcaacacgccaggcagc

SEQ ID NO: 70024 - DNA, 75 bp, Artificial Sequence
  Synthetic
tcggggtccaaacgctatgctgaatgggtaatatcaacacgccaggcagcgcaactcaggaggaagctggagttt

SEQ ID NO: 70025 - DNA, 75 bp, Artificial Sequence
  Synthetic
caagacgcccagattttaactcaccaaatcatgtatgtaccaccaggaggtccagtaccagacaaggtggactca

SEQ ID NO: 70026 - DNA, 75 bp, Artificial Sequence
  Synthetic
gttgggcatttatgacaggtgggctgttctgccacgccatgccaagcctggaccgaccatcctgatgaatgacca

SEQ ID NO: 70027 - DNA, 75 bp, Artificial Sequence
  Synthetic
aaatcatgtatgtaccaccaggaggtccagtaccagacaaggtggactcatacgtgtggcagacatccacgaacc

SEQ ID NO: 70028 - DNA, 75 bp, Artificial Sequence
  Synthetic
caaacttctatgatggctggtcagagttctccaggaatggggtgtatggcataaatactctaaataacatgggaa

SEQ ID NO: 70029 - DNA, 75 bp, Artificial Sequence
  Synthetic
gttctccaggaatggggtgtatggcataaatactctaaataacatgggaacgttgtacgcaagacatgtcaatac

SEQ ID NO: 70030 - DNA, 75 bp, Artificial Sequence
  Synthetic
agcaattaataccagtaaattccccaacatgtacattccagtgggacaagtcacggattacggcttcctaaacct

SEQ ID NO: 70031 - DNA, 75 bp, Artificial Sequence
  Synthetic
acccccaagattgtgtcaatatgaaaaagcgaagaatgtcaacttccaacctagtggggtgacaacaaccagaca

SEQ ID NO: 70032 - DNA, 75 bp, Artificial Sequence
  Synthetic
caggtcagtgtggtggagtgctcatgtccactggcaaagtcttgggaatccatgttggtggaaatggtcatcaag

SEQ ID NO: 70033 - DNA, 75 bp, Artificial Sequence
  Synthetic
aaagcgaagaatgtcaacttccaacctagtggggtgacaacaaccagacagagcatcaccacaatgacaaacact

SEQ ID NO: 70034 - DNA, 75 bp, Artificial Sequence
  Synthetic
attgagttcattgagagctcaaaggatgcaggattcccgattatcaacacaccaagtaagactaagctggagcca

SEQ ID NO: 70035 - DNA, 75 bp, Artificial Sequence
  Synthetic
atgcaggattcccgattatcaacacaccaagtaagactaagctggagccaagtgtcttccaccaggtttttgaag

SEQ ID NO: 70036 - DNA, 75 bp, Artificial Sequence
  Synthetic
gccgattggcaaaactgtgtgtgggaggactacaacagggacctcctcgtaagcaccaccactgcccacgggtgt

SEQ ID NO: 70037 - DNA, 75 bp, Artificial Sequence
  Synthetic
aggactacaacagggacctcctcgtaagcaccaccactgcccacgggtgtgatgttatagccagatgccaatgca

SEQ ID NO: 70038 - DNA, 75 bp, Artificial Sequence
  Synthetic
agtacatagggaatgtcaacacacacgtggatgagtacatgatggaggcagtggatcattatgcaggccaactag

SEQ ID NO: 70039 - DNA, 75 bp, Artificial Sequence
  Synthetic
ttcagcagagtgagtattaccccaagagatatcagtcccacgtactacttgctgcagggttctccgagccaggtg

SEQ ID NO: 70040 - DNA, 75 bp, Artificial Sequence
  Synthetic
gagatatcagtcccacgtactacttgctgcagggttctccgagccaggtgattgtggtggtatcttgaggtgcga

SEQ ID NO: 70041 - DNA, 75 bp, Artificial Sequence
  Synthetic
atctaacaacgagcgccggttacccatatgttgcactgggcatcaagaagagagacatcctctcaaagaggacca

SEQ ID NO: 70042 - DNA, 75 bp, Artificial Sequence
  Synthetic
gttggaagatgacgcaatggaacagggcgttagggattatgttgagcaactagggaacgcctttggctcaggctt

SEQ ID NO: 70043 - DNA, 75 bp, Artificial Sequence
  Synthetic
agctcaggtccgcagagaaggtagcaaaaggaaagtctaggctgatcgaagcatccagtttgaatgattcagtgg

SEQ ID NO: 70044 - DNA, 75 bp, Artificial Sequence
  Synthetic
gtcaagactccatcttggaaaaatccttgaaagcattggttaagatcatctcagcactagtcatagtggtgagga

SEQ ID NO: 70045 - DNA, 75 bp, Artificial Sequence
  Synthetic
gcatccagtttgaatgattcagtggcaatgagacagacatttggtaatctgtacaaaactttccacctgaaccca

SEQ ID NO: 70046 - DNA, 75 bp, Artificial Sequence
  Synthetic
caaaataccagtgatgttggatggacatctcatagcatttgattactctgggtatgatgctagcttaagtcctgt

SEQ ID NO: 70047 - DNA, 75 bp, Artificial Sequence
  Synthetic
agcagaaagtgtcccaatactatggaatccccatggctgaaagacagaacaatggttggcttaagaaattcacgg

SEQ ID NO: 70048 - DNA, 75 bp, Artificial Sequence
  Synthetic
ggtatgatgctagcttaagtcctgtttggtttgcttgcttaaaaatgctacttgagaagcttggatatacacaca

SEQ ID NO: 70049 - DNA, 75 bp, Artificial Sequence
  Synthetic
aagagactaactacattgactacttgtgcaactcccatcacctgtacagagacaagcattactttgtgaggggtg

SEQ ID NO: 70050 - DNA, 75 bp, Artificial Sequence
  Synthetic
gacaagcattactttgtgaggggtggcatgccctcagggtgttctggcaccagtatctttaactcaatgatcaac

SEQ ID NO: 70051 - DNA, 75 bp, Artificial Sequence
  Synthetic
agattttgccggaggtcagggaaaaacacgagtttctgagcagactaaaacaactacccctgctggaaagccaga

SEQ ID NO: 70052 - DNA, 75 bp, Artificial Sequence
  Synthetic
cagtatctttaactcaatgatcaacaatatcataatcaggacactaatgctgaaagtgtacaagggaattgactt

SEQ ID NO: 70053 - DNA, 75 bp, Artificial Sequence
  Synthetic
caactacccctgctggaaagccagatcgccaccattgaacaaagtgcgccttcacaaagtgaccaggaacaattg

SEQ ID NO: 70054 - DNA, 75 bp, Artificial Sequence
  Synthetic
actacatacagttcaagtccaaatgccgtattgaacctgtatgtcttttgctacacgggagccctggtgctggaa

SEQ ID NO: 70055 - DNA, 75 bp, Artificial Sequence
  Synthetic
acccagaccactttgacggttacaaacagcaggctgtcgtgattatggatgacttgtgccagaacccggatggca

SEQ ID NO: 70056 - DNA, 75 bp, Artificial Sequence
  Synthetic
agatggaccaaagatccaaagaacactcaagatcatgtgcgctcactgtgtctattggcctggcacaacggagag

SEQ ID NO: 70057 - DNA, 75 bp, Artificial Sequence
  Synthetic
acagcaggctgtcgtgattatggatgacttgtgccagaacccggatggcaaggatgtatcgttgttttgccaaat

SEQ ID NO: 70058 - DNA, 75 bp, Artificial Sequence
  Synthetic
cacgaatatgaggagttcatccgtaaaattagaagcgtcccagtcggacgttgcttgaccctccctgcgttttca

SEQ ID NO: 70059 - DNA, 75 bp, Artificial Sequence
  Synthetic
actcgcttccactaatgcaggatccatcaatgcccccactgtgtcggacagcagagctcttgccagaaggttcca

SEQ ID NO: 70060 - DNA, 75 bp, Artificial Sequence
  Synthetic
atcaatgcccccactgtgtcggacagcagagctcttgccagaaggttccatttcgatatgaacatcgagatcatt

SEQ ID NO: 70061 - DNA, 75 bp, Artificial Sequence
  Synthetic
aattggcttaaccctactgtactaaccgaactagataacggtgcagtaggggtaaattctccgcattcggtgcgg

SEQ ID NO: 70062 - DNA, 75 bp, Artificial Sequence
  Synthetic
ttaaaacagcctgtgggttgttcccacccacagggcccactgggcgctagcacactggtattacggtacctttgt

SEQ ID NO: 70063 - DNA, 75 bp, Artificial Sequence
  Synthetic
aacttcaaaaagtgttgcccactggtctgtggtaaggccattcaatttatagataggagaacacaagtgaggtac

SEQ ID NO: 70064 - DNA, 75 bp, Artificial Sequence
  Synthetic
tctgtggtaaggccattcaatttatagataggagaacacaagtgaggtactcactagacatgcttgtgactgaaa

SEQ ID NO: 70065 - DNA, 75 bp, Artificial Sequence
  Synthetic
gggaactcaaaattagtgtggcaccagatacgccccccccacctgcaattgcagatctgctaaaatctgtggaca

SEQ ID NO: 70066 - DNA, 75 bp, Artificial Sequence
  Synthetic
agatacgccccccccacctgcaattgcagatctgctaaaatctgtggacagtgaggcagtcagagagtattgtaa

SEQ ID NO: 70067 - DNA, 75 bp, Artificial Sequence
  Synthetic
cctacaggcgcttactacctttgtctctgtggcagggatcatatacattatatacaaactatttgcaggattcca

SEQ ID NO: 70068 - DNA, 75 bp, Artificial Sequence
  Synthetic
tctgtggcagggatcatatacattatatacaaactatttgcaggattccagggagcttacactggtatgcctaac

SEQ ID NO: 70069 - DNA, 75 bp, Artificial Sequence
  Synthetic
ttcccattggctgcttatggtgacaatcgaggaattgttgccatatagctattggattggccatccggtgtcaaa

SEQ ID NO: 70070 - DNA, 75 bp, Artificial Sequence
  Synthetic
aagagaaatgccagcactgtaaaaactgagtacggcgagttcacaatgcttggaatctacgacagatgggcggtg

SEQ ID NO: 70071 - DNA, 75 bp, Artificial Sequence
  Synthetic
ctgagtacggcgagttcacaatgcttggaatctacgacagatgggcggtgttgccccgacatgccaaacctggac

SEQ ID NO: 70072 - DNA, 75 bp, Artificial Sequence
  Synthetic
ggatttgtaccactgaactttaaggcgctcatcactctcaactatattttatcccttaacgcaacaaaatgggtg

SEQ ID NO: 70073 - DNA, 75 bp, Artificial Sequence
  Synthetic
ggcacacgaaaccagcctgaatgctagcggcaactcaaccattcatttcaccaacatcaattattacaaggatgc

SEQ ID NO: 70074 - DNA, 75 bp, Artificial Sequence
  Synthetic
tggagttaacacttttgaaacttaataggaatgagaagtttagggacatccggggtttcttggcgagagaagagg

SEQ ID NO: 70075 - DNA, 75 bp, Artificial Sequence
  Synthetic
taggaatgagaagtttagggacatccggggtttcttggcgagagaagaggtcgaggtcaatgaagctgtccttgc

SEQ ID NO: 70076 - DNA, 75 bp, Artificial Sequence
  Synthetic
gatcaaatctctacctgccctgaactcccccacagtggaggagtgcgggtatagtgatagagttcgatcaatcac

SEQ ID NO: 70077 - DNA, 75 bp, Artificial Sequence
  Synthetic
tcccccacagtggaggagtgcgggtatagtgatagagttcgatcaatcacactagggaactcaaccatcactaca

SEQ ID NO: 70078 - DNA, 75 bp, Artificial Sequence
  Synthetic
tggaacccccactaagcgcatgctgatgtacaacttccccacgcgtgcaggtcaatgtggtggtgtcctaatgtc

SEQ ID NO: 70079 - DNA, 75 bp, Artificial Sequence
  Synthetic
atgtacaacttccccacgcgtgcaggtcaatgtggtggtgtcctaatgtcaacaggcaaagtccttgggatacac

SEQ ID NO: 70080 - DNA, 75 bp, Artificial Sequence
  Synthetic
gatcaaccaacgcagccagatgtagcaacatgcaggttctacacattggattcaataaagtggcagaagaactca

SEQ ID NO: 70081 - DNA, 75 bp, Artificial Sequence
  Synthetic
ttcaataaagtggcagaagaactcaaatgggtggtggtggaagtttccagaggctctcagcaacatgggtttgtt

SEQ ID NO: 70082 - DNA, 75 bp, Artificial Sequence
  Synthetic
gagttcattgagagctccaaagaagccggtttcccggtcatcaacacccccagtaaaacaaagcttgagcccagt

SEQ ID NO: 70083 - DNA, 75 bp, Artificial Sequence
  Synthetic
ccggtttcccggtcatcaacacccccagtaaaacaaagcttgagcccagtgttttccatcatgtgttcgagggaa

SEQ ID NO: 70084 - DNA, 75 bp, Artificial Sequence
  Synthetic
tcaccagggttgtctgcttgttgtgtgtgtaccggaagctgaaatgggatgtgccacaattgggaacactgttaa

SEQ ID NO: 70085 - DNA, 75 bp, Artificial Sequence
  Synthetic
acatcggcaacgtgaatactcacgtggatgaatacatgatggaagctgtcgaccattatgcagggcaactggcga

SEQ ID NO: 70086 - DNA, 75 bp, Artificial Sequence
  Synthetic
ggatgaatacatgatggaagctgtcgaccattatgcagggcaactggcgacccttgatatcagcacagagcctat

SEQ ID NO: 70087 - DNA, 75 bp, Artificial Sequence
  Synthetic
atgcaaacggcgagcatgatgtgcagacagctgttcacaacgctggaatgggtgttggtgtgggcaacctaacga

SEQ ID NO: 70088 - DNA, 75 bp, Artificial Sequence
  Synthetic
tgtcgctcttggtatcaaaaagagagatattttgtcaaaaaagaccagggatttgacaaagctaaaagagtgcat

SEQ ID NO: 70089 - DNA, 75 bp, Artificial Sequence
  Synthetic
gatattttgtcaaaaaagaccagggatttgacaaagctaaaagagtgcatggacaaatatggcttaaacctccct

SEQ ID NO: 70090 - DNA, 75 bp, Artificial Sequence
  Synthetic
gtaatgccttacataaacagtgtaccaatggacaatatgtttaggcattacaatttcacgttgatggtcatccca

SEQ ID NO: 70091 - DNA, 75 bp, Artificial Sequence
  Synthetic
caatttcacgttgatggtcatcccatttgtcaagttggactacacggatcaggctacgacgtatgtacctattac

SEQ ID NO: 70092 - DNA, 75 bp, Artificial Sequence
  Synthetic
tcgagtctaaacgattcagtggccatgaggcagacttttgggaacctatacaaaacatttcacctgaatccagga

SEQ ID NO: 70093 - DNA, 75 bp, Artificial Sequence
  Synthetic
tgaggcagacttttgggaacctatacaaaacatttcacctgaatccaggaatagtaacaggcagcgcagtcggtt

SEQ ID NO: 70094 - DNA, 75 bp, Artificial Sequence
  Synthetic
atgacgccagtttaagcccggtgtggtttgcgtgcctgaaactgctactagagaaactggggtactcacacaaag

SEQ ID NO: 70095 - DNA, 75 bp, Artificial Sequence
  Synthetic
gtttgcgtgcctgaaactgctactagagaaactggggtactcacacaaagaaaccaattatatagactacttgtg

SEQ ID NO: 70096 - DNA, 75 bp, Artificial Sequence
  Synthetic
caacgtggacacagtgactacacagatggacatgtaccgaatccctgtctcaaacactgcagatctacaacaaca

SEQ ID NO: 70097 - DNA, 75 bp, Artificial Sequence
  Synthetic
atggacatgtaccgaatccctgtctcaaacactgcagatctacaacaacaagtgttcggcattcgcttgcaacca

SEQ ID NO: 70098 - DNA, 75 bp, Artificial Sequence
  Synthetic
catttttaattcaatgatcaataacataatcattagaacactcatgctaaaggtttacaagggaatagacctgga

SEQ ID NO: 70099 - DNA, 75 bp, Artificial Sequence
  Synthetic
aaatttacatttatgttctgtggtgctgccatggcaactggaaaattcctgatagcttactcaccaccaggtgct

SEQ ID NO: 70100 - DNA, 75 bp, Artificial Sequence
  Synthetic
ctgccatggcaactggaaaattcctgatagcttactcaccaccaggtgctaacccccccaccaacagaaaggacg

SEQ ID NO: 70101 - DNA, 75 bp, Artificial Sequence
  Synthetic
tgaagctgggagagggtatggactaatcatgacaccagctgacaaaggggaatgcttcaacgaggtaacatggac

SEQ ID NO: 70102 - DNA, 75 bp, Artificial Sequence
  Synthetic
atcatgacaccagctgacaaaggggaatgcttcaacgaggtaacatggaccaatgtcactttcctgaaaaggtac

SEQ ID NO: 70103 - DNA, 75 bp, Artificial Sequence
  Synthetic
agacacattataggctcgtccagcaagacgagtacaccagcgcgggttttataacatgttggtatcaaacaggca

SEQ ID NO: 70104 - DNA, 75 bp, Artificial Sequence
  Synthetic
agacgagtacaccagcgcgggttttataacatgttggtatcaaacaggcatgatagtccccccgggcaccccgac

SEQ ID NO: 70105 - DNA, 75 bp, Artificial Sequence
  Synthetic
tggaccaaagaccccaaaaacactcaagaccatgtgcgatccttgtgcttattggcttggcacaatggggagcaa

SEQ ID NO: 70106 - DNA, 75 bp, Artificial Sequence
  Synthetic
cagccaaagtgccctattacaaggagatgaagatgaagggagagcgagcttagtgactgttgcagatacgattag

SEQ ID NO: 70107 - DNA, 75 bp, Artificial Sequence
  Synthetic
tagtgactgttgcagatacgattagccgtggaccaagtaactccgagagagtgcccgcactgacagcagctgaaa

SEQ ID NO: 70108 - DNA, 75 bp, Artificial Sequence
  Synthetic
ctacgcaggagatggctggactctttctaggagcacaatttgatttaatccaaattggcttgaccctaccacact

SEQ ID NO: 70109 - DNA, 75 bp, Artificial Sequence
  Synthetic
gtaaagaattaccattcccgctcagagtcctcaattgagaatttcttatgtagagcagcttgtgtgtatatggca

SEQ ID NO: 70110 - DNA, 75 bp, Artificial Sequence
  Synthetic
agtcctcaattgagaatttcttatgtagagcagcttgtgtgtatatggcagagtacaaaacaacctctgacacag

SEQ ID NO: 70111 - DNA, 75 bp, Artificial Sequence
  Synthetic
cctacctcaggttcgacatggaaatcactctcgtgatcaccagtcgccaggatcaaggcaccagattggaccaag

SEQ ID NO: 70112 - DNA, 75 bp, Artificial Sequence
  Synthetic
cactctcgtgatcaccagtcgccaggatcaaggcaccagattggaccaagacatgccagtgttgacacaccaaat

SEQ ID NO: 70113 - DNA, 75 bp, Artificial Sequence
  Synthetic
catattttggacagaagggaacgcaccagcccgcatgtctatcccttttgtgagtataggcaatgcctacagtag

SEQ ID NO: 70114 - DNA, 75 bp, Artificial Sequence
  Synthetic
ccagcccgcatgtctatcccttttgtgagtataggcaatgcctacagtagcttctatgatggatggtcacacttt

SEQ ID NO: 70115 - DNA, 75 bp, Artificial Sequence
  Synthetic
agcccactaccaataactagtactgtgcgggtgtatttcaaacccaaacacgtacgtgcttgggtgcctcggcca

SEQ ID NO: 70116 - DNA, 75 bp, Artificial Sequence
  Synthetic
cattcagtgttgatttcacgccagagccagtcaccgaaaagcgtgccaccgtcaacacagtcacgaccattcaac

SEQ ID NO: 70117 - DNA, 75 bp, Artificial Sequence
  Synthetic
ggcatctagcgacccatacggattggcagagttgcgtctgggaggactacaacagggacctgttggtgagtacta

SEQ ID NO: 70118 - DNA, 75 bp, Artificial Sequence
  Synthetic
gcagagttgcgtctgggaggactacaacagggacctgttggtgagtactactacggcccacggatgcgacaccat

SEQ ID NO: 70119 - DNA, 75 bp, Artificial Sequence
  Synthetic
acctggattggtagaagtgcaggaaagtgaatactatcccaagagataccagtcccacgtgctccttgcagccgg

SEQ ID NO: 70120 - DNA, 75 bp, Artificial Sequence
  Synthetic
agtgaatactatcccaagagataccagtcccacgtgctccttgcagccggattttccgagccaggcgactgcggt

SEQ ID NO: 70121 - DNA, 75 bp, Artificial Sequence
  Synthetic
gtgcgagaccttttgtggctggaagacgacgctatggagcagggagtgagagactacgttgaacaactcgggaac

SEQ ID NO: 70122 - DNA, 75 bp, Artificial Sequence
  Synthetic
acgacgctatggagcagggagtgagagactacgttgaacaactcgggaacgcttttggctcagggttcactaacc

SEQ ID NO: 70123 - DNA, 75 bp, Artificial Sequence
  Synthetic
ctctagtcaaaatcatatcagcactagtcattgtcgtgaggaatcacgatgacctcatcacagtcacagccactc

SEQ ID NO: 70124 - DNA, 75 bp, Artificial Sequence
  Synthetic
agtcattgtcgtgaggaatcacgatgacctcatcacagtcacagccactctcgcgctcatcggttgcacttcctc

SEQ ID NO: 70125 - DNA, 75 bp, Artificial Sequence
  Synthetic
aaccagtctgtctactgctccatggaagccccggagccgggaaatccgtggcaaccaacctaatcgggcgctcac

SEQ ID NO: 70126 - DNA, 75 bp, Artificial Sequence
  Synthetic
ctgttgtaatcatggacgacttatgccaaaaccccgatggtaaagatgtgtctttattttgtcagatggtctcta

SEQ ID NO: 70127 - DNA, 75 bp, Artificial Sequence
  Synthetic
ccaaaaccccgatggtaaagatgtgtctttattttgtcagatggtctctagtgtcgacttcgttccaccaatggc

SEQ ID NO: 70128 - DNA, 75 bp, Artificial Sequence
  Synthetic
acccactgtgtcagacagtagagcgctcgctaggaggttccacttcgacatgaacatagaggtcatctctatgta

SEQ ID NO: 70129 - DNA, 75 bp, Artificial Sequence
  Synthetic
aggagtgttgccctgtcaatttcaagaagtgttgcccacttgtatgtggtaaagccatccagttcattgacagaa

SEQ ID NO: 70130 - DNA, 75 bp, Artificial Sequence
  Synthetic
gagtataatcacagacatagtgtgggagcaacacttgaggctcttttccaaggtccaccagtgtatagagaaatc

SEQ ID NO: 70131 - DNA, 75 bp, Artificial Sequence
  Synthetic
gagcaacacttgaggctcttttccaaggtccaccagtgtatagagaaatcaagattagcgttgctccggagattc

SEQ ID NO: 70132 - DNA, 75 bp, Artificial Sequence
  Synthetic
gatggttagtgcccgagattaactctaccttacaaattgaaaaacacgtgagtagggctttcatatgcctgcaag

SEQ ID NO: 70133 - DNA, 75 bp, Artificial Sequence
  Synthetic
agtagggctttcatatgcctgcaagcactcactacctttgtctctgtggcagggatcatttacatcatatacaag

SEQ ID NO: 70134 - DNA, 75 bp, Artificial Sequence
  Synthetic
aaagttcagggtcccgcctttgaattcgccgtggctatgatgaagagaaatgctagtacagtaaaaacagagtac

SEQ ID NO: 70135 - DNA, 75 bp, Artificial Sequence
  Synthetic
ctaatgaatgaacaagaagtgggtgtggttgatgcaaaagaattggtggataaggatggtaccaacctagagctg

SEQ ID NO: 70136 - DNA, 75 bp, Artificial Sequence
  Synthetic
tggttgatgcaaaagaattggtggataaggatggtaccaacctagagctgacactcctaaaactcaacaggaatg

SEQ ID NO: 70137 - DNA, 75 bp, Artificial Sequence
  Synthetic
ctagcaaatttccaaacatgtacatccccgttggtcaagtaacagattatggtttcctaaatctgggtgggaccc

SEQ ID NO: 70138 - DNA, 75 bp, Artificial Sequence
  Synthetic
caacggtcaccagggcttctcagcggccctgctacgccactatttcaatgatgaacagggcgaaattgagttcat

SEQ ID NO: 70139 - DNA, 75 bp, Artificial Sequence
  Synthetic
caaaactcgagcccagtgttttccatcaagtgtttgaagggaataaggaacctgcagtgttgaggaatggggacc

SEQ ID NO: 70140 - DNA, 75 bp, Artificial Sequence
  Synthetic
aacgtgaacacacatgtggatgagtacatgatggaggccgttgaccattatgccggacagctagcaaccttagac

SEQ ID NO: 70141 - DNA, 75 bp, Artificial Sequence
  Synthetic
atccaagaagactaaggacttgacaaagctgaaggagtgcatggacaagtatggattgaacctccccatggtcac

SEQ ID NO: 70142 - DNA, 75 bp, Artificial Sequence
  Synthetic
caatgactcagtagctatgagacaaacttttgggaacctgtacaaaacattccacctaaacccaggcatagtgac

SEQ ID NO: 70143 - DNA, 75 bp, Artificial Sequence
  Synthetic
acttttgggaacctgtacaaaacattccacctaaacccaggcatagtgacaggcagcgcagtcggttgtgaccct

SEQ ID NO: 70144 - DNA, 75 bp, Artificial Sequence
  Synthetic
agcttgagcccggtgtggttcgcctgtctgaaattgttactagagaaattgggatacacgcacaaagacaccaac

SEQ ID NO: 70145 - DNA, 75 bp, Artificial Sequence
  Synthetic
gggatacacgcacaaagacaccaactacatagattacctatgcaactctcaccacctgtacagggacaaacacta

SEQ ID NO: 70146 - DNA, 75 bp, Artificial Sequence
  Synthetic
acaccatgatcaacaacataattattagaacactgatgttgaaagtgtataaggggatagacttagatcagttca

SEQ ID NO: 70147 - DNA, 75 bp, Artificial Sequence
  Synthetic
caccctgtgatgccaatgaaagatatacatgaatcaattaggtggactaaagaccccaaaaacacccaggaccat

SEQ ID NO: 70148 - DNA, 75 bp, Artificial Sequence
  Synthetic
ggcacaacggagagcacgaatacgaagaattcgtgtccaagatcaggagcgtcccagtagggcgctgtttgaccc

SEQ ID NO: 70149 - DNA, 75 bp, Artificial Sequence
  Synthetic
atccacagggcccaccgggcgctagcacactggtatctcggtacctttgtgcgcctgttttatccacccttttcc

SEQ ID NO: 70150 - DNA, 75 bp, Artificial Sequence
  Synthetic
ttgggtgtccgtgtttccttttattcttactctggctgcttatggtgacaattgaaaggttgttaccatatagct

SEQ ID NO: 70151 - DNA, 75 bp, Artificial Sequence
  Synthetic
ctttaaacactcttaacttcattctaatccttaattcactaaaatgggagcacaggtttccacgcagaagacagg

SEQ ID NO: 70152 - DNA, 75 bp, Artificial Sequence
  Synthetic
aatccttaattcactaaaatgggagcacaggtttccacgcagaagacaggtgcgcacgagaccagcttgaacgcc

SEQ ID NO: 70153 - DNA, 75 bp, Artificial Sequence
  Synthetic
gagttgcaacaagatcccggcaagtttactgaccctgtgaaagatttaatggtgaaaacccttcctgctttgaac

SEQ ID NO: 70154 - DNA, 75 bp, Artificial Sequence
  Synthetic
ttactgaccctgtgaaagatttaatggtgaaaacccttcctgctttgaactcccccagcgccgaggaatgcggat

SEQ ID NO: 70155 - DNA, 75 bp, Artificial Sequence
  Synthetic
ggtacggagagtggccatcttatctgagtgataaggaagcaactgcggaggaccaaccaactcagccagatgtgg

SEQ ID NO: 70156 - DNA, 75 bp, Artificial Sequence
  Synthetic
gagtgataaggaagcaactgcggaggaccaaccaactcagccagatgtggccacttgcaggttctatactttgga

SEQ ID NO: 70157 - DNA, 75 bp, Artificial Sequence
  Synthetic
cgggcaaaatatgcactatcactacttgggaagggcaggatataccatacatgtacagtgcaacgcctccaaatt

SEQ ID NO: 70158 - DNA, 75 bp, Artificial Sequence
  Synthetic
ttgggaagggcaggatataccatacatgtacagtgcaacgcctccaaatttcatcaagggtgcttgttagtggtg

SEQ ID NO: 70159 - DNA, 75 bp, Artificial Sequence
  Synthetic
gaaccccatgtgttcacctcggattcgataacagggaagaaggtgcaggcggcagtgtgtaatgcaggaatgggg

SEQ ID NO: 70160 - DNA, 75 bp, Artificial Sequence
  Synthetic
cgataacagggaagaaggtgcaggcggcagtgtgtaatgcaggaatgggggttggtgtgggcaacctgacgatat

SEQ ID NO: 70161 - DNA, 75 bp, Artificial Sequence
  Synthetic
tggacaatatgtttagacattacaatttcacgctgatgataataccttttgccccactgaactacaatgagggtg

SEQ ID NO: 70162 - DNA, 75 bp, Artificial Sequence
  Synthetic
tttcacgctgatgataataccttttgccccactgaactacaatgagggtgcaacggcgtatgtgccagtcacagt

SEQ ID NO: 70163 - DNA, 75 bp, Artificial Sequence
  Synthetic
gcctggtagcactcaatttctaacatcagatgattttcaatcgccctccgctatgccacaatttgatgagacccc

SEQ ID NO: 70164 - DNA, 75 bp, Artificial Sequence
  Synthetic
tcagatgattttcaatcgccctccgctatgccacaatttgatgagaccccagagatgcacataccaggagaagtt

SEQ ID NO: 70165 - DNA, 75 bp, Artificial Sequence
  Synthetic
gaggcttatcagattgctgtggggacagggaatactgacaaaaccaagcccatcttcagctttcaaatggatccg

SEQ ID NO: 70166 - DNA, 75 bp, Artificial Sequence
  Synthetic
cagggaatactgacaaaaccaagcccatcttcagctttcaaatggatccggggtactctagtgtgctgaagcgta

SEQ ID NO: 70167 - DNA, 75 bp, Artificial Sequence
  Synthetic
cagctatggccacaggcaaactattgatctcatactcacccccgggagcttccgtccccacctcgcgaaaggatg

SEQ ID NO: 70168 - DNA, 75 bp, Artificial Sequence
  Synthetic
gatctcatactcacccccgggagcttccgtccccacctcgcgaaaggatgcgatgttgggtacgcatatcatatg

SEQ ID NO: 70169 - DNA, 75 bp, Artificial Sequence
  Synthetic
tgacccgtacaccagtgctggttacataacatgttggtaccaaacgaacatcgtggtccctcctggcgcacccac

SEQ ID NO: 70170 - DNA, 75 bp, Artificial Sequence
  Synthetic
ataacatgttggtaccaaacgaacatcgtggtccctcctggcgcacccactagttgcgacgtgttgtgctttgca

SEQ ID NO: 70171 - DNA, 75 bp, Artificial Sequence
  Synthetic
gacaaccaagatagaacagtcgcagacacacaaccgagcggcccatcaaactcaaaggagatacctgcacttaca

SEQ ID NO: 70172 - DNA, 75 bp, Artificial Sequence
  Synthetic
acacacaaccgagcggcccatcaaactcaaaggagatacctgcacttacagccgttgagacaggacacacctcac

SEQ ID NO: 70173 - DNA, 75 bp, Artificial Sequence
  Synthetic
acttcatggggcgtgccgcctgcgtgttcatggaccagtacaagttaaatggagaggaaacatccaccgacaact

SEQ ID NO: 70174 - DNA, 75 bp, Artificial Sequence
  Synthetic
gttcatggaccagtacaagttaaatggagaggaaacatccaccgacaactttgcagtgtggaccataaacgttag

SEQ ID NO: 70175 - DNA, 75 bp, Artificial Sequence
  Synthetic
tactagctgccaagatcaagggacgcagttagagcaagacatgcctgtcttgacacaccagatcatgtatgtccc

SEQ ID NO: 70176 - DNA, 75 bp, Artificial Sequence
  Synthetic
cagttagagcaagacatgcctgtcttgacacaccagatcatgtatgtcccaccgggaggaccaataccagccaaa

SEQ ID NO: 70177 - DNA, 75 bp, Artificial Sequence
  Synthetic
tcaattccattcattagcgtgggtaatgcgtatagtttgttctacgatggatggtcacactttacacaggacggg

SEQ ID NO: 70178 - DNA, 75 bp, Artificial Sequence
  Synthetic
atgcgtatagtttgttctacgatggatggtcacactttacacaggacgggacttacggttacacgactctaaatg

SEQ ID NO: 70179 - DNA, 75 bp, Artificial Sequence
  Synthetic
tcaagccaaagcacataaaagcttgggtaccacgcccaccgaggttgtgcccttacattaacaaaagtgatgtga

SEQ ID NO: 70180 - DNA, 75 bp, Artificial Sequence
  Synthetic
ggtaccacgcccaccgaggttgtgcccttacattaacaaaagtgatgtgaacttcgtggtcacagaagtcactga

SEQ ID NO: 70181 - DNA, 75 bp, Artificial Sequence
  Synthetic
gtctggggcagtatatataggcaattacagggttgtaaacaggcacttagcaacccactttgattggcaaaactg

SEQ ID NO: 70182 - DNA, 75 bp, Artificial Sequence
  Synthetic
tacagggttgtaaacaggcacttagcaacccactttgattggcaaaactgcgtgtgggaggattgcaacagagac

SEQ ID NO: 70183 - DNA, 75 bp, Artificial Sequence
  Synthetic
tgtcaatcaaaaaacaagcattacccgataagctttgagggacccggccttgtagaagtacaggagagtgaatac

SEQ ID NO: 70184 - DNA, 75 bp, Artificial Sequence
  Synthetic
cgataagctttgagggacccggccttgtagaagtacaggagagtgaatactaccctaaaagataccagtctcatg

SEQ ID NO: 70185 - DNA, 75 bp, Artificial Sequence
  Synthetic
tcgtgaccatgggaggagaaggtgtggtcggctttgccgacgtgcgtgatctcctgtggttggaagatgatgcaa

SEQ ID NO: 70186 - DNA, 75 bp, Artificial Sequence
  Synthetic
accccagtgtagatcaggtcgatgagtcaccgcaatcctcacgggcgaccgtggcggtggctgcgctggcggcct

SEQ ID NO: 70187 - DNA, 75 bp, Artificial Sequence
  Synthetic
ggtcggctttgccgacgtgcgtgatctcctgtggttggaagatgatgcaatggaacagggggtgaaagattatgt

SEQ ID NO: 70188 - DNA, 75 bp, Artificial Sequence
  Synthetic
gcttgtgggtcaagactccattctggagaagtctctaaaagccttggtgagaataatatcagctctagtaatagt

SEQ ID NO: 70189 - DNA, 75 bp, Artificial Sequence
  Synthetic
gagaagtctctaaaagccttggtgagaataatatcagctctagtaatagtggtgaggaaccatgatgacctgatt

SEQ ID NO: 70190 - DNA, 75 bp, Artificial Sequence
  Synthetic
ttattggctgcttatggtgacaattgagagattgttaccatatagctattggattggccatccggtgagcgacag

SEQ ID NO: 70191 - DNA, 75 bp, Artificial Sequence
  Synthetic
tactacggcatacccatggccgagcgccagaacagcggatggctcaagaagtttacagagatgaccaacgcctgc

SEQ ID NO: 70192 - DNA, 75 bp, Artificial Sequence
  Synthetic
cttaaactcgcagaaatgggggcacaggtctcaacgcagaaaactggtgcacacgaaacagggctgaacgctagc

SEQ ID NO: 70193 - DNA, 75 bp, Artificial Sequence
  Synthetic
agagaaaaacacgagttcctaaacagattgaaacagctccccctgctggagagtcagattgccacaattgagcag

SEQ ID NO: 70194 - DNA, 75 bp, Artificial Sequence
  Synthetic
gattgaaacagctccccctgctggagagtcagattgccacaattgagcagagtgcaccgtcccagagtgatcaag

SEQ ID NO: 70195 - DNA, 75 bp, Artificial Sequence
  Synthetic
aaagagtgttttcccttgagaagaagatgtgcaattacatacagttcaagtccaaatgccgtattgaacctgtat

SEQ ID NO: 70196 - DNA, 75 bp, Artificial Sequence
  Synthetic
aattaaacagttcggtatactcactgccaccagatccagatcacttcgacggttacaaacaacaagcagtagtga

SEQ ID NO: 70197 - DNA, 75 bp, Artificial Sequence
  Synthetic
gccaccagatccagatcacttcgacggttacaaacaacaagcagtagtgatcatggacgacctgtgccagaatcc

SEQ ID NO: 70198 - DNA, 75 bp, Artificial Sequence
  Synthetic
ggagaagggcattctgtttacatccccctttgtcctggcatcaaccaatgcgggatccatcaatgccccgacagt

SEQ ID NO: 70199 - DNA, 75 bp, Artificial Sequence
  Synthetic
ccctttgtcctggcatcaaccaatgcgggatccatcaatgccccgacagtatctgacagcagagccctagcgagg

SEQ ID NO: 70200 - DNA, 75 bp, Artificial Sequence
  Synthetic
ttgcatctggttccaacaagttagtgcagagagtggtatataacgcaggtatggggattggtgtagggaatttaa

SEQ ID NO: 70201 - DNA, 75 bp, Artificial Sequence
  Synthetic
gtgaagacgtgtgatgaagagtgttgtccagccaacttcaagaaatgttgcccgctagtatgtggaaaggccatc

SEQ ID NO: 70202 - DNA, 75 bp, Artificial Sequence
  Synthetic
gtccagccaacttcaagaaatgttgcccgctagtatgtggaaaggccatccaattcattgacaggaggactcagg

SEQ ID NO: 70203 - DNA, 75 bp, Artificial Sequence
  Synthetic
tcgaggcattatttcaaggaccaccggtatatagagaaatcaaaattagcgtggcaccagaaataccgccgccgc

SEQ ID NO: 70204 - DNA, 75 bp, Artificial Sequence
  Synthetic
ggtatatagagaaatcaaaattagcgtggcaccagaaataccgccgccgccatccattgcagacttacttaagtc

SEQ ID NO: 70205 - DNA, 75 bp, Artificial Sequence
  Synthetic
aatagagaagcatgttagcagagccttcatctgtctacaggcattgactacatttgtttctgtagcaggaatcat

SEQ ID NO: 70206 - DNA, 75 bp, Artificial Sequence
  Synthetic
ttcatctgtctacaggcattgactacatttgtttctgtagcaggaatcatctatataatttacaagctctttgca

SEQ ID NO: 70207 - DNA, 75 bp, Artificial Sequence
  Synthetic
ggacccgcttttgaattcgctgtggccatgatgaaaaggaattctagcactgtgaagactgaatacggtgagttc

SEQ ID NO: 70208 - DNA, 75 bp, Artificial Sequence
  Synthetic
ccatgatgaaaaggaattctagcactgtgaagactgaatacggtgagttcacgatgttgggcatctatgataggt

SEQ ID NO: 70209 - DNA, 75 bp, Artificial Sequence
  Synthetic
caaaggaactggtggacaaagacggtaccaacctagaattgacactcctcaagttgaacagaaatgaaaagttta

SEQ ID NO: 70210 - DNA, 75 bp, Artificial Sequence
  Synthetic
tgcgtcctgtgcataccatggataagccaaactcactatcggtacgtggcttctgatgaatacacagctggtggt

SEQ ID NO: 70211 - DNA, 75 bp, Artificial Sequence
  Synthetic
taccaacctagaattgacactcctcaagttgaacagaaatgaaaagtttagggacattagaggctttctagctag

SEQ ID NO: 70212 - DNA, 75 bp, Artificial Sequence
  Synthetic
ttctgatgaatacacagctggtggttttattacttgctggtatcaaaccaacattgtggtccctgctgacgcgca

SEQ ID NO: 70213 - DNA, 75 bp, Artificial Sequence
  Synthetic
acaagtcacagattacgggttcctaaatctgggcggcacacccaccaagagaatgcttatgtataactttcccac

SEQ ID NO: 70214 - DNA, 75 bp, Artificial Sequence
  Synthetic
aatctgggcggcacacccaccaagagaatgcttatgtataactttcccactagggctggacagtgtggtggtgtg

SEQ ID NO: 70215 - DNA, 75 bp, Artificial Sequence
  Synthetic
aggcattacttcaatgatgagcaaggagagattgaattcattgaaagctcaaaagaagcagggttcccggtcatc

SEQ ID NO: 70216 - DNA, 75 bp, Artificial Sequence
  Synthetic
gagagattgaattcattgaaagctcaaaagaagcagggttcccggtcatcaacacacccagcaaaactaagctgg

SEQ ID NO: 70217 - DNA, 75 bp, Artificial Sequence
  Synthetic
ccgagacggggcacacatcccaggtggttccaggggacaccatgcaaacgcgccacgtgaagaattatcattcaa

SEQ ID NO: 70218 - DNA, 75 bp, Artificial Sequence
  Synthetic
ccaaacgctatgccgaatgggtggttacaacacgacaggcggcacaactgaggaggaagttggaattcttcacgt

SEQ ID NO: 70219 - DNA, 75 bp, Artificial Sequence
  Synthetic
aagccaactttgaagaggccatattttccaagtacattggaaatgtcaacacacacgtggatgagtacatgctgg

SEQ ID NO: 70220 - DNA, 75 bp, Artificial Sequence
  Synthetic
ttccaagtacattggaaatgtcaacacacacgtggatgagtacatgctggaggcagttgaccactacgctggaca

SEQ ID NO: 70221 - DNA, 75 bp, Artificial Sequence
  Synthetic
tcttgacctaacaacgagtgcaggctatccctacgtcacactgggtattaaaaagagagacatcctttcgaagaa

SEQ ID NO: 70222 - DNA, 75 bp, Artificial Sequence
  Synthetic
tatccctacgtcacactgggtattaaaaagagagacatcctttcgaagaaaacaaaggacttggccaagctgagg

SEQ ID NO: 70223 - DNA, 75 bp, Artificial Sequence
  Synthetic
gcattggtaatgcttattcaaatttttatgatggttggtcagagttctccagaaatggggtgtatggcatcaaca

SEQ ID NO: 70224 - DNA, 75 bp, Artificial Sequence
  Synthetic
gtagcaaaagggaagtctagattgattgaagcatccagtcttaatgattcagtagcaatgagacagacatttggt

SEQ ID NO: 70225 - DNA, 75 bp, Artificial Sequence
  Synthetic
ttgaagcatccagtcttaatgattcagtagcaatgagacagacatttggtaatttgtacaagacttttcacttaa

SEQ ID NO: 70226 - DNA, 75 bp, Artificial Sequence
  Synthetic
acgggcacctcatagcatttgactattcaggttatgatgccagcttgagccctgtttggttcgcctgcctaaaat

SEQ ID NO: 70227 - DNA, 75 bp, Artificial Sequence
  Synthetic
ttcaggttatgatgccagcttgagccctgtttggttcgcctgcctaaaattgttacttgagaagcttgggtacac

SEQ ID NO: 70228 - DNA, 75 bp, Artificial Sequence
  Synthetic
aggtgggatgccctcagggtgctctggtactagcatctttaattcaatgataaacaacatcataattagaaccct

SEQ ID NO: 70229 - DNA, 75 bp, Artificial Sequence
  Synthetic
ggtactagcatctttaattcaatgataaacaacatcataattagaaccctcatgctaaaagtatacaagggaatt

SEQ ID NO: 70230 - DNA, 75 bp, Artificial Sequence
  Synthetic
ggtgtatttttgtgcttccagaaacaagcacttcccagttagctttgaaggcccaggcttggttgaggtgcaaga

SEQ ID NO: 70231 - DNA, 75 bp, Artificial Sequence
  Synthetic
ctacttgctgaggctggtaaagactatgggttgatcatgacaccagcagacaaaggtgaatgcttcaatgaagtt

SEQ ID NO: 70232 - DNA, 75 bp, Artificial Sequence
  Synthetic
atgggttgatcatgacaccagcagacaaaggtgaatgcttcaatgaagttacttggactaacgtcactttcctga

SEQ ID NO: 70233 - DNA, 75 bp, Artificial Sequence
  Synthetic
caattaggtggactaaggatccaaagaacacccaggaccacgtgcgctcactgtgcttgttggcgtggcacaatg

SEQ ID NO: 70234 - DNA, 75 bp, Artificial Sequence
  Synthetic
gagagcacgagtatgaggagttcatccagaagatcaggagtgttccagttgggcgctgcttgaccctccctgcgt

SEQ ID NO: 70235 - DNA, 75 bp, Artificial Sequence
  Synthetic
cactcacagggcccactgggcgctagcaccctggtataacggtaccattgtgcgcctgttttaccacccctttcc

SEQ ID NO: 70236 - DNA, 75 bp, Artificial Sequence
  Synthetic
cactcacagggcccactgggcgctagcaccctggtataacggtacctttgtgcgcctgttttaccacccctttcc

SEQ ID NO: 70237 - DNA, 75 bp, Artificial Sequence
  Synthetic
cactcacagggcccactgggcgctagcaccctggtataacggtacccttgtgcgcctgttttaccacccctttcc

SEQ ID NO: 70238 - DNA, 75 bp, Artificial Sequence
  Synthetic
cactcacagggcccactgggcgctagcaccctggtataacggtaccgttgtgcgcctgttttaccacccctttcc

SEQ ID NO: 70239 - DNA, 75 bp, Artificial Sequence
  Synthetic
cactcacagggcccactgggcgctagcaccctggtattacggtaccattgtgcgcctgttttaccacccctttcc

SEQ ID NO: 70240 - DNA, 75 bp, Artificial Sequence
  Synthetic
cactcacagggcccactgggcgctagcaccctggtattacggtacctttgtgcgcctgttttaccacccctttcc

SEQ ID NO: 70241 - DNA, 75 bp, Artificial Sequence
  Synthetic
cactcacagggcccactgggcgctagcaccctggtattacggtacccttgtgcgcctgttttaccacccctttcc

SEQ ID NO: 70242 - DNA, 75 bp, Artificial Sequence
  Synthetic
cactcacagggcccactgggcgctagcaccctggtattacggtaccgttgtgcgcctgttttaccacccctttcc

SEQ ID NO: 70243 - DNA, 75 bp, Artificial Sequence
  Synthetic
cactcacagggcccactgggcgctagcaccctggtatcacggtaccattgtgcgcctgttttaccacccctttcc

SEQ ID NO: 70244 - DNA, 75 bp, Artificial Sequence
  Synthetic
cactcacagggcccactgggcgctagcaccctggtatcacggtacctttgtgcgcctgttttaccacccctttcc

SEQ ID NO: 70245 - DNA, 75 bp, Artificial Sequence
  Synthetic
cactcacagggcccactgggcgctagcaccctggtatcacggtacccttgtgcgcctgttttaccacccctttcc

SEQ ID NO: 70246 - DNA, 75 bp, Artificial Sequence
  Synthetic
cactcacagggcccactgggcgctagcaccctggtatcacggtaccgttgtgcgcctgttttaccacccctttcc

SEQ ID NO: 70247 - DNA, 75 bp, Artificial Sequence
  Synthetic
cactcacagggcccactgggcgctagcaccctggtatgacggtaccattgtgcgcctgttttaccacccctttcc

SEQ ID NO: 70248 - DNA, 75 bp, Artificial Sequence
  Synthetic
cactcacagggcccactgggcgctagcaccctggtatgacggtacctttgtgcgcctgttttaccacccctttcc

SEQ ID NO: 70249 - DNA, 75 bp, Artificial Sequence
  Synthetic
cactcacagggcccactgggcgctagcaccctggtatgacggtacccttgtgcgcctgttttaccacccctttcc

SEQ ID NO: 70250 - DNA, 75 bp, Artificial Sequence
  Synthetic
cactcacagggcccactgggcgctagcaccctggtatgacggtaccgttgtgcgcctgttttaccacccctttcc

SEQ ID NO: 70251 - DNA, 75 bp, Artificial Sequence
  Synthetic
ctctcacagggcccactgggcgctagcaccctggtataacggtaccattgtgcgcctgttttaccacccctttcc

SEQ ID NO: 70252 - DNA, 75 bp, Artificial Sequence
  Synthetic
ctctcacagggcccactgggcgctagcaccctggtataacggtacctttgtgcgcctgttttaccacccctttcc

SEQ ID NO: 70253 - DNA, 75 bp, Artificial Sequence
  Synthetic
ctctcacagggcccactgggcgctagcaccctggtataacggtacccttgtgcgcctgttttaccacccctttcc

SEQ ID NO: 70254 - DNA, 75 bp, Artificial Sequence
  Synthetic
ctctcacagggcccactgggcgctagcaccctggtataacggtaccgttgtgcgcctgttttaccacccctttcc

SEQ ID NO: 70255 - DNA, 75 bp, Artificial Sequence
  Synthetic
ctctcacagggcccactgggcgctagcaccctggtattacggtaccattgtgcgcctgttttaccacccctttcc

SEQ ID NO: 70256 - DNA, 75 bp, Artificial Sequence
  Synthetic
ctctcacagggcccactgggcgctagcaccctggtattacggtacctttgtgcgcctgttttaccacccctttcc

SEQ ID NO: 70257 - DNA, 75 bp, Artificial Sequence
  Synthetic
ctctcacagggcccactgggcgctagcaccctggtattacggtacccttgtgcgcctgttttaccacccctttcc

SEQ ID NO: 70258 - DNA, 75 bp, Artificial Sequence
  Synthetic
ctctcacagggcccactgggcgctagcaccctggtattacggtaccgttgtgcgcctgttttaccacccctttcc

SEQ ID NO: 70259 - DNA, 75 bp, Artificial Sequence
  Synthetic
ctctcacagggcccactgggcgctagcaccctggtatcacggtaccattgtgcgcctgttttaccacccctttcc

SEQ ID NO: 70260 - DNA, 75 bp, Artificial Sequence
  Synthetic
ctctcacagggcccactgggcgctagcaccctggtatcacggtacctttgtgcgcctgttttaccacccctttcc

SEQ ID NO: 70261 - DNA, 75 bp, Artificial Sequence
  Synthetic
ctctcacagggcccactgggcgctagcaccctggtatcacggtacccttgtgcgcctgttttaccacccctttcc

SEQ ID NO: 70262 - DNA, 75 bp, Artificial Sequence
  Synthetic
ctctcacagggcccactgggcgctagcaccctggtatcacggtaccgttgtgcgcctgttttaccacccctttcc

SEQ ID NO: 70263 - DNA, 75 bp, Artificial Sequence
  Synthetic
ctctcacagggcccactgggcgctagcaccctggtatgacggtaccattgtgcgcctgttttaccacccctttcc

SEQ ID NO: 70264 - DNA, 75 bp, Artificial Sequence
  Synthetic
ctctcacagggcccactgggcgctagcaccctggtatgacggtacctttgtgcgcctgttttaccacccctttcc

SEQ ID NO: 70265 - DNA, 75 bp, Artificial Sequence
  Synthetic
ctctcacagggcccactgggcgctagcaccctggtatgacggtacccttgtgcgcctgttttaccacccctttcc

SEQ ID NO: 70266 - DNA, 75 bp, Artificial Sequence
  Synthetic
ctctcacagggcccactgggcgctagcaccctggtatgacggtaccgttgtgcgcctgttttaccacccctttcc

SEQ ID NO: 70267 - DNA, 75 bp, Artificial Sequence
  Synthetic
ccctcacagggcccactgggcgctagcaccctggtataacggtaccattgtgcgcctgttttaccacccctttcc

SEQ ID NO: 70268 - DNA, 75 bp, Artificial Sequence
  Synthetic
ccctcacagggcccactgggcgctagcaccctggtataacggtacctttgtgcgcctgttttaccacccctttcc

SEQ ID NO: 70269 - DNA, 75 bp, Artificial Sequence
  Synthetic
ccctcacagggcccactgggcgctagcaccctggtataacggtacccttgtgcgcctgttttaccacccctttcc

SEQ ID NO: 70270 - DNA, 75 bp, Artificial Sequence
  Synthetic
ccctcacagggcccactgggcgctagcaccctggtataacggtaccgttgtgcgcctgttttaccacccctttcc

SEQ ID NO: 70271 - DNA, 75 bp, Artificial Sequence
  Synthetic
ccctcacagggcccactgggcgctagcaccctggtattacggtaccattgtgcgcctgttttaccacccctttcc

SEQ ID NO: 70272 - DNA, 75 bp, Artificial Sequence
  Synthetic
ccctcacagggcccactgggcgctagcaccctggtattacggtacctttgtgcgcctgttttaccacccctttcc

SEQ ID NO: 70273 - DNA, 75 bp, Artificial Sequence
  Synthetic
ccctcacagggcccactgggcgctagcaccctggtattacggtacccttgtgcgcctgttttaccacccctttcc

SEQ ID NO: 70274 - DNA, 75 bp, Artificial Sequence
  Synthetic
ccctcacagggcccactgggcgctagcaccctggtattacggtaccgttgtgcgcctgttttaccacccctttcc

SEQ ID NO: 70275 - DNA, 75 bp, Artificial Sequence
  Synthetic
ccctcacagggcccactgggcgctagcaccctggtatcacggtaccattgtgcgcctgttttaccacccctttcc

SEQ ID NO: 70276 - DNA, 75 bp, Artificial Sequence
  Synthetic
ccctcacagggcccactgggcgctagcaccctggtatcacggtacctttgtgcgcctgttttaccacccctttcc

SEQ ID NO: 70277 - DNA, 75 bp, Artificial Sequence
  Synthetic
ccctcacagggcccactgggcgctagcaccctggtatcacggtacccttgtgcgcctgttttaccacccctttcc

SEQ ID NO: 70278 - DNA, 75 bp, Artificial Sequence
  Synthetic
ccctcacagggcccactgggcgctagcaccctggtatcacggtaccgttgtgcgcctgttttaccacccctttcc

SEQ ID NO: 70279 - DNA, 75 bp, Artificial Sequence
  Synthetic
ccctcacagggcccactgggcgctagcaccctggtatgacggtaccattgtgcgcctgttttaccacccctttcc

SEQ ID NO: 70280 - DNA, 75 bp, Artificial Sequence
  Synthetic
ccctcacagggcccactgggcgctagcaccctggtatgacggtacctttgtgcgcctgttttaccacccctttcc

SEQ ID NO: 70281 - DNA, 75 bp, Artificial Sequence
  Synthetic
ccctcacagggcccactgggcgctagcaccctggtatgacggtacccttgtgcgcctgttttaccacccctttcc

SEQ ID NO: 70282 - DNA, 75 bp, Artificial Sequence
  Synthetic
ccctcacagggcccactgggcgctagcaccctggtatgacggtaccgttgtgcgcctgttttaccacccctttcc

SEQ ID NO: 70283 - DNA, 75 bp, Artificial Sequence
  Synthetic
cgctcacagggcccactgggcgctagcaccctggtataacggtaccattgtgcgcctgttttaccacccctttcc

SEQ ID NO: 70284 - DNA, 75 bp, Artificial Sequence
  Synthetic
cgctcacagggcccactgggcgctagcaccctggtataacggtacctttgtgcgcctgttttaccacccctttcc

SEQ ID NO: 70285 - DNA, 75 bp, Artificial Sequence
  Synthetic
cgctcacagggcccactgggcgctagcaccctggtataacggtacccttgtgcgcctgttttaccacccctttcc

SEQ ID NO: 70286 - DNA, 75 bp, Artificial Sequence
  Synthetic
cgctcacagggcccactgggcgctagcaccctggtataacggtaccgttgtgcgcctgttttaccacccctttcc

SEQ ID NO: 70287 - DNA, 75 bp, Artificial Sequence
  Synthetic
cgctcacagggcccactgggcgctagcaccctggtattacggtaccattgtgcgcctgttttaccacccctttcc

SEQ ID NO: 70288 - DNA, 75 bp, Artificial Sequence
  Synthetic
cgctcacagggcccactgggcgctagcaccctggtattacggtacctttgtgcgcctgttttaccacccctttcc

SEQ ID NO: 70289 - DNA, 75 bp, Artificial Sequence
  Synthetic
cgctcacagggcccactgggcgctagcaccctggtattacggtacccttgtgcgcctgttttaccacccctttcc

SEQ ID NO: 70290 - DNA, 75 bp, Artificial Sequence
  Synthetic
cgctcacagggcccactgggcgctagcaccctggtattacggtaccgttgtgcgcctgttttaccacccctttcc

SEQ ID NO: 70291 - DNA, 75 bp, Artificial Sequence
  Synthetic
cgctcacagggcccactgggcgctagcaccctggtatcacggtaccattgtgcgcctgttttaccacccctttcc

SEQ ID NO: 70292 - DNA, 75 bp, Artificial Sequence
  Synthetic
cgctcacagggcccactgggcgctagcaccctggtatcacggtacctttgtgcgcctgttttaccacccctttcc

SEQ ID NO: 70293 - DNA, 75 bp, Artificial Sequence
  Synthetic
cgctcacagggcccactgggcgctagcaccctggtatcacggtacccttgtgcgcctgttttaccacccctttcc

SEQ ID NO: 70294 - DNA, 75 bp, Artificial Sequence
  Synthetic
cgctcacagggcccactgggcgctagcaccctggtatcacggtaccgttgtgcgcctgttttaccacccctttcc

SEQ ID NO: 70295 - DNA, 75 bp, Artificial Sequence
  Synthetic
cgctcacagggcccactgggcgctagcaccctggtatgacggtaccattgtgcgcctgttttaccacccctttcc

SEQ ID NO: 70296 - DNA, 75 bp, Artificial Sequence
  Synthetic
cgctcacagggcccactgggcgctagcaccctggtatgacggtacctttgtgcgcctgttttaccacccctttcc

SEQ ID NO: 70297 - DNA, 75 bp, Artificial Sequence
  Synthetic
cgctcacagggcccactgggcgctagcaccctggtatgacggtacccttgtgcgcctgttttaccacccctttcc

SEQ ID NO: 70298 - DNA, 75 bp, Artificial Sequence
  Synthetic
cgctcacagggcccactgggcgctagcaccctggtatgacggtaccgttgtgcgcctgttttaccacccctttcc

SEQ ID NO: 70299 - DNA, 75 bp, Artificial Sequence
  Synthetic
tagaatggctcaaagtcaagatcctgccagaggtgaaggagaaacatgagttcctaaccagacttaaacaactcc

SEQ ID NO: 70300 - DNA, 75 bp, Artificial Sequence
  Synthetic
cttcgagaaacccagtaccaccatgaaagttgcgcagtgtttcgctccgcacaaccccagtgtagatcaggtcga

SEQ ID NO: 70301 - DNA, 75 bp, Artificial Sequence
  Synthetic
tgagtcaccgcatcccccacaggtgactgtggcggtggctgcgttggcggcctgcccatggggcaacccatggga

SEQ ID NO: 70302 - DNA, 75 bp, Artificial Sequence
  Synthetic
ctccggcccctgaatgcggctaatcctaactgtggagcagatacccacacaccagtgggcagtctgtcgtaatgg

SEQ ID NO: 70303 - DNA, 75 bp, Artificial Sequence
  Synthetic
tttgggtgtccgtgtttccttttattctcatattggctgcttatggtgacaattgaaaggttgttgccatatagc

SEQ ID NO: 70304 - DNA, 75 bp, Artificial Sequence
  Synthetic
ctgctttggaagagaaaggtattttgtttacctccccctttgtcttggcttcgaccaatgctggttccatcaatg

SEQ ID NO: 70305 - DNA, 75 bp, Artificial Sequence
  Synthetic
gtccttaatactcttaactacatcataaacctcaatacgacgcgatgggagcgcaggtgtcaacgcagaaaaccg

SEQ ID NO: 70306 - DNA, 75 bp, Artificial Sequence
  Synthetic
taaacctcaatacgacgcgatgggagcgcaggtgtcaacgcagaaaaccggagcgcatgagaccagcctgaaagc

SEQ ID NO: 70307 - DNA, 75 bp, Artificial Sequence
  Synthetic
aaaagtgctgcccccttgtatgcgggaaagctatacagtttattgacagaaggactcaaatgagatactccttgg

SEQ ID NO: 70308 - DNA, 75 bp, Artificial Sequence
  Synthetic
agacatgacacaagacccatccaaattcacagagccaatgaaagacatcatgataaagtcactaccggcgttaaa

SEQ ID NO: 70309 - DNA, 75 bp, Artificial Sequence
  Synthetic
ttcacagagccaatgaaagacatcatgataaagtcactaccggcgttaaactcacctactgtggaggagtgcggg

SEQ ID NO: 70310 - DNA, 75 bp, Artificial Sequence
  Synthetic
aaggtccaccagtatacagggaaattaaaatcagtgtcgcacctgagaccccaccaccaccagctattgcagatt

SEQ ID NO: 70311 - DNA, 75 bp, Artificial Sequence
  Synthetic
gcgtatggtgagtggccggagtatctatctgacaaagaagcaactgccgaggatcagcccacccagccagacgtg

SEQ ID NO: 70312 - DNA, 75 bp, Artificial Sequence
  Synthetic
tatctgacaaagaagcaactgccgaggatcagcccacccagccagacgtggctacttgccgcttctacacattag

SEQ ID NO: 70313 - DNA, 75 bp, Artificial Sequence
  Synthetic
ggatggcttgttcctgagattagctctacccttcagattgagaagcatgtcagtcgagccttcatctgccttcag

SEQ ID NO: 70314 - DNA, 75 bp, Artificial Sequence
  Synthetic
tcggacaaaacatgcactatcactacctgggcagagcggggtacacgattcacgtgcagtgcaacgcatccaagt

SEQ ID NO: 70315 - DNA, 75 bp, Artificial Sequence
  Synthetic
cctgggcagagcggggtacacgattcacgtgcagtgcaacgcatccaagtttcaccaagggtgcctactagtagt

SEQ ID NO: 70316 - DNA, 75 bp, Artificial Sequence
  Synthetic
agcaccttgcactttcacaaaaattaaatcctcagaacagaatggggtgcaaaccatagtgtgcaacgccggtat

SEQ ID NO: 70317 - DNA, 75 bp, Artificial Sequence
  Synthetic
aaatcctcagaacagaatggggtgcaaaccatagtgtgcaacgccggtatgggggttggtgttggtaatctgaca

SEQ ID NO: 70318 - DNA, 75 bp, Artificial Sequence
  Synthetic
ccaatggacaatatgtttaggcattacaatttcaccctcatgatcattcccttctctcctctcaaatttgctggc

SEQ ID NO: 70319 - DNA, 75 bp, Artificial Sequence
  Synthetic
acaatttcaccctcatgatcattcccttctctcctctcaaatttgctggcacagctacatacgtgcctatcacag

SEQ ID NO: 70320 - DNA, 75 bp, Artificial Sequence
  Synthetic
tcctggccaaagaagaggtggaagttaatgaagctgttctggcaataaacactagcaagttcccgaacatgtata

SEQ ID NO: 70321 - DNA, 75 bp, Artificial Sequence
  Synthetic
caccaggcagttcccagtttttgacatccgacgactaccagtcaccatccgcaatgccacagttcgatgtgaccc

SEQ ID NO: 70322 - DNA, 75 bp, Artificial Sequence
  Synthetic
atccgacgactaccagtcaccatccgcaatgccacagttcgatgtgaccccaccgatgcatataccaggcgaagt

SEQ ID NO: 70323 - DNA, 75 bp, Artificial Sequence
  Synthetic
ttgagagttcaaaggaagcaggtttcccagtcatcaacacaccgagcagaaccaaattagaaccaagtgtgttcc

SEQ ID NO: 70324 - DNA, 75 bp, Artificial Sequence
  Synthetic
ggaagcattctgcgtgccagtgaatacagggagccactccactgataccgccatcttctctttccaattagatcc

SEQ ID NO: 70325 - DNA, 75 bp, Artificial Sequence
  Synthetic
acagggagccactccactgataccgccatcttctctttccaattagatcctggcaatggatcagtgctacagcgc

SEQ ID NO: 70326 - DNA, 75 bp, Artificial Sequence
  Synthetic
aagcaatcttctctaagtacattggcaatgtgaacacacatgtggatgaatacatgatggaagctgttgatcatt

SEQ ID NO: 70327 - DNA, 75 bp, Artificial Sequence
  Synthetic
caatgtgaacacacatgtggatgaatacatgatggaagctgttgatcattacgcaggacaactagccactctgga

SEQ ID NO: 70328 - DNA, 75 bp, Artificial Sequence
  Synthetic
acagcaatgacaacgggtaagctgctcttagcatactccccaccaggcgctggtctcccagccaatcgaaaagac

SEQ ID NO: 70329 - DNA, 75 bp, Artificial Sequence
  Synthetic
tcttagcatactccccaccaggcgctggtctcccagccaatcgaaaagacgccatgctgtgtacccacattatct

SEQ ID NO: 70330 - DNA, 75 bp, Artificial Sequence
  Synthetic
cggacccgtacaccgacgcaggctacatcacctgttggtaccagaccagtgtagtggtaccacctgacaccccaa

SEQ ID NO: 70331 - DNA, 75 bp, Artificial Sequence
  Synthetic
catcacctgttggtaccagaccagtgtagtggtaccacctgacaccccaacatcatgtgatattatgtgttttgt

SEQ ID NO: 70332 - DNA, 75 bp, Artificial Sequence
  Synthetic
agatgaagcacgcaccaccaaggatacagtggccaatacaacaccaagtggtcccgcaaataccgaacaggtacc

SEQ ID NO: 70333 - DNA, 75 bp, Artificial Sequence
  Synthetic
ttccatctgaacccaggaatcgtgaccggtagtgcagttggatgcgatcccgacctcttctggagcaagatccct

SEQ ID NO: 70334 - DNA, 75 bp, Artificial Sequence
  Synthetic
acagtggccaatacaacaccaagtggtcccgcaaataccgaacaggtacctgccctcactgcagtggagactggg

SEQ ID NO: 70335 - DNA, 75 bp, Artificial Sequence
  Synthetic
ccggtagtgcagttggatgcgatcccgacctcttctggagcaagatccctgtgatgctagatgggcatctcatag

SEQ ID NO: 70336 - DNA, 75 bp, Artificial Sequence
  Synthetic
acactagaaaacttcttcggtagagcagcatgcgtgtgcgtgaagcggtatcaaattcgagggactgaggggtca

SEQ ID NO: 70337 - DNA, 75 bp, Artificial Sequence
  Synthetic
ttgggtattcacacaaggagacaaattacattgattatctgtgcaactcccaccacctttacaaggataaacact

SEQ ID NO: 70338 - DNA, 75 bp, Artificial Sequence
  Synthetic
cagcatgcgtgtgcgtgaagcggtatcaaattcgagggactgaggggtcaacagacagatacgctagctggagaa

SEQ ID NO: 70339 - DNA, 75 bp, Artificial Sequence
  Synthetic
ttacattgattatctgtgcaactcccaccacctttacaaggataaacactactttgtgcgtggtggtatgccctc

SEQ ID NO: 70340 - DNA, 75 bp, Artificial Sequence
  Synthetic
cttttgtaataaccagctgccaggaccctggcacaacactggatcaagacatgcctgttctcacacaccaagtta

SEQ ID NO: 70341 - DNA, 75 bp, Artificial Sequence
  Synthetic
caaaggcattgatttggatcaatttagaatgattgcatatggcgatgatgtaattgcctcgtacccatggcccat

SEQ ID NO: 70342 - DNA, 75 bp, Artificial Sequence
  Synthetic
ccctggcacaacactggatcaagacatgcctgttctcacacaccaagttatgtacataccacccggtggcccggt

SEQ ID NO: 70343 - DNA, 75 bp, Artificial Sequence
  Synthetic
agaatgattgcatatggcgatgatgtaattgcctcgtacccatggcccattgacgcctcattgctcgctgaggcc

SEQ ID NO: 70344 - DNA, 75 bp, Artificial Sequence
  Synthetic
accgcggatgtccatacctttcatgagcattggtaacgcctacagtagtttttatgacgggtggtcacattacac

SEQ ID NO: 70345 - DNA, 75 bp, Artificial Sequence
  Synthetic
acattcctaaagagatatttcagagctgatgagcaatacccctttttggtccacccagtaatgcccatgaaggac

SEQ ID NO: 70346 - DNA, 75 bp, Artificial Sequence
  Synthetic
agcattggtaacgcctacagtagtttttatgacgggtggtcacattacacacaggatggagcgtatggttacaca

SEQ ID NO: 70347 - DNA, 75 bp, Artificial Sequence
  Synthetic
ctgatgagcaatacccctttttggtccacccagtaatgcccatgaaggacatacatgaatccatcaggtggacaa

SEQ ID NO: 70348 - DNA, 75 bp, Artificial Sequence
  Synthetic
agggtgtacttcaagcccaaacacatacgagcttgggtaccgcgaccacccaggttgtgcccatacttgcgtaag

SEQ ID NO: 70349 - DNA, 75 bp, Artificial Sequence
  Synthetic
aagagttcattcgcaagatcagaagcgtcccagttgggcgctgtttaactttgcctgcattttcgactttgcgca

SEQ ID NO: 70350 - DNA, 75 bp, Artificial Sequence
  Synthetic
tacgagcttgggtaccgcgaccacccaggttgtgcccatacttgcgtaagggaaacgtgaatttcaatccaacag

SEQ ID NO: 70351 - DNA, 75 bp, Artificial Sequence
  Synthetic
ggaaatggttggactctttctaaactagagacaatttagtataatttaaattggcttaaccctaccgcactaacc

SEQ ID NO: 70352 - DNA, 75 bp, Artificial Sequence
  Synthetic
ttgggcaacaatctggggctgtctacgtgggcaactacagggtggtgaatagacacctcgccacccacagtgact

SEQ ID NO: 70353 - DNA, 75 bp, Artificial Sequence
  Synthetic
cgtgggcaactacagggtggtgaatagacacctcgccacccacagtgactggcaaaactgtgtgtgggaagacta

SEQ ID NO: 70354 - DNA, 75 bp, Artificial Sequence
  Synthetic
ggtgtatttctgtgcctcaaagaaccggcattatccagttagttttgagggaccaggacttgtggaagttcaaga

SEQ ID NO: 70355 - DNA, 75 bp, Artificial Sequence
  Synthetic
cggcattatccagttagttttgagggaccaggacttgtggaagttcaagagagtgagtattatccaaaaaggtac

SEQ ID NO: 70356 - DNA, 75 bp, Artificial Sequence
  Synthetic
gtcatcggcatcgtgactatgggtggcgagggcgttgttgggttcgctgacgtgcgcgaccttctgtggttggag

SEQ ID NO: 70357 - DNA, 75 bp, Artificial Sequence
  Synthetic
gcgagggcgttgttgggttcgctgacgtgcgcgaccttctgtggttggaggatgacgcgatggaacagggggtga

SEQ ID NO: 70358 - DNA, 75 bp, Artificial Sequence
  Synthetic
tcaaagaatcattaattggacaagattccattctggagaaatcacttaaagctttggtcaaaatcatatcagcat

SEQ ID NO: 70359 - DNA, 75 bp, Artificial Sequence
  Synthetic
ttccattctggagaaatcacttaaagctttggtcaaaatcatatcagcattagtcatcgtggtgagaaatcacga

SEQ ID NO: 70360 - DNA, 75 bp, Artificial Sequence
  Synthetic
ggtgtcccaatactacgggattcctatggctgaaaggcaaagtaatgggtggttaaagaagtttactgagatgac

SEQ ID NO: 70361 - DNA, 75 bp, Artificial Sequence
  Synthetic
atggctgaaaggcaaagtaatgggtggttaaagaagtttactgagatgaccaacgcctgtaaaggcatggaatgg

SEQ ID NO: 70362 - DNA, 75 bp, Artificial Sequence
  Synthetic
tttctcaacagactgaagcaactgccactcttggagagccaaattgccaccatagaacagagtgcaccctcgcaa

SEQ ID NO: 70363 - DNA, 75 bp, Artificial Sequence
  Synthetic
cactcttggagagccaaattgccaccatagaacagagtgcaccctcgcaaagcgatcaagaacagctcttctcca

SEQ ID NO: 70364 - DNA, 75 bp, Artificial Sequence
  Synthetic
tggaaaaaaagatgagcaattacatacagttcaagtccaaatgccgtattgaaccagtatgcctgctccttcatg

SEQ ID NO: 70365 - DNA, 75 bp, Artificial Sequence
  Synthetic
acagttcaagtccaaatgccgtattgaaccagtatgcctgctccttcatggcagccccggagctggtaaatcagt

SEQ ID NO: 70366 - DNA, 75 bp, Artificial Sequence
  Synthetic
ccactttgatggatataaacaacaggcggtggtgatcatggatgatctctgtcagaacccagatgggaaggatgt

SEQ ID NO: 70367 - DNA, 75 bp, Artificial Sequence
  Synthetic
gcggtggtgatcatggatgatctctgtcagaacccagatgggaaggatgtgtcgctgttttgtcagatggtatct

SEQ ID NO: 70368 - DNA, 75 bp, Artificial Sequence
  Synthetic
tcgactaacgcaggatccattaacgcgcccacagtgtcagacagcagagcgctcgccagaagattccacttcgac

SEQ ID NO: 70369 - DNA, 75 bp, Artificial Sequence
  Synthetic
cgcccacagtgtcagacagcagagcgctcgccagaagattccacttcgacatgaatatcgaggtggtttccatgt

SEQ ID NO: 70370 - DNA, 75 bp, Artificial Sequence
  Synthetic
aaaagtgttgcccattggtgtgtggtaaggccatccaattcattgataggagaacccaagttagatactcactgg

SEQ ID NO: 70371 - DNA, 75 bp, Artificial Sequence
  Synthetic
taaggccatccaattcattgataggagaacccaagttagatactcactggacatgctggtcactgaaatgtttag

SEQ ID NO: 70372 - DNA, 75 bp, Artificial Sequence
  Synthetic
taaaatcagcgtcgccccagagacaccccctccaccagcaattgccgacctcctaaaatcagtggatagtgaggc

SEQ ID NO: 70373 - DNA, 75 bp, Artificial Sequence
  Synthetic
ccccctccaccagcaattgccgacctcctaaaatcagtggatagtgaggctgtcagagaatactgtaaggagagg

SEQ ID NO: 70374 - DNA, 75 bp, Artificial Sequence
  Synthetic
gccttaactacatttgtttcggtggccggtataatctacattatttacaagttgtttgctggcttccagggtgca

SEQ ID NO: 70375 - DNA, 75 bp, Artificial Sequence
  Synthetic
ccggtataatctacattatttacaagttgtttgctggcttccagggtgcatacactgggatgcctaatcagaaac

SEQ ID NO: 70376 - DNA, 75 bp, Artificial Sequence
  Synthetic
acgctagtacagttaaaacagaatatggtgagtttacaatgcttggcatctatgacaggtgggcagtgctaccgc

SEQ ID NO: 70377 - DNA, 75 bp, Artificial Sequence
  Synthetic
tggtgagtttacaatgcttggcatctatgacaggtgggcagtgctaccgcgccatgctaaacctggacccaccat

SEQ ID NO: 70378 - DNA, 75 bp, Artificial Sequence
  Synthetic
gacactactgaagctcaaccgcaatgagaagttcagggacatcagaggcttccttgcaagggaggaggttgaggt

SEQ ID NO: 70379 - DNA, 75 bp, Artificial Sequence
  Synthetic
gagaagttcagggacatcagaggcttccttgcaagggaggaggttgaggtgaacgaggcggttctggcaataaac

SEQ ID NO: 70380 - DNA, 75 bp, Artificial Sequence
  Synthetic
ccaacgaagagaatgctcatgtacaacttccccaccagagcaggacagtgtggtggtgtcctcatgtcaacagga

SEQ ID NO: 70381 - DNA, 75 bp, Artificial Sequence
  Synthetic
acttccccaccagagcaggacagtgtggtggtgtcctcatgtcaacaggaaaagtccttggaatacatgtgggag

SEQ ID NO: 70382 - DNA, 75 bp, Artificial Sequence
  Synthetic
ttgagagctctaaagatgcaggcttccctgtgattaacacccccagcaaaactaaattggaaccaagtgtgttcc

SEQ ID NO: 70383 - DNA, 75 bp, Artificial Sequence
  Synthetic
ccctgtgattaacacccccagcaaaactaaattggaaccaagtgtgttccatcaggttttcgaaggcaacaagga

SEQ ID NO: 70384 - DNA, 75 bp, Artificial Sequence
  Synthetic
caatgtcaatacacatgtggacgagtacatgcaggaggctgtggaccactatgcagggcaactagccacactaga

SEQ ID NO: 70385 - DNA, 75 bp, Artificial Sequence
  Synthetic
tacatgcaggaggctgtggaccactatgcagggcaactagccacactagacatcagcactgagcccatgaaacta

SEQ ID NO: 70386 - DNA, 75 bp, Artificial Sequence
  Synthetic
ctaggtataaaaaagagggacattctttccaagaaaaccaaagatctcaccaagttgagagaatgcatggataaa

SEQ ID NO: 70387 - DNA, 75 bp, Artificial Sequence
  Synthetic
tttccaagaaaaccaaagatctcaccaagttgagagaatgcatggataaatatggtctgaacctgccaatggtga

SEQ ID NO: 70388 - DNA, 75 bp, Artificial Sequence
  Synthetic
tcaacgattcagtggcgatgaggcaaacatttggaaacttgtacaagaccttccacctcaatccgggcatagtca

SEQ ID NO: 70389 - DNA, 75 bp, Artificial Sequence
  Synthetic
aacatttggaaacttgtacaagaccttccacctcaatccgggcatagtcacgggtagtgccgttgggtgtgatcc

SEQ ID NO: 70390 - DNA, 75 bp, Artificial Sequence
  Synthetic
cagtctcagcccggtgtggtttgcatgtttgaaactcctcttggaaaaattagggtacacacatagggaaacaaa

SEQ ID NO: 70391 - DNA, 75 bp, Artificial Sequence
  Synthetic
tgtttgaaactcctcttggaaaaattagggtacacacatagggaaacaaattacatagattatctctgcaactcc

SEQ ID NO: 70392 - DNA, 75 bp, Artificial Sequence
  Synthetic
aattctatgattaacaacatcataatcaggactctgatgctaaaagtctacaaaggtatcgatttggatcaattc

SEQ ID NO: 70393 - DNA, 75 bp, Artificial Sequence
  Synthetic
tcaggactctgatgctaaaagtctacaaaggtatcgatttggatcaattcagaatgatagcatacggggacgacg

SEQ ID NO: 70394 - DNA, 75 bp, Artificial Sequence
  Synthetic
ccccagctgacaaaggagagtgtttcaatgaggtaacgtggacaaacgtgacattcctgaaaagatacttcagag

SEQ ID NO: 70395 - DNA, 75 bp, Artificial Sequence
  Synthetic
caatgaggtaacgtggacaaacgtgacattcctgaaaagatacttcagagcagatgaacagtacccatttctagt

SEQ ID NO: 70396 - DNA, 75 bp, Artificial Sequence
  Synthetic
cgtacgctcactgtgcttattggcttggcacaatggtgagcgcgaatatgaggagttcattcgcaagatcagaag

SEQ ID NO: 70397 - DNA, 75 bp, Artificial Sequence
  Synthetic
aggagttcattcgcaagatcagaagcgtgcccgtagggcgctgtttgactctccccgcattttcaacactgcgta

SEQ ID NO: 70398 - DNA, 75 bp, Artificial Sequence
  Synthetic
tttaaaacagcctgtgggttgatcccacccgcagggcccactgggcgccagcacactggtatcaaggtacctttg

SEQ ID NO: 70399 - DNA, 75 bp, Artificial Sequence
  Synthetic
gcacactggtatcaaggtacctttgtgcgcctgttttataaaccctcccccccttgtgagaaacttagaagcaat

SEQ ID NO: 70400 - DNA, 75 bp, Artificial Sequence
  Synthetic
tgcgcctgttttataaaccctcccccccttgtgagaaacttagaagcaatgcacaccgatcaatagtgggcgtgg

SEQ ID NO: 70401 - DNA, 75 bp, Artificial Sequence
  Synthetic
gagaaagcgttcgttacccggccagctacttcgagaagcttagtagcgccatggaagctgcgaagcgtttcgctc

SEQ ID NO: 70402 - DNA, 75 bp, Artificial Sequence
  Synthetic
cgatgagtcaccgcatatccccacgggtgaccgtggcggtggctgcgttggcggcctgcctacagggcaacctgt

SEQ ID NO: 70403 - DNA, 75 bp, Artificial Sequence
  Synthetic
ctactttgggtgtccgtgtttctttttatttctatattggctgcttatggtgacaattgaaggattgttaccata

SEQ ID NO: 70404 - DNA, 75 bp, Artificial Sequence
  Synthetic
gaccaactatcgaactttgtgctacattcttaaattgaacgcaataaaatgggagctcaagtgtcgactcaaaag

SEQ ID NO: 70405 - DNA, 75 bp, Artificial Sequence
  Synthetic
attcttaaattgaacgcaataaaatgggagctcaagtgtcgactcaaaagactggagcgcatgaaactggtctga

SEQ ID NO: 70406 - DNA, 75 bp, Artificial Sequence
  Synthetic
gacaagacttcacacaagatccaagcaagtttacagaaccagttaaagatgttatgattaaatctctgccagcat

SEQ ID NO: 70407 - DNA, 75 bp, Artificial Sequence
  Synthetic
caagtttacagaaccagttaaagatgttatgattaaatctctgccagcattgaactcgcccactgtagaagagtg

SEQ ID NO: 70408 - DNA, 75 bp, Artificial Sequence
  Synthetic
tgttgcatacggtgtgtggcccgagtacctaggtgacaacgaagctacagcagaagaccagcccactcaaccaga

SEQ ID NO: 70409 - DNA, 75 bp, Artificial Sequence
  Synthetic
tacctaggtgacaacgaagctacagcagaagaccagcccactcaaccagatgttgctacatgcaggttttacact

SEQ ID NO: 70410 - DNA, 75 bp, Artificial Sequence
  Synthetic
ttgtttggacagaacatgctgtaccactaccttgggaaggctggttacaccatacacgtccagtgcaatgcctca

SEQ ID NO: 70411 - DNA, 75 bp, Artificial Sequence
  Synthetic
actaccttgggaaggctggttacaccatacacgtccagtgcaatgcctcaaagtttcatcagggatgtctactgg

SEQ ID NO: 70412 - DNA, 75 bp, Artificial Sequence
  Synthetic
gtgaacgagccatgaacttcaaagccgacactacaggggaagaaaactccgtgcaagctgcagtatggaatgcgg

SEQ ID NO: 70413 - DNA, 75 bp, Artificial Sequence
  Synthetic
cgacactacaggggaagaaaactccgtgcaagctgcagtatggaatgcggggttgggcgtttgcgccggcaacct

SEQ ID NO: 70414 - DNA, 75 bp, Artificial Sequence
  Synthetic
tgtccccatggataacatgtttagacaccagaatttcaccctgatgctcatcccatttgtccttcttgattatag

SEQ ID NO: 70415 - DNA, 75 bp, Artificial Sequence
  Synthetic
caccagaatttcaccctgatgctcatcccatttgtccttcttgattatagtgatggagcttcaagttacgtgccc

SEQ ID NO: 70416 - DNA, 75 bp, Artificial Sequence
  Synthetic
atgctgaccccgggcagtaatcagtttctcacctccgacgactttcagtcaccatcagctatgccgcaatttgat

SEQ ID NO: 70417 - DNA, 75 bp, Artificial Sequence
  Synthetic
ttctcacctccgacgactttcagtcaccatcagctatgccgcaatttgatgtaacaccagagatgaccattccag

SEQ ID NO: 70418 - DNA, 75 bp, Artificial Sequence
  Synthetic
attctatggaggcgtacagggtggaggtcaacacatcgaaacacgcaggagaccaagtatttgggtttaaactag

SEQ ID NO: 70419 - DNA, 75 bp, Artificial Sequence
  Synthetic
ggtcaacacatcgaaacacgcaggagaccaagtatttgggtttaaactagatccgggtctgatgcagtgctaaac

SEQ ID NO: 70420 - DNA, 75 bp, Artificial Sequence
  Synthetic
gggtcagccatgacaactggtaagttcctcctgtctacgcaccaccaggagccggagcaccaacgaagcgtaagg

SEQ ID NO: 70421 - DNA, 75 bp, Artificial Sequence
  Synthetic
tcctcctgtctacgcaccaccaggagccggagcaccaacgaagcgtaaggacgccatgttggggacccatgtggt

SEQ ID NO: 70422 - DNA, 75 bp, Artificial Sequence
  Synthetic
gaaggacccatactcggctgcggggtatgtcacctgttggtatcagacgggagtagtgtcaccggctgggaacca

SEQ ID NO: 70423 - DNA, 75 bp, Artificial Sequence
  Synthetic
tatgtcacctgttggtatcagacgggagtagtgtcaccggctgggaaccagcctaagtgttatattatgtgcttc

SEQ ID NO: 70424 - DNA, 75 bp, Artificial Sequence
  Synthetic
ggggaagtgccagatgctgtgaccggagccatagtgcgcgttgccgacacactccacacggggccatcgaacaac

SEQ ID NO: 70425 - DNA, 75 bp, Artificial Sequence
  Synthetic
gagccatagtgcgcgttgccgacacactccacacggggccatcgaacaacgaagcaatacccaacttgacggcgg

SEQ ID NO: 70426 - DNA, 75 bp, Artificial Sequence
  Synthetic
gctcagagtcttcgattgaaaactttctggcacgggccgcttgtgtgtattacctcaattatcaaacaggatcag

SEQ ID NO: 70427 - DNA, 75 bp, Artificial Sequence
  Synthetic
tctggcacgggccgcttgtgtgtattacctcaattatcaaacaggatcagggcctggtactcaatactttggcca

SEQ ID NO: 70428 - DNA, 75 bp, Artificial Sequence
  Synthetic
ggaaattacaattgtgatcaccagctcacaagatcaatctaccatttcaaacccagacacgccaattctgacaca

SEQ ID NO: 70429 - DNA, 75 bp, Artificial Sequence
  Synthetic
tcacaagatcaatctaccatttcaaacccagacacgccaattctgacacaccagatcatgtatgtgccaccgggg

SEQ ID NO: 70430 - DNA, 75 bp, Artificial Sequence
  Synthetic
aatgcacctgcccgcatatccattccattcatcagtgttgggaatgcttatagcagtttctacgacgggtggtcg

SEQ ID NO: 70431 - DNA, 75 bp, Artificial Sequence
  Synthetic
cattcatcagtgttgggaatgcttatagcagtttctacgacgggtggtcgaacttctcccagaatggtcgatacg

SEQ ID NO: 70432 - DNA, 75 bp, Artificial Sequence
  Synthetic
gtgtcgcccgcatatacttcaaaccaaaacatgttaaggcgttgatcccgcgaccgccgcgattgtgcccttaca

SEQ ID NO: 70433 - DNA, 75 bp, Artificial Sequence
  Synthetic
aaaacatgttaaggcgttgatcccgcgaccgccgcgattgtgcccttacatccacgccggggactttacttccag

SEQ ID NO: 70434 - DNA, 75 bp, Artificial Sequence
  Synthetic
ttgggaactataggttgttaaatagcaccttgccacacatgctgactggcaaaattgcgtgtgggaggactacaa

SEQ ID NO: 70435 - DNA, 75 bp, Artificial Sequence
  Synthetic
caccttgccacacatgctgactggcaaaattgcgtgtgggaggactacaacagggacctgctggtcagtactacc

SEQ ID NO: 70436 - DNA, 75 bp, Artificial Sequence
  Synthetic
cactatccaatcacttttgaagggccaggcctagtggaatccaagaaagtgagtattatccaaagaagtatcagt

SEQ ID NO: 70437 - DNA, 75 bp, Artificial Sequence
  Synthetic
caggcctagtggaatccaagaaagtgagtattatccaaagaagtatcagtcccatgtgcttttaaccgctgggtt

SEQ ID NO: 70438 - DNA, 75 bp, Artificial Sequence
  Synthetic
ggcgttgttgggttcgcagatattagagacctcctatggctggaggatgatgccatggaacagggtgtgagagac

SEQ ID NO: 70439 - DNA, 75 bp, Artificial Sequence
  Synthetic
gagacctcctatggctggaggatgatgccatggaacagggtgtgagagactacgtggagcaactagggaatgcat

SEQ ID NO: 70440 - DNA, 75 bp, Artificial Sequence
  Synthetic
tactggagaagtccttgaaggcattgatcaaaatcatctcagccctggtgattgtggtaaggaaccacgaagatc

SEQ ID NO: 70441 - DNA, 75 bp, Artificial Sequence
  Synthetic
gatcaaaatcatctcagccctggtgattgtggtaaggaaccacgaagatcttatcacagtcacagccacactcgc

SEQ ID NO: 70442 - DNA, 75 bp, Artificial Sequence
  Synthetic
ctgagcgccagaaacaacggatggctaaagaaattcactgaaaatgaccaacgcctgcaaggggaatggaatgga

SEQ ID NO: 70443 - DNA, 75 bp, Artificial Sequence
  Synthetic
taaagaaattcactgaaaatgaccaacgcctgcaaggggaatggaatggatagccattaaaatacaaaaattcat

SEQ ID NO: 70444 - DNA, 75 bp, Artificial Sequence
  Synthetic
cctactgggaaagccaaattgctaccattgaacaaagtgcaccgtcccagggcgaccaagagcagcttttttcca

SEQ ID NO: 70445 - DNA, 75 bp, Artificial Sequence
  Synthetic
cattgaacaaagtgcaccgtcccagggcgaccaagagcagcttttttccaatgtgcagtatttcgctcattattg

SEQ ID NO: 70446 - DNA, 75 bp, Artificial Sequence
  Synthetic
acaattcaagtcccaatgccgtattgaacctgtatgtttactcttacacgggagcccaggagctgggaaatcggt

SEQ ID NO: 70447 - DNA, 75 bp, Artificial Sequence
  Synthetic
gaacctgtatgtttactcttacacgggagcccaggagctgggaaatcggtcgccaccaaattaattggttgttca

SEQ ID NO: 70448 - DNA, 75 bp, Artificial Sequence
  Synthetic
gctgtagtgattatgggtgatttgtgtcaggattccaggtggcaaggacatatccctattctgtaaaatggtgtc

SEQ ID NO: 70449 - DNA, 75 bp, Artificial Sequence
  Synthetic
gtcaggattccaggtggcaaggacatatccctattctgtaaaatggtgtcgagtgtcgactttgttccaccaatg

SEQ ID NO: 70450 - DNA, 75 bp, Artificial Sequence
  Synthetic
gcaccaacagtgtcggacagcagggcgttagccagaaggttccactttgacatgaacattgaagtgatttctatg

SEQ ID NO: 70451 - DNA, 75 bp, Artificial Sequence
  Synthetic
cgttagccagaaggttccactttgacatgaacattgaagtgatttctatgtacagtcaaaatggcaagatcaaca

SEQ ID NO: 70452 - DNA, 75 bp, Artificial Sequence
  Synthetic
gtaaggccatccagttcatcgatagaagaactcaagtgaggtattccctggatatgctagtaactgagatgtgta

SEQ ID NO: 70453 - DNA, 75 bp, Artificial Sequence
  Synthetic
aagaactcaagtgaggtattccctggatatgctagtaactgagatgtgtagagaatacaaccacagacacagtgt

SEQ ID NO: 70454 - DNA, 75 bp, Artificial Sequence
  Synthetic
tccaccgccaccagcaattgcagacctgttgaaatcagtggatagtgaagcggtcagggagtactgtaaagagaa

SEQ ID NO: 70455 - DNA, 75 bp, Artificial Sequence
  Synthetic
ctgttgaaatcagtggatagtgaagcggtcagggagtactgtaaagagaagggatggttggttcccgagatcaat

SEQ ID NO: 70456 - DNA, 75 bp, Artificial Sequence
  Synthetic
gctgggataatttatatcatttacaagttgtttgcagggttccagggtgcttatacagggatgcccaaccaaaaa

SEQ ID NO: 70457 - DNA, 75 bp, Artificial Sequence
  Synthetic
agttgtttgcagggttccagggtgcttatacagggatgcccaaccaaaaacccaaagtgcccacactaaggcaag

SEQ ID NO: 70458 - DNA, 75 bp, Artificial Sequence
  Synthetic
ccagaagagcttgagcaacggggagaccgccaacatgtttgaatcccaaaactccacagggcaaacagcagtcca

SEQ ID NO: 70459 - DNA, 75 bp, Artificial Sequence
  Synthetic
acggtgaatttaccatgctaggcatctatgataggtgggccgttcttccacgccacgccaaacctggaccgacca

SEQ ID NO: 70460 - DNA, 75 bp, Artificial Sequence
  Synthetic
ttctcatgaatgatcaagaagttggcgtgttggatgccaaggaactggtggataaagatggcacaaaccttgaac

SEQ ID NO: 70461 - DNA, 75 bp, Artificial Sequence
  Synthetic
tcaacgaagctgtcctggcgattaacaccagcaagttcccaaacatgtacatcccagtaggacaggtcacagact

SEQ ID NO: 70462 - DNA, 75 bp, Artificial Sequence
  Synthetic
caccagcaagttcccaaacatgtacatcccagtaggacaggtcacagactatggtttcttaaacctaggtggcac

SEQ ID NO: 70463 - DNA, 75 bp, Artificial Sequence
  Synthetic
caaggtgttgggaatacatgttggtgggaacggtcaccaaggcttttcagcagctctcctcaaacactacttcaa

SEQ ID NO: 70464 - DNA, 75 bp, Artificial Sequence
  Synthetic
gggaacggtcaccaaggcttttcagcagctctcctcaaacactacttcaactgatgagccaggtgaaattgaatt

SEQ ID NO: 70465 - DNA, 75 bp, Artificial Sequence
  Synthetic
cactattgggggaaatactgaattactatacccattggtcgggtagcatcaaattaacattcatgttctgtgggt

SEQ ID NO: 70466 - DNA, 75 bp, Artificial Sequence
  Synthetic
tccaccaggtgtttgaggggaataaagagccagctgtcttcaggaatgtgacccacgcttcatagccaatttgga

SEQ ID NO: 70467 - DNA, 75 bp, Artificial Sequence
  Synthetic
agagccagctgtcttcaggaatgtgacccacgcttcatagccaatttggaggaggctatattctcaatgtacatt

SEQ ID NO: 70468 - DNA, 75 bp, Artificial Sequence
  Synthetic
tgacatcaacattgaaccaatgaaattagaggatgctgtgtatggtactgaaggctagaagctctcgatttgaca

SEQ ID NO: 70469 - DNA, 75 bp, Artificial Sequence
  Synthetic
ataacatgttggtaccagacgaacattgtggtgcctgcagacactcaaagtgactgcaagatcttgtgcttcgtg

SEQ ID NO: 70470 - DNA, 75 bp, Artificial Sequence
  Synthetic
ttagaggatgctgtgtatggtactgaaggctagaagctctcgatttgacaacgagtgcgggatatccgtatgttg

SEQ ID NO: 70471 - DNA, 75 bp, Artificial Sequence
  Synthetic
cccccaggtgaggcagtggagagggccattgcacgcgtcgctgataccattgggagcggtccagttaactcagag

SEQ ID NO: 70472 - DNA, 75 bp, Artificial Sequence
  Synthetic
aatatggactaaacctgccaatggtaacatacgtgaaagatgaactcagatcagcagagaagtggccaaagggaa

SEQ ID NO: 70473 - DNA, 75 bp, Artificial Sequence
  Synthetic
aacatacgtgaaagatgaactcagatcagcagagaagtggccaaagggaaatccaggcttattgaggcatctagc

SEQ ID NO: 70474 - DNA, 75 bp, Artificial Sequence
  Synthetic
acaggcagcgcagtcggatgtgatcccgacctcttctggagtaagatacctgtaatgctagatggacatctcata

SEQ ID NO: 70475 - DNA, 75 bp, Artificial Sequence
  Synthetic
ccgacctcttctggagtaagatacctgtaatgctagatggacatctcatagccttcgattactccggctacgacg

SEQ ID NO: 70476 - DNA, 75 bp, Artificial Sequence
  Synthetic
attatattgactacttgtgcaactcccaccacctgtacagggacaaacattactttgtgcgttgtggtatgccct

SEQ ID NO: 70477 - DNA, 75 bp, Artificial Sequence
  Synthetic
gaacagtccaccatacaaggccaggattcaccagtgctcacgcatcaaatcatgtatgtgcccccaggtggcccg

SEQ ID NO: 70478 - DNA, 75 bp, Artificial Sequence
  Synthetic
ccaccacctgtacagggacaaacattactttgtgcgttgtggtatgccctcagggtgctccggcaccagcatctt

SEQ ID NO: 70479 - DNA, 75 bp, Artificial Sequence
  Synthetic
caggagtgaattgcatacggtgacgagtgatcattgcatcttacccctggccaatcgatgcctccttgcttgccg

SEQ ID NO: 70480 - DNA, 75 bp, Artificial Sequence
  Synthetic
agtgatcattgcatcttacccctggccaatcgatgcctccttgcttgccgaagccggcaaggggtatggattgat

SEQ ID NO: 70481 - DNA, 75 bp, Artificial Sequence
  Synthetic
ttagagcagacgaagcagtaccctttcctggttcacccagtcatgccgatgaaggacattcatgaatccattaga

SEQ ID NO: 70482 - DNA, 75 bp, Artificial Sequence
  Synthetic
caggcaatgtgaattttgaacctactggcgtgactgaaagtaggacagacataacaactatgcagaccaccggtg

SEQ ID NO: 70483 - DNA, 75 bp, Artificial Sequence
  Synthetic
tcctggttcacccagtcatgccgatgaaggacattcatgaatccattagatggaccaaagacccaaagaataccc

SEQ ID NO: 70484 - DNA, 75 bp, Artificial Sequence
  Synthetic
ataacaactatgcagaccaccggtgcctatggacagcaatcaggcgccgtgtacattggcaactacagaatagtg

SEQ ID NO: 70485 - DNA, 75 bp, Artificial Sequence
  Synthetic
atcagatagcatcccagttgggcgctgtttgactttacctgcgttttcaaccctgcgcaggaaatggttggactc

SEQ ID NO: 70486 - DNA, 75 bp, Artificial Sequence
  Synthetic
cattaaccgaactagacaacaatgcagtaggggtaaattttccgcgttcggtgcggaaaaaaaaaaaaaaaaaaa

SEQ ID NO: 70487 - DNA, 75 bp, Artificial Sequence
  Synthetic
ttaaaacagcctgtgggttgctcccacccacagggcccactgggcgtcagcacactggtatcaaggtacctttgt

SEQ ID NO: 70488 - DNA, 75 bp, Artificial Sequence
  Synthetic
cacactggtatcaaggtacctttgtgcgcctgttttacaaaccctccccccccttgtaacaaacttagaagcaat

SEQ ID NO: 70489 - DNA, 75 bp, Artificial Sequence
  Synthetic
acttctgtctccccggaccgagtatcaatagactgcttgcgtggttgaaggagaaagcgtccgttacccgaccaa

SEQ ID NO: 70490 - DNA, 75 bp, Artificial Sequence
  Synthetic
gcgaccgtggcggtggctgcgttggcggcctgcctacggggtaacccgtaggacgcttcaatgtagacatggtgc

SEQ ID NO: 70491 - DNA, 75 bp, Artificial Sequence
  Synthetic
cgggcaactctgcagcggaaccgactactttgggtgtccgtgtttctttttattttgtactggctgcttatggtg

SEQ ID NO: 70492 - DNA, 75 bp, Artificial Sequence
  Synthetic
gttgggttcgtaccattcaataaggctaattaccaaatcttgtgttacatcctcagattgaacacatcgaaatgg

SEQ ID NO: 70493 - DNA, 75 bp, Artificial Sequence
  Synthetic
ctaattaccaaatcttgtgttacatcctcagattgaacacatcgaaatgggagctcaagtgtcaacccaaaagac

SEQ ID NO: 70494 - DNA, 75 bp, Artificial Sequence
  Synthetic
catacagttcaagtccaaatgccgtattgagcctgtatgtctgctattgcatgggagccctggggccggtaagtc

SEQ ID NO: 70495 - DNA, 75 bp, Artificial Sequence
  Synthetic
tgctgcttccaactcggcgaatcgacaggacttcacacaagatccaagtaagtttacagaaccagtcaaagatat

SEQ ID NO: 70496 - DNA, 75 bp, Artificial Sequence
  Synthetic
caggacttcacacaagatccaagtaagtttacagaaccagtcaaagatatcatgattaaatctctgccggctctg

SEQ ID NO: 70497 - DNA, 75 bp, Artificial Sequence
  Synthetic
agatcacttcgatggttacaagcaacaagccgtcgtaattatggatgatctgtgtcaaaatccagatggcaaaga

SEQ ID NO: 70498 - DNA, 75 bp, Artificial Sequence
  Synthetic
acgcaggagtgtgcaaatgttgttgttgcatacggagtgtggcctgaatacttgggtgacaacgaggccacagca

SEQ ID NO: 70499 - DNA, 75 bp, Artificial Sequence
  Synthetic
cgtatccctgttctgtcaaatggtttccagtgtggattttgtaccaccaatggccgcacttgaagagaaggggat

SEQ ID NO: 70500 - DNA, 75 bp, Artificial Sequence
  Synthetic
ttgcatacggagtgtggcctgaatacttgggtgacaacgaggccacagcagaagaccagcccacccaaccagatg

SEQ ID NO: 70501 - DNA, 75 bp, Artificial Sequence
  Synthetic
agctttagccaggaggttccattttgacatgaacatagaggtaatttcaatgtatagtcaaaatggcaaagtcaa

SEQ ID NO: 70502 - DNA, 75 bp, Artificial Sequence
  Synthetic
ccgacgcactgaatgacatgggactgtttggacaaaacatgctataccactacctcgggagggccggttacacca

SEQ ID NO: 70503 - DNA, 75 bp, Artificial Sequence
  Synthetic
gtttggacaaaacatgctataccactacctcgggagggccggttacaccatacatgtccagtgtaacgcctcaaa

SEQ ID NO: 70504 - DNA, 75 bp, Artificial Sequence
  Synthetic
gacatgaacatagaggtaatttcaatgtatagtcaaaatggcaaagtcaacatgcccatgtcagtgaaaacgtgc

SEQ ID NO: 70505 - DNA, 75 bp, Artificial Sequence
  Synthetic
agaagaacacaggtgaggtactccttggatatgttggtcactgagatgttcagagagtacaaccatagacatagt

SEQ ID NO: 70506 - DNA, 75 bp, Artificial Sequence
  Synthetic
caatcaagagcacttaagtcaaggtgagcgagccatgagctttaaagccgacaccacaggggaaacagaagtgca

SEQ ID NO: 70507 - DNA, 75 bp, Artificial Sequence
  Synthetic
gagcgagccatgagctttaaagccgacaccacaggggaaacagaagtgcaagctgcagtgtggaacgcggggtta

SEQ ID NO: 70508 - DNA, 75 bp, Artificial Sequence
  Synthetic
gatcaagattagtgttgcacctgaaaccccaccaccaccagcaatcgcagatctgctaaaatcagtggacagcga

SEQ ID NO: 70509 - DNA, 75 bp, Artificial Sequence
  Synthetic
gtcatgccctacatcaattgtgttcccatggataatatgtttagacaccagaatttcaccttgatgctaattcca

SEQ ID NO: 70510 - DNA, 75 bp, Artificial Sequence
  Synthetic
ccatggataatatgtttagacaccagaatttcaccttgatgctaattccatttgttccgctagattacagcgatg

SEQ ID NO: 70511 - DNA, 75 bp, Artificial Sequence
  Synthetic
cgtcagcagggcattcatatgcctccaagcgctaacaacctttgtttctgtggccggaatcatatatatcattta

SEQ ID NO: 70512 - DNA, 75 bp, Artificial Sequence
  Synthetic
caagcgctaacaacctttgtttctgtggccggaatcatatatatcatttacaagttattcgctggattccagggt

SEQ ID NO: 70513 - DNA, 75 bp, Artificial Sequence
  Synthetic
ggaaacaagggctgccgaccatgctaaccccaggtagcaatcaattcctcacatctgacgactttcagtcaccat

SEQ ID NO: 70514 - DNA, 75 bp, Artificial Sequence
  Synthetic
aaccccaggtagcaatcaattcctcacatctgacgactttcagtcaccatcagctatgccacaatttgatgtaac

SEQ ID NO: 70515 - DNA, 75 bp, Artificial Sequence
  Synthetic
gagtttgctgtggctatgatgaagagaaactccagcacagtgaaaaccgaatatggtgaattcaccatgctaggc

SEQ ID NO: 70516 - DNA, 75 bp, Artificial Sequence
  Synthetic
gaaactccagcacagtgaaaaccgaatatggtgaattcaccatgctaggcatttacgataggtgggccgtcctcc

SEQ ID NO: 70517 - DNA, 75 bp, Artificial Sequence
  Synthetic
caacgttgaggaggctgttaattctatggaggcatacagggtggaagttaacacatcaaaacacgcaggagacca

SEQ ID NO: 70518 - DNA, 75 bp, Artificial Sequence
  Synthetic
atggaggcatacagggtggaagttaacacatcaaaacacgcaggagaccaagtgttcgggttcaaactagatccg

SEQ ID NO: 70519 - DNA, 75 bp, Artificial Sequence
  Synthetic
tggataaagatggcacaaatcttgaactaacactgctgaagctcaatcggaatgagaagtttagggacatcaggg

SEQ ID NO: 70520 - DNA, 75 bp, Artificial Sequence
  Synthetic
actaacactgctgaagctcaatcggaatgagaagtttagggacatcaggggctttctcgccaaagaggaggtgga

SEQ ID NO: 70521 - DNA, 75 bp, Artificial Sequence
  Synthetic
aaattaacctttgtcttttgtgggtcagccatgacgactggtaagtttcttttgtcttatgcaccaccgggcgcc

SEQ ID NO: 70522 - DNA, 75 bp, Artificial Sequence
  Synthetic
cagccatgacgactggtaagtttcttttgtcttatgcaccaccgggcgccggcgctccaacaaagcgcaaggatg

SEQ ID NO: 70523 - DNA, 75 bp, Artificial Sequence
  Synthetic
ctatggcttcttgaacttgggtggcacccccacgaagagaatgcttatgtataacttcccaactagggcgggcca

SEQ ID NO: 70524 - DNA, 75 bp, Artificial Sequence
  Synthetic
acccccacgaagagaatgcttatgtataacttcccaactagggcgggccagtgcggtggtgtcctcatgtccacc

SEQ ID NO: 70525 - DNA, 75 bp, Artificial Sequence
  Synthetic
aggcacactacaggtttgtggagaaagatccatactcggccgcggggtatgtcacctgttggtaccagacgggag

SEQ ID NO: 70526 - DNA, 75 bp, Artificial Sequence
  Synthetic
agatccatactcggccgcggggtatgtcacctgttggtaccagacgggagtggtgtcaccggctggaaatcagcc

SEQ ID NO: 70527 - DNA, 75 bp, Artificial Sequence
  Synthetic
aatgatgagcaaggtgagattgaattcatcgaaagctcaaaagatgcagggttcccagtcatcaacgcaccaagc

SEQ ID NO: 70528 - DNA, 75 bp, Artificial Sequence
  Synthetic
tcatcgaaagctcaaaagatgcagggttcccagtcatcaacgcaccaagcaagaccaaactggaaccgagcgttt

SEQ ID NO: 70529 - DNA, 75 bp, Artificial Sequence
  Synthetic
caaccaggagagcttctaccagggagatgtgcaagacgctgtgactggggccatagtgcgtgtcgccgatacgct

SEQ ID NO: 70530 - DNA, 75 bp, Artificial Sequence
  Synthetic
gatgtgcaagacgctgtgactggggccatagtgcgtgtcgccgatacgctccacacaggaccaacaaacaatgaa

SEQ ID NO: 70531 - DNA, 75 bp, Artificial Sequence
  Synthetic
aggaggctatattctcaaagtatattgggaatgttaatacacatgtggatgagtacatgatggaagctgtggatc

SEQ ID NO: 70532 - DNA, 75 bp, Artificial Sequence
  Synthetic
tgggaatgttaatacacatgtggatgagtacatgatggaagctgtggatcactacgcagggcagctagccacgct

SEQ ID NO: 70533 - DNA, 75 bp, Artificial Sequence
  Synthetic
catgtgattaacatgcacacccgctcggaatcttcaattgaaaattttctagcacgggccgcatgtgtgtattat

SEQ ID NO: 70534 - DNA, 75 bp, Artificial Sequence
  Synthetic
cggaatcttcaattgaaaattttctagcacgggccgcatgtgtgtattatctaaattatcaaacagggtcagggc

SEQ ID NO: 70535 - DNA, 75 bp, Artificial Sequence
  Synthetic
caccagtgcagggtatccgtatgtcgcattgggcataaaaaagagagacatattgtccaagaagaccaaagacct

SEQ ID NO: 70536 - DNA, 75 bp, Artificial Sequence
  Synthetic
gcattgggcataaaaaagagagacatattgtccaagaagaccaaagacctgactaaactgaaagagtgcatggat

SEQ ID NO: 70537 - DNA, 75 bp, Artificial Sequence
  Synthetic
tcacttacctgagatttgatatggaaatcacaattgtaatcaccagttcacaagatcaatccaccattccaaacc

SEQ ID NO: 70538 - DNA, 75 bp, Artificial Sequence
  Synthetic
aatcacaattgtaatcaccagttcacaagatcaatccaccattccaaacccggacacgccaatcctgacgcacca

SEQ ID NO: 70539 - DNA, 75 bp, Artificial Sequence
  Synthetic
aagtctagacttattgaagcatccagtctaaacgactctgttgcaatgaggcaaacatttggtaacctgtacaag

SEQ ID NO: 70540 - DNA, 75 bp, Artificial Sequence
  Synthetic
gtctaaacgactctgttgcaatgaggcaaacatttggtaacctgtacaaggcattccacttgaacccggggattg

SEQ ID NO: 70541 - DNA, 75 bp, Artificial Sequence
  Synthetic
cagtgtgttttggacagaaggaaacgcacctgcccgcatatccatcccattcataagtgttgggaatgcttatag

SEQ ID NO: 70542 - DNA, 75 bp, Artificial Sequence
  Synthetic
gcacctgcccgcatatccatcccattcataagtgttgggaatgcttatagtagtttttacgacgggtggtcgaac

SEQ ID NO: 70543 - DNA, 75 bp, Artificial Sequence
  Synthetic
tagcctttgattactctgggtacgatgccagtttgagcccagtgtggtttgcttgtctgaagctattgcttgaga

SEQ ID NO: 70544 - DNA, 75 bp, Artificial Sequence
  Synthetic
tgccagtttgagcccagtgtggtttgcttgtctgaagctattgcttgagaaacttgggtattcacacaaggagac

SEQ ID NO: 70545 - DNA, 75 bp, Artificial Sequence
  Synthetic
cccagtcccaacacttacacaagtgttgcccgaatatacttcaaaccaaaacatgtgagggcttgggttccgcgg

SEQ ID NO: 70546 - DNA, 75 bp, Artificial Sequence
  Synthetic
ttgcccgaatatacttcaaaccaaaacatgtgagggcttgggttccgcggccaccacgactgtgcccctacatca

SEQ ID NO: 70547 - DNA, 75 bp, Artificial Sequence
  Synthetic
ctcgggatgttctggaaccagcatctttaattcgatgatcaacaacatcattatcagaacactgatgctcaaagt

SEQ ID NO: 70548 - DNA, 75 bp, Artificial Sequence
  Synthetic
ttatcagaacactgatgctcaaagtgtacaaaggcatcgacttagatcaattcaggatgattgcatatggtgatg

SEQ ID NO: 70549 - DNA, 75 bp, Artificial Sequence
  Synthetic
ggcaacaatcaggggctatttatgttgggaactatagagtggtgaataggcatctggcaacctacagtgattggc

SEQ ID NO: 70550 - DNA, 75 bp, Artificial Sequence
  Synthetic
tgggaactatagagtggtgaataggcatctggcaacctacagtgattggcagaattgtgtctgggaggattacaa

SEQ ID NO: 70551 - DNA, 75 bp, Artificial Sequence
  Synthetic
tgacaccagcagataagggagagtgctttaatgaagtgacttggaccaatgttaccttcctgaaaaggtatttca

SEQ ID NO: 70552 - DNA, 75 bp, Artificial Sequence
  Synthetic
ctttaatgaagtgacttggaccaatgttaccttcctgaaaaggtatttcagagcagatgagcaataccctttcct

SEQ ID NO: 70553 - DNA, 75 bp, Artificial Sequence
  Synthetic
gtacttttgtgcatcaaagaaaagacactacccgatcagttttgaaggacctggcttggtagaagtccaggagaa

SEQ ID NO: 70554 - DNA, 75 bp, Artificial Sequence
  Synthetic
cactacccgatcagttttgaaggacctggcttggtagaagtccaggagaacgaatactaccccaagagataccaa

SEQ ID NO: 70555 - DNA, 75 bp, Artificial Sequence
  Synthetic
ccatgtgcgctcattgtgcctattggcttggcacaatggggagcgcgaatacgatgagttcatccgcaaaatcag

SEQ ID NO: 70556 - DNA, 75 bp, Artificial Sequence
  Synthetic
ataggcctggttactatgggtggtgaaggtgtagtgggcttcgccgatgtccgcgacctactgtggctggaggac

SEQ ID NO: 70557 - DNA, 75 bp, Artificial Sequence
  Synthetic
aaggtgtagtgggcttcgccgatgtccgcgacctactgtggctggaggacgacgcaatggaacagggggtgaaag

SEQ ID NO: 70558 - DNA, 75 bp, Artificial Sequence
  Synthetic
aatttggagacaattttgcgtgatctaaattggcttaaccctaccgcactaaccgaactagataatggtgcggca

SEQ ID NO: 70559 - DNA, 75 bp, Artificial Sequence
  Synthetic
ttaaaacagcctgtgggttgcacccacccgcagggcccactgggcgctagtacactggtaccccggtacccttgt

SEQ ID NO: 70560 - DNA, 75 bp, Artificial Sequence
  Synthetic
aagaatccctgctaggtcaagactcgatcctggaaaaatctctcaaggccctagttaagatcatttcagcactgg

SEQ ID NO: 70561 - DNA, 75 bp, Artificial Sequence
  Synthetic
tacactggtaccccggtacccttgtacgcctgttttatttctccctcccccaaccagtaacctagaagtaaagca

SEQ ID NO: 70562 - DNA, 75 bp, Artificial Sequence
  Synthetic
catggtggtggctcaaacagaaagtgtcacagtattacggaatacccatggctgagcgccagaacaacggatggc

SEQ ID NO: 70563 - DNA, 75 bp, Artificial Sequence
  Synthetic
ttctgtaaccccgggccgagtatcaatagactgctcacgcggttgagggagaaaacgctcgttatccggctgact

SEQ ID NO: 70564 - DNA, 75 bp, Artificial Sequence
  Synthetic
agtggctcaaagtcaagatcctaccagaggtaaaggaaaaacacgaatttctgaccaggcttaagcaactccccc

SEQ ID NO: 70565 - DNA, 75 bp, Artificial Sequence
  Synthetic
gatcaagagcagcttttctcaaacgtccagtactttgcccactattgcagaaaatacgcacccctatatgctgct

SEQ ID NO: 70566 - DNA, 75 bp, Artificial Sequence
  Synthetic
cctccggcccctgaatgcggctaatcctaactgcggagcacgtgcctccaatccagggggtggcgtgtcgtaacg

SEQ ID NO: 70567 - DNA, 75 bp, Artificial Sequence
  Synthetic
ttcttatcttggctgcttatggtgacaattgaaggattgttaccatatagctattggattggccatccggtgact

SEQ ID NO: 70568 - DNA, 75 bp, Artificial Sequence
  Synthetic
gccgagaagctcaacagctcggtgtattccttaccacctgatccagaccactttgacggttacaaacaacaagcc

SEQ ID NO: 70569 - DNA, 75 bp, Artificial Sequence
  Synthetic
ttaacacttaatacgtcaaaatgggagcacaggtatcaacacagaagacaggtgcacacgagactggattgaacg

SEQ ID NO: 70570 - DNA, 75 bp, Artificial Sequence
  Synthetic
agcacaggtatcaacacagaagacaggtgcacacgagactggattgaacgctagtggaaattccattatacacta

SEQ ID NO: 70571 - DNA, 75 bp, Artificial Sequence
  Synthetic
atttactgaaccagtcaaggatgtaatgattaaaaccctaccagcattaaattcaccaagtgcagaggagtgcgg

SEQ ID NO: 70572 - DNA, 75 bp, Artificial Sequence
  Synthetic
atgattaaaaccctaccagcattaaattcaccaagtgcagaggagtgcggctatagcgaccgagtgcgctcaatc

SEQ ID NO: 70573 - DNA, 75 bp, Artificial Sequence
  Synthetic
ctgagagacgatgaagcaacagcagaagaccagcccacccaaccagacgtggctacgtgtcgcttctacacacta

SEQ ID NO: 70574 - DNA, 75 bp, Artificial Sequence
  Synthetic
aagaccagcccacccaaccagacgtggctacgtgtcgcttctacacactagattcagtttcttgggaagagacat

SEQ ID NO: 70575 - DNA, 75 bp, Artificial Sequence
  Synthetic
gaccaccgatgtatagagaaatcaagatcagtgtggctcccgaaaccccaccaccaccagcaatcgcagacctgt

SEQ ID NO: 70576 - DNA, 75 bp, Artificial Sequence
  Synthetic
gatcagtgtggctcccgaaaccccaccaccaccagcaatcgcagacctgttaaagtcagtggacagcgaagcagt

SEQ ID NO: 70577 - DNA, 75 bp, Artificial Sequence
  Synthetic
acttggggcgcacaggatacaccattcacgtccaatgtaatgcttccaaattccatcagggatgtttgctggttg

SEQ ID NO: 70578 - DNA, 75 bp, Artificial Sequence
  Synthetic
tcacgtccaatgtaatgcttccaaattccatcagggatgtttgctggttgtatgcgtacccgaggctgagatggg

SEQ ID NO: 70579 - DNA, 75 bp, Artificial Sequence
  Synthetic
ccaccaccagcaatcgcagacctgttaaagtcagtggacagcgaagcagtgagggagtactgcaaggagaaggga

SEQ ID NO: 70580 - DNA, 75 bp, Artificial Sequence
  Synthetic
ctctccagattgagaagcatgttagcagagccttcatatgcctccaggcactaacaacctttgtctccgtggccg

SEQ ID NO: 70581 - DNA, 75 bp, Artificial Sequence
  Synthetic
caaggccactgcggcagcaggtgcggttcaaactgcggtatttaatgctggcatgggagttggcgttggtaacct

SEQ ID NO: 70582 - DNA, 75 bp, Artificial Sequence
  Synthetic
gttcaaactgcggtatttaatgctggcatgggagttggcgttggtaacctaacaatatatcctcaccaatggata

SEQ ID NO: 70583 - DNA, 75 bp, Artificial Sequence
  Synthetic
aagtgcccacactgaggcaagccaaggtgcaaggtcccgcttttgaatttgccgtagctatgatgaagagaaact

SEQ ID NO: 70584 - DNA, 75 bp, Artificial Sequence
  Synthetic
gccgtagctatgatgaagagaaactccagcacggtgaaaacagaatacggcgaatttactatgctaggcgtctat

SEQ ID NO: 70585 - DNA, 75 bp, Artificial Sequence
  Synthetic
cactacaacttcaccctcatgctaataccctttgcaccgatgaagagtgtgggggggacgtcctatgtgccaatc

SEQ ID NO: 70586 - DNA, 75 bp, Artificial Sequence
  Synthetic
taccctttgcaccgatgaagagtgtgggggggacgtcctatgtgccaatcaccatcacaatagcaccaatgaaag

SEQ ID NO: 70587 - DNA, 75 bp, Artificial Sequence
  Synthetic
aggatggcacaaaccttgaactcacactgctgaaactcaaccggaatgaaaagtttagagacatcaggggcttcc

SEQ ID NO: 70588 - DNA, 75 bp, Artificial Sequence
  Synthetic
ttttaacctcggatgactaccaatcgccatgtgcaatgccagagtttgatgttacaccacaaatgaagataccag

SEQ ID NO: 70589 - DNA, 75 bp, Artificial Sequence
  Synthetic
gccatgtgcaatgccagagtttgatgttacaccacaaatgaagataccaggggaagtgcacaatctaatggaaat

SEQ ID NO: 70590 - DNA, 75 bp, Artificial Sequence
  Synthetic
cagtaggacaggtaacagattatggtttcctgaacttgggtggcacccccacgaagagaatgctcatgtacaact

SEQ ID NO: 70591 - DNA, 75 bp, Artificial Sequence
  Synthetic
tttcctgaacttgggtggcacccccacgaagagaatgctcatgtacaacttccctaccagagctggtcaatgtgg

SEQ ID NO: 70592 - DNA, 75 bp, Artificial Sequence
  Synthetic
agtcattgcgggaaatactgaaaacaaactgcccatcttcagtttccaggtaaaccctggaggcagtactgtgct

SEQ ID NO: 70593 - DNA, 75 bp, Artificial Sequence
  Synthetic
aaactgcccatcttcagtttccaggtaaaccctggaggcagtactgtgctacaaagaactctccttggggaaatc

SEQ ID NO: 70594 - DNA, 75 bp, Artificial Sequence
  Synthetic
tctcctaaaacactatttcaatgatgaacaaggtgagatcgagttcattgagaactcgaaggacgcgggattccc

SEQ ID NO: 70595 - DNA, 75 bp, Artificial Sequence
  Synthetic
gaacaaggtgagatcgagttcattgagaactcgaaggacgcgggattcccaatcattaacacgccaagtaaaaag

SEQ ID NO: 70596 - DNA, 75 bp, Artificial Sequence
  Synthetic
gaacaaggtgagatcgagttcattgagaactcgaaggacgcgggattcccaatcattaacacgccaagtaaaatg

SEQ ID NO: 70597 - DNA, 75 bp, Artificial Sequence
  Synthetic
gaacaaggtgagatcgagttcattgagaactcgaaggacgcgggattcccaatcattaacacgccaagtaaaacg

SEQ ID NO: 70598 - DNA, 75 bp, Artificial Sequence
  Synthetic
gaacaaggtgagatcgagttcattgagaactcgaaggacgcgggattcccaatcattaacacgccaagtaaaagg

SEQ ID NO: 70599 - DNA, 75 bp, Artificial Sequence
  Synthetic
aaacttctattagcctactcccctccaggagcatcagtcccgaagagcagaagggacgctatgctgggcacacat

SEQ ID NO: 70600 - DNA, 75 bp, Artificial Sequence
  Synthetic
caggagcatcagtcccgaagagcagaagggacgctatgctgggcacacatgtgatctgggacgttggccttcaat

SEQ ID NO: 70601 - DNA, 75 bp, Artificial Sequence
  Synthetic
cgactcaaagcaaactttgaggaggcaatcttctccaagtacattggcaatgtaaacacacatgtagatgagtac

SEQ ID NO: 70602 - DNA, 75 bp, Artificial Sequence
  Synthetic
ccgggtatattacttgttggtatcagaccaacatagttgtaccaccagacactccgtcgagctgcgtggttctgt

SEQ ID NO: 70603 - DNA, 75 bp, Artificial Sequence
  Synthetic
gaccaacatagttgtaccaccagacactccgtcgagctgcgtggttctgtgttttgtgtcggcgtgcaatgattt

SEQ ID NO: 70604 - DNA, 75 bp, Artificial Sequence
  Synthetic
gatgcagtgtacggtacagagggactggaagcccttgatctaaccactagtgcaggatacccgtacgtcgcatta

SEQ ID NO: 70605 - DNA, 75 bp, Artificial Sequence
  Synthetic
tggaagcccttgatctaaccactagtgcaggatacccgtacgtcgcattaggcatcaaaaagagagacattttgt

SEQ ID NO: 70606 - DNA, 75 bp, Artificial Sequence
  Synthetic
ggacaacgctgttgtgcgagtggcggacaccattaggagcggcccctctaactcagaagcaatccctgcattgac

SEQ ID NO: 70607 - DNA, 75 bp, Artificial Sequence
  Synthetic
gacaccattaggagcggcccctctaactcagaagcaatccctgcattgacagctgccgaaaccgggcacacctcc

SEQ ID NO: 70608 - DNA, 75 bp, Artificial Sequence
  Synthetic
acgtgaaggatgagctcagatcagcagaaaaagtggctaaaggcaaatctaggcttattgaagcatctagcttga

SEQ ID NO: 70609 - DNA, 75 bp, Artificial Sequence
  Synthetic
aatttcctgtgtagagcagcatgtgtgcacatagctaagtatgaagccaagagcacacaagatcccacggaccgg

SEQ ID NO: 70610 - DNA, 75 bp, Artificial Sequence
  Synthetic
tgcacatagctaagtatgaagccaagagcacacaagatcccacggaccggtttgatagctgggaaataagaacta

SEQ ID NO: 70611 - DNA, 75 bp, Artificial Sequence
  Synthetic
gcagtgcggtcggatgtgatcctgacctcttctggagtaaaatacccgttatgctagacggacatctcatagcct

SEQ ID NO: 70612 - DNA, 75 bp, Artificial Sequence
  Synthetic
cctcttctggagtaaaatacccgttatgctagacggacatctcatagcctttgattactccgggtatgatgccag

SEQ ID NO: 70613 - DNA, 75 bp, Artificial Sequence
  Synthetic
tcaccagctatcaacatcagagcacaatctcgcaggatataccaccgctgacacaccaaatcatgtatataccac

SEQ ID NO: 70614 - DNA, 75 bp, Artificial Sequence
  Synthetic
aatctcgcaggatataccaccgctgacacaccaaatcatgtatataccaccaggtggccctataccaacagctgt

SEQ ID NO: 70615 - DNA, 75 bp, Artificial Sequence
  Synthetic
catcgactacctgtgtaactcccaccatctgtacagagataaacactacttcgtgcgtggtggcatgccatcggg

SEQ ID NO: 70616 - DNA, 75 bp, Artificial Sequence
  Synthetic
tcgtgcgtggtggcatgccatcgggttgctctggcaccagcatcttcaactcaatgattaacaatatcataatca

SEQ ID NO: 70617 - DNA, 75 bp, Artificial Sequence
  Synthetic
catccccttcattagtataggcaatgcatatagcagcttttatgatgggtggtcacacttcgatcaaaagggggc

SEQ ID NO: 70618 - DNA, 75 bp, Artificial Sequence
  Synthetic
gcatatagcagcttttatgatgggtggtcacacttcgatcaaaagggggcgtacgggtttaacacacttaacaag

SEQ ID NO: 70619 - DNA, 75 bp, Artificial Sequence
  Synthetic
ttgcatcttacccctggccaatcgacgcctctttgcttgctgaagccggtaaggggtatggactgatcatgacac

SEQ ID NO: 70620 - DNA, 75 bp, Artificial Sequence
  Synthetic
aaacccaaacacgtaaaagcgtgggtcccccgaccaccccgcctgtgccagtacaagaataaagcggacgtgaat

SEQ ID NO: 70621 - DNA, 75 bp, Artificial Sequence
  Synthetic
tgaagtcacttggactaatgtcacctttttgaagaggtatttcagagcagatgagcaataccctttcctggttca

SEQ ID NO: 70622 - DNA, 75 bp, Artificial Sequence
  Synthetic
tcccccgaccaccccgcctgtgccagtacaagaataaagcggacgtgaattttgaacccgaaccagtaaccaaga

SEQ ID NO: 70623 - DNA, 75 bp, Artificial Sequence
  Synthetic
gcgctccttgtgcctattggcctggcacaatggggagcacgaatacgaggaattcattaagaagatcaggagcgt

SEQ ID NO: 70624 - DNA, 75 bp, Artificial Sequence
  Synthetic
gagctatatacgttggaaactatagagtcatcaatagacaccttgccacacacaccgattggcaaaactgtgtgt

SEQ ID NO: 70625 - DNA, 75 bp, Artificial Sequence
  Synthetic
agtcatcaatagacaccttgccacacacaccgattggcaaaactgtgtgtgggaggactacaacagagatctcct

SEQ ID NO: 70626 - DNA, 75 bp, Artificial Sequence
  Synthetic
aatggttggattccttttaaattggagacaatttggtacaaattaaattggctcaaccctactacacccaccgaa

SEQ ID NO: 70627 - DNA, 75 bp, Artificial Sequence
  Synthetic
ttctagaaacaaacactacccagtgagctttgaggggccaggcttggtggaagtccaagagagtgagtactaccc

SEQ ID NO: 70628 - DNA, 75 bp, Artificial Sequence
  Synthetic
agctttgaggggccaggcttggtggaagtccaagagagtgagtactaccctaagagataccagtcccatgtcctc

SEQ ID NO: 70629 - DNA, 75 bp, Artificial Sequence
  Synthetic
gcacaacccaagtgtagatcaggctgatgagtcaccgcattccccacgggtaaccgtggcggtggctgcgttggc

SEQ ID NO: 70630 - DNA, 75 bp, Artificial Sequence
  Synthetic
actatgggcggtgagggtgtcgtgggtttcgcagatgtccgtgatctactgtggcttgaggatgacgccatggag

SEQ ID NO: 70631 - DNA, 75 bp, Artificial Sequence
  Synthetic
gtttcgcagatgtccgtgatctactgtggcttgaggatgacgccatggagcaaggtgttaaggattacgtggaac

SEQ ID NO: 70632 - DNA, 75 bp, Artificial Sequence
  Synthetic
atttctattttggctgcttatggtgacaattgagagattgttaccatatagctattggattggccatccggtgac

SEQ ID NO: 70633 - DNA, 75 bp, Artificial Sequence
  Synthetic
acaattgagagattgttaccatatagctattggattggccatccggtgacaagtagagcaattatctacctattt

SEQ ID NO: 70634 - DNA, 75 bp, Artificial Sequence
  Synthetic
tgggtcaagattctatactagaaaagtccttgaaggcactggtcaagatcatatcagccctggtgattgtggtga

SEQ ID NO: 70635 - DNA, 75 bp, Artificial Sequence
  Synthetic
gtccttgaaggcactggtcaagatcatatcagccctggtgattgtggtgagaaaccatgacgatctgattacagt

SEQ ID NO: 70636 - DNA, 75 bp, Artificial Sequence
  Synthetic
agcgcaggtgtcaacgcagaaaacgggcgcgcacgaaactggggtgaatgcaagcggcaactccataatccatta

SEQ ID NO: 70637 - DNA, 75 bp, Artificial Sequence
  Synthetic
ggcgcgcacgaaactggggtgaatgcaagcggcaactccataatccattacacaaatattaactattacaaggat

SEQ ID NO: 70638 - DNA, 75 bp, Artificial Sequence
  Synthetic
cggaatacccatggctgagcgccagaacagtggatggcttaagaagtttaccgagatgacaaacgcctgtaaggg

SEQ ID NO: 70639 - DNA, 75 bp, Artificial Sequence
  Synthetic
aacagtggatggcttaagaagtttaccgagatgacaaacgcctgtaagggcatggagtggatagctatcaaaatt

SEQ ID NO: 70640 - DNA, 75 bp, Artificial Sequence
  Synthetic
atgataaaatcgctccctgccctaaactccccaacggttgaagaatgtggatacagtgatagggtaagatccatc

SEQ ID NO: 70641 - DNA, 75 bp, Artificial Sequence
  Synthetic
actccccaacggttgaagaatgtggatacagtgatagggtaagatccatcaccctaggcaactccaccatcacta

SEQ ID NO: 70642 - DNA, 75 bp, Artificial Sequence
  Synthetic
aaacaacttcctcttttagagagccaaatcgccacaatcgagcaaagtgcaccatctcagagtgaccaggaacaa

SEQ ID NO: 70643 - DNA, 75 bp, Artificial Sequence
  Synthetic
aaatcgccacaatcgagcaaagtgcaccatctcagagtgaccaggaacaactgttttccaacgttcagtactttg

SEQ ID NO: 70644 - DNA, 75 bp, Artificial Sequence
  Synthetic
aggatcaaccaacgcaaccggatgttgccacgtgcaggttttacacgcttgactccgtgcaatggcaaaagacat

SEQ ID NO: 70645 - DNA, 75 bp, Artificial Sequence
  Synthetic
tgccacgtgcaggttttacacgcttgactccgtgcaatggcaaaagacatcaccagggtggtggtggaaactacc

SEQ ID NO: 70646 - DNA, 75 bp, Artificial Sequence
  Synthetic
gcaattacatacagttcaagtccaaatgccgtattgaacctgtatgcttgcttctgcacggaagtcctggcgccg

SEQ ID NO: 70647 - DNA, 75 bp, Artificial Sequence
  Synthetic
atgccgtattgaacctgtatgcttgcttctgcacggaagtcctggcgccggcaaatcagttgcaacaaacctaat

SEQ ID NO: 70648 - DNA, 75 bp, Artificial Sequence
  Synthetic
acacgtacagtgcaatgcatctaaattccaccaggggtgcctgctggtagtgtgtgtgccggaggctgagatggg

SEQ ID NO: 70649 - DNA, 75 bp, Artificial Sequence
  Synthetic
caaacaacaggccgtagtgatcatggatgatctgtgccagaatcctgacggtaaggacgtctccttattctgcca

SEQ ID NO: 70650 - DNA, 75 bp, Artificial Sequence
  Synthetic
tgtgtgtgccggaggctgagatgggatgtgcgactctggacaatacaccatcgagtgaggaattactagggggtg

SEQ ID NO: 70651 - DNA, 75 bp, Artificial Sequence
  Synthetic
gatgatctgtgccagaatcctgacggtaaggacgtctccttattctgccaaatggtttccagtgtggattttgta

SEQ ID NO: 70652 - DNA, 75 bp, Artificial Sequence
  Synthetic
tccatcaacgctccaaccgtgtcagacagtagggccctagcaaggagattccactttgacatgaatattgaagtg

SEQ ID NO: 70653 - DNA, 75 bp, Artificial Sequence
  Synthetic
acagtagggccctagcaaggagattccactttgacatgaatattgaagtgatttccatgtacagtcagagtggta

SEQ ID NO: 70654 - DNA, 75 bp, Artificial Sequence
  Synthetic
cctgactatcttcccgcaccagtggatcaatttgcgcacgaacaacagcgccactattgtaatgccgtacacaaa

SEQ ID NO: 70655 - DNA, 75 bp, Artificial Sequence
  Synthetic
ctgccctggatccaccacatatgtaccaatcactgtaacgatagcacccatgtgtgctgagtacaacgggctgcg

SEQ ID NO: 70656 - DNA, 75 bp, Artificial Sequence
  Synthetic
tagtgtgcgggaaggctatccaattcattgacagaagaacccaagttagatattctttagatatgcttgtgactg

SEQ ID NO: 70657 - DNA, 75 bp, Artificial Sequence
  Synthetic
ccaatcactgtaacgatagcacccatgtgtgctgagtacaacgggctgcgactggcggggcatcaaggtctgccc

SEQ ID NO: 70658 - DNA, 75 bp, Artificial Sequence
  Synthetic
gatgtcactccagaaatgaggatacctggtgaagtaaaaaatttaatggaaatagcagaagtcgattcagtggtg

SEQ ID NO: 70659 - DNA, 75 bp, Artificial Sequence
  Synthetic
ctggtgaagtaaaaaatttaatggaaatagcagaagtcgattcagtggtgccagtgcaaaatatcggagagaaag

SEQ ID NO: 70660 - DNA, 75 bp, Artificial Sequence
  Synthetic
attgcagacttgctcaagtcagtggacagtgaggccgtgagagagtattgcaaagagaaaggatggctggtacca

SEQ ID NO: 70661 - DNA, 75 bp, Artificial Sequence
  Synthetic
tgcagccaggttactcgagcgtgtttagccgcacactcctgggggagatcctcaactactatactcactggtcag

SEQ ID NO: 70662 - DNA, 75 bp, Artificial Sequence
  Synthetic
tagccgcacactcctgggggagatcctcaactactatactcactggtcaggtagcataaagcttactttcatgtt

SEQ ID NO: 70663 - DNA, 75 bp, Artificial Sequence
  Synthetic
taatctacaagctctttgcgggttttcaaggggcgtacacaggaatgcccaaccagaagcccaaagtacccaccc

SEQ ID NO: 70664 - DNA, 75 bp, Artificial Sequence
  Synthetic
agtcgatgcaatgcttggcacgcatgttgtgtgggatgtaggtttgcaatccagctgcgtcctatgtataccctg

SEQ ID NO: 70665 - DNA, 75 bp, Artificial Sequence
  Synthetic
aaaccgagtacggtgaatttaccatgttaggcatctacgacagatgggccgtcttaccacgccatgctaaacctg

SEQ ID NO: 70666 - DNA, 75 bp, Artificial Sequence
  Synthetic
gttgtgtgggatgtaggtttgcaatccagctgcgtcctatgtataccctggattagccaaacacattaccggtac

SEQ ID NO: 70667 - DNA, 75 bp, Artificial Sequence
  Synthetic
gttaggcatctacgacagatgggccgtcttaccacgccatgctaaacctggaccaaccattctaatgaatgacca

SEQ ID NO: 70668 - DNA, 75 bp, Artificial Sequence
  Synthetic
gcacagagctcatgttacataatgtgcttcgtatcagcttgtaatgatttctctgtgaggctactaaaagacacg

SEQ ID NO: 70669 - DNA, 75 bp, Artificial Sequence
  Synthetic
aaaccgaaatgagaagttcagggatataagaggcttcttggccaaggaagaggtggaggttaacgaggccgtact

SEQ ID NO: 70670 - DNA, 75 bp, Artificial Sequence
  Synthetic
gcttcgtatcagcttgtaatgatttctctgtgaggctactaaaagacacgccctttatatcgcaacaaaattttc

SEQ ID NO: 70671 - DNA, 75 bp, Artificial Sequence
  Synthetic
ataagaggcttcttggccaaggaagaggtggaggttaacgaggccgtacttgcaattaatactagcaagtttccc

SEQ ID NO: 70672 - DNA, 75 bp, Artificial Sequence
  Synthetic
attccgaagctataccggctctcacggcagctgagactggacacacatcacaagttgtcccaggcgataccatgc

SEQ ID NO: 70673 - DNA, 75 bp, Artificial Sequence
  Synthetic
cttatgtacaacttccccacaagggctggacagtgtggcggtgtgctcatgtccactggcaaagttctagggatt

SEQ ID NO: 70674 - DNA, 75 bp, Artificial Sequence
  Synthetic
ggcagctgagactggacacacatcacaagttgtcccaggcgataccatgcagacgcgtcacgtaaaaaattacca

SEQ ID NO: 70675 - DNA, 75 bp, Artificial Sequence
  Synthetic
ctggacagtgtggcggtgtgctcatgtccactggcaaagttctagggattcatgtagggggaaatggacaccaag

SEQ ID NO: 70676 - DNA, 75 bp, Artificial Sequence
  Synthetic
agggtcaaatcgatacgctgagtgggtgataacaactcgccaagcagtgcaattgagaagaaagctagagttctt

SEQ ID NO: 70677 - DNA, 75 bp, Artificial Sequence
  Synthetic
aagcgggattcccggttatcaacacgcctagtaagaccaaattagagcccagtgtcttccaccaagtctttgaag

SEQ ID NO: 70678 - DNA, 75 bp, Artificial Sequence
  Synthetic
gtgataacaactcgccaagcagtgcaattgagaagaaagctagagttcttcacatacatgaggtttgacttggag

SEQ ID NO: 70679 - DNA, 75 bp, Artificial Sequence
  Synthetic
gcctagtaagaccaaattagagcccagtgtcttccaccaagtctttgaaggcaacaaggaaccagcggtcctcaa

SEQ ID NO: 70680 - DNA, 75 bp, Artificial Sequence
  Synthetic
ataatgtacgtgccaccaggtggcccagtgccagataaggttgactcatacgtgtggcagacgtccaccaatccc

SEQ ID NO: 70681 - DNA, 75 bp, Artificial Sequence
  Synthetic
tgtggatgaatacatgttggaagccattgaccactatgctgggcaactggccaccctagacattagcaccgagcc

SEQ ID NO: 70682 - DNA, 75 bp, Artificial Sequence
  Synthetic
attgaccactatgctgggcaactggccaccctagacattagcaccgagccaatgaaactagaggatgcagtgtac

SEQ ID NO: 70683 - DNA, 75 bp, Artificial Sequence
  Synthetic
aacttttatgatggttggtcagagttcgccagaagcggggtgtatggcataaacactttgaacaatatgggaacc

SEQ ID NO: 70684 - DNA, 75 bp, Artificial Sequence
  Synthetic
tcgccagaagcggggtgtatggcataaacactttgaacaatatgggaaccctttacgcaagacatgtgaatgctg

SEQ ID NO: 70685 - DNA, 75 bp, Artificial Sequence
  Synthetic
agagatatcctctcaaagaagaccaaggacttgactaaattaaaggagtgcatggacaagtatggcttgaacttg

SEQ ID NO: 70686 - DNA, 75 bp, Artificial Sequence
  Synthetic
aggacttgactaaattaaaggagtgcatggacaagtatggcttgaacttgccaatggtgacctatgtgaaggatg

SEQ ID NO: 70687 - DNA, 75 bp, Artificial Sequence
  Synthetic
ctccaaggctgtgtcaatatgagaaagcaaagaatgtcaatttccaacccagtggtgtaacgacaaccagacaga

SEQ ID NO: 70688 - DNA, 75 bp, Artificial Sequence
  Synthetic
agcaaagaatgtcaatttccaacccagtggtgtaacgacaaccagacagagtattactgcaatgacaaatactgg

SEQ ID NO: 70689 - DNA, 75 bp, Artificial Sequence
  Synthetic
caatgagacaaacatttggcaatctgtacaaagctttccacctaaacccagggattgtgactggtagtgcggtcg

SEQ ID NO: 70690 - DNA, 75 bp, Artificial Sequence
  Synthetic
agactggcagaactgcgtatgggaggactacaacagggacctattgataagcactaccaccgctcatgggtgcga

SEQ ID NO: 70691 - DNA, 75 bp, Artificial Sequence
  Synthetic
catcttatagcattcgattattctggatatgacgctagtttaagtcctgtatggtttgcctgtttaaaattgcta

SEQ ID NO: 70692 - DNA, 75 bp, Artificial Sequence
  Synthetic
gactacaacagggacctattgataagcactaccaccgctcatgggtgcgacacaatagcaagatgccagtgcgcg

SEQ ID NO: 70693 - DNA, 75 bp, Artificial Sequence
  Synthetic
cagaagagtgaattctatcctaaaaggtatcagtcacacgtgttactcgccacaggatactctgagccaggggac

SEQ ID NO: 70694 - DNA, 75 bp, Artificial Sequence
  Synthetic
ggtatcagtcacacgtgttactcgccacaggatactctgagccaggggactgtgggggcatcctgaggtgtgagc

SEQ ID NO: 70695 - DNA, 75 bp, Artificial Sequence
  Synthetic
gcatgccctcagggtgttctggcaccagtatcttcaactcaatgatcaacaatatcataattaggacccttatgt

SEQ ID NO: 70696 - DNA, 75 bp, Artificial Sequence
  Synthetic
catggcctatagatgcatctttgctcgctgaggctggcagaggctatgggctgatcatgacaccagcagataagg

SEQ ID NO: 70697 - DNA, 75 bp, Artificial Sequence
  Synthetic
tagaagatgacgccatggaacagggtgtcaaggactatgtagaacaattgggaaatgcctttggctcagggttta

SEQ ID NO: 70698 - DNA, 75 bp, Artificial Sequence
  Synthetic
ctgatcatgacaccagcagataagggagagtgcttcaacgaggtgacctggactaacgtcactttcctaaagagg

SEQ ID NO: 70699 - DNA, 75 bp, Artificial Sequence
  Synthetic
tgtcaaggactatgtagaacaattgggaaatgcctttggctcagggtttacaaaccaaatctgtgaacaggttaa

SEQ ID NO: 70700 - DNA, 75 bp, Artificial Sequence
  Synthetic
agccctagtgatagtagtgaggaaccacgacgatctcatcactgtcactgccactctcgcactaattggttgcac

SEQ ID NO: 70701 - DNA, 75 bp, Artificial Sequence
  Synthetic
cacgacgatctcatcactgtcactgccactctcgcactaattggttgcacatcatcgccgtggcgatggctcaag

SEQ ID NO: 70702 - DNA, 75 bp, Artificial Sequence
  Synthetic
cccaagaccacgtgcgctcactgtgcttattggcttggcacaatggagagcatgaatacgaggagtttattcgaa

SEQ ID NO: 70703 - DNA, 75 bp, Artificial Sequence
  Synthetic
ccttctaaattagagacaatttgaaacaatttaaattggcttaaccctactgcgctaaccgaactagataacggc

SEQ ID NO: 70704 - DNA, 75 bp, Artificial Sequence
  Synthetic
atgaccaatgcctgcaaaggcatggaatggattgccgttaaaatccagaaattcattgagtggctcaaggtcaag

SEQ ID NO: 70705 - DNA, 75 bp, Artificial Sequence
  Synthetic
aatggattgccgttaaaatccagaaattcattgagtggctcaaggtcaagatcttgccagaggtcaaagagaagc

SEQ ID NO: 70706 - DNA, 75 bp, Artificial Sequence
  Synthetic
cacagagtgaccaagagcaactcttctccaatgtccagtatttcgctcactactgtagaaaatatgcacctctgt

SEQ ID NO: 70707 - DNA, 75 bp, Artificial Sequence
  Synthetic
ctccaatgtccagtatttcgctcactactgtagaaaatatgcacctctgtacgcagctgaggcaaaaagggtttt

SEQ ID NO: 70708 - DNA, 75 bp, Artificial Sequence
  Synthetic
agccgtgtctagatcaagcactcctgtttccccggaccgagtatcaatagactgctcacgcggttgaaggagaaa

SEQ ID NO: 70709 - DNA, 75 bp, Artificial Sequence
  Synthetic
ccatggtagtccaggtgccggaaagtctgtggcaactaatctgattgggcgctcactggcggaaaaactcaacag

SEQ ID NO: 70710 - DNA, 75 bp, Artificial Sequence
  Synthetic
tctgtggcaactaatctgattgggcgctcactggcggaaaaactcaacagttcagtttactcattaccacccgac

SEQ ID NO: 70711 - DNA, 75 bp, Artificial Sequence
  Synthetic
gatgtgtccctattttgccaaatggtgtcaagcgttgactttgtaccgcccatggcagcgctagaggagaaggga

SEQ ID NO: 70712 - DNA, 75 bp, Artificial Sequence
  Synthetic
tgtcaagcgttgactttgtaccgcccatggcagcgctagaggagaagggaatcctcttcacatctccatttgtgc

SEQ ID NO: 70713 - DNA, 75 bp, Artificial Sequence
  Synthetic
actccgcagcggaaccgactactttgggtgtccgtgtttccttttattccaaatctggctgcttatggtgacaat

SEQ ID NO: 70714 - DNA, 75 bp, Artificial Sequence
  Synthetic
ttgacatgaatatcgaggtgatctctatgtatagccagaatggaaaaatcaacatgccaatgtctgttaagacgt

SEQ ID NO: 70715 - DNA, 75 bp, Artificial Sequence
  Synthetic
tatgtatagccagaatggaaaaatcaacatgccaatgtctgttaagacgtgtgatgacgaatgctgtccagtaaa

SEQ ID NO: 70716 - DNA, 75 bp, Artificial Sequence
  Synthetic
attcgtgccacttagtctgaaagttttgagaacactcaactacgttttattgctgaatagtgcaagatgggagct

SEQ ID NO: 70717 - DNA, 75 bp, Artificial Sequence
  Synthetic
ttgagaacactcaactacgttttattgctgaatagtgcaagatgggagctcaagtgtcaacccaaaaaactgggg

SEQ ID NO: 70718 - DNA, 75 bp, Artificial Sequence
  Synthetic
actggatatgttggttactgaaatgtttagagagtacaatcataggcacagtgtgggcgccactcttgaggccct

SEQ ID NO: 70719 - DNA, 75 bp, Artificial Sequence
  Synthetic
tttagagagtacaatcataggcacagtgtgggcgccactcttgaggccctatttcaaggaccaccagtttatagg

SEQ ID NO: 70720 - DNA, 75 bp, Artificial Sequence
  Synthetic
catccaactcagccaacaggcaggatttctcacaagatcccagcaaattcaccgagcctatgaaagatgtcatga

SEQ ID NO: 70721 - DNA, 75 bp, Artificial Sequence
  Synthetic
tttctcacaagatcccagcaaattcaccgagcctatgaaagatgtcatgattaaatctctcccagctttgaattc

SEQ ID NO: 70722 - DNA, 75 bp, Artificial Sequence
  Synthetic
gaagccgtcagagaatactgtaaggaaatgggatggttagtaccagaggttaattccaccttgcagattgaaaag

SEQ ID NO: 70723 - DNA, 75 bp, Artificial Sequence
  Synthetic
aaatgggatggttagtaccagaggttaattccaccttgcagattgaaaagcatgtcagcagggcatttatttgct

SEQ ID NO: 70724 - DNA, 75 bp, Artificial Sequence
  Synthetic
ggagagcgcgaatgtggtagttgggtatggtgtctggccagagtatttgagggatgacgaagccactgcgcaaga

SEQ ID NO: 70725 - DNA, 75 bp, Artificial Sequence
  Synthetic
tatggtgtctggccagagtatttgagggatgacgaagccactgcgcaagatcaacccacccagccagacgtagct

SEQ ID NO: 70726 - DNA, 75 bp, Artificial Sequence
  Synthetic
gcgcctacacagggatgccaaatcaaaaacccaaggtgcccacattgagacaagctaaagtacagggtccagcat

SEQ ID NO: 70727 - DNA, 75 bp, Artificial Sequence
  Synthetic
aaaacccaaggtgcccacattgagacaagctaaagtacagggtccagcatttgagttcgcggtagcaatgatgaa

SEQ ID NO: 70728 - DNA, 75 bp, Artificial Sequence
  Synthetic
gctctagccgagatgggcttgtttgggcaaaacatgttataccactacttaggcaggtcaggttacacgatacat

SEQ ID NO: 70729 - DNA, 75 bp, Artificial Sequence
  Synthetic
ggcaaaacatgttataccactacttaggcaggtcaggttacacgatacatgtgcagtgcaacgcatccaaattcc

SEQ ID NO: 70730 - DNA, 75 bp, Artificial Sequence
  Synthetic
gccacgccacgccaaacccggaccaaccattctaatgaacgatcaagagattggagtgctggatgctaaagagct

SEQ ID NO: 70731 - DNA, 75 bp, Artificial Sequence
  Synthetic
accattctaatgaacgatcaagagattggagtgctggatgctaaagagctaattgacaaggatggaacgaacctg

SEQ ID NO: 70732 - DNA, 75 bp, Artificial Sequence
  Synthetic
acactaaacttagcaataccgaacacgccagcaccttcgggtcagtgaactccaatgaagcaggagctgtgcaaa

SEQ ID NO: 70733 - DNA, 75 bp, Artificial Sequence
  Synthetic
cgccagcaccttcgggtcagtgaactccaatgaagcaggagctgtgcaaaatgtggttcataatgcagggatggg

SEQ ID NO: 70734 - DNA, 75 bp, Artificial Sequence
  Synthetic
gaggtaaatgaagcagtgttggcaataaacacaagtaaattcccaaacatgtacatacctgttggccaagttact

SEQ ID NO: 70735 - DNA, 75 bp, Artificial Sequence
  Synthetic
taaacacaagtaaattcccaaacatgtacatacctgttggccaagttactgattacggctttctgaatttggggg

SEQ ID NO: 70736 - DNA, 75 bp, Artificial Sequence
  Synthetic
gatgccatatattaatagtgtgccaatggataacatgttcagacattacaacttcacactaatggtgatcccatt

SEQ ID NO: 70737 - DNA, 75 bp, Artificial Sequence
  Synthetic
atggataacatgttcagacattacaacttcacactaatggtgatcccattcgcccagcttgactatgcccctagc

SEQ ID NO: 70738 - DNA, 75 bp, Artificial Sequence
  Synthetic
cggggaaagtgcttggaatacacgtaggcggaaacggccaccagggtttctccgctgctctcctcagacactatt

SEQ ID NO: 70739 - DNA, 75 bp, Artificial Sequence
  Synthetic
aggcggaaacggccaccagggtttctccgctgctctcctcagacactatttcaatgaagaacaaggagaaataga

SEQ ID NO: 70740 - DNA, 75 bp, Artificial Sequence
  Synthetic
aagcaagggttaccgacaatgcttactccaggcagcaaccagtttctgacgtcagatgacttccaatcaccgtca

SEQ ID NO: 70741 - DNA, 75 bp, Artificial Sequence
  Synthetic
ctccaggcagcaaccagtttctgacgtcagatgacttccaatcaccgtcagcaatgccgcaatttgatgtgacac

SEQ ID NO: 70742 - DNA, 75 bp, Artificial Sequence
  Synthetic
attccaccaagttttcgaaggcaacaaggaaccggcagtccttaagaatggagacccacgactcaaggctgactt

SEQ ID NO: 70743 - DNA, 75 bp, Artificial Sequence
  Synthetic
aaggaaccggcagtccttaagaatggagacccacgactcaaggctgacttcgaggaggcaatcttctccaagtac

SEQ ID NO: 70744 - DNA, 75 bp, Artificial Sequence
  Synthetic
acttggtagacaaggttaacacgattgaggcatatagagtccccgtgaagtcaatgagcggaagtgctacacaag

SEQ ID NO: 70745 - DNA, 75 bp, Artificial Sequence
  Synthetic
tgaggcatatagagtccccgtgaagtcaatgagcggaagtgctacacaagtctttggtttcaagctgcagcctgg

SEQ ID NO: 70746 - DNA, 75 bp, Artificial Sequence
  Synthetic
ttagacatcagtacggaatctatgaagctggaggatgccgtgtatggtacagaggggttggaggcgctagactta

SEQ ID NO: 70747 - DNA, 75 bp, Artificial Sequence
  Synthetic
agctggaggatgccgtgtatggtacagaggggttggaggcgctagacttaaccaccagcgcaggttacccctacg

SEQ ID NO: 70748 - DNA, 75 bp, Artificial Sequence
  Synthetic
gctgaccttcacgtattgcggcgcagccatgaccactggcaaatttttaattgcatactcaccacctggtgctgg

SEQ ID NO: 70749 - DNA, 75 bp, Artificial Sequence
  Synthetic
gccatgaccactggcaaatttttaattgcatactcaccacctggtgctggagttcctgccaaccgcaaggatgct

SEQ ID NO: 70750 - DNA, 75 bp, Artificial Sequence
  Synthetic
acaagtatggcctgaacctgccaatggtaacatatgttaaggacgagttgaggtctgctgaaaaggtagccaagg

SEQ ID NO: 70751 - DNA, 75 bp, Artificial Sequence
  Synthetic
ggtaacatatgttaaggacgagttgaggtctgctgaaaaggtagccaagggaaaatccaggctcatagaggcttc

SEQ ID NO: 70752 - DNA, 75 bp, Artificial Sequence
  Synthetic
accaactaccgcttcgtgactcatgacgcatacacagatgcgggatttattacatgctggtaccagactaatata

SEQ ID NO: 70753 - DNA, 75 bp, Artificial Sequence
  Synthetic
acgcatacacagatgcgggatttattacatgctggtaccagactaatatagtgtcacccccagatatcccagctg

SEQ ID NO: 70754 - DNA, 75 bp, Artificial Sequence
  Synthetic
tgttacgggcagtgctgttgggtgtgatccagacgtgttttggagcaaaatccctgttatgcttgatggatacct

SEQ ID NO: 70755 - DNA, 75 bp, Artificial Sequence
  Synthetic
gatccagacgtgttttggagcaaaatccctgttatgcttgatggatacctcatagcctttgattactcgggctat

SEQ ID NO: 70756 - DNA, 75 bp, Artificial Sequence
  Synthetic
cccagaacgccctcctacaaaatgatccagcaactgccatagttagatcggttgagagagtggctgataccatag

SEQ ID NO: 70757 - DNA, 75 bp, Artificial Sequence
  Synthetic
tccagcaactgccatagttagatcggttgagagagtggctgataccatagcaagtggacccactaactcagagag

SEQ ID NO: 70758 - DNA, 75 bp, Artificial Sequence
  Synthetic
acaaactacatagactacctctgtaactcccaccacctatatcgggacaagcactactttgtgagaggtgggatg

SEQ ID NO: 70759 - DNA, 75 bp, Artificial Sequence
  Synthetic
actcccaccacctatatcgggacaagcactactttgtgagaggtgggatgccatcaggttgctcaggcaccagca

SEQ ID NO: 70760 - DNA, 75 bp, Artificial Sequence
  Synthetic
tgttgtgaaccatcacattagatcagagtcctctattgaaaacttcctgagcaggtccgcctgcgtgtacatcga

SEQ ID NO: 70761 - DNA, 75 bp, Artificial Sequence
  Synthetic
gagtcctctattgaaaacttcctgagcaggtccgcctgcgtgtacatcgacatgtatgggacaaaagagaatggt

SEQ ID NO: 70762 - DNA, 75 bp, Artificial Sequence
  Synthetic
agtttagaatgattgcatatggagatgatgtgatcgcctcttacccatggcctattgatgcttcgttattagctg

SEQ ID NO: 70763 - DNA, 75 bp, Artificial Sequence
  Synthetic
tgatgtgatcgcctcttacccatggcctattgatgcttcgttattagctgaagcaggaaggggttatggtctgat

SEQ ID NO: 70764 - DNA, 75 bp, Artificial Sequence
  Synthetic
acatacattagatttgatgttgaaatcacttttgtaatcactagcacacagggaacaccgactcaaaagaacaag

SEQ ID NO: 70765 - DNA, 75 bp, Artificial Sequence
  Synthetic
tcacttttgtaatcactagcacacagggaacaccgactcaaaagaacaaggataccccagttcttacacaccaaa

SEQ ID NO: 70766 - DNA, 75 bp, Artificial Sequence
  Synthetic
cagggcagatgagcaatacccattcctggtccatccagtgatgcctatgaaagacatacatgagtccattagatg

SEQ ID NO: 70767 - DNA, 75 bp, Artificial Sequence
  Synthetic
ctggtccatccagtgatgcctatgaaagacatacatgagtccattagatggaccaaggatccaagaaacacacag

SEQ ID NO: 70768 - DNA, 75 bp, Artificial Sequence
  Synthetic
gtgttttctggacagaagggaatgccccagcccgtatgtcaattcccttcatgagcgtagggaacgcctattgta

SEQ ID NO: 70769 - DNA, 75 bp, Artificial Sequence
  Synthetic
cccagcccgtatgtcaattcccttcatgagcgtagggaacgcctattgtaacttttacgacgggtggtcacactt

SEQ ID NO: 70770 - DNA, 75 bp, Artificial Sequence
  Synthetic
agaagcgtgcccgtggggcgctgtttaactcttcccgcgttttcaaccctacgcagaaagtggctggactccttc

SEQ ID NO: 70771 - DNA, 75 bp, Artificial Sequence
  Synthetic
cacccttggaccatacaatagcacggttcgggtttacttcaaacccaaacatgtgaaggcatgggtacccagacc

SEQ ID NO: 70772 - DNA, 75 bp, Artificial Sequence
  Synthetic
taaaactagagcataattagtaagatttaattggcttaaccctaccacatgtaccgaacttgacaaaagtgcggt

SEQ ID NO: 70773 - DNA, 75 bp, Artificial Sequence
  Synthetic
gttcgggtttacttcaaacccaaacatgtgaaggcatgggtacccagaccaccgcgcctgtgcgactacgtttac

SEQ ID NO: 70774 - DNA, 75 bp, Artificial Sequence
  Synthetic
gtgccgtcagtggttaaccacggggcttttgggcatcaatcaggggctgcgtatgttggaagctaccgtgtggtg

SEQ ID NO: 70775 - DNA, 75 bp, Artificial Sequence
  Synthetic
cttttgggcatcaatcaggggctgcgtatgttggaagctaccgtgtggtgaaccggcatctggcaacccatgtgg

SEQ ID NO: 70776 - DNA, 75 bp, Artificial Sequence
  Synthetic
cagccacgttttgatcaagcacttctgttaccccggactgagtatcaatagactgctcacgcggttgaaggagaa

SEQ ID NO: 70777 - DNA, 75 bp, Artificial Sequence
  Synthetic
ctattgccagatgccagtgtacaacaggggtctatttctgtgcttcaaagaacaaacattacccagtttcatttg

SEQ ID NO: 70778 - DNA, 75 bp, Artificial Sequence
  Synthetic
aggggtctatttctgtgcttcaaagaacaaacattacccagtttcatttgaaggtccaggactggttgaagttca

SEQ ID NO: 70779 - DNA, 75 bp, Artificial Sequence
  Synthetic
tggtgggatcctcaggtgtgagcacggagtgattggtctcgtgacgatggggggtgaaggagtggtcggatttgc

SEQ ID NO: 70780 - DNA, 75 bp, Artificial Sequence
  Synthetic
ggagtgattggtctcgtgacgatggggggtgaaggagtggtcggatttgctgatgtccgcgatctgctgtggttg

SEQ ID NO: 70781 - DNA, 75 bp, Artificial Sequence
  Synthetic
aactgcggagcacacaccctcaagccagagggcagtgtgtcgtaacgggcaactctgcagcggaaccgactactt

SEQ ID NO: 70782 - DNA, 75 bp, Artificial Sequence
  Synthetic
aaccagatttgcgagcaagtaaatctcctgaaagagtcgctggtgggccaggattccatcctagagaaatcactc

SEQ ID NO: 70783 - DNA, 75 bp, Artificial Sequence
  Synthetic
tcctgaaagagtcgctggtgggccaggattccatcctagagaaatcactcaaagccctggtaaaaattatctcag

SEQ ID NO: 70784 - DNA, 75 bp, Artificial Sequence
  Synthetic
aagttgaatacagcaaaatgggagctcaagtatcaacgcaaaagactggggcacatgagaccgggctgaatgcta

SEQ ID NO: 70785 - DNA, 75 bp, Artificial Sequence
  Synthetic
tcaagtatcaacgcaaaagactggggcacatgagaccgggctgaatgctagcggcaattccatcattcactacac

SEQ ID NO: 70786 - DNA, 75 bp, Artificial Sequence
  Synthetic
cgtccccatggcgctggcttaaacaaaaagtctcccaatactatggcattcctatggctgagcgccagaacagcg

SEQ ID NO: 70787 - DNA, 75 bp, Artificial Sequence
  Synthetic
aaaagtctcccaatactatggcattcctatggctgagcgccagaacagcgggtggctcaagaagttcacagaaat

SEQ ID NO: 70788 - DNA, 75 bp, Artificial Sequence
  Synthetic
cacagaaccagtaaaagatatcatgattaaatcactaccagctctcaactcccccacagtagaggagtgcggata

SEQ ID NO: 70789 - DNA, 75 bp, Artificial Sequence
  Synthetic
attaaatcactaccagctctcaactcccccacagtagaggagtgcggatacagtgacagggcgagatcaatcaca

SEQ ID NO: 70790 - DNA, 75 bp, Artificial Sequence
  Synthetic
cctgccagaagtcaaagaaaaacacgtatttttaaacaggctcaaacagctccccctgctggaaagccaaatagc

SEQ ID NO: 70791 - DNA, 75 bp, Artificial Sequence
  Synthetic
gtatttttaaacaggctcaaacagctccccctgctggaaagccaaatagccaccattgagcaaagtgcaccatca

SEQ ID NO: 70792 - DNA, 75 bp, Artificial Sequence
  Synthetic
aaggatagtgaggcaacagcagaggaccaaccgacccaaccagacgttgccacatgtaggttctatacccttgac

SEQ ID NO: 70793 - DNA, 75 bp, Artificial Sequence
  Synthetic
cacatgtaggttctatacccttgactctgtgcaatggcagaaaacctcaccaggatggtggtggaagctgcccga

SEQ ID NO: 70794 - DNA, 75 bp, Artificial Sequence
  Synthetic
gcagttgaggcaaagagagtgttttccctcgaaaagaaaatgagcaattacatacagttcaagtccaaatgccgt

SEQ ID NO: 70795 - DNA, 75 bp, Artificial Sequence
  Synthetic
ccctcgaaaagaaaatgagcaattacatacagttcaagtccaaatgccgtattgagccagtatgtctgctcttgc

SEQ ID NO: 70796 - DNA, 75 bp, Artificial Sequence
  Synthetic
tgtgcagtgcaatgcatctaagttccaccaaggatgcttgctagtagtgtgtgtaccggaagctgagatgggttg

SEQ ID NO: 70797 - DNA, 75 bp, Artificial Sequence
  Synthetic
cagtgtattccctaccaccagatccagaccattttgatgggtacaagcaacaagctgtcgtgattatggacgatc

SEQ ID NO: 70798 - DNA, 75 bp, Artificial Sequence
  Synthetic
agaccattttgatgggtacaagcaacaagctgtcgtgattatggacgatctgtgccaaaatccagatggtaaaga

SEQ ID NO: 70799 - DNA, 75 bp, Artificial Sequence
  Synthetic
ggtcgcatccgggtccaacaagttggtacagagggtggtgtataatgcaggcatgggggtgggtgttggaaacct

SEQ ID NO: 70800 - DNA, 75 bp, Artificial Sequence
  Synthetic
cttgtttacctctccattcgtcttggcctcaactaatgcaggttccatcaacgcgccaaccgtttcagacagcag

SEQ ID NO: 70801 - DNA, 75 bp, Artificial Sequence
  Synthetic
gcctcaactaatgcaggttccatcaacgcgccaaccgtttcagacagcagagctcttgctagaagattccacttt

SEQ ID NO: 70802 - DNA, 75 bp, Artificial Sequence
  Synthetic
caattgtgatgccatacaccaacagtgtacctatggataacatgtttaggcataacaacgtcaccctaatggtta

SEQ ID NO: 70803 - DNA, 75 bp, Artificial Sequence
  Synthetic
gatgaagagtgctgcccagccaatttcaagaaatgttgcccccttgtatgtgggaaggccatccagtttattgac

SEQ ID NO: 70804 - DNA, 75 bp, Artificial Sequence
  Synthetic
tcaagaaatgttgcccccttgtatgtgggaaggccatccagtttattgacagaaggacccaaatgaggtactcct

SEQ ID NO: 70805 - DNA, 75 bp, Artificial Sequence
  Synthetic
gtgccgagtacaatgggttacgtttagcagggcaccagggcttaccaaccatgaatactccggggagctgtcaat

SEQ ID NO: 70806 - DNA, 75 bp, Artificial Sequence
  Synthetic
tccaaggcccgccagtgtataaagagattaaaattagtgttgcacctgaaactccaccaccaccagcaattgcag

SEQ ID NO: 70807 - DNA, 75 bp, Artificial Sequence
  Synthetic
gtgaggtgaagaacttgatggaaatagctgaggttgactcagttgtcccagtccaaaatgttggagagaaggtca

SEQ ID NO: 70808 - DNA, 75 bp, Artificial Sequence
  Synthetic
gattaaaattagtgttgcacctgaaactccaccaccaccagcaattgcagacttattgaaatcagtggacagtga

SEQ ID NO: 70809 - DNA, 75 bp, Artificial Sequence
  Synthetic
actctatggaagcataccagatacctgtgagatccaatgaaggatctggaacgcaagtattcggctttccactgc

SEQ ID NO: 70810 - DNA, 75 bp, Artificial Sequence
  Synthetic
tgtcagtcgagcctttatttgcctccaagcactgacaacttttgtgtctgtggctggaatcatatacatcattta

SEQ ID NO: 70811 - DNA, 75 bp, Artificial Sequence
  Synthetic
caagcactgacaacttttgtgtctgtggctggaatcatatacatcatttataaattgtttgcaggattccagggc

SEQ ID NO: 70812 - DNA, 75 bp, Artificial Sequence
  Synthetic
gcataaagcttacgtttatgttctgtggttcggccatggctactggaaaattccttttggcatactcaccaccag

SEQ ID NO: 70813 - DNA, 75 bp, Artificial Sequence
  Synthetic
gagtttgctgtggccatgatgaaaagaaactccagtacagtgaaaacagaatatggtgagttcaccatgttgggt

SEQ ID NO: 70814 - DNA, 75 bp, Artificial Sequence
  Synthetic
gtttgggacgtggggctacaatcaagttgcgtgctgtgtataccctggataagccaaacacactaccggtatgtt

SEQ ID NO: 70815 - DNA, 75 bp, Artificial Sequence
  Synthetic
gaaactccagtacagtgaaaacagaatatggtgagttcaccatgttgggtatctacgacaggtgggctgtcctac

SEQ ID NO: 70816 - DNA, 75 bp, Artificial Sequence
  Synthetic
aagccaaacacactaccggtatgttgcttcagatgagtataccgcagggggttttattacgtgctggtatcaaac

SEQ ID NO: 70817 - DNA, 75 bp, Artificial Sequence
  Synthetic
tagacaaagatggtacaaatctggaactgacactactcaaactcaatcggaacgagaaattcagagacatcagag

SEQ ID NO: 70818 - DNA, 75 bp, Artificial Sequence
  Synthetic
actgacactactcaaactcaatcggaacgagaaattcagagacatcagaggctttctagccaaagaggaagtgga

SEQ ID NO: 70819 - DNA, 75 bp, Artificial Sequence
  Synthetic
ttacggctttctaaacttaggtggcaccccgactaagagaatgctaatgtacaattttcccacgagagcaggtca

SEQ ID NO: 70820 - DNA, 75 bp, Artificial Sequence
  Synthetic
tgctgagacaggtcacacgtcacaagtagtgccgggtgacaccatgcagacacgccacgttaagaactaccattc

SEQ ID NO: 70821 - DNA, 75 bp, Artificial Sequence
  Synthetic
accccgactaagagaatgctaatgtacaattttcccacgagagcaggtcagtgtggcggtgtcctcatgtccact

SEQ ID NO: 70822 - DNA, 75 bp, Artificial Sequence
  Synthetic
cacgccacgttaagaactaccattcaaggtccgagtcaaccatagagaacttcctatgtaggtcagcatgcgtgt

SEQ ID NO: 70823 - DNA, 75 bp, Artificial Sequence
  Synthetic
aatgatgagcaaggggagattgagtttatagaaagctcaaaagacgcggggtttcctgttattaacaccccaagc

SEQ ID NO: 70824 - DNA, 75 bp, Artificial Sequence
  Synthetic
ttatagaaagctcaaaagacgcggggtttcctgttattaacaccccaagcaaaaccaagcttgaaccgagtgttt

SEQ ID NO: 70825 - DNA, 75 bp, Artificial Sequence
  Synthetic
ttaggagaaagctagaattctttacctacgtccggttcgacctggagctgacgtttgtcataacaagtactcaac

SEQ ID NO: 70826 - DNA, 75 bp, Artificial Sequence
  Synthetic
ctacgtccggttcgacctggagctgacgtttgtcataacaagtactcaacagccctcaaccacacagaaccaaga

SEQ ID NO: 70827 - DNA, 75 bp, Artificial Sequence
  Synthetic
aggaagctatcttctccaaatacatagggaatgttaacacgcacgtggatgaatatatgctagaggctgtggatc

SEQ ID NO: 70828 - DNA, 75 bp, Artificial Sequence
  Synthetic
agggaatgttaacacgcacgtggatgaatatatgctagaggctgtggatcattatgcaggacagttggccaccct

SEQ ID NO: 70829 - DNA, 75 bp, Artificial Sequence
  Synthetic
gtggcaaacatctacgaatcccagtgtgttttggaccgagggaaacgccccgccgcgcatgtccataccgttttt

SEQ ID NO: 70830 - DNA, 75 bp, Artificial Sequence
  Synthetic
cgccgcgcatgtccataccgtttttgagcattggcaacgcctattcaaatttctatgacggatggtctgaatttt

SEQ ID NO: 70831 - DNA, 75 bp, Artificial Sequence
  Synthetic
aacgagtgcggggtacccatacgttgcgctaggcatcaagaagagagacatcctatccaagaagactaaagattt

SEQ ID NO: 70832 - DNA, 75 bp, Artificial Sequence
  Synthetic
gcgctaggcatcaagaagagagacatcctatccaagaagactaaagatttgaccaaacttaaagaatgtatggat

SEQ ID NO: 70833 - DNA, 75 bp, Artificial Sequence
  Synthetic
gcacgggtccaataaaaagcaccattagaatctacttcaaaccgaagcatgtcaaagcgtggatacctagaccac

SEQ ID NO: 70834 - DNA, 75 bp, Artificial Sequence
  Synthetic
aaagaacgtgaacttccgacccagcggagttaccactactaggcaaagcatcactacaatgacaaatacgggcgc

SEQ ID NO: 70835 - DNA, 75 bp, Artificial Sequence
  Synthetic
aagtccagactaattgaagcatctagtttgaatgactccgtggcgatgaggcaaacatttggcaacttgtacaaa

SEQ ID NO: 70836 - DNA, 75 bp, Artificial Sequence
  Synthetic
gtttgaatgactccgtggcgatgaggcaaacatttggcaacttgtacaaaaccttccacttaaacccggggattg

SEQ ID NO: 70837 - DNA, 75 bp, Artificial Sequence
  Synthetic
ctggcaaaactgtgtgtgggaaagttacaacagagacctcttagtgagcacgaccacagcacatggatgtgatat

SEQ ID NO: 70838 - DNA, 75 bp, Artificial Sequence
  Synthetic
tagcttttgactactccggctacgatgccagtttgagccctgtatggtttgcttgtctgaagctgctgctcgaga

SEQ ID NO: 70839 - DNA, 75 bp, Artificial Sequence
  Synthetic
cgaccacagcacatggatgtgatattatagccagatgtcagtgcacaacgggagtgtacttttgtgcgtccaaaa

SEQ ID NO: 70840 - DNA, 75 bp, Artificial Sequence
  Synthetic
tgccagtttgagccctgtatggtttgcttgtctgaagctgctgctcgagaagctcgggtacacacacaaggagac

SEQ ID NO: 70841 - DNA, 75 bp, Artificial Sequence
  Synthetic
accaatcccatgtgcttttagcagctggattttccgaaccaggtgactgtggcggtatcctaaggtgtgagcatg

SEQ ID NO: 70842 - DNA, 75 bp, Artificial Sequence
  Synthetic
ctcggggtgctccggtaccagtattttcaattcaatgatcaataacattataatcagggcactgatgttaaaggt

SEQ ID NO: 70843 - DNA, 75 bp, Artificial Sequence
  Synthetic
gggtgaaggcgtggtcggctttgcagacatccgtgatctcctgtggctggaagatgatgcaatggaacagggagt

SEQ ID NO: 70844 - DNA, 75 bp, Artificial Sequence
  Synthetic
tttagaatgatagcatatggtgatgatgtaattgcatcttatccctggcctattgatgcctccttgctcgctgaa

SEQ ID NO: 70845 - DNA, 75 bp, Artificial Sequence
  Synthetic
cctgaaagaatcactagtgggtcaagactccatcttagagaaatctctaaaagccttagttaagataatatcagc

SEQ ID NO: 70846 - DNA, 75 bp, Artificial Sequence
  Synthetic
gtcacttttttaaagaggtacttcagagcagacgagcaataccctttcttagtccaccctgtcatgcccatgaaa

SEQ ID NO: 70847 - DNA, 75 bp, Artificial Sequence
  Synthetic
gtccccgtggcggtggctcaaacagaaggtgtcacaatattacggaatccctttggctgaacgccaaaacaatag

SEQ ID NO: 70848 - DNA, 75 bp, Artificial Sequence
  Synthetic
gcttggcacaatggggagcacgagtatgaggaattcattcgaaagatcagaagcgtccctgttggacgctgtttg

SEQ ID NO: 70849 - DNA, 75 bp, Artificial Sequence
  Synthetic
cattgaatggctcaaagtaaaaattttgccagaggtcagggaaaaacacgaattcctgaacagacttaaacaact

SEQ ID NO: 70850 - DNA, 75 bp, Artificial Sequence
  Synthetic
tcccacccgcagggcccactgggcgctagcacactggtattgcggtacctttgtgcgcctgttttatccaccccc

SEQ ID NO: 70851 - DNA, 75 bp, Artificial Sequence
  Synthetic
gatcacttcgacggatacaaacagcaggccgtggtgattatggacgatctatgccagaatcctgatgggaaagac

SEQ ID NO: 70852 - DNA, 75 bp, Artificial Sequence
  Synthetic
aggccgtggtgattatggacgatctatgccagaatcctgatgggaaagacgtctccttgttctgccaaatggttt

SEQ ID NO: 70853 - DNA, 75 bp, Artificial Sequence
  Synthetic
catcgaccaatgcaggatctattaatgctccaaccgtgtcagatagcagagccttggcaaggagatttcactttg

SEQ ID NO: 70854 - DNA, 75 bp, Artificial Sequence
  Synthetic
tgctccaaccgtgtcagatagcagagccttggcaaggagatttcactttgacatgaacatcgaggttatttccat

SEQ ID NO: 70855 - DNA, 75 bp, Artificial Sequence
  Synthetic
taaaaagtgctgccctcttgtgtgtgggaaggctatacaattcattgatagaagaacacaggtcagatactctct

SEQ ID NO: 70856 - DNA, 75 bp, Artificial Sequence
  Synthetic
gggaaggctatacaattcattgatagaagaacacaggtcagatactctctagacatgctagtcaccgagatgttt

SEQ ID NO: 70857 - DNA, 75 bp, Artificial Sequence
  Synthetic
atcaaaattagcgttgcaccagagacaccaccaccgcccgccattgcggacctgctcaaatcggtagatagtgag

SEQ ID NO: 70858 - DNA, 75 bp, Artificial Sequence
  Synthetic
caccaccaccgcccgccattgcggacctgctcaaatcggtagatagtgaggctgtgagggagtactgcaaagaaa

SEQ ID NO: 70859 - DNA, 75 bp, Artificial Sequence
  Synthetic
ggatacggtgtgtggccagattacttaaaggacagtgaagcaacagctgaggatcaaccgacacaaccagatgtt

SEQ ID NO: 70860 - DNA, 75 bp, Artificial Sequence
  Synthetic
aggcattgaccacatttgtgtcagtggctggaatcatatatataatatataagctctttgcgggttttcaaggtg

SEQ ID NO: 70861 - DNA, 75 bp, Artificial Sequence
  Synthetic
ggctggaatcatatatataatatataagctctttgcgggttttcaaggtgcttatacaggagtgcccaaccagaa

SEQ ID NO: 70862 - DNA, 75 bp, Artificial Sequence
  Synthetic
gacgccttgtctaacttggggttgtttggccagaacatgcagtatcactacttgggccggactgggtataccata

SEQ ID NO: 70863 - DNA, 75 bp, Artificial Sequence
  Synthetic
gaactcaagcacggtgaaaactgaatatggcgagtttaccatgctgggcatctatgacaggtgggccgttttgcc

SEQ ID NO: 70864 - DNA, 75 bp, Artificial Sequence
  Synthetic
ctgacactactcaaattgaaccggaatgagaagttcagagacatcagaggcttcttagccaaggaggaagtggag

SEQ ID NO: 70865 - DNA, 75 bp, Artificial Sequence
  Synthetic
cttcttagccaaggaggaagtggaggttaatgaggcagtgctagcaattaacaccagcaagtttcccaacatgta

SEQ ID NO: 70866 - DNA, 75 bp, Artificial Sequence
  Synthetic
cacccaccaagagaatgcttatgtacaacttccccacaagagcaggccagtgtggtggagtgctcatgtccaccg

SEQ ID NO: 70867 - DNA, 75 bp, Artificial Sequence
  Synthetic
caacttccccacaagagcaggccagtgtggtggagtgctcatgtccaccggcaaggtactgggtatccatgttgg

SEQ ID NO: 70868 - DNA, 75 bp, Artificial Sequence
  Synthetic
caatcactgttacaatagcacccatgtgtgccgagtacaacgggctgcgcttggcaagccatcaaggccttccaa

SEQ ID NO: 70869 - DNA, 75 bp, Artificial Sequence
  Synthetic
tattgagagctcaaaggacgccgggtttccagtcatcaacacaccaagtaaaacaaagttggagcctagtgtttt

SEQ ID NO: 70870 - DNA, 75 bp, Artificial Sequence
  Synthetic
acgtcaccccagagatgaagatacccggtgaggtgaagaatctaatggaaatagcagaagttgactcagtagtgc

SEQ ID NO: 70871 - DNA, 75 bp, Artificial Sequence
  Synthetic
tttccagtcatcaacacaccaagtaaaacaaagttggagcctagtgttttccaccaggtctttgaggggaacaaa

SEQ ID NO: 70872 - DNA, 75 bp, Artificial Sequence
  Synthetic
ggaaatgtcaacacacacgtggatgagtacatgctggaagcagtggaccactacgcaggccaactagccacccta

SEQ ID NO: 70873 - DNA, 75 bp, Artificial Sequence
  Synthetic
agtacatgctggaagcagtggaccactacgcaggccaactagccaccctagatatcagcactgaaccaatgaaac

SEQ ID NO: 70874 - DNA, 75 bp, Artificial Sequence
  Synthetic
tgtggctcggctatggccactggaaaattcttgctggcgtactcaccgccgggtgccggcgccccaacgaagaga

SEQ ID NO: 70875 - DNA, 75 bp, Artificial Sequence
  Synthetic
cactgggtatcaagaagagggacatcctctctaagaagactaaggacctaacaaagttaaaggaatgtatggaca

SEQ ID NO: 70876 - DNA, 75 bp, Artificial Sequence
  Synthetic
cctctctaagaagactaaggacctaacaaagttaaaggaatgtatggacaagtatggcctgaacctaccaatggt

SEQ ID NO: 70877 - DNA, 75 bp, Artificial Sequence
  Synthetic
ataagccaaacacactatcggtacgtggcttctgacgagtatacagctggtggttttattacttgctggtatcag

SEQ ID NO: 70878 - DNA, 75 bp, Artificial Sequence
  Synthetic
tggcttctgacgagtatacagctggtggttttattacttgctggtatcagaccaacattgtggtccctgctgatg

SEQ ID NO: 70879 - DNA, 75 bp, Artificial Sequence
  Synthetic
tttgaatgattcagtggcgatgagacagacatttggtaatctgtacaaaactttccacctaaacccaggggttgt

SEQ ID NO: 70880 - DNA, 75 bp, Artificial Sequence
  Synthetic
cctttatatcccaggacagctttttccaaggcccagtcgaggatgcgataacagccgcaattggtagagttgctg

SEQ ID NO: 70881 - DNA, 75 bp, Artificial Sequence
  Synthetic
ccagacctcttttggagcaagataccagtgatgttagatggacatctcatagcatttgattactctgggtacgat

SEQ ID NO: 70882 - DNA, 75 bp, Artificial Sequence
  Synthetic
gcagccgagacagggcacacatcccaggtggtcccaggagataccatgcaaacgcgccacgtaaaaaattatcat

SEQ ID NO: 70883 - DNA, 75 bp, Artificial Sequence
  Synthetic
aactacattgactacttgtgcaactcccatcacctgtacagggataaacattactttgtgaggggtggcatgccc

SEQ ID NO: 70884 - DNA, 75 bp, Artificial Sequence
  Synthetic
cttggcataacggggagcacgaatatgaggagttcatccgtaaaattagaagcgtcccagtcggacgttgtttga

SEQ ID NO: 70885 - DNA, 75 bp, Artificial Sequence
  Synthetic
attaggatttattttaaaccaaagcacgttaaagcttggatacccagacctcctaggttatgccagtacgagaag

SEQ ID NO: 70886 - DNA, 75 bp, Artificial Sequence
  Synthetic
ttaaaacagcctgtgggttgtacccacccacagggcccactgggcgctagcactctggtattgcggtacctttgt

SEQ ID NO: 70887 - DNA, 75 bp, Artificial Sequence
  Synthetic
acccacagggcccactgggcgctagcactctggtattgcggtacctttgtgcgcctgttttacccaccctccccc

SEQ ID NO: 70888 - DNA, 75 bp, Artificial Sequence
  Synthetic
tgtatgtggggaattacagggtggtgaacagacacttagcgacacacactgattggcggaattgtgtgtgggaag

SEQ ID NO: 70889 - DNA, 75 bp, Artificial Sequence
  Synthetic
tgttaccccggactgagtatcaataagctgccaaagcggctgaaggagaaaacgttcgttacccggccaattact

SEQ ID NO: 70890 - DNA, 75 bp, Artificial Sequence
  Synthetic
gcggtggaatcctcaggtgcgagcacggtgttatcgggcttgtgaccatgggaggcgatggagtggtcggatttg

SEQ ID NO: 70891 - DNA, 75 bp, Artificial Sequence
  Synthetic
agtctattgagctaattggtagtcctccggcccctgaatgcggctaatcctaactgcggagcaggcactcgcaga

SEQ ID NO: 70892 - DNA, 75 bp, Artificial Sequence
  Synthetic
gaaacgctttcggttcagggtttaccaatcaaatttgtgaacaggttaacctcttgaaagaaacattaataggtc

SEQ ID NO: 70893 - DNA, 75 bp, Artificial Sequence
  Synthetic
ggctttgtgccacttaatttgaaggttgttaagacgctcaatctgatactacttctaaataaagcaaaatgggag

SEQ ID NO: 70894 - DNA, 75 bp, Artificial Sequence
  Synthetic
gcactagtaatagtggttagaaaccacgatgatctggtgacgataactgctaccctcgccctaattgggtgtacg

SEQ ID NO: 70895 - DNA, 75 bp, Artificial Sequence
  Synthetic
ccaacataaattactacaaggatgcggcttccaactcagcaaataggcaggactttacacaagaccccagcaaat

SEQ ID NO: 70896 - DNA, 75 bp, Artificial Sequence
  Synthetic
gggtggctcaagaagtttacagagatgactaacgcatgcaaagggatggagtggattgccatcaagatccaaaag

SEQ ID NO: 70897 - DNA, 75 bp, Artificial Sequence
  Synthetic
ggcttccaactcagcaaataggcaggactttacacaagaccccagcaaattcaccgagccagttaaggatgtgat

SEQ ID NO: 70898 - DNA, 75 bp, Artificial Sequence
  Synthetic
tctagggaactcgaccattacaacacaggagtgtgcaaacgtggtggtcgcatatggggtgtggcccgattacct

SEQ ID NO: 70899 - DNA, 75 bp, Artificial Sequence
  Synthetic
caggagtgtgcaaacgtggtggtcgcatatggggtgtggcccgattacctgcatgatgatgaagcaactgcagag

SEQ ID NO: 70900 - DNA, 75 bp, Artificial Sequence
  Synthetic
tcccttgagaagaaaatgagtaattacatacagttcaagtccaaatgccgcattgaacctgtatgtttgttgttg

SEQ ID NO: 70901 - DNA, 75 bp, Artificial Sequence
  Synthetic
gcagggtggtggtggaagtttcctgatgcgctgtccaatatgggcctgttcgggcaaaatatgcagtatcactac

SEQ ID NO: 70902 - DNA, 75 bp, Artificial Sequence
  Synthetic
atgcgctgtccaatatgggcctgttcgggcaaaatatgcagtatcactacctaggtagatcggggtacacgattc

SEQ ID NO: 70903 - DNA, 75 bp, Artificial Sequence
  Synthetic
gctctaacctaaacaacgctccactagcggctgacctgagtgcaggggaggtggcgcgccaattcactgtagaac

SEQ ID NO: 70904 - DNA, 75 bp, Artificial Sequence
  Synthetic
agcggctgacctgagtgcaggggaggtggcgcgccaattcactgtagaacccgcaaatggacaaaatcaggtaca

SEQ ID NO: 70905 - DNA, 75 bp, Artificial Sequence
  Synthetic
gtcaagtgttgatttcgttccaccaatggctgctttggaagagaaaggaattttgtttacctcccccttcgtctt

SEQ ID NO: 70906 - DNA, 75 bp, Artificial Sequence
  Synthetic
acgcacgaacaacagtgctacaatagtaatgccatacataaatagtgtgcccatggacaatatgttcaggcacaa

SEQ ID NO: 70907 - DNA, 75 bp, Artificial Sequence
  Synthetic
gggccttggccagaagatttcactttgacatgaatatcgaggtcatatcaatgtacagccagaatggcaaaatta

SEQ ID NO: 70908 - DNA, 75 bp, Artificial Sequence
  Synthetic
gtaatgccatacataaatagtgtgcccatggacaatatgttcaggcacaataactttactctgatgatcattccc

SEQ ID NO: 70909 - DNA, 75 bp, Artificial Sequence
  Synthetic
tgacatgaatatcgaggtcatatcaatgtacagccagaatggcaaaattaatatgcctatgtcagtcaaaacatg

SEQ ID NO: 70910 - DNA, 75 bp, Artificial Sequence
  Synthetic
gaatacaacggattaaggctagcagggcaccagggcttacccgtgatgaccacacccggtagcacccagttccta

SEQ ID NO: 70911 - DNA, 75 bp, Artificial Sequence
  Synthetic
ggcaccagggcttacccgtgatgaccacacccggtagcacccagttcctaacttcagatgatttccaatcaccat

SEQ ID NO: 70912 - DNA, 75 bp, Artificial Sequence
  Synthetic
aagtcgactcagtggttccggtcaacaacaccgaaactaatgtaaatggcatggatgcatatcgcatacctgtac

SEQ ID NO: 70913 - DNA, 75 bp, Artificial Sequence
  Synthetic
caacaccgaaactaatgtaaatggcatggatgcatatcgcatacctgtacaatcgaacatggataccggtggcca

SEQ ID NO: 70914 - DNA, 75 bp, Artificial Sequence
  Synthetic
ctacacacactggtcaggcagcattaaactccccttcatgttttgtggatccgccatggccactggtaagttttt

SEQ ID NO: 70915 - DNA, 75 bp, Artificial Sequence
  Synthetic
aaactccccttcatgttttgtggatccgccatggccactggtaagtttttgctagcctactcccctccaggcgcc

SEQ ID NO: 70916 - DNA, 75 bp, Artificial Sequence
  Synthetic
aagccaaaagtgcccacactaaggcaagccaaagtgcaaggccccgcttttgagtttgctgtggctatgatgaag

SEQ ID NO: 70917 - DNA, 75 bp, Artificial Sequence
  Synthetic
gtgctatgtataccatggattagccagacacattaccgattcgtggtggcagatgagtacacagctggcggtttc

SEQ ID NO: 70918 - DNA, 75 bp, Artificial Sequence
  Synthetic
agacacattaccgattcgtggtggcagatgagtacacagctggcggtttcataacctgctggtatcaaacaaatg

SEQ ID NO: 70919 - DNA, 75 bp, Artificial Sequence
  Synthetic
gaatgctgagagacaccaaattcattagtcaaactgcattttatcaaagcccagtggagggcgccatagagagag

SEQ ID NO: 70920 - DNA, 75 bp, Artificial Sequence
  Synthetic
aggttaatgaagctgttctggcaataaacaccagcaagttcccgaacatgtacataccagttggtcaggtaacag

SEQ ID NO: 70921 - DNA, 75 bp, Artificial Sequence
  Synthetic
tagtcaaactgcattttatcaaagcccagtggagggcgccatagagagagccattgcacgggtcgctgacactat

SEQ ID NO: 70922 - DNA, 75 bp, Artificial Sequence
  Synthetic
ccccagtgataacatgcaaaccaggcacgtgaagaactaccattcacgctccgaaaccagcgtcgagaactttct

SEQ ID NO: 70923 - DNA, 75 bp, Artificial Sequence
  Synthetic
cacgtgaagaactaccattcacgctccgaaaccagcgtcgagaactttctgtgtaggtctgcatgtgtatatttt

SEQ ID NO: 70924 - DNA, 75 bp, Artificial Sequence
  Synthetic
gttttccagtcatcaacacaccgagcagaaccaaattggaaccaagcgtgttccaccaagtgtttgagggtaaca

SEQ ID NO: 70925 - DNA, 75 bp, Artificial Sequence
  Synthetic
ctcaggagaaaactagaaatgtttacgtacttgcgtttcgacattgaactcacctttgtcattacaagtgcgcaa

SEQ ID NO: 70926 - DNA, 75 bp, Artificial Sequence
  Synthetic
cgtacttgcgtttcgacattgaactcacctttgtcattacaagtgcgcaagaccaatccactatttcccaagacg

SEQ ID NO: 70927 - DNA, 75 bp, Artificial Sequence
  Synthetic
ttggcaatgtgaacacacatgtagatgagtacatgatggaagccgttgatcattacgcgggacaactagccactc

SEQ ID NO: 70928 - DNA, 75 bp, Artificial Sequence
  Synthetic
ggcaaacatccaccaaccccagcgtcttttggaccgagggtaacgctccaccacgtatgtcagttccctttatga

SEQ ID NO: 70929 - DNA, 75 bp, Artificial Sequence
  Synthetic
cttttggaccgagggtaacgctccaccacgtatgtcagttccctttatgagtatcggtaatgcttatagcacatt

SEQ ID NO: 70930 - DNA, 75 bp, Artificial Sequence
  Synthetic
catccgccacgttaacgggcccaacccagtaccaattaccagcacagtgaggatatactttaagcccaagcatgt

SEQ ID NO: 70931 - DNA, 75 bp, Artificial Sequence
  Synthetic
ccagtaccaattaccagcacagtgaggatatactttaagcccaagcatgttaaggcctgggtgcctaggcctcca

SEQ ID NO: 70932 - DNA, 75 bp, Artificial Sequence
  Synthetic
accaccatgaatactacaggagcctttgggcaacaatcaggggccgcgtacgtgggaaactatagggtggtgaat

SEQ ID NO: 70933 - DNA, 75 bp, Artificial Sequence
  Synthetic
ttgggcaacaatcaggggccgcgtacgtgggaaactatagggtggtgaatagacatttggccacgcacgctgact

SEQ ID NO: 70934 - DNA, 75 bp, Artificial Sequence
  Synthetic
tcgcaaggtgccaatgcaacaccggggtttacttttgtgcatcaaggaataaacactacccagtgacctttgaag

SEQ ID NO: 70935 - DNA, 75 bp, Artificial Sequence
  Synthetic
ctaattacatcgattatctatgcaactcccaccacctgtacagggataaacactactttgtgcgcggtggtatgc

SEQ ID NO: 70936 - DNA, 75 bp, Artificial Sequence
  Synthetic
aaacactacccagtgacctttgaaggaccaggtctagtggaagttcaggagagtgaatactatccaaagagatac

SEQ ID NO: 70937 - DNA, 75 bp, Artificial Sequence
  Synthetic
tttacaaaggcattgacctggatcaatttaggatgattgcatatggtgatgatgtgatagcatcctacccctggc

SEQ ID NO: 70938 - DNA, 75 bp, Artificial Sequence
  Synthetic
gtcatcggtctcgtgactatgggaggtgagggtgttgttggctttgccgatgtgcgtgacctgctgtggttggag

SEQ ID NO: 70939 - DNA, 75 bp, Artificial Sequence
  Synthetic
gtgagggtgttgttggctttgccgatgtgcgtgacctgctgtggttggaggacgatgccatggaacagggagtga

SEQ ID NO: 70940 - DNA, 75 bp, Artificial Sequence
  Synthetic
tgaaggaatcactagtgggtcaggactccatcctggaaaaatccctcaaagctctcgtgaagatcatctcagctc

SEQ ID NO: 70941 - DNA, 75 bp, Artificial Sequence
  Synthetic
ctccatcctggaaaaatccctcaaagctctcgtgaagatcatctcagctctggtaatagtagtgagaaatcacga

SEQ ID NO: 70942 - DNA, 75 bp, Artificial Sequence
  Synthetic
agagcagatgaccaataccctttcttggtacacccagtcatgcccatgaaggacatccacgaatccattaggtgg

SEQ ID NO: 70943 - DNA, 75 bp, Artificial Sequence
  Synthetic
ggtgtctcagtactatggcattcccatggctgagcgccagagcaacgggtggctcaagaaattcacggaagtgac

SEQ ID NO: 70944 - DNA, 75 bp, Artificial Sequence
  Synthetic
atggctgagcgccagagcaacgggtggctcaagaaattcacggaagtgaccaatgcttgcaagggcatggagtgg

SEQ ID NO: 70945 - DNA, 75 bp, Artificial Sequence
  Synthetic
gaattagagacaatttactataatctaaattggcttaaccctaccgcacttaccgaactagacaatggtgtagta

SEQ ID NO: 70946 - DNA, 75 bp, Artificial Sequence
  Synthetic
ttcctcaacagacttaaacaactccccctcttggaaagtcaaattgctaccattgaacagagcgcaccgtcccag

SEQ ID NO: 70947 - DNA, 75 bp, Artificial Sequence
  Synthetic
cttcgaaaaacctagtaacaccatgaacgttgcggagtgtttcgctcagcacttcccccgtgtagatcaggtcga

SEQ ID NO: 70948 - DNA, 75 bp, Artificial Sequence
  Synthetic
acttcccccgtgtagatcaggtcgatgagtcaccgcgttcctcacgggtgaccgtggcggtggctgcgttggcgg

SEQ ID NO: 70949 - DNA, 75 bp, Artificial Sequence
  Synthetic
acagttcaagtccaaatgccgtattgaacctgtatgcttgctactacatggcagccccggagcagggaaatcagt

SEQ ID NO: 70950 - DNA, 75 bp, Artificial Sequence
  Synthetic
tcactttgatggttacaagcaacaagccgttgtgatcatggacgatctgtgccaaaatccagatggaaaagatgt

SEQ ID NO: 70951 - DNA, 75 bp, Artificial Sequence
  Synthetic
tcaaccaatgcaggatccattaacgcaccaacagtttcagacagcagagccctagctaggaggttccactttgac

SEQ ID NO: 70952 - DNA, 75 bp, Artificial Sequence
  Synthetic
gaagagtgctgtccagtcaacttcaagaagtgctgccctcttgtgtgcggaaaagccattcagttcattgataga

SEQ ID NO: 70953 - DNA, 75 bp, Artificial Sequence
  Synthetic
agaagtgctgccctcttgtgtgcggaaaagccattcagttcattgatagaagaactcaagttaggtattccttgg

SEQ ID NO: 70954 - DNA, 75 bp, Artificial Sequence
  Synthetic
aagggccaccagtgtacagggagatcaaaattagtgtcgcacctgaaaccccaccaccaccagcgattgcggact

SEQ ID NO: 70955 - DNA, 75 bp, Artificial Sequence
  Synthetic
caaaattagtgtcgcacctgaaaccccaccaccaccagcgattgcggacttgttgaaatcggtggacagtgaagc

SEQ ID NO: 70956 - DNA, 75 bp, Artificial Sequence
  Synthetic
cagtcgggcctttatctgcctccaagcactgacaaccttcgtgtctgtggctggaatcatttacatcatctataa

SEQ ID NO: 70957 - DNA, 75 bp, Artificial Sequence
  Synthetic
gcactgacaaccttcgtgtctgtggctggaatcatttacatcatctataaactgtttgcaggattccagggcgca

SEQ ID NO: 70958 - DNA, 75 bp, Artificial Sequence
  Synthetic
ttcgcggtggccatgatgaagaggaactccagtacagtaaaaacagaatatggcgaatttacaatgttgggtgtc

SEQ ID NO: 70959 - DNA, 75 bp, Artificial Sequence
  Synthetic
actccagtacagtaaaaacagaatatggcgaatttacaatgttgggtgtctatgacaggtgggctgtcttaccac

SEQ ID NO: 70960 - DNA, 75 bp, Artificial Sequence
  Synthetic
acaaagatggtacaaacctggagttgacgctactgaagctcaatcgaaatgagaaattcagagatatcaggggat

SEQ ID NO: 70961 - DNA, 75 bp, Artificial Sequence
  Synthetic
ttcccgtaggacaggttacagattacggcttcctgaacctaggtggcacacctactaagagaatgctaatgtaca

SEQ ID NO: 70962 - DNA, 75 bp, Artificial Sequence
  Synthetic
ggaatggtcatcaaggtttttcagcagctctccttaagcactacttcaatgatgaacaaggagagattgaattca

SEQ ID NO: 70963 - DNA, 75 bp, Artificial Sequence
  Synthetic
agctctccttaagcactacttcaatgatgaacaaggagagattgaattcatcgagagctcaaaggatgcagggtt

SEQ ID NO: 70964 - DNA, 75 bp, Artificial Sequence
  Synthetic
accagcagttcttagaaatggtgatccacgccttaaagccaactttgaggaggccatattttctaaatacattgg

SEQ ID NO: 70965 - DNA, 75 bp, Artificial Sequence
  Synthetic
ccacgccttaaagccaactttgaggaggccatattttctaaatacattgggaacgttaacacacatgtggacgaa

SEQ ID NO: 70966 - DNA, 75 bp, Artificial Sequence
  Synthetic
gaagatgcagtgtatggcacagaagggttagaggctctggacctaacaacgagtgcggggtatccatatgttgca

SEQ ID NO: 70967 - DNA, 75 bp, Artificial Sequence
  Synthetic
ggttagaggctctggacctaacaacgagtgcggggtatccatatgttgcactaggtattaagaagagagacatcc

SEQ ID NO: 70968 - DNA, 75 bp, Artificial Sequence
  Synthetic
cctatgtgaaggatgaactaagatcggcagaaaaggtggccaaaggaaaatctagactcattgaagcatccagtc

SEQ ID NO: 70969 - DNA, 75 bp, Artificial Sequence
  Synthetic
ggcagaaaaggtggccaaaggaaaatctagactcattgaagcatccagtctgaatgattctgttgcgatgaggca

SEQ ID NO: 70970 - DNA, 75 bp, Artificial Sequence
  Synthetic
agatctcttttggagcaaaatacctgtaatgctggacggacacctcatagctttcgattactctggctatgacgc

SEQ ID NO: 70971 - DNA, 75 bp, Artificial Sequence
  Synthetic
gtaatgctggacggacacctcatagctttcgattactctggctatgacgccagcctgagccccgtttggtttgct

SEQ ID NO: 70972 - DNA, 75 bp, Artificial Sequence
  Synthetic
catcacctgtatagggacaaacactactttgtgcgtggcggcatgccctcagggtgctccggcaccagcatcttc

SEQ ID NO: 70973 - DNA, 75 bp, Artificial Sequence
  Synthetic
actttgtgcgtggcggcatgccctcagggtgctccggcaccagcatcttcaattcaatgatcaacaacattataa

SEQ ID NO: 70974 - DNA, 75 bp, Artificial Sequence
  Synthetic
tgattgcatcatacccttggcccattgatgcctctctgctcgctgaggctggcaaaggctatggcttaatcatga

SEQ ID NO: 70975 - DNA, 75 bp, Artificial Sequence
  Synthetic
tgatgcctctctgctcgctgaggctggcaaaggctatggcttaatcatgacaccagcagacaagggagagtgttt

SEQ ID NO: 70976 - DNA, 75 bp, Artificial Sequence
  Synthetic
tcaccctgtcatgcccatgaaggacatccacgagtccataagacggaccaaagacccaaagaacacccaggatca

SEQ ID NO: 70977 - DNA, 75 bp, Artificial Sequence
  Synthetic
atccacgagtccataagacggaccaaagacccaaagaacacccaggatcacgtgcgctcactgtgcttactggca

SEQ ID NO: 70978 - DNA, 75 bp, Artificial Sequence
  Synthetic
ctacctgcgttctcgacactacgcagaaagtggttggattccttctaaattagagacaattcgataaaatttgaa

SEQ ID NO: 70979 - DNA, 75 bp, Artificial Sequence
  Synthetic
caggagtgtgcaaatgtggttgtaggatatggagtgtggcccacctatttgagagatgatgaagcaacagcagaa

SEQ ID NO: 70980 - DNA, 75 bp, Artificial Sequence
  Synthetic
gccagctgagtcttggccaagcacttctgttaccccggaccgagtatcaataagctactcacgtggctgaaagag

SEQ ID NO: 70981 - DNA, 75 bp, Artificial Sequence
  Synthetic
taaacctcaacacaacaaaatgggagcgcaagtatcaacacaaaaaaccggggctcatgagaccggtttgaatgc

SEQ ID NO: 70982 - DNA, 75 bp, Artificial Sequence
  Synthetic
gcgcaagtatcaacacaaaaaaccggggctcatgagaccggtttgaatgccagtgggaactctaccatacactac

SEQ ID NO: 70983 - DNA, 75 bp, Artificial Sequence
  Synthetic
gaatacaatggattgcgcttggccggcaagcagggcctgcccacgatgttaacacctggaaccaaccggtttctc

SEQ ID NO: 70984 - DNA, 75 bp, Artificial Sequence
  Synthetic
gcaagcagggcctgcccacgatgttaacacctggaaccaaccggtttctcacatctgacgaattccaatctccct

SEQ ID NO: 70985 - DNA, 75 bp, Artificial Sequence
  Synthetic
ttcacagagccggtaaaggatgtaatggttaagaccctgcccgcattaaattcacccactgtggaagaatgcggc

SEQ ID NO: 70986 - DNA, 75 bp, Artificial Sequence
  Synthetic
tggttaagaccctgcccgcattaaattcacccactgtggaagaatgcggctatagtgatcgagtgcgctcgatca

SEQ ID NO: 70987 - DNA, 75 bp, Artificial Sequence
  Synthetic
aatcggactctgagggacccgttaacaacagcgagggtaaagtgttatccatcgagtcataccagatccctgttc

SEQ ID NO: 70988 - DNA, 75 bp, Artificial Sequence
  Synthetic
tgagcgatcgtgaagccactgcagtggatcaaccgacacagcctgatgtggcgacgtgccgcttctacactcttg

SEQ ID NO: 70989 - DNA, 75 bp, Artificial Sequence
  Synthetic
cactggtgggtcaaatattgaactactacacccattggtcagaaatcatccagttaactttcatgttctgtggtt

SEQ ID NO: 70990 - DNA, 75 bp, Artificial Sequence
  Synthetic
ggatcaaccgacacagcctgatgtggcgacgtgccgcttctacactcttgaatcagtgaaatgggagagttcctc

SEQ ID NO: 70991 - DNA, 75 bp, Artificial Sequence
  Synthetic
tcttggaaggactggctacaccatacacgtgcagtgtaatgcatcaaagttccatcaggggtgtctgctcgtcgt

SEQ ID NO: 70992 - DNA, 75 bp, Artificial Sequence
  Synthetic
cacgtgcagtgtaatgcatcaaagttccatcaggggtgtctgctcgtcgtgtgtgtgcccgaagccgagatgggt

SEQ ID NO: 70993 - DNA, 75 bp, Artificial Sequence
  Synthetic
aagagcacagaccaaacgggaccgcagactgcagtccacaatgcgggcatgggcgtagccgtggggaacttaaca

SEQ ID NO: 70994 - DNA, 75 bp, Artificial Sequence
  Synthetic
agactgcagtccacaatgcgggcatgggcgtagccgtggggaacttaacaatatttcctcatcagtggatcaact

SEQ ID NO: 70995 - DNA, 75 bp, Artificial Sequence
  Synthetic
acaattttaccctaatggtgatccctttcgccaaattggaacactcccctcaggcttcaacatacgtaccgatca

SEQ ID NO: 70996 - DNA, 75 bp, Artificial Sequence
  Synthetic
tttcgccaaattggaacactcccctcaggcttcaacatacgtaccgatcactgtcactgtggctcccatgtgcgc

SEQ ID NO: 70997 - DNA, 75 bp, Artificial Sequence
  Synthetic
aacgtcagacgattttcagtctccatctgcaatgccacaatttgacgtcaccccggaaatccaaattccaggcca

SEQ ID NO: 70998 - DNA, 75 bp, Artificial Sequence
  Synthetic
tctgcaatgccacaatttgacgtcaccccggaaatccaaattccaggccaagtgaggaacctaatggaaatagcc

SEQ ID NO: 70999 - DNA, 75 bp, Artificial Sequence
  Synthetic
aggccacagaccagtagcggtgaacaagtttttggattccagttacaaccaggctacgatagcgtattgaaacat

SEQ ID NO: 71000 - DNA, 75 bp, Artificial Sequence
  Synthetic
attacgccaactggtcaggaagcatgaagctaaccttcatgtactgtggtgcagcgatggcaaccggtaagttcc

SEQ ID NO: 71001 - DNA, 75 bp, Artificial Sequence
  Synthetic
gggacgttggtttacagtccagctgcgtgttgtgtgtaccatggattagccaaaccaactacaggtacgtcacta

SEQ ID NO: 71002 - DNA, 75 bp, Artificial Sequence
  Synthetic
ctacaagcaccatattgtgctttgtatccgcgtgcaacgatttctctgtgagactgctgcgtgatacaccattta

SEQ ID NO: 71003 - DNA, 75 bp, Artificial Sequence
  Synthetic
tagccagtgggcctgtcaacaccgagcaaattcctgccttgacagcagtggagacagggcacacatcacaagtgg

SEQ ID NO: 71004 - DNA, 75 bp, Artificial Sequence
  Synthetic
gcaaattcctgccttgacagcagtggagacagggcacacatcacaagtggtaccgagtgatacaatgcagacacg

SEQ ID NO: 71005 - DNA, 75 bp, Artificial Sequence
  Synthetic
ccatagccagatgtcaatgcacaactggggtgtatttttgtgcctcaaggaacaaacattacccagtcgtctttg

SEQ ID NO: 71006 - DNA, 75 bp, Artificial Sequence
  Synthetic
cgcccaatatgccacagagaaggttaacgatgaattggacagatacaccaactgggaaataacaaccagacaagt

SEQ ID NO: 71007 - DNA, 75 bp, Artificial Sequence
  Synthetic
tgtgcttttcagagccaggagactgcggtggtatcatgagatgcgaacatgttgttgttggtattgtaaccatgg

SEQ ID NO: 71008 - DNA, 75 bp, Artificial Sequence
  Synthetic
aacgatgaattggacagatacaccaactgggaaataacaaccagacaagtagcacagttgaggcgtaagctagag

SEQ ID NO: 71009 - DNA, 75 bp, Artificial Sequence
  Synthetic
cggtggtatcatgagatgcgaacatgttgttgttggtattgtaaccatgggtggtgagggcgttgttggatttgc

SEQ ID NO: 71010 - DNA, 75 bp, Artificial Sequence
  Synthetic
gcatcggactcccctccactaacgcaccaagtgatgtatgtaccgccaggaggcccaattcctaaaagttatgaa

SEQ ID NO: 71011 - DNA, 75 bp, Artificial Sequence
  Synthetic
accaagtgatgtatgtaccgccaggaggcccaattcctaaaagttatgaagattttgcctggcagacatccacta

SEQ ID NO: 71012 - DNA, 75 bp, Artificial Sequence
  Synthetic
tagtgattgtggtgagaaaccatgatgacctaataacagtgactgccaccctggccctcattggctgcacttcat

SEQ ID NO: 71013 - DNA, 75 bp, Artificial Sequence
  Synthetic
attgcaacttctatgatggatggtctcacttcagtcagagcggtgtgtacggatataccaccctgaacaacatgg

SEQ ID NO: 71014 - DNA, 75 bp, Artificial Sequence
  Synthetic
tcacttcagtcagagcggtgtgtacggatataccaccctgaacaacatgggacatttgtattttagacatgtgaa

SEQ ID NO: 71015 - DNA, 75 bp, Artificial Sequence
  Synthetic
caatgcttgcaaagggatggaatggatcgcaatcaaaatccaaaaatttatagattggctcaaggttaaaatctt

SEQ ID NO: 71016 - DNA, 75 bp, Artificial Sequence
  Synthetic
tcgtgcgccacgcttgtgcccgtatttgtatgcgagaaatgttaattttgatgtgcaaggcgtaaccgaatctcg

SEQ ID NO: 71017 - DNA, 75 bp, Artificial Sequence
  Synthetic
ttgtatgcgagaaatgttaattttgatgtgcaaggcgtaaccgaatctcggggcaaaatcactcttgaccgatca

SEQ ID NO: 71018 - DNA, 75 bp, Artificial Sequence
  Synthetic
gtcaacagacacctcgccacacacgtcgactggcagaattgcgtgtgggaggattacaatagagacctattagtt

SEQ ID NO: 71019 - DNA, 75 bp, Artificial Sequence
  Synthetic
tcgactggcagaattgcgtgtgggaggattacaatagagacctattagttagcaccaccacagcccacgggtgtg

SEQ ID NO: 71020 - DNA, 75 bp, Artificial Sequence
  Synthetic
ttgaagggcccgggctcattgaggtgcaggagagtgagtattacccaaaaaggtaccagtcccatgtgttgctcg

SEQ ID NO: 71021 - DNA, 75 bp, Artificial Sequence
  Synthetic
ctagctgagaagcttaacagttcagtatactccttgccacctgacccagatcacttcgatggttacaaacaacaa

SEQ ID NO: 71022 - DNA, 75 bp, Artificial Sequence
  Synthetic
gcaggagagtgagtattacccaaaaaggtaccagtcccatgtgttgctcgccgcaggattttctgagccaggtga

SEQ ID NO: 71023 - DNA, 75 bp, Artificial Sequence
  Synthetic
agtgtggatttcgtaccaccaatggctgcactcgaagagaaggggattctattcacctccccttttgtcctagca

SEQ ID NO: 71024 - DNA, 75 bp, Artificial Sequence
  Synthetic
tgctgatgtgcgcgacctcctatggttggaagacgatgctatggagcaaggtgtgaaagactatgtcgaacaatt

SEQ ID NO: 71025 - DNA, 75 bp, Artificial Sequence
  Synthetic
ttggaagacgatgctatggagcaaggtgtgaaagactatgtcgaacaattgggaaacgcttttggctcgggcttc

SEQ ID NO: 71026 - DNA, 75 bp, Artificial Sequence
  Synthetic
atagtcaaaatggaaaaatcaacatgcccatgtcagtgaaaatgtgtgatgaagagtgttgcccagttaatttca

SEQ ID NO: 71027 - DNA, 75 bp, Artificial Sequence
  Synthetic
ttaaaagctctggtcaaaattatatcagctttggtaattgtggtgaggaaccacgatgacctaatcacgatgaca

SEQ ID NO: 71028 - DNA, 75 bp, Artificial Sequence
  Synthetic
cagctttggtaattgtggtgaggaaccacgatgacctaatcacgatgacagccacactggcccttattggttgca

SEQ ID NO: 71029 - DNA, 75 bp, Artificial Sequence
  Synthetic
atatgttggtcactgagatgttcagagagtacaaccatagacacagtgtgggggcaacccttgaggcgctgttcc

SEQ ID NO: 71030 - DNA, 75 bp, Artificial Sequence
  Synthetic
atggctggctcaaaaagttcactgagatgacgaacgcgtgtaaaggcatggaatggatagccgtcaagatccaaa

SEQ ID NO: 71031 - DNA, 75 bp, Artificial Sequence
  Synthetic
caagattagcgttgcacctgaaactccaccgccaccagcaatcgcagatttgttaaaatcagtggacagcgaggc

SEQ ID NO: 71032 - DNA, 75 bp, Artificial Sequence
  Synthetic
agctcccgttattggagagccagattgccacaatcgagcaaagtgcaccatcgcagagtgaccaggagcagctgt

SEQ ID NO: 71033 - DNA, 75 bp, Artificial Sequence
  Synthetic
gcactaacaacctttgtttctgtggccggaataatatatatcatttacaagttattcgcagggttccagggtgcg

SEQ ID NO: 71034 - DNA, 75 bp, Artificial Sequence
  Synthetic
tttcccttgagaaaaagatgagcaattacatacagttcaagtccaaatgccgtattgaacctgtatgcctgctct

SEQ ID NO: 71035 - DNA, 75 bp, Artificial Sequence
  Synthetic
tttgctgtggccatgatgaagaggaattccagcacggtgaaaacagagtatggtgagttcactatgctaggcatc

SEQ ID NO: 71036 - DNA, 75 bp, Artificial Sequence
  Synthetic
gttcagtgtattcactaccaccagacccagaccacttcgacggctacaaacaacaggccgtagtgatcatggatg

SEQ ID NO: 71037 - DNA, 75 bp, Artificial Sequence
  Synthetic
cccagaccacttcgacggctacaaacaacaggccgtagtgatcatggatgacttatgtcagaaccccgacggcaa

SEQ ID NO: 71038 - DNA, 75 bp, Artificial Sequence
  Synthetic
gtgctggatgcaaaagagctggtggacaaggatggcacaaatcttgagctgacactgctgaagcttaaccgaaat

SEQ ID NO: 71039 - DNA, 75 bp, Artificial Sequence
  Synthetic
cattctattcacctccccctttgtcctggcatcaaccaacgcaggttccatcaacgctccaactgtgtcagacag

SEQ ID NO: 71040 - DNA, 75 bp, Artificial Sequence
  Synthetic
ctggcatcaaccaacgcaggttccatcaacgctccaactgtgtcagacagcagagcactagctaggagattccat

SEQ ID NO: 71041 - DNA, 75 bp, Artificial Sequence
  Synthetic
tgtgatgaagagtgctgcccaatcaatttcaagagatgctgcccactagtatgtgggaaggctattcaattcatt

SEQ ID NO: 71042 - DNA, 75 bp, Artificial Sequence
  Synthetic
atttcaagagatgctgcccactagtatgtgggaaggctattcaattcattgacagaagaacccaggttagatact

SEQ ID NO: 71043 - DNA, 75 bp, Artificial Sequence
  Synthetic
tgttccaaggaccaccagtatacagagaaatcaagatcagtgtagcaccagaaacaccaccaccaccagccattg

SEQ ID NO: 71044 - DNA, 75 bp, Artificial Sequence
  Synthetic
agaaatcaagatcagtgtagcaccagaaacaccaccaccaccagccattgcagacttgcttaagtcagtggatag

SEQ ID NO: 71045 - DNA, 75 bp, Artificial Sequence
  Synthetic
acacgttagtagagcgttcatctgcctgcaagcactaactacctttgtctcggttgcaggaatcatctacataat

SEQ ID NO: 71046 - DNA, 75 bp, Artificial Sequence
  Synthetic
ctgcaagcactaactacctttgtctcggttgcaggaatcatctacataatctacaaactctttgcaggttttcaa

SEQ ID NO: 71047 - DNA, 75 bp, Artificial Sequence
  Synthetic
ttcgaattcgcagtagccatgatgaaaaggaattcaagcacagtgaaaaccgagtatggtgaattcaccatgctg

SEQ ID NO: 71048 - DNA, 75 bp, Artificial Sequence
  Synthetic
aaaggaattcaagcacagtgaaaaccgagtatggtgaattcaccatgctgggcatttatgacagatgggctgtgt

SEQ ID NO: 71049 - DNA, 75 bp, Artificial Sequence
  Synthetic
tagtggacaaagatggcaccaacttagagttgacactactcaaactgaaccggaatgagaggttcagggacatca

SEQ ID NO: 71050 - DNA, 75 bp, Artificial Sequence
  Synthetic
cgggcagcgctgtcggatgtgaccccgacctcttttggagtaaaataccagtaatgctagatggacatctcatag

SEQ ID NO: 71051 - DNA, 75 bp, Artificial Sequence
  Synthetic
agagttgacactactcaaactgaaccggaatgagaggttcagggacatcagaggtttcctagccaaggaagaggt

SEQ ID NO: 71052 - DNA, 75 bp, Artificial Sequence
  Synthetic
agattatggcttcttgaacctaggtggtacacccactaagagaatgctcatgtataacttccccacaagagccgg

SEQ ID NO: 71053 - DNA, 75 bp, Artificial Sequence
  Synthetic
ggtacacccactaagagaatgctcatgtataacttccccacaagagccggtcagtgtggtggggtgcttatgtcc

SEQ ID NO: 71054 - DNA, 75 bp, Artificial Sequence
  Synthetic
ttagaacactgatgttgaaggtgtacaagggcattgacctggatcagttcaggatgattgcatatggagacgatg

SEQ ID NO: 71055 - DNA, 75 bp, Artificial Sequence
  Synthetic
tttaatgatgaacaaggggagattgagttcatcgaaaattcaagggacgcggggttcccagtgatcaacacaccc

SEQ ID NO: 71056 - DNA, 75 bp, Artificial Sequence
  Synthetic
agttcatcgaaaattcaagggacgcggggttcccagtgatcaacacacccagcaagaccaaactggaaccaagtg

SEQ ID NO: 71057 - DNA, 75 bp, Artificial Sequence
  Synthetic
tcgaggaagccatattttccaaatacatcgggaatgtcaacacacacgtggatgagtacatgttggaagctgtcg

SEQ ID NO: 71058 - DNA, 75 bp, Artificial Sequence
  Synthetic
catcgggaatgtcaacacacacgtggatgagtacatgttggaagctgtcgaccactatgctgggcagttggccgc

SEQ ID NO: 71059 - DNA, 75 bp, Artificial Sequence
  Synthetic
gacaacgagcgcaggctacccctatgttgcgctgggcatcaagaaaagggatattctctcaaagaaaaccaaaga

SEQ ID NO: 71060 - DNA, 75 bp, Artificial Sequence
  Synthetic
gttgcgctgggcatcaagaaaagggatattctctcaaagaaaaccaaagacctgaccaaattgaaagagtgcatg

SEQ ID NO: 71061 - DNA, 75 bp, Artificial Sequence
  Synthetic
gggaagtctaggttgattgaagcatccagtcttaatgattcagtggcaatgagacaaacatttggcaatttgtac

SEQ ID NO: 71062 - DNA, 75 bp, Artificial Sequence
  Synthetic
ccagtcttaatgattcagtggcaatgagacaaacatttggcaatttgtacaagacctttcacttaaacccaggaa

SEQ ID NO: 71063 - DNA, 75 bp, Artificial Sequence
  Synthetic
gacaaaccagtcgcatcttgatcaagcacttctgtctccccggaccgagtatcaataaactgctcacgcggttga

SEQ ID NO: 71064 - DNA, 75 bp, Artificial Sequence
  Synthetic
tcatagcatttgattactccggctatgacgccagcttaagtcctgtctggtttgcttgtttgaaattgctacttg

SEQ ID NO: 71065 - DNA, 75 bp, Artificial Sequence
  Synthetic
tgacgccagcttaagtcctgtctggtttgcttgtttgaaattgctacttgggaaacttggatacactcacaagga

SEQ ID NO: 71066 - DNA, 75 bp, Artificial Sequence
  Synthetic
gccctcagggtgttcgggtaccagcatcttcaactcaatgatcaataacatcatcatcaggactcttatgttaaa

SEQ ID NO: 71067 - DNA, 75 bp, Artificial Sequence
  Synthetic
gcgaagagtctattgagctagttggtagtcctccggcccctgaatgcggctaatcctaactgcggagcaggcacc

SEQ ID NO: 71068 - DNA, 75 bp, Artificial Sequence
  Synthetic
atcttcaactcaatgatcaataacatcatcatcaggactcttatgttaaaagtatacaagggaattgacctggac

SEQ ID NO: 71069 - DNA, 75 bp, Artificial Sequence
  Synthetic
aacgggcaactctgcagcggaaccgactactttgggtgtccgtgtttccttttacctcaattttggctgcttatg

SEQ ID NO: 71070 - DNA, 75 bp, Artificial Sequence
  Synthetic
gaggctggcaaagactacgggttaatcatgacaccagcagataaaggagagtgcttcaatgaggtgacctggact

SEQ ID NO: 71071 - DNA, 75 bp, Artificial Sequence
  Synthetic
tcatgacaccagcagataaaggagagtgcttcaatgaggtgacctggactaacgtaactttcttgaaacggtact

SEQ ID NO: 71072 - DNA, 75 bp, Artificial Sequence
  Synthetic
ttcgttggttttataccactcaccctcgcggaggttaagattttactttatataatacacttgaacacattaaaa

SEQ ID NO: 71073 - DNA, 75 bp, Artificial Sequence
  Synthetic
tcgcggaggttaagattttactttatataatacacttgaacacattaaaatgggagcacaggtgtcaactcaaaa

SEQ ID NO: 71074 - DNA, 75 bp, Artificial Sequence
  Synthetic
ggaccaaagatccaaagaacacccaagatcacgtgcgctcgctgtgcctattggcctggcacaacggagagcacg

SEQ ID NO: 71075 - DNA, 75 bp, Artificial Sequence
  Synthetic
agatgcagcgtcaaattccgccaacagacaagatttcaaacaagatcctagtaaattcacggaaccgctcaaaga

SEQ ID NO: 71076 - DNA, 75 bp, Artificial Sequence
  Synthetic
agacaagatttcaaacaagatcctagtaaattcacggaaccgctcaaagatgtaatggtgaagtctttaccagca

SEQ ID NO: 71077 - DNA, 75 bp, Artificial Sequence
  Synthetic
tgcgcaggaagtggttggactccttttaaaattagagacaatttaaagcaatttgaattggcttaaccctactgt

SEQ ID NO: 71078 - DNA, 75 bp, Artificial Sequence
  Synthetic
ttaaaattagagacaatttaaagcaatttgaattggcttaaccctactgtactaaccgaactagacaacggtgtg

SEQ ID NO: 71079 - DNA, 75 bp, Artificial Sequence
  Synthetic
acccacagggcccactgggcgttagcactctggtatcacggtacctttgtgcgcctgttttatccaccctcccta

SEQ ID NO: 71080 - DNA, 75 bp, Artificial Sequence
  Synthetic
actacacaggaaagtgccaacgttgttattggatatggggagtggccagggtacttggcggatgatcaggctacg

SEQ ID NO: 71081 - DNA, 75 bp, Artificial Sequence
  Synthetic
ttattggatatggggagtggccagggtacttggcggatgatcaggctacggcagaggatcaaccgactcagccag

SEQ ID NO: 71082 - DNA, 75 bp, Artificial Sequence
  Synthetic
taccagacgcactgaaagacatgggactgtttggccaaaacatgtattatcactacttaggaagagcaggctaca

SEQ ID NO: 71083 - DNA, 75 bp, Artificial Sequence
  Synthetic
actgtttggccaaaacatgtattatcactacttaggaagagcaggctacacgatacatgtccagtgcaacgcatc

SEQ ID NO: 71084 - DNA, 75 bp, Artificial Sequence
  Synthetic
gtttgccgtggaagaaatcaccaagggtgaggaagcaatggagttcacagcaggtaaccaccagggtaccaccac

SEQ ID NO: 71085 - DNA, 75 bp, Artificial Sequence
  Synthetic
ggtgaggaagcaatggagttcacagcaggtaaccaccagggtaccaccaccagtgtccaaaaggcagtttgcaac

SEQ ID NO: 71086 - DNA, 75 bp, Artificial Sequence
  Synthetic
gccactatagtaatgccatatataaactgtgtcccgatggataccatgtaccgacactacaatttcaccctaatg

SEQ ID NO: 71087 - DNA, 75 bp, Artificial Sequence
  Synthetic
actgtgtcccgatggataccatgtaccgacactacaatttcaccctaatggtgattccctttgtacaattgagat

SEQ ID NO: 71088 - DNA, 75 bp, Artificial Sequence
  Synthetic
ggttttataccgttagattacaaagtcctaaacaccctgaatctcattataacacttaattcagcaaaatgggag

SEQ ID NO: 71089 - DNA, 75 bp, Artificial Sequence
  Synthetic
tatcagcacatcaagggcttccagttctcaacacgccaggaagcaatcagtttttgaccactgatgattaccaat

SEQ ID NO: 71090 - DNA, 75 bp, Artificial Sequence
  Synthetic
tctcaacacgccaggaagcaatcagtttttgaccactgatgattaccaatctccatgcgccatgcctgaatatga

SEQ ID NO: 71091 - DNA, 75 bp, Artificial Sequence
  Synthetic
ctaatattaactactacaaggatgccgcctcaaactcggcaaatcgtcaggactttacccaggacccaagcaagt

SEQ ID NO: 71092 - DNA, 75 bp, Artificial Sequence
  Synthetic
gactttacccaggacccaagcaagtttactgagcctgtgaaggacgtgatggttaaatcattacccgccctcaac

SEQ ID NO: 71093 - DNA, 75 bp, Artificial Sequence
  Synthetic
tgtgaacaatctgagtgacaaggtcaacacaattgagaccttcgggattccagtgagtgcaagtgatagcgcgca

SEQ ID NO: 71094 - DNA, 75 bp, Artificial Sequence
  Synthetic
aacacaattgagaccttcgggattccagtgagtgcaagtgatagcgcgcaaaccgcagctattttcacattccaa

SEQ ID NO: 71095 - DNA, 75 bp, Artificial Sequence
  Synthetic
acttggcaactccaccattaccacccaggagtgtgcgaatgtggttgtgggatatggcgtgtggccaagttactt

SEQ ID NO: 71096 - DNA, 75 bp, Artificial Sequence
  Synthetic
caggagtgtgcgaatgtggttgtgggatatggcgtgtggccaagttacttacaggatgacgaagccacagcagag

SEQ ID NO: 71097 - DNA, 75 bp, Artificial Sequence
  Synthetic
ggtagtataaaattaacattccttttttgtggctcggcaatggctaccggcaagattttgttagcgtactcccct

SEQ ID NO: 71098 - DNA, 75 bp, Artificial Sequence
  Synthetic
tttgtggctcggcaatggctaccggcaagattttgttagcgtactcccctcctggggctggagttccaactaaaa

SEQ ID NO: 71099 - DNA, 75 bp, Artificial Sequence
  Synthetic
gatggctggtggtggaagttccctgaggcactcaagaatatgggcttgttcgggcaaaacatggaataccattac

SEQ ID NO: 71100 - DNA, 75 bp, Artificial Sequence
  Synthetic
aggcactcaagaatatgggcttgttcgggcaaaacatggaataccattacctaggcaggtctggatacaccattc

SEQ ID NO: 71101 - DNA, 75 bp, Artificial Sequence
  Synthetic
ggattagtcaaacgcattacaggttagtggaccaggatgaatacacggcagctggttacatatcagggtggtacc

SEQ ID NO: 71102 - DNA, 75 bp, Artificial Sequence
  Synthetic
agtggaccaggatgaatacacggcagctggttacatatcagggtggtaccaaaccaacttgattgtgccacccag

SEQ ID NO: 71103 - DNA, 75 bp, Artificial Sequence
  Synthetic
gctcggatacagaaagagaagtagttgcagcatcactcagcagtgaggacacagccaagagtttctcgcgcacag

SEQ ID NO: 71104 - DNA, 75 bp, Artificial Sequence
  Synthetic
gacagtcgtgtataatgctggcatgggcgtaggtgttgggaacttaaccatcttccctcaccagtggattaatct

SEQ ID NO: 71105 - DNA, 75 bp, Artificial Sequence
  Synthetic
cccattcatagagcaagaagcggcattgcaaggtgacgatgataggccccagggcacccgcggtagcaccgtaca

SEQ ID NO: 71106 - DNA, 75 bp, Artificial Sequence
  Synthetic
ttgcaaggtgacgatgataggccccagggcacccgcggtagcaccgtacaagacactcaaaagagcggcccatca

SEQ ID NO: 71107 - DNA, 75 bp, Artificial Sequence
  Synthetic
gcggaccaataacagcgccactatagtcatgccatacataaatagtgtgccaatggacaacatgtttcgacatta

SEQ ID NO: 71108 - DNA, 75 bp, Artificial Sequence
  Synthetic
cagaccagacacgtggtgaactaccactccaggtcagaatcaaccatagaaaattttctgtgcaggtctgcatgt

SEQ ID NO: 71109 - DNA, 75 bp, Artificial Sequence
  Synthetic
actccaggtcagaatcaaccatagaaaattttctgtgcaggtctgcatgtgtctacatcggcacctataattcaa

SEQ ID NO: 71110 - DNA, 75 bp, Artificial Sequence
  Synthetic
agtaactgtagcgcccatgtatgccgagtataatgggctcagattagcctcgcatcaaggattacccacgatgct

SEQ ID NO: 71111 - DNA, 75 bp, Artificial Sequence
  Synthetic
acatcagatgatttccaatcaccatcagccatgccgcaatttgacgttacaccagaaatgaaaataccaggtgag

SEQ ID NO: 71112 - DNA, 75 bp, Artificial Sequence
  Synthetic
cagccatgccgcaatttgacgttacaccagaaatgaaaataccaggtgaggtccacaacttgatggagatggcag

SEQ ID NO: 71113 - DNA, 75 bp, Artificial Sequence
  Synthetic
ggaagtgtgaaattttcacatacttacgatttgacatggaagtgacctttgtgattacgagtacaaccaccaatg

SEQ ID NO: 71114 - DNA, 75 bp, Artificial Sequence
  Synthetic
acgatttgacatggaagtgacctttgtgattacgagtacaaccaccaatggagggtcagtcagcaatgaagcccc

SEQ ID NO: 71115 - DNA, 75 bp, Artificial Sequence
  Synthetic
cggggggggatcagttgcatacacaggtctttgggttccagatgcagccgggcttaaatagtgtgttcaaacgca

SEQ ID NO: 71116 - DNA, 75 bp, Artificial Sequence
  Synthetic
ctccaccaatcctagcgtgttttggactgaagggagcacgccaccacgcatgtcaatcccatttatcagcatcgg

SEQ ID NO: 71117 - DNA, 75 bp, Artificial Sequence
  Synthetic
ggcttaaatagtgtgttcaaacgcacattgctgggagagattttgaattattatgcacactggtcaggtagtgtg

SEQ ID NO: 71118 - DNA, 75 bp, Artificial Sequence
  Synthetic
actgaagggagcacgccaccacgcatgtcaatcccatttatcagcatcggcaatgcatacagcatgttctatgat

SEQ ID NO: 71119 - DNA, 75 bp, Artificial Sequence
  Synthetic
attagcatactcaccaccaggtgcctctcccccccaaaatcgcaaacaggctatgttggggacacacgttatatg

SEQ ID NO: 71120 - DNA, 75 bp, Artificial Sequence
  Synthetic
tctcccccccaaaatcgcaaacaggctatgttggggacacacgttatatgggatgtgggtttacaatctagctgt

SEQ ID NO: 71121 - DNA, 75 bp, Artificial Sequence
  Synthetic
catgtgggagcggtggagcgcactatcacaagtaaagtgcgggtgtacttcaagcccaagcacgtacggggctgg

SEQ ID NO: 71122 - DNA, 75 bp, Artificial Sequence
  Synthetic
tcacaagtaaagtgcgggtgtacttcaagcccaagcacgtacggggctgggtgccgcgtccacctaggttgtgtc

SEQ ID NO: 71123 - DNA, 75 bp, Artificial Sequence
  Synthetic
gtcacatgttggtaccaaactggattaatcgtaccgcctggggcgccaccatcgtgtaccatattgtgctttgcc

SEQ ID NO: 71124 - DNA, 75 bp, Artificial Sequence
  Synthetic
cgaatctggcgaattgcggtgcttacggccaacaatctggagccatctatgtgagcaactacagagtggtgaata

SEQ ID NO: 71125 - DNA, 75 bp, Artificial Sequence
  Synthetic
atcgtgtaccatattgtgctttgcctcagcttgtaacgatttctcagtgcgcatgctcagagacacaccgttcat

SEQ ID NO: 71126 - DNA, 75 bp, Artificial Sequence
  Synthetic
cggccaacaatctggagccatctatgtgagcaactacagagtggtgaatagacacttggctacccacacagactg

SEQ ID NO: 71127 - DNA, 75 bp, Artificial Sequence
  Synthetic
cggttgcaagggtggctgatacaatgccaactggaccgcgcaacactgagagtatacctgctttgacagcagtag

SEQ ID NO: 71128 - DNA, 75 bp, Artificial Sequence
  Synthetic
gccaactggaccgcgcaacactgagagtatacctgctttgacagcagtagaaacaggacatacctcccaggtcgt

SEQ ID NO: 71129 - DNA, 75 bp, Artificial Sequence
  Synthetic
agccaggtgccagtgcactactggggtctacttttgtgcgtctagaaacaagcactacccggtgtcctttgaagg

SEQ ID NO: 71130 - DNA, 75 bp, Artificial Sequence
  Synthetic
gtctacttttgtgcgtctagaaacaagcactacccggtgtcctttgaaggaccaggccttgttgaagttcaagag

SEQ ID NO: 71131 - DNA, 75 bp, Artificial Sequence
  Synthetic
gtgcagggccgcatgtgtgtacataacaacgtacaaatcagccggggggacgccaacagaaagatatgcaagttg

SEQ ID NO: 71132 - DNA, 75 bp, Artificial Sequence
  Synthetic
acaacgtacaaatcagccggggggacgccaacagaaagatatgcaagttggcgcattaacaccagacagatggta

SEQ ID NO: 71133 - DNA, 75 bp, Artificial Sequence
  Synthetic
gggatacttagatgtgaacacggagtcattgggatagtaaccatggggggtgagggtgtcgtcggctttgctgac

SEQ ID NO: 71134 - DNA, 75 bp, Artificial Sequence
  Synthetic
tcattgggatagtaaccatggggggtgagggtgtcgtcggctttgctgacgtgcgtgacctcctgtggttggagg

SEQ ID NO: 71135 - DNA, 75 bp, Artificial Sequence
  Synthetic
caagaccctgggacccagttagcgcaggacatgcccgttttgacgcaccagatcatgtacatcccgcctggtgga

SEQ ID NO: 71136 - DNA, 75 bp, Artificial Sequence
  Synthetic
aggacatgcccgttttgacgcaccagatcatgtacatcccgcctggtggaccagtaccaaatagcgccacggatt

SEQ ID NO: 71137 - DNA, 75 bp, Artificial Sequence
  Synthetic
aaatttgtgagcaggttaaccttttaaaggaatcgcttgtgggtcaagactccatcctagaaaaatccctgaaag

SEQ ID NO: 71138 - DNA, 75 bp, Artificial Sequence
  Synthetic
aaaggaatcgcttgtgggtcaagactccatcctagaaaaatccctgaaagctctagtgaaaataatatcagcctt

SEQ ID NO: 71139 - DNA, 75 bp, Artificial Sequence
  Synthetic
tcataagcattggaaacgcgtatagtaacttttatgatggatggtcccacttcactcaggagggcgtgtatgggt

SEQ ID NO: 71140 - DNA, 75 bp, Artificial Sequence
  Synthetic
taacttttatgatggatggtcccacttcactcaggagggcgtgtatgggtttaactcgctgaacaacatgggcca

SEQ ID NO: 71141 - DNA, 75 bp, Artificial Sequence
  Synthetic
tccgtggcggtggcttaaacagaaagtgtcacagtactatggaatacccatggctgagcgccaaagcaatgggtg

SEQ ID NO: 71142 - DNA, 75 bp, Artificial Sequence
  Synthetic
gtgtcacagtactatggaatacccatggctgagcgccaaagcaatgggtggcttaaaaagtttactgagatgacg

SEQ ID NO: 71143 - DNA, 75 bp, Artificial Sequence
  Synthetic
acacgtgcgcgcttgggtcccaagaccgcccagactgtgcccgtatgtcaagagttcaaacgtgaacttcaaacc

SEQ ID NO: 71144 - DNA, 75 bp, Artificial Sequence
  Synthetic
ccgcccagactgtgcccgtatgtcaagagttcaaacgtgaacttcaaaccaactgctgtcaccaccgagcgaaaa

SEQ ID NO: 71145 - DNA, 75 bp, Artificial Sequence
  Synthetic
ccagaggtcaaggaaaagcatgagttcttaaatagacttaagcagcttcccttactggaaagtcaaatcgccaca

SEQ ID NO: 71146 - DNA, 75 bp, Artificial Sequence
  Synthetic
tcttaaatagacttaagcagcttcccttactggaaagtcaaatcgccacaattgaacagagtgcaccatcccaga

SEQ ID NO: 71147 - DNA, 75 bp, Artificial Sequence
  Synthetic
gtgtacgtgggtaattacagagtggtcaatagacatctggccacatctaccgactggcaaaatagcgtatgggaa

SEQ ID NO: 71148 - DNA, 75 bp, Artificial Sequence
  Synthetic
tcaatagacatctggccacatctaccgactggcaaaatagcgtatgggaagattacaacagagacctattggtga

SEQ ID NO: 71149 - DNA, 75 bp, Artificial Sequence
  Synthetic
ggggcaagcactacccagtgagttttgagggtccaggccttgtggaggttcaagaaagtgaatactatccaaaga

SEQ ID NO: 71150 - DNA, 75 bp, Artificial Sequence
  Synthetic
tgagggtccaggccttgtggaggttcaagaaagtgaatactatccaaagagatatcagtcacatgtactacttgc

SEQ ID NO: 71151 - DNA, 75 bp, Artificial Sequence
  Synthetic
gtactcattaccaccagacccagatcactttgatggttataaacaacaagctgttgtgatcatggatgacctgtg

SEQ ID NO: 71152 - DNA, 75 bp, Artificial Sequence
  Synthetic
cactttgatggttataaacaacaagctgttgtgatcatggatgacctgtgccagaatcctgacggaaaagacgtc

SEQ ID NO: 71153 - DNA, 75 bp, Artificial Sequence
  Synthetic
gggtggggaaggcgtggtaggctttgctgacattcgtgacttgctgtggttggaggatgacgccatggagcaggg

SEQ ID NO: 71154 - DNA, 75 bp, Artificial Sequence
  Synthetic
gctgacattcgtgacttgctgtggttggaggatgacgccatggagcagggtgtgagagattacgtggaacagctc

SEQ ID NO: 71155 - DNA, 75 bp, Artificial Sequence
  Synthetic
tttacctctccatttgtcctggcatcaaccaatgccggatccatcaacgctccaaccgtctcggacagtagggcc

SEQ ID NO: 71156 - DNA, 75 bp, Artificial Sequence
  Synthetic
caaccaatgccggatccatcaacgctccaaccgtctcggacagtagggccctggcacggaggtttcactttgaca

SEQ ID NO: 71157 - DNA, 75 bp, Artificial Sequence
  Synthetic
caagattccatcttggagaagtccctgaaagcgttggtcaaaatcatatcagctctagtgattgtagtgagaaac

SEQ ID NO: 71158 - DNA, 75 bp, Artificial Sequence
  Synthetic
aagagtgttgcccagttaacttcaagaaatgctgcccgttggtatgtggtaaagctatccaattcattgatagaa

SEQ ID NO: 71159 - DNA, 75 bp, Artificial Sequence
  Synthetic
gaaatgctgcccgttggtatgtggtaaagctatccaattcattgatagaaggactcaggtcagatactctctaga

SEQ ID NO: 71160 - DNA, 75 bp, Artificial Sequence
  Synthetic
gggaccaccagtgtacagagaaatcaagatcagtgtgtcgccagagatacctccaccaccagccattgcagatct

SEQ ID NO: 71161 - DNA, 75 bp, Artificial Sequence
  Synthetic
aagatcagtgtgtcgccagagatacctccaccaccagccattgcagatctgcttaaatcagtggacagtgaagct

SEQ ID NO: 71162 - DNA, 75 bp, Artificial Sequence
  Synthetic
agcagagcctttatttgcctgcaagcagtgaccaccttcgtttcagtggcagggatcatctacataatctacaaa

SEQ ID NO: 71163 - DNA, 75 bp, Artificial Sequence
  Synthetic
cagtgaccaccttcgtttcagtggcagggatcatctacataatctacaaactctttgcgggtttccaaggagctt

SEQ ID NO: 71164 - DNA, 75 bp, Artificial Sequence
  Synthetic
ctccaatgtgcagtattttgcacactactgcaggaaatacgcaccactatatgcagttgaggcaaagagggtgtt

SEQ ID NO: 71165 - DNA, 75 bp, Artificial Sequence
  Synthetic
tcgctgtagccatgatgaagagaaattcaagtacagtgaagactgaatatggcgagttcaccatgttgggtatct

SEQ ID NO: 71166 - DNA, 75 bp, Artificial Sequence
  Synthetic
ttcaagtacagtgaagactgaatatggcgagttcaccatgttgggtatctatgataaatgggctgttttgccacg

SEQ ID NO: 71167 - DNA, 75 bp, Artificial Sequence
  Synthetic
ttccgtgtactctttaccaccggacccagaccactttgatgggtacaaacagcaagcagtagtgataatggatga

SEQ ID NO: 71168 - DNA, 75 bp, Artificial Sequence
  Synthetic
ccagaccactttgatgggtacaaacagcaagcagtagtgataatggatgacctgtgtcagaacccagatgggaag

SEQ ID NO: 71169 - DNA, 75 bp, Artificial Sequence
  Synthetic
taaggatggcaccaacttggaattaacgctgctcaagttgaaccgaaacgagaaattcagggatatcaggggttt

SEQ ID NO: 71170 - DNA, 75 bp, Artificial Sequence
  Synthetic
acgctgctcaagttgaaccgaaacgagaaattcagggatatcaggggtttcctggccaaggaagaggtggaagtc

SEQ ID NO: 71171 - DNA, 75 bp, Artificial Sequence
  Synthetic
attttgttcacttcaccatttgttctagcatccaccaatgccggatcaattaacgcccccactgtatctgacagt

SEQ ID NO: 71172 - DNA, 75 bp, Artificial Sequence
  Synthetic
tagcatccaccaatgccggatcaattaacgcccccactgtatctgacagtagggcccttgctagaagatttcact

SEQ ID NO: 71173 - DNA, 75 bp, Artificial Sequence
  Synthetic
ggctttttgaacttgggtggtacacccactaaacgaatgctcatgtataactttcccactagggctgggcagtgt

SEQ ID NO: 71174 - DNA, 75 bp, Artificial Sequence
  Synthetic
ccactaaacgaatgctcatgtataactttcccactagggctgggcagtgtggtggtgtgcttatgtctaccggta

SEQ ID NO: 71175 - DNA, 75 bp, Artificial Sequence
  Synthetic
gtgatgaggattgctgtccggtcaattttaagaaatgctgtccactagtgtgcggcaaggccatccagtttatcg

SEQ ID NO: 71176 - DNA, 75 bp, Artificial Sequence
  Synthetic
acaggagaacccaagttagatactcgttggacatgctggtcacagagatgttcagggaatacaaccacagacaca

SEQ ID NO: 71177 - DNA, 75 bp, Artificial Sequence
  Synthetic
atgagcaaggagaaattgaattcattgaaaactcaaaggaggtgggattcccggtcatcaacacacctagtaaaa

SEQ ID NO: 71178 - DNA, 75 bp, Artificial Sequence
  Synthetic
tgaaaactcaaaggaggtgggattcccggtcatcaacacacctagtaaaaccaagttggaacccagcgtctttca

SEQ ID NO: 71179 - DNA, 75 bp, Artificial Sequence
  Synthetic
gtgtaggagccactcttgaagctttgttccaaggaccaccagtctatagggaaattaagattagcgttgctccag

SEQ ID NO: 71180 - DNA, 75 bp, Artificial Sequence
  Synthetic
agacgccccccccaccggcgattgctgatctgttgaaatcggtagacagcgaggctgtgagagagtactgcaagg

SEQ ID NO: 71181 - DNA, 75 bp, Artificial Sequence
  Synthetic
tgatctgttgaaatcggtagacagcgaggctgtgagagagtactgcaaggagaaaggttggctcgtgccagaaat

SEQ ID NO: 71182 - DNA, 75 bp, Artificial Sequence
  Synthetic
ggccatattctccaaatacattggaaatgttaatacacatgtggatgattacatgttggaggcagttgaccccta

SEQ ID NO: 71183 - DNA, 75 bp, Artificial Sequence
  Synthetic
aatgttaatacacatgtggatgattacatgttggaggcagttgacccctacgctgggcaattagccaccctggat

SEQ ID NO: 71184 - DNA, 75 bp, Artificial Sequence
  Synthetic
agtggctggtataatttacatcatatacaagttgtttgctggcttccaaggtgcatacacaggaataccaaacca

SEQ ID NO: 71185 - DNA, 75 bp, Artificial Sequence
  Synthetic
tacaagttgtttgctggcttccaaggtgcatacacaggaataccaaaccagaaacccaaagtacccactcttaga

SEQ ID NO: 71186 - DNA, 75 bp, Artificial Sequence
  Synthetic
agtgcaggctacccctatgtcgcgctgggcatcaagaagagagatatcctttcaaagaaaacaaaggacctgacc

SEQ ID NO: 71187 - DNA, 75 bp, Artificial Sequence
  Synthetic
tgggcatcaagaagagagatatcctttcaaagaaaacaaaggacctgaccaaactaaaggagtgtatggataagt

SEQ ID NO: 71188 - DNA, 75 bp, Artificial Sequence
  Synthetic
gaatatggcgagttcaccatgctcggaatctatgataggtgggcggtgttgccacgacacgcaaaacctggacca

SEQ ID NO: 71189 - DNA, 75 bp, Artificial Sequence
  Synthetic
gaatctatgataggtgggcggtgttgccacgacacgcaaaacctggaccaaccatcttaatgaacgaccaagagg

SEQ ID NO: 71190 - DNA, 75 bp, Artificial Sequence
  Synthetic
ctaggctaattgaagcatccagcctcaatgactcagtagcaatgagacagacttttggcaatttgtacaagacct

SEQ ID NO: 71191 - DNA, 75 bp, Artificial Sequence
  Synthetic
caatgactcagtagcaatgagacagacttttggcaatttgtacaagacctttcatctaaatccagggattgtaac

SEQ ID NO: 71192 - DNA, 75 bp, Artificial Sequence
  Synthetic
gaaatgagaaatttagagatatccgagggtttctagcaagagaggaggttgaggtcaatgaggctgtgcttgcta

SEQ ID NO: 71193 - DNA, 75 bp, Artificial Sequence
  Synthetic
agggtttctagcaagagaggaggttgaggtcaatgaggctgtgcttgctatcaacacaagtaagttcccaaacat

SEQ ID NO: 71194 - DNA, 75 bp, Artificial Sequence
  Synthetic
atttgactactcaggttatgacgccagcttaagccccgtctggtttgcctgcttaaaattgttacttgagaaact

SEQ ID NO: 71195 - DNA, 75 bp, Artificial Sequence
  Synthetic
agcttaagccccgtctggtttgcctgcttaaaattgttacttgagaaacttgggtacacccacaaagagactaac

SEQ ID NO: 71196 - DNA, 75 bp, Artificial Sequence
  Synthetic
gtataacttcccaaccagagcaggacaatgtggcggcgttttaatgtcgacaggaaaagtcttgggaatacatgt

SEQ ID NO: 71197 - DNA, 75 bp, Artificial Sequence
  Synthetic
gggtgctctggcaccagtatcttcaattcaatgattaacaacattatcatcagaacccttatgttgaaagtatac

SEQ ID NO: 71198 - DNA, 75 bp, Artificial Sequence
  Synthetic
attcaatgattaacaacattatcatcagaacccttatgttgaaagtatacaagggaattgatttggaccagttca

SEQ ID NO: 71199 - DNA, 75 bp, Artificial Sequence
  Synthetic
tctgctgccctccttagacactatttcaatgaggaacaaggacagatagaattcattgaaagttcaaaagaggca

SEQ ID NO: 71200 - DNA, 75 bp, Artificial Sequence
  Synthetic
gaaaagactacgggttgatcatgacaccagcagataaaggggagtgcttcaatgaagtaacatggaccaacgtca

SEQ ID NO: 71201 - DNA, 75 bp, Artificial Sequence
  Synthetic
accagcagataaaggggagtgcttcaatgaagtaacatggaccaacgtcacctttttaaaaaggtatttcagagc

SEQ ID NO: 71202 - DNA, 75 bp, Artificial Sequence
  Synthetic
aaggaaccggcagtcctcagaaatggtgacccgcgcctcaaggccaactttgaagaggcaattttctccaagtac

SEQ ID NO: 71203 - DNA, 75 bp, Artificial Sequence
  Synthetic
tgaagaggcaattttctccaagtacatcggcaatgtcaatacacatgtggacgaatacatgcatgaagccgtgga

SEQ ID NO: 71204 - DNA, 75 bp, Artificial Sequence
  Synthetic
agatccaaagaacactcaagaccatgtgcgctcactgtgcctattggcttggcacaatggagagcacgagtacga

SEQ ID NO: 71205 - DNA, 75 bp, Artificial Sequence
  Synthetic
aactggaagatgctgtctatggtacagaggggttagaagctttagacttgactaccagcgcaggctacccgtatg

SEQ ID NO: 71206 - DNA, 75 bp, Artificial Sequence
  Synthetic
agaggggttagaagctttagacttgactaccagcgcaggctacccgtatgtggccttaggcattaagaaaagaga

SEQ ID NO: 71207 - DNA, 75 bp, Artificial Sequence
  Synthetic
ggcacaatggagagcacgagtacgaggagtttatccgtaaaattaggagcgtcccagtcgggcgctgcttaaccc

SEQ ID NO: 71208 - DNA, 75 bp, Artificial Sequence
  Synthetic
ggtgacatatgttaaggatgagctaagatccgctgaaaaggtggccaaagggaaatccagactcattgaggcctc

SEQ ID NO: 71209 - DNA, 75 bp, Artificial Sequence
  Synthetic
ggaaatccagactcattgaggcctctagtcttaatgattcagtagcaatgaggcagacgtttgggaacctgtata

SEQ ID NO: 71210 - DNA, 75 bp, Artificial Sequence
  Synthetic
cagccatgtcttgatcaagcacctctgtttccccggacctagtatcaatagactgctcgcgcggttgaaagagaa

SEQ ID NO: 71211 - DNA, 75 bp, Artificial Sequence
  Synthetic
ttccagtcatgcttgacggccatctcatagcctttgactactctggttacgatgctagtcttagtccggtttggt

SEQ ID NO: 71212 - DNA, 75 bp, Artificial Sequence
  Synthetic
catagcctttgactactctggttacgatgctagtcttagtccggtttggttcgcatgtctgaagctcctcctgga

SEQ ID NO: 71213 - DNA, 75 bp, Artificial Sequence
  Synthetic
acactactttgtgaggggtgggatgccatcaggatgttcagggactagcatatttaactctatgattaataacat

SEQ ID NO: 71214 - DNA, 75 bp, Artificial Sequence
  Synthetic
ccatcaggatgttcagggactagcatatttaactctatgattaataacatcataatcaggaccctcatgctaaaa

SEQ ID NO: 71215 - DNA, 75 bp, Artificial Sequence
  Synthetic
gtctattgagctagttagtagtcctccggcccctgaatgcggctaatcctaactgcggagcacgtgcttccaatc

SEQ ID NO: 71216 - DNA, 75 bp, Artificial Sequence
  Synthetic
cctatagacgcttccttattggctgaagcagggaaagactatgggctgattatgactccagcagacaagggtgag

SEQ ID NO: 71217 - DNA, 75 bp, Artificial Sequence
  Synthetic
ttgcattggctgcttatggtgacaattgagagattgttaccatatagctattggattggccatccggtgacaaac

SEQ ID NO: 71218 - DNA, 75 bp, Artificial Sequence
  Synthetic
tatgactccagcagacaagggtgagtgctttaatgaagtgacctgggccaatgttacattcttaaaaagatactt

SEQ ID NO: 71219 - DNA, 75 bp, Artificial Sequence
  Synthetic
ttgagagattgttaccatatagctattggattggccatccggtgacaaacagagcaattatatatctctttgttg

SEQ ID NO: 71220 - DNA, 75 bp, Artificial Sequence
  Synthetic
gaccaaagatcctaagaacacacaagaccacgtgcgctcgctgtgtctattggcctggcacaatggtgagcacga

SEQ ID NO: 71221 - DNA, 75 bp, Artificial Sequence
  Synthetic
acaagtgtcaacgcaaaagactggagcccatgacactgggctaaatgccagtgggaattcgatcatccattacac

SEQ ID NO: 71222 - DNA, 75 bp, Artificial Sequence
  Synthetic
gcccatgacactgggctaaatgccagtgggaattcgatcatccattacaccaacattaactactacaaggatgca

SEQ ID NO: 71223 - DNA, 75 bp, Artificial Sequence
  Synthetic
gtcaagtccctgccggctctcaactcacccactgcagaggagtgtggttatagcgacagggtgagatcaataaca

SEQ ID NO: 71224 - DNA, 75 bp, Artificial Sequence
  Synthetic
taaagttaaagtgcaattggctaatcacaattggcttaaccctactgcatgaaccgaactagacataagtgcggt

SEQ ID NO: 71225 - DNA, 75 bp, Artificial Sequence
  Synthetic
cacccactgcagaggagtgtggttatagcgacagggtgagatcaataacattgggtaattcaacaataacaaccc

SEQ ID NO: 71226 - DNA, 75 bp, Artificial Sequence
  Synthetic
tttaaaacagcctgtgggttgttcccacccacaggcgccaccgggcgttagcacactggtatcacggtacccttg

SEQ ID NO: 71227 - DNA, 75 bp, Artificial Sequence
  Synthetic
gcacactggtatcacggtacccttgtgcgcctgttttataaccccaccccgagtaaaccttagaagcaatgcacc

SEQ ID NO: 71228 - DNA, 75 bp, Artificial Sequence
  Synthetic
atcaaccaacacagccagatgtggcgacttgccgcttctatactctagactccatacactgggagaaagagtcac

SEQ ID NO: 71229 - DNA, 75 bp, Artificial Sequence
  Synthetic
gacttgccgcttctatactctagactccatacactgggagaaagagtcacctgggtggtggtggaagtttccaga

SEQ ID NO: 71230 - DNA, 75 bp, Artificial Sequence
  Synthetic
ttcgagaagcctagtaacaccatgaaggttgcagagtgtttcgctcagcacttcccctgtgtagatcaggccgat

SEQ ID NO: 71231 - DNA, 75 bp, Artificial Sequence
  Synthetic
tgtgcaatgcaatgcatctaagttccatcaagggtgtttgctggttgtgtgtgtcccggaagccgagatgggatg

SEQ ID NO: 71232 - DNA, 75 bp, Artificial Sequence
  Synthetic
catcaagggtgtttgctggttgtgtgtgtcccggaagccgagatgggatgcgcggacgtacaaggggttgtgacg

SEQ ID NO: 71233 - DNA, 75 bp, Artificial Sequence
  Synthetic
aatcaagtgtgcaacgctggcatgggagtcggagtggggaacttgaccattttccctcaccaatggataaacctg

SEQ ID NO: 71234 - DNA, 75 bp, Artificial Sequence
  Synthetic
gagtcggagtggggaacttgaccattttccctcaccaatggataaacctgagaaccaacaatagtgcgactattg

SEQ ID NO: 71235 - DNA, 75 bp, Artificial Sequence
  Synthetic
attgagagattgttaccatatagctattggattggccatccggtgagcaacagagctattgtgtatctgtttact

SEQ ID NO: 71236 - DNA, 75 bp, Artificial Sequence
  Synthetic
tcgcaaagcttgattacacagcgactgcctcatacgtgccaattaccgttacggttgcacctatgtgtgctgagt

SEQ ID NO: 71237 - DNA, 75 bp, Artificial Sequence
  Synthetic
tgcctcatacgtgccaattaccgttacggttgcacctatgtgtgctgagtacaacgggttgaggctgtccacacc

SEQ ID NO: 71238 - DNA, 75 bp, Artificial Sequence
  Synthetic
ctcaagtgtcaacacagaaaactggagctcatgaaaccagtttaagtgcggcaggtaattcaattatacattata

SEQ ID NO: 71239 - DNA, 75 bp, Artificial Sequence
  Synthetic
agctcatgaaaccagtttaagtgcggcaggtaattcaattatacattatacgaacatcaactactataaagatgc

SEQ ID NO: 71240 - DNA, 75 bp, Artificial Sequence
  Synthetic
tgccatgccacaatttgactcgaccccagaaatgcatataccgggtgaggtgaagaacctgatggagattgcaga

SEQ ID NO: 71241 - DNA, 75 bp, Artificial Sequence
  Synthetic
ccagaaatgcatataccgggtgaggtgaagaacctgatggagattgcagaggttgattcagtcgtgccggttaac

SEQ ID NO: 71242 - DNA, 75 bp, Artificial Sequence
  Synthetic
gattaagtctttacctgccctcaactcaccaacagtagaagagtgcgggtacagcgatcgggttaggtccatcac

SEQ ID NO: 71243 - DNA, 75 bp, Artificial Sequence
  Synthetic
tcaccaacagtagaagagtgcgggtacagcgatcgggttaggtccatcacccttggaaactccacgataaccacg

SEQ ID NO: 71244 - DNA, 75 bp, Artificial Sequence
  Synthetic
gtgttcggatttgaaatgcaaccaggaaaggaaaccgtattcaagcgcacattagttggagaaatcttgaactac

SEQ ID NO: 71245 - DNA, 75 bp, Artificial Sequence
  Synthetic
gaaaggaaaccgtattcaagcgcacattagttggagaaatcttgaactactacgctcattggtcaggcagcctaa

SEQ ID NO: 71246 - DNA, 75 bp, Artificial Sequence
  Synthetic
gatcaacccacacagcctgacgtagcaacatgccgcttttatactttagattcaatcaagtgggaaaagggatcg

SEQ ID NO: 71247 - DNA, 75 bp, Artificial Sequence
  Synthetic
caacatgccgcttttatactttagattcaatcaagtgggaaaagggatcggtggggtggtggtggaagttcccag

SEQ ID NO: 71248 - DNA, 75 bp, Artificial Sequence
  Synthetic
accctccaaagaacagaaaggatgccatgttaggcactcatatcatctgggatgtggggttgcagtcaagctgtg

SEQ ID NO: 71249 - DNA, 75 bp, Artificial Sequence
  Synthetic
catgttaggcactcatatcatctgggatgtggggttgcagtcaagctgtgtactgtgtgtgccatggattagcca

SEQ ID NO: 71250 - DNA, 75 bp, Artificial Sequence
  Synthetic
acctacaatgtaacgcttccaagttccatcaagggtgtttgctagtagtgtgtgtgcccgaggctgagatgggag

SEQ ID NO: 71251 - DNA, 75 bp, Artificial Sequence
  Synthetic
ccatcaagggtgtttgctagtagtgtgtgtgcccgaggctgagatgggaggagctgtggttggacaagcattttc

SEQ ID NO: 71252 - DNA, 75 bp, Artificial Sequence
  Synthetic
ggtggtgccgcccaacacacccacacagtgcaccattttatgttttgtgtcggcatgcaatgacttctccgtgcg

SEQ ID NO: 71253 - DNA, 75 bp, Artificial Sequence
  Synthetic
cagtgcaccattttatgttttgtgtcggcatgcaatgacttctccgtgcgtttgctgaaagatacgccatttata

SEQ ID NO: 71254 - DNA, 75 bp, Artificial Sequence
  Synthetic
aactgctatacacaatgcagggatgggcgtaggtgtagggaacctcactatctacccgcaccagtggataaattt

SEQ ID NO: 71255 - DNA, 75 bp, Artificial Sequence
  Synthetic
ggcgtaggtgtagggaacctcactatctacccgcaccagtggataaatttgcgcaccaacaacagtgccaccata

SEQ ID NO: 71256 - DNA, 75 bp, Artificial Sequence
  Synthetic
caaaggggaccaagcaattcggaacagatacctgcgctcacggcggtagaaactggccacacctcacaagtggta

SEQ ID NO: 71257 - DNA, 75 bp, Artificial Sequence
  Synthetic
agatacctgcgctcacggcggtagaaactggccacacctcacaagtggtacccggtgacaccatgcagaccagac

SEQ ID NO: 71258 - DNA, 75 bp, Artificial Sequence
  Synthetic
tttgtgaaactggactatgccgacaccgcatccacgtacgtgccaattacagtgacggtggccccaatgtgtgcg

SEQ ID NO: 71259 - DNA, 75 bp, Artificial Sequence
  Synthetic
ccgcatccacgtacgtgccaattacagtgacggtggccccaatgtgtgcggagtataacggcttacgtctggcac

SEQ ID NO: 71260 - DNA, 75 bp, Artificial Sequence
  Synthetic
gtaattacagtagaaacaacgaaaagcctgaggataagtacatgagttgggtgatcaacacgcggcagatggtgc

SEQ ID NO: 71261 - DNA, 75 bp, Artificial Sequence
  Synthetic
gcctgaggataagtacatgagttgggtgatcaacacgcggcagatggtgcagctacgacgtaagtttgaaatgtt

SEQ ID NO: 71262 - DNA, 75 bp, Artificial Sequence
  Synthetic
gcgctttgccacaatttgatgtgacgcctagtatgaacatcccaggagaagtgaagaacctaatggaaatagcag

SEQ ID NO: 71263 - DNA, 75 bp, Artificial Sequence
  Synthetic
gcctagtatgaacatcccaggagaagtgaagaacctaatggaaatagcagaagtggactcggtcgtgcccgtgaa

SEQ ID NO: 71264 - DNA, 75 bp, Artificial Sequence
  Synthetic
agatgctccagtgtttactcaccagatcatgtacgtgcctccaggaggtccagtacccaacagtgtggatgattt

SEQ ID NO: 71265 - DNA, 75 bp, Artificial Sequence
  Synthetic
atcatgtacgtgcctccaggaggtccagtacccaacagtgtggatgatttttcctggcaaacatcaacgaacccc

SEQ ID NO: 71266 - DNA, 75 bp, Artificial Sequence
  Synthetic
ggtttttggcctcagattgcaaccaggcttagatagtgtgtttaagcacactctgttgggagaaattctaaacta

SEQ ID NO: 71267 - DNA, 75 bp, Artificial Sequence
  Synthetic
ggcttagatagtgtgtttaagcacactctgttgggagaaattctaaactactatgcgcactggtcaggcagcatg

SEQ ID NO: 71268 - DNA, 75 bp, Artificial Sequence
  Synthetic
aacttttatgatggctggtcacatttctcacaaaatggggtatatggttacaacaccttaaacaatatgggcaag

SEQ ID NO: 71269 - DNA, 75 bp, Artificial Sequence
  Synthetic
tctcacaaaatggggtatatggttacaacaccttaaacaatatgggcaagatttatattagacaggtgaacgagc

SEQ ID NO: 71270 - DNA, 75 bp, Artificial Sequence
  Synthetic
aaccccccgaaaacacgaaaggatgcaatgctgggaacacatatcatatgggacattggtttacaatctagctgt

SEQ ID NO: 71271 - DNA, 75 bp, Artificial Sequence
  Synthetic
caatgctgggaacacatatcatatgggacattggtttacaatctagctgtgtgttgtgtgtgccatggatcagtc

SEQ ID NO: 71272 - DNA, 75 bp, Artificial Sequence
  Synthetic
caccgcggctctgtgcatacaagaaatcatctaatgtgaacttcgaaccagagaacgtcactgaagtcagagcag

SEQ ID NO: 71273 - DNA, 75 bp, Artificial Sequence
  Synthetic
atcatctaatgtgaacttcgaaccagagaacgtcactgaagtcagagcagacattaatcacatccccctcacttt

SEQ ID NO: 71274 - DNA, 75 bp, Artificial Sequence
  Synthetic
tgattgtcccaccaggaaccccaaattctagctctattatgtgctttgcatcagcgtgcaacgacttctcagtaa

SEQ ID NO: 71275 - DNA, 75 bp, Artificial Sequence
  Synthetic
ttctagctctattatgtgctttgcatcagcgtgcaacgacttctcagtaagaatgttgagggacacaccattcat

SEQ ID NO: 71276 - DNA, 75 bp, Artificial Sequence
  Synthetic
gggcaattatagaatagtcaacaggcacttggccacgcacactgactgggagaactgcgtgtgggatgattacaa

SEQ ID NO: 71277 - DNA, 75 bp, Artificial Sequence
  Synthetic
cacttggccacgcacactgactgggagaactgcgtgtgggatgattacaacagggacctgctggtgtgcaccacc

SEQ ID NO: 71278 - DNA, 75 bp, Artificial Sequence
  Synthetic
gcgtacggggcctagcaattccgcgagcgtacctgcactcactgcagttgagacagggcacacctcgcaagttac

SEQ ID NO: 71279 - DNA, 75 bp, Artificial Sequence
  Synthetic
agcgtacctgcactcactgcagttgagacagggcacacctcgcaagttactccaagtgacactatgcagacaaga

SEQ ID NO: 71280 - DNA, 75 bp, Artificial Sequence
  Synthetic
cactacccgatctcttttgagggtccaggcattgtggaggtgcaagaaagtgaatattatcccaggaggtaccag

SEQ ID NO: 71281 - DNA, 75 bp, Artificial Sequence
  Synthetic
caggcattgtggaggtgcaagaaagtgaatattatcccaggaggtaccagacacacgtgttactcgctgcaggat

SEQ ID NO: 71282 - DNA, 75 bp, Artificial Sequence
  Synthetic
gaagagtacaagaccactgataagcatgttaacaagaaattcgtcgcctggccaatcaacacaaaacaaatggtt

SEQ ID NO: 71283 - DNA, 75 bp, Artificial Sequence
  Synthetic
atgttaacaagaaattcgtcgcctggccaatcaacacaaaacaaatggttcagatgcggaggaagctggaaatgt

SEQ ID NO: 71284 - DNA, 75 bp, Artificial Sequence
  Synthetic
aaggtgtggtcggttttgctgacgtccgtgatctcctatggttggaagatgacgcaatggagcagggtgtcaagg

SEQ ID NO: 71285 - DNA, 75 bp, Artificial Sequence
  Synthetic
ccgtgatctcctatggttggaagatgacgcaatggagcagggtgtcaaggattacgtggaacagctagggaacgc

SEQ ID NO: 71286 - DNA, 75 bp, Artificial Sequence
  Synthetic
aggacatgcccgtgttgacgcgccaaatcatgtatgtgccacctggcggtccgattccagcaaaagttgatgatt

SEQ ID NO: 71287 - DNA, 75 bp, Artificial Sequence
  Synthetic
aatcatgtatgtgccacctggcggtccgattccagcaaaagttgatgattatgcctggcagacgtctacaaaccc

SEQ ID NO: 71288 - DNA, 75 bp, Artificial Sequence
  Synthetic
catcctggaaaaatccctgaaggcactagttaaaatcatatcagccttggtaatcgtggtcagaaaccacgaaga

SEQ ID NO: 71289 - DNA, 75 bp, Artificial Sequence
  Synthetic
ctagttaaaatcatatcagccttggtaatcgtggtcagaaaccacgaagacctcatcactgtgacagccacgctc

SEQ ID NO: 71290 - DNA, 75 bp, Artificial Sequence
  Synthetic
caatttttatgacgggtggtcaaattttgatcagaggggctcatacgggtacaataccctgaataacttaggtca

SEQ ID NO: 71291 - DNA, 75 bp, Artificial Sequence
  Synthetic
tttgatcagaggggctcatacgggtacaataccctgaataacttaggtcacatatatgtgagacacgtgagtgga

SEQ ID NO: 71292 - DNA, 75 bp, Artificial Sequence
  Synthetic
gctgagcgccagaacaacggatggctcaagaaattcactgagatgacaaatgcttgcaagggaatggagtggatc

SEQ ID NO: 71293 - DNA, 75 bp, Artificial Sequence
  Synthetic
tcaagaaattcactgagatgacaaatgcttgcaagggaatggagtggatcgccatcaagatccaaaagtttattg

SEQ ID NO: 71294 - DNA, 75 bp, Artificial Sequence
  Synthetic
cctccaaggctatgccaatacaagaaggcatttagcgtggatttcacgccaactcccattacagacaccaggaaa

SEQ ID NO: 71295 - DNA, 75 bp, Artificial Sequence
  Synthetic
aggcatttagcgtggatttcacgccaactcccattacagacaccaggaaagacatcaacactgtaaccaccgtgg

SEQ ID NO: 71296 - DNA, 75 bp, Artificial Sequence
  Synthetic
tccttgaaagccagattgctaccattgaacaaagtgcgccatcacagagtgatcaagaacaacttttctccaatg

SEQ ID NO: 71297 - DNA, 75 bp, Artificial Sequence
  Synthetic
tgaacaaagtgcgccatcacagagtgatcaagaacaacttttctccaatgtccagtacttcgctcactactgcag

SEQ ID NO: 71298 - DNA, 75 bp, Artificial Sequence
  Synthetic
atgtgggcaactacagagtgatcaacagacacctggcaacacacacggattggcaaaattgcgtgtgggaggatt

SEQ ID NO: 71299 - DNA, 75 bp, Artificial Sequence
  Synthetic
cagacacctggcaacacacacggattggcaaaattgcgtgtgggaggattacaatagagacctccttgtgagcac

SEQ ID NO: 71300 - DNA, 75 bp, Artificial Sequence
  Synthetic
gttcaagtccaaatgccgtattgaacctgtatgtctactcctccacggtaatccaggggctggaaaatcagtggc

SEQ ID NO: 71301 - DNA, 75 bp, Artificial Sequence
  Synthetic
cctgtatgtctactcctccacggtaatccaggggctggaaaatcagtggctaccaacttgatagggagatccctt

SEQ ID NO: 71302 - DNA, 75 bp, Artificial Sequence
  Synthetic
caagcactaccctgtttcattcgaagggccaggtttagtggaagtccaagagagtgaatactaccctaaaagata

SEQ ID NO: 71303 - DNA, 75 bp, Artificial Sequence
  Synthetic
gggccaggtttagtggaagtccaagagagtgaatactaccctaaaagatatcaatcccatgtacttctggcagca

SEQ ID NO: 71304 - DNA, 75 bp, Artificial Sequence
  Synthetic
gtagtgatcatggatgatctgtgtcagaatccagacgggaaggatgtgtccctgttttgtcagatggtatcaagt

SEQ ID NO: 71305 - DNA, 75 bp, Artificial Sequence
  Synthetic
agaatccagacgggaaggatgtgtccctgttttgtcagatggtatcaagtgttgattttgtgccacctatggcag

SEQ ID NO: 71306 - DNA, 75 bp, Artificial Sequence
  Synthetic
ggcgaaggtgttgtgggttttgctgacgtgcgcgacctcttatggttagaggatgacgctatggagcagggtgtg

SEQ ID NO: 71307 - DNA, 75 bp, Artificial Sequence
  Synthetic
acgtgcgcgacctcttatggttagaggatgacgctatggagcagggtgtgaaggactacgtggagcaacttggaa

SEQ ID NO: 71308 - DNA, 75 bp, Artificial Sequence
  Synthetic
ccacagtgtcagacagcagggcgcttgctagaagattccactttgacatgaacattgaagttatctctatgtaca

SEQ ID NO: 71309 - DNA, 75 bp, Artificial Sequence
  Synthetic
catgtctgttaagacatgtgatgaggagtgttgtccaacaaactttaagaaatgttgcccactggtgtgtggcaa

SEQ ID NO: 71310 - DNA, 75 bp, Artificial Sequence
  Synthetic
actccatcttagagaaatctctaaaagccctagtcaagataatatcagccttagtgatcgtggtgaggaaccacg

SEQ ID NO: 71311 - DNA, 75 bp, Artificial Sequence
  Synthetic
agccctagtcaagataatatcagccttagtgatcgtggtgaggaaccacgatgacctaattacagtgactgccat

SEQ ID NO: 71312 - DNA, 75 bp, Artificial Sequence
  Synthetic
gccacactcgaagccctattccaagggcctccagtctatagagagattaagatcagtgtcactccagagacgccc

SEQ ID NO: 71313 - DNA, 75 bp, Artificial Sequence
  Synthetic
catggctgaacgccaaaatgatagctggctcaagaaattcactgaaatgacaaatgcctgcaaacgaatggagtg

SEQ ID NO: 71314 - DNA, 75 bp, Artificial Sequence
  Synthetic
tggctagtaccggaggtcaactccacattacagattgagaagcacgtcagcagggcattcatctgcctgcaggcc

SEQ ID NO: 71315 - DNA, 75 bp, Artificial Sequence
  Synthetic
gttcctgaacagacttaaacagcttcccctattagagagtcagattgccaccatcgagcagagtgcaccatccca

SEQ ID NO: 71316 - DNA, 75 bp, Artificial Sequence
  Synthetic
cattacagattgagaagcacgtcagcagggcattcatctgcctgcaggccttaaccacatttgtttcagtggctg

SEQ ID NO: 71317 - DNA, 75 bp, Artificial Sequence
  Synthetic
aagtacccactttgagacaagctaaagtacagggtccagcatttgaatttgctgtggcgatgatgaagaggaatg

SEQ ID NO: 71318 - DNA, 75 bp, Artificial Sequence
  Synthetic
agtacagggtccagcatttgaatttgctgtggcgatgatgaagaggaatgccagcacggcaaagactgaatatgg

SEQ ID NO: 71319 - DNA, 75 bp, Artificial Sequence
  Synthetic
tacagttcaagtccaaatgccgtattgagcctgtatgtttgctcctacatgggagtccaggtgccggcaagtcgg

SEQ ID NO: 71320 - DNA, 75 bp, Artificial Sequence
  Synthetic
catgaacgaccaagaggttggcgtgctggacgccaaagagttggttgacaaagacgggacaaacttagagttaac

SEQ ID NO: 71321 - DNA, 75 bp, Artificial Sequence
  Synthetic
atcactttgatggctacaaacaacaggccgtagtgattatggatgacctatgccagaaccctgatggaaaagatg

SEQ ID NO: 71322 - DNA, 75 bp, Artificial Sequence
  Synthetic
ggccgtagtgattatggatgacctatgccagaaccctgatggaaaagatgtctccttgttttgccaaatggtctc

SEQ ID NO: 71323 - DNA, 75 bp, Artificial Sequence
  Synthetic
ctggacgccaaagagttggttgacaaagacgggacaaacttagagttaactctcctgaaacttaaccgcaatgag

SEQ ID NO: 71324 - DNA, 75 bp, Artificial Sequence
  Synthetic
agcaagtttccaaacatgtacattcccgttggtcaagtcactgattatggtttcttgaatctggggggcactcca

SEQ ID NO: 71325 - DNA, 75 bp, Artificial Sequence
  Synthetic
atcgactaatgcaggatccataaatgctccaactgtgtcagacagcagggccttagcaaggaggtttcacttcga

SEQ ID NO: 71326 - DNA, 75 bp, Artificial Sequence
  Synthetic
gctccaactgtgtcagacagcagggccttagcaaggaggtttcacttcgatatgaacattgaagttatctccatg

SEQ ID NO: 71327 - DNA, 75 bp, Artificial Sequence
  Synthetic
ccgttggtcaagtcactgattatggtttcttgaatctggggggcactccaactaaaaggatgctcatgtacaact

SEQ ID NO: 71328 - DNA, 75 bp, Artificial Sequence
  Synthetic
acggccatcaagggttttctgctgctctcctcagacactacttcaatgaggagcagggagagatagagttcattg

SEQ ID NO: 71329 - DNA, 75 bp, Artificial Sequence
  Synthetic
aagaagtgttgccctctagtatgtggtaaagccatccagttcatagacagaagaacccaagttagatactccctt

SEQ ID NO: 71330 - DNA, 75 bp, Artificial Sequence
  Synthetic
gtaaagccatccagttcatagacagaagaacccaagttagatactcccttgacatgctggtaactgagatgttta

SEQ ID NO: 71331 - DNA, 75 bp, Artificial Sequence
  Synthetic
tctcctcagacactacttcaatgaggagcagggagagatagagttcattgagagttccaaggatgcgggctaccc

SEQ ID NO: 71332 - DNA, 75 bp, Artificial Sequence
  Synthetic
agcagttcttagaaatggggatccacgacttaaagtcaactttgaggaagcgatcttctccaagtacattggcaa

SEQ ID NO: 71333 - DNA, 75 bp, Artificial Sequence
  Synthetic
ttaagatcagtgttgcgccagagacaccaccaccacctgtcatcgctgatctactcaagtcggtggacagtgagg

SEQ ID NO: 71334 - DNA, 75 bp, Artificial Sequence
  Synthetic
accaccaccacctgtcatcgctgatctactcaagtcggtggacagtgaggatgtgagagagtactgcaaagaaaa

SEQ ID NO: 71335 - DNA, 75 bp, Artificial Sequence
  Synthetic
cgacttaaagtcaactttgaggaagcgatcttctccaagtacattggcaatgtcaacactcatgtggatgagcac

SEQ ID NO: 71336 - DNA, 75 bp, Artificial Sequence
  Synthetic
gatgctgtgtatggcactgaaggactggaagcactagacttaaccaccagtgcaggctacccgtatgtggcactt

SEQ ID NO: 71337 - DNA, 75 bp, Artificial Sequence
  Synthetic
ggcaataaccacattcgtgtcagtagctgggatcatctacataatatataagctctttgcaggctttcagggtgc

SEQ ID NO: 71338 - DNA, 75 bp, Artificial Sequence
  Synthetic
gctgggatcatctacataatatataagctctttgcaggctttcagggtgcatatacaggaatacccaatcagaaa

SEQ ID NO: 71339 - DNA, 75 bp, Artificial Sequence
  Synthetic
tggaagcactagacttaaccaccagtgcaggctacccgtatgtggcacttggcatcaagaagagagacatacttt

SEQ ID NO: 71340 - DNA, 75 bp, Artificial Sequence
  Synthetic
atatcaaggatgagttaagatctgccgagaaagtagccatgggaaaatccagacttattgaggcctccagcctta

SEQ ID NO: 71341 - DNA, 75 bp, Artificial Sequence
  Synthetic
aactcaagcacggtgaagactgagtatggcgaattcaccatgctgggcatctatgacaggtgggccgtcttacca

SEQ ID NO: 71342 - DNA, 75 bp, Artificial Sequence
  Synthetic
atggcgaattcaccatgctgggcatctatgacaggtgggccgtcttaccacgccacgctaagcctggaccaacca

SEQ ID NO: 71343 - DNA, 75 bp, Artificial Sequence
  Synthetic
cgagaaagtagccatgggaaaatccagacttattgaggcctccagccttaatgactcagtggcgatgagacaaac

SEQ ID NO: 71344 - DNA, 75 bp, Artificial Sequence
  Synthetic
tgtgttttggagcaaaatccccgtcatgcttgatgggcacctaatagcctttgactactcgggttacgacgctag

SEQ ID NO: 71345 - DNA, 75 bp, Artificial Sequence
  Synthetic
tgacattgcttaaattaaacaggaatgagaagttcagagacatcagaggcttcttagctaaggaggagatggagg

SEQ ID NO: 71346 - DNA, 75 bp, Artificial Sequence
  Synthetic
atgcttgatgggcacctaatagcctttgactactcgggttacgacgctagtctcagcccagtgtggtttgcatgt

SEQ ID NO: 71347 - DNA, 75 bp, Artificial Sequence
  Synthetic
catttgtacagagacaagcactacttcgtaagaggagggatgccgtcaggatgctcaggcactagcatatttaac

SEQ ID NO: 71348 - DNA, 75 bp, Artificial Sequence
  Synthetic
tcgtaagaggagggatgccgtcaggatgctcaggcactagcatatttaactctatgattaacaacatcataatca

SEQ ID NO: 71349 - DNA, 75 bp, Artificial Sequence
  Synthetic
tcgcttcatacccgtggcccattgatgcttcgctcctagctgaagcaggaagagattatggcctgatcatgaccc

SEQ ID NO: 71350 - DNA, 75 bp, Artificial Sequence
  Synthetic
attgagagttcaaaggatgcagggttcccgattatcaatacacctagtaagaccaagctggagccaagtgtcttc

SEQ ID NO: 71351 - DNA, 75 bp, Artificial Sequence
  Synthetic
tgcttcgctcctagctgaagcaggaagagattatggcctgatcatgaccccagctgataaaggtgagtgcttcaa

SEQ ID NO: 71352 - DNA, 75 bp, Artificial Sequence
  Synthetic
catcaagtttttgaaggtgtcaaagaaccagcggtcctcaggaatggtgatccacgcctcaaagctaattttgag

SEQ ID NO: 71353 - DNA, 75 bp, Artificial Sequence
  Synthetic
tcctgtgatgcccatgaaagacatacatgagtccattagatggactaaggatcccaaaaacacacaggaccacgt

SEQ ID NO: 71354 - DNA, 75 bp, Artificial Sequence
  Synthetic
cacaacggggagcacgagtacgaggagttcattcgtaagattagaagtgtgcccgttgggcgctgcttaacactt

SEQ ID NO: 71355 - DNA, 75 bp, Artificial Sequence
  Synthetic
cgagtgcaggttacccttatgttgctctgggcatcaagaagagggacattctctcaaagaagaccagggacctga

SEQ ID NO: 71356 - DNA, 75 bp, Artificial Sequence
  Synthetic
acccacagggcctactgggcgctagcactctggtattgcggtacccttgtgcgcctgttttagaacccccccccc

SEQ ID NO: 71357 - DNA, 75 bp, Artificial Sequence
  Synthetic
acctatgtgaaagatcaactcagatctgcagagaaggtggcaaagggaaagtctaggctcattgaggcgtccagt

SEQ ID NO: 71358 - DNA, 75 bp, Artificial Sequence
  Synthetic
ttttcacctaaacccagggattgtgactggcagtgccgtcgggtgtgacccggatctcttttggagtaaaatacc

SEQ ID NO: 71359 - DNA, 75 bp, Artificial Sequence
  Synthetic
attacattgattacctgtgcaactcccatcacctgtacagggacaagcattatttcgtgcggggtggcatgccat

SEQ ID NO: 71360 - DNA, 75 bp, Artificial Sequence
  Synthetic
acaaagggatcgacttggatcaattcaggatgattgcttatggtgacgatgtgatcgcatcatacccgtggccca

SEQ ID NO: 71361 - DNA, 75 bp, Artificial Sequence
  Synthetic
caggatgattgcttatggtgacgatgtgatcgcatcatacccgtggcccatagatgcgtctttgcttgctgaagc

SEQ ID NO: 71362 - DNA, 75 bp, Artificial Sequence
  Synthetic
gagattgttaccatatagctattggattggccgtccagtgactaacagagctatcatattcctcttcgttgggtt

SEQ ID NO: 71363 - DNA, 75 bp, Artificial Sequence
  Synthetic
cacattcctaaagaggtattttagagcagatgaacaatacccctttttagtgcaccctgttatgcctatgaaaga

SEQ ID NO: 71364 - DNA, 75 bp, Artificial Sequence
  Synthetic
gtctcaacgcaaaagaccggagcacatgagacactgctagaggctgctcacggagcgacaataaactacactaac

SEQ ID NO: 71365 - DNA, 75 bp, Artificial Sequence
  Synthetic
atgagacactgctagaggctgctcacggagcgacaataaactacactaacattaactactacaaagatgccgcat

SEQ ID NO: 71366 - DNA, 75 bp, Artificial Sequence
  Synthetic
ttggcacaacggggagcacgaatatgaggagttcattcgcaaaatcaggagcgtcccagttggacgttgtttgac

SEQ ID NO: 71367 - DNA, 75 bp, Artificial Sequence
  Synthetic
aatccatgccggccttaaactccccgtctgctgaagagtgcgggtacagtgacagggtgagatccctgaccttag

SEQ ID NO: 71368 - DNA, 75 bp, Artificial Sequence
  Synthetic
gtctgctgaagagtgcgggtacagtgacagggtgagatccctgaccttaggcaactccaccataacaacacagga

SEQ ID NO: 71369 - DNA, 75 bp, Artificial Sequence
  Synthetic
accaacgcaaccggatgttgccacgtgtaggttttacacgctagaatcagtgtcatggcagagcgggtcagccgg

SEQ ID NO: 71370 - DNA, 75 bp, Artificial Sequence
  Synthetic
tgtaggttttacacgctagaatcagtgtcatggcagagcgggtcagccgggtggtggtggaaatttccggaagcc

SEQ ID NO: 71371 - DNA, 75 bp, Artificial Sequence
  Synthetic
cagtgtaatgcatccaaattccaccagggttgtctcttagtggtgtgtgtgccagaagccgaaatggggtgcgca

SEQ ID NO: 71372 - DNA, 75 bp, Artificial Sequence
  Synthetic
agggttgtctcttagtggtgtgtgtgccagaagccgaaatggggtgcgcagatgtgaagagcgtggtcactgcct

SEQ ID NO: 71373 - DNA, 75 bp, Artificial Sequence
  Synthetic
gagtcaccgcactcctcacgggcgaccgtggcggtggctgcgctggcggcctgcccatggggcaacccatgggac

SEQ ID NO: 71374 - DNA, 75 bp, Artificial Sequence
  Synthetic
cagctgtatgtaatgcaggaatgggggttgctgtaggaaaccttacaatatttccacatcagtggatcaacctgc

SEQ ID NO: 71375 - DNA, 75 bp, Artificial Sequence
  Synthetic
ggttgctgtaggaaaccttacaatatttccacatcagtggatcaacctgcgtaccaataattgtgccaccattgt

SEQ ID NO: 71376 - DNA, 75 bp, Artificial Sequence
  Synthetic
attgagagattgttaccatatagctattggattggccatccggtgacaaatagagcaattgtttacttatttgtc

SEQ ID NO: 71377 - DNA, 75 bp, Artificial Sequence
  Synthetic
cgccccattagccagccaaggggggtcgacatacgtacccataacaattacaatcgcacccatgtgcgcggaata

SEQ ID NO: 71378 - DNA, 75 bp, Artificial Sequence
  Synthetic
tcgacatacgtacccataacaattacaatcgcacccatgtgcgcggaatacaacggattgagactctcaacgcaa

SEQ ID NO: 71379 - DNA, 75 bp, Artificial Sequence
  Synthetic
cacaggtatcaacacaaaagaccggggcgcatgagactggattaaacgccagcggaaattcagtcattcattaca

SEQ ID NO: 71380 - DNA, 75 bp, Artificial Sequence
  Synthetic
ggcgcatgagactggattaaacgccagcggaaattcagtcattcattacaccaacattaattactataaagatgc

SEQ ID NO: 71381 - DNA, 75 bp, Artificial Sequence
  Synthetic
gccatgcctgagtttgatgtgaccccgccaatggatataccaggagaagttcgtaacatcatggagattgccgaa

SEQ ID NO: 71382 - DNA, 75 bp, Artificial Sequence
  Synthetic
cgccaatggatataccaggagaagttcgtaacatcatggagattgccgaagtggactccgtggtccctgtgaata

SEQ ID NO: 71383 - DNA, 75 bp, Artificial Sequence
  Synthetic
gataaagactttaccagcattaaattccccatctgttgaggaatgcggctttagcgaccgggtaaggtccataac

SEQ ID NO: 71384 - DNA, 75 bp, Artificial Sequence
  Synthetic
tccccatctgttgaggaatgcggctttagcgaccgggtaaggtccataaccctaggaaactccaccatcacaacc

SEQ ID NO: 71385 - DNA, 75 bp, Artificial Sequence
  Synthetic
ctatattttcattccaactaaatccagggaatagccccgtgcttaaccgtaccctgcttggtgagattataaact

SEQ ID NO: 71386 - DNA, 75 bp, Artificial Sequence
  Synthetic
agggaatagccccgtgcttaaccgtaccctgcttggtgagattataaactattatgcacactggtcaggtagtat

SEQ ID NO: 71387 - DNA, 75 bp, Artificial Sequence
  Synthetic
gaccagcctacacagccagatgtcgccacgtgcagattttacacgctagaatcagtggagtggcaagggagctca

SEQ ID NO: 71388 - DNA, 75 bp, Artificial Sequence
  Synthetic
ccacgtgcagattttacacgctagaatcagtggagtggcaagggagctcagctggctggtggtggaaatttccgg

SEQ ID NO: 71389 - DNA, 75 bp, Artificial Sequence
  Synthetic
ttcagtgcccactagtcgcaaggatgccatgttaggcacgcatataatatgggacctggggctacaatccagttg

SEQ ID NO: 71390 - DNA, 75 bp, Artificial Sequence
  Synthetic
gccatgttaggcacgcatataatatgggacctggggctacaatccagttgtgtgttgtgcgttccatggatcagt

SEQ ID NO: 71391 - DNA, 75 bp, Artificial Sequence
  Synthetic
atgtgcaatgcaatgcatcgaagttccaccaaggctgtctgctcgtggtatgtgtaccagaggccgaaatgggat

SEQ ID NO: 71392 - DNA, 75 bp, Artificial Sequence
  Synthetic
ccaccaaggctgtctgctcgtggtatgtgtaccagaggccgaaatgggatgctccaacgttgacagagttgtaac

SEQ ID NO: 71393 - DNA, 75 bp, Artificial Sequence
  Synthetic
atcatagtgccgccagacaccccaactgattgcattgtgctctgcttcgtttcggcttgtaacgacttctcagtt

SEQ ID NO: 71394 - DNA, 75 bp, Artificial Sequence
  Synthetic
ctgattgcattgtgctctgcttcgtttcggcttgtaacgacttctcagttcgaatgctgaaagacaccccttttg

SEQ ID NO: 71395 - DNA, 75 bp, Artificial Sequence
  Synthetic
aaacgtggtacacaatgctgcaatgggggttggtgtgggaaatttgaccatatttccacatcaatggatcaactt

SEQ ID NO: 71396 - DNA, 75 bp, Artificial Sequence
  Synthetic
tatttccacatcaatggatcaacttgcgcacaaacaacagtgctaccatagtgatgccctatataaacagtgtgc

SEQ ID NO: 71397 - DNA, 75 bp, Artificial Sequence
  Synthetic
tcatgagtggtccgtcaaattcacaacaggtccccgctcttaccgctgtggagacaggacacacatcacaggttg

SEQ ID NO: 71398 - DNA, 75 bp, Artificial Sequence
  Synthetic
tcatgagtggtccgtcaaattcacaacaggtccccgctcttaccgctgtggagactggacacacatcacaggttg

SEQ ID NO: 71399 - DNA, 75 bp, Artificial Sequence
  Synthetic
tcatgagtggtccgtcaaattcacaacaggtccccgctcttaccgctgtggagaccggacacacatcacaggttg

SEQ ID NO: 71400 - DNA, 75 bp, Artificial Sequence
  Synthetic
tcatgagtggtccgtcaaattcacaacaggtccccgctcttaccgctgtggagacgggacacacatcacaggttg

SEQ ID NO: 71401 - DNA, 75 bp, Artificial Sequence
  Synthetic
acaggtccccgctcttaccgctgtggagacaggacacacatcacaggttgtcccaagtgacaccatccaaaccag

SEQ ID NO: 71402 - DNA, 75 bp, Artificial Sequence
  Synthetic
acaggtccccgctcttaccgctgtggagactggacacacatcacaggttgtcccaagtgacaccatccaaaccag

SEQ ID NO: 71403 - DNA, 75 bp, Artificial Sequence
  Synthetic
acaggtccccgctcttaccgctgtggagaccggacacacatcacaggttgtcccaagtgacaccatccaaaccag

SEQ ID NO: 71404 - DNA, 75 bp, Artificial Sequence
  Synthetic
acaggtccccgctcttaccgctgtggagacgggacacacatcacaggttgtcccaagtgacaccatccaaaccag

SEQ ID NO: 71405 - DNA, 75 bp, Artificial Sequence
  Synthetic
gagcctcaagcgttgtcccgatcaccgtgaccatagcccccatgacagcagagtacaacggtttaaggctgggct

SEQ ID NO: 71406 - DNA, 75 bp, Artificial Sequence
  Synthetic
tgccaattacaatgcaaagggcgacaagacggatgtgaacaggtttgatagatgggagatcaacattcgtgagat

SEQ ID NO: 71407 - DNA, 75 bp, Artificial Sequence
  Synthetic
cgtgaccatagcccccatgacagcagagtacaacggtttaaggctgggctcggtgcaaggcctccccactatgaa

SEQ ID NO: 71408 - DNA, 75 bp, Artificial Sequence
  Synthetic
aagacggatgtgaacaggtttgatagatgggagatcaacattcgtgagatggtgcagttacgcaggaaatgtgag

SEQ ID NO: 71409 - DNA, 75 bp, Artificial Sequence
  Synthetic
cccagagatgcatataccaggtgaggtgcgtaacctgatggaaattgcggaggtggactctgtagtgcccgtaaa

SEQ ID NO: 71410 - DNA, 75 bp, Artificial Sequence
  Synthetic
aatcaagatatgcctgtcctaacccaccagattatgtacgtgcccccgggaggctcagtacccagtagtgttgag

SEQ ID NO: 71411 - DNA, 75 bp, Artificial Sequence
  Synthetic
gtgcgtaacctgatggaaattgcggaggtggactctgtagtgcccgtaaacaacacagatgccaatgttaatggc

SEQ ID NO: 71412 - DNA, 75 bp, Artificial Sequence
  Synthetic
accagattatgtacgtgcccccgggaggctcagtacccagtagtgttgagagctatgcatggcagacgtctacaa

SEQ ID NO: 71413 - DNA, 75 bp, Artificial Sequence
  Synthetic
agtggtagcgtactctgtagaaccctgctaggcgagatattaaactactatactcactggagcggtagcataaaa

SEQ ID NO: 71414 - DNA, 75 bp, Artificial Sequence
  Synthetic
atagcagtttctatgatgggtggtcgcactttactcaaaagggggtttatggatataatacactaaataagatgg

SEQ ID NO: 71415 - DNA, 75 bp, Artificial Sequence
  Synthetic
tactcactggagcggtagcataaaactcaccttcatgttctgcgggtccgcgatggcaacaggtaaattcctaat

SEQ ID NO: 71416 - DNA, 75 bp, Artificial Sequence
  Synthetic
gcactttactcaaaagggggtttatggatataatacactaaataagatggggcaattgtttgtcagacatgtgaa

SEQ ID NO: 71417 - DNA, 75 bp, Artificial Sequence
  Synthetic
tgtggggttacaatctagctgtgtattgtgcatcccatggatcagtcaaactcactatcggtttgtacaacacga

SEQ ID NO: 71418 - DNA, 75 bp, Artificial Sequence
  Synthetic
caggcccccacgattgtgcccttatgtgaacaaaacgaatgtgaattttaataccacacaagtgacaaaacccag

SEQ ID NO: 71419 - DNA, 75 bp, Artificial Sequence
  Synthetic
ttgtgcatcccatggatcagtcaaactcactatcggtttgtacaacacgatgtctacactgatgccggatacata

SEQ ID NO: 71420 - DNA, 75 bp, Artificial Sequence
  Synthetic
gtgaacaaaacgaatgtgaattttaataccacacaagtgacaaaacccagaaatgacctcaatgatgtgcccaag

SEQ ID NO: 71421 - DNA, 75 bp, Artificial Sequence
  Synthetic
gcatgcaatgatttctcagtcagactcttgaaagacacaccatttatcacgcagaagaacttctttcaaggcgac

SEQ ID NO: 71422 - DNA, 75 bp, Artificial Sequence
  Synthetic
attaacaggcacttggctacacatgcagattggcaaaactgcgtgtgggaggactacaacagggatttgctcgtg

SEQ ID NO: 71423 - DNA, 75 bp, Artificial Sequence
  Synthetic
gcagaagaacttctttcaaggcgacaaggcttctgaggtcacagtctccgatacacaacctagcgggcctagtaa

SEQ ID NO: 71424 - DNA, 75 bp, Artificial Sequence
  Synthetic
cagattggcaaaactgcgtgtgggaggactacaacagggatttgctcgtgagcaccactacaacacatgggtgtg

SEQ ID NO: 71425 - DNA, 75 bp, Artificial Sequence
  Synthetic
aagcggtgcctagtgacaccattcaaacgaggtgtgtgttgaaccgacacaagcgttcagaatcatccatagaaa

SEQ ID NO: 71426 - DNA, 75 bp, Artificial Sequence
  Synthetic
tcgagggcccaggcctagttgaagtgcaggagagtgaatactacccaaagaggtaccagtctcacgtactccttg

SEQ ID NO: 71427 - DNA, 75 bp, Artificial Sequence
  Synthetic
aacgaggtgtgtgttgaaccgacacaagcgttcagaatcatccatagaaaacttcttgtgtcgctcggcttgtgt

SEQ ID NO: 71428 - DNA, 75 bp, Artificial Sequence
  Synthetic
gcaggagagtgaatactacccaaagaggtaccagtctcacgtactccttgcaatgggattttcagaacctggaga

SEQ ID NO: 71429 - DNA, 75 bp, Artificial Sequence
  Synthetic
ggttgctcagttgaggagaaagctggaaatgttcacatacttaagatttgatttggaagtgacgtttgttattac

SEQ ID NO: 71430 - DNA, 75 bp, Artificial Sequence
  Synthetic
tgctgacgtgcgcgacctcctgtggctagaggatgatgcaatggagcagggagtaaaagactacgtggaacaact

SEQ ID NO: 71431 - DNA, 75 bp, Artificial Sequence
  Synthetic
gaaatgttcacatacttaagatttgatttggaagtgacgtttgttattacaagtgcccaagtcacctctacaaac

SEQ ID NO: 71432 - DNA, 75 bp, Artificial Sequence
  Synthetic
ctagaggatgatgcaatggagcagggagtaaaagactacgtggaacaactcgggaacgcctttggctccggtttc

SEQ ID NO: 71433 - DNA, 75 bp, Artificial Sequence
  Synthetic
gacgattacgcgtggcagacgtctacgaacccgagtatattctggactgagggaaacgcaccagcgcgcatgtcc

SEQ ID NO: 71434 - DNA, 75 bp, Artificial Sequence
  Synthetic
cttaaagctctagtgaagataatatcagccttgatagtagtagtgaggaatcatgatgatctgatcactgtgacc

SEQ ID NO: 71435 - DNA, 75 bp, Artificial Sequence
  Synthetic
gggaaacgcaccagcgcgcatgtccatcccattcattagtgtgggtaacgcatacagcagcttttatgacgggtg

SEQ ID NO: 71436 - DNA, 75 bp, Artificial Sequence
  Synthetic
cagccttgatagtagtagtgaggaatcatgatgatctgatcactgtgaccgccacgttggcacttataggttgca

SEQ ID NO: 71437 - DNA, 75 bp, Artificial Sequence
  Synthetic
atggttggctcaagaagttcaccgagatgacgaacgcctgtaagggcatggaatggatagctgtcaaaattcaaa

SEQ ID NO: 71438 - DNA, 75 bp, Artificial Sequence
  Synthetic
taacggggcaagcccagggcctgtgaagagcacgatccggatctacatgaaaccaaaacacgtcaaagcatggat

SEQ ID NO: 71439 - DNA, 75 bp, Artificial Sequence
  Synthetic
aagagcacgatccggatctacatgaaaccaaaacacgtcaaagcatggatcccaaggccgccgcgactctgcgaa

SEQ ID NO: 71440 - DNA, 75 bp, Artificial Sequence
  Synthetic
gatgacgaacgcctgtaagggcatggaatggatagctgtcaaaattcaaaaatttattgagtggctcaaagttaa

SEQ ID NO: 71441 - DNA, 75 bp, Artificial Sequence
  Synthetic
tgctacgattgaacaaagtgcaccatcccagagtgaccaggaacaactcttttctaatgttcagtattttgccca

SEQ ID NO: 71442 - DNA, 75 bp, Artificial Sequence
  Synthetic
ccaagcactggtggtaggctggtgacaagaggggttttcgggcaacaatctggtgctgtctacgtgggaaactac

SEQ ID NO: 71443 - DNA, 75 bp, Artificial Sequence
  Synthetic
tcccagagtgaccaggaacaactcttttctaatgttcagtattttgcccactattgcaggaaatatgcccccctt

SEQ ID NO: 71444 - DNA, 75 bp, Artificial Sequence
  Synthetic
tggtgctgtctacgtgggaaactacagggtcgtgaacaggcatcttgctacacacaatgattggcaaaattgtgt

SEQ ID NO: 71445 - DNA, 75 bp, Artificial Sequence
  Synthetic
cgtattgagcccgtatgtctacttttgcatgggagccctggtgcgggcaagtcggtggcaacaagcctgattggg

SEQ ID NO: 71446 - DNA, 75 bp, Artificial Sequence
  Synthetic
ggtgtgatactatcgccagatgccaatgtaccgccggtgtctactattgtgcatcaagaaataagcactacccag

SEQ ID NO: 71447 - DNA, 75 bp, Artificial Sequence
  Synthetic
atgtaccgccggtgtctactattgtgcatcaagaaataagcactacccagtcacttttgaaggacctggcctagt

SEQ ID NO: 71448 - DNA, 75 bp, Artificial Sequence
  Synthetic
tgcatgggagccctggtgcgggcaagtcggtggcaacaagcctgattgggagatcactcgctgaaaaattgaaca

SEQ ID NO: 71449 - DNA, 75 bp, Artificial Sequence
  Synthetic
acttgtgtcaaaaccccgatgggaaggatgtgtctttgttctgtcaaatggtttctagtgtggactttgtgccgc

SEQ ID NO: 71450 - DNA, 75 bp, Artificial Sequence
  Synthetic
gggcgactgtggtggaatcctgaggtgtgagcatggtgttatcggcatagtgacaatgggtggtgaaggcgtcgt

SEQ ID NO: 71451 - DNA, 75 bp, Artificial Sequence
  Synthetic
tgtgagcatggtgttatcggcatagtgacaatgggtggtgaaggcgtcgttggttttgctgacgtgcgcgacctc

SEQ ID NO: 71452 - DNA, 75 bp, Artificial Sequence
  Synthetic
ggatgtgtctttgttctgtcaaatggtttctagtgtggactttgtgccgcccatggctgccctggaagagaaggg

SEQ ID NO: 71453 - DNA, 75 bp, Artificial Sequence
  Synthetic
cagggctctggcaaggaggttccacttcgatatgaatatcgaggtcatctccatgtacagtcagaatggcaagat

SEQ ID NO: 71454 - DNA, 75 bp, Artificial Sequence
  Synthetic
ggatttactaaccaaatttgtgaacaggtcaaccttctcaaagaatcactggtcggacaagattccatcttggag

SEQ ID NO: 71455 - DNA, 75 bp, Artificial Sequence
  Synthetic
ttcgatatgaatatcgaggtcatctccatgtacagtcagaatggcaagataaacatgccaatggcggtgaaaaca

SEQ ID NO: 71456 - DNA, 75 bp, Artificial Sequence
  Synthetic
tcatatcagctttagtcatcgtggtgagaaatcatgatgacttgattacggtgaccgcaacactagccctcattg

SEQ ID NO: 71457 - DNA, 75 bp, Artificial Sequence
  Synthetic
gatagaagaactcagattaggtactccctagacatgctagtgaccgagatgtttagagagtacattcacagacac

SEQ ID NO: 71458 - DNA, 75 bp, Artificial Sequence
  Synthetic
gctgcacctcgtccccgtggcgatggctcaaacaaaaagtctcccaatattacggaattcctatggcagagagac

SEQ ID NO: 71459 - DNA, 75 bp, Artificial Sequence
  Synthetic
gctcaaacaaaaagtctcccaatattacggaattcctatggcagagagacaaaacaatggctggttgaagaaatt

SEQ ID NO: 71460 - DNA, 75 bp, Artificial Sequence
  Synthetic
ccctagacatgctagtgaccgagatgtttagagagtacattcacagacacagcgtcggggccactcttgaggcac

SEQ ID NO: 71461 - DNA, 75 bp, Artificial Sequence
  Synthetic
cggatttacttaagtcaatagacagtgaagatgtaagagagtactgcaaagagaaagggtggctagtgcctgagg

SEQ ID NO: 71462 - DNA, 75 bp, Artificial Sequence
  Synthetic
agttaaaatcttgcctgaggtcaaagaaaaacacgagttccttaacagattaaaacaattacctttgttggagag

SEQ ID NO: 71463 - DNA, 75 bp, Artificial Sequence
  Synthetic
gaaaaacacgagttccttaacagattaaaacaattacctttgttggagagccagatcaccaccattgagcaaagt

SEQ ID NO: 71464 - DNA, 75 bp, Artificial Sequence
  Synthetic
tgaagatgtaagagagtactgcaaagagaaagggtggctagtgcctgaggtcaactccactctgcaaatcgagaa

SEQ ID NO: 71465 - DNA, 75 bp, Artificial Sequence
  Synthetic
ctataaactctttgcaggctttcaaggagcatacacagggatgcctaatcagaaacccaaggtgcccactcttag

SEQ ID NO: 71466 - DNA, 75 bp, Artificial Sequence
  Synthetic
cctctatatgctgctgaagcaaagagagtgttctccttggaaaagaagatgagtaactacatacagttcaagtcc

SEQ ID NO: 71467 - DNA, 75 bp, Artificial Sequence
  Synthetic
gagtgttctccttggaaaagaagatgagtaactacatacagttcaagtccaaatgccgtattgaacctgtatgcc

SEQ ID NO: 71468 - DNA, 75 bp, Artificial Sequence
  Synthetic
ggagcatacacagggatgcctaatcagaaacccaaggtgcccactcttaggcaagctaaagtgcaagggccagcg

SEQ ID NO: 71469 - DNA, 75 bp, Artificial Sequence
  Synthetic
ggcatttatgacaggtgggccgttttgccacgccacgccaaacctgggccaaccatactgatgaatgatcaagag

SEQ ID NO: 71470 - DNA, 75 bp, Artificial Sequence
  Synthetic
ttaatagttcggtatattccctaccgcctgatcccgaccactttgacggctataaacagcaagccgtcgtgatca

SEQ ID NO: 71471 - DNA, 75 bp, Artificial Sequence
  Synthetic
gcctgatcccgaccactttgacggctataaacagcaagccgtcgtgatcatggacgacctgtgtcaaaatccaga

SEQ ID NO: 71472 - DNA, 75 bp, Artificial Sequence
  Synthetic
tgccacgccacgccaaacctgggccaaccatactgatgaatgatcaagaggtcggtgtgatggatgctaaggagc

SEQ ID NO: 71473 - DNA, 75 bp, Artificial Sequence
  Synthetic
gaggtttcctagctagggaagaggtagaagtcaatgaggctgtactagccattaacaccagcaagtttcctaaca

SEQ ID NO: 71474 - DNA, 75 bp, Artificial Sequence
  Synthetic
aaaaggtattcttttcacttcaccctttgttctcgcttccaccaatgcagggtccattaatgcacctactgtgtc

SEQ ID NO: 71475 - DNA, 75 bp, Artificial Sequence
  Synthetic
tttgttctcgcttccaccaatgcagggtccattaatgcacctactgtgtcagatagtagagctctcgctagaagg

SEQ ID NO: 71476 - DNA, 75 bp, Artificial Sequence
  Synthetic
agaagtcaatgaggctgtactagccattaacaccagcaagtttcctaacatgtacattccagttgggcaggtcac

SEQ ID NO: 71477 - DNA, 75 bp, Artificial Sequence
  Synthetic
tcagtgtggcggggttctcatgtccactggcaaggttttagggattcatgttggtggaaacggtcatcaaggctt

SEQ ID NO: 71478 - DNA, 75 bp, Artificial Sequence
  Synthetic
aagacctgtgatgaagagtgctgcccggccaacttcaaaaagtgctgtccactggtttgtggtaaggccatccaa

SEQ ID NO: 71479 - DNA, 75 bp, Artificial Sequence
  Synthetic
cggccaacttcaaaaagtgctgtccactggtttgtggtaaggccatccaatttatagataggagaactcagatga

SEQ ID NO: 71480 - DNA, 75 bp, Artificial Sequence
  Synthetic
actggcaaggttttagggattcatgttggtggaaacggtcatcaaggcttctcagccgctcttctcaaacattac

SEQ ID NO: 71481 - DNA, 75 bp, Artificial Sequence
  Synthetic
agcaaaactaagctggagcccagtgtcttccaccaagtatttgaaggtaataaagaaccagcagtcctcagaaac

SEQ ID NO: 71482 - DNA, 75 bp, Artificial Sequence
  Synthetic
aggccctttttcaaggtccaccagtgtatagagagatcaaaattagtgtggcaccagagacaccccccccgcctg

SEQ ID NO: 71483 - DNA, 75 bp, Artificial Sequence
  Synthetic
gtatagagagatcaaaattagtgtggcaccagagacaccccccccgcctgcaattgcagatctgctacaatccgt

SEQ ID NO: 71484 - DNA, 75 bp, Artificial Sequence
  Synthetic
tcttccaccaagtatttgaaggtaataaagaaccagcagtcctcagaaacggcgatcctcgactcaaagccaact

SEQ ID NO: 71485 - DNA, 75 bp, Artificial Sequence
  Synthetic
accactatgctggacaattggccaccctggacatcagcactgaaccactgaagttagaggatgcagtgtacggaa

SEQ ID NO: 71486 - DNA, 75 bp, Artificial Sequence
  Synthetic
tgagaagcacgtcagtagagctttcatttgcctccaagcactcacaacattcgtctcagtggcaggaataatata

SEQ ID NO: 71487 - DNA, 75 bp, Artificial Sequence
  Synthetic
cctggacatcagcactgaaccactgaagttagaggatgcagtgtacggaactgaaggccttgaggctcttgactt

SEQ ID NO: 71488 - DNA, 75 bp, Artificial Sequence
  Synthetic
gttgagacaagcgaaggttcagggacctgcctttgaatttgccgtggctatgatgaagagaaacgctagtactgt

SEQ ID NO: 71489 - DNA, 75 bp, Artificial Sequence
  Synthetic
cttgaccaaactaaaggagtgtatggataagtatggcctaaacctaccaatggtgacttatgtaaaagatgagct

SEQ ID NO: 71490 - DNA, 75 bp, Artificial Sequence
  Synthetic
tgatgaagagaaacgctagtactgtgaaaaccgagtacggtgagttcacaatgcttgggatctatgacagatggg

SEQ ID NO: 71491 - DNA, 75 bp, Artificial Sequence
  Synthetic
gataagtatggcctaaacctaccaatggtgacttatgtaaaagatgagcttagatctgcagagaaggtagaaaaa

SEQ ID NO: 71492 - DNA, 75 bp, Artificial Sequence
  Synthetic
aagacctttcacttaaatccaggaattgtaactggtagcgcagttgggtgcgacccagaccttttctggagcaaa

SEQ ID NO: 71493 - DNA, 75 bp, Artificial Sequence
  Synthetic
ttgtaactggtagcgcagttgggtgcgacccagaccttttctggagcaaaataccggttatgctggatggacacc

SEQ ID NO: 71494 - DNA, 75 bp, Artificial Sequence
  Synthetic
taatctagagctgacactcctaagacttaacaggaatgagaaatttagggacatccgaggtttcttagcaagaga

SEQ ID NO: 71495 - DNA, 75 bp, Artificial Sequence
  Synthetic
acatccgaggtttcttagcaagagaggaagcggaggtcaatgaggccgtgcttgccattaacaccagcaaatttc

SEQ ID NO: 71496 - DNA, 75 bp, Artificial Sequence
  Synthetic
agaaacttgggtacacctgcaaggaaaccaactacattgattacctgtgcaactctcaccacctgtacagggata

SEQ ID NO: 71497 - DNA, 75 bp, Artificial Sequence
  Synthetic
aaccaactacattgattacctgtgcaactctcaccacctgtacagggataaacattacttcgtgagaggtggtat

SEQ ID NO: 71498 - DNA, 75 bp, Artificial Sequence
  Synthetic
tgctgatgtataacttccccacacgcgcaggacagtgtggcggtgtcttgatgtcaacaggcaaagtccttggaa

SEQ ID NO: 71499 - DNA, 75 bp, Artificial Sequence
  Synthetic
cgcaggacagtgtggcggtgtcttgatgtcaacaggcaaagtccttggaatacatgtcggtggcaatgggcacca

SEQ ID NO: 71500 - DNA, 75 bp, Artificial Sequence
  Synthetic
agtatacaaaggaattgacttggaccagttcaggatgattgcgtacggagatgacgtaattgcgtcatacccatg

SEQ ID NO: 71501 - DNA, 75 bp, Artificial Sequence
  Synthetic
cagttcaggatgattgcgtacggagatgacgtaattgcgtcatacccatggcccatagatgcttctttgcttgct

SEQ ID NO: 71502 - DNA, 75 bp, Artificial Sequence
  Synthetic
ggaagccggctttccggtcatcaacactcctagcaaaacaaagtttgagcccagtgtcttccatcaagtgtttga

SEQ ID NO: 71503 - DNA, 75 bp, Artificial Sequence
  Synthetic
actcctagcaaaacaaagtttgagcccagtgtcttccatcaagtgtttgaaggaaacaaggagccagcagtgctg

SEQ ID NO: 71504 - DNA, 75 bp, Artificial Sequence
  Synthetic
aacgtcactttcttaaagaggtactttagagcagatgagcaatacccctttttagtacaccctgttatgcccatg

SEQ ID NO: 71505 - DNA, 75 bp, Artificial Sequence
  Synthetic
ttagagcagatgagcaatacccctttttagtacaccctgttatgcccatgaaggacatacatgagtcaattagat

SEQ ID NO: 71506 - DNA, 75 bp, Artificial Sequence
  Synthetic
catgtagatgagtacatgatggaggccgttgaccactatgctgggcagttagcaaccttagacatcagtacagaa

SEQ ID NO: 71507 - DNA, 75 bp, Artificial Sequence
  Synthetic
ccgttgaccactatgctgggcagttagcaaccttagacatcagtacagaacctatgaagcttgaggatgctgtct

SEQ ID NO: 71508 - DNA, 75 bp, Artificial Sequence
  Synthetic
aatatgaggagttcatccgtaagatcagaagcgtcccggttgggcgctgcttgaccctccccgcgttttctactt

SEQ ID NO: 71509 - DNA, 75 bp, Artificial Sequence
  Synthetic
agagggacatcctatccaagaagactaaggacttgacaaaactgaaggagtgcatggacaagtacggattgaacc

SEQ ID NO: 71510 - DNA, 75 bp, Artificial Sequence
  Synthetic
ttaagattggagacaatttgatataacttcgattggcttaaccctattgcgttaaccgaactagccaacgatgca

SEQ ID NO: 71511 - DNA, 75 bp, Artificial Sequence
  Synthetic
taaggacttgacaaaactgaaggagtgcatggacaagtacggattgaacctccctatggtcacctatgtgaaaga

SEQ ID NO: 71512 - DNA, 75 bp, Artificial Sequence
  Synthetic
ggctatgagacagactttcgggaatctgtacaaaacatttcacctgaatccaggcatagtgacaggcagtgcagt

SEQ ID NO: 71513 - DNA, 75 bp, Artificial Sequence
  Synthetic
ctgtacaaaacatttcacctgaatccaggcatagtgacaggcagtgcagttggttgcgaccctgatctattttgg

SEQ ID NO: 71514 - DNA, 75 bp, Artificial Sequence
  Synthetic
gcgcctgttttatttcccccctcccgaagtaacctagaagcaggtaatatacggtcaataggtgacacagtatac

SEQ ID NO: 71515 - DNA, 75 bp, Artificial Sequence
  Synthetic
gtgtggttcgcctgtctgaaattgctgctagagaaactggggtacacgcacaaagagactaactacatagactac

SEQ ID NO: 71516 - DNA, 75 bp, Artificial Sequence
  Synthetic
tgctagagaaactggggtacacgcacaaagagactaactacatagactacttgtgtaactctcaccacttgtata

SEQ ID NO: 71517 - DNA, 75 bp, Artificial Sequence
  Synthetic
acaacataatcatcagaacactcatgctaaaggtttataagggtatagacctggatcaattcaggatgatagcct

SEQ ID NO: 71518 - DNA, 75 bp, Artificial Sequence
  Synthetic
ggtacttcagagcagacgaacaatatccattcctcgtccatcccgtaatgccaatgaaggacattcatgagtcga

SEQ ID NO: 71519 - DNA, 75 bp, Artificial Sequence
  Synthetic
tccattcctcgtccatcccgtaatgccaatgaaggacattcatgagtcgatcaggtggactaaagacccaaaaaa

SEQ ID NO: 71520 - DNA, 75 bp, Artificial Sequence
  Synthetic
actaagcacccttaattttattatattacttaactcgacaaaatgggagcacaagtgtcaacacaaaagacagga

SEQ ID NO: 71521 - DNA, 75 bp, Artificial Sequence
  Synthetic
ttacttaactcgacaaaatgggagcacaagtgtcaacacaaaagacaggagcacacgagactggtctgaacgcca

SEQ ID NO: 71522 - DNA, 75 bp, Artificial Sequence
  Synthetic
caaaatcaggagcgtcccggttgggcgctgcttgaccctgcctgcgttttcaactctacgcaggaaatggctgga

SEQ ID NO: 71523 - DNA, 75 bp, Artificial Sequence
  Synthetic
acatgtcacaagacccgggcaagttcactgagccacttaaggacgtaatgataaaatccctcccggcgctgaatt

SEQ ID NO: 71524 - DNA, 75 bp, Artificial Sequence
  Synthetic
cactgagccacttaaggacgtaatgataaaatccctcccggcgctgaattccccatccgctgaggaatgcggata

SEQ ID NO: 71525 - DNA, 75 bp, Artificial Sequence
  Synthetic
ttaaaacaggctgtgggttggccatccggtgagcccactgggcgctagcacactggtatcacggtacctttgtgc

SEQ ID NO: 71526 - DNA, 75 bp, Artificial Sequence
  Synthetic
atacggggaatggccacgctacctggaagacaaggaggccgtcgctgaggaccaacccactcagccagacgttgc

SEQ ID NO: 71527 - DNA, 75 bp, Artificial Sequence
  Synthetic
gaagacaaggaggccgtcgctgaggaccaacccactcagccagacgttgccacttgtaggttttacaccatggaa

SEQ ID NO: 71528 - DNA, 75 bp, Artificial Sequence
  Synthetic
gggcagaacatgtactatcactatttgggaagggctggatacacaatccatgtgcagtgcaatgcctcaaaattc

SEQ ID NO: 71529 - DNA, 75 bp, Artificial Sequence
  Synthetic
tgggaagggctggatacacaatccatgtgcagtgcaatgcctcaaaattccaccagggctgcttgctcgtggcgt

SEQ ID NO: 71530 - DNA, 75 bp, Artificial Sequence
  Synthetic
taccaatgaagttttccaaccaaaaggagacttccgccaacaaagtgcaaaacgcagtgtggaacgctgggatgg

SEQ ID NO: 71531 - DNA, 75 bp, Artificial Sequence
  Synthetic
ggagacttccgccaacaaagtgcaaaacgcagtgtggaacgctgggatgggggtcggagtggggaacttaacgat

SEQ ID NO: 71532 - DNA, 75 bp, Artificial Sequence
  Synthetic
tactggctgcttatggtgacaattgaaagattgttaccatatagctattggattggccacccggtgacaaacaga

SEQ ID NO: 71533 - DNA, 75 bp, Artificial Sequence
  Synthetic
aatggataccatgtacagacatcaaaatttcacactaatgataatcccattcgttccattaactgttaatgcggc

SEQ ID NO: 71534 - DNA, 75 bp, Artificial Sequence
  Synthetic
aaagattgttaccatatagctattggattggccacccggtgacaaacagagcaataatttatcaatttgtagggt

SEQ ID NO: 71535 - DNA, 75 bp, Artificial Sequence
  Synthetic
aatttcacactaatgataatcccattcgttccattaactgttaatgcggcagcatctaatcaggtccctatcaca

SEQ ID NO: 71536 - DNA, 75 bp, Artificial Sequence
  Synthetic
ggtgtcgacacaaaagaccggtgcacacgagaccagcttaagtgcgactggcaactctatcatccactacacaaa

SEQ ID NO: 71537 - DNA, 75 bp, Artificial Sequence
  Synthetic
acaccagggagtaaccagttcttgacatcagacgattttcagtccccttctgcaatgccacaatttgatgtgaca

SEQ ID NO: 71538 - DNA, 75 bp, Artificial Sequence
  Synthetic
catcagacgattttcagtccccttctgcaatgccacaatttgatgtgacaccgatgatgcacatccctggagagg

SEQ ID NO: 71539 - DNA, 75 bp, Artificial Sequence
  Synthetic
cattaactattacaaggatgccgcctccaactcggcaaatcgccaggacttcacgcaggatccgagcaagttcac

SEQ ID NO: 71540 - DNA, 75 bp, Artificial Sequence
  Synthetic
tggaagcttttcagattccagtctcaactggatcacactcgggagagggcgccatatttgcctttcagctcgatc

SEQ ID NO: 71541 - DNA, 75 bp, Artificial Sequence
  Synthetic
aactggatcacactcgggagagggcgccatatttgcctttcagctcgatccaggtagcggatcagttctcaagca

SEQ ID NO: 71542 - DNA, 75 bp, Artificial Sequence
  Synthetic
cactgcaatgacaactggcaaactgctgatagcctactcaccaccgggagctaacgttccagagaatagaaagga

SEQ ID NO: 71543 - DNA, 75 bp, Artificial Sequence
  Synthetic
ctgatagcctactcaccaccgggagctaacgttccagagaatagaaaggatgcgatgctaggtacacacatggtt

SEQ ID NO: 71544 - DNA, 75 bp, Artificial Sequence
  Synthetic
gtaggtcagggtatacaatccatgtgcaatgcaacgcatccaaattccaccaaggctgtctcctcgtggtgtgtg

SEQ ID NO: 71545 - DNA, 75 bp, Artificial Sequence
  Synthetic
acagatgtgtacactagcgcgggatacatctcagggtggtatcaaaccagcatcgttgtcccccccaaaacacct

SEQ ID NO: 71546 - DNA, 75 bp, Artificial Sequence
  Synthetic
acatctcagggtggtatcaaaccagcatcgttgtcccccccaaaacacctaccgagtgcaagatcctctgttttg

SEQ ID NO: 71547 - DNA, 75 bp, Artificial Sequence
  Synthetic
cacgggtgaaacggctgtacagacggctgtatgcaatgcaggtatgggcgtgggggttggtaacctaactatctt

SEQ ID NO: 71548 - DNA, 75 bp, Artificial Sequence
  Synthetic
gtgataaggtggcaaccgtggaggacactaaagctagtggaccaagcaactccgaacaggtacctgccgtgactg

SEQ ID NO: 71549 - DNA, 75 bp, Artificial Sequence
  Synthetic
cactaaagctagtggaccaagcaactccgaacaggtacctgccgtgactgccgctgaaactggacacacatcaca

SEQ ID NO: 71550 - DNA, 75 bp, Artificial Sequence
  Synthetic
ggacaatatgtttagacacaacaacttcacattgatgattattccttttgcaccattggattacgtcacaggagc

SEQ ID NO: 71551 - DNA, 75 bp, Artificial Sequence
  Synthetic
ttcacattgatgattattccttttgcaccattggattacgtcacaggagcatcctcttacatcccaattacagtg

SEQ ID NO: 71552 - DNA, 75 bp, Artificial Sequence
  Synthetic
cttctttagtcgtgctgcgtgtgtaaaggtcatggagtacactcttgggcaaaatgtcgaagcacacgacacata

SEQ ID NO: 71553 - DNA, 75 bp, Artificial Sequence
  Synthetic
aaggtcatggagtacactcttgggcaaaatgtcgaagcacacgacacatatgccagttgggatatctcggtgaga

SEQ ID NO: 71554 - DNA, 75 bp, Artificial Sequence
  Synthetic
ccaggtagtacacagttcttgacatcagacgattttcaatcaccatcggctatgccacaatttgatgtgacccct

SEQ ID NO: 71555 - DNA, 75 bp, Artificial Sequence
  Synthetic
tatgccacaatttgatgtgacccctgaaatgaacataccaggacaggttaggaacttgatggagattgcggaagt

SEQ ID NO: 71556 - DNA, 75 bp, Artificial Sequence
  Synthetic
accagctaccaagtaccaggaacgctgcaaacccaagatatgccagtgctgacgcaccaaatcatgtacgttcca

SEQ ID NO: 71557 - DNA, 75 bp, Artificial Sequence
  Synthetic
tgcaaacccaagatatgccagtgctgacgcaccaaatcatgtacgttccacctggaggcccagtccccgcaaagg

SEQ ID NO: 71558 - DNA, 75 bp, Artificial Sequence
  Synthetic
tactgatgaaatggggggacagatatttggcttccctctacaaccgggagcatcaagtgtattgcagagaacact

SEQ ID NO: 71559 - DNA, 75 bp, Artificial Sequence
  Synthetic
ccatcccatacatgggaattggaaatgcgtatagtagtttctatgatgggtggtcaaatttcaatcatactgggg

SEQ ID NO: 71560 - DNA, 75 bp, Artificial Sequence
  Synthetic
tgcgtatagtagtttctatgatgggtggtcaaatttcaatcatactggggtttacgggtacaatacactaaatca

SEQ ID NO: 71561 - DNA, 75 bp, Artificial Sequence
  Synthetic
cgccagatagtaggaagaacgctatgctgggaacccacgttatatgggatgttggtctgcagtccagctgcgtgt

SEQ ID NO: 71562 - DNA, 75 bp, Artificial Sequence
  Synthetic
taaaccaaagcacgttagtgcatgggtgccacgacccccacggttgtgtgcgtacaaaaataagaccaatgtgaa

SEQ ID NO: 71563 - DNA, 75 bp, Artificial Sequence
  Synthetic
gtgccacgacccccacggttgtgtgcgtacaaaaataagaccaatgtgaactttgagaccgcgcctgtaaccgaa

SEQ ID NO: 71564 - DNA, 75 bp, Artificial Sequence
  Synthetic
catgctggtatcaaaccaatgttatagttccagccgaagcgcagaagtcttgctacataatgtgcttcgtatcag

SEQ ID NO: 71565 - DNA, 75 bp, Artificial Sequence
  Synthetic
agttccagccgaagcgcagaagtcttgctacataatgtgcttcgtatcagcatgtaacgatttctcagtacgtat

SEQ ID NO: 71566 - DNA, 75 bp, Artificial Sequence
  Synthetic
tcaggagcagtgtacgtgggcaattacaggttgttgaacagacatctcgccacacatactgattggcaaaattgt

SEQ ID NO: 71567 - DNA, 75 bp, Artificial Sequence
  Synthetic
acaggttgttgaacagacatctcgccacacatactgattggcaaaattgtgtgtgggaagactacaatagggatc

SEQ ID NO: 71568 - DNA, 75 bp, Artificial Sequence
  Synthetic
cgcggtccatcaaactctgaacaaatcccagccttaacagctgttgaaactggacacacctctcaagtggaccca

SEQ ID NO: 71569 - DNA, 75 bp, Artificial Sequence
  Synthetic
gccgatctaggaacaaacactatccggtcagttttgaagggccaggactagtggaggttcaagagagcgagtatt

SEQ ID NO: 71570 - DNA, 75 bp, Artificial Sequence
  Synthetic
ggtcagttttgaagggccaggactagtggaggttcaagagagcgagtattaccctaagagataccaatcccacgt

SEQ ID NO: 71571 - DNA, 75 bp, Artificial Sequence
  Synthetic
aggtccgcttgtgtaatctacataaagtattctagtgctgagtcaaacaatttgaagcgttatgcagagtgggtc

SEQ ID NO: 71572 - DNA, 75 bp, Artificial Sequence
  Synthetic
agtattctagtgctgagtcaaacaatttgaagcgttatgcagagtgggtcatcaacacaagacaggtagctcagc

SEQ ID NO: 71573 - DNA, 75 bp, Artificial Sequence
  Synthetic
cgtgaccatgggcggtgagggcgttgtttgcttcgctgacgtgcgcgacctcctgtggttggaggatgatgcgat

SEQ ID NO: 71574 - DNA, 75 bp, Artificial Sequence
  Synthetic
gtttgcttcgctgacgtgcgcgacctcctgtggttggaggatgatgcgatggaacagggagtgaaggattatgtt

SEQ ID NO: 71575 - DNA, 75 bp, Artificial Sequence
  Synthetic
aaatgtccaccgccactaactcggatgtgccagtgcagacgcaccaaataatgtatgtaccacctggaggccctg

SEQ ID NO: 71576 - DNA, 75 bp, Artificial Sequence
  Synthetic
tgtgccagtgcagacgcaccaaataatgtatgtaccacctggaggccctgtgccaacatcagtcaatgactatgt

SEQ ID NO: 71577 - DNA, 75 bp, Artificial Sequence
  Synthetic
ctgattgggcaagactctattttggagaagtcactcaaagccttagtaaagatcatatcagcattggtcattgta

SEQ ID NO: 71578 - DNA, 75 bp, Artificial Sequence
  Synthetic
agaagtcactcaaagccttagtaaagatcatatcagcattggtcattgtagtgagaaatcacgacgatttaatca

SEQ ID NO: 71579 - DNA, 75 bp, Artificial Sequence
  Synthetic
gagcatcggtaatgcttataccatgttttacgacggatggtcaaacttctctagggatggtatatacgggtacaa

SEQ ID NO: 71580 - DNA, 75 bp, Artificial Sequence
  Synthetic
ttttacgacggatggtcaaacttctctagggatggtatatacgggtacaactcactcaacaacatggggaccata

SEQ ID NO: 71581 - DNA, 75 bp, Artificial Sequence
  Synthetic
atcacggaattcccatggcagagaggcaaaataatggctggttaaagaagttcacggagatgaccaacgcctgta

SEQ ID NO: 71582 - DNA, 75 bp, Artificial Sequence
  Synthetic
gtcaaagcgtatgtaccacgcccaccgcgtttgtgtcagtacaagaaagctaagaatgtgaactttgatgttgaa

SEQ ID NO: 71583 - DNA, 75 bp, Artificial Sequence
  Synthetic
aggagaaacatgagtttctaaacaggctgaaacaactgcctttgttagaaagccagatcaccactattgagcaga

SEQ ID NO: 71584 - DNA, 75 bp, Artificial Sequence
  Synthetic
aactacaaaatagttaatagacacttggccacacatgccgattggcagagttgtgtgtgggaaaactacaacaga

SEQ ID NO: 71585 - DNA, 75 bp, Artificial Sequence
  Synthetic
tggccacacatgccgattggcagagttgtgtgtgggaaaactacaacagagacctcctcgtaagcacaactacag

SEQ ID NO: 71586 - DNA, 75 bp, Artificial Sequence
  Synthetic
gagagtgttttcccttgagaagaaaatgagcaactacatacagttcaagtccaaatgccgtattgaacctgtatg

SEQ ID NO: 71587 - DNA, 75 bp, Artificial Sequence
  Synthetic
ccaccggacccagatcacttcgacggttataaacaacaggctgttgtgatcatggatgacttgtgccaaaaccca

SEQ ID NO: 71588 - DNA, 75 bp, Artificial Sequence
  Synthetic
gccagatggtctctagtgttgacttcgttccaccaatggcagcacttgaagagaaaggcattctcttcacgtcac

SEQ ID NO: 71589 - DNA, 75 bp, Artificial Sequence
  Synthetic
gattgttggctttgctgatgtccgcgacctactatggttagaggatgacgcgatggagcagggggtcaaagacta

SEQ ID NO: 71590 - DNA, 75 bp, Artificial Sequence
  Synthetic
gtcactggtgggccaggactctattttagagaagtctctcaaagcactcgtgaagattatatcagcattagtgat

SEQ ID NO: 71591 - DNA, 75 bp, Artificial Sequence
  Synthetic
gtaactgtgactgccactcttgcccttgttggatgcacgtcgtcaccatggcgctggcttaaacagaaggtgtca

SEQ ID NO: 71592 - DNA, 75 bp, Artificial Sequence
  Synthetic
gtggatagtgaggcggtcagagagtactgcaaagaaaaagggtggttagtgcccgaagttaactccactctgcaa

SEQ ID NO: 71593 - DNA, 75 bp, Artificial Sequence
  Synthetic
acagacttaaacaactccccctattggaaagccaaattgccaccattgaacaaagtgcaccgtctcagagtgatc

SEQ ID NO: 71594 - DNA, 75 bp, Artificial Sequence
  Synthetic
acattaagacaggccaaggttcaagggccagcttttgagtttgcggtggccatgatgaaacggaacgccagcact

SEQ ID NO: 71595 - DNA, 75 bp, Artificial Sequence
  Synthetic
cctgggcccaccattctaatgaacgaccaggaagtgggtgtagtggatgccaaggagttagtggacaaagatggc

SEQ ID NO: 71596 - DNA, 75 bp, Artificial Sequence
  Synthetic
cccagatggaaaggacgtgtccttgttttgccaaatggtttccagtgtggactttgtaccaccaatggccgcact

SEQ ID NO: 71597 - DNA, 75 bp, Artificial Sequence
  Synthetic
tacttgccattaacaccagcaagtttccaaacatgtacattccagttgggcaggtaacagattatggcttcctta

SEQ ID NO: 71598 - DNA, 75 bp, Artificial Sequence
  Synthetic
agtctcagacagccgggctttggctagaaggtttcactttgacatgaacattgaagttatatcaatgtacagtca

SEQ ID NO: 71599 - DNA, 75 bp, Artificial Sequence
  Synthetic
agaaggtttcactttgacatgaacattgaagttatatcaatgtacagtcagaacggaaagattaacatgcccatg

SEQ ID NO: 71600 - DNA, 75 bp, Artificial Sequence
  Synthetic
aattcacgttggtggcaatggacaccaagggttctcggcagccttgttacgtcactacttcaatgatgaacaggg

SEQ ID NO: 71601 - DNA, 75 bp, Artificial Sequence
  Synthetic
attcagttcattgacaggaaaacccaagtgagatactcactagacatgttggtcactgaaatgtttagagaatac

SEQ ID NO: 71602 - DNA, 75 bp, Artificial Sequence
  Synthetic
aagtgagatactcactagacatgttggtcactgaaatgtttagagaatacaaccacaggcacagtgtgggggcga

SEQ ID NO: 71603 - DNA, 75 bp, Artificial Sequence
  Synthetic
taagaaatggggatcctaggctgaaggctaactttgaagaagccattttctccaagtacatcggcaatgtaaaca

SEQ ID NO: 71604 - DNA, 75 bp, Artificial Sequence
  Synthetic
ctccagtgatcgcagacctgctgaaatcagtggatagtgaggcagttagagaatactgcaaggaaaggggatggt

SEQ ID NO: 71605 - DNA, 75 bp, Artificial Sequence
  Synthetic
ggctaactttgaagaagccattttctccaagtacatcggcaatgtaaacactcatgtggatgagtacatgttgga

SEQ ID NO: 71606 - DNA, 75 bp, Artificial Sequence
  Synthetic
gcaaattgagaaacacgtgagtagggctttcatctgcctacaggcgctcaccacttttgtctctgtggcagggat

SEQ ID NO: 71607 - DNA, 75 bp, Artificial Sequence
  Synthetic
ttatggaactgagggcctagaagcactagattttaccacaagtgcagggtatccttattttgcccttggcattag

SEQ ID NO: 71608 - DNA, 75 bp, Artificial Sequence
  Synthetic
ctagattttaccacaagtgcagggtatccttattttgcccttggcattaggaagagagacattctatctaagaag

SEQ ID NO: 71609 - DNA, 75 bp, Artificial Sequence
  Synthetic
accaaccctaagacaggctaaggttcaagggccagcttttgaatttgcggtagccatgatgaagagaaacgccag

SEQ ID NO: 71610 - DNA, 75 bp, Artificial Sequence
  Synthetic
gatgaattgagatcagcggagaaggtggccaaaggcaagtccaggctaatcgaagcatcgagtctgaatgactca

SEQ ID NO: 71611 - DNA, 75 bp, Artificial Sequence
  Synthetic
tggccaaaggcaagtccaggctaatcgaagcatcgagtctgaatgactcagtagccatgagacagacctttggga

SEQ ID NO: 71612 - DNA, 75 bp, Artificial Sequence
  Synthetic
acgctaaagagttggtagacaaggatggtactaatttggaactgacactcttgaaactcaataggaatgagaaat

SEQ ID NO: 71613 - DNA, 75 bp, Artificial Sequence
  Synthetic
ggagcaagatcccagttatgcttgatggccatctcattgcttttgactacagcgggtatgatgccagtttgagcc

SEQ ID NO: 71614 - DNA, 75 bp, Artificial Sequence
  Synthetic
tggccatctcattgcttttgactacagcgggtatgatgccagtttgagcccggtgtggtttgcttgcttgaaact

SEQ ID NO: 71615 - DNA, 75 bp, Artificial Sequence
  Synthetic
tagagacaaacattactttgtaagaggaggaatgccctctgggtgctcaggaactagcatctttaattcaatgat

SEQ ID NO: 71616 - DNA, 75 bp, Artificial Sequence
  Synthetic
gttttaatgtcaaccggcaaagtgctcgggatacacgttgggggcaatggacaccaagggttctcggcagcctta

SEQ ID NO: 71617 - DNA, 75 bp, Artificial Sequence
  Synthetic
ggaggaatgccctctgggtgctcaggaactagcatctttaattcaatgatcaacaatataatcattagaacacta

SEQ ID NO: 71618 - DNA, 75 bp, Artificial Sequence
  Synthetic
attaacactcccagcaaaacaaagctcgagcctagcgtgttccatcatatctttgaagggaataaggagccagca

SEQ ID NO: 71619 - DNA, 75 bp, Artificial Sequence
  Synthetic
tatccacatcccgttgatgcatcactgttagctgaagctggcaaagggtatggtttaatcatgacaccagccgac

SEQ ID NO: 71620 - DNA, 75 bp, Artificial Sequence
  Synthetic
tgttagctgaagctggcaaagggtatggtttaatcatgacaccagccgacaagggagagtgctttaatgaagtca

SEQ ID NO: 71621 - DNA, 75 bp, Artificial Sequence
  Synthetic
aacactcatgtggatgagtacatgcaggaagccgttgaccactatgcagggcaactagcaactctagacattagc

SEQ ID NO: 71622 - DNA, 75 bp, Artificial Sequence
  Synthetic
tgccaatgaaagatattcatgaatcaattaggtggactaaagaccccaaaaacacccaggatcatgtgcgatcct

SEQ ID NO: 71623 - DNA, 75 bp, Artificial Sequence
  Synthetic
aacacccaggatcatgtgcgatccttgtgtctattggcctggcacaatggagagcaggaatatgaagaatttgtg

SEQ ID NO: 71624 - DNA, 75 bp, Artificial Sequence
  Synthetic
gggtacccctacgttgccctcggtattaagaagagagatatcctatccaagaagactaaggatctaacaaagctt

SEQ ID NO: 71625 - DNA, 75 bp, Artificial Sequence
  Synthetic
gattctttttaaattagagtacaattcggtttaattccaattggcttaaccctaccacactcaccgaactagaca

SEQ ID NO: 71626 - DNA, 75 bp, Artificial Sequence
  Synthetic
tcggtttaattccaattggcttaaccctaccacactcaccgaactagacaacggtgtggtaggggtaaattctcc

SEQ ID NO: 71627 - DNA, 75 bp, Artificial Sequence
  Synthetic
tgattgaggcgtccagcttgaacgactcagtggcaatgagacagactttcggtaacttgtacaaaacattccatc

SEQ ID NO: 71628 - DNA, 75 bp, Artificial Sequence
  Synthetic
tcgacggtcacctcattgctttcgattacagtggatatgatgctagcctgagtccggtgtggtttgcctgtctaa

SEQ ID NO: 71629 - DNA, 75 bp, Artificial Sequence
  Synthetic
ttacagtggatatgatgctagcctgagtccggtgtggtttgcctgtctaaaactgctattagagaagttgggtta

SEQ ID NO: 71630 - DNA, 75 bp, Artificial Sequence
  Synthetic
aagaggaggaatgccatccggatgttctgggaccagtattttcaactcaatgattaataacataattattagaac

SEQ ID NO: 71631 - DNA, 75 bp, Artificial Sequence
  Synthetic
tgattaataacataattattagaacactgatgttgaaggtatacaaagggatagatttggaccaattcaggatga

SEQ ID NO: 71632 - DNA, 75 bp, Artificial Sequence
  Synthetic
ttgggtgtccgtgtttccttttattcttatactggctgcttatggtgacaattgagaaattgttaccatatagct

SEQ ID NO: 71633 - DNA, 75 bp, Artificial Sequence
  Synthetic
cactcaaaacacttaaatacattgtaaatcttaacacaacaaaatgggggcgcaggtgtcaacacaaaaaaccgg

SEQ ID NO: 71634 - DNA, 75 bp, Artificial Sequence
  Synthetic
agacaaaggagagtgctttaatgaagtgacatggaccaacgtcacttttttgaaaaggtacttcagagcagatga

SEQ ID NO: 71635 - DNA, 75 bp, Artificial Sequence
  Synthetic
caaaaacacccaggaccacgtacgatccttgtgtctattggcctggcataatggagagcaggaatacgaagaatt

SEQ ID NO: 71636 - DNA, 75 bp, Artificial Sequence
  Synthetic
gatcaagaccttgcctgccttgaactcgcctactgtagaagaatgtggctatagtgatcgagtgcgctcgatcac

SEQ ID NO: 71637 - DNA, 75 bp, Artificial Sequence
  Synthetic
tcgcctactgtagaagaatgtggctatagtgatcgagtgcgctcgatcaccttgggaaactccacgatcaccaca

SEQ ID NO: 71638 - DNA, 75 bp, Artificial Sequence
  Synthetic
caacgtgccgcttctacactcttgagtcagtgaaatgggagagttcatcggcagggtggtggtggaagttcccag

SEQ ID NO: 71639 - DNA, 75 bp, Artificial Sequence
  Synthetic
acccacagggcccactgggcgccagcacactggtatcacggtacccttgtgcgcctgttttatccacccctcccc

SEQ ID NO: 71640 - DNA, 75 bp, Artificial Sequence
  Synthetic
ctatggataacatgtacaggcattataactttaccctaatggtgatcccatttgccaagttggagcactcacctc

SEQ ID NO: 71641 - DNA, 75 bp, Artificial Sequence
  Synthetic
aactctgcagcggaaccgactactttgggtgtccgtgtttctttttattcttatattggctgcttatggtgacaa

SEQ ID NO: 71642 - DNA, 75 bp, Artificial Sequence
  Synthetic
caccccagggagtacacaattcttgacatcagatgattttcaatccccatctgcaatgccacagtttgacgtcac

SEQ ID NO: 71643 - DNA, 75 bp, Artificial Sequence
  Synthetic
caactgaacgcaagaagatgggagcacaagtatcgactcaaaagactggggctcacgagaccgggcttaacgcca

SEQ ID NO: 71644 - DNA, 75 bp, Artificial Sequence
  Synthetic
acaagtatcgactcaaaagactggggctcacgagaccgggcttaacgccagcggcaattctgtgatccactatac

SEQ ID NO: 71645 - DNA, 75 bp, Artificial Sequence
  Synthetic
caatactgagggaaatgtaaactcaatggaggcttacagaataccagtaaggccacagaccagtagtggtgagca

SEQ ID NO: 71646 - DNA, 75 bp, Artificial Sequence
  Synthetic
caccgaaccaatgaaagatgtaatgatcaagacattaccggcgttgaactccccatcagtggaagagtgtggatt

SEQ ID NO: 71647 - DNA, 75 bp, Artificial Sequence
  Synthetic
atcaagacattaccggcgttgaactccccatcagtggaagagtgtggatttagtgatagagtgagatcaataacc

SEQ ID NO: 71648 - DNA, 75 bp, Artificial Sequence
  Synthetic
aaggatactgaggcaacggcagaggatcaaccaacacaacctgatgttgccacctgcaggttctatacactagaa

SEQ ID NO: 71649 - DNA, 75 bp, Artificial Sequence
  Synthetic
atcaaccaacacaacctgatgttgccacctgcaggttctatacactagaatcagttgagtggcagggaagttctg

SEQ ID NO: 71650 - DNA, 75 bp, Artificial Sequence
  Synthetic
ttgggagggcaggctacaccatccacgtgcagtgcaatgcatcgaaattccatcaagggtgcctgctagtagtgt

SEQ ID NO: 71651 - DNA, 75 bp, Artificial Sequence
  Synthetic
tccgcgtgcaatgacttctctgtgagattactgcgcgatacaccatttataacgcaacaagctttgtatcaaaat

SEQ ID NO: 71652 - DNA, 75 bp, Artificial Sequence
  Synthetic
cgtgcagtgcaatgcatcgaaattccatcaagggtgcctgctagtagtgtgtgtacctgaggctgaaatgggttg

SEQ ID NO: 71653 - DNA, 75 bp, Artificial Sequence
  Synthetic
caaattcctgccttgacagcagtggagacaggacacacatcacaagtggtaccgagtgacacaatgcaaacacgg

SEQ ID NO: 71654 - DNA, 75 bp, Artificial Sequence
  Synthetic
caacaccaatcaaaatgatgtacaaaatgtggtgcacaacgcagcaatgggggttggagtgggcaacctgacaat

SEQ ID NO: 71655 - DNA, 75 bp, Artificial Sequence
  Synthetic
aatgtggtgcacaacgcagcaatgggggttggagtgggcaacctgacaatattcccccatcagtggataaacctg

SEQ ID NO: 71656 - DNA, 75 bp, Artificial Sequence
  Synthetic
ctgggagataacaaccagacaagtggcgcaactgaggcgcaagctggaaatgttcacatacatgagattcgacct

SEQ ID NO: 71657 - DNA, 75 bp, Artificial Sequence
  Synthetic
aatttcacactaatgatcatcccgtttgctaagctagaatacgtctctggtgcttcgagcgtggtgccaatcaca

SEQ ID NO: 71658 - DNA, 75 bp, Artificial Sequence
  Synthetic
ttgctaagctagaatacgtctctggtgcttcgagcgtggtgccaatcacagtgaccattgcgcccatgtcagctg

SEQ ID NO: 71659 - DNA, 75 bp, Artificial Sequence
  Synthetic
catctgacgacttccaatcaccctcggccatgccacaattcgatgttacccccgagatgcacatcccaggagaag

SEQ ID NO: 71660 - DNA, 75 bp, Artificial Sequence
  Synthetic
ggccatgccacaattcgatgttacccccgagatgcacatcccaggagaagtgcgaaatctaatggaaattgcaga

SEQ ID NO: 71661 - DNA, 75 bp, Artificial Sequence
  Synthetic
attttgcatggcagacatccactaacccaagcgtattctggacggagggtaatgccccccccaggatgtcgatac

SEQ ID NO: 71662 - DNA, 75 bp, Artificial Sequence
  Synthetic
cacttcagtcagagcggtgtttatggatataccaccttgaacaacatgggtcacttatactttagacatgtgaac

SEQ ID NO: 71663 - DNA, 75 bp, Artificial Sequence
  Synthetic
ggtgagcaaggtaggggagcaggtgtttggattccagcttgaaccgggtagtggtagtgtgctatgcaggaccct

SEQ ID NO: 71664 - DNA, 75 bp, Artificial Sequence
  Synthetic
gatataccaccttgaacaacatgggtcacttatactttagacatgtgaacaaatcgactgcttacccagtcaata

SEQ ID NO: 71665 - DNA, 75 bp, Artificial Sequence
  Synthetic
tttggattccagcttgaaccgggtagtggtagtgtgctatgcaggaccctattgggtgagatattgaattattat

SEQ ID NO: 71666 - DNA, 75 bp, Artificial Sequence
  Synthetic
tgtatgcaaggaatgtcaactttgatgtgcaaggggtgaccgagtctcgggacaaaattactcttgaccgatcaa

SEQ ID NO: 71667 - DNA, 75 bp, Artificial Sequence
  Synthetic
tcatacgccccgcctggtgctggcttcccggaaaaccggaaagatgcaatgttagggacacatgtggtatgggat

SEQ ID NO: 71668 - DNA, 75 bp, Artificial Sequence
  Synthetic
tgtgcaaggggtgaccgagtctcgggacaaaattactcttgaccgatcaacccataatcctttaacaaacactgg

SEQ ID NO: 71669 - DNA, 75 bp, Artificial Sequence
  Synthetic
tcccggaaaaccggaaagatgcaatgttagggacacatgtggtatgggatgttgggctgcagtctagctgcgttc

SEQ ID NO: 71670 - DNA, 75 bp, Artificial Sequence
  Synthetic
cgattggcagaattgcgtgtgggaggactacaatagagacttgttagtcagcaccaccacagcccacggatgtga

SEQ ID NO: 71671 - DNA, 75 bp, Artificial Sequence
  Synthetic
cgtgttggtaccagaccagccttgtggttcctgcagaaacccctcagcagtgcactattttgtgtttcatctcag

SEQ ID NO: 71672 - DNA, 75 bp, Artificial Sequence
  Synthetic
ggttcctgcagaaacccctcagcagtgcactattttgtgtttcatctcagcatgtaacgatttctcagtaagact

SEQ ID NO: 71673 - DNA, 75 bp, Artificial Sequence
  Synthetic
ggtatcagtcccatgtgttacttgccgcagggttttctgaaccaggtgactgtgggggcatcttgaggtgcgaac

SEQ ID NO: 71674 - DNA, 75 bp, Artificial Sequence
  Synthetic
cacacagcctagcggtccaagtaattctgtcagcgtgccaatgcttactgctgctgagaccgggcacacatctca

SEQ ID NO: 71675 - DNA, 75 bp, Artificial Sequence
  Synthetic
tctgtcagcgtgccaatgcttactgctgctgagaccgggcacacatctcaagcagtacccagtgacactatacag

SEQ ID NO: 71676 - DNA, 75 bp, Artificial Sequence
  Synthetic
tactacacaacctatgacactcacggggatgcagccgacgcaaagtacgccagttggacgataaccacccgaaaa

SEQ ID NO: 71677 - DNA, 75 bp, Artificial Sequence
  Synthetic
gggatgcagccgacgcaaagtacgccagttggacgataaccacccgaaaagctgcacagctgcggagaaaactag

SEQ ID NO: 71678 - DNA, 75 bp, Artificial Sequence
  Synthetic
ccaaccaaatttgtgagcaggtcaatctcctcaaggagtcgctagtaggccaggactccattttagaaaaatctc

SEQ ID NO: 71679 - DNA, 75 bp, Artificial Sequence
  Synthetic
tgaaggcacttgtgaaaatcatttcagcattggtaattgtggtgagaaaccacgatgacctggtaacagtgaccg

SEQ ID NO: 71680 - DNA, 75 bp, Artificial Sequence
  Synthetic
aacgtcagggcgcgcctgttctcacgcatcaagtcatgtacgtgccaccaggtggtgcagtacccgctagtgtgg

SEQ ID NO: 71681 - DNA, 75 bp, Artificial Sequence
  Synthetic
gcatcaagtcatgtacgtgccaccaggtggtgcagtacccgctagtgtggacgattatgcgtggcagacgtccac

SEQ ID NO: 71682 - DNA, 75 bp, Artificial Sequence
  Synthetic
atacagtagcttctatgatgggtggtccaactttacacagaatggagtttacgggttcaacacgctaaacaacat

SEQ ID NO: 71683 - DNA, 75 bp, Artificial Sequence
  Synthetic
gttcatagagtggcttaaggttaaaatcttaccagaggtaaaggagaaacatgagttcctaaccagacttaaaca

SEQ ID NO: 71684 - DNA, 75 bp, Artificial Sequence
  Synthetic
tccaactttacacagaatggagtttacgggttcaacacgctaaacaacatgggaaagctatacgtacgacacgtc

SEQ ID NO: 71685 - DNA, 75 bp, Artificial Sequence
  Synthetic
cccagacctcctcgcctctgcgagtacgaaaaatcaggcaatgtaaacttcaaacccaagggcgtgacagagagc

SEQ ID NO: 71686 - DNA, 75 bp, Artificial Sequence
  Synthetic
acgaaaaatcaggcaatgtaaacttcaaacccaagggcgtgacagagagccggacgtctatcaaattagaaaaac

SEQ ID NO: 71687 - DNA, 75 bp, Artificial Sequence
  Synthetic
ggatagccaatagacacctggcaacgcatgatgattggcagaattgcgtgtgggaagattataacagggatctgt

SEQ ID NO: 71688 - DNA, 75 bp, Artificial Sequence
  Synthetic
gcatgatgattggcagaattgcgtgtgggaagattataacagggatctgttagtcagcaccaccacagctcacgg

SEQ ID NO: 71689 - DNA, 75 bp, Artificial Sequence
  Synthetic
ttcagtgtactccctaccaccagatccagatcactttgatggttacaaacagcaagccgtggtaatcatggatga

SEQ ID NO: 71690 - DNA, 75 bp, Artificial Sequence
  Synthetic
tagctttgaagggcctggcctcgtggaggtccaagaaagtgaatactaccccaagaggtatcaatcccatgtatt

SEQ ID NO: 71691 - DNA, 75 bp, Artificial Sequence
  Synthetic
aatggctgcactagaggagaagggcatcctattcacatcccccttcgtgctggcctcaacaaacgcaggatccat

SEQ ID NO: 71692 - DNA, 75 bp, Artificial Sequence
  Synthetic
gaggtccaagaaagtgaatactaccccaagaggtatcaatcccatgtattactagctgcgggattttcagagcca

SEQ ID NO: 71693 - DNA, 75 bp, Artificial Sequence
  Synthetic
tggcctcaacaaacgcaggatccattaacgcgccaacagtatcagacagtcgggccctggctaggaggttccact

SEQ ID NO: 71694 - DNA, 75 bp, Artificial Sequence
  Synthetic
ggttttgccgatgtgcgtgacctgctgtggttagaggatgatgccatggaacaaggagtgaaagattacgtggaa

SEQ ID NO: 71695 - DNA, 75 bp, Artificial Sequence
  Synthetic
tgtggttagaggatgatgccatggaacaaggagtgaaagattacgtggaacagctggggaacgccttcgggtcgg

SEQ ID NO: 71696 - DNA, 75 bp, Artificial Sequence
  Synthetic
gcgacgaagaatgctgcccagttaacttcaaaagatgctgtcctcttgtgtgtgggaaagctatccagttcattg

SEQ ID NO: 71697 - DNA, 75 bp, Artificial Sequence
  Synthetic
aatctctcaaggccctggtcaagattatatcagcactggtgatagtggtaagaaatcatgatgatctgataacag

SEQ ID NO: 71698 - DNA, 75 bp, Artificial Sequence
  Synthetic
gtgttggggcaacccttgaggcactgttccaaggcccgccagtgtacagggagatcaagattagtgtagcacctg

SEQ ID NO: 71699 - DNA, 75 bp, Artificial Sequence
  Synthetic
gttccaaggcccgccagtgtacagggagatcaagattagtgtagcacctgaaaccccgccaccgccagcaatcgc

SEQ ID NO: 71700 - DNA, 75 bp, Artificial Sequence
  Synthetic
agaaatcatgatgatctgataacagtgactgctaccctcgcccttatcggatgcaccacatctccatggcgctgg

SEQ ID NO: 71701 - DNA, 75 bp, Artificial Sequence
  Synthetic
caactccactcttcagattgagaagcacgtcagcagggccttcatatgcctccaagcactaacaacatttgtttc

SEQ ID NO: 71702 - DNA, 75 bp, Artificial Sequence
  Synthetic
actgagatgaccaatgcctgcaaaggcatggagtggatctctatcaaaattcagaaatttatcgaatggcttaag

SEQ ID NO: 71703 - DNA, 75 bp, Artificial Sequence
  Synthetic
cacgtcagcagggccttcatatgcctccaagcactaacaacatttgtttccgtggccggaatcatatacatcatt

SEQ ID NO: 71704 - DNA, 75 bp, Artificial Sequence
  Synthetic
gaagcagctaccacttctagaaagtcagattgccaccatagaacagagtgcaccgtcacaaagtgatcaagagca

SEQ ID NO: 71705 - DNA, 75 bp, Artificial Sequence
  Synthetic
caagccaaagtgcaaggtcctgcttttgagtttgcggtggccatgatgaaaagaaactccagcactgtgaaaaca

SEQ ID NO: 71706 - DNA, 75 bp, Artificial Sequence
  Synthetic
gaatatggtgagtttaccatgttgggcatctatgacagatgggccgttttgccacgccatgccaagcccggacca

SEQ ID NO: 71707 - DNA, 75 bp, Artificial Sequence
  Synthetic
gaatagttcagtgtactccttgccaccagacccagatcactttgatggatacaagcaacaggctgttgtgatcat

SEQ ID NO: 71708 - DNA, 75 bp, Artificial Sequence
  Synthetic
taaacactagcaagttcccaaacatgtacatccctgtagggcaggttacagactacggttttctaaacttaggtg

SEQ ID NO: 71709 - DNA, 75 bp, Artificial Sequence
  Synthetic
accaccaatggccgcactagaggaaaagggcatcctgttcacttccccttttgtcctggcttcaaccaatgctgg

SEQ ID NO: 71710 - DNA, 75 bp, Artificial Sequence
  Synthetic
ctggtaaggtgttggggatacacgttggtggaaatgggcaccagggcttctcagcagctctccttaaacattact

SEQ ID NO: 71711 - DNA, 75 bp, Artificial Sequence
  Synthetic
aaaatcaacatgcccatgtcagttaagacgtgtgatgaagagtgttgcccggtcaattttaaaagatgttgccct

SEQ ID NO: 71712 - DNA, 75 bp, Artificial Sequence
  Synthetic
ggattcccagtcattaacacaccaagtaaaaccaaattggaaccgagtgtcttccatcaagtatttgagggaaac

SEQ ID NO: 71713 - DNA, 75 bp, Artificial Sequence
  Synthetic
gtaaaaccaaattggaaccgagtgtcttccatcaagtatttgagggaaacaaagaacctgcagtcctcagaaatg

SEQ ID NO: 71714 - DNA, 75 bp, Artificial Sequence
  Synthetic
gagatgtttagggaatacaaccacagacacagtgtcggggcaacccttgaggcgctattccaaggtccaccagtg

SEQ ID NO: 71715 - DNA, 75 bp, Artificial Sequence
  Synthetic
gacacagtgtcggggcaacccttgaggcgctattccaaggtccaccagtgtacaaagagatcaaaatcagcgttg

SEQ ID NO: 71716 - DNA, 75 bp, Artificial Sequence
  Synthetic
atgagtacatgatggaggctgtggaccactatgcagggcagttagccacgctggacatcagcacggaaccaatga

SEQ ID NO: 71717 - DNA, 75 bp, Artificial Sequence
  Synthetic
ctggacatcagcacggaaccaatgaagttggaagatgccgtatacggcacagaagggttggaagcactcgattta

SEQ ID NO: 71718 - DNA, 75 bp, Artificial Sequence
  Synthetic
gcaaggagaaaggatggctagttcctgaaatcaattctactctccaaattgagaagcatgttagtcgagccttta

SEQ ID NO: 71719 - DNA, 75 bp, Artificial Sequence
  Synthetic
tgaaatcaattctactctccaaattgagaagcatgttagtcgagcctttatctgcctccaagcactaacaacttt

SEQ ID NO: 71720 - DNA, 75 bp, Artificial Sequence
  Synthetic
catactgtccaagaagaccaaagacttgaccaaactgaaggagtgcatggacaaatatggattgaatttgccaat

SEQ ID NO: 71721 - DNA, 75 bp, Artificial Sequence
  Synthetic
ttgaccaaactgaaggagtgcatggacaaatatggattgaatttgccaatggtaacctacgtgaaagatgagctc

SEQ ID NO: 71722 - DNA, 75 bp, Artificial Sequence
  Synthetic
taaccaaaaacctaaagtgcccacactaagacaggccaaggtgcaaggccccgcttttgaatttgctgtggccat

SEQ ID NO: 71723 - DNA, 75 bp, Artificial Sequence
  Synthetic
ctaagacaggccaaggtgcaaggccccgcttttgaatttgctgtggccatgatgaaaaggaactccagtacagtg

SEQ ID NO: 71724 - DNA, 75 bp, Artificial Sequence
  Synthetic
aggcaaacatttggtaacctgtataaaacattccatctaaacccagggattgtgactggcagtgctgttggatgt

SEQ ID NO: 71725 - DNA, 75 bp, Artificial Sequence
  Synthetic
ttcctgtaatgctagatgggcatctcatagcctttgattactctgggtacgatgctagtttgagcccggtgtggt

SEQ ID NO: 71726 - DNA, 75 bp, Artificial Sequence
  Synthetic
ggaccaaccattcttatgaatgaacaagaagttggcgtgctggatgctaaagaattagtggataaagatggcaca

SEQ ID NO: 71727 - DNA, 75 bp, Artificial Sequence
  Synthetic
aagaagttggcgtgctggatgctaaagaattagtggataaagatggcacaaatcttgaactgacattgctaagac

SEQ ID NO: 71728 - DNA, 75 bp, Artificial Sequence
  Synthetic
acactactttgtgcgcggtggcatgccttcaggatgttctggtaccagtatttttaattcaatgattaataatat

SEQ ID NO: 71729 - DNA, 75 bp, Artificial Sequence
  Synthetic
tagcaattaacactagcaaatttccaaatatgtacatccctgtggggcaggtcacggactatggctttctaaatc

SEQ ID NO: 71730 - DNA, 75 bp, Artificial Sequence
  Synthetic
aaatatgtacatccctgtggggcaggtcacggactatggctttctaaatctgggtggtacccccacaaaaagaat

SEQ ID NO: 71731 - DNA, 75 bp, Artificial Sequence
  Synthetic
tgatgtgattgcatcctatccctggccaattgacgccgccttgcttgctgaagctggtaaggggtatggactgat

SEQ ID NO: 71732 - DNA, 75 bp, Artificial Sequence
  Synthetic
ccaattgacgccgccttgcttgctgaagctggtaaggggtatggactgattatgacgccagcggacaaaggggaa

SEQ ID NO: 71733 - DNA, 75 bp, Artificial Sequence
  Synthetic
acatgtaggtgggaacgggcaccagggcttttcagcagctcttctcaagcactacttcaatgatgagcaagggga

SEQ ID NO: 71734 - DNA, 75 bp, Artificial Sequence
  Synthetic
ggcttttcagcagctcttctcaagcactacttcaatgatgagcaaggggagattgagttcattgagagctcaaag

SEQ ID NO: 71735 - DNA, 75 bp, Artificial Sequence
  Synthetic
ttggttcatcctgtcatgcctatgaaggacatccacgaatcaatcaggtggacgaaggacccaaagaacacccaa

SEQ ID NO: 71736 - DNA, 75 bp, Artificial Sequence
  Synthetic
gggaataaagaaccagcagtcctcagaaatggagacccacgcctcaaagccaactttgaagaggccatattttct

SEQ ID NO: 71737 - DNA, 75 bp, Artificial Sequence
  Synthetic
tggcctggcacaatggggagcacgaatatgaggagttcatcaagaaaattagaagcgtcccggttgggcgctgct

SEQ ID NO: 71738 - DNA, 75 bp, Artificial Sequence
  Synthetic
acgtggacgagtacatgctagaagccgtggaccactatgcagggcaactggccaccctcgacattaacactgaac

SEQ ID NO: 71739 - DNA, 75 bp, Artificial Sequence
  Synthetic
taaaacagcctgtgggttgttcccacccacagggcccactgggcgctagcacactggtatcacggtacctttgtg

SEQ ID NO: 71740 - DNA, 75 bp, Artificial Sequence
  Synthetic
catacgtggcactaggtattaagaagagagacatcttgtccaagaagaccaaggacctaaccaaattaaaagagt

SEQ ID NO: 71741 - DNA, 75 bp, Artificial Sequence
  Synthetic
gagagacatcttgtccaagaagaccaaggacctaaccaaattaaaagagtgcatggataagtatggcctgaactt

SEQ ID NO: 71742 - DNA, 75 bp, Artificial Sequence
  Synthetic
agcatccagcttgaacgattccgttgcaatgagacagacatttggtaatttatataagacatttcacctgaatcc

SEQ ID NO: 71743 - DNA, 75 bp, Artificial Sequence
  Synthetic
gcaatgagacagacatttggtaatttatataagacatttcacctgaatccggggattgtgactggcagtgcagtg

SEQ ID NO: 71744 - DNA, 75 bp, Artificial Sequence
  Synthetic
ggttacgacgccagcctgagccctgtgtggtttgcatgcttaaaactgctgctcgagaagatcgggtactcacac

SEQ ID NO: 71745 - DNA, 75 bp, Artificial Sequence
  Synthetic
tgtggtttgcatgcttaaaactgctgctcgagaagatcgggtactcacacaaggagacaaattacatagattacc

SEQ ID NO: 71746 - DNA, 75 bp, Artificial Sequence
  Synthetic
ctagcattttcaactcaatgattaacaacatcataatcaggacactaatgctgaaagtgtacaaggggattgact

SEQ ID NO: 71747 - DNA, 75 bp, Artificial Sequence
  Synthetic
ttgaaagattgttgccatatagctattggattggccatccggtgacaaacagagctattatttacctttttgttg

SEQ ID NO: 71748 - DNA, 75 bp, Artificial Sequence
  Synthetic
caacatcataatcaggacactaatgctgaaagtgtacaaggggattgacttggaccggtttagaatgattgcata

SEQ ID NO: 71749 - DNA, 75 bp, Artificial Sequence
  Synthetic
actgattatgacaccagcagataagggggagtgtttcaacgaagtcacttggactaatgtcacctttttgaagag

SEQ ID NO: 71750 - DNA, 75 bp, Artificial Sequence
  Synthetic
ggggagtgtttcaacgaagtcacttggactaatgtcacctttttgaagagatacttcagggctgatgagcagtac

SEQ ID NO: 71751 - DNA, 75 bp, Artificial Sequence
  Synthetic
acccaagatcacgttcgatcgttgtgcttattggcctggcacaacggggaacaggaatacgaggaattcatccaa

SEQ ID NO: 71752 - DNA, 75 bp, Artificial Sequence
  Synthetic
gcttattggcctggcacaacggggaacaggaatacgaggaattcatccaaaagatcagaagcgtcccggttgggc

SEQ ID NO: 71753 - DNA, 75 bp, Artificial Sequence
  Synthetic
cagtgatagggtaaggtccatcaccttgggtaactcaactataacaactcaggagtgtgcaaatgtggttgtagg

SEQ ID NO: 71754 - DNA, 75 bp, Artificial Sequence
  Synthetic
aattggcttaaccctactgcactaaccgaactagataacggtgcagtaggggtaaattctccgcattcggtgcgg

SEQ ID NO: 71755 - DNA, 75 bp, Artificial Sequence
  Synthetic
cgggatggtggtggaaatttcccgatgcactatctaacatgggtttgttcgggcaaaacatgcaataccattacc

SEQ ID NO: 71756 - DNA, 75 bp, Artificial Sequence
  Synthetic
aactgagcctcgaccaagcacttctgttaccccggactgagtatcaataggctgctcgcgtggctgatggagaaa

SEQ ID NO: 71757 - DNA, 75 bp, Artificial Sequence
  Synthetic
cgagaaacctagtaccaccatggaagttgcgcagcgtttcgctccgcacaaccccagtgtagatcaggtcgatga

SEQ ID NO: 71758 - DNA, 75 bp, Artificial Sequence
  Synthetic
accccagtgtagatcaggtcgatgagtcactgcgttccccacgggtgaccgtggcagtggctgcgttggcggcct

SEQ ID NO: 71759 - DNA, 75 bp, Artificial Sequence
  Synthetic
agtgggcagtctgtcgtaacgggcaactctgcagcggaaccgactactttgggtgaccgtgtttccttttatttt

SEQ ID NO: 71760 - DNA, 75 bp, Artificial Sequence
  Synthetic
ttttatacctctcaaccacaaggttataagtactctcaaccttgttttagcatttaacacagcaaaatgggagct

SEQ ID NO: 71761 - DNA, 75 bp, Artificial Sequence
  Synthetic
ataagtactctcaaccttgttttagcatttaacacagcaaaatgggagctcaagtatctactcagaagacagggg

SEQ ID NO: 71762 - DNA, 75 bp, Artificial Sequence
  Synthetic
cttccaactcgacaaacaggcaagactttacgcaggacccaggcaagttcaccgaaccagtgaaagacatcatga

SEQ ID NO: 71763 - DNA, 75 bp, Artificial Sequence
  Synthetic
gccctctgctgaggagtgcggtttcagtgacagggtccgttccattaccctaggcaactccactattaccaccca

SEQ ID NO: 71764 - DNA, 75 bp, Artificial Sequence
  Synthetic
ccaacccacacagcctgatgttgcaacttgtcgtttttacactttggaatctgtgcaatggatgaaaaattcagc

SEQ ID NO: 71765 - DNA, 75 bp, Artificial Sequence
  Synthetic
acttgtcgtttttacactttggaatctgtgcaatggatgaaaaattcagctggatggtggtggaagctgcaacat

SEQ ID NO: 71766 - DNA, 75 bp, Artificial Sequence
  Synthetic
taacatgctggtaccagacgaacattgtggtgcctgcagacactcaaagtgactgcaagatcttgtgctttgtgt

SEQ ID NO: 71767 - DNA, 75 bp, Artificial Sequence
  Synthetic
gtgcaatgtaatgcctcaaaattccatcaagggtgtttacttgtcgtgtgtgtaccggaggcagaaatgggatgc

SEQ ID NO: 71768 - DNA, 75 bp, Artificial Sequence
  Synthetic
ttgctgagctatctggaggggatgtcgccagagtgttcactgacaccaaagtgggcgaatccaatgcaaagaagg

SEQ ID NO: 71769 - DNA, 75 bp, Artificial Sequence
  Synthetic
acctgcggacaaataacagcgctaccatagtcatgccgtacataaacagtgttcccatggataatatgtttagac

SEQ ID NO: 71770 - DNA, 75 bp, Artificial Sequence
  Synthetic
catagtcatgccgtacataaacagtgttcccatggataatatgtttagacataacaacatcacactgatgatcat

SEQ ID NO: 71771 - DNA, 75 bp, Artificial Sequence
  Synthetic
tgcagagtacaatggtctccggctagctagtaaccagggcctgccggtgatgacgacgccggggagcacacaatt

SEQ ID NO: 71772 - DNA, 75 bp, Artificial Sequence
  Synthetic
gctagtaaccagggcctgccggtgatgacgacgccggggagcacacaattcctcacctcggatgattttcagtcc

SEQ ID NO: 71773 - DNA, 75 bp, Artificial Sequence
  Synthetic
gctgaggtagactcagtggtgcctgtaaacaatacagaagacaacgtgagtagtctcaaagcctaccagatccca

SEQ ID NO: 71774 - DNA, 75 bp, Artificial Sequence
  Synthetic
taaacaatacagaagacaacgtgagtagtctcaaagcctaccagatcccagtacagtctaacagtgacaatggta

SEQ ID NO: 71775 - DNA, 75 bp, Artificial Sequence
  Synthetic
attactacacccactggagtggcagcataaaactcacattcatgttttgtgggtctgcaatggctactggcaaat

SEQ ID NO: 71776 - DNA, 75 bp, Artificial Sequence
  Synthetic
gatgctatgttgggcactcacgtcatatgggatgttgggctacaatcaagctgtgtgctgtgtgtaccgtggatc

SEQ ID NO: 71777 - DNA, 75 bp, Artificial Sequence
  Synthetic
aacatagttgttcctgctgatgtgcaaagctcatgtgacatcctgtgctttgtgtcggcttgtaatgacttctca

SEQ ID NO: 71778 - DNA, 75 bp, Artificial Sequence
  Synthetic
aaagctcatgtgacatcctgtgctttgtgtcggcttgtaatgacttctcagtgcggatgctaaaggacacccctt

SEQ ID NO: 71779 - DNA, 75 bp, Artificial Sequence
  Synthetic
cggttagctcacgacccaccaactcagagtccatccccgctctcaccgctgcagagaccgggcacacctcccaag

SEQ ID NO: 71780 - DNA, 75 bp, Artificial Sequence
  Synthetic
agagtccatccccgctctcaccgctgcagagaccgggcacacctcccaagtcgtacctagtgacaccatgcagac

SEQ ID NO: 71781 - DNA, 75 bp, Artificial Sequence
  Synthetic
aggatgatgcaatggagcagggtgtgaaagactacgtagaacagcttggaaatgcttttggctctggcttcacca

SEQ ID NO: 71782 - DNA, 75 bp, Artificial Sequence
  Synthetic
aatgcttttggctctggcttcaccaaccaaatttgtgaacaggttaaccttctcaaagaaacattgattggtcaa

SEQ ID NO: 71783 - DNA, 75 bp, Artificial Sequence
  Synthetic
ctatgccacctacacgaacaacacagaaaaagggtacgcagagtgggtcgtaaacactaggcaagtagcccaatt

SEQ ID NO: 71784 - DNA, 75 bp, Artificial Sequence
  Synthetic
tatctaagatttgacttagagttgacattcgtgataacgagcgctcaacaacccagtactgccactagcgtggat

SEQ ID NO: 71785 - DNA, 75 bp, Artificial Sequence
  Synthetic
tggcaaacctccaccaaccctagtgttttctggacggaagggaatgctccaccaaggatgtcaattccgtttatc

SEQ ID NO: 71786 - DNA, 75 bp, Artificial Sequence
  Synthetic
acatgaggcatgtcaacgaggcagggcaaggcccaattaagagcactgtcagaatgtactttaaacctaagcatg

SEQ ID NO: 71787 - DNA, 75 bp, Artificial Sequence
  Synthetic
gagtcaccacaagcagactggacattacaacaacaggtgtatttggccagcaatcaggtgctatatacgttggta

SEQ ID NO: 71788 - DNA, 75 bp, Artificial Sequence
  Synthetic
tacaacaacaggtgtatttggccagcaatcaggtgctatatacgttggtaactatagagtggtaaacaggcacct

SEQ ID NO: 71789 - DNA, 75 bp, Artificial Sequence
  Synthetic
ccacggttgtgacaccatagccaggtgccaatgcacaaccggagtgtatttctgcgcctcaaggggcaagcacta

SEQ ID NO: 71790 - DNA, 75 bp, Artificial Sequence
  Synthetic
tgccaatgcacaaccggagtgtatttctgcgcctcaaggggcaagcactatccagtcatctttgagggcccgggt

SEQ ID NO: 71791 - DNA, 75 bp, Artificial Sequence
  Synthetic
cgtccacaaatgccggttccatcaatgcgccgacagtatcagatagccgggctttagctaggaggttccattttg

SEQ ID NO: 71792 - DNA, 75 bp, Artificial Sequence
  Synthetic
gaaccaggagactgtggtgggatcctgagatgtgagcatggtgtcatcggcatcgtaactatgggtggtgagggc

SEQ ID NO: 71793 - DNA, 75 bp, Artificial Sequence
  Synthetic
atgaagagtgttgtccagccaacttcaagcggtgttgccctctcgtatgcggtaaggctattcagttcattgata

SEQ ID NO: 71794 - DNA, 75 bp, Artificial Sequence
  Synthetic
tgagatgtgagcatggtgtcatcggcatcgtaactatgggtggtgagggcgttgttggctttgcagatgtacgcg

SEQ ID NO: 71795 - DNA, 75 bp, Artificial Sequence
  Synthetic
gaaaaacccaagtgaggtattcgctggacatgctggttaccgagatgtttagggagtacaaccatagacacagtg

SEQ ID NO: 71796 - DNA, 75 bp, Artificial Sequence
  Synthetic
gttcgggtttcacaaaccagatctgcgagcaggttaacattctaaaagaatcattggtaggtcaagattccatct

SEQ ID NO: 71797 - DNA, 75 bp, Artificial Sequence
  Synthetic
cgagcaggttaacattctaaaagaatcattggtaggtcaagattccatcttagagaagtcgcttaaagccttagt

SEQ ID NO: 71798 - DNA, 75 bp, Artificial Sequence
  Synthetic
ctcccccgccgcctgcaattgcagatttactaaaatcagtggacagtgaagcggtcagggagtattgcaaagaga

SEQ ID NO: 71799 - DNA, 75 bp, Artificial Sequence
  Synthetic
gatcggctgcacttcctccccatggcggtggctcaaacagaaagtctcccagtattacgggattcccgtggcaga

SEQ ID NO: 71800 - DNA, 75 bp, Artificial Sequence
  Synthetic
cggtggctcaaacagaaagtctcccagtattacgggattcccgtggcagagaggcaaaacaacaattggctaaag

SEQ ID NO: 71801 - DNA, 75 bp, Artificial Sequence
  Synthetic
ttgaaagttaaaatcttaccagaggtagaggaaaaacacgagttcctacataggttaaaacaactacccctgctg

SEQ ID NO: 71802 - DNA, 75 bp, Artificial Sequence
  Synthetic
taggttaaaacaactacccctgctggagagccagattgccaccattgaacagagtgcaccatctcaaagcgatca

SEQ ID NO: 71803 - DNA, 75 bp, Artificial Sequence
  Synthetic
attctcatgaatgaccaagaggttggtgtgctggatgcaaaagaactggtggataaagatggcacaaatcttgaa

SEQ ID NO: 71804 - DNA, 75 bp, Artificial Sequence
  Synthetic
caagagagtgttctccctagaaaagaaaatgagcaattacatacagttcaagtccaaatgccgtattgagcctgt

SEQ ID NO: 71805 - DNA, 75 bp, Artificial Sequence
  Synthetic
atgagaagttcagggatatcagaggttttcttgccaaagaagaggtagaggttaatgaagccgtcctggcaataa

SEQ ID NO: 71806 - DNA, 75 bp, Artificial Sequence
  Synthetic
aaaacttaatagttcagtgtattccctaccaccagaccctgatcactttgacgggtacaaacaacaggccgtcgt

SEQ ID NO: 71807 - DNA, 75 bp, Artificial Sequence
  Synthetic
ctaccaccagaccctgatcactttgacgggtacaaacaacaggccgtcgttatcatggatgatttgtgtcagaac

SEQ ID NO: 71808 - DNA, 75 bp, Artificial Sequence
  Synthetic
cccccacaaagagaatgcttatgtacaacttcccaaccagagcaggccaatgtggtggtgtcctcatgtccaccg

SEQ ID NO: 71809 - DNA, 75 bp, Artificial Sequence
  Synthetic
gcagctctcctcaaacactacttcaatgatgagcaaggtgagattgaatttattgaaaactccaaagaggcgggc

SEQ ID NO: 71810 - DNA, 75 bp, Artificial Sequence
  Synthetic
gaggaaaaaggcatccttttcacatcaccatttgttctcgcttcaaccaacgcaggatcaatcaacgctcccact

SEQ ID NO: 71811 - DNA, 75 bp, Artificial Sequence
  Synthetic
tattgaaaactccaaagaggcgggcttccctgttattaatacaccaagcaagaccaaattggaaccgagtgtctt

SEQ ID NO: 71812 - DNA, 75 bp, Artificial Sequence
  Synthetic
caccatttgttctcgcttcaaccaacgcaggatcaatcaacgctcccactgtgtcagacagcagagcgctagcaa

SEQ ID NO: 71813 - DNA, 75 bp, Artificial Sequence
  Synthetic
cagtgaaaacctgtgatgacgaatgctgccctgtcaacttcaagaagtgttgtccactagtgtgtggcaaggcta

SEQ ID NO: 71814 - DNA, 75 bp, Artificial Sequence
  Synthetic
ctgccctgtcaacttcaagaagtgttgtccactagtgtgtggcaaggctattcagtttattgacagaagaaccca

SEQ ID NO: 71815 - DNA, 75 bp, Artificial Sequence
  Synthetic
actcgaggcactatttcagggtccaccagtgtacagagaaatcaagattagtgttgcaccggaaacccctccccc

SEQ ID NO: 71816 - DNA, 75 bp, Artificial Sequence
  Synthetic
ccagtgtacagagaaatcaagattagtgttgcaccggaaacccctcccccaccggcaattgctgacctattaaaa

SEQ ID NO: 71817 - DNA, 75 bp, Artificial Sequence
  Synthetic
caaattgaaaaacacgtgagtagagctttcatctgcctgcaagcgctcactacctttatctctgtagcagggatt

SEQ ID NO: 71818 - DNA, 75 bp, Artificial Sequence
  Synthetic
agtcccggctcattgaagcttctagtttgaatgattctgtggcgatgaggcagacctttggcaatctgtacaaga

SEQ ID NO: 71819 - DNA, 75 bp, Artificial Sequence
  Synthetic
ctttcatctgcctgcaagcgctcactacctttatctctgtagcagggattatatacattatatacaagttgtttg

SEQ ID NO: 71820 - DNA, 75 bp, Artificial Sequence
  Synthetic
catttcacctgaacccagggattgtgacaggtagcgcagttgggtgtgatccagatctcttttggagtaaaatac

SEQ ID NO: 71821 - DNA, 75 bp, Artificial Sequence
  Synthetic
aagggccagccttcgagtttgctgtggctatgatgaagagaaacgccagtacagtcaagactgagtatggcgagt

SEQ ID NO: 71822 - DNA, 75 bp, Artificial Sequence
  Synthetic
ggctatgatgaagagaaacgccagtacagtcaagactgagtatggcgagttcactatgcttgggatttatgacag

SEQ ID NO: 71823 - DNA, 75 bp, Artificial Sequence
  Synthetic
gccagcttgagccctgtgtggtttgcttgtctaaagctactgcttgagaagcttggatacttacataaagagaca

SEQ ID NO: 71824 - DNA, 75 bp, Artificial Sequence
  Synthetic
tgctaaagaactggttgacaaagatggtactaacctggagctgacacttcttaaactcaataggaatgaaaagtt

SEQ ID NO: 71825 - DNA, 75 bp, Artificial Sequence
  Synthetic
ggtactaacctggagctgacacttcttaaactcaataggaatgaaaagttcagagatatccgaggcttcttggta

SEQ ID NO: 71826 - DNA, 75 bp, Artificial Sequence
  Synthetic
ggccaggtatcagactatggcttcctcaacctgggtgggactcctaccaagcgtatgctgatgtacaattttccc

SEQ ID NO: 71827 - DNA, 75 bp, Artificial Sequence
  Synthetic
tcaacctgggtgggactcctaccaagcgtatgctgatgtacaattttcccactcgtgcagggcaatgtggtggtg

SEQ ID NO: 71828 - DNA, 75 bp, Artificial Sequence
  Synthetic
tcacctttttgaaaaggtatttcagagcagatgagcaatatcctttcttgatccacccagttatgcctatgaagg

SEQ ID NO: 71829 - DNA, 75 bp, Artificial Sequence
  Synthetic
tacgccactacttcaatgacgagcagggcgaaatcgagtttattgaaaactccaaagaggctggctttccagtca

SEQ ID NO: 71830 - DNA, 75 bp, Artificial Sequence
  Synthetic
gggcgaaatcgagtttattgaaaactccaaagaggctggctttccagtcatcaacacccctagtaaaacaaagct

SEQ ID NO: 71831 - DNA, 75 bp, Artificial Sequence
  Synthetic
gaaggctaattttgaagaagccatcttctccaaatacatcggaaacgtgaacacgcacgtggacgagtacatgat

SEQ ID NO: 71832 - DNA, 75 bp, Artificial Sequence
  Synthetic
attggagacaatttaatatgatttaaattggcttaaccctaccgcactcaccgaactagaaaacggtgcggtagg

SEQ ID NO: 71833 - DNA, 75 bp, Artificial Sequence
  Synthetic
ttctccaaatacatcggaaacgtgaacacgcacgtggacgagtacatgatggaagccgtcgatcactacgcagga

SEQ ID NO: 71834 - DNA, 75 bp, Artificial Sequence
  Synthetic
gcattggacttaaccactagtgcagggtacccctatgttgcccttggcattaagaagagagacatcttgtccaag

SEQ ID NO: 71835 - DNA, 75 bp, Artificial Sequence
  Synthetic
ggtacccctatgttgcccttggcattaagaagagagacatcttgtccaagaaaaccaaagacttaacgaagctaa

SEQ ID NO: 71836 - DNA, 75 bp, Artificial Sequence
  Synthetic
aagtagccaagggtaaatccagactaattgaggcatcgagcctgaatgactcagtggccatgagacagacttttg

SEQ ID NO: 71837 - DNA, 75 bp, Artificial Sequence
  Synthetic
aattgaggcatcgagcctgaatgactcagtggccatgagacagacttttggcaacctatataaaacattccacct

SEQ ID NO: 71838 - DNA, 75 bp, Artificial Sequence
  Synthetic
attggattggccatccagtgtccaatagagcaatcatttaccttttcgttggatttattccacttgactacaaag

SEQ ID NO: 71839 - DNA, 75 bp, Artificial Sequence
  Synthetic
tgatggccatctcattgctttcgactacagtgggtatgatgctagcttgagcccagtgtggttcgcttgtctaaa

SEQ ID NO: 71840 - DNA, 75 bp, Artificial Sequence
  Synthetic
tacagtgggtatgatgctagcttgagcccagtgtggttcgcttgtctaaaactgttgctagagaagctagggtat

SEQ ID NO: 71841 - DNA, 75 bp, Artificial Sequence
  Synthetic
agaggaggaatgccgtccgggtgctctgggactagcatctttaattcaatgattaacaacataatcatcagaaca

SEQ ID NO: 71842 - DNA, 75 bp, Artificial Sequence
  Synthetic
ctgggactagcatctttaattcaatgattaacaacataatcatcagaacactaatgctgaaggtgtacaaaggga

SEQ ID NO: 71843 - DNA, 75 bp, Artificial Sequence
  Synthetic
atagtgatcgagtgcgctcgatcaccttgggaaactccacgatcaccacgcaggagtgcgctaatgtggttgtgg

SEQ ID NO: 71844 - DNA, 75 bp, Artificial Sequence
  Synthetic
cactgctagctgaagctggcaaggggtacggtctgatcatgacaccagcagataagggagaatgcttcaatgaag

SEQ ID NO: 71845 - DNA, 75 bp, Artificial Sequence
  Synthetic
gtacggtctgatcatgacaccagcagataagggagaatgcttcaatgaagtgacgtggaccaacgtcaccttcct

SEQ ID NO: 71846 - DNA, 75 bp, Artificial Sequence
  Synthetic
gtcgatcaggtggactaaagaccctaaaaacacccaggatcacgtgcgatctttgtgcctattggcctggcacaa

SEQ ID NO: 71847 - DNA, 75 bp, Artificial Sequence
  Synthetic
aaaaacacccaggatcacgtgcgatctttgtgcctattggcctggcacaacggagagcaagagtatgaagaattt

SEQ ID NO: 71848 - DNA, 75 bp, Artificial Sequence
  Synthetic
ctagattctttttaaattagagcgcaatttgacttaattccagttggcttaaccctaccacacttaccgaactag

SEQ ID NO: 71849 - DNA, 75 bp, Artificial Sequence
  Synthetic
caagcaatggagttcagtgcagagaaaagcacagaccaaacgggaccacaaaccgcagttcacaatgcgggcatg

SEQ ID NO: 71850 - DNA, 75 bp, Artificial Sequence
  Synthetic
aatttgacttaattccagttggcttaaccctaccacacttaccgaactagaaaacggtgtggtaggggtaaattc

SEQ ID NO: 71851 - DNA, 75 bp, Artificial Sequence
  Synthetic
acccacagggcccactgggcgctagcacactggtattacggtacctttgcgcgcctgttttatctaccctccccc

SEQ ID NO: 71852 - DNA, 75 bp, Artificial Sequence
  Synthetic
ccatggacaacatgtacaggcattataactttaccctaatggtgatcccatttgctaagttggaacactcacccc

SEQ ID NO: 71853 - DNA, 75 bp, Artificial Sequence
  Synthetic
cagtgagcagtctgtcgtaatgggcaactctgcggcggaaccgactactttgggtgaccgtgtttccttttattc

SEQ ID NO: 71854 - DNA, 75 bp, Artificial Sequence
  Synthetic
cattgcttactcaccaccaggggctggcgtccccggcagtaggaaggatgctatgctcgggacacatgtcatatg

SEQ ID NO: 71855 - DNA, 75 bp, Artificial Sequence
  Synthetic
gctttgtaccactaaactataaagtgttaaatactctcaactttatcctaaaactcaacaaagcaaaatgggagc

SEQ ID NO: 71856 - DNA, 75 bp, Artificial Sequence
  Synthetic
aaacatcaactattacaaagatgcagcctcaaactctgccaaccgacaggactttacgcaagatccaggaaagtt

SEQ ID NO: 71857 - DNA, 75 bp, Artificial Sequence
  Synthetic
gcctcaaactctgccaaccgacaggactttacgcaagatccaggaaagtttacagagccggttaaagacataatg

SEQ ID NO: 71858 - DNA, 75 bp, Artificial Sequence
  Synthetic
ataacttgctggtaccagacaagcattgtgacaccaccagacatacccaccactagtaccatattatgctttgta

SEQ ID NO: 71859 - DNA, 75 bp, Artificial Sequence
  Synthetic
gaccctgaaagtgcaatcaacaaggccgtaggtagagtggccgacacagtggccagtggacctgtcaacaccgag

SEQ ID NO: 71860 - DNA, 75 bp, Artificial Sequence
  Synthetic
ctaggtaattccacaatcacaacccaagagtgcgctaatgtggttgtgggctatggcacttggccacggtacttg

SEQ ID NO: 71861 - DNA, 75 bp, Artificial Sequence
  Synthetic
ctatggcacttggccacggtacttgagcgacaaagaggcaacggcagaggaccagccaacgcaaccagatgttgc

SEQ ID NO: 71862 - DNA, 75 bp, Artificial Sequence
  Synthetic
tccgagtgacacgatgcaaacacggcatgtgatcaattaccacaccagatcagagtcgtcaatagaaaacttcat

SEQ ID NO: 71863 - DNA, 75 bp, Artificial Sequence
  Synthetic
ctggttggtggtggaaattccctgatgcactgtcagacatggggttgtttgctcaaaacatgatgtatcactatc

SEQ ID NO: 71864 - DNA, 75 bp, Artificial Sequence
  Synthetic
cgtgcaatgtaacgcatccaagttccaccaagggtgtttgctggttgtgtgtgtgccagaggctgaaatggggtg

SEQ ID NO: 71865 - DNA, 75 bp, Artificial Sequence
  Synthetic
caccaagggtgtttgctggttgtgtgtgtgccagaggctgaaatggggtgcaccaataaagaaaataccccttta

SEQ ID NO: 71866 - DNA, 75 bp, Artificial Sequence
  Synthetic
gatgtccagaccgcagtatgtaacgctggaatgggagtaggagttggtaatctaacgatttttccacatcagtgg

SEQ ID NO: 71867 - DNA, 75 bp, Artificial Sequence
  Synthetic
ctggaatgggagtaggagttggtaatctaacgatttttccacatcagtggattaatttgcgtaccaacaatagcg

SEQ ID NO: 71868 - DNA, 75 bp, Artificial Sequence
  Synthetic
gatataccaccttgaataacatgggtcacttatactttagacatgtgaacaaatcgactgcttacccagttaaca

SEQ ID NO: 71869 - DNA, 75 bp, Artificial Sequence
  Synthetic
tcatcccctttgtaccgcttgattatgtcaatggttcatccccatacatacccattactgttactgtggccccga

SEQ ID NO: 71870 - DNA, 75 bp, Artificial Sequence
  Synthetic
tgtcaatggttcatccccatacatacccattactgttactgtggccccgatgtctgcagagtataacggactgcg

SEQ ID NO: 71871 - DNA, 75 bp, Artificial Sequence
  Synthetic
gtcaccctcagctatgccacagtttgacgtcacaccagaaatggaaatcccaggacaagtgcacaacttgatgga

SEQ ID NO: 71872 - DNA, 75 bp, Artificial Sequence
  Synthetic
gacgtcacaccagaaatggaaatcccaggacaagtgcacaacttgatggaaatagcagaagttgactcagtggtg

SEQ ID NO: 71873 - DNA, 75 bp, Artificial Sequence
  Synthetic
tcaacaggcatcttgctacacacaatgattggcagaactgcgtgtgggaggactacaacagagacttgctggtca

SEQ ID NO: 71874 - DNA, 75 bp, Artificial Sequence
  Synthetic
ggggcacaggtgtttgggttttcattgcagcccggtgcttctagtgtgttgcaacgcacactacttggagaaatt

SEQ ID NO: 71875 - DNA, 75 bp, Artificial Sequence
  Synthetic
tgcagcccggtgcttctagtgtgttgcaacgcacactacttggagaaattttaaactattacacacattggtctg

SEQ ID NO: 71876 - DNA, 75 bp, Artificial Sequence
  Synthetic
cgggagctggggtgccaccggatagaaagaaagcaatgcttggaacacacgtcatatgggacgtggggctgcaat

SEQ ID NO: 71877 - DNA, 75 bp, Artificial Sequence
  Synthetic
tgcgggggtatcttgaggtgcgaacatggcgtcatagggcttgtgaccatggggggcgaaggtgttgttggcttt

SEQ ID NO: 71878 - DNA, 75 bp, Artificial Sequence
  Synthetic
gtcatatgggacgtggggctgcaatctagttgcgtgttgtgcgtaccatggattagccaaacacattacaggtat

SEQ ID NO: 71879 - DNA, 75 bp, Artificial Sequence
  Synthetic
aacaaatgtcatagcaccggctgatgccctgtccacgtgttacatcatgtgcatggtgtccgcttgcaacgactt

SEQ ID NO: 71880 - DNA, 75 bp, Artificial Sequence
  Synthetic
gccctgtccacgtgttacatcatgtgcatggtgtccgcttgcaacgacttttcagtgcgcatgttgcgtgatacc

SEQ ID NO: 71881 - DNA, 75 bp, Artificial Sequence
  Synthetic
gacaccattggtagtggaccatcgaactcggaagctatacctgcactcacagcagttgaaacaggccacacatcg

SEQ ID NO: 71882 - DNA, 75 bp, Artificial Sequence
  Synthetic
ctacgcttgcccttataggatgcacctcatcaccgtggcgctggctcaaacaaaaagtgtcgcagtactatggca

SEQ ID NO: 71883 - DNA, 75 bp, Artificial Sequence
  Synthetic
actcggaagctatacctgcactcacagcagttgaaacaggccacacatcgcaagtcacccctagtgacacaatgc

SEQ ID NO: 71884 - DNA, 75 bp, Artificial Sequence
  Synthetic
ctcatcaccgtggcgctggctcaaacaaaaagtgtcgcagtactatggcatacccatggctgagcgccagaacaa

SEQ ID NO: 71885 - DNA, 75 bp, Artificial Sequence
  Synthetic
tgttttatacaacgtacacaaacagcaagaacgctgccaaggaaaagaagttcgcaacgtggaaagtgagtgtta

SEQ ID NO: 71886 - DNA, 75 bp, Artificial Sequence
  Synthetic
attcatagaatggcttaaagtcaagatcctgccagaggtgagagagaagcatgaatttcttaacagacttaagca

SEQ ID NO: 71887 - DNA, 75 bp, Artificial Sequence
  Synthetic
caagaacgctgccaaggaaaagaagttcgcaacgtggaaagtgagtgttagacaagctgctcaattgagaagaaa

SEQ ID NO: 71888 - DNA, 75 bp, Artificial Sequence
  Synthetic
gccaccatcgagcaaagtgcaccgtctcaaagtgatcaagaacagcttttctcaaatgtccagtacttcgcccat

SEQ ID NO: 71889 - DNA, 75 bp, Artificial Sequence
  Synthetic
tgccatgaacctggatgtaccagtgctgacccatcaaataatgtacgtaccacccggtggaccggtacctgagac

SEQ ID NO: 71890 - DNA, 75 bp, Artificial Sequence
  Synthetic
ctgacccatcaaataatgtacgtaccacccggtggaccggtacctgagactgtggacgattacaattggcaaacg

SEQ ID NO: 71891 - DNA, 75 bp, Artificial Sequence
  Synthetic
tacatacagttcaagtccaaatgccgcattgagcctgtatgtctgctcttacacgggagtcctggggctggtaag

SEQ ID NO: 71892 - DNA, 75 bp, Artificial Sequence
  Synthetic
aacgcatatagcatgttctacgacgggtggtccgagttcagacacgatggtgtttatggattaaacaccttaaat

SEQ ID NO: 71893 - DNA, 75 bp, Artificial Sequence
  Synthetic
ggtggtccgagttcagacacgatggtgtttatggattaaacaccttaaataatatgggtactatatatgccagac

SEQ ID NO: 71894 - DNA, 75 bp, Artificial Sequence
  Synthetic
ccagatcactttgatggtcacaaacaacaagcggtcctgattattgatgtcctatacctcaatccagatggctgg

SEQ ID NO: 71895 - DNA, 75 bp, Artificial Sequence
  Synthetic
aacaagcggtcctgattattgatgtcctatacctcaatccagatggctgggacgtatctcttttcagcccaaagg

SEQ ID NO: 71896 - DNA, 75 bp, Artificial Sequence
  Synthetic
gggttccgcgaccaccccgtctggcccagtacctcaaagccaacaacgttaacttcgatgtcactgacgtgacag

SEQ ID NO: 71897 - DNA, 75 bp, Artificial Sequence
  Synthetic
ccagtacctcaaagccaacaacgttaacttcgatgtcactgacgtgacagaaaagagggatagcctcacgaccac

SEQ ID NO: 71898 - DNA, 75 bp, Artificial Sequence
  Synthetic
tagcatccacaaacgccggctccatcaacgcaccaacagtctcggacagccgagccttagccaggaggttccatt

SEQ ID NO: 71899 - DNA, 75 bp, Artificial Sequence
  Synthetic
caacgcaccaacagtctcggacagccgagccttagccaggaggttccattttgacatgaatatagaggtcatttc

SEQ ID NO: 71900 - DNA, 75 bp, Artificial Sequence
  Synthetic
cagtgattggcagaactgcgtgtgggaggactacaatagggaccttctcgtgagtaccaccacagcccacgggtg

SEQ ID NO: 71901 - DNA, 75 bp, Artificial Sequence
  Synthetic
ttttaaaagatgttgcccccttgtgtgtgggaaggctatccagttcatcgatagaaaaacacaagtcagatactc

SEQ ID NO: 71902 - DNA, 75 bp, Artificial Sequence
  Synthetic
tgagtaccaccacagcccacgggtgtgacaccattgccaggtgtcgatgcacaacaggcgtatacttctgcgcat

SEQ ID NO: 71903 - DNA, 75 bp, Artificial Sequence
  Synthetic
agaggtatcaatcacatgtgctacttgcagcggggttttcagaaccaggggactgtggtggaatcctcaggtgcg

SEQ ID NO: 71904 - DNA, 75 bp, Artificial Sequence
  Synthetic
ttcgcagacgtccgcgatctactatggctggaggatgacgccatggaacagggagtgagagattatgtcgagcaa

SEQ ID NO: 71905 - DNA, 75 bp, Artificial Sequence
  Synthetic
ggacaggattccatcctagagaagtctctcaaagcacttgttaaaattatttcagcactagtaattgttgtgagg

SEQ ID NO: 71906 - DNA, 75 bp, Artificial Sequence
  Synthetic
cacttcatcaccgtggcgatggctcaaacaaaaagtatcacagtactatggtgtacccatggctgagcgccagaa

SEQ ID NO: 71907 - DNA, 75 bp, Artificial Sequence
  Synthetic
gaagttcatagagtggcttaaagtcaaaattctgccagaggtaaaggagaaacatgaattcctaaccagacttaa

SEQ ID NO: 71908 - DNA, 75 bp, Artificial Sequence
  Synthetic
acaactgcctcttctggaaagccaaattgccacaattgaacaaagtgcaccatcccagagtgaccaggaacagct

SEQ ID NO: 71909 - DNA, 75 bp, Artificial Sequence
  Synthetic
aactacatacagttcaagtccaagtgccgtattgaacccgtatgtttgcttttacacggtagccctggagcagga

SEQ ID NO: 71910 - DNA, 75 bp, Artificial Sequence
  Synthetic
gtgatccgcgactcaaagccaattttgaggaggcaatcttctcgaagtacatcggcaatgtgaacacacatgtag

SEQ ID NO: 71911 - DNA, 75 bp, Artificial Sequence
  Synthetic
gacccagaccactttgatggttataaacagcaagcagttgtgattatggacgacctatgccaaaacccagatggc

SEQ ID NO: 71912 - DNA, 75 bp, Artificial Sequence
  Synthetic
aacagcaagcagttgtgattatggacgacctatgccaaaacccagatggcaaggacgtatctttgttctgccaga

SEQ ID NO: 71913 - DNA, 75 bp, Artificial Sequence
  Synthetic
tcttggcatcgaccaacgccgggtctatcaacgcccccacagtttccgacagtcgagcattggccagaaggttcc

SEQ ID NO: 71914 - DNA, 75 bp, Artificial Sequence
  Synthetic
tatcaacgcccccacagtttccgacagtcgagcattggccagaaggttccatttcgacatgaatatcgaagtcat

SEQ ID NO: 71915 - DNA, 75 bp, Artificial Sequence
  Synthetic
taatttcaaaaagtgctgtcctcttgtgtgtggaaaagccatccagttcatagacaggagaactcaagtgagata

SEQ ID NO: 71916 - DNA, 75 bp, Artificial Sequence
  Synthetic
tagacaggagaactcaagtgagatattcccttgatatgctagttacagagatgtttagggagtacaaccataggc

SEQ ID NO: 71917 - DNA, 75 bp, Artificial Sequence
  Synthetic
ctgagacaccaccaccaccagccatcgcagatctgctcaagtcagtggacagtgaagcggtaagagaatactgca

SEQ ID NO: 71918 - DNA, 75 bp, Artificial Sequence
  Synthetic
cgcagatctgctcaagtcagtggacagtgaagcggtaagagaatactgcaaagaaaagggatggctagtgccgga

SEQ ID NO: 71919 - DNA, 75 bp, Artificial Sequence
  Synthetic
gtccgtggctggcattatttacatcatctacaaactctttgcagggtttcagggtgcatacacaggactgcctag

SEQ ID NO: 71920 - DNA, 75 bp, Artificial Sequence
  Synthetic
atctacaaactctttgcagggtttcagggtgcatacacaggactgcctagtcaaaaaccgaaggtaccaacctta

SEQ ID NO: 71921 - DNA, 75 bp, Artificial Sequence
  Synthetic
acagaatatggagaattcactatgttgggcatttacgacagatgggctgttctcccacgccacgccaaacctggg

SEQ ID NO: 71922 - DNA, 75 bp, Artificial Sequence
  Synthetic
tgggcatttacgacagatgggctgttctcccacgccacgccaaacctgggccaactattctcatgaatgatcagg

SEQ ID NO: 71923 - DNA, 75 bp, Artificial Sequence
  Synthetic
accgtaatgagaagtttagggacatcagaggcttcttggctaaggaagaggtggaggtcagcgaggccgtcctag

SEQ ID NO: 71924 - DNA, 75 bp, Artificial Sequence
  Synthetic
cagaggcttcttggctaaggaagaggtggaggtcagcgaggccgtcctagcaattaacactagcaaattccccaa

SEQ ID NO: 71925 - DNA, 75 bp, Artificial Sequence
  Synthetic
taaattagagacaatttgagaataatttaaattggcttaaccctatcgcactcaccgaactcgataacggtgcgg

SEQ ID NO: 71926 - DNA, 75 bp, Artificial Sequence
  Synthetic
catgtataacttcccaactagagcgggccaatgtggtggtgtcctcatgtcgacaggcaaagtgctaggcatcca

SEQ ID NO: 71927 - DNA, 75 bp, Artificial Sequence
  Synthetic
ggccaatgtggtggtgtcctcatgtcgacaggcaaagtgctaggcatccacgtcgggggaaatggccaccagggg

SEQ ID NO: 71928 - DNA, 75 bp, Artificial Sequence
  Synthetic
aagcaacttagaagtctgtcacaaatggtcaatagacagctcaacacgccagttgagtctagaccaagcacttct

SEQ ID NO: 71929 - DNA, 75 bp, Artificial Sequence
  Synthetic
gcagggtttccagtcattaatactccaagcaagaccaagctagaaccaagtgtcttccaccaagttttcgaaggg

SEQ ID NO: 71930 - DNA, 75 bp, Artificial Sequence
  Synthetic
caagcaagaccaagctagaaccaagtgtcttccaccaagttttcgaagggaataaggagccagcagtcctcagga

SEQ ID NO: 71931 - DNA, 75 bp, Artificial Sequence
  Synthetic
tggatgaatatatgcaggaggctgtggatcactatgcagggcaactggctactctagacatcagcacggaaccaa

SEQ ID NO: 71932 - DNA, 75 bp, Artificial Sequence
  Synthetic
ggatcactatgcagggcaactggctactctagacatcagcacggaaccaatgaggttggaagacgcggtgtatgg

SEQ ID NO: 71933 - DNA, 75 bp, Artificial Sequence
  Synthetic
cggcccctgaatgcggctaatcctaactgcggagcaggtacccacgagccagtgggcagcctgtcgtaatgggca

SEQ ID NO: 71934 - DNA, 75 bp, Artificial Sequence
  Synthetic
agacatcttatccaaaaagaccaaggatctaaccaaactgaaggagtgcatggacaagtacggtttgaacttgcc

SEQ ID NO: 71935 - DNA, 75 bp, Artificial Sequence
  Synthetic
gatctaaccaaactgaaggagtgcatggacaagtacggtttgaacttgccaatggtgacttatgtgaaagacgag

SEQ ID NO: 71936 - DNA, 75 bp, Artificial Sequence
  Synthetic
atgagacaaacattcggcaatttgtacaagacattccacctaaatccagggattgtaacaggcagtgcggtcggg

SEQ ID NO: 71937 - DNA, 75 bp, Artificial Sequence
  Synthetic
tttacaacgctaaactacattttgtcattgaacacggcaagatgggagcccaagtttcctcacagaaagtcggcg

SEQ ID NO: 71938 - DNA, 75 bp, Artificial Sequence
  Synthetic
cattgaacacggcaagatgggagcccaagtttcctcacagaaagtcggcgctcatgaaactaaactcaatactgg

SEQ ID NO: 71939 - DNA, 75 bp, Artificial Sequence
  Synthetic
acaagacattccacctaaatccagggattgtaacaggcagtgcggtcgggtgcgaccctgatctcttttggagta

SEQ ID NO: 71940 - DNA, 75 bp, Artificial Sequence
  Synthetic
ggtttgcttgtttgaagctgctgcttgagaagctcggttatacacacaaagaaacaaattacatcgactacttgt

SEQ ID NO: 71941 - DNA, 75 bp, Artificial Sequence
  Synthetic
cctagaacaggatcctagcaaatttacggagccagtgctcgatgttatggtaaagtcacttccagcactgaattc

SEQ ID NO: 71942 - DNA, 75 bp, Artificial Sequence
  Synthetic
acggagccagtgctcgatgttatggtaaagtcacttccagcactgaattcaccaagtgctgaagagtgtggatac

SEQ ID NO: 71943 - DNA, 75 bp, Artificial Sequence
  Synthetic
tgagaagctcggttatacacacaaagaaacaaattacatcgactacttgtgtaattctcaccacctgtacagagg

SEQ ID NO: 71944 - DNA, 75 bp, Artificial Sequence
  Synthetic
catcataattaggactctaatgctgaaggtgtacaaaggtatcgaccttgaccagtttaggatgattgcctatgg

SEQ ID NO: 71945 - DNA, 75 bp, Artificial Sequence
  Synthetic
tatggtgaatggccccactacctctctgatgatgaggccacagcagaggatcaaccaacccagcccgacgttgcc

SEQ ID NO: 71946 - DNA, 75 bp, Artificial Sequence
  Synthetic
ctgatgatgaggccacagcagaggatcaaccaacccagcccgacgttgccacgtgtagattttacacactggact

SEQ ID NO: 71947 - DNA, 75 bp, Artificial Sequence
  Synthetic
aaggtgtacaaaggtatcgaccttgaccagtttaggatgattgcctatggtgatgatgtgatcgcctcatacccc

SEQ ID NO: 71948 - DNA, 75 bp, Artificial Sequence
  Synthetic
gagagtttcaatgaagtgacatggaccaacgttactttcctaaaaagatactttagagcagatgagcagtacccc

SEQ ID NO: 71949 - DNA, 75 bp, Artificial Sequence
  Synthetic
gccaaaacatgtactaccactacttgggtagggctggctataccatacacgtgcaatgtaatgcctctaaatttc

SEQ ID NO: 71950 - DNA, 75 bp, Artificial Sequence
  Synthetic
gggtagggctggctataccatacacgtgcaatgtaatgcctctaaatttcaccaagggtgcttgctggtcgtttg

SEQ ID NO: 71951 - DNA, 75 bp, Artificial Sequence
  Synthetic
ccaacgttactttcctaaaaagatactttagagcagatgagcagtacccctttttggtccaccctgttatgccta

SEQ ID NO: 71952 - DNA, 75 bp, Artificial Sequence
  Synthetic
tattggcctggcacaatggggagcatgaatatgaagaattcatccgtaagattagaagcgttccggtggggcgct

SEQ ID NO: 71953 - DNA, 75 bp, Artificial Sequence
  Synthetic
ggcacatgagttcactgaatcggcagctcccagcactcagggaaatgtgcagacagcagtgtgcaatgcggctat

SEQ ID NO: 71954 - DNA, 75 bp, Artificial Sequence
  Synthetic
gctcccagcactcagggaaatgtgcagacagcagtgtgcaatgcggctatgggtgtgggcgtcggtaatctgaca

SEQ ID NO: 71955 - DNA, 75 bp, Artificial Sequence
  Synthetic
ccaatggataacatgtacagacactacaacttcacattaatgattataccattcgtggctttggacttcaacaac

SEQ ID NO: 71956 - DNA, 75 bp, Artificial Sequence
  Synthetic
acaacttcacattaatgattataccattcgtggctttggacttcaacaacaccgcctcaaacgtgccgataacca

SEQ ID NO: 71957 - DNA, 75 bp, Artificial Sequence
  Synthetic
caccaggtagtaatcaattcctaacatcagatgattaccagtcaccatgtgcactgccccagtacgatgtcaccc

SEQ ID NO: 71958 - DNA, 75 bp, Artificial Sequence
  Synthetic
atcagatgattaccagtcaccatgtgcactgccccagtacgatgtcaccccacccatgcacattccgggagaagt

SEQ ID NO: 71959 - DNA, 75 bp, Artificial Sequence
  Synthetic
gaaggcttatcgtgtgcaagtgtcgacagggaaccatagtggcacggaaccaatatttagctttcaaatggatcc

SEQ ID NO: 71960 - DNA, 75 bp, Artificial Sequence
  Synthetic
acagggaaccatagtggcacggaaccaatatttagctttcaaatggatccgggtagtagcacggtcatgaggcac

SEQ ID NO: 71961 - DNA, 75 bp, Artificial Sequence
  Synthetic
tcggccatggccactggtaagttattacttgcatattcaccacccggtgcctctgtcccaaccagtcgcaaagac

SEQ ID NO: 71962 - DNA, 75 bp, Artificial Sequence
  Synthetic
tacttgcatattcaccacccggtgcctctgtcccaaccagtcgcaaagacgcaatgcttggaacacacatcattt

SEQ ID NO: 71963 - DNA, 75 bp, Artificial Sequence
  Synthetic
atgatgaatacaccagtgccgggtatgttacatgttggtaccaaaccagcattgttgtgccacccgagaccccta

SEQ ID NO: 71964 - DNA, 75 bp, Artificial Sequence
  Synthetic
tgttacatgttggtaccaaaccagcattgttgtgccacccgagacccctacacactgcgacatactcgggttcat

SEQ ID NO: 71965 - DNA, 75 bp, Artificial Sequence
  Synthetic
agatgaggtgaagcatgaacccacagtggccaacacaacagcaagtggaccatcaaattcacaacaagtaccggc

SEQ ID NO: 71966 - DNA, 75 bp, Artificial Sequence
  Synthetic
gtggccaacacaacagcaagtggaccatcaaattcacaacaagtaccggcactcacagcagtggagactgggcac

SEQ ID NO: 71967 - DNA, 75 bp, Artificial Sequence
  Synthetic
ctggagaacttcctcggaagatcagcatgcgtgcacattgactcgtataagaccaagggagtgaccggcgagagc

SEQ ID NO: 71968 - DNA, 75 bp, Artificial Sequence
  Synthetic
catgcgtgcacattgactcgtataagaccaagggagtgaccggcgagagcacccggtacgcatcatgggagatca

SEQ ID NO: 71969 - DNA, 75 bp, Artificial Sequence
  Synthetic
ttgtgattacaagtcgccaggagcaaggggccaaactgtcgcagaacatgccagtattaacacatcagatcatgt

SEQ ID NO: 71970 - DNA, 75 bp, Artificial Sequence
  Synthetic
aggggccaaactgtcgcagaacatgccagtattaacacatcagatcatgtatgtcccaccgggcgggcctatacc

SEQ ID NO: 71971 - DNA, 75 bp, Artificial Sequence
  Synthetic
acgaatgtcaataccgtttgttagcataggaaacgcatacagcaatttctatgatgggtggtcgcacttctcaca

SEQ ID NO: 71972 - DNA, 75 bp, Artificial Sequence
  Synthetic
gtttattgagtggctcaaagttaagatcttaccagaggtgagggagaaacatgagtttcttaacagattgaaaca

SEQ ID NO: 71973 - DNA, 75 bp, Artificial Sequence
  Synthetic
ataggaaacgcatacagcaatttctatgatgggtggtcgcacttctcacaaaacggtgcgtatggttacacggca

SEQ ID NO: 71974 - DNA, 75 bp, Artificial Sequence
  Synthetic
atgtatatgaagcccaaacacgtgcgggcttgggtgccaagaccaccacgcctgtgtccatacctgcgggcgggt

SEQ ID NO: 71975 - DNA, 75 bp, Artificial Sequence
  Synthetic
gggcttgggtgccaagaccaccacgcctgtgtccatacctgcgggcgggtgatataaactttgaagtgactgatg

SEQ ID NO: 71976 - DNA, 75 bp, Artificial Sequence
  Synthetic
accatggagcgtttggccaccaatcaggtgctgtatatgtaggaaactacagggtgataaatagacacctagcca

SEQ ID NO: 71977 - DNA, 75 bp, Artificial Sequence
  Synthetic
aggtgctgtatatgtaggaaactacagggtgataaatagacacctagccacacccacggattggcaaaactgtgt

SEQ ID NO: 71978 - DNA, 75 bp, Artificial Sequence
  Synthetic
gtgcacaacaggtgtgtacttttgcttgtcaaaaaataagcattatccagtctcttttgagggcccgggtctggt

SEQ ID NO: 71979 - DNA, 75 bp, Artificial Sequence
  Synthetic
ttgtcaaaaaataagcattatccagtctcttttgagggcccgggtctggtggaagttcaggagagtgagtattac

SEQ ID NO: 71980 - DNA, 75 bp, Artificial Sequence
  Synthetic
tgcgagcatggtgtcatcggaatcgtgaccatggggggtgaaggcattgttggctttgctgacgtacgcgacctg

SEQ ID NO: 71981 - DNA, 75 bp, Artificial Sequence
  Synthetic
tgaccatggggggtgaaggcattgttggctttgctgacgtacgcgacctgctgtggttagaagacgacgcaatgg

SEQ ID NO: 71982 - DNA, 75 bp, Artificial Sequence
  Synthetic
aagtcaacctcttgaaagaatcactagtgggtcaagactcaatcctagagaagtctctgaaagccctagtcaaaa

SEQ ID NO: 71983 - DNA, 75 bp, Artificial Sequence
  Synthetic
agtgggtcaagactcaatcctagagaagtctctgaaagccctagtcaaaataatatcagccctagtaattgtggt

SEQ ID NO: 71984 - DNA, 75 bp, Artificial Sequence
  Synthetic
gcttaagcaaaaagtgtcacagtactatggaatacctatggccgaacgccaaaataatggatggctcaagaagtt

SEQ ID NO: 71985 - DNA, 75 bp, Artificial Sequence
  Synthetic
tatggaatacctatggccgaacgccaaaataatggatggctcaagaagttcaccgagatgacaaacgcctgtaag

SEQ ID NO: 71986 - DNA, 75 bp, Artificial Sequence
  Synthetic
gcgtaggaaatggttggactccttttaaagttaaagtgcaattggctaatcacaattggcttaaccctaccgcat

SEQ ID NO: 71987 - DNA, 75 bp, Artificial Sequence
  Synthetic
gaaaagcacgatttcctgaacagactcaaacagcttcccttattagaaagtcagattgccacaattgagcagagt

SEQ ID NO: 71988 - DNA, 75 bp, Artificial Sequence
  Synthetic
tgtgggttgttcccacccacagggcccactgggcgctagtacactggtaccaaggtacctttgtacgcctgtttt

SEQ ID NO: 71989 - DNA, 75 bp, Artificial Sequence
  Synthetic
caaggtacctttgtacgcctgttttataccccctccccgatccgaaacttagaagtaaagcaaacccgatcaata

SEQ ID NO: 71990 - DNA, 75 bp, Artificial Sequence
  Synthetic
tcagattgccacaattgagcagagtgcgccatcccagagtgatcaagagcaattgttttcaaatgtccagtactt

SEQ ID NO: 71991 - DNA, 75 bp, Artificial Sequence
  Synthetic
gcggttgaaggagaaaacgtccgtcatccggctaactacttcgagaaacccagtagcaccatggaagttgcagag

SEQ ID NO: 71992 - DNA, 75 bp, Artificial Sequence
  Synthetic
tcaacagctcagtgtactcactacccccagatccagatcacttcgatggctacaaacagcaggccgtagtgatta

SEQ ID NO: 71993 - DNA, 75 bp, Artificial Sequence
  Synthetic
gacatggtgtgaagagtctattgagctagttagtaatcctccggcccctgaatgcggctaatcctaactgcggag

SEQ ID NO: 71994 - DNA, 75 bp, Artificial Sequence
  Synthetic
ctagttagtaatcctccggcccctgaatgcggctaatcctaactgcggagcacatactcctactccaaggagcag

SEQ ID NO: 71995 - DNA, 75 bp, Artificial Sequence
  Synthetic
cagatggtttccagtgtggatttcgttccacccatggccgccctggaggagaagggcattttgttcacctctccg

SEQ ID NO: 71996 - DNA, 75 bp, Artificial Sequence
  Synthetic
tgcttatggtgacaattgaaagattgttaccatatagctattggattggccatccggtgtcaaacagagcaatag

SEQ ID NO: 71997 - DNA, 75 bp, Artificial Sequence
  Synthetic
gttaccatatagctattggattggccatccggtgtcaaacagagcaatagtgtacctattcgctgggtttatccc

SEQ ID NO: 71998 - DNA, 75 bp, Artificial Sequence
  Synthetic
cagtcaactttaagaaatgttgcccgctagtgtgtggaaaggccatccaattcatagacagaagaactcaagtca

SEQ ID NO: 71999 - DNA, 75 bp, Artificial Sequence
  Synthetic
acgcaaaagaccggagcgcatgagactgggctaagtgccagcggaagctccatcatccactatacaaacataaac

SEQ ID NO: 72000 - DNA, 75 bp, Artificial Sequence
  Synthetic
ctgggctaagtgccagcggaagctccatcatccactatacaaacataaactattacaaggatgcggcctccaatt

SEQ ID NO: 72001 - DNA, 75 bp, Artificial Sequence
  Synthetic
gcaccagaaacaccaccaccaccagccatcgcggacttgcttaaatcagtggatagcgaagccgtgagagagtat

SEQ ID NO: 72002 - DNA, 75 bp, Artificial Sequence
  Synthetic
tgccagctctgaactcaccaacagctgaggagtgtggttatagcgaccgcgtgcgctccatcaccctcggcaatt

SEQ ID NO: 72003 - DNA, 75 bp, Artificial Sequence
  Synthetic
tgaggagtgtggttatagcgaccgcgtgcgctccatcaccctcggcaattcaacaataacgactcaagaatgcgc

SEQ ID NO: 72004 - DNA, 75 bp, Artificial Sequence
  Synthetic
atctgcctgcaggcaataaccacatttgtatcagtagctggaattatctacataatatacaagctttttgcaggc

SEQ ID NO: 72005 - DNA, 75 bp, Artificial Sequence
  Synthetic
cataatatacaagctttttgcaggctttcaaggtgcatacacaggaatgcccaaccagaagcccaaggtacccac

SEQ ID NO: 72006 - DNA, 75 bp, Artificial Sequence
  Synthetic
tcaaccagatgttgctacctgtcggttttacaccctagactcagtgcactgggaaaaggaatctgcaggctggtg

SEQ ID NO: 72007 - DNA, 75 bp, Artificial Sequence
  Synthetic
ttttacaccctagactcagtgcactgggaaaaggaatctgcaggctggtggtggaagttcccagaagccctaaaa

SEQ ID NO: 72008 - DNA, 75 bp, Artificial Sequence
  Synthetic
cctaaggcaagcaaaagtgcagggtccagcgtttgaattcgctgttgcgatgatgaagaggaactcaagtacagt

SEQ ID NO: 72009 - DNA, 75 bp, Artificial Sequence
  Synthetic
aacgcatccaagttccatcaggggtgtctcctcgtggtgtgtgtccccgaggcggagatggggtgttcaaccacg

SEQ ID NO: 72010 - DNA, 75 bp, Artificial Sequence
  Synthetic
gtctcctcgtggtgtgtgtccccgaggcggagatggggtgttcaaccacgacagaagaagtcatagcaagtgaac

SEQ ID NO: 72011 - DNA, 75 bp, Artificial Sequence
  Synthetic
tggaccaaccattctgatgaatgaccaggaggtgggtgtgttggatgctaaagagttggtggataaggatggtac

SEQ ID NO: 72012 - DNA, 75 bp, Artificial Sequence
  Synthetic
tgtgcaatgcaggaatgggggtgggagtgggcaatctgaccatattcccacaccagtggataaacttaagaacaa

SEQ ID NO: 72013 - DNA, 75 bp, Artificial Sequence
  Synthetic
agtgggcaatctgaccatattcccacaccagtggataaacttaagaacaaacaatagtgctacaatagtcatgcc

SEQ ID NO: 72014 - DNA, 75 bp, Artificial Sequence
  Synthetic
ctagcaattaacaccagcaagttccccaacatgtacatcccagtaggtcaagtcacagattatggcttcctgaat

SEQ ID NO: 72015 - DNA, 75 bp, Artificial Sequence
  Synthetic
attggattacacggcagccacatcatatgtgccaataacggtcaccatagcaccgatgtgtgccgaatataacgg

SEQ ID NO: 72016 - DNA, 75 bp, Artificial Sequence
  Synthetic
atgtccactggtaaagtcctggggatccacgttggggggaatggtcatcaaggcttttcagctgcactccttaag

SEQ ID NO: 72017 - DNA, 75 bp, Artificial Sequence
  Synthetic
tatgtgccaataacggtcaccatagcaccgatgtgtgccgaatataacggcctcaggttggcgacccctcatcaa

SEQ ID NO: 72018 - DNA, 75 bp, Artificial Sequence
  Synthetic
ccacaattcgatgtcactccagagatgcacattccgggagaagtacgaaacttgatggagatagcagaggtggat

SEQ ID NO: 72019 - DNA, 75 bp, Artificial Sequence
  Synthetic
tgcacattccgggagaagtacgaaacttgatggagatagcagaggtggattcagtggtccctgtcaacaacatac

SEQ ID NO: 72020 - DNA, 75 bp, Artificial Sequence
  Synthetic
gcttccaagtacaaccgggaaaagaaagtgtgtttaaaagaactttgctgggggaaatactcaattattacgcac

SEQ ID NO: 72021 - DNA, 75 bp, Artificial Sequence
  Synthetic
aagtgtgtttaaaagaactttgctgggggaaatactcaattattacgcacactggtcagggagtatcaagcttac

SEQ ID NO: 72022 - DNA, 75 bp, Artificial Sequence
  Synthetic
tgatttaacaacaagtgcaggctacccctatgtcgcactgggcatcaagaagagagacatcctctcaaagaagac

SEQ ID NO: 72023 - DNA, 75 bp, Artificial Sequence
  Synthetic
ccctatgtcgcactgggcatcaagaagagagacatcctctcaaagaagaccaaggacctgaccaagctaaaagag

SEQ ID NO: 72024 - DNA, 75 bp, Artificial Sequence
  Synthetic
caaggacctgaccaagctaaaagagtgcatggataagtatggtctgaacctaccaatggtgacttatgtgaaaga

SEQ ID NO: 72025 - DNA, 75 bp, Artificial Sequence
  Synthetic
agaagaccgtaagggcgcgatgttgggcacccacgtaatatgggacgtgggcttgcaatctagctgcgttctgtg

SEQ ID NO: 72026 - DNA, 75 bp, Artificial Sequence
  Synthetic
ggcacccacgtaatatgggacgtgggcttgcaatctagctgcgttctgtgcatcccgtggatcagtcaaacgcat

SEQ ID NO: 72027 - DNA, 75 bp, Artificial Sequence
  Synthetic
ccaccagaaacccccacgcagtgcaccatattgtgctttgtgtccgcgtgcaacgacttttcggttaggttgctg

SEQ ID NO: 72028 - DNA, 75 bp, Artificial Sequence
  Synthetic
ccatattgtgctttgtgtccgcgtgcaacgacttttcggttaggttgctgaaagattctccgtttgtggagcaaa

SEQ ID NO: 72029 - DNA, 75 bp, Artificial Sequence
  Synthetic
tgggtgtgacccagacctcttttggagcaaaataccagtgatgttagatggacatctcatagcatttgattactc

SEQ ID NO: 72030 - DNA, 75 bp, Artificial Sequence
  Synthetic
gaccgagcaattcggagcgggttccagcgttaacggccgttgagacaggtcacacagcacaggttaccccgagtg

SEQ ID NO: 72031 - DNA, 75 bp, Artificial Sequence
  Synthetic
agcgttaacggccgttgagacaggtcacacagcacaggttaccccgagtgatacaatgcaaactagacatgtaca

SEQ ID NO: 72032 - DNA, 75 bp, Artificial Sequence
  Synthetic
taaagagacaaactacattgactacttatgcaactcccatcacctgtacagagataagcattactttgtgagggg

SEQ ID NO: 72033 - DNA, 75 bp, Artificial Sequence
  Synthetic
tagtagcaatgcaacaacacaagatgaacaatacatgtcatggacaattaataccagacagatggtgcagctgag

SEQ ID NO: 72034 - DNA, 75 bp, Artificial Sequence
  Synthetic
gaacaatacatgtcatggacaattaataccagacagatggtgcagctgagacgcaaattcgaaatgttcacctac

SEQ ID NO: 72035 - DNA, 75 bp, Artificial Sequence
  Synthetic
ggctgatcatgacaccagcagataagggagagtgctttaatgaagtcacttggaccaacgtcactttcctaaaga

SEQ ID NO: 72036 - DNA, 75 bp, Artificial Sequence
  Synthetic
cccgtaatgtgccaccaaatcatgtatgtgccacctggtggcccggtgcctaagagtgttgatgacttcacatgg

SEQ ID NO: 72037 - DNA, 75 bp, Artificial Sequence
  Synthetic
atgtgccacctggtggcccggtgcctaagagtgttgatgacttcacatggcaaacctctactaaccctagtgtct

SEQ ID NO: 72038 - DNA, 75 bp, Artificial Sequence
  Synthetic
cacccaagatcatgtgcgctcactgtgtctattggcctggcacaacggagagcacgaatatgaggagttcatccg

SEQ ID NO: 72039 - DNA, 75 bp, Artificial Sequence
  Synthetic
atgatggctggtcacacttctctcaaaatggggtttacgggtttaatgcactcaataacatgggtaaactgtatg

SEQ ID NO: 72040 - DNA, 75 bp, Artificial Sequence
  Synthetic
aaatggggtttacgggtttaatgcactcaataacatgggtaaactgtatgtgagacaagtgaacctaaaagcccc

SEQ ID NO: 72041 - DNA, 75 bp, Artificial Sequence
  Synthetic
caaccctacgcaggaaatggttggactctttttaaattagagacaatttgaaataatttgaattggcttaaccct

SEQ ID NO: 72042 - DNA, 75 bp, Artificial Sequence
  Synthetic
tctatgtaagtacctgaagtctgggagtgtcaattttgagcccactgatttgacagaaaaacggaaatccagaaa

SEQ ID NO: 72043 - DNA, 75 bp, Artificial Sequence
  Synthetic
ttaaaaccaggctgtgggttgttcccacccatagggcccactgggcgccagcactctggtattccggtacctttg

SEQ ID NO: 72044 - DNA, 75 bp, Artificial Sequence
  Synthetic
agtgtcaattttgagcccactgatttgacagaaaaacggaaatccagaaagtacatcccaaaaactttcagacca

SEQ ID NO: 72045 - DNA, 75 bp, Artificial Sequence
  Synthetic
cacctggcaactcacaacgactggcagaactgcgtgtgggaggattataacagggacctcatggtgagcaccacc

SEQ ID NO: 72046 - DNA, 75 bp, Artificial Sequence
  Synthetic
agaactgcgtgtgggaggattataacagggacctcatggtgagcaccaccactgcacacgggtgtgacaccatag

SEQ ID NO: 72047 - DNA, 75 bp, Artificial Sequence
  Synthetic
caggattagtggaggttcaggagaatgagtattaccccaagagatatcaatcccatgtccttcttgcggtaggat

SEQ ID NO: 72048 - DNA, 75 bp, Artificial Sequence
  Synthetic
tgagtattaccccaagagatatcaatcccatgtccttcttgcggtaggattctccgagcctggtgattgcggtgg

SEQ ID NO: 72049 - DNA, 75 bp, Artificial Sequence
  Synthetic
gcgcgacctcttgtggttagaggacgatgcgatggagcagggtgtgaaggactatgtagaacaacttggaaacgc

SEQ ID NO: 72050 - DNA, 75 bp, Artificial Sequence
  Synthetic
cagagcgattgtttatctatttgttggtttcataccattaaattttaaagttttaagaactatcaacttgatcat

SEQ ID NO: 72051 - DNA, 75 bp, Artificial Sequence
  Synthetic
atttgcgagcaagtcaatctcctaaaagagtcactggtgggccaggactccatcctagagaagtccctgaaagcc

SEQ ID NO: 72052 - DNA, 75 bp, Artificial Sequence
  Synthetic
aatgggaattcggttatccattacacaaacattaattattacaaagatgcagcttcgaattcagcaaacaggcaa

SEQ ID NO: 72053 - DNA, 75 bp, Artificial Sequence
  Synthetic
gctgaacgccaaaacaacgggtggctaaaaaagttcactgagatgacaaacgcctgcaagggtatggaatggata

SEQ ID NO: 72054 - DNA, 75 bp, Artificial Sequence
  Synthetic
gccgttaaaattcagaaattcattgagtggctcaaaatcaaaatcctgccagaagtcagggaaaaacatgaattc

SEQ ID NO: 72055 - DNA, 75 bp, Artificial Sequence
  Synthetic
ctgaacagactcaagcagctccctctattggaaagtcagatcgtcacaatcgagcaaagcgcaccatcccagagt

SEQ ID NO: 72056 - DNA, 75 bp, Artificial Sequence
  Synthetic
atctgttatgtgggagaagtcttcggcgggctggtggtggaagtttccagatgcacttgcagagatgggcctatt

SEQ ID NO: 72057 - DNA, 75 bp, Artificial Sequence
  Synthetic
atgcacttgcagagatgggcctattcggccaaaatatgctgtaccattatctaggaagatcaggctacaccatac

SEQ ID NO: 72058 - DNA, 75 bp, Artificial Sequence
  Synthetic
gaagcaaagagggtgttctctcttgagaagaagatgagcaattacatacagttcaagtccaaatgccgtattgag

SEQ ID NO: 72059 - DNA, 75 bp, Artificial Sequence
  Synthetic
ctgcacagctcgacaagacattgaatcataccaaacttagcaacacagaacacgccagcacattcgggtccatga

SEQ ID NO: 72060 - DNA, 75 bp, Artificial Sequence
  Synthetic
cacctcaccatttgtcctggcatcaactaatgcaggatccatcaacgccccaacagtgtcagatagcagggccct

SEQ ID NO: 72061 - DNA, 75 bp, Artificial Sequence
  Synthetic
caacagtgtcagatagcagggccctagcacgaagatttcactttgacatgaacatcgaagttatctccatgtaca

SEQ ID NO: 72062 - DNA, 75 bp, Artificial Sequence
  Synthetic
tgtgacagttgcccccatgtgtgccgaatacaatggactaagattggcagggaaacagggattaccaacaatgct

SEQ ID NO: 72063 - DNA, 75 bp, Artificial Sequence
  Synthetic
accagagattgaaatccccggtgaggtgaagaatttaatggagatagctgaggttgattccgtggtcccagtgaa

SEQ ID NO: 72064 - DNA, 75 bp, Artificial Sequence
  Synthetic
attgaagcttacagaatccctgtcaaatcaatgagtggtagtgcaacgcaagtttttgggttcaagttgcaacca

SEQ ID NO: 72065 - DNA, 75 bp, Artificial Sequence
  Synthetic
ctatgttaggcacccacattgtctgggacataggattgcagtcgagttgtgtgctctgtgtgccatggattagtc

SEQ ID NO: 72066 - DNA, 75 bp, Artificial Sequence
  Synthetic
ataaccacatttgtatcagtagctggaattatatacataatatacaagctctttgcaggctttcaaggtgcgtac

SEQ ID NO: 72067 - DNA, 75 bp, Artificial Sequence
  Synthetic
attacatgctggtaccaaacgaacatagtgtcacccccagacatcccggcagacagtacaatcctatgttttgtt

SEQ ID NO: 72068 - DNA, 75 bp, Artificial Sequence
  Synthetic
gctgtagcaatgatgaagaggaactcaagcacagtgaagactgagtacggtgaattcaccatgttgggcatctat

SEQ ID NO: 72069 - DNA, 75 bp, Artificial Sequence
  Synthetic
caagcacagtgaagactgagtacggtgaattcaccatgttgggcatctatgataggtgggccgtcttaccgcgtc

SEQ ID NO: 72070 - DNA, 75 bp, Artificial Sequence
  Synthetic
atctcaaaacgcacttctccaaaatgacccggctactgccattgtcagatcagtggaacgggtggcggacaccat

SEQ ID NO: 72071 - DNA, 75 bp, Artificial Sequence
  Synthetic
aggacggtacaaacttagaactgacactgctcaagctgaacagaaacgagaagttcagagacatcagaggctttt

SEQ ID NO: 72072 - DNA, 75 bp, Artificial Sequence
  Synthetic
cagtgggacaggtcacagattacggcttcctaaacctaggtggcacgcccacaaaaaggatgcttatgtataatt

SEQ ID NO: 72073 - DNA, 75 bp, Artificial Sequence
  Synthetic
atggtcatcaaggcttttcagctgcactccttaagcactatttcaatgatgaacaaggggaaatcgagttcatcg

SEQ ID NO: 72074 - DNA, 75 bp, Artificial Sequence
  Synthetic
actccttaagcactatttcaatgatgaacaaggggaaatcgagttcatcgagaactcaagagatgcgggatttcc

SEQ ID NO: 72075 - DNA, 75 bp, Artificial Sequence
  Synthetic
agcagttctcaggaatggtgacccacgcctcaaagctaatttcgaggaggccatcttttccaagtacatcggaaa

SEQ ID NO: 72076 - DNA, 75 bp, Artificial Sequence
  Synthetic
cagcactgaaccaatgaaattggaggatgctgtgtatggaaccgaaggccttgaagctctcgatttaacaacaag

SEQ ID NO: 72077 - DNA, 75 bp, Artificial Sequence
  Synthetic
atgcacataatgttgatttcacccctagaggagtcacagacaaaagggacaagatcacactggaaagagatgacc

SEQ ID NO: 72078 - DNA, 75 bp, Artificial Sequence
  Synthetic
agagaaagtagcaaatggaaagtctaggttgattgaagcatccagtttgaatgattcagtggcaatgagacagac

SEQ ID NO: 72079 - DNA, 75 bp, Artificial Sequence
  Synthetic
tgtggtggaattctcaggtgtgagcatggtgtcatcgggctagtcaccatgggtggcgaaggcgtagtcggcttt

SEQ ID NO: 72080 - DNA, 75 bp, Artificial Sequence
  Synthetic
ggacactaatgctgaaagtgtacaagggaatcgacttggaccaattcaggatgatcgcatatggtgatgatgtaa

SEQ ID NO: 72081 - DNA, 75 bp, Artificial Sequence
  Synthetic
atgatcgcatatggtgatgatgtaattgcatcatacccttggcccatagatgcatccttactcgctgaggctggt

SEQ ID NO: 72082 - DNA, 75 bp, Artificial Sequence
  Synthetic
agcactagtaattgtagtgagaaaccatgatgatttaataacagtgactgcaaccctcgcccttattggctgcac

SEQ ID NO: 72083 - DNA, 75 bp, Artificial Sequence
  Synthetic
catgatgatttaataacagtgactgcaaccctcgcccttattggctgcacttcatcgccgtggcggtggctcaaa

SEQ ID NO: 72084 - DNA, 75 bp, Artificial Sequence
  Synthetic
atgactaatgcttgcaaggggatggagtggattgccatcaaaatccagaaattcatagagtggcttaaagttaag

SEQ ID NO: 72085 - DNA, 75 bp, Artificial Sequence
  Synthetic
atccaaagaacacccaagatcatgtgcgctcactgtgtctattggcttggcacaacggagagcacgaatatgagg

SEQ ID NO: 72086 - DNA, 75 bp, Artificial Sequence
  Synthetic
cacaacggagagcacgaatatgaggagttcacccgtaaaattagaagcgtcccagtcgggcgttgcttaaccctc

SEQ ID NO: 72087 - DNA, 75 bp, Artificial Sequence
  Synthetic
acgaatttctcactagacttaaacagttgcctctcttggagagccagattgccaccatagaacagagtgcaccat

SEQ ID NO: 72088 - DNA, 75 bp, Artificial Sequence
  Synthetic
atgctgctgaggcaaaaagagtgttctccctagaaaagaaaatgagcaactacatacagttcaagtccaaatgcc

SEQ ID NO: 72089 - DNA, 75 bp, Artificial Sequence
  Synthetic
aacgcaacttagaagcacaacttaaatggtcaatagacggctcagtatgccaactgagtctcgatcaagcacttc

SEQ ID NO: 72090 - DNA, 75 bp, Artificial Sequence
  Synthetic
gatctttagctgagaagctcaacagttcagtatactccttgccacccgacccagatcactttgatggctacaaac

SEQ ID NO: 72091 - DNA, 75 bp, Artificial Sequence
  Synthetic
ggctgctcacgcggctgaaggggaaaccgttcgttacccgactaactacttcgagaaacctagtaccaccatgaa

SEQ ID NO: 72092 - DNA, 75 bp, Artificial Sequence
  Synthetic
tcgagaaacctagtaccaccatgaaagttgcgcagcgtttcgctccgcacaaccccagtgtagatcaggccgatg

SEQ ID NO: 72093 - DNA, 75 bp, Artificial Sequence
  Synthetic
aatggccgcactcgaagagaaggggattctattcacctccccttttgtcctagcatccacaaatgctggctccat

SEQ ID NO: 72094 - DNA, 75 bp, Artificial Sequence
  Synthetic
cttcaatactgacatggtgcgaagagtctattgagctagttggtagtcctccggcccctgaatgcggctaatcct

SEQ ID NO: 72095 - DNA, 75 bp, Artificial Sequence
  Synthetic
aatgtacagtcagaatggcaagatcaacatgcccatgtcggtgaaaacgtgcgatgaagagtgttgcccagtcaa

SEQ ID NO: 72096 - DNA, 75 bp, Artificial Sequence
  Synthetic
aacatgcccatgtcggtgaaaacgtgcgatgaagagtgttgcccagtcaactttaaaagatgttgcccccttgtg

SEQ ID NO: 72097 - DNA, 75 bp, Artificial Sequence
  Synthetic
ttgagagattgtaaccatattgctattggattggccacccggcgacgaatagaacagttgcttacctgtttgtta

SEQ ID NO: 72098 - DNA, 75 bp, Artificial Sequence
  Synthetic
ttcagagagtacaatcatagacacagtgtgggggcaacccttgaggcactgttccaaggcccaccagtgtataaa

SEQ ID NO: 72099 - DNA, 75 bp, Artificial Sequence
  Synthetic
cttaaacaccctttaatttcatcataacgctcaatacgttaaaatgggagctcaggtgtcaacacaaaagaccgg

SEQ ID NO: 72100 - DNA, 75 bp, Artificial Sequence
  Synthetic
gttccaaggcccaccagtgtataaagagatcaagattagcgttgcgcctgaaactccaccgccaccagcaatcgc

SEQ ID NO: 72101 - DNA, 75 bp, Artificial Sequence
  Synthetic
ctcaggtgtcaacacaaaagaccggtgctcatgagaccagcttgagtgcagcgggcaactcagtcattcattaca

SEQ ID NO: 72102 - DNA, 75 bp, Artificial Sequence
  Synthetic
taactccactcttcagattgagaagcatgttagcagggtattcatatgcctccaagcgctaacaacctttgtctc

SEQ ID NO: 72103 - DNA, 75 bp, Artificial Sequence
  Synthetic
tcaccgaacctgtgaaagacatcatggtcaaatctatgcctgccctcaattccccatcagcagaggagtgtggct

SEQ ID NO: 72104 - DNA, 75 bp, Artificial Sequence
  Synthetic
gtgcttacacagggatgcccaatcaaaaacccaaggtgccaacactaagacaagctaaggtgcagggtcctgctt

SEQ ID NO: 72105 - DNA, 75 bp, Artificial Sequence
  Synthetic
caagctaaggtgcagggtcctgcttttgagtttgctgtggccatgatgaagaggaactccagcacggtgaaaaca

SEQ ID NO: 72106 - DNA, 75 bp, Artificial Sequence
  Synthetic
caagaatgtgcaaacgtggtggttggatatggggtgtggccaacttacttgaaggatgaagaggcaacagcagag

SEQ ID NO: 72107 - DNA, 75 bp, Artificial Sequence
  Synthetic
gaaggatgaagaggcaacagcagaggatcaacccactcaaccagatgtggccacgtgcaggttttacacgctcga

SEQ ID NO: 72108 - DNA, 75 bp, Artificial Sequence
  Synthetic
gatcaacccactcaaccagatgtggccacgtgcaggttttacacgctcgaatctgtgatgtggcaacagagttca

SEQ ID NO: 72109 - DNA, 75 bp, Artificial Sequence
  Synthetic
cttgggagagccgggtacacgatacacgtgcagtgcaacgcgtccaaatttcaccaagggtgtctgctggtggta

SEQ ID NO: 72110 - DNA, 75 bp, Artificial Sequence
  Synthetic
acgtgcagtgcaacgcgtccaaatttcaccaagggtgtctgctggtggtatgtgtgccagaagcagaaatggggt

SEQ ID NO: 72111 - DNA, 75 bp, Artificial Sequence
  Synthetic
ggaatgagaagtttagggatatcagaggctttcttgctaaagaagaggtggaggttagtgaggctgtcctggcta

SEQ ID NO: 72112 - DNA, 75 bp, Artificial Sequence
  Synthetic
actccaccggggaaacggccgtgcaagctaatgtgatcaatgctggcatgggtgttggtgttggtaatctaacta

SEQ ID NO: 72113 - DNA, 75 bp, Artificial Sequence
  Synthetic
gtacaacttccctaccagagctggccaatgtggtggcgttctcatgtccacgggcaaagtgttagggatacatgt

SEQ ID NO: 72114 - DNA, 75 bp, Artificial Sequence
  Synthetic
agctaatgtgatcaatgctggcatgggtgttggtgttggtaatctaactatcttcccccatcagtggatcaactt

SEQ ID NO: 72115 - DNA, 75 bp, Artificial Sequence
  Synthetic
tcaatgatgaacaaggtgagatcgagttcattgagagctcgaaggacgctggattcccaatcattaacacaccaa

SEQ ID NO: 72116 - DNA, 75 bp, Artificial Sequence
  Synthetic
caattttacactcatggccatcccgttcgccccactgagctacagcacaggggctaccacgtacgtaccaatcac

SEQ ID NO: 72117 - DNA, 75 bp, Artificial Sequence
  Synthetic
gagacccacgactcaaagcaaattttgaggaggcaatcttttccaaatacattggtaatgtgaacacacacgtag

SEQ ID NO: 72118 - DNA, 75 bp, Artificial Sequence
  Synthetic
cagccatgccacaattcgatgtcactcctgagatggatattccaggacaagtcaacaacttgatggagattgcag

SEQ ID NO: 72119 - DNA, 75 bp, Artificial Sequence
  Synthetic
tcctgagatggatattccaggacaagtcaacaacttgatggagattgcagaagtagattctgtggtgccagtaaa

SEQ ID NO: 72120 - DNA, 75 bp, Artificial Sequence
  Synthetic
aactagaggatgcagtgtatggtacagaggggttggaagcacttgatctaaccaccagtgcagggtacccgtatg

SEQ ID NO: 72121 - DNA, 75 bp, Artificial Sequence
  Synthetic
ggtttttgggttcccattgaccccaggggccaatagtgtgttaaacaggactttgctgggagaaatcttaaacta

SEQ ID NO: 72122 - DNA, 75 bp, Artificial Sequence
  Synthetic
ctatgcccattggtcaggcagcatcaaactaacatttatgttttgcgggtcagcgatggctacaggaaaattctt

SEQ ID NO: 72123 - DNA, 75 bp, Artificial Sequence
  Synthetic
ggggcaccgaccacacgcaaggaggcgatgctaggtactcacgtgatctgggatgtgggtctacaatcgagctgc

SEQ ID NO: 72124 - DNA, 75 bp, Artificial Sequence
  Synthetic
cgatgctaggtactcacgtgatctgggatgtgggtctacaatcgagctgcgtattgtgtataccatggattagtc

SEQ ID NO: 72125 - DNA, 75 bp, Artificial Sequence
  Synthetic
ttgtggtgcctgcagatgcacagagtgactgtaagatcttgtgttttgtgtcggcatgtaacgatttttcagtta

SEQ ID NO: 72126 - DNA, 75 bp, Artificial Sequence
  Synthetic
tgactgtaagatcttgtgttttgtgtcggcatgtaacgatttttcagttaggatgctcaaggacacaccctttat

SEQ ID NO: 72127 - DNA, 75 bp, Artificial Sequence
  Synthetic
tgggagcggaccagttaactcggaatccattccagctctaaccgccgcagagacagggcacacgtcacaagttgt

SEQ ID NO: 72128 - DNA, 75 bp, Artificial Sequence
  Synthetic
tccattccagctctaaccgccgcagagacagggcacacgtcacaagttgtaccatcagacacaatgcaaactagg

SEQ ID NO: 72129 - DNA, 75 bp, Artificial Sequence
  Synthetic
cagagcagatgagcaataccccttcctggtccatcctgtcatgccgatgaaagacatccatgaatcaatcagatg

SEQ ID NO: 72130 - DNA, 75 bp, Artificial Sequence
  Synthetic
accacatacaagaaccatgactctgatggcgacaacttcgcctactgggtgatcaacacacggcaagttgctcaa

SEQ ID NO: 72131 - DNA, 75 bp, Artificial Sequence
  Synthetic
gatcaacacacggcaagttgctcaactgcgtcggaagctcgaaatgttcacgtacgcaagatttgatctggagtt

SEQ ID NO: 72132 - DNA, 75 bp, Artificial Sequence
  Synthetic
aatgtatgtacctccaggtggcccagtgcccacaaaggtaaacagctacagctggcaaacgtccaccaacccgag

SEQ ID NO: 72133 - DNA, 75 bp, Artificial Sequence
  Synthetic
gctggcaaacgtccaccaacccgagtgtgttctggacggaagggagcgcaccgcctcgaatgtcgataccattca

SEQ ID NO: 72134 - DNA, 75 bp, Artificial Sequence
  Synthetic
ttaaaacagcctgtgggttgttcccacccacagggcccatgggcgctagcacactggtatcgtggtacctttgtg

SEQ ID NO: 72135 - DNA, 75 bp, Artificial Sequence
  Synthetic
acactggtatcgtggtacctttgtgcgcctgttttatacaccctccccatttgtaacttagaagtaaagcaatat

SEQ ID NO: 72136 - DNA, 75 bp, Artificial Sequence
  Synthetic
cgcctgttttatacaccctccccatttgtaacttagaagtaaagcaatattgatcaatagcaagcatggcacacc

SEQ ID NO: 72137 - DNA, 75 bp, Artificial Sequence
  Synthetic
gacaagcaagggacatacggcatcagcacactaaacaacatggggacactatatatgagacatgtgaatgatggg

SEQ ID NO: 72138 - DNA, 75 bp, Artificial Sequence
  Synthetic
acgttcgttaaccggccaactacttcgagaagcccagtatcaccatgaaagttgcagagcgtttcgctcagcact

SEQ ID NO: 72139 - DNA, 75 bp, Artificial Sequence
  Synthetic
ataacaaccatgaaaaccactggcgccttcgggcagcagtctggtgccgtgtacgttggcaactatagagtggtg

SEQ ID NO: 72140 - DNA, 75 bp, Artificial Sequence
  Synthetic
acctacggggcaacccgtaggacgctctaatacagacatggtgagaagagcctattgagctagttggtagtcctc

SEQ ID NO: 72141 - DNA, 75 bp, Artificial Sequence
  Synthetic
aatagacatctcgcaacgcgcgcggactggcaaaactgtgtgtgggaagactacgacagagaccttctagtgagc

SEQ ID NO: 72142 - DNA, 75 bp, Artificial Sequence
  Synthetic
ccattgccaggtgcgattgcacagcaggagtgtacttctgcgcctccagaaataagcactatccagtcacatttg

SEQ ID NO: 72143 - DNA, 75 bp, Artificial Sequence
  Synthetic
aggagtgtacttctgcgcctccagaaataagcactatccagtcacatttgaggggcccggtcttgtggaggttca

SEQ ID NO: 72144 - DNA, 75 bp, Artificial Sequence
  Synthetic
ttgtttggctgcttatggtgacaattgaaagattgttgccatatagctattgggtcggccacctggtatctaaca

SEQ ID NO: 72145 - DNA, 75 bp, Artificial Sequence
  Synthetic
tggagggattctcagatgccaacatggggtgattggcatagttaccgtggggggagaaggtgttgttggttttgc

SEQ ID NO: 72146 - DNA, 75 bp, Artificial Sequence
  Synthetic
aactcaattcattgaaatgggagcacaggtgtctacacaaaagactggtgcgcatgagacccttcttgaagctgc

SEQ ID NO: 72147 - DNA, 75 bp, Artificial Sequence
  Synthetic
caggtgtctacacaaaagactggtgcgcatgagacccttcttgaagctgcccagggtgccacaataaattatacc

SEQ ID NO: 72148 - DNA, 75 bp, Artificial Sequence
  Synthetic
aatcaaatttgcgaacaggttacccttctaaaagagtcgttaattggacaggattctgtccttgagaagtctctc

SEQ ID NO: 72149 - DNA, 75 bp, Artificial Sequence
  Synthetic
actgaaccagtaaaggacctaatgattaaatcaatgccagctttgaactcgccctcggcggaggagtgtgggtat

SEQ ID NO: 72150 - DNA, 75 bp, Artificial Sequence
  Synthetic
ttaaatcaatgccagctttgaactcgccctcggcggaggagtgtgggtatagcgatagggtacgttctttgaccc

SEQ ID NO: 72151 - DNA, 75 bp, Artificial Sequence
  Synthetic
cgatgacctcattacggtcaccgccacactggcgttaataggatgtactacctcaccatggcgctggctcaagca

SEQ ID NO: 72152 - DNA, 75 bp, Artificial Sequence
  Synthetic
ctgatgatcaagccactgctgaggaccaaccaacacaaccagacgtggccacatgccggttttacacattagagt

SEQ ID NO: 72153 - DNA, 75 bp, Artificial Sequence
  Synthetic
ccaaccaacacaaccagacgtggccacatgccggttttacacattagagtctgtgtcatggcagcgcgactcccc

SEQ ID NO: 72154 - DNA, 75 bp, Artificial Sequence
  Synthetic
gaccaatgcctgtaagggcatggagtggatagccatcaagatccaaaagttcatagagtggttgaaggttaagat

SEQ ID NO: 72155 - DNA, 75 bp, Artificial Sequence
  Synthetic
taccactcttggaaagtcaaatagcaactattgagcagagtgcaccatctcaatgtgaccaggagcaactattct

SEQ ID NO: 72156 - DNA, 75 bp, Artificial Sequence
  Synthetic
aggccgagcaggatacaccattcatgtgcagtgcaatgcctcaaaatttcaccagggttgcctactcgtagtttg

SEQ ID NO: 72157 - DNA, 75 bp, Artificial Sequence
  Synthetic
gtgcagtgcaatgcctcaaaatttcaccagggttgcctactcgtagtttgtgtcccagaggcggagatggggtgc

SEQ ID NO: 72158 - DNA, 75 bp, Artificial Sequence
  Synthetic
cacttgaaaagaagatgagcaattacatacagttcaagtccaaatgccgtattgaacctgtctgtctcttgctcc

SEQ ID NO: 72159 - DNA, 75 bp, Artificial Sequence
  Synthetic
gccaccgctgcacctggcaaagtacagaccgcggtgatcaacgcggcaatgggggtgggcgttggcaaccttacc

SEQ ID NO: 72160 - DNA, 75 bp, Artificial Sequence
  Synthetic
agaccgcggtgatcaacgcggcaatgggggtgggcgttggcaaccttaccatatatccccatcagtggatcaacc

SEQ ID NO: 72161 - DNA, 75 bp, Artificial Sequence
  Synthetic
cggtgtactcactaccaccagatccagaccatttcgatggttacaaacagcaagctgttgtcatcatggacgact

SEQ ID NO: 72162 - DNA, 75 bp, Artificial Sequence
  Synthetic
caagctgttgtcatcatggacgacttgtgccagaacccggacggtaaagatgtgtccttgttctgtcagatggtc

SEQ ID NO: 72163 - DNA, 75 bp, Artificial Sequence
  Synthetic
acaactttaccctgatgatcatcccatttgctcccttagaaacaaagggaggctctacatatgtcccaatcacag

SEQ ID NO: 72164 - DNA, 75 bp, Artificial Sequence
  Synthetic
atttgctcccttagaaacaaagggaggctctacatatgtcccaatcacagtgaccattgccccaatgtgtgcaga

SEQ ID NO: 72165 - DNA, 75 bp, Artificial Sequence
  Synthetic
gcgtccaccaatgcagggtcagttaacgcccccacggtctccgacagtagagcactcgtaagaaggttccatttt

SEQ ID NO: 72166 - DNA, 75 bp, Artificial Sequence
  Synthetic
cacgtcagacgactatcaatccccatgcgcgatgccggagtatgatgttactcccccactaaaaataccagggga

SEQ ID NO: 72167 - DNA, 75 bp, Artificial Sequence
  Synthetic
acgcccccacggtctccgacagtagagcactcgtaagaaggttccattttgacatgaacatcgaggttgtttcca

SEQ ID NO: 72168 - DNA, 75 bp, Artificial Sequence
  Synthetic
tgcgcgatgccggagtatgatgttactcccccactaaaaataccaggggaagtcaacaacatcatggaaatagcc

SEQ ID NO: 72169 - DNA, 75 bp, Artificial Sequence
  Synthetic
tcaaaaagtgctgtccactagtgtgtggcaaagctatacaattcatagacaggaggacccaagttaggtattcat

SEQ ID NO: 72170 - DNA, 75 bp, Artificial Sequence
  Synthetic
agtgctggcactgcaccaaggactaatgccgtattcactttccaattagaccctggcaatagccccgtactaaac

SEQ ID NO: 72171 - DNA, 75 bp, Artificial Sequence
  Synthetic
tggcaaagctatacaattcatagacaggaggacccaagttaggtattcattggacatgctggttaccgaaatgtt

SEQ ID NO: 72172 - DNA, 75 bp, Artificial Sequence
  Synthetic
atgccgtattcactttccaattagaccctggcaatagccccgtactaaaccgcacattactgggggagatcatta

SEQ ID NO: 72173 - DNA, 75 bp, Artificial Sequence
  Synthetic
gatcaaaatcagtgttgccccagaaactcctccaccaccagcagttgccgacttactgaaatcagtagacagtga

SEQ ID NO: 72174 - DNA, 75 bp, Artificial Sequence
  Synthetic
tattacttgcttactccccaccgggagcctcagtacctagtagtaggaaagatgctatgttgggcacccatatcg

SEQ ID NO: 72175 - DNA, 75 bp, Artificial Sequence
  Synthetic
actcctccaccaccagcagttgccgacttactgaaatcagtagacagtgaggctgtgagggagtactgcaaggag

SEQ ID NO: 72176 - DNA, 75 bp, Artificial Sequence
  Synthetic
agcctcagtacctagtagtaggaaagatgctatgttgggcacccatatcgtgtgggacattgggctacaatcaag

SEQ ID NO: 72177 - DNA, 75 bp, Artificial Sequence
  Synthetic
caagctctaaccacatttgtctcggttgcaggcataatatacatcatctacaaattgtttgcaggtttccaaggc

SEQ ID NO: 72178 - DNA, 75 bp, Artificial Sequence
  Synthetic
atacatcacatgttggtatcaaaccaacatcattgtgccgccagaaacccctactgaatgtattgtgctttgctt

SEQ ID NO: 72179 - DNA, 75 bp, Artificial Sequence
  Synthetic
ttgcaggcataatatacatcatctacaaattgtttgcaggtttccaaggcgcatacacagggatgcctaatcaga

SEQ ID NO: 72180 - DNA, 75 bp, Artificial Sequence
  Synthetic
aacatcattgtgccgccagaaacccctactgaatgtattgtgctttgctttgtatcagcgtgtaatgacttctca

SEQ ID NO: 72181 - DNA, 75 bp, Artificial Sequence
  Synthetic
gaaacgccagtacagtgaaaactgagtacggtgaattcaccatgcttgggatttacgacaggtgggcggtgttgc

SEQ ID NO: 72182 - DNA, 75 bp, Artificial Sequence
  Synthetic
tcagctatctccagggtagcagataccattagctcaggtcctagtaacactgttgctataccagcgctcaccgcg

SEQ ID NO: 72183 - DNA, 75 bp, Artificial Sequence
  Synthetic
gtacggtgaattcaccatgcttgggatttacgacaggtgggcggtgttgccacgccatgccaaacctggccccac

SEQ ID NO: 72184 - DNA, 75 bp, Artificial Sequence
  Synthetic
ccattagctcaggtcctagtaacactgttgctataccagcgctcaccgcggcagaaacgggccacacatcgcaag

SEQ ID NO: 72185 - DNA, 75 bp, Artificial Sequence
  Synthetic
attgactctcttgaagctcaaccgcaacgagaagtttagagacatcaggggattcttagcacgagaggaggtcga

SEQ ID NO: 72186 - DNA, 75 bp, Artificial Sequence
  Synthetic
tcctgtgtagatccgcgtgtgtgcatattgcgtcatacaacgcatacggtgatgttggatcagacagtagatatg

SEQ ID NO: 72187 - DNA, 75 bp, Artificial Sequence
  Synthetic
gattcttagcacgagaggaggtcgaagtgaacgaagctgtcctagcaataaacacaagtaaattcccgaatatgt

SEQ ID NO: 72188 - DNA, 75 bp, Artificial Sequence
  Synthetic
tattgcgtcatacaacgcatacggtgatgttggatcagacagtagatatgatagttgggagatcaacatcaggga

SEQ ID NO: 72189 - DNA, 75 bp, Artificial Sequence
  Synthetic
acaatttcccaactagggcaggccagtgtgggggtgtccttatgtcaacagggaaagtcctgggaatacatgtag

SEQ ID NO: 72190 - DNA, 75 bp, Artificial Sequence
  Synthetic
tagcaagcaagatcaagggacttcgctatcacaagacatgccagtgctaacacatcagatcatgtacgtgccgcc

SEQ ID NO: 72191 - DNA, 75 bp, Artificial Sequence
  Synthetic
gtgtgggggtgtccttatgtcaacagggaaagtcctgggaatacatgtaggagggaatggacaccaagggttttc

SEQ ID NO: 72192 - DNA, 75 bp, Artificial Sequence
  Synthetic
ctatcacaagacatgccagtgctaacacatcagatcatgtacgtgccgccaggcggatccgtgcccactagcgtc

SEQ ID NO: 72193 - DNA, 75 bp, Artificial Sequence
  Synthetic
atttcccgtgatcaacacccccagcaagacaaaattggaaccaagtgtgtttcaccacgtgttcgagggcaacaa

SEQ ID NO: 72194 - DNA, 75 bp, Artificial Sequence
  Synthetic
atcccattcattagcatagggaatgcatacagcagcttctacgacgggtggtcacatttcacccaacaaggtggc

SEQ ID NO: 72195 - DNA, 75 bp, Artificial Sequence
  Synthetic
aagacaaaattggaaccaagtgtgtttcaccacgtgttcgagggcaacaaggaaccagcggttctcagaaatggg

SEQ ID NO: 72196 - DNA, 75 bp, Artificial Sequence
  Synthetic
catacagcagcttctacgacgggtggtcacatttcacccaacaaggtggctatggctataatacactgaacaaga

SEQ ID NO: 72197 - DNA, 75 bp, Artificial Sequence
  Synthetic
gagtacatgatggaggctgtagatcattatgcaggacaactagccacactggacatcagcacggagcccatgaag

SEQ ID NO: 72198 - DNA, 75 bp, Artificial Sequence
  Synthetic
aaccaaagcatgttagagcgtgggtgccaaggccacctagattgtgcccgtacatcaataaagcggactgtaact

SEQ ID NO: 72199 - DNA, 75 bp, Artificial Sequence
  Synthetic
gccaaggccacctagattgtgcccgtacatcaataaagcggactgtaacttcgctgttacaccactcaccaaaca

SEQ ID NO: 72200 - DNA, 75 bp, Artificial Sequence
  Synthetic
ctagaagatgccgtgtatggcacagaggggctcgaagcactagacctgaccaccagtgcaggttacccttatgtg

SEQ ID NO: 72201 - DNA, 75 bp, Artificial Sequence
  Synthetic
tcctatccaagaagaccagagaccttaccaagctaaaggaatgcatggataaatatggtctaaacctgccaatgg

SEQ ID NO: 72202 - DNA, 75 bp, Artificial Sequence
  Synthetic
cgccatatatgtgggtaattatagggtggtgaataggcacttggctacacaaaatgattggcaaaattgcgtctg

SEQ ID NO: 72203 - DNA, 75 bp, Artificial Sequence
  Synthetic
gtggtgaataggcacttggctacacaaaatgattggcaaaattgcgtctgggaggattacaaccgggatttgttg

SEQ ID NO: 72204 - DNA, 75 bp, Artificial Sequence
  Synthetic
tcaaagagcaagcattatccagtcacttttgaagggccaggcttggttgaagtacaagaaagtgagtattaccca

SEQ ID NO: 72205 - DNA, 75 bp, Artificial Sequence
  Synthetic
cttttgaagggccaggcttggttgaagtacaagaaagtgagtattacccaaagagataccagtcccacgtacttc

SEQ ID NO: 72206 - DNA, 75 bp, Artificial Sequence
  Synthetic
cccgtcatgctcgatggacatctcatagcgtttgactattcaggctatgacgccagcctcagcccagtgtggttt

SEQ ID NO: 72207 - DNA, 75 bp, Artificial Sequence
  Synthetic
ccatgggtggagagggtgttgttggatttgctgacgttagagatttgctgtggttggaggatgatgccatggagc

SEQ ID NO: 72208 - DNA, 75 bp, Artificial Sequence
  Synthetic
atttgctgacgttagagatttgctgtggttggaggatgatgccatggagcagggcgtcagagactatgtggagca

SEQ ID NO: 72209 - DNA, 75 bp, Artificial Sequence
  Synthetic
tcccaccacctgtacagggacagacactactttgtgaggggcggcatgccatcaggatgctcaggcactagcata

SEQ ID NO: 72210 - DNA, 75 bp, Artificial Sequence
  Synthetic
gggccaagactccatcttggagaaatctctgaaagccctggttaaaataatatcagccctggtgattgtggtgcg

SEQ ID NO: 72211 - DNA, 75 bp, Artificial Sequence
  Synthetic
tctctgaaagccctggttaaaataatatcagccctggtgattgtggtgcgaaatcatgacgacctgatcacagtg

SEQ ID NO: 72212 - DNA, 75 bp, Artificial Sequence
  Synthetic
ttcagaatgattgcatatggggatgatgtgatagcttcatacccgtggcctatcgatgcctcactactagctgaa

SEQ ID NO: 72213 - DNA, 75 bp, Artificial Sequence
  Synthetic
ggaatacccatggctgaacgccaaaacaatggctggctcaagaaatttaccgaaatgacaaatgcttgcaagggc

SEQ ID NO: 72214 - DNA, 75 bp, Artificial Sequence
  Synthetic
aaacatgaattcctaaacagactcaaacaactccccctgttagaaagtcaaattgccactatcgagcaaagtgca

SEQ ID NO: 72215 - DNA, 75 bp, Artificial Sequence
  Synthetic
aaattagagcacaattagtcaatcataattggctcaaccctaccgcatgaaccgaacttgataaaagtgcggtag

SEQ ID NO: 72216 - DNA, 75 bp, Artificial Sequence
  Synthetic
taattacatacagttcaagtccaaatgccgtattgagcctgtatgtctgctcttgcatgggagtcccggtgcagg

SEQ ID NO: 72217 - DNA, 75 bp, Artificial Sequence
  Synthetic
acccacagggcccactgggcgctagcactctggtaccgcggtacctttgtgcgcctgttttatatcccccctccc

SEQ ID NO: 72218 - DNA, 75 bp, Artificial Sequence
  Synthetic
agatccagatcacttcgatggctacaaacagcaggctgtagtgatcatggacgatctatgtcagaatcctgatgg

SEQ ID NO: 72219 - DNA, 75 bp, Artificial Sequence
  Synthetic
aaacagcaggctgtagtgatcatggacgatctatgtcagaatcctgatgggaaggatgtttccttgttctgtcag

SEQ ID NO: 72220 - DNA, 75 bp, Artificial Sequence
  Synthetic
ttctgtctccccggaccaagtatcaatagactgctcacgcggttgaaggagaaagcgttcgttacccgactaact

SEQ ID NO: 72221 - DNA, 75 bp, Artificial Sequence
  Synthetic
acttcgagaaacccagtagcactatgaaagttgcgaggcgtttcgctcaacacttccccagtgtagatcaggtcg

SEQ ID NO: 72222 - DNA, 75 bp, Artificial Sequence
  Synthetic
agtctattgagctagttagtagtcctccggcccctgaatgcggctaatcctaactgcggagcacataccctcaac

SEQ ID NO: 72223 - DNA, 75 bp, Artificial Sequence
  Synthetic
atagatagaagaactcaagtcagatactccctcgatatgctggtgactgagatgtttagggaatataaccacagg

SEQ ID NO: 72224 - DNA, 75 bp, Artificial Sequence
  Synthetic
taactctgcagcggaaccgactactttgggtgtccgtgtttccttttatccttacattggctgcttatggtgaca

SEQ ID NO: 72225 - DNA, 75 bp, Artificial Sequence
  Synthetic
cttacattggctgcttatggtgacaattgaaagattgttaccatatagctattggattggccatccagtgtctaa

SEQ ID NO: 72226 - DNA, 75 bp, Artificial Sequence
  Synthetic
attgaaagattgttaccatatagctattggattggccatccagtgtctaatagagctattatatacctctttgtt

SEQ ID NO: 72227 - DNA, 75 bp, Artificial Sequence
  Synthetic
acaattaaacacagcaaaatgggagctcaggtttcaacgcaaaaaactggagcacacgagaccgggttgagagct

SEQ ID NO: 72228 - DNA, 75 bp, Artificial Sequence
  Synthetic
ctcaggtttcaacgcaaaaaactggagcacacgagaccgggttgagagctagtggtaattccattattcactaca

SEQ ID NO: 72229 - DNA, 75 bp, Artificial Sequence
  Synthetic
tgtctgcaggctataaccacattcgtgtcagtggctggaattatctacataatatacaagctctttgcaggcttt

SEQ ID NO: 72230 - DNA, 75 bp, Artificial Sequence
  Synthetic
tcacagagccagtaaaggatatcatgatcaagtccatgccagcccttaactcgccgtctgccgaggagtgtggat

SEQ ID NO: 72231 - DNA, 75 bp, Artificial Sequence
  Synthetic
gatcaagtccatgccagcccttaactcgccgtctgccgaggagtgtggatatagtgacagagtgagatctatcac

SEQ ID NO: 72232 - DNA, 75 bp, Artificial Sequence
  Synthetic
gcatttgaatttgctgttgcaatgatgaagaggaactcaagcacagtgaagactgagtatggtgaattcaccatg

SEQ ID NO: 72233 - DNA, 75 bp, Artificial Sequence
  Synthetic
caaagatgaagaggctacagcagaggaccaaccaactcagccagacgtagcaacgtgcaggttctataccctgga

SEQ ID NO: 72234 - DNA, 75 bp, Artificial Sequence
  Synthetic
gaccaaccaactcagccagacgtagcaacgtgcaggttctataccctggagtccgtgatgtggcagcagagttca

SEQ ID NO: 72235 - DNA, 75 bp, Artificial Sequence
  Synthetic
agttggtggacaaggatggtacaaatctagagctgacactactcaagctgaataggaacgagaagttcagagaca

SEQ ID NO: 72236 - DNA, 75 bp, Artificial Sequence
  Synthetic
tctagagctgacactactcaagctgaataggaacgagaagttcagagacattagagggttcttagccaaggaaga

SEQ ID NO: 72237 - DNA, 75 bp, Artificial Sequence
  Synthetic
ctggggagagctggatacacagtgcatgtacaatgcaacgcctccaagtttcaccaaggatgtttgctggtagtc

SEQ ID NO: 72238 - DNA, 75 bp, Artificial Sequence
  Synthetic
atgtacaatgcaacgcctccaagtttcaccaaggatgtttgctggtagtctgtgtaccagaggctgagatggggt

SEQ ID NO: 72239 - DNA, 75 bp, Artificial Sequence
  Synthetic
acacgactgggcagacagctgtgcaggccaacgtcattaatgcaggaatgggagtgggcgtcggtaacctaacca

SEQ ID NO: 72240 - DNA, 75 bp, Artificial Sequence
  Synthetic
ggccaacgtcattaatgcaggaatgggagtgggcgtcggtaacctaaccatcttcccacatcaatggatcaactt

SEQ ID NO: 72241 - DNA, 75 bp, Artificial Sequence
  Synthetic
cctagcaagaccaaattggagccgagtgtctttcaccaagtttttgaaggcaataaagagccagcagttctcagg

SEQ ID NO: 72242 - DNA, 75 bp, Artificial Sequence
  Synthetic
caatttcactctaatgattatacccttcgcacccttgagctacagtacaggtgcaactacctacgtgccgatcac

SEQ ID NO: 72243 - DNA, 75 bp, Artificial Sequence
  Synthetic
ttcgcacccttgagctacagtacaggtgcaactacctacgtgccgatcacagtgactgtggcgccaatgtgtgca

SEQ ID NO: 72244 - DNA, 75 bp, Artificial Sequence
  Synthetic
attttgaggaagccatcttttccaaatacatcggaaatgtcaacacacacgtggatgaatacatgctggaagcta

SEQ ID NO: 72245 - DNA, 75 bp, Artificial Sequence
  Synthetic
acttctgatgatttccagtcgccctccgccatgccacagtttgacgtgacgccagagatggcaatccctggacag

SEQ ID NO: 72246 - DNA, 75 bp, Artificial Sequence
  Synthetic
ccgccatgccacagtttgacgtgacgccagagatggcaatccctggacaggtgaataacttaatggagattgcag

SEQ ID NO: 72247 - DNA, 75 bp, Artificial Sequence
  Synthetic
cttaacaacaagtgcaggctacccctatgtcgcactgggtatcaagaagagagacatcctctcaaggaagaccaa

SEQ ID NO: 72248 - DNA, 75 bp, Artificial Sequence
  Synthetic
aatcaaactcaaccaatggttcacaagtatttgggttccctcttatccctggcgctagtagcgtgttgaacagaa

SEQ ID NO: 72249 - DNA, 75 bp, Artificial Sequence
  Synthetic
agtatttgggttccctcttatccctggcgctagtagcgtgttgaacagaacactcttaggtgagatccttaatta

SEQ ID NO: 72250 - DNA, 75 bp, Artificial Sequence
  Synthetic
actggcatactcaccacctggtgctggagctccaacgaccagaaaagaagcaatgctcggaacgcacgtcatttg

SEQ ID NO: 72251 - DNA, 75 bp, Artificial Sequence
  Synthetic
ggagctccaacgaccagaaaagaagcaatgctcggaacgcacgtcatttgggacgtcgggctgcagtccagctgc

SEQ ID NO: 72252 - DNA, 75 bp, Artificial Sequence
  Synthetic
atcacatgctggtaccagacaaatattgtggtacctgctgatacacaaagcgactgcaaaatcctatgcttcgtg

SEQ ID NO: 72253 - DNA, 75 bp, Artificial Sequence
  Synthetic
ttgtggtacctgctgatacacaaagcgactgcaaaatcctatgcttcgtgtcagcatgcaatgacttttctgtgc

SEQ ID NO: 72254 - DNA, 75 bp, Artificial Sequence
  Synthetic
gaaagtgtacaagggaattgacttggaccagttcaggatgatcgcatatggtgatgatgtaattgcatcataccc

SEQ ID NO: 72255 - DNA, 75 bp, Artificial Sequence
  Synthetic
cgattgctcgcgtagctgataccataagtagtggtcctgttaactcagagtcaataccggcacttacagcagcag

SEQ ID NO: 72256 - DNA, 75 bp, Artificial Sequence
  Synthetic
aagtagtggtcctgttaactcagagtcaataccggcacttacagcagcagaaactgggcacacgtctcaggtggt

SEQ ID NO: 72257 - DNA, 75 bp, Artificial Sequence
  Synthetic
gtgtagatctgcgtgtgtatattatactacttacaagaaccatggcaccgatggcgacaattttgcctattgggt

SEQ ID NO: 72258 - DNA, 75 bp, Artificial Sequence
  Synthetic
actacttacaagaaccatggcaccgatggcgacaattttgcctattgggtgattaatacaagacaggttgcgcag

SEQ ID NO: 72259 - DNA, 75 bp, Artificial Sequence
  Synthetic
gagcaatctaccattcaaggccaagactcgcctgtgttaactcatcaaataatgtacgtgcccccagggggccca

SEQ ID NO: 72260 - DNA, 75 bp, Artificial Sequence
  Synthetic
actcgcctgtgttaactcatcaaataatgtacgtgcccccagggggcccagtgcccaccaaaatcaacagttaca

SEQ ID NO: 72261 - DNA, 75 bp, Artificial Sequence
  Synthetic
ttagtattgggaatgcttatagcatgttctatgatgggtgggctaagtttgacaaacaagggacctatggcataa

SEQ ID NO: 72262 - DNA, 75 bp, Artificial Sequence
  Synthetic
gttctatgatgggtgggctaagtttgacaaacaagggacctatggcataaataccttgaacaacatgggcactct

SEQ ID NO: 72263 - DNA, 75 bp, Artificial Sequence
  Synthetic
cgtgaaaacgtgggtccctagaccaccaagattatgccaataccagaaagcgggcaacgtcaattttgaaccaac

SEQ ID NO: 72264 - DNA, 75 bp, Artificial Sequence
  Synthetic
ccaagattatgccaataccagaaagcgggcaacgtcaattttgaaccaactggggtgacagaatcccgcaccgaa

SEQ ID NO: 72265 - DNA, 75 bp, Artificial Sequence
  Synthetic
aacagacacctagccactagtgaagattggcagaggtgcgtgtgggaggattataacagagacctcctcgttagc

SEQ ID NO: 72266 - DNA, 75 bp, Artificial Sequence
  Synthetic
attggcagaggtgcgtgtgggaggattataacagagacctcctcgttagcaccaccacagcccacgggtgcgata

SEQ ID NO: 72267 - DNA, 75 bp, Artificial Sequence
  Synthetic
tttgggtgtccgtgtttccttttattcttacattggctgcttatggtgacaatcaaggaattgttaccatatagc

SEQ ID NO: 72268 - DNA, 75 bp, Artificial Sequence
  Synthetic
aagggcccgggcttgttgaggtacaggagagtgagtactatccaaaaagataccagtcccatgtactgctcgccg

SEQ ID NO: 72269 - DNA, 75 bp, Artificial Sequence
  Synthetic
ggagagtgagtactatccaaaaagataccagtcccatgtactgctcgccgcaggattttctgagccaggcgactg

SEQ ID NO: 72270 - DNA, 75 bp, Artificial Sequence
  Synthetic
agtctcaacaccctttgctatatcattaaattgaactcagcaaaatgggcgcacaagtgtcaactcaaaaggcag

SEQ ID NO: 72271 - DNA, 75 bp, Artificial Sequence
  Synthetic
ttaaattgaactcagcaaaatgggcgcacaagtgtcaactcaaaaggcaggcacgcacgaggcatcccttcgtgc

SEQ ID NO: 72272 - DNA, 75 bp, Artificial Sequence
  Synthetic
tgatgtgcgcgacctcctatggttagaagacgacgctatggaacagggtgtgaaggactatgtcgagcaactagg

SEQ ID NO: 72273 - DNA, 75 bp, Artificial Sequence
  Synthetic
gaagacgacgctatggaacagggtgtgaaggactatgtcgagcaactaggaaacgcttttggctcgggtttcact

SEQ ID NO: 72274 - DNA, 75 bp, Artificial Sequence
  Synthetic
ggagtttgaccaagatcccagcaagttcactgagcccgttaaggatgtcatgattaaatctctaccagctttgaa

SEQ ID NO: 72275 - DNA, 75 bp, Artificial Sequence
  Synthetic
ttcactgagcccgttaaggatgtcatgattaaatctctaccagctttgaactcaccgtccgcagaggagtgtggg

SEQ ID NO: 72276 - DNA, 75 bp, Artificial Sequence
  Synthetic
aaagcactcgttaaaattatatcagcactagttatagtagtgagaaatcatgatgatcttgtgacgatcactgcc

SEQ ID NO: 72277 - DNA, 75 bp, Artificial Sequence
  Synthetic
cactagttatagtagtgagaaatcatgatgatcttgtgacgatcactgccactctggccttaatcggttgtacat

SEQ ID NO: 72278 - DNA, 75 bp, Artificial Sequence
  Synthetic
gcctatggagaatggccgagttaccttaaggacaccgaagccacggcagaagatcaacccactcaacctgatgtc

SEQ ID NO: 72279 - DNA, 75 bp, Artificial Sequence
  Synthetic
ttaaggacaccgaagccacggcagaagatcaacccactcaacctgatgtcgctacatgtagattttatacacttg

SEQ ID NO: 72280 - DNA, 75 bp, Artificial Sequence
  Synthetic
actggcttaaaaagttcactgaaatgaccaacgcctgtaagggtatggagtggatagctgttaaaatacaaaaat

SEQ ID NO: 72281 - DNA, 75 bp, Artificial Sequence
  Synthetic
gaccaacgcctgtaagggtatggagtggatagctgttaaaatacaaaaatttattgattggctcaaggtcaagat

SEQ ID NO: 72282 - DNA, 75 bp, Artificial Sequence
  Synthetic
tcggacagaatatgcactaccactatctgggtagaacgggatatacagtacatgtgcagtgcaatgcatccaagt

SEQ ID NO: 72283 - DNA, 75 bp, Artificial Sequence
  Synthetic
tctgggtagaacgggatatacagtacatgtgcagtgcaatgcatccaagttccaccaagggtgtttgttggtggt

SEQ ID NO: 72284 - DNA, 75 bp, Artificial Sequence
  Synthetic
taccattgaacaaagtgcaccctcccaaagtgaccaggagcagctattctccaatgtccagtactttgcacacta

SEQ ID NO: 72285 - DNA, 75 bp, Artificial Sequence
  Synthetic
caaagtgaccaggagcagctattctccaatgtccagtactttgcacactactgcaggaagtatgcaccactgtat

SEQ ID NO: 72286 - DNA, 75 bp, Artificial Sequence
  Synthetic
gagtccctgtgagttcacccctagtagtgtgacaggggaaaacgcggtacaaacagctgtgtgtaatgccgcgat

SEQ ID NO: 72287 - DNA, 75 bp, Artificial Sequence
  Synthetic
agtgtgacaggggaaaacgcggtacaaacagctgtgtgtaatgccgcgatgggagtagcggttggcaatttgacc

SEQ ID NO: 72288 - DNA, 75 bp, Artificial Sequence
  Synthetic
attgaacctgtatgtttgcttctgcacggaagtccgggtgctgggaaatcagtcgccaccaacttgattgggcgc

SEQ ID NO: 72289 - DNA, 75 bp, Artificial Sequence
  Synthetic
acggaagtccgggtgctgggaaatcagtcgccaccaacttgattgggcgctcgttggctgaaaaactaaacagct

SEQ ID NO: 72290 - DNA, 75 bp, Artificial Sequence
  Synthetic
cctatggacaacatgtttagacaccaaaatttcacgctaatgatcataccatttgcacccctggaggtatccgga

SEQ ID NO: 72291 - DNA, 75 bp, Artificial Sequence
  Synthetic
aaaatttcacgctaatgatcataccatttgcacccctggaggtatccggaggcatcacacccagcgtgcctataa

SEQ ID NO: 72292 - DNA, 75 bp, Artificial Sequence
  Synthetic
tgtgtcaaaacccagacggtggggatatttcactattctgccagatggtctccagtgtagactttgtgcccccaa

SEQ ID NO: 72293 - DNA, 75 bp, Artificial Sequence
  Synthetic
tatttcactattctgccagatggtctccagtgtagactttgtgcccccaatggcagcgctagaggagaaaggtat

SEQ ID NO: 72294 - DNA, 75 bp, Artificial Sequence
  Synthetic
atacgcccggtagtaaccaattcttaacatcggatgattatcaatcaccatctgcaatgccacagtttgacgtca

SEQ ID NO: 72295 - DNA, 75 bp, Artificial Sequence
  Synthetic
aacatcggatgattatcaatcaccatctgcaatgccacagtttgacgtcaccccattgatgcatataccaggtga

SEQ ID NO: 72296 - DNA, 75 bp, Artificial Sequence
  Synthetic
agcgcttgccagaagattccattttgatatgaatattgaggttatttctatgtatagtcaaaatggtaagatcaa

SEQ ID NO: 72297 - DNA, 75 bp, Artificial Sequence
  Synthetic
gatatgaatattgaggttatttctatgtatagtcaaaatggtaagatcaacatgcccatgtctgtcagaacatgt

SEQ ID NO: 72298 - DNA, 75 bp, Artificial Sequence
  Synthetic
gatggaggcatatcaaatcccggtcaacaccggtaatcaccccaagacaaaggctatattcagtttccccttaga

SEQ ID NO: 72299 - DNA, 75 bp, Artificial Sequence
  Synthetic
aacaccggtaatcaccccaagacaaaggctatattcagtttccccttagacccagggaatagttctgtgatgaat

SEQ ID NO: 72300 - DNA, 75 bp, Artificial Sequence
  Synthetic
agaagaacccaggtcagatactcactggacatgttagtgactgaaatgttcagagagtataaccacagacatagc

SEQ ID NO: 72301 - DNA, 75 bp, Artificial Sequence
  Synthetic
tggacatgttagtgactgaaatgttcagagagtataaccacagacatagcgtgggcgccacccttgaagcattat

SEQ ID NO: 72302 - DNA, 75 bp, Artificial Sequence
  Synthetic
gggaccgcaatggccactggtaagattctgttatcatattcaccacccggagcttcggtccctgagagtaggacc

SEQ ID NO: 72303 - DNA, 75 bp, Artificial Sequence
  Synthetic
ttctgttatcatattcaccacccggagcttcggtccctgagagtaggacccaagccatgctaggcactcatgtca

SEQ ID NO: 72304 - DNA, 75 bp, Artificial Sequence
  Synthetic
accttttaaaatcagtagatagtgaggcggttagagaatactgtagggagaagggctggcttgtaccggaaatta

SEQ ID NO: 72305 - DNA, 75 bp, Artificial Sequence
  Synthetic
ggcggttagagaatactgtagggagaagggctggcttgtaccggaaattaattccacactgcagattgaaaaaca

SEQ ID NO: 72306 - DNA, 75 bp, Artificial Sequence
  Synthetic
atgaagatgtgtacactagcgcgggttatgttacagcatggtaccagaccaccatcgtggttccaccacaaacgc

SEQ ID NO: 72307 - DNA, 75 bp, Artificial Sequence
  Synthetic
ttatgttacagcatggtaccagaccaccatcgtggttccaccacaaacgccaaccagttgtaagatactgtgttt

SEQ ID NO: 72308 - DNA, 75 bp, Artificial Sequence
  Synthetic
caaacttttcgccggtttccagggcgcgtacacagggatgccaaatcaaaagcccaaggtgcccactctgaggca

SEQ ID NO: 72309 - DNA, 75 bp, Artificial Sequence
  Synthetic
gcgtacacagggatgccaaatcaaaagcccaaggtgcccactctgaggcaagctaaggtgcagggtccggcattt

SEQ ID NO: 72310 - DNA, 75 bp, Artificial Sequence
  Synthetic
aggggatgacaagcaggtgggggctccaactgtagctgatacccgaccaagcaccagccaaaacacggagcgcat

SEQ ID NO: 72311 - DNA, 75 bp, Artificial Sequence
  Synthetic
ccaactgtagctgatacccgaccaagcaccagccaaaacacggagcgcattccagcacttacggcggcagagacc

SEQ ID NO: 72312 - DNA, 75 bp, Artificial Sequence
  Synthetic
atctatgataggtgggccgttttgccacgtcatgccaaacccgggccaactattctgatgaacgaccaggaagta

SEQ ID NO: 72313 - DNA, 75 bp, Artificial Sequence
  Synthetic
cacgtcatgccaaacccgggccaactattctgatgaacgaccaggaagtaggagtggtggatgcaaaagagctgg

SEQ ID NO: 72314 - DNA, 75 bp, Artificial Sequence
  Synthetic
tctactgtggaaaatttctttggtagagctgcatgtgtcaaagtgagacaatatagcatggggagattggctgcg

SEQ ID NO: 72315 - DNA, 75 bp, Artificial Sequence
  Synthetic
gagctgcatgtgtcaaagtgagacaatatagcatggggagattggctgcggaggaagacaagtacactagctggg

SEQ ID NO: 72316 - DNA, 75 bp, Artificial Sequence
  Synthetic
gcttcttggctaaagaagaggtggaagtcaatgaggctgtgctagctattaataccagcaagttccccaacatgt

SEQ ID NO: 72317 - DNA, 75 bp, Artificial Sequence
  Synthetic
agtcaatgaggctgtgctagctattaataccagcaagttccccaacatgtacatcccagtaggacaggtcacaga

SEQ ID NO: 72318 - DNA, 75 bp, Artificial Sequence
  Synthetic
tcaccattgttatcaccagctatcagaaacagggcacaaacctcgaccaggacatgccagtcttaacccaccaga

SEQ ID NO: 72319 - DNA, 75 bp, Artificial Sequence
  Synthetic
gaaacagggcacaaacctcgaccaggacatgccagtcttaacccaccagatcatgtatgtaccaccgggtgggcc

SEQ ID NO: 72320 - DNA, 75 bp, Artificial Sequence
  Synthetic
gtgcggcggtgtactcatgtccactggcaaagtactaggcatccatgtggggggaaatggacaccaaggtttttc

SEQ ID NO: 72321 - DNA, 75 bp, Artificial Sequence
  Synthetic
ggcaaagtactaggcatccatgtggggggaaatggacaccaaggtttttcagctgctctcctcaaacactacttc

SEQ ID NO: 72322 - DNA, 75 bp, Artificial Sequence
  Synthetic
accagctcgcatttctattccattcatcagtgtaggcaacgcatatagcagcttctacgatggatggtcacactt

SEQ ID NO: 72323 - DNA, 75 bp, Artificial Sequence
  Synthetic
atcagtgtaggcaacgcatatagcagcttctacgatggatggtcacacttcacccaacgaggtgtctatgggttc

SEQ ID NO: 72324 - DNA, 75 bp, Artificial Sequence
  Synthetic
aaaaccaaattggaacccagtgtttttcaccaggtcttcgaaggcaacaaggaaccagccgtcctcagaaacggt

SEQ ID NO: 72325 - DNA, 75 bp, Artificial Sequence
  Synthetic
ttcaccaggtcttcgaaggcaacaaggaaccagccgtcctcagaaacggtgatccacgcctcaaggctaattttg

SEQ ID NO: 72326 - DNA, 75 bp, Artificial Sequence
  Synthetic
gcaaggatttactttaaaccaaagcatgtgcaagcatgggttccaagaccaccgcgcttgtgcaaatatatcaac

SEQ ID NO: 72327 - DNA, 75 bp, Artificial Sequence
  Synthetic
atgtgcaagcatgggttccaagaccaccgcgcttgtgcaaatatatcaacaggtacaatgtcaatttccacgtgg

SEQ ID NO: 72328 - DNA, 75 bp, Artificial Sequence
  Synthetic
actacgctggacaattggccactcttgatatcagcacagaaccaatgaaattggaggacgcggtgtacggaaccg

SEQ ID NO: 72329 - DNA, 75 bp, Artificial Sequence
  Synthetic
tgatatcagcacagaaccaatgaaattggaggacgcggtgtacggaaccgagggtcttgaagctctcgatttaac

SEQ ID NO: 72330 - DNA, 75 bp, Artificial Sequence
  Synthetic
cgggagcttttggtcaccaatctggagcggtctacgtgggcaattacaagatagtaaacagacacttggccaccc

SEQ ID NO: 72331 - DNA, 75 bp, Artificial Sequence
  Synthetic
agcggtctacgtgggcaattacaagatagtaaacagacacttggccacccacgacgattggcaaaactgtgtttg

SEQ ID NO: 72332 - DNA, 75 bp, Artificial Sequence
  Synthetic
gaccaaactaaaagagtgcatggataagtatggtttaaacctaccaatggtgacatatgtgaaggatgagctcag

SEQ ID NO: 72333 - DNA, 75 bp, Artificial Sequence
  Synthetic
aagtatggtttaaacctaccaatggtgacatatgtgaaggatgagctcagatccgcggagaaggtggcaaaagga

SEQ ID NO: 72334 - DNA, 75 bp, Artificial Sequence
  Synthetic
cacaaccggggtgtatttctgtgcatccaagaacaaacactacccagtatacctcgagggtcctggtctcgtgga

SEQ ID NO: 72335 - DNA, 75 bp, Artificial Sequence
  Synthetic
tccaagaacaaacactacccagtatacctcgagggtcctggtctcgtggaggtacaggagagtgaatactacccc

SEQ ID NO: 72336 - DNA, 75 bp, Artificial Sequence
  Synthetic
actttccatttgaatccagggattgtaactggcagtgcagttggatgtgatccagacctattctggagtaaaata

SEQ ID NO: 72337 - DNA, 75 bp, Artificial Sequence
  Synthetic
taactggcagtgcagttggatgtgatccagacctattctggagtaaaataccagtgttgttagacggacacctca

SEQ ID NO: 72338 - DNA, 75 bp, Artificial Sequence
  Synthetic
gagcatggagtcatcggcattgtcactatgggtggtgagggggttgtcggctttgccgacatacgagatctccta

SEQ ID NO: 72339 - DNA, 75 bp, Artificial Sequence
  Synthetic
ctatgggtggtgagggggttgtcggctttgccgacatacgagatctcctatggttggaagatgatgcaatggaac

SEQ ID NO: 72340 - DNA, 75 bp, Artificial Sequence
  Synthetic
agcttgggtacactcacaaagagaccaattatattgactatttgtgcaactcccatcacctgtatagggacaagc

SEQ ID NO: 72341 - DNA, 75 bp, Artificial Sequence
  Synthetic
caattatattgactatttgtgcaactcccatcacctgtatagggacaagcattactttgtgagaggtggcatgcc

SEQ ID NO: 72342 - DNA, 75 bp, Artificial Sequence
  Synthetic
tcaacctcctcaaggagtctctggttggacaagattccattttggagaagtcccttaaagctctagttaagatta

SEQ ID NO: 72343 - DNA, 75 bp, Artificial Sequence
  Synthetic
tggacaagattccattttggagaagtcccttaaagctctagttaagattatatcagcattggtcattgtggtgag

SEQ ID NO: 72344 - DNA, 75 bp, Artificial Sequence
  Synthetic
gtacaaggggattgatttggaccagttcagaatgatcgcttatggtgacgacgtgatcgcatcatacccatggcc

SEQ ID NO: 72345 - DNA, 75 bp, Artificial Sequence
  Synthetic
ttcagaatgatcgcttatggtgacgacgtgatcgcatcatacccatggcccatagacgcgtctctgctcgctgag

SEQ ID NO: 72346 - DNA, 75 bp, Artificial Sequence
  Synthetic
caaacagaaagtctcccaatattacggaatccccatggcggagagacagaataatggttggttgaagaagttcac

SEQ ID NO: 72347 - DNA, 75 bp, Artificial Sequence
  Synthetic
gttactttcctaaaaagatatttcagagcggatgagcagtatcccttcctagtgcaccctgttatgcctatgaaa

SEQ ID NO: 72348 - DNA, 75 bp, Artificial Sequence
  Synthetic
taaaattttgccagaagtcaaagagaagcatgagtttctgaacagactaaaacagctgccattgttagaaagcca

SEQ ID NO: 72349 - DNA, 75 bp, Artificial Sequence
  Synthetic
aagcatgagtttctgaacagactaaaacagctgccattgttagaaagccagattgccaccattgagcagagtgca

SEQ ID NO: 72350 - DNA, 75 bp, Artificial Sequence
  Synthetic
gcttggcacaatggagaacacgaatatgaggagtttatcaaaaaaatcagaagcgtcccagttgggcgttgcttg

SEQ ID NO: 72351 - DNA, 75 bp, Artificial Sequence
  Synthetic
ttgtatgctgctgaagctaaaagagtgttctccctagaaaagaaaatgagcaattacatacagttcaagtccaaa

SEQ ID NO: 72352 - DNA, 75 bp, Artificial Sequence
  Synthetic
tgttctccctagaaaagaaaatgagcaattacatacagttcaagtccaaatgtcgtattgaacctgtatgtcttt

SEQ ID NO: 72353 - DNA, 75 bp, Artificial Sequence
  Synthetic
acagctcagtttactcactaccacctgacccagatcactttgatggctataagcagcaagctgtcgtgatcatgg

SEQ ID NO: 72354 - DNA, 75 bp, Artificial Sequence
  Synthetic
tgacccagatcactttgatggctataagcagcaagctgtcgtgatcatggatgatttgtgccaaaacccagacgg

SEQ ID NO: 72355 - DNA, 75 bp, Artificial Sequence
  Synthetic
aggaattctctttacgtcgccatttgtcctcgcctctaccaatgcagggtcaattaatgcccccacagtgtcaga

SEQ ID NO: 72356 - DNA, 75 bp, Artificial Sequence
  Synthetic
gtcctcgcctctaccaatgcagggtcaattaatgcccccacagtgtcagacagcagagcgcttgccaggagattc

SEQ ID NO: 72357 - DNA, 75 bp, Artificial Sequence
  Synthetic
ctgacatggtgcgaagagtctattgagctaattggtagtcctccggcccctgaatgcggctaatcctaactgcgg

SEQ ID NO: 72358 - DNA, 75 bp, Artificial Sequence
  Synthetic
acctgtgacgaagaatgctgcccggtcaactttaaaaagtgttgtccactggtttgtggtaaggccatccaattt

SEQ ID NO: 72359 - DNA, 75 bp, Artificial Sequence
  Synthetic
tcaactttaaaaagtgttgtccactggtttgtggtaaggccatccaatttatagacaggagaactcaagtgagat

SEQ ID NO: 72360 - DNA, 75 bp, Artificial Sequence
  Synthetic
gctgcttatggtgacaattgagagattgttaccatatagctattggattggccatccagtgacaaacagagctat

SEQ ID NO: 72361 - DNA, 75 bp, Artificial Sequence
  Synthetic
cactcttccaaggcccaccggtatacagggagataaaaattagtgtcgccccagaaaccccccctccacccgcaa

SEQ ID NO: 72362 - DNA, 75 bp, Artificial Sequence
  Synthetic
cagggagataaaaattagtgtcgccccagaaaccccccctccacccgcaattgctgacttgctgaaatcggtgga

SEQ ID NO: 72363 - DNA, 75 bp, Artificial Sequence
  Synthetic
ccattaagccaaaaggtcttagccactctcaattatatactattgcttaatacaacgaaatgggagctcaggtgt

SEQ ID NO: 72364 - DNA, 75 bp, Artificial Sequence
  Synthetic
aaagcatgtgagcagagctttcatttgtctgcaagcactcacaaccttcgtctccgtggcaggaatcatatatat

SEQ ID NO: 72365 - DNA, 75 bp, Artificial Sequence
  Synthetic
tgtctgcaagcactcacaaccttcgtctccgtggcaggaatcatatatatcatctataaactgtttgcaggtttc

SEQ ID NO: 72366 - DNA, 75 bp, Artificial Sequence
  Synthetic
attactacaaggatgctgcatccaactccgcaaacaggcaagacttcacacaagacccaggtaagttcactgaac

SEQ ID NO: 72367 - DNA, 75 bp, Artificial Sequence
  Synthetic
tatgcctgcgttgaactcaccctctgctgaggaatgcggctacagtgacagagtgcgttccatcacattaggtaa

SEQ ID NO: 72368 - DNA, 75 bp, Artificial Sequence
  Synthetic
gcttttgaattcgcggtggccatgatgaagagaaatgccagtaccgtgaagaccgagtacggcgagttcacgatg

SEQ ID NO: 72369 - DNA, 75 bp, Artificial Sequence
  Synthetic
tgaagagaaatgccagtaccgtgaagaccgagtacggcgagttcacgatgcttgggatttacgacagatgggcag

SEQ ID NO: 72370 - DNA, 75 bp, Artificial Sequence
  Synthetic
cgaggctacagccgaggatcaacccacacaacctgacgtggccacctgccgcttctatactttagaatcagtgca

SEQ ID NO: 72371 - DNA, 75 bp, Artificial Sequence
  Synthetic
agctagttgacaaagatggtaccaaccttgaactgacactcctgaaactcaacagaaatgagaagtttagggaca

SEQ ID NO: 72372 - DNA, 75 bp, Artificial Sequence
  Synthetic
ccttgaactgacactcctgaaactcaacagaaatgagaagtttagggacattcggggcttcctggcgagggaaga

SEQ ID NO: 72373 - DNA, 75 bp, Artificial Sequence
  Synthetic
tggtggaagctgcctgatgcactgtcgcagatgggcttgtttggtcaaaacatgcaataccactacttaggaaga

SEQ ID NO: 72374 - DNA, 75 bp, Artificial Sequence
  Synthetic
aacagactatggcttcctcaacctgggtggcacccccaccaagcgcatgctaatgtacaacttccccactcgtgc

SEQ ID NO: 72375 - DNA, 75 bp, Artificial Sequence
  Synthetic
gcaatgcctcaaagttccatcaaggttgtctgcttgtggtgtgtgtgcctgaggctgagatggggtgctctaact

SEQ ID NO: 72376 - DNA, 75 bp, Artificial Sequence
  Synthetic
ggtggcacccccaccaagcgcatgctaatgtacaacttccccactcgtgcagggcagtgtggtggcgtcctaatg

SEQ ID NO: 72377 - DNA, 75 bp, Artificial Sequence
  Synthetic
agtcaaacgccaagaaagtacagacagcggtgtggaacgccggaatgggcgttggagtgggtaatctcactattt

SEQ ID NO: 72378 - DNA, 75 bp, Artificial Sequence
  Synthetic
tacttcaatgatgagcagggtgaaattgaattcattgaaagctccaaggaagctggcttcccagtcattaacact

SEQ ID NO: 72379 - DNA, 75 bp, Artificial Sequence
  Synthetic
ttgaattcattgaaagctccaaggaagctggcttcccagtcattaacactcccagcaaaacaaaactcgaaccca

SEQ ID NO: 72380 - DNA, 75 bp, Artificial Sequence
  Synthetic
gaccaacaacagtgcaacgctggtgatgccttacataaacagcgtccccatggacaacatgttcaggcacaataa

SEQ ID NO: 72381 - DNA, 75 bp, Artificial Sequence
  Synthetic
atgccttacataaacagcgtccccatggacaacatgttcaggcacaataacttaacactaatgattatcccattc

SEQ ID NO: 72382 - DNA, 75 bp, Artificial Sequence
  Synthetic
actttgaggaagccatattctccaaatacatcggaaacgtgaacactcacgtggatgagtacatgatggaggctg

SEQ ID NO: 72383 - DNA, 75 bp, Artificial Sequence
  Synthetic
atacatcggaaacgtgaacactcacgtggatgagtacatgatggaggctgtcgatcactatgcggggcaactggc

SEQ ID NO: 72384 - DNA, 75 bp, Artificial Sequence
  Synthetic
tacaacgggctacggctggccagcaaccagggtctaccagttatgacaacacctgggagcacacaatttctaact

SEQ ID NO: 72385 - DNA, 75 bp, Artificial Sequence
  Synthetic
accagggtctaccagttatgacaacacctgggagcacacaatttctaacttcagatgacttccagtcaccgtcag

SEQ ID NO: 72386 - DNA, 75 bp, Artificial Sequence
  Synthetic
tctaaccacaagtgcggggtacccctacgtggccctcgggatcaagaagagggatatcctatccaaaaagaccaa

SEQ ID NO: 72387 - DNA, 75 bp, Artificial Sequence
  Synthetic
tggactcagtggtgcctgtgaataacacagaggacaacgtgagtagccttaaggcataccagattccagtacagt

SEQ ID NO: 72388 - DNA, 75 bp, Artificial Sequence
  Synthetic
actgagatcagcagagaaggtggccaagggcaaatccagacttattgaggcgtcgagtctgaatgactcagtggc

SEQ ID NO: 72389 - DNA, 75 bp, Artificial Sequence
  Synthetic
ttttggttttcccttacagccgggagccaataacgtgctgaatagaaccctcttgggtgaaatcctaaactatta

SEQ ID NO: 72390 - DNA, 75 bp, Artificial Sequence
  Synthetic
aagggcaaatccagacttattgaggcgtcgagtctgaatgactcagtggccatgagacagacttttgggaacctg

SEQ ID NO: 72391 - DNA, 75 bp, Artificial Sequence
  Synthetic
ggcatactcaccacctggagcaggagtcccgaaaaaccgaaaagatgccatgctgggcacccacgtcatatggga

SEQ ID NO: 72392 - DNA, 75 bp, Artificial Sequence
  Synthetic
ttgtgcgtaccgtggattagccaaacacactacagatacgtggttgaggatgaatacacagcagccggatatgtt

SEQ ID NO: 72393 - DNA, 75 bp, Artificial Sequence
  Synthetic
tgcaattcccatcatctgtacagagacaaacactactttgtgagaggagggatgccatctgggtgttctggaact

SEQ ID NO: 72394 - DNA, 75 bp, Artificial Sequence
  Synthetic
acatgctggtaccaaacaaatatcgtggtgccagctgatgtgcaaagctcatgtgacatcttgtgctttgtttca

SEQ ID NO: 72395 - DNA, 75 bp, Artificial Sequence
  Synthetic
tggtgccagctgatgtgcaaagctcatgtgacatcttgtgctttgtttcagcttgcaatgatttctctgtgcgga

SEQ ID NO: 72396 - DNA, 75 bp, Artificial Sequence
  Synthetic
gatcaattcaggatgatagcatacggggatgatgtcatcgcgtcatacccgcatcccatcgatgcatcactgttg

SEQ ID NO: 72397 - DNA, 75 bp, Artificial Sequence
  Synthetic
gggatgatgtcatcgcgtcatacccgcatcccatcgatgcatcactgttggctgaggccggcaaaggatatggct

SEQ ID NO: 72398 - DNA, 75 bp, Artificial Sequence
  Synthetic
tggcacgtgtggcggacacgattagttcacggcccactaactcggagtcaattccagcgctcaccgctgccgaga

SEQ ID NO: 72399 - DNA, 75 bp, Artificial Sequence
  Synthetic
attttagggcagacgaacaatacccttttcttgtccatccagtaatgccaatgaaagacatccatgaatctatca

SEQ ID NO: 72400 - DNA, 75 bp, Artificial Sequence
  Synthetic
gtgaaaaactaccactcacggtccgaatcgtccattgaaaatttcctgtgccggtctgcctgtgtatactatgcc

SEQ ID NO: 72401 - DNA, 75 bp, Artificial Sequence
  Synthetic
ctattggcctggcacaatggagagcatgaatacgaagaatttgtgtctaagatcagaagtgtcccggtagggcgc

SEQ ID NO: 72402 - DNA, 75 bp, Artificial Sequence
  Synthetic
aagttggaactcttcacatatctaaggtttgacttagaactaacatttgttataacgagtgcacaacaacccagt

SEQ ID NO: 72403 - DNA, 75 bp, Artificial Sequence
  Synthetic
ttaattccaattggcttaaccctaccacactcaccgaactagacaacggtgtggtaggggtaaattctccgcatt

SEQ ID NO: 72404 - DNA, 75 bp, Artificial Sequence
  Synthetic
aaggttaaagattatgcatggcaaacctccacaaaccccagcgttttctggacagaaggaaacgccccaccaagg

SEQ ID NO: 72405 - DNA, 75 bp, Artificial Sequence
  Synthetic
cctccacaaaccccagcgttttctggacagaaggaaacgccccaccaaggatgtccatcccattcattagcattg

SEQ ID NO: 72406 - DNA, 75 bp, Artificial Sequence
  Synthetic
tgtttccccggaccgagtatcaataggctgctcacgcggctgaaggagaaagtgttcgttacccggccaattact

SEQ ID NO: 72407 - DNA, 75 bp, Artificial Sequence
  Synthetic
acaacatgggcacattgtatatgaggcatgtcaatgaagcggggcagggtccaattaaaagtactgttagaatat

SEQ ID NO: 72408 - DNA, 75 bp, Artificial Sequence
  Synthetic
ccaattaaaagtactgttagaatatatttcaaacccaagcacgtgaaggcgtgggtaccacgtccgccaagattg

SEQ ID NO: 72409 - DNA, 75 bp, Artificial Sequence
  Synthetic
acaggcacttttggtcagcagtccggagcaatatacgtgggcaattacaggatagtcaataggcacctggcaaca

SEQ ID NO: 72410 - DNA, 75 bp, Artificial Sequence
  Synthetic
gggaggattacaacagggacctcctggtatgcactacaacggcgcacggttgtgacaatattgcaaggtgccagt

SEQ ID NO: 72411 - DNA, 75 bp, Artificial Sequence
  Synthetic
tgggtgtccgtgtttccttttatttttatgctggctgcttatggtgacaattgaggaattgttaccatatagcta

SEQ ID NO: 72412 - DNA, 75 bp, Artificial Sequence
  Synthetic
gggattgtggtggcattctcaggtgtgaacatggtgttataggcatcgtgaccatgggtggtgagggtattgttg

SEQ ID NO: 72413 - DNA, 75 bp, Artificial Sequence
  Synthetic
actcagcacacttaattacattataactctcaacacaacaagatgggtgctcaagtctcaacacagaagacagga

SEQ ID NO: 72414 - DNA, 75 bp, Artificial Sequence
  Synthetic
actctcaacacaacaagatgggtgctcaagtctcaacacagaagacaggagcacacgaaaccagtctgaatgcca

SEQ ID NO: 72415 - DNA, 75 bp, Artificial Sequence
  Synthetic
agcttggaaacgcctttggttctgggtttaccaaccagatttgcgagcaagtcaatctgttaaaagagtcactaa

SEQ ID NO: 72416 - DNA, 75 bp, Artificial Sequence
  Synthetic
atttcacacaagaccctagcaagtttactgaacctatgaaagacatcatgatcaaatccttacctgctctaaatt

SEQ ID NO: 72417 - DNA, 75 bp, Artificial Sequence
  Synthetic
tactgaacctatgaaagacatcatgatcaaatccttacctgctctaaattctcccacagtggaggagtgcgggtt

SEQ ID NO: 72418 - DNA, 75 bp, Artificial Sequence
  Synthetic
gaaaccacgatgacctcataacagtcactgctaccttagccctgattggctgtaccacttcaccgtggcggtggc

SEQ ID NO: 72419 - DNA, 75 bp, Artificial Sequence
  Synthetic
gtacggagtgtggcccacttatttatctgatgacgaggccactgcggaggatcagccaacacaaccagatgtagc

SEQ ID NO: 72420 - DNA, 75 bp, Artificial Sequence
  Synthetic
tgtaccacttcaccgtggcggtggctaaagaaaaaagtatctcaatactacgggattcccatggctgagagacag

SEQ ID NO: 72421 - DNA, 75 bp, Artificial Sequence
  Synthetic
tctgatgacgaggccactgcggaggatcagccaacacaaccagatgtagcaacatgcaggttctacacattagac

SEQ ID NO: 72422 - DNA, 75 bp, Artificial Sequence
  Synthetic
caaaagttcattgagtggctcaaaattaagatcttgccagaagttaaggaaaaacacgagtttcttaccagactt

SEQ ID NO: 72423 - DNA, 75 bp, Artificial Sequence
  Synthetic
ggccagaacatgatgtaccactatcttggcagagctggatacacgatacacgtgcagtgcaatgcatctaaattc

SEQ ID NO: 72424 - DNA, 75 bp, Artificial Sequence
  Synthetic
ttggcagagctggatacacgatacacgtgcagtgcaatgcatctaaattccatcagggttgtttactcgtcgtgt

SEQ ID NO: 72425 - DNA, 75 bp, Artificial Sequence
  Synthetic
aaattgctaccattgagcagagtgcaccatcacagagtgatcaggaacaactgttctccaatgtacagtattttg

SEQ ID NO: 72426 - DNA, 75 bp, Artificial Sequence
  Synthetic
aagcctacgagttcaccgaaggcaatgcaaacggtgaacacgatgtgcagacagctgtccacaacgctggcatgg

SEQ ID NO: 72427 - DNA, 75 bp, Artificial Sequence
  Synthetic
tgcaaacggtgaacacgatgtgcagacagctgtccacaacgctggcatgggcgttggtgtaggcaacctgacaat

SEQ ID NO: 72428 - DNA, 75 bp, Artificial Sequence
  Synthetic
gcaactacatacagttcaagtccaaatgccgtattgaaccagtctgtttattgctccatggtagccctggagccg

SEQ ID NO: 72429 - DNA, 75 bp, Artificial Sequence
  Synthetic
tggacgctcacttgcagagaagctcaacagttcagtatattcattgccaccagacccagaccatttcgacggcta

SEQ ID NO: 72430 - DNA, 75 bp, Artificial Sequence
  Synthetic
aatggaaaacatgttcaggcattacaatttcacgttgatggtcatcccattcgtcaagctggattacacggatca

SEQ ID NO: 72431 - DNA, 75 bp, Artificial Sequence
  Synthetic
aatttcacgttgatggtcatcccattcgtcaagctggattacacggatcaggctactacgtatgtgcctatcaca

SEQ ID NO: 72432 - DNA, 75 bp, Artificial Sequence
  Synthetic
taaacaacaagctgtcgtaatcatggatgacctgtgccagaacccagatgggaaagacgtatccttgttctgcca

SEQ ID NO: 72433 - DNA, 75 bp, Artificial Sequence
  Synthetic
actcctggaagcaaccagttcctcacatcggatgacttccaatcgccatcggccctgccacaatttgacgtaacg

SEQ ID NO: 72434 - DNA, 75 bp, Artificial Sequence
  Synthetic
catcggatgacttccaatcgccatcggccctgccacaatttgacgtaacgcccccacttaacatcccgggagagg

SEQ ID NO: 72435 - DNA, 75 bp, Artificial Sequence
  Synthetic
aaattaacatgccaatgtcagtgaaaacttgcgatgaggagtgttgcccggtcaactttaagaagtgttgtccgt

SEQ ID NO: 72436 - DNA, 75 bp, Artificial Sequence
  Synthetic
tggacatgtaccgaattcccgtttcaaacacggcagacctacagcagcaggtgtttggcattcgcttgcaaccag

SEQ ID NO: 72437 - DNA, 75 bp, Artificial Sequence
  Synthetic
aaacacggcagacctacagcagcaggtgtttggcattcgcttgcaaccagggttggacaatgttttaaagagaac

SEQ ID NO: 72438 - DNA, 75 bp, Artificial Sequence
  Synthetic
agatgtttagagaatacaaccacaggcacagcgtgggggcaacactcgaggcacttttccaaggcccacccgtgt

SEQ ID NO: 72439 - DNA, 75 bp, Artificial Sequence
  Synthetic
tgctatggcgactggaaaattcctgatagcctactcaccaccaggtgctaacccccctaccaacaggaaagatgc

SEQ ID NO: 72440 - DNA, 75 bp, Artificial Sequence
  Synthetic
atagcctactcaccaccaggtgctaacccccctaccaacaggaaagatgctatgcttggtactcacattgtatgg

SEQ ID NO: 72441 - DNA, 75 bp, Artificial Sequence
  Synthetic
gatgagtacaccagcgcgggtttcataacatgctggtaccaaacaggcatgatagttccccctggtaccccaaca

SEQ ID NO: 72442 - DNA, 75 bp, Artificial Sequence
  Synthetic
taacatgctggtaccaaacaggcatgatagttccccctggtaccccaacatcatgttccatcatgtgctttgtgt

SEQ ID NO: 72443 - DNA, 75 bp, Artificial Sequence
  Synthetic
taagacaggctaaggttcaagggccagcttttgagtttgcggtggccatgatgaagagaaacgccagtactgtaa

SEQ ID NO: 72444 - DNA, 75 bp, Artificial Sequence
  Synthetic
atgaagataaagggagggcgaacctggtgactgtcgcagacacgattagtcgtggaccaagtaactctgagagag

SEQ ID NO: 72445 - DNA, 75 bp, Artificial Sequence
  Synthetic
atgaagagaaacgccagtactgtaaaaaccgagtacggcgagttcacaatgcttggcatctatgacaggtgggca

SEQ ID NO: 72446 - DNA, 75 bp, Artificial Sequence
  Synthetic
agcttttgagtttgcggtggccatgatgaagagaaacgccagtactgtaaaaaccgagtacggcgagttcacaat

SEQ ID NO: 72447 - DNA, 75 bp, Artificial Sequence
  Synthetic
ggtgactgtcgcagacacgattagtcgtggaccaagtaactctgagagagtgccagcgctgacagcagctgaaac

SEQ ID NO: 72448 - DNA, 75 bp, Artificial Sequence
  Synthetic
gtcctcaattgagaatttcctatgcagagcggcctgtgtatacatggcagagtacaaaacaacctccgacacaga

SEQ ID NO: 72449 - DNA, 75 bp, Artificial Sequence
  Synthetic
atttggaactaacactcctgaaactcaatagaaatgagaaattcagagacattcgaggtttcctaacgcgagaag

SEQ ID NO: 72450 - DNA, 75 bp, Artificial Sequence
  Synthetic
agagcggcctgtgtatacatggcagagtacaaaacaacctccgacacagaatccaagaagtatgtggcgtggaag

SEQ ID NO: 72451 - DNA, 75 bp, Artificial Sequence
  Synthetic
actctcgtgatcactagtcgtcaggaccaaggcaccagattggaccaggatatgccagtgctaacacaccaaata

SEQ ID NO: 72452 - DNA, 75 bp, Artificial Sequence
  Synthetic
accaaggcaccagattggaccaggatatgccagtgctaacacaccaaataatgtacatcccaccagggggcccga

SEQ ID NO: 72453 - DNA, 75 bp, Artificial Sequence
  Synthetic
ggttctcagcagccctgctacgtcactatttcaacgatgagcagggtgagattgagttcatcgagagttccaagg

SEQ ID NO: 72454 - DNA, 75 bp, Artificial Sequence
  Synthetic
cagcacgaatgtccatcccctttgtgagtataggcaacgcctacagtagcttttatgatgggtggtctcacttca

SEQ ID NO: 72455 - DNA, 75 bp, Artificial Sequence
  Synthetic
gagtataggcaacgcctacagtagcttttatgatgggtggtctcacttcaatcaacaaggatcatatggatacaa

SEQ ID NO: 72456 - DNA, 75 bp, Artificial Sequence
  Synthetic
aactttgaggaggccatcttttcaaagtacattggcaatgtcaacacccatgtggatgagtacatgcaggaagcc

SEQ ID NO: 72457 - DNA, 75 bp, Artificial Sequence
  Synthetic
gcgggtgtacttcaaacccaaacacgtgcgcgcttgggtacctcggccaccacgcttgtgtgagtataagaaacc

SEQ ID NO: 72458 - DNA, 75 bp, Artificial Sequence
  Synthetic
gtgcgcgcttgggtacctcggccaccacgcttgtgtgagtataagaaaccattcagtgttgatttcacaccagag

SEQ ID NO: 72459 - DNA, 75 bp, Artificial Sequence
  Synthetic
gggcaacaatcaggggcagtttacgtgggtaactacaggctggtaaacagacacctggcaacacataatgattgg

SEQ ID NO: 72460 - DNA, 75 bp, Artificial Sequence
  Synthetic
tgggtaactacaggctggtaaacagacacctggcaacacataatgattggcaaaactgtgtgtgggaagactaca

SEQ ID NO: 72461 - DNA, 75 bp, Artificial Sequence
  Synthetic
tgtacttttgccaatctaggaacaagcactacccagtcagcttcgagggtccaggcttagtggaggttcaggaaa

SEQ ID NO: 72462 - DNA, 75 bp, Artificial Sequence
  Synthetic
gcatccagcttaaacgactcagtggcaatgagacagactttcggcaacctgtacaaaacattccatctgaacccg

SEQ ID NO: 72463 - DNA, 75 bp, Artificial Sequence
  Synthetic
caatgagacagactttcggcaacctgtacaaaacattccatctgaacccgggcatagtgactggcagtgcagttg

SEQ ID NO: 72464 - DNA, 75 bp, Artificial Sequence
  Synthetic
gcactacccagtcagcttcgagggtccaggcttagtggaggttcaggaaagtgagtattaccccaaaagatacca

SEQ ID NO: 72465 - DNA, 75 bp, Artificial Sequence
  Synthetic
cattggcattgtgaccatgggaggtgagggcgtcgtcggttttgcagacgtgcgcgacctcttgtggttggagga

SEQ ID NO: 72466 - DNA, 75 bp, Artificial Sequence
  Synthetic
gagggcgtcgtcggttttgcagacgtgcgcgacctcttgtggttggaggatgacgcaatggagcaaggtgtgagg

SEQ ID NO: 72467 - DNA, 75 bp, Artificial Sequence
  Synthetic
aaggagacactaattggtcaagattccatcttagaaaagtctttgaaagccttagttaagattatatcagcattg

SEQ ID NO: 72468 - DNA, 75 bp, Artificial Sequence
  Synthetic
cagcatttttaattcaatgattaacaacataattattagaacactgatgctgaaggtgtacaaagggatagattt

SEQ ID NO: 72469 - DNA, 75 bp, Artificial Sequence
  Synthetic
ccatcttagaaaagtctttgaaagccttagttaagattatatcagcattggtcattgtggtgaggaaccacgatg

SEQ ID NO: 72470 - DNA, 75 bp, Artificial Sequence
  Synthetic
aacataattattagaacactgatgctgaaggtgtacaaagggatagatttggatcaatttaggatgattgcatat

SEQ ID NO: 72471 - DNA, 75 bp, Artificial Sequence
  Synthetic
cacacccaattgacgcctcactgctggctgaagccggtaaggggtatggtctgatcatgacaccagcagacaagg

SEQ ID NO: 72472 - DNA, 75 bp, Artificial Sequence
  Synthetic
tgtcccagtactatggaatccctatggttgagagacaaaacaatggatggctcaagaaattcacggaaatgacta

SEQ ID NO: 72473 - DNA, 75 bp, Artificial Sequence
  Synthetic
ggttgagagacaaaacaatggatggctcaagaaattcacggaaatgactaacgcctgtaagggcatggagtggat

SEQ ID NO: 72474 - DNA, 75 bp, Artificial Sequence
  Synthetic
cctcaacagactaaaacagctgccattgttagagagccagatagccactatcgaacagagtgcgccttcacagag

SEQ ID NO: 72475 - DNA, 75 bp, Artificial Sequence
  Synthetic
ctcaagatcacgtgcgatccttgtgcttattggcctggcacaatggagagcaagaatatgaggaattcgtgtcca

SEQ ID NO: 72476 - DNA, 75 bp, Artificial Sequence
  Synthetic
ttgttagagagccagatagccactatcgaacagagtgcgccttcacagagcgatcaggagcagctgttttccaat

SEQ ID NO: 72477 - DNA, 75 bp, Artificial Sequence
  Synthetic
agttcaagtccaaatgccgtattgaacctgtctgtcttttgctccacgggagccccggtgctggtaagtctgtag

SEQ ID NO: 72478 - DNA, 75 bp, Artificial Sequence
  Synthetic
cacccacagggcccaatgggcgctagcacactggtatcacggtacctttgtgcgcctgttttatccacccctccc

SEQ ID NO: 72479 - DNA, 75 bp, Artificial Sequence
  Synthetic
actttgacggttacaaacagcaagccgttgtgatcatggacgacttgtgtcaaaatccggacggcaaggacgtgt

SEQ ID NO: 72480 - DNA, 75 bp, Artificial Sequence
  Synthetic
accaactgggccgtgaccaagcacttctgtgaccccggaccgagtatcaataagctactcacgtggctgaaggag

SEQ ID NO: 72481 - DNA, 75 bp, Artificial Sequence
  Synthetic
cgttgtgatcatggacgacttgtgtcaaaatccggacggcaaggacgtgtccttgttttgccagatggtgtcgag

SEQ ID NO: 72482 - DNA, 75 bp, Artificial Sequence
  Synthetic
aaccaatgccggctccatcaatgctccaactgtgtcagatagtagagcgcttgcaaggagattccactttgacat

SEQ ID NO: 72483 - DNA, 75 bp, Artificial Sequence
  Synthetic
ccaactgtgtcagatagtagagcgcttgcaaggagattccactttgacatgaacatcgaagtcatctcaatgtac

SEQ ID NO: 72484 - DNA, 75 bp, Artificial Sequence
  Synthetic
aagtgctgcccactggtgtgtggcaaagccatccaattcatcgatagaaggacacaggtgaggtactcgttagac

SEQ ID NO: 72485 - DNA, 75 bp, Artificial Sequence
  Synthetic
aagccatccaattcatcgatagaaggacacaggtgaggtactcgttagacatgctagtcactgagatgttcagag

SEQ ID NO: 72486 - DNA, 75 bp, Artificial Sequence
  Synthetic
attggattggccatccggtgtctaatagagcaattatctacctttttgttggatttattccacttgactataaag

SEQ ID NO: 72487 - DNA, 75 bp, Artificial Sequence
  Synthetic
aaatcagcgttgcaccagagaccccccccccacccgcaatagcggatctgctgaagtctgtggacagtgaagcag

SEQ ID NO: 72488 - DNA, 75 bp, Artificial Sequence
  Synthetic
ccccccacccgcaatagcggatctgctgaagtctgtggacagtgaagcagttagagagtactgcaaggaaaaggg

SEQ ID NO: 72489 - DNA, 75 bp, Artificial Sequence
  Synthetic
actcaccacatttgtctcagtggcaggaataatatacatcatttacaaattgtttgctggctttcaaggggcgta

SEQ ID NO: 72490 - DNA, 75 bp, Artificial Sequence
  Synthetic
ggaataatatacatcatttacaaattgtttgctggctttcaaggggcgtacactggaatgcctaaccaaaaaccc

SEQ ID NO: 72491 - DNA, 75 bp, Artificial Sequence
  Synthetic
tcacagagccggtaaaggatgtaatgatcaagaccttgcccgccctgaactcgcctactgtagaagaatgtggct

SEQ ID NO: 72492 - DNA, 75 bp, Artificial Sequence
  Synthetic
ttagtgatcgagtgcgctcaatcaccttgggaaactccacgatcaccacacaggaatgtgcaaatgtggttgtgg

SEQ ID NO: 72493 - DNA, 75 bp, Artificial Sequence
  Synthetic
gccagtactgtgaagactgagtacggtgaatttactatgcttggaatctacgacagatgggcggtgctaccccgt

SEQ ID NO: 72494 - DNA, 75 bp, Artificial Sequence
  Synthetic
gtgaatttactatgcttggaatctacgacagatgggcggtgctaccccgtcacgccaaacctgggcccaccatcc

SEQ ID NO: 72495 - DNA, 75 bp, Artificial Sequence
  Synthetic
gtcagtgaaatgggagagctcatcggcggggtggtggtggaagttcccagaagcccttagtgacatgggattgtt

SEQ ID NO: 72496 - DNA, 75 bp, Artificial Sequence
  Synthetic
cacttctaaaactcaatagaaatgagaagtttagagacatccggggcttcttggcaagagaagaggccgaggtca

SEQ ID NO: 72497 - DNA, 75 bp, Artificial Sequence
  Synthetic
gaagtttagagacatccggggcttcttggcaagagaagaggccgaggtcaatgaggctgttcttgcaatcaacac

SEQ ID NO: 72498 - DNA, 75 bp, Artificial Sequence
  Synthetic
caccaagcgtatgctgatgtacaactttcccacccgcgcaggacaatgtggtggtgtcctaatgtcaactggaaa

SEQ ID NO: 72499 - DNA, 75 bp, Artificial Sequence
  Synthetic
tttcccacccgcgcaggacaatgtggtggtgtcctaatgtcaactggaaaggttctcggaatacacgttggtgga

SEQ ID NO: 72500 - DNA, 75 bp, Artificial Sequence
  Synthetic
aaccgcagttcataacgcgggcatgggcgtagccgtggggaacttaacaatatttccccaccaatggatcaacct

SEQ ID NO: 72501 - DNA, 75 bp, Artificial Sequence
  Synthetic
gtgatgccctacataaatagcgtacctatggacaacatgtacaggcattataactttaccctaatggtgatccca

SEQ ID NO: 72502 - DNA, 75 bp, Artificial Sequence
  Synthetic
gagagctccaaggaagctggcttcccagtcattaacactcccagtaaaacaaagcttgagcccagtgtctttcat

SEQ ID NO: 72503 - DNA, 75 bp, Artificial Sequence
  Synthetic
gcgatcttctccaaatatattggaaatgtgaacacacatgtggatgagtacatgatggaagctgtcgaccattac

SEQ ID NO: 72504 - DNA, 75 bp, Artificial Sequence
  Synthetic
gtcaccagggtctgccaacaatgaatactccaggaagcacacaattcttgacatcagatgatttccagtccccat

SEQ ID NO: 72505 - DNA, 75 bp, Artificial Sequence
  Synthetic
tactccaggaagcacacaattcttgacatcagatgatttccagtccccatccgcaatgccgcaatttgacgtcac

SEQ ID NO: 72506 - DNA, 75 bp, Artificial Sequence
  Synthetic
ttggaagcactggacctgaccactagtgcagggtacccctacgttgcccttggcatcaaaaagagagatatctta

SEQ ID NO: 72507 - DNA, 75 bp, Artificial Sequence
  Synthetic
tatgtgaaggatgagttgaggtcagcagaaaaagtggccaaaggtaagtccaggttaattgaagcatcgagtctg

SEQ ID NO: 72508 - DNA, 75 bp, Artificial Sequence
  Synthetic
cagaaaaagtggccaaaggtaagtccaggttaattgaagcatcgagtctgaatgattcagtggctatgaggcaga

SEQ ID NO: 72509 - DNA, 75 bp, Artificial Sequence
  Synthetic
ctacgccaactggtcaggaagcatgaagctaacctttatgtactgtggtgcagcaatggcaaccggtaagttcct

SEQ ID NO: 72510 - DNA, 75 bp, Artificial Sequence
  Synthetic
cagcaatggcaaccggtaagttcctcatagcttattcaccaccaggggccggtgttcccgggagtaggaaggatg

SEQ ID NO: 72511 - DNA, 75 bp, Artificial Sequence
  Synthetic
atctattctggagtaagatcccagtcatgcttgacggccatcttattgcttttgactacagtggatatgatgcca

SEQ ID NO: 72512 - DNA, 75 bp, Artificial Sequence
  Synthetic
catgcttgacggccatcttattgcttttgactacagtggatatgatgccagtttgagcccagtgtggtttgcttg

SEQ ID NO: 72513 - DNA, 75 bp, Artificial Sequence
  Synthetic
tgatgcctacaccgatgcaggctacatcacttgctggtaccagacaagcattgtgacaccaccagacatacccac

SEQ ID NO: 72514 - DNA, 75 bp, Artificial Sequence
  Synthetic
ccacctgtacagagataaacattactttgtgagagggggaatgccatctggatgctcagggactagcatcttcaa

SEQ ID NO: 72515 - DNA, 75 bp, Artificial Sequence
  Synthetic
tccgcgtgtaacgacttctctgtgcggttactgcgtgatacaccatttataacgcaacaagccttgtatcaaaat

SEQ ID NO: 72516 - DNA, 75 bp, Artificial Sequence
  Synthetic
tttgtgagagggggaatgccatctggatgctcagggactagcatcttcaactcaatgatcaacaacattattatc

SEQ ID NO: 72517 - DNA, 75 bp, Artificial Sequence
  Synthetic
attgcatcatacccacatcccattgatgcctcactgctagctgaagccggcaggggatatggcctgatcatgaca

SEQ ID NO: 72518 - DNA, 75 bp, Artificial Sequence
  Synthetic
agacaggacacacatcacaagtagtaccgagtgacacaatgcaaacacgacacgtgatcaattaccacaccagat

SEQ ID NO: 72519 - DNA, 75 bp, Artificial Sequence
  Synthetic
atgcctcactgctagctgaagccggcaggggatatggcctgatcatgacaccagctgacaaaggagaatgcttta

SEQ ID NO: 72520 - DNA, 75 bp, Artificial Sequence
  Synthetic
atgatgagttggacaggtacactaactgggagataacaaccaggcaagtggcgcaactaaggcgcaagctggaaa

SEQ ID NO: 72521 - DNA, 75 bp, Artificial Sequence
  Synthetic
acccagtaatgccaatgaaagacatccatgaatctatcagatggactaaagatcctaagaacactcaggatcatg

SEQ ID NO: 72522 - DNA, 75 bp, Artificial Sequence
  Synthetic
ctgggagataacaaccaggcaagtggcgcaactaaggcgcaagctggaaatgttcacatacatgagatttgacct

SEQ ID NO: 72523 - DNA, 75 bp, Artificial Sequence
  Synthetic
gcacaatggagagcaagagtatgaagaatttgtgtccaagatcaggagtgtcccggtagggcgctgtttgaccct

SEQ ID NO: 72524 - DNA, 75 bp, Artificial Sequence
  Synthetic
cccaagcgtattctggacggagggtaatgccccccccaggatgtcaataccattcatgagcgttggtaacgcgta

SEQ ID NO: 72525 - DNA, 75 bp, Artificial Sequence
  Synthetic
cctgtgggttgatcccacccacagggcccattgggcgctagcacactggtatcacggtacctttgtgcgcctgtt

SEQ ID NO: 72526 - DNA, 75 bp, Artificial Sequence
  Synthetic
cacttcagtcaaagcggcgtctacgggtataccaccttgaacaacatggggcacttatactttagacatgtaaac

SEQ ID NO: 72527 - DNA, 75 bp, Artificial Sequence
  Synthetic
ggtataccaccttgaacaacatggggcacttatactttagacatgtaaacaaatcgaccgcttacccagtcaaca

SEQ ID NO: 72528 - DNA, 75 bp, Artificial Sequence
  Synthetic
tgtacgcaaggaatgtcaactttgatgtgcaaggggtaaccgagtctcgggataaaattacccttgaccggtcaa

SEQ ID NO: 72529 - DNA, 75 bp, Artificial Sequence
  Synthetic
gataaaattacccttgaccggtcaacccacaatcccttaacaaacactggtgtttttggccaacaatcaggagca

SEQ ID NO: 72530 - DNA, 75 bp, Artificial Sequence
  Synthetic
gactacaatagagacttgctagtcagcaccaccacagcccatggatgtgatgtcattgccagatgccagtgttcc

SEQ ID NO: 72531 - DNA, 75 bp, Artificial Sequence
  Synthetic
ggaataaacactacccagtatcatttgaagggcccgggcttgttgaggtgcaggagagtgagtattacccaaaaa

SEQ ID NO: 72532 - DNA, 75 bp, Artificial Sequence
  Synthetic
aattatctacctgtttattggctttatacctctcaattacaaggttataaatactcttaacttcattttaatgct

SEQ ID NO: 72533 - DNA, 75 bp, Artificial Sequence
  Synthetic
atacctctcaattacaaggttataaatactcttaacttcattttaatgcttaacacagcaaaatgggggctcaag

SEQ ID NO: 72534 - DNA, 75 bp, Artificial Sequence
  Synthetic
tagaagatgatgctatggagcagggtgtgaaagactatgtcgagcaactcggcaatgcctttggctcaggattca

SEQ ID NO: 72535 - DNA, 75 bp, Artificial Sequence
  Synthetic
tgtgaaagactatgtcgagcaactcggcaatgcctttggctcaggattcactaaccaaatctgtgagcaggtcaa

SEQ ID NO: 72536 - DNA, 75 bp, Artificial Sequence
  Synthetic
tcaattattacaaggatgccgcttccaactcagcaaacaggcaagacttcacacaggacccaggcaagtttactg

SEQ ID NO: 72537 - DNA, 75 bp, Artificial Sequence
  Synthetic
ggcaatgcctttggctcaggattcactaaccaaatctgtgagcaggtcaatctcctcaaagagtcactagttggc

SEQ ID NO: 72538 - DNA, 75 bp, Artificial Sequence
  Synthetic
tctgccgaggagtgcggttacagtgacagagtccgttccattaccctaggtaactccactattaccactcaggag

SEQ ID NO: 72539 - DNA, 75 bp, Artificial Sequence
  Synthetic
cacgatgacctagtaacagtgaccgccactcttgcccttgttgggtgcacgtcgtcaccatggcgttggctcaaa

SEQ ID NO: 72540 - DNA, 75 bp, Artificial Sequence
  Synthetic
tacccatggctgaacgccaaaacaacgggtggctcaagaaattcacagagatgaccaatgcctgcaaaggaatgg

SEQ ID NO: 72541 - DNA, 75 bp, Artificial Sequence
  Synthetic
gtcgtttttacactctggaatctgtacaatggatgaaaaattcagccggatggtggtggaagctgcctgacgcat

SEQ ID NO: 72542 - DNA, 75 bp, Artificial Sequence
  Synthetic
aatgtaacgcctcaaaattccatcaagggtgcttacttgttgtgtgtgtaccagaggcagagatgggatgttcca

SEQ ID NO: 72543 - DNA, 75 bp, Artificial Sequence
  Synthetic
ctcaaatgttcaatactttgcccactactgcagaaagtacgcacctctgtatgccactgaggccaaaagagtgtt

SEQ ID NO: 72544 - DNA, 75 bp, Artificial Sequence
  Synthetic
cgagctgtctggaggggatgttgccaaggtgtttactgacacaaaagtgggcgaatctaatgcaaagaaagtgca

SEQ ID NO: 72545 - DNA, 75 bp, Artificial Sequence
  Synthetic
ttcagtgtattccctaccaccagacccagaccatttcgacggttacaaacaacaggccgttgtaattatggatga

SEQ ID NO: 72546 - DNA, 75 bp, Artificial Sequence
  Synthetic
gtcatgccctacataaacagtgttcccatggataatatgtttagacacaacaacatcacgctgatgatcattccg

SEQ ID NO: 72547 - DNA, 75 bp, Artificial Sequence
  Synthetic
gatgtgtccttattttgccaaatggtttccagtgtggacttcgtaccaccaatggctgcactagaagagaaaggt

SEQ ID NO: 72548 - DNA, 75 bp, Artificial Sequence
  Synthetic
gagtacaatggtcttcgattagctagtaaccagggcctgccagtgatgacgacaccggggagcacacaattcctt

SEQ ID NO: 72549 - DNA, 75 bp, Artificial Sequence
  Synthetic
gtaaccagggcctgccagtgatgacgacaccggggagcacacaattccttacctcggatgatttccagtccccat

SEQ ID NO: 72550 - DNA, 75 bp, Artificial Sequence
  Synthetic
aggtagactcagtggtgcctgtgaacaatacagaggacaacgtgagtagtctcaaggcctatcagattccagtgc

SEQ ID NO: 72551 - DNA, 75 bp, Artificial Sequence
  Synthetic
caatacagaggacaacgtgagtagtctcaaggcctatcagattccagtgcagtctaacagtgacaatggtaagca

SEQ ID NO: 72552 - DNA, 75 bp, Artificial Sequence
  Synthetic
cttcaagaagtgttgcccccttgtgtgtgggaaggccatccagttcatcgatagaagaacacaagtgaggtattc

SEQ ID NO: 72553 - DNA, 75 bp, Artificial Sequence
  Synthetic
tgtgggaaggccatccagttcatcgatagaagaacacaagtgaggtattcccttgacatgttggtcaccgaaatg

SEQ ID NO: 72554 - DNA, 75 bp, Artificial Sequence
  Synthetic
tcatgttgggcacgcacgtcatatgggatgttgggctacaatcaagctgtgtgctgtgcgtgccgtggatcagcc

SEQ ID NO: 72555 - DNA, 75 bp, Artificial Sequence
  Synthetic
taactccactcttcaaattgagaaacacgttagcagggcgttcatatgtctccaagcactaacaacctttgtttc

SEQ ID NO: 72556 - DNA, 75 bp, Artificial Sequence
  Synthetic
caagccaaggtacaaggtcccgcttttgaatttgctgtggctatgatgagaagaaattccagcacagtgaaaaca

SEQ ID NO: 72557 - DNA, 75 bp, Artificial Sequence
  Synthetic
tagctcgcgacccaccaactcagagtctatccccgctcttaccgctgcggagaccgggcatacctcccaagtcgt

SEQ ID NO: 72558 - DNA, 75 bp, Artificial Sequence
  Synthetic
tctatccccgctcttaccgctgcggagaccgggcatacctcccaagtcgtacctagtgacaccatgcagacaagg

SEQ ID NO: 72559 - DNA, 75 bp, Artificial Sequence
  Synthetic
accatcctcatgaatgatcaagaagtaggagtgctggatgcaaaagagttggtagacaaggatggtacgaacctt

SEQ ID NO: 72560 - DNA, 75 bp, Artificial Sequence
  Synthetic
ggtagacaaggatggtacgaaccttgaactaacactactaaagctcaaccgcaatgaaaaatttagagatatcag

SEQ ID NO: 72561 - DNA, 75 bp, Artificial Sequence
  Synthetic
gctacctacacgaacaacacagaaaaaggatacgcagagtgggtcgtaaacactaggcaagtggcccaattaagg

SEQ ID NO: 72562 - DNA, 75 bp, Artificial Sequence
  Synthetic
gtacatccctgtgggacaagtcacagattacggcttcctgaatttgggcggcacccccaccaagaggatgctcat

SEQ ID NO: 72563 - DNA, 75 bp, Artificial Sequence
  Synthetic
tgaggtttgatttagagctgacatttgtgataacgagcgctcaacaacctagtactgccactagcgtggatgccc

SEQ ID NO: 72564 - DNA, 75 bp, Artificial Sequence
  Synthetic
gattacggcttcctgaatttgggcggcacccccaccaagaggatgctcatgtacaacttccccactagagcaggc

SEQ ID NO: 72565 - DNA, 75 bp, Artificial Sequence
  Synthetic
tcagcagccctcctcaaacactacttcaatgatgagcaaggtgagattgaattcatcgaaagctcaaaagacgca

SEQ ID NO: 72566 - DNA, 75 bp, Artificial Sequence
  Synthetic
tcaatgatgagcaaggtgagattgaattcatcgaaagctcaaaagacgcaggattcccagttattaacacgccga

SEQ ID NO: 72567 - DNA, 75 bp, Artificial Sequence
  Synthetic
taaataacatgggcactttgtatatgaggcatgtcaacgaggcagggcaaggcccaattaagagcactgttagaa

SEQ ID NO: 72568 - DNA, 75 bp, Artificial Sequence
  Synthetic
gagacccgcgacttaaagtcaactttgaggaggcaatcttctccaagtacattggcaatgtaaatacacatgtag

SEQ ID NO: 72569 - DNA, 75 bp, Artificial Sequence
  Synthetic
gaggcatgtcaacgaggcagggcaaggcccaattaagagcactgttagaatatatttcaaacctaaacatgtgaa

SEQ ID NO: 72570 - DNA, 75 bp, Artificial Sequence
  Synthetic
atgagtacatgatggaggccgttgaccattatgcaggacaattagctaccctggacattagcacagagccaatga

SEQ ID NO: 72571 - DNA, 75 bp, Artificial Sequence
  Synthetic
cactacaagcagactggacatcacaacaacaggtgcatttggccagcaatcaggcgccatatacgttggtaacta

SEQ ID NO: 72572 - DNA, 75 bp, Artificial Sequence
  Synthetic
agaagggctggaagcgctcgacctgaccaccagcgcaggatacccgtacgttgcgttaggcatcaagaagagaga

SEQ ID NO: 72573 - DNA, 75 bp, Artificial Sequence
  Synthetic
acaacaggtgcatttggccagcaatcaggcgccatatacgttggtaactatagagtggtgaacagacatcttgca

SEQ ID NO: 72574 - DNA, 75 bp, Artificial Sequence
  Synthetic
accaccagcgcaggatacccgtacgttgcgttaggcatcaagaagagagacatcttatctaagaagaccaaagat

SEQ ID NO: 72575 - DNA, 75 bp, Artificial Sequence
  Synthetic
ggttgtgataccatagccagatgccaatgcacaaccggagtgtatttctgcgcctcaaggggtaggcactatcca

SEQ ID NO: 72576 - DNA, 75 bp, Artificial Sequence
  Synthetic
aatgcacaaccggagtgtatttctgcgcctcaaggggtaggcactatccagtcacctttgagggcccgggtctcg

SEQ ID NO: 72577 - DNA, 75 bp, Artificial Sequence
  Synthetic
ggaagtctaggcttattgaagcatccagcttgaatgactctgtcgcaatgaggcagacttttggcaatttataca

SEQ ID NO: 72578 - DNA, 75 bp, Artificial Sequence
  Synthetic
caggtgactgcggcggaatcctgagatgcgagcatggtgttgtcggcatcgtaaccatgggcggtgatggcgttg

SEQ ID NO: 72579 - DNA, 75 bp, Artificial Sequence
  Synthetic
gacgctagcctcagccccgtatggtttgcttgtttgaaattgctattagaaaagcttggctattcacacaaggag

SEQ ID NO: 72580 - DNA, 75 bp, Artificial Sequence
  Synthetic
tttatggttggaggatgacgcaatggaacagggtgtgagaggttacgtggaacagctcgggaatgcctttggttt

SEQ ID NO: 72581 - DNA, 75 bp, Artificial Sequence
  Synthetic
actcccatcacctgtacagggacaaacactactttgtgcgtggtggcatgccctcaggatgctctggcaccagca

SEQ ID NO: 72582 - DNA, 75 bp, Artificial Sequence
  Synthetic
tagagcagatgagcagtaccctttcttggttcacccagtcatgcccatgaaggatatccatgagtccatcagatg

SEQ ID NO: 72583 - DNA, 75 bp, Artificial Sequence
  Synthetic
gtacgaagagttcatccgaaagattagaagtgtcccagttgggcgctgtttaactttacctgcattttcaacact

SEQ ID NO: 72584 - DNA, 75 bp, Artificial Sequence
  Synthetic
taaattagagacaatttaacataatttgaattggcttaaccctaccacacccaccgaactagacaacggtgcggt

SEQ ID NO: 72585 - DNA, 75 bp, Artificial Sequence
  Synthetic
gtacaaacagcaagcagtagtgataatggatgatctgtgtcagaacccagatgggaaggatgtatcactattctg

SEQ ID NO: 72586 - DNA, 75 bp, Artificial Sequence
  Synthetic
gaaaacgttcgttacccggccaattacttcgagaaacccagtaacaccatgaaggttgcgcagtgtttcgctccg

SEQ ID NO: 72587 - DNA, 75 bp, Artificial Sequence
  Synthetic
attcgttctagcatccaccaatgccggatcaattaacgcccccactgtttcagacagtagggcccttgccagaag

SEQ ID NO: 72588 - DNA, 75 bp, Artificial Sequence
  Synthetic
agagtctattgagctaattggtagtcctccggcccctgaatgcggctaatcctaactgcggagcagatacccaca

SEQ ID NO: 72589 - DNA, 75 bp, Artificial Sequence
  Synthetic
taaaacatgtgatgaagagtgctgtccggtcaactttaagaaatgctgcccattagtgtgcggtaaggccattca

SEQ ID NO: 72590 - DNA, 75 bp, Artificial Sequence
  Synthetic
ccggtcaactttaagaaatgctgcccattagtgtgcggtaaggccattcaatttattgacaggaggacccaagtc

SEQ ID NO: 72591 - DNA, 75 bp, Artificial Sequence
  Synthetic
aatagagcaatcgtgtatttgtttgttggtttcgtaccattaaattacaaggtcataaacaccctcaatcttatt

SEQ ID NO: 72592 - DNA, 75 bp, Artificial Sequence
  Synthetic
ccagaaatcaactccgctttgcaaattgaaaagcacgtcagtagagccttcatttgcctccaagctctcaccaca

SEQ ID NO: 72593 - DNA, 75 bp, Artificial Sequence
  Synthetic
ttgaaaagcacgtcagtagagccttcatttgcctccaagctctcaccacatttgtatcagtagctggaataatct

SEQ ID NO: 72594 - DNA, 75 bp, Artificial Sequence
  Synthetic
ctagtggtagctcaattatccactacaccaatatcaattattacaaagatgctgcatcgaactccgctaacaggc

SEQ ID NO: 72595 - DNA, 75 bp, Artificial Sequence
  Synthetic
ctcttagacaagccaaagtgcaaggcccagcatttgaattcgccatagccatgatgaaaagaaatgccagcacag

SEQ ID NO: 72596 - DNA, 75 bp, Artificial Sequence
  Synthetic
cccagcatttgaattcgccatagccatgatgaaaagaaatgccagcacagtaaaaacagagtatggcgagttcac

SEQ ID NO: 72597 - DNA, 75 bp, Artificial Sequence
  Synthetic
gttcagtgatcgtgtacgctccattactttgggcaactccacgatcaccacacaagagtgtgccaatgtagtggt

SEQ ID NO: 72598 - DNA, 75 bp, Artificial Sequence
  Synthetic
ccaagaggttggcgtgttggatgccaaggagttggtggacaaggacggtaccaacttggagctgacacttttgaa

SEQ ID NO: 72599 - DNA, 75 bp, Artificial Sequence
  Synthetic
aggaccagccaacccaacctgatgtagcgacatgtcgattctacactctggagtcagtcacttgggagaaagact

SEQ ID NO: 72600 - DNA, 75 bp, Artificial Sequence
  Synthetic
aaggagttggtggacaaggacggtaccaacttggagctgacacttttgaagctcaatagaaatgagaaatttaga

SEQ ID NO: 72601 - DNA, 75 bp, Artificial Sequence
  Synthetic
atctgggtagagctggttacacaatacatgtacaatgcaatgcctcaaagtttcatcaaggatgtttactagtgg

SEQ ID NO: 72602 - DNA, 75 bp, Artificial Sequence
  Synthetic
ccgaacatgtacatcccagttggccaagtcacggactatggatttctgaaccttgggggcacgcccaccaagagg

SEQ ID NO: 72603 - DNA, 75 bp, Artificial Sequence
  Synthetic
acatgtacaatgcaatgcctcaaagtttcatcaaggatgtttactagtggtgtgtgtgccagaggctgaaatggg

SEQ ID NO: 72604 - DNA, 75 bp, Artificial Sequence
  Synthetic
aagtcacggactatggatttctgaaccttgggggcacgcccaccaagaggatgctcatgtacaactttcctacca

SEQ ID NO: 72605 - DNA, 75 bp, Artificial Sequence
  Synthetic
aggggttctctgccgctctccttagacactatttcaatgaggaacaggggcagatagagttcattgaaagttcaa

SEQ ID NO: 72606 - DNA, 75 bp, Artificial Sequence
  Synthetic
acactatttcaatgaggaacaggggcagatagagttcattgaaagttcaaaagaggcaggttccccagtaatcaa

SEQ ID NO: 72607 - DNA, 75 bp, Artificial Sequence
  Synthetic
tagaaatggtgacccgcgcctcaaggccaactttgaagaggcaattttctctaaatacatgggcaatgtcaacac

SEQ ID NO: 72608 - DNA, 75 bp, Artificial Sequence
  Synthetic
gccaactttgaagaggcaattttctctaaatacatgggcaatgtcaacacacatgtggatgaatatatgcatgaa

SEQ ID NO: 72609 - DNA, 75 bp, Artificial Sequence
  Synthetic
atgaacgtgccaggtagcaatcaattcctcacctctgacgacttccagtcaccgtcagcaatgccacagtttgat

SEQ ID NO: 72610 - DNA, 75 bp, Artificial Sequence
  Synthetic
tcctcacctctgacgacttccagtcaccgtcagcaatgccacagtttgatgtgacgcctgaattggacattccag

SEQ ID NO: 72611 - DNA, 75 bp, Artificial Sequence
  Synthetic
tatggcacagaggggttaggaaccctagacttgactaccagcgcaggctacccgtatgtagccttaggcattaag

SEQ ID NO: 72612 - DNA, 75 bp, Artificial Sequence
  Synthetic
gtgacgcctgaattggacattccaggtgaggtgaagaacttgatggaggtcgctgaggttgattctgtggtgcca

SEQ ID NO: 72613 - DNA, 75 bp, Artificial Sequence
  Synthetic
tagacttgactaccagcgcaggctacccgtatgtagccttaggcattaagaaaagggatatactgtccaagaaga

SEQ ID NO: 72614 - DNA, 75 bp, Artificial Sequence
  Synthetic
acgagctgagatccgctgaaaaggtggttaaaggaaaatccagactccatgaggcatccagtttgaatgactccg

SEQ ID NO: 72615 - DNA, 75 bp, Artificial Sequence
  Synthetic
aaccaggattggacagcgtatttaaacatacgctgttgggggagatattaaattactatgcccactggtcaggca

SEQ ID NO: 72616 - DNA, 75 bp, Artificial Sequence
  Synthetic
ggttaaaggaaaatccagactccatgaggcatccagtttgaatgactccgtggcaatgagacagacatttggcaa

SEQ ID NO: 72617 - DNA, 75 bp, Artificial Sequence
  Synthetic
gagcaagatcccagtcatgctcgatggccacctcattgcttttgactacagtgggtatgatgctagcttgagtcc

SEQ ID NO: 72618 - DNA, 75 bp, Artificial Sequence
  Synthetic
ggccacctcattgcttttgactacagtgggtatgatgctagcttgagtccagtgtggttcgcatgtctaaagctg

SEQ ID NO: 72619 - DNA, 75 bp, Artificial Sequence
  Synthetic
catgcgtgctatgcatcccttggatcagccagactcactacagattggtgcaccaagacgaatacaccagtgctg

SEQ ID NO: 72620 - DNA, 75 bp, Artificial Sequence
  Synthetic
agagacaaacactactttgtaagaggaggaatgccatctgggtgttccggcacaagcatatttaactccataatt

SEQ ID NO: 72621 - DNA, 75 bp, Artificial Sequence
  Synthetic
gaggaatgccatctgggtgttccggcacaagcatatttaactccataatttacaacatcataatcaggaacctaa

SEQ ID NO: 72622 - DNA, 75 bp, Artificial Sequence
  Synthetic
actcatggcctattgatgcatacctgttagccgaagcagggaaagattacggttttataatgaccccagcagaca

SEQ ID NO: 72623 - DNA, 75 bp, Artificial Sequence
  Synthetic
ctcaagcagtgccagcacttactgcagtggagaccgggcacacttcgcaagtagtacctggtgataccatacaaa

SEQ ID NO: 72624 - DNA, 75 bp, Artificial Sequence
  Synthetic
gttagccgaagcagggaaagattacggttttataatgaccccagcagacaagggagaatgcttcaatgaggtgac

SEQ ID NO: 72625 - DNA, 75 bp, Artificial Sequence
  Synthetic
tttctaagtaggtcggcatgtgtgtacatgggagaatactacaccacgaatacagatgagaccaagagatttgcc

SEQ ID NO: 72626 - DNA, 75 bp, Artificial Sequence
  Synthetic
gccaatgaaggacattcaagaatccattaggtggaccaaggatccaaagaacacacaggatcatgtgcgatcatt

SEQ ID NO: 72627 - DNA, 75 bp, Artificial Sequence
  Synthetic
attaggtggaccaaggatccaaagaacacacaggatcatgtgcgatcattgtgcttattggcctggcacaatggg

SEQ ID NO: 72628 - DNA, 75 bp, Artificial Sequence
  Synthetic
aactggacgattaacgcaagacgtatggtgcaaatgagaaggaaacttgaaatgttcacatacatccgctttgat

SEQ ID NO: 72629 - DNA, 75 bp, Artificial Sequence
  Synthetic
tcgtcactgcgcaggaggtggcttgtttccttttaatttggagcaaccttcgaagatttaaaattggcttaaccc

SEQ ID NO: 72630 - DNA, 75 bp, Artificial Sequence
  Synthetic
catcaaattatgtacatcccaccaggcggccccattcccaaatccactacagactatgcatggcaaacatcaacc

SEQ ID NO: 72631 - DNA, 75 bp, Artificial Sequence
  Synthetic
tttccttttaatttggagcaaccttcgaagatttaaaattggcttaaccctaccgcatgaaccgaacttgataca

SEQ ID NO: 72632 - DNA, 75 bp, Artificial Sequence
  Synthetic
ttaaaatagcctgtgggttgctcccacccacagggcccaagtggcgtagtacttggtattccggtacctttgtac

SEQ ID NO: 72633 - DNA, 75 bp, Artificial Sequence
  Synthetic
acttggtattccggtacctttgtacacctatttacaaaccctaccccttgtaaccttagaagcaattatttaacc

SEQ ID NO: 72634 - DNA, 75 bp, Artificial Sequence
  Synthetic
acctatttacaaaccctaccccttgtaaccttagaagcaattatttaaccgctcactagggggtgtgctatccaa

SEQ ID NO: 72635 - DNA, 75 bp, Artificial Sequence
  Synthetic
taccgttaaccggcagtctacttcgggaagcccagtaactacattgaaactttgaggcgttacactcagcacata

SEQ ID NO: 72636 - DNA, 75 bp, Artificial Sequence
  Synthetic
ggaagcccagtaactacattgaaactttgaggcgttacactcagcacataaccccaatgtgtagttctggtcgat

SEQ ID NO: 72637 - DNA, 75 bp, Artificial Sequence
  Synthetic
taagaatgcatcgactgtgaacttctcatctacaaacattaccgacaagagagacagcatcacctacataccaga

SEQ ID NO: 72638 - DNA, 75 bp, Artificial Sequence
  Synthetic
tcatctacaaacattaccgacaagagagacagcatcacctacataccagacaccgtcaagcctgacgtgtcgaac

SEQ ID NO: 72639 - DNA, 75 bp, Artificial Sequence
  Synthetic
gacgcctaattgtggacatggtgtgaagagcctactgagctagactgtagtcctccggcccctgaatgcggctaa

SEQ ID NO: 72640 - DNA, 75 bp, Artificial Sequence
  Synthetic
aagagcctactgagctagactgtagtcctccggcccctgaatgcggctaatcctaaccctggagcatccgcgtgc

SEQ ID NO: 72641 - DNA, 75 bp, Artificial Sequence
  Synthetic
tttcatactgggtcgcttatggttacaactaattgttgtaatcattggcagtgcgcgctgaccacgcgattattg

SEQ ID NO: 72642 - DNA, 75 bp, Artificial Sequence
  Synthetic
caactaattgttgtaatcattggcagtgcgcgctgaccacgcgattattgatatttccatttgttggatactcca

SEQ ID NO: 72643 - DNA, 75 bp, Artificial Sequence
  Synthetic
tgaacatggggtcattggcatcgtgaccatgggtggtgaaggcgttgttggctttgctgacgtacgcgatctcct

SEQ ID NO: 72644 - DNA, 75 bp, Artificial Sequence
  Synthetic
ctggtgcgcatgaaactggtaacgttgccactggaggctcaacaataaattacacctccataaattattataagg

SEQ ID NO: 72645 - DNA, 75 bp, Artificial Sequence
  Synthetic
tgccactggaggctcaacaataaattacacctccataaattattataaggattcagcatctaattcagctaacag

SEQ ID NO: 72646 - DNA, 75 bp, Artificial Sequence
  Synthetic
tgggccaagattccatactggaaaagtccttgaaagcgctagtcaagatcatctcagccctagtcatagtggtaa

SEQ ID NO: 72647 - DNA, 75 bp, Artificial Sequence
  Synthetic
gaattcaccgtcagtggaggaatgtggatatagtgacagagtgcgtcaaattacactagggaattcaaccatcac

SEQ ID NO: 72648 - DNA, 75 bp, Artificial Sequence
  Synthetic
ggatatagtgacagagtgcgtcaaattacactagggaattcaaccatcacgacgcaagagtgtgccaatgctgtg

SEQ ID NO: 72649 - DNA, 75 bp, Artificial Sequence
  Synthetic
tgcacttcgtcgccatggcggtggctcaaacaaaaggtgtcacagtactatgggatacccatggccgagcgtcag

SEQ ID NO: 72650 - DNA, 75 bp, Artificial Sequence
  Synthetic
gtcgcaacatgccgattttacactcttgactcggtgcagtggcagaagaattcaaaggggtggtggtggaaattt

SEQ ID NO: 72651 - DNA, 75 bp, Artificial Sequence
  Synthetic
ttgactcggtgcagtggcagaagaattcaaaggggtggtggtggaaatttcctgatgctctttcaaacttaggct

SEQ ID NO: 72652 - DNA, 75 bp, Artificial Sequence
  Synthetic
caaaaatttattgagtggctaaaagtcaaaatcttgccagaagtgaaagaaaaacacgagtttctcagcagatta

SEQ ID NO: 72653 - DNA, 75 bp, Artificial Sequence
  Synthetic
aaaacacgagtttctcagcagattaaagcaactaccacttctagaaagtcagattgctaccatcgaacagagtgc

SEQ ID NO: 72654 - DNA, 75 bp, Artificial Sequence
  Synthetic
ggtttcaccaagggtgtcttcttgtagtgtgcgtaccagaagcagaaatggggtgttctaacgtgaacaatcaac

SEQ ID NO: 72655 - DNA, 75 bp, Artificial Sequence
  Synthetic
agtgtgcgtaccagaagcagaaatggggtgttctaacgtgaacaatcaacccagttttgaacagttggctaatgg

SEQ ID NO: 72656 - DNA, 75 bp, Artificial Sequence
  Synthetic
cctatatgctgctgaggcaaagagggtgttctcactagagaagaagatgagtaactacatacagttcaagtccaa

SEQ ID NO: 72657 - DNA, 75 bp, Artificial Sequence
  Synthetic
aatgggagttggtgtggggaacctgaccatctacccccatcagtggataaatttaagaacaaacaacagtgctac

SEQ ID NO: 72658 - DNA, 75 bp, Artificial Sequence
  Synthetic
accatctacccccatcagtggataaatttaagaacaaacaacagtgctacaatagtcatgccatatattaattgt

SEQ ID NO: 72659 - DNA, 75 bp, Artificial Sequence
  Synthetic
aatagctcagtgtattccctaccaccagaccccgaccactttgatgggtacaaacagcaagcggtggtgatcatg

SEQ ID NO: 72660 - DNA, 75 bp, Artificial Sequence
  Synthetic
cagaccccgaccactttgatgggtacaaacagcaagcggtggtgatcatggatgacttgtgccaaaacccagatg

SEQ ID NO: 72661 - DNA, 75 bp, Artificial Sequence
  Synthetic
gcaggggcaactacattcgttcccattaccgtgactgttgcccctatgtgcgcagagtataacggccttcgccta

SEQ ID NO: 72662 - DNA, 75 bp, Artificial Sequence
  Synthetic
ttaccgtgactgttgcccctatgtgcgcagagtataacggccttcgcctagcctcaccacagggcttgccaacaa

SEQ ID NO: 72663 - DNA, 75 bp, Artificial Sequence
  Synthetic
ccaccaatggcggcactggaggaaaaagggatcctctttacatccccgttcgttctagcatcaaccaacgctggc

SEQ ID NO: 72664 - DNA, 75 bp, Artificial Sequence
  Synthetic
taacccctgaaatgagtattccaggtcaagtgcgcaaccttatggagattgcagaggtggattctgttgtaccag

SEQ ID NO: 72665 - DNA, 75 bp, Artificial Sequence
  Synthetic
tcaagtgcgcaaccttatggagattgcagaggtggattctgttgtaccagtaaacaacctggccagtaccatatc

SEQ ID NO: 72666 - DNA, 75 bp, Artificial Sequence
  Synthetic
atctctatgtacagtcagaatggtaagatcaacatgcctatgtcagtgaagacatgtgatgaagagtgctgccca

SEQ ID NO: 72667 - DNA, 75 bp, Artificial Sequence
  Synthetic
accaggtgcaaatagtgttttaaaacgaactctagtgggtgagattctgaattactacacccactggtcaggaag

SEQ ID NO: 72668 - DNA, 75 bp, Artificial Sequence
  Synthetic
cgaactctagtgggtgagattctgaattactacacccactggtcaggaagtttgaagtttactttcatgttttgc

SEQ ID NO: 72669 - DNA, 75 bp, Artificial Sequence
  Synthetic
tattcgctggacatgttagtcacagaaatgttcagggagtacaatcatagacacagtgtgggagctacacttgag

SEQ ID NO: 72670 - DNA, 75 bp, Artificial Sequence
  Synthetic
aaatgttcagggagtacaatcatagacacagtgtgggagctacacttgaggccctgttccaaggaccaccaatct

SEQ ID NO: 72671 - DNA, 75 bp, Artificial Sequence
  Synthetic
caggccatgctgggcacccacgttatatgggacttaggattgcaatctagctgtgtgctgtgtgtcccatggatc

SEQ ID NO: 72672 - DNA, 75 bp, Artificial Sequence
  Synthetic
tatgggacttaggattgcaatctagctgtgtgctgtgtgtcccatggatcagccaaacccactacaggtatgtag

SEQ ID NO: 72673 - DNA, 75 bp, Artificial Sequence
  Synthetic
ccaccagtactggtctattgtgttttgtgtcagcgtgcaacgattttagcgttaggcttttaaaggacaccccct

SEQ ID NO: 72674 - DNA, 75 bp, Artificial Sequence
  Synthetic
gtctcagtcgcgggaataatatacatcatttataaactatttgcaggctttcaaggcgcctatacaggcatgcca

SEQ ID NO: 72675 - DNA, 75 bp, Artificial Sequence
  Synthetic
tgtgtcagcgtgcaacgattttagcgttaggcttttaaaggacaccccctttatatcgcaaactgcttttcttca

SEQ ID NO: 72676 - DNA, 75 bp, Artificial Sequence
  Synthetic
atgaaaagaaacgctagtacggtaaaaaccgagtacggcgaatttaccatgctgggtatctatgataagtgggca

SEQ ID NO: 72677 - DNA, 75 bp, Artificial Sequence
  Synthetic
cacggctgtcccagccctgacagcagcggagaccggccacacctcccaagtcacacctagcgacacactacaaac

SEQ ID NO: 72678 - DNA, 75 bp, Artificial Sequence
  Synthetic
aaaccgagtacggcgaatttaccatgctgggtatctatgataagtgggcagtgttaccgcgccacgccaaaccag

SEQ ID NO: 72679 - DNA, 75 bp, Artificial Sequence
  Synthetic
gcggagaccggccacacctcccaagtcacacctagcgacacactacaaaccagacacgttagaaactaccactct

SEQ ID NO: 72680 - DNA, 75 bp, Artificial Sequence
  Synthetic
taatcgaaatgaaaagtttagagacatcagagggttcctggcaagagaggaagttgaagtaaatgaagctgtctt

SEQ ID NO: 72681 - DNA, 75 bp, Artificial Sequence
  Synthetic
tcagcagggagcgcacggtttgctagttgggtgattaacacacgaaatgtagtacaatttaggaggaagttggaa

SEQ ID NO: 72682 - DNA, 75 bp, Artificial Sequence
  Synthetic
atcagagggttcctggcaagagaggaagttgaagtaaatgaagctgtcttagccataaacacaagtaagttcccg

SEQ ID NO: 72683 - DNA, 75 bp, Artificial Sequence
  Synthetic
gttgggtgattaacacacgaaatgtagtacaatttaggaggaagttggaattgttcacctatgctagatttgaca

SEQ ID NO: 72684 - DNA, 75 bp, Artificial Sequence
  Synthetic
ctcatgtacaacttcccaaccagggcagggcaatgtggaggtgttctcatgtcaacagggaaagtcctgggaata

SEQ ID NO: 72685 - DNA, 75 bp, Artificial Sequence
  Synthetic
atcaaattatgtatgtaccacctggaggaccagtacctactgcttatgatgattatacctggcagtcttccacca

SEQ ID NO: 72686 - DNA, 75 bp, Artificial Sequence
  Synthetic
aggaccagtacctactgcttatgatgattatacctggcagtcttccaccaaccccagtgtgttctggactgaggg

SEQ ID NO: 72687 - DNA, 75 bp, Artificial Sequence
  Synthetic
atagaattcattgagagctcgaaagacgcgggttttcccgtgatcaatactcccagcaagacaaaattagaacca

SEQ ID NO: 72688 - DNA, 75 bp, Artificial Sequence
  Synthetic
caactttgaagcacagggcgcatatggaatcaacactttgaacaatatgggtaccatctttgtgaggcatgtaaa

SEQ ID NO: 72689 - DNA, 75 bp, Artificial Sequence
  Synthetic
acgcgggttttcccgtgatcaatactcccagcaagacaaaattagaaccaagtgtgtttcaccaagtgtttgagg

SEQ ID NO: 72690 - DNA, 75 bp, Artificial Sequence
  Synthetic
ggaatcaacactttgaacaatatgggtaccatctttgtgaggcatgtaaatacattcaacccagccccaattata

SEQ ID NO: 72691 - DNA, 75 bp, Artificial Sequence
  Synthetic
agtacatcggtaatgtcaacacacacgtggatgagtacatgcaagaggctgtggaccactacgcaggacagctgg

SEQ ID NO: 72692 - DNA, 75 bp, Artificial Sequence
  Synthetic
attaaagctacaaatgtgaactttagcaagacttcagtaaccgaaccaagagacagtattacaacttatggtgca

SEQ ID NO: 72693 - DNA, 75 bp, Artificial Sequence
  Synthetic
gcaagacttcagtaaccgaaccaagagacagtattacaacttatggtgcattttctcagcagccgggtgcagtgt

SEQ ID NO: 72694 - DNA, 75 bp, Artificial Sequence
  Synthetic
ggtacagaggggctagaggcgctagatttaaccaccagtgcaggatacccctacgtggccctgggtatcaaaaag

SEQ ID NO: 72695 - DNA, 75 bp, Artificial Sequence
  Synthetic
ggaatagggaccttttagttaccaccgtccaagcacatggatgtcatcaggttgctcgttgttcctgtacaacag

SEQ ID NO: 72696 - DNA, 75 bp, Artificial Sequence
  Synthetic
cgtccaagcacatggatgtcatcaggttgctcgttgttcctgtacaacaggggtatattatagcaagtactataa

SEQ ID NO: 72697 - DNA, 75 bp, Artificial Sequence
  Synthetic
ccaatggtgacttatgtcaaggatgagttgagatctgctgagaaagtggctaagggaaagtctagactcattgaa

SEQ ID NO: 72698 - DNA, 75 bp, Artificial Sequence
  Synthetic
gcaaacacatgtcttgctggctaatggcccagcacaacctggtgattgcggcgggttgctgtgttgtacgcatgg

SEQ ID NO: 72699 - DNA, 75 bp, Artificial Sequence
  Synthetic
gtacaagaccttccacctccacccaggtattgttacgggcagcgccgttggatgtgacccagatgtgttttggag

SEQ ID NO: 72700 - DNA, 75 bp, Artificial Sequence
  Synthetic
ggcccagcacaacctggtgattgcggcgggttgctgtgttgtacgcatggagtggttggcatcctcacagcgggt

SEQ ID NO: 72701 - DNA, 75 bp, Artificial Sequence
  Synthetic
gtggttcgcgtgcttgaagctccttttagagaaactaggatacacaaacaaggaaacaaactacatagactacct

SEQ ID NO: 72702 - DNA, 75 bp, Artificial Sequence
  Synthetic
aaagactacgtggagcagcttgggaccgccttcggaacgggtttcacaacccagattaatgagcaaattgcacat

SEQ ID NO: 72703 - DNA, 75 bp, Artificial Sequence
  Synthetic
ccgccttcggaacgggtttcacaacccagattaatgagcaaattgcacatttgaaggagtgcttgatcgggcagg

SEQ ID NO: 72704 - DNA, 75 bp, Artificial Sequence
  Synthetic
ctgtaattcccatcatttgtacagggacaaacactactttgtgagaggtggtatgccatcaggatgttcaggcac

SEQ ID NO: 72705 - DNA, 75 bp, Artificial Sequence
  Synthetic
aagacttggtgaccgtgactgcgaccttagcactgattggatgttccggttcaccatgggcatggctgaagcaaa

SEQ ID NO: 72706 - DNA, 75 bp, Artificial Sequence
  Synthetic
cttagcactgattggatgttccggttcaccatgggcatggctgaagcaaaaagtcgcccagctgtttgggattcc

SEQ ID NO: 72707 - DNA, 75 bp, Artificial Sequence
  Synthetic
ggatcaattcaagatgattgcctacggagacgatgtgattgcttcgtacccatggcctattgatgcctcgctttt

SEQ ID NO: 72708 - DNA, 75 bp, Artificial Sequence
  Synthetic
ggagacgatgtgattgcttcgtacccatggcctattgatgcctcgcttttagctgaagcagggaaggattatggc

SEQ ID NO: 72709 - DNA, 75 bp, Artificial Sequence
  Synthetic
gattgctcaaaagattcaaaagttcattgagtggttgaagcagaagattttaccggaagtgaaggaaaaacatga

SEQ ID NO: 72710 - DNA, 75 bp, Artificial Sequence
  Synthetic
attgagtggttgaagcagaagattttaccggaagtgaaggaaaaacatgagtttctaactagattaaaacaactg

SEQ ID NO: 72711 - DNA, 75 bp, Artificial Sequence
  Synthetic
tacttcagagcagacgagcagtacccgttcctagtacaccctgtcatgccaatgaaggacatacatgagtccatt

SEQ ID NO: 72712 - DNA, 75 bp, Artificial Sequence
  Synthetic
aacgtgcaatattttgcgcattactgcaggaagtacgctcccctctacgccgctgaagccaggagagtgtatcaa

SEQ ID NO: 72713 - DNA, 75 bp, Artificial Sequence
  Synthetic
gcaggaagtacgctcccctctacgccgctgaagccaggagagtgtatcaattggagaagcgtgttaataactacg

SEQ ID NO: 72714 - DNA, 75 bp, Artificial Sequence
  Synthetic
ccttctaaaattagagcataattaatggactttaattggctcgaccctaccgcatgaaccgaacttgacaaaagt

SEQ ID NO: 72715 - DNA, 75 bp, Artificial Sequence
  Synthetic
tagccaccaatttgattggcagagcaattgcagagaagttaaatagctcagtatattctctaccacctgatccgg

SEQ ID NO: 72716 - DNA, 75 bp, Artificial Sequence
  Synthetic
ttaaaacagcctgtgggttgttcccacccacaggcccattgggcgctagcactctggtatcacggtacctttgtg

SEQ ID NO: 72717 - DNA, 75 bp, Artificial Sequence
  Synthetic
aattgcagagaagttaaatagctcagtatattctctaccacctgatccggaccactttgatggatataaacaaca

SEQ ID NO: 72718 - DNA, 75 bp, Artificial Sequence
  Synthetic
tagtgttgactttgttccaccaatggctgcactagaagaaaagggaattttgttcacatcaccgtttgtgttggc

SEQ ID NO: 72719 - DNA, 75 bp, Artificial Sequence
  Synthetic
gctgcactagaagaaaagggaattttgttcacatcaccgtttgtgttggcttcaaccaatgctagctccatccat

SEQ ID NO: 72720 - DNA, 75 bp, Artificial Sequence
  Synthetic
taccagcagagcgggaagttgaacatgccattggcagccaagtcatgtgatgatgagtgtattccggcgaatttc

SEQ ID NO: 72721 - DNA, 75 bp, Artificial Sequence
  Synthetic
gtcaccgcgttccccacgggcgaccgtggcggtggctgcgttggcggcctgcctacggggaaacccgtaggacgc

SEQ ID NO: 72722 - DNA, 75 bp, Artificial Sequence
  Synthetic
tgccattggcagccaagtcatgtgatgatgagtgtattccggcgaatttcaaaaaatgttgtcccttagtgtgtg

SEQ ID NO: 72723 - DNA, 75 bp, Artificial Sequence
  Synthetic
gagagtataaccatagacacaatgttggcaacgttctggaagctttattccaagggccccctacatatagggaga

SEQ ID NO: 72724 - DNA, 75 bp, Artificial Sequence
  Synthetic
tggcaacgttctggaagctttattccaagggccccctacatatagggagatcaaaatctcagttgcaccagatat

SEQ ID NO: 72725 - DNA, 75 bp, Artificial Sequence
  Synthetic
tggattggccatccggtgactaacagagcaattatatatctctttgttgggtttataccacttagcttgaaagag

SEQ ID NO: 72726 - DNA, 75 bp, Artificial Sequence
  Synthetic
aggttggattattccagaacaggcctctagcctagtcaccgaaaaacatataagtagggcctttatttgcctaca

SEQ ID NO: 72727 - DNA, 75 bp, Artificial Sequence
  Synthetic
gttaaaacactacatctcatcattaaactaaatacaacaaaatgggggctcaagtatcaacacaaaagactggag

SEQ ID NO: 72728 - DNA, 75 bp, Artificial Sequence
  Synthetic
aactaaatacaacaaaatgggggctcaagtatcaacacaaaagactggagcacatgagaccgggctgaatgcaag

SEQ ID NO: 72729 - DNA, 75 bp, Artificial Sequence
  Synthetic
tctagcctagtcaccgaaaaacatataagtagggcctttatttgcctacaagccctcactacctttatttcggtt

SEQ ID NO: 72730 - DNA, 75 bp, Artificial Sequence
  Synthetic
cctaaagtccctaccattagacaagcaaaagtgcagggtcctagttttgagtttgcaatatcaatgatgaggaga

SEQ ID NO: 72731 - DNA, 75 bp, Artificial Sequence
  Synthetic
tttcactcaagacccaggtaaatttactgagccagtgaaggacattatgatcaaatcgatgccagcattgaactc

SEQ ID NO: 72732 - DNA, 75 bp, Artificial Sequence
  Synthetic
actgagccagtgaaggacattatgatcaaatcgatgccagcattgaactccccctctgccgaagagtgtggttat

SEQ ID NO: 72733 - DNA, 75 bp, Artificial Sequence
  Synthetic
caaaagtgcagggtcctagttttgagtttgcaatatcaatgatgaggagaaacgctagcacggtgaagactggca

SEQ ID NO: 72734 - DNA, 75 bp, Artificial Sequence
  Synthetic
ttatcatgaatgacttggaagtgaaagttttggatgcaaaagagctcgttgaccaacagggtgtaaatctggaat

SEQ ID NO: 72735 - DNA, 75 bp, Artificial Sequence
  Synthetic
tatggtgtgtggccagaatatttgaaggacaatgaagccacaggcgaggaccaaccaacacaacccgacgtggcc

SEQ ID NO: 72736 - DNA, 75 bp, Artificial Sequence
  Synthetic
aggacaatgaagccacaggcgaggaccaaccaacacaacccgacgtggccacatgtcggttctacactttagagt

SEQ ID NO: 72737 - DNA, 75 bp, Artificial Sequence
  Synthetic
agttttggatgcaaaagagctcgttgaccaacagggtgtaaatctggaattgaccttggtgaagcttgataggaa

SEQ ID NO: 72738 - DNA, 75 bp, Artificial Sequence
  Synthetic
tactagcaagtttccaaacatgttcataccagtgggtcaggtcactgagtatggtttcttaaacctgagtggagt

SEQ ID NO: 72739 - DNA, 75 bp, Artificial Sequence
  Synthetic
gacaaaatatgcagtaccactacttagggagaacaggctacaccatccacgtgcagtgcaacgcatctaagtttc

SEQ ID NO: 72740 - DNA, 75 bp, Artificial Sequence
  Synthetic
agggagaacaggctacaccatccacgtgcagtgcaacgcatctaagtttcatcagggctgtctactagtggtgtg

SEQ ID NO: 72741 - DNA, 75 bp, Artificial Sequence
  Synthetic
ataccagtgggtcaggtcactgagtatggtttcttaaacctgagtggagtccccacacaccgcatgctcatgtac

SEQ ID NO: 72742 - DNA, 75 bp, Artificial Sequence
  Synthetic
ggtaatggtcaccaagggtttgctgctgcactgctcagacactacttcgctgatgaacagggtgaaattgagtgg

SEQ ID NO: 72743 - DNA, 75 bp, Artificial Sequence
  Synthetic
tgctagaatgttcactgacaccgaagtggggacatccaacgataagaaagtacaaacagcagtgtggaatgcagg

SEQ ID NO: 72744 - DNA, 75 bp, Artificial Sequence
  Synthetic
gtggggacatccaacgataagaaagtacaaacagcagtgtggaatgcaggtatgggtgttggtgttggcaacctg

SEQ ID NO: 72745 - DNA, 75 bp, Artificial Sequence
  Synthetic
ctgcactgctcagacactacttcgctgatgaacagggtgaaattgagtggacggtgcctagtaaggaaagtggct

SEQ ID NO: 72746 - DNA, 75 bp, Artificial Sequence
  Synthetic
agcctgcagttctgaacaagaaagaccccagattgaaagtagatttcgaggaagcaatcttttcaaagtatgtgg

SEQ ID NO: 72747 - DNA, 75 bp, Artificial Sequence
  Synthetic
gttcccatggacaacatgtatagacacaacaacttgacactgatgataatcccattcgtcccgctcaactatagt

SEQ ID NO: 72748 - DNA, 75 bp, Artificial Sequence
  Synthetic
acaacaacttgacactgatgataatcccattcgtcccgctcaactatagtgagggatcatcaccttacgtaccaa

SEQ ID NO: 72749 - DNA, 75 bp, Artificial Sequence
  Synthetic
ccccagattgaaagtagatttcgaggaagcaatcttttcaaagtatgtggggaatgtgaacacgcacatggatga

SEQ ID NO: 72750 - DNA, 75 bp, Artificial Sequence
  Synthetic
tgaagaggcagtctacggaactgatggacttgaagcattagatctaaccactagtgctggttacccatatgtaac

SEQ ID NO: 72751 - DNA, 75 bp, Artificial Sequence
  Synthetic
tgacgacaccgggtagcacgcaatttctgacttctgatgatttccaatcgccatcagcaatgccacaattcgacg

SEQ ID NO: 72752 - DNA, 75 bp, Artificial Sequence
  Synthetic
tctgacttctgatgatttccaatcgccatcagcaatgccacaattcgacgtcacaccagagatgcagatcccggg

SEQ ID NO: 72753 - DNA, 75 bp, Artificial Sequence
  Synthetic
ggacttgaagcattagatctaaccactagtgctggttacccatatgtaactatgggggtaaagaaaagggatatt

SEQ ID NO: 72754 - DNA, 75 bp, Artificial Sequence
  Synthetic
acatatgtcaaagatgagctcagatctagagacaaagtagagaagggcaagtcgcgcctgattgaagcgtcgagt

SEQ ID NO: 72755 - DNA, 75 bp, Artificial Sequence
  Synthetic
tggtcttaaagcctaccaaatccccgtgcaatccaatagcgacaatagaaggcaagtgttcgggtttcccttaca

SEQ ID NO: 72756 - DNA, 75 bp, Artificial Sequence
  Synthetic
gtgcaatccaatagcgacaatagaaggcaagtgttcgggtttcccttacaacctggggccaacaatgttctcaac

SEQ ID NO: 72757 - DNA, 75 bp, Artificial Sequence
  Synthetic
ctagagacaaagtagagaagggcaagtcgcgcctgattgaagcgtcgagtctaaacgattccgtggcaatgaggc

SEQ ID NO: 72758 - DNA, 75 bp, Artificial Sequence
  Synthetic
cagatttgttttggagtaagattccagtaatattggatggggaattaatcgcatttgattatacaggatatgatg

SEQ ID NO: 72759 - DNA, 75 bp, Artificial Sequence
  Synthetic
ggatcggcgatggccactgggaagtttttgttagcatactcaccaccaggcgcaggggttccaaaaaacagaaga

SEQ ID NO: 72760 - DNA, 75 bp, Artificial Sequence
  Synthetic
ttttgttagcatactcaccaccaggcgcaggggttccaaaaaacagaagagacgcaatgttgggtacacatgtca

SEQ ID NO: 72761 - DNA, 75 bp, Artificial Sequence
  Synthetic
agtaatattggatggggaattaatcgcatttgattatacaggatatgatgctagcttgagcccagtctggtttgg

SEQ ID NO: 72762 - DNA, 75 bp, Artificial Sequence
  Synthetic
atatcacttatataaagataaatattactttgtgtctggaggaatgccgtcaggttgctccggcacgtctatctt

SEQ ID NO: 72763 - DNA, 75 bp, Artificial Sequence
  Synthetic
tggaggatgagtatacagcggcagggtatgttacatgctggtaccaaacaaatatcattgttccagcggacgttc

SEQ ID NO: 72764 - DNA, 75 bp, Artificial Sequence
  Synthetic
gtatgttacatgctggtaccaaacaaatatcattgttccagcggacgttcaaagcacatgcgacatcttgtgctt

SEQ ID NO: 72765 - DNA, 75 bp, Artificial Sequence
  Synthetic
tactttgtgtctggaggaatgccgtcaggttgctccggcacgtctatcttcaataccatgattaataatataata

SEQ ID NO: 72766 - DNA, 75 bp, Artificial Sequence
  Synthetic
gtaattgcatcatacccatattcaatagatgcaggcctacttgctaaggcggggaaggagtacggtctgacaatg

SEQ ID NO: 72767 - DNA, 75 bp, Artificial Sequence
  Synthetic
gggcccagtggaagaatcggtggaacgcgccatggtgcgcgtggctgatacggtcagctcaaagcctacgaattc

SEQ ID NO: 72768 - DNA, 75 bp, Artificial Sequence
  Synthetic
cgcgccatggtgcgcgtggctgatacggtcagctcaaagcctacgaattcagaatccatccccgccctcactgct

SEQ ID NO: 72769 - DNA, 75 bp, Artificial Sequence
  Synthetic
tagatgcaggcctacttgctaaggcggggaaggagtacggtctgacaatgacaccagctgacaagagtacagagt

SEQ ID NO: 72770 - DNA, 75 bp, Artificial Sequence
  Synthetic
tacatccagtcatgccaatgaaggagatacatgagtccattaggtggaccaaggacccacgttgcactcaagagc

SEQ ID NO: 72771 - DNA, 75 bp, Artificial Sequence
  Synthetic
aggtcggaatcttccattgaaaatttcttgtgccgatctgcttgtgtgtattacgccacctacaataataattct

SEQ ID NO: 72772 - DNA, 75 bp, Artificial Sequence
  Synthetic
gatacatgagtccattaggtggaccaaggacccacgttgcactcaagagcatgtaaggtccctgtgccaactggc

SEQ ID NO: 72773 - DNA, 75 bp, Artificial Sequence
  Synthetic
ttacgccacctacaataataattctgagaagggctacgcagagtgggttatcaacaccaggcaggttgcgcagtt

SEQ ID NO: 72774 - DNA, 75 bp, Artificial Sequence
  Synthetic
actcccagcctactctacattacgtagaaagtggcttgattcattttaattaggcccatatttgactttaatttg

SEQ ID NO: 72775 - DNA, 75 bp, Artificial Sequence
  Synthetic
gcccagtaccgctaccagtgtagacgcacctgtacaaacccaacagataatgtatgtgcctccaggcgggccggt

SEQ ID NO: 72776 - DNA, 75 bp, Artificial Sequence
  Synthetic
gcacctgtacaaacccaacagataatgtatgtgcctccaggcgggccggtacctaccaaggttacagactacgcc

SEQ ID NO: 72777 - DNA, 75 bp, Artificial Sequence
  Synthetic
taggcccatatttgactttaatttggctaattgggttaaccctgtcacgtatctggacgtgacataagcgtgaca

SEQ ID NO: 72778 - DNA, 75 bp, Artificial Sequence
  Synthetic
ttaaaacagcctgtgggttgtacccacccacagggcccactgggcgctagcactctggtatcacggtacctttgt

SEQ ID NO: 72779 - DNA, 75 bp, Artificial Sequence
  Synthetic
agtattggaaatgcttatagctgcttttatgatggatggacacagttctctaggaatggggtttacggcattaat

SEQ ID NO: 72780 - DNA, 75 bp, Artificial Sequence
  Synthetic
tttatgatggatggacacagttctctaggaatggggtttacggcattaataccctgaacaacatgggtacgctgt

SEQ ID NO: 72781 - DNA, 75 bp, Artificial Sequence
  Synthetic
ctgtttccccggaccgagtatcaatagactgctcacgcggttgaaggagaaaacgttcgttacccggctaactac

SEQ ID NO: 72782 - DNA, 75 bp, Artificial Sequence
  Synthetic
tgaaggcgtgggtgcccagaccgccgaggctatgtcaatatgagaagcaaaagaatgttaatttcaacccaacag

SEQ ID NO: 72783 - DNA, 75 bp, Artificial Sequence
  Synthetic
gaggctatgtcaatatgagaagcaaaagaatgttaatttcaacccaacaggagtcaccacaacgcgctcaaacat

SEQ ID NO: 72784 - DNA, 75 bp, Artificial Sequence
  Synthetic
cgccacccgcgaggactggcagcggtgcgtgtgggaagattacaacagagatcttcttgtgagtacaaccacggc

SEQ ID NO: 72785 - DNA, 75 bp, Artificial Sequence
  Synthetic
tgcgtgtgggaagattacaacagagatcttcttgtgagtacaaccacggcacatggatgcgatatcatagccagg

SEQ ID NO: 72786 - DNA, 75 bp, Artificial Sequence
  Synthetic
cttataatggctgcttatggtgacaattgaaagattgttaccatatagctattggattggccatccggtgtctaa

SEQ ID NO: 72787 - DNA, 75 bp, Artificial Sequence
  Synthetic
cttgtggaggttcaagagagtgagtactatccaaagaggtaccaatcccacgtgcttttagcggcaggcttttcc

SEQ ID NO: 72788 - DNA, 75 bp, Artificial Sequence
  Synthetic
actatccaaagaggtaccaatcccacgtgcttttagcggcaggcttttccgaaccaggggattgtggtggaatcc

SEQ ID NO: 72789 - DNA, 75 bp, Artificial Sequence
  Synthetic
ctcaggtttcaacgcaaaaaaccggagcacatgagaccgggctgaatgccagcggtaattccaccatccattata

SEQ ID NO: 72790 - DNA, 75 bp, Artificial Sequence
  Synthetic
agcacatgagaccgggctgaatgccagcggtaattccaccatccattatacaaatattaactactataaggatgc

SEQ ID NO: 72791 - DNA, 75 bp, Artificial Sequence
  Synthetic
acctgctgtggttagaagatgatgcaatggagcagggggtcaaagattacgtagagcaacttggaaacgcctttg

SEQ ID NO: 72792 - DNA, 75 bp, Artificial Sequence
  Synthetic
ggtcaggattcactaaccaagtctgtgaacaggttaaccttttgaaagagtccctagtgggccaagactccatct

SEQ ID NO: 72793 - DNA, 75 bp, Artificial Sequence
  Synthetic
gatcaaatctatgccagctctcaattcaccatctgctgaggaatgtggatacagtgacagagtgaggtccatcac

SEQ ID NO: 72794 - DNA, 75 bp, Artificial Sequence
  Synthetic
tcaccatctgctgaggaatgtggatacagtgacagagtgaggtccatcacgttgggaaactcgacaatcaccaca

SEQ ID NO: 72795 - DNA, 75 bp, Artificial Sequence
  Synthetic
taacagtgactgcaacacttgccctcattggctgcacctcctcaccatggagatggcttaagcaaaaggtgtccc

SEQ ID NO: 72796 - DNA, 75 bp, Artificial Sequence
  Synthetic
cattggctgcacctcctcaccatggagatggcttaagcaaaaggtgtcccagtactatggcattccaatggctga

SEQ ID NO: 72797 - DNA, 75 bp, Artificial Sequence
  Synthetic
gatcaacctacacaaccagatgtggcaacgtgcagattctacaccttggagtccgtgatgtggcaacagacctca

SEQ ID NO: 72798 - DNA, 75 bp, Artificial Sequence
  Synthetic
caacgtgcagattctacaccttggagtccgtgatgtggcaacagacctcacctggatggtgggggaaattcccag

SEQ ID NO: 72799 - DNA, 75 bp, Artificial Sequence
  Synthetic
taaaatccagaaatttatagaatggctcaaagttaaaatcctaccagaagttaaagaaaaacatgagttcttaaa

SEQ ID NO: 72800 - DNA, 75 bp, Artificial Sequence
  Synthetic
atgtgcagtgtaatgcctccaagttccatcaaggatgcttgctggtcgtatgtgttccagaggctgagatggggt

SEQ ID NO: 72801 - DNA, 75 bp, Artificial Sequence
  Synthetic
cagacttaaacaacttccgttactggagagtcagattgccaccattgagcaaagtgcaccttctcagagtgatca

SEQ ID NO: 72802 - DNA, 75 bp, Artificial Sequence
  Synthetic
ccatcaaggatgcttgctggtcgtatgtgttccagaggctgagatggggtgtgcaactatagccaataagccaga

SEQ ID NO: 72803 - DNA, 75 bp, Artificial Sequence
  Synthetic
ggccaacgtcattaatgcaggtatgggagtgggtgttggtaacctaaccattttcccgcatcaatggattaactt

SEQ ID NO: 72804 - DNA, 75 bp, Artificial Sequence
  Synthetic
ggagtgggtgttggtaacctaaccattttcccgcatcaatggattaacttgcgaaccaacaacagtgccacaata

SEQ ID NO: 72805 - DNA, 75 bp, Artificial Sequence
  Synthetic
ctaccaccagacccagaccattttgacggttacaaacaacaggccgttgtgatcatggatgatttatgccagaac

SEQ ID NO: 72806 - DNA, 75 bp, Artificial Sequence
  Synthetic
tttgctcccttgagttatagcacaggtgcaaccacctacgtaccaataacagtgactgtagcgccaatgtgtgca

SEQ ID NO: 72807 - DNA, 75 bp, Artificial Sequence
  Synthetic
acggttacaaacaacaggccgttgtgatcatggatgatttatgccagaacccagatggtaaggatgtttctttgt

SEQ ID NO: 72808 - DNA, 75 bp, Artificial Sequence
  Synthetic
gtgcaaccacctacgtaccaataacagtgactgtagcgccaatgtgtgcagaatacaatggcttgcgattggcgg

SEQ ID NO: 72809 - DNA, 75 bp, Artificial Sequence
  Synthetic
ctccctttgtcctggcttcaaccaacgccggctctattaatgctccaacagtttcagacagtagggcactggcta

SEQ ID NO: 72810 - DNA, 75 bp, Artificial Sequence
  Synthetic
ccgccatgccacagtttgacgtgacgccggagatggcaatccctgggcaagtgaataacttaatggagattgcag

SEQ ID NO: 72811 - DNA, 75 bp, Artificial Sequence
  Synthetic
cgccggctctattaatgctccaacagtttcagacagtagggcactggctaggaggtttcactttgatatgaacat

SEQ ID NO: 72812 - DNA, 75 bp, Artificial Sequence
  Synthetic
gccggagatggcaatccctgggcaagtgaataacttaatggagattgcagaagtcgactccgtagttccagttaa

SEQ ID NO: 72813 - DNA, 75 bp, Artificial Sequence
  Synthetic
ttgcccagtcaactttaagaaatgctgccccttagtgtgtggaaaggctatccagtttatagatagaaggacaca

SEQ ID NO: 72814 - DNA, 75 bp, Artificial Sequence
  Synthetic
agtgtttgggtttcatcttacccctggcgataccagagtgttcaacggaacgctactgggtgaaatccttgacta

SEQ ID NO: 72815 - DNA, 75 bp, Artificial Sequence
  Synthetic
tgccccttagtgtgtggaaaggctatccagtttatagatagaaggacacaagtcagatactcccttgacatgctg

SEQ ID NO: 72816 - DNA, 75 bp, Artificial Sequence
  Synthetic
ggcgataccagagtgttcaacggaacgctactgggtgaaatccttgactattataccctctggtcagggagcatc

SEQ ID NO: 72817 - DNA, 75 bp, Artificial Sequence
  Synthetic
ccaatatatagagagattaagatcagtattgcgccagagacgccaccaccacctgccattgcagatctactcaaa

SEQ ID NO: 72818 - DNA, 75 bp, Artificial Sequence
  Synthetic
ggggcaccaacgaccagaaaggaggcaatgcttggaacgcacgtcatttgggatgtcgggttgcaatccagctgc

SEQ ID NO: 72819 - DNA, 75 bp, Artificial Sequence
  Synthetic
gtattgcgccagagacgccaccaccacctgccattgcagatctactcaaatcagtagacagtgaggctgtgaggg

SEQ ID NO: 72820 - DNA, 75 bp, Artificial Sequence
  Synthetic
caatgcttggaacgcacgtcatttgggatgtcgggttgcaatccagctgcgtgctgtgcatcccgtggattagtc

SEQ ID NO: 72821 - DNA, 75 bp, Artificial Sequence
  Synthetic
cctttatctgtttgcaagcattgactacttttgtctcagtagcaggaatcatctacataatatataaactcttcg

SEQ ID NO: 72822 - DNA, 75 bp, Artificial Sequence
  Synthetic
ttgtagtacctgctgatacacaaagtgactgcaagatcttatgttttgtgtcagcatgcaatgacttctctgtga

SEQ ID NO: 72823 - DNA, 75 bp, Artificial Sequence
  Synthetic
tacttttgtctcagtagcaggaatcatctacataatatataaactcttcgcaggctttcaaggagcatacacggg

SEQ ID NO: 72824 - DNA, 75 bp, Artificial Sequence
  Synthetic
tgactgcaagatcttatgttttgtgtcagcatgcaatgacttctctgtgaggatgctgaaagacacacctttcat

SEQ ID NO: 72825 - DNA, 75 bp, Artificial Sequence
  Synthetic
agccatgatgaagaggaattcgagcacagtgaaaactgaatacggtgagttcactatgctgggtatctatgatag

SEQ ID NO: 72826 - DNA, 75 bp, Artificial Sequence
  Synthetic
aagtagtggccctgtcaattcggagtcaataccggcattaacagcagcagagaccggccacacgtctcaggtggt

SEQ ID NO: 72827 - DNA, 75 bp, Artificial Sequence
  Synthetic
acagtgaaaactgaatacggtgagttcactatgctgggtatctatgataggtgggctgttttgccacgtcatgcc

SEQ ID NO: 72828 - DNA, 75 bp, Artificial Sequence
  Synthetic
tcaataccggcattaacagcagcagagaccggccacacgtctcaggtggtcccagcagacactatgcaaaccagg

SEQ ID NO: 72829 - DNA, 75 bp, Artificial Sequence
  Synthetic
ggtacaaacttggaactgacactacttaagctgaaccgaaatgaaaagttcagagatattaggggcttcttagcc

SEQ ID NO: 72830 - DNA, 75 bp, Artificial Sequence
  Synthetic
actacctacaagaaccatggcaccaatggtgacaactttgcctactgggtgatcagtacaagacaggttgcgcaa

SEQ ID NO: 72831 - DNA, 75 bp, Artificial Sequence
  Synthetic
atggtgacaactttgcctactgggtgatcagtacaagacaggttgcgcaactacgccgcaagttggaaatgttca

SEQ ID NO: 72832 - DNA, 75 bp, Artificial Sequence
  Synthetic
ctgtgctagcaattaacaccagcaagttccctaacatgtatatcccagtgggacaagttacagagtatggcttcc

SEQ ID NO: 72833 - DNA, 75 bp, Artificial Sequence
  Synthetic
actcacctgtgttgactcaccaaataatgtacgtgcccccaggtggtccagtgcccaccaagattgacagttaca

SEQ ID NO: 72834 - DNA, 75 bp, Artificial Sequence
  Synthetic
aatgtacgtgcccccaggtggtccagtgcccaccaagattgacagttacagctggcagacatcaaccaacccaag

SEQ ID NO: 72835 - DNA, 75 bp, Artificial Sequence
  Synthetic
tgctcatgtccactggcaaagttttggggatccatgttggcgggaatggtcatcaaggcttctcagcggcacttc

SEQ ID NO: 72836 - DNA, 75 bp, Artificial Sequence
  Synthetic
ggggatccatgttggcgggaatggtcatcaaggcttctcagcggcacttcttaaacactacttcaatgatgaaca

SEQ ID NO: 72837 - DNA, 75 bp, Artificial Sequence
  Synthetic
gttttatgacgggtgggctaagttcgataaacaaggaacttacggtataaacaccttgaacaacatgggcaccct

SEQ ID NO: 72838 - DNA, 75 bp, Artificial Sequence
  Synthetic
gataaacaaggaacttacggtataaacaccttgaacaacatgggcaccctgtacatgcgtcacgtaaatgatggg

SEQ ID NO: 72839 - DNA, 75 bp, Artificial Sequence
  Synthetic
ggagccaagtgtcttccaccaggtttttgaaggcaataaagagccagcagtcctcaggaatggcgatccacgcct

SEQ ID NO: 72840 - DNA, 75 bp, Artificial Sequence
  Synthetic
cccaggctatgtcaataccagaaagcgggcaatgttaactttgaaccaaccggggtgacggagtctcgcaccgaa

SEQ ID NO: 72841 - DNA, 75 bp, Artificial Sequence
  Synthetic
ggaagctgttgaccattatgctggtcaattggcaaccttagacatcagcaccgagccaatgagattggaagatgc

SEQ ID NO: 72842 - DNA, 75 bp, Artificial Sequence
  Synthetic
cgggcaatgttaactttgaaccaaccggggtgacggagtctcgcaccgaaatcacggcaatgcgaaccactggcg

SEQ ID NO: 72843 - DNA, 75 bp, Artificial Sequence
  Synthetic
taaaaagagggacatcctctcaaagaagaccagagacctgaccaagctgaaggagtgcatggacaagtatggcct

SEQ ID NO: 72844 - DNA, 75 bp, Artificial Sequence
  Synthetic
actggcaaggatgtgtgtgggaggattacaacagggatctcctcgtcagcaccaccacagcctacgggtgtgata

SEQ ID NO: 72845 - DNA, 75 bp, Artificial Sequence
  Synthetic
aggagtgcatggacaagtatggcctaaacctaccaatggtaacctatgtgaaagatgaactcagatctgcagaga

SEQ ID NO: 72846 - DNA, 75 bp, Artificial Sequence
  Synthetic
ttacaacagggatctcctcgtcagcaccaccacagcctacgggtgtgataccatagccagatgccagtgctccac

SEQ ID NO: 72847 - DNA, 75 bp, Artificial Sequence
  Synthetic
ggagagtgaatattaccccaaaagataccagtcccatgttctgctagccgcagggttttctgaaccaggtgattg

SEQ ID NO: 72848 - DNA, 75 bp, Artificial Sequence
  Synthetic
taccagtcccatgttctgctagccgcagggttttctgaaccaggtgattgtggaggcattttgaggtgcgagcac

SEQ ID NO: 72849 - DNA, 75 bp, Artificial Sequence
  Synthetic
gccgtcgggtgtgatccagatctcttttggagcaagataccagtgatgttggatggccatctcgtagcttttgat

SEQ ID NO: 72850 - DNA, 75 bp, Artificial Sequence
  Synthetic
gaagatgacgcgatggagcaaggcgtgaaagattatgttgagcagctaggaaacgcctttggctcaggattcacc

SEQ ID NO: 72851 - DNA, 75 bp, Artificial Sequence
  Synthetic
tgaaagattatgttgagcagctaggaaacgcctttggctcaggattcaccaatcagatctgcgagcaagttaatc

SEQ ID NO: 72852 - DNA, 75 bp, Artificial Sequence
  Synthetic
actacctgtgcaactcccatcacctgtacagggataaacattactttgtgcggggtggcatgccatcaggatgct

SEQ ID NO: 72853 - DNA, 75 bp, Artificial Sequence
  Synthetic
cattagttattgtagtgaggaaccatgatgacctgatcacagtaacggccacacttgccctcattggttgcacca

SEQ ID NO: 72854 - DNA, 75 bp, Artificial Sequence
  Synthetic
tgatgacctgatcacagtaacggccacacttgccctcattggttgcaccacttccccttggcgttggcttaaacg

SEQ ID NO: 72855 - DNA, 75 bp, Artificial Sequence
  Synthetic
gaccaacgcgtgcaagggcatggagtggatagccatcaaaattcagaagtttatagagtggttaaaagttaaaat

SEQ ID NO: 72856 - DNA, 75 bp, Artificial Sequence
  Synthetic
taccattgaacagagcgcaccatcacaaagtgaccaagagcagctgttctccaatgtacagtacttcgcacatta

SEQ ID NO: 72857 - DNA, 75 bp, Artificial Sequence
  Synthetic
catacagttcaagtccaaatgccgtattgaacctgtctgtttgctgctccacgggagccctggagctgggaagtc

SEQ ID NO: 72858 - DNA, 75 bp, Artificial Sequence
  Synthetic
ttggactctttttaaattagagacaatttgaactaattttaattggcttaaccctaccgcactaaccgaactaga

SEQ ID NO: 72859 - DNA, 75 bp, Artificial Sequence
  Synthetic
attgaacctgtctgtttgctgctccacgggagccctggagctgggaagtccgtggcaaccaacctaattgggcgt

SEQ ID NO: 72860 - DNA, 75 bp, Artificial Sequence
  Synthetic
ttaaaacagcctgtgggttgtacccacccacagggcccactgggcgctagcacactggtatcacggtacctttgt

SEQ ID NO: 72861 - DNA, 75 bp, Artificial Sequence
  Synthetic
cacactggtatcacggtacctttgtgcgcctgttttataccccctaccccaactttaaacttagaagcaaagcaa

SEQ ID NO: 72862 - DNA, 75 bp, Artificial Sequence
  Synthetic
caggctgtcgtgatcatggatgatttgtgccagaacccagatgggaaggatgtgtctctcttttgtcagatggtg

SEQ ID NO: 72863 - DNA, 75 bp, Artificial Sequence
  Synthetic
tgtgccagaacccagatgggaaggatgtgtctctcttttgtcagatggtgtccagtgtcgattttgttccaccga

SEQ ID NO: 72864 - DNA, 75 bp, Artificial Sequence
  Synthetic
tagactgctcacgcggttgaaggagaaaacgttcgttacccgaccaactacttcgagaaacctagtaacaccatg

SEQ ID NO: 72865 - DNA, 75 bp, Artificial Sequence
  Synthetic
acgctccaactgtatcagacagtagagctctagcaaggagattccacttcgatatgaatattgaggtcatttcaa

SEQ ID NO: 72866 - DNA, 75 bp, Artificial Sequence
  Synthetic
agctctagcaaggagattccacttcgatatgaatattgaggtcatttcaatgtacagtcagaatggtaaaatcaa

SEQ ID NO: 72867 - DNA, 75 bp, Artificial Sequence
  Synthetic
cggaaaagctatccaattcatagataggaggacgcaggtgaggtactccttggacatgctcgtaactgaaatgtt

SEQ ID NO: 72868 - DNA, 75 bp, Artificial Sequence
  Synthetic
aggaggacgcaggtgaggtactccttggacatgctcgtaactgaaatgtttagggagtacaaccacaggcacagc

SEQ ID NO: 72869 - DNA, 75 bp, Artificial Sequence
  Synthetic
tttgggtgtccgtgtttccttttattctcaaactggctgcttatggtgacaatctcagagttgttaccatatagc

SEQ ID NO: 72870 - DNA, 75 bp, Artificial Sequence
  Synthetic
acccccccgccacccgcaattgccgacttgctaaaatcagtagacagtgaggcagttagggagtactgcaaggat

SEQ ID NO: 72871 - DNA, 75 bp, Artificial Sequence
  Synthetic
acttgctaaaatcagtagacagtgaggcagttagggagtactgcaaggataaggggtggttagtgcccgaagtca

SEQ ID NO: 72872 - DNA, 75 bp, Artificial Sequence
  Synthetic
gttttcagaacattgaattatattctaaccctcaacaagacgaaatgggagcccaagtgtcaacacagaagacgg

SEQ ID NO: 72873 - DNA, 75 bp, Artificial Sequence
  Synthetic
taaccctcaacaagacgaaatgggagcccaagtgtcaacacagaagacgggggcgcacgaaactggactgaatgc

SEQ ID NO: 72874 - DNA, 75 bp, Artificial Sequence
  Synthetic
tggcggggattatatacatcatttacaagctgtttgcaggtttccaaggggcttacactggtttgccaaatcaaa

SEQ ID NO: 72875 - DNA, 75 bp, Artificial Sequence
  Synthetic
caagctgtttgcaggtttccaaggggcttacactggtttgccaaatcaaaaacccaaagtgccaaccttaagaca

SEQ ID NO: 72876 - DNA, 75 bp, Artificial Sequence
  Synthetic
ggacttcacgcaagaccccagcaaatttgcagaaccaatgaaagatgtgatgataaagacactcccagcattaaa

SEQ ID NO: 72877 - DNA, 75 bp, Artificial Sequence
  Synthetic
tttgcagaaccaatgaaagatgtgatgataaagacactcccagcattaaactcaccaaccgtcgaggaatgtggc

SEQ ID NO: 72878 - DNA, 75 bp, Artificial Sequence
  Synthetic
atatggtgaatttacaatgctcgggatttacgacagatgggcggtgttgccccggcacgccaagcctggacctac

SEQ ID NO: 72879 - DNA, 75 bp, Artificial Sequence
  Synthetic
atttacgacagatgggcggtgttgccccggcacgccaagcctggacctaccattataatgaatgaccaagaagtg

SEQ ID NO: 72880 - DNA, 75 bp, Artificial Sequence
  Synthetic
gcgtacggagaatggccatcatacttatcagatggcgaagcaacggcagaggaccagccgacccaaccggacgta

SEQ ID NO: 72881 - DNA, 75 bp, Artificial Sequence
  Synthetic
tatcagatggcgaagcaacggcagaggaccagccgacccaaccggacgtagcgacatgcagattttataccttag

SEQ ID NO: 72882 - DNA, 75 bp, Artificial Sequence
  Synthetic
aatgagaaattcagggacatccgaggcttcctggcaaaagaagaagttgaggttaacgaggctgtactcgcgatt

SEQ ID NO: 72883 - DNA, 75 bp, Artificial Sequence
  Synthetic
gcttcctggcaaaagaagaagttgaggttaacgaggctgtactcgcgattaataccagcaaatttccaaacatgt

SEQ ID NO: 72884 - DNA, 75 bp, Artificial Sequence
  Synthetic
ttggtcaaaacatgcactatcactatttaggtaggacgggatacaccatacatgtacagtgtaatgcctcaaagt

SEQ ID NO: 72885 - DNA, 75 bp, Artificial Sequence
  Synthetic
tttaggtaggacgggatacaccatacatgtacagtgtaatgcctcaaagttccaccaaggatgtgtgcttgtggt

SEQ ID NO: 72886 - DNA, 75 bp, Artificial Sequence
  Synthetic
acaacttccccacccgcgcagggcagtgcggtggcgtcctaatgtcaacaggcaaagtcctcggaatacatgttg

SEQ ID NO: 72887 - DNA, 75 bp, Artificial Sequence
  Synthetic
gtgcggtggcgtcctaatgtcaacaggcaaagtcctcggaatacatgttggtggaaacggacaccagggattctc

SEQ ID NO: 72888 - DNA, 75 bp, Artificial Sequence
  Synthetic
acgagcctcactgttcaccaaggacaaatccacaaatcaacatggcgtgcagactatagtgcataatgcagccat

SEQ ID NO: 72889 - DNA, 75 bp, Artificial Sequence
  Synthetic
aaatccacaaatcaacatggcgtgcagactatagtgcataatgcagccatgggcgtgggagtggggaacttgaca

SEQ ID NO: 72890 - DNA, 75 bp, Artificial Sequence
  Synthetic
ctttccggtcatcaacactcccagtaaaacaaagcttgagcccagtgtcttccatcacgtgtttgagggttataa

SEQ ID NO: 72891 - DNA, 75 bp, Artificial Sequence
  Synthetic
aaaacaaagcttgagcccagtgtcttccatcacgtgtttgagggttataaggagccagcagtgttaaggaatggg

SEQ ID NO: 72892 - DNA, 75 bp, Artificial Sequence
  Synthetic
cccatggacaacatgtacaggcattacaatttcacactaatgatcatacccttcgctaaactggagtacgcggac

SEQ ID NO: 72893 - DNA, 75 bp, Artificial Sequence
  Synthetic
acaatttcacactaatgatcatacccttcgctaaactggagtacgcggacacagcatccagctatgtgcccataa

SEQ ID NO: 72894 - DNA, 75 bp, Artificial Sequence
  Synthetic
gagtacatgctggaagctgttgaccactacgcaggacagctagcaactctggacatcagcacagaacctatgaaa

SEQ ID NO: 72895 - DNA, 75 bp, Artificial Sequence
  Synthetic
actacgcaggacagctagcaactctggacatcagcacagaacctatgaaatttcaggtgccagtgtacggcagtg

SEQ ID NO: 72896 - DNA, 75 bp, Artificial Sequence
  Synthetic
acacaccagggagcactcaatttctcacttcagacgatttccaatcgccttccgccatgcctcagttcgacgtga

SEQ ID NO: 72897 - DNA, 75 bp, Artificial Sequence
  Synthetic
cacttcagacgatttccaatcgccttccgccatgcctcagttcgacgtgacaccagagatgcacataccaggtgc

SEQ ID NO: 72898 - DNA, 75 bp, Artificial Sequence
  Synthetic
ttctatccaagaagaccagagacctatcaaaactgaaaggtttcatggataaatatgggctaaatctccctatgg

SEQ ID NO: 72899 - DNA, 75 bp, Artificial Sequence
  Synthetic
atcaaaactgaaaggtttcatggataaatatgggctaaatctccctatggtgacacgcctgaaggatgagttaag

SEQ ID NO: 72900 - DNA, 75 bp, Artificial Sequence
  Synthetic
gatggacgcgtacaggatccccgtcatgacctcgaaagcaggagaacaggtttttggcttccaattggaccctgg

SEQ ID NO: 72901 - DNA, 75 bp, Artificial Sequence
  Synthetic
atgacctcgaaagcaggagaacaggtttttggcttccaattggaccctggacatggcactgttatgtgtaggaca

SEQ ID NO: 72902 - DNA, 75 bp, Artificial Sequence
  Synthetic
acagacctttggaaatttgtataaaacatttcatatgaatccaggcatagtgacaggcagtgcagttgggtgtga

SEQ ID NO: 72903 - DNA, 75 bp, Artificial Sequence
  Synthetic
acatttcatatgaatccaggcatagtgacaggcagtgcagttgggtgtgatcccgatctcttctggagtaaaatc

SEQ ID NO: 72904 - DNA, 75 bp, Artificial Sequence
  Synthetic
gcaatggcaactggtaaattcttgttggcttatgcgccaccaggtgctggctttcccaccaccaggaaggatgca

SEQ ID NO: 72905 - DNA, 75 bp, Artificial Sequence
  Synthetic
tggcttatgcgccaccaggtgctggctttcccaccaccaggaaggatgcaatgctgggaacacatgttgtgtggg

SEQ ID NO: 72906 - DNA, 75 bp, Artificial Sequence
  Synthetic
gcatgcctgaaactgctgctagagaagctggggtactcacacaaagaaaccaactacatagattatttgtgcaac

SEQ ID NO: 72907 - DNA, 75 bp, Artificial Sequence
  Synthetic
acatatacaccagtgcaggttttatcacatgttggtatcaaaccagtattgttgtcccagcaagcacaccacagc

SEQ ID NO: 72908 - DNA, 75 bp, Artificial Sequence
  Synthetic
cacatgttggtatcaaaccagtattgttgtcccagcaagcacaccacagcagagcaccatcttgtgctttgtctc

SEQ ID NO: 72909 - DNA, 75 bp, Artificial Sequence
  Synthetic
ttcaactcaatgattaataacattattattagaacactaatgttgaaggtgtacaagggaatagacctggaccaa

SEQ ID NO: 72910 - DNA, 75 bp, Artificial Sequence
  Synthetic
ccagcacaatggggcgatcgttgccaacacaacagctagcggaccttctaattcggaaagcataccggcacttac

SEQ ID NO: 72911 - DNA, 75 bp, Artificial Sequence
  Synthetic
aacacaacagctagcggaccttctaattcggaaagcataccggcacttactgcggctgagactggccacacatcg

SEQ ID NO: 72912 - DNA, 75 bp, Artificial Sequence
  Synthetic
tgacaccagccgacaagggagagtgcttcaacgaagtgacatggaccaacgtcaccttcctgaaaagatacttta

SEQ ID NO: 72913 - DNA, 75 bp, Artificial Sequence
  Synthetic
cttcaacgaagtgacatggaccaacgtcaccttcctgaaaagatactttagggcagatgagcagtatcctttcct

SEQ ID NO: 72914 - DNA, 75 bp, Artificial Sequence
  Synthetic
aacttcctgtgtagatctgcctgtgtgtactacaccacgtacaacactcagggcgagcaagcacatgataaatac

SEQ ID NO: 72915 - DNA, 75 bp, Artificial Sequence
  Synthetic
tgtactacaccacgtacaacactcagggcgagcaagcacatgataaatacgcaagttggccaatcacgactagaa

SEQ ID NO: 72916 - DNA, 75 bp, Artificial Sequence
  Synthetic
tcatgtgcgatccttgtgcctattggcctggcacaatggagagcaagaatatgaggagtttgtgtccaaaatcag

SEQ ID NO: 72917 - DNA, 75 bp, Artificial Sequence
  Synthetic
cgagcgcccagatcacatccacgaaccaaaaccaggatgccccagtactcacacatcaggtgatgtatgtacccc

SEQ ID NO: 72918 - DNA, 75 bp, Artificial Sequence
  Synthetic
ccaaaaccaggatgccccagtactcacacatcaggtgatgtatgtacccccagggggggtggtaccgcgcagtgt

SEQ ID NO: 72919 - DNA, 75 bp, Artificial Sequence
  Synthetic
aattggagccaatttgatgtgatttgaattggcccaaccctaccacactcaccgaactagaccatagtgtggtag

SEQ ID NO: 72920 - DNA, 75 bp, Artificial Sequence
  Synthetic
aataccattcattagtgtgggcaacgcctacagcagcttttacgacgggtggtcacactttgaacaaaccggggt

SEQ ID NO: 72921 - DNA, 75 bp, Artificial Sequence
  Synthetic
gcctacagcagcttttacgacgggtggtcacactttgaacaaaccggggtatatggattcaatacccttaataat

SEQ ID NO: 72922 - DNA, 75 bp, Artificial Sequence
  Synthetic
aattgggttttgaccaagcacttctgttaccccggactgagtaccaataggctgccaaagcggctgaaggggaaa

SEQ ID NO: 72923 - DNA, 75 bp, Artificial Sequence
  Synthetic
aaacctaaacatgtgaaagcgtggatacctaggcccccacggttgtgcgactatgtgaaatctggcaacgtcaac

SEQ ID NO: 72924 - DNA, 75 bp, Artificial Sequence
  Synthetic
tacctaggcccccacggttgtgcgactatgtgaaatctggcaacgtcaactttgaaccaaaaggagtcaccgaga

SEQ ID NO: 72925 - DNA, 75 bp, Artificial Sequence
  Synthetic
ctggggtaatctacgtgggcaattatagagtggtcaacaggcacctagctacccgcaccgactggaagaatctcg

SEQ ID NO: 72926 - DNA, 75 bp, Artificial Sequence
  Synthetic
tagagtggtcaacaggcacctagctacccgcaccgactggaagaatctcgtgtgggaggactacaacagggactt

SEQ ID NO: 72927 - DNA, 75 bp, Artificial Sequence
  Synthetic
gggtgtccgtgtttctttttattcttacactggctgcttatggtgacaattgaagaattgttaccatatagctat

SEQ ID NO: 72928 - DNA, 75 bp, Artificial Sequence
  Synthetic
ccagagtaaaaacaaacactatccagtttcatttgaaggcccaggattggttgaggttcaagagagtgaatacta

SEQ ID NO: 72929 - DNA, 75 bp, Artificial Sequence
  Synthetic
gtttcatttgaaggcccaggattggttgaggttcaagagagtgaatactaccccagaaggtatcagtctcatgtg

SEQ ID NO: 72930 - DNA, 75 bp, Artificial Sequence
  Synthetic
gtaaggactctcaatttcattttgtgcttgaataaggcgaaatgggggcacaagtttcaacacaaaagacaggag

SEQ ID NO: 72931 - DNA, 75 bp, Artificial Sequence
  Synthetic
gcttgaataaggcgaaatgggggcacaagtttcaacacaaaagacaggagcccatgaaacatcgctgaacgcatc

SEQ ID NO: 72932 - DNA, 75 bp, Artificial Sequence
  Synthetic
gtgaccatgggcggtgagggtgttgtcggatttgccgatgtgcgagatctcttgtggttggaggatgatgccatg

SEQ ID NO: 72933 - DNA, 75 bp, Artificial Sequence
  Synthetic
cttctctcaagaccccagcaagtttactgagccactaaaagatgtgatgattaaatcgctccccgcactcaactc

SEQ ID NO: 72934 - DNA, 75 bp, Artificial Sequence
  Synthetic
gggtttctccaaccagatctgtgaacaggtcaatctcttgaaagagtctttgataggacaagactctatcctaga

SEQ ID NO: 72935 - DNA, 75 bp, Artificial Sequence
  Synthetic
actgagccactaaaagatgtgatgattaaatcgctccccgcactcaactcaccatcggcggaagagtgcgggtac

SEQ ID NO: 72936 - DNA, 75 bp, Artificial Sequence
  Synthetic
ggtgactgccacactagccctcattggttgtacctcgtccccatggcgatggctcaaacagaaagtgtcccaata

SEQ ID NO: 72937 - DNA, 75 bp, Artificial Sequence
  Synthetic
tatggtgagtggcctgaatacctagcagatgatcaggccactgcagaagaccaaccgacccaaccggacgttgcc

SEQ ID NO: 72938 - DNA, 75 bp, Artificial Sequence
  Synthetic
cagatgatcaggccactgcagaagaccaaccgacccaaccggacgttgccacgtgtcgtttttacacgcttgatt

SEQ ID NO: 72939 - DNA, 75 bp, Artificial Sequence
  Synthetic
caaaataacggctggcttaagaagttcactgagatgacaaatgcttgcaagggtatggaatggatagccaccaaa

SEQ ID NO: 72940 - DNA, 75 bp, Artificial Sequence
  Synthetic
gccaaaacatgtactaccactatctgggtagagcgggatacacaatccacgtacagtgcaatgcctcgcgctttc

SEQ ID NO: 72941 - DNA, 75 bp, Artificial Sequence
  Synthetic
gggtagagcgggatacacaatccacgtacagtgcaatgcctcgcgctttcatcaaggttgcttgctggtcgtgtg

SEQ ID NO: 72942 - DNA, 75 bp, Artificial Sequence
  Synthetic
ggctttgcaatttaccgaaactggatctggtggcacgacggcgggggtgcaaacagctgtgtgtaacgctggcat

SEQ ID NO: 72943 - DNA, 75 bp, Artificial Sequence
  Synthetic
agagtgttctcccttgaaaagaagatgagcaactacatacagttcaagtccaaatgccgtattgagcctgtatgt

SEQ ID NO: 72944 - DNA, 75 bp, Artificial Sequence
  Synthetic
tctggtggcacgacggcgggggtgcaaacagctgtgtgtaacgctggcatgggtgtcgctgttggaaatctcact

SEQ ID NO: 72945 - DNA, 75 bp, Artificial Sequence
  Synthetic
aattggaaggtcacttgctgaaaagcttaacagctcagtgtactcactacccccagatccagatcacttcgatgg

SEQ ID NO: 72946 - DNA, 75 bp, Artificial Sequence
  Synthetic
cccatggataacatgtttaggcactataattttaccctaatgatcattccattcgtgccattggccgaaatggga

SEQ ID NO: 72947 - DNA, 75 bp, Artificial Sequence
  Synthetic
ataattttaccctaatgatcattccattcgtgccattggccgaaatgggaggaaccacttatgtacccatcaccg

SEQ ID NO: 72948 - DNA, 75 bp, Artificial Sequence
  Synthetic
tcaaatggtctccagcgtggacttcgtaccacccatggctgccctggaagagaaaggcattttgttcacctcccc

SEQ ID NO: 72949 - DNA, 75 bp, Artificial Sequence
  Synthetic
cacccggtagtgatcagttcttgacctcagatgattaccagtcaccatgtgctatgccagagtacgatgtcacac

SEQ ID NO: 72950 - DNA, 75 bp, Artificial Sequence
  Synthetic
ctcagatgattaccagtcaccatgtgctatgccagagtacgatgtcacaccaccaatgcggatccccggtgaagt

SEQ ID NO: 72951 - DNA, 75 bp, Artificial Sequence
  Synthetic
gcgcgtttaccagatcccagttagtgcagcgaacagctcacaaacagagtcagtatttgcctttcaactagatcc

SEQ ID NO: 72952 - DNA, 75 bp, Artificial Sequence
  Synthetic
gcagcgaacagctcacaaacagagtcagtatttgcctttcaactagatcccgggcatggtagtgttttgaataga

SEQ ID NO: 72953 - DNA, 75 bp, Artificial Sequence
  Synthetic
ctgagatgttcagggaatacaatcacaggcacagtgttggggcaacccttgaggcgctattccagggtccaccga

SEQ ID NO: 72954 - DNA, 75 bp, Artificial Sequence
  Synthetic
caggcacagtgttggggcaacccttgaggcgctattccagggtccaccgatatacagagaaattaagatcagcgt

SEQ ID NO: 72955 - DNA, 75 bp, Artificial Sequence
  Synthetic
tcagccatggccaccggtaagctcttactagcctactcaccacctggggccgatgtgcctaaatctcgaaaagat

SEQ ID NO: 72956 - DNA, 75 bp, Artificial Sequence
  Synthetic
tactagcctactcaccacctggggccgatgtgcctaaatctcgaaaagatgcaatgttgggaacccacatagtat

SEQ ID NO: 72957 - DNA, 75 bp, Artificial Sequence
  Synthetic
ctgcaaagaaaaaggatggctagttccagaaattaactccaccctacagattgagaagcacgttagccgggcctt

SEQ ID NO: 72958 - DNA, 75 bp, Artificial Sequence
  Synthetic
aggacgcatattcagctgccggttacatctcatgctggtaccaaacaaatataattgtgccaccatcaacaccca

SEQ ID NO: 72959 - DNA, 75 bp, Artificial Sequence
  Synthetic
catctcatgctggtaccaaacaaatataattgtgccaccatcaacacccacgcagtgcttcctgttgggctttgt

SEQ ID NO: 72960 - DNA, 75 bp, Artificial Sequence
  Synthetic
acataatttataaactctttgcaggcttccaaggagcatatacggggatgcccaaccagaaacccagagtgccca

SEQ ID NO: 72961 - DNA, 75 bp, Artificial Sequence
  Synthetic
agatgatccaccgcattcgatctcaaacacggttgcaaacaccaaccctagtggtccaaccaactcagaaaggat

SEQ ID NO: 72962 - DNA, 75 bp, Artificial Sequence
  Synthetic
aacacggttgcaaacaccaaccctagtggtccaaccaactcagaaaggatcccagcgctcacagcagcggaaact

SEQ ID NO: 72963 - DNA, 75 bp, Artificial Sequence
  Synthetic
tgaagactgagtatggtgaattcaccatgttaggcatttatgacaggtgggctgttttgccgcgccatgccaagc

SEQ ID NO: 72964 - DNA, 75 bp, Artificial Sequence
  Synthetic
tcatcaattgagaactttttgtgcagatcagcttgcgcacacatgtcatcgtatgaggccttcccaacaacaaca

SEQ ID NO: 72965 - DNA, 75 bp, Artificial Sequence
  Synthetic
aaagaattagtggataaggacggtacaaacctagaattgacactgctcaagttgaacaggaatgaaaaattcaga

SEQ ID NO: 72966 - DNA, 75 bp, Artificial Sequence
  Synthetic
gatcagcttgcgcacacatgtcatcgtatgaggccttcccaacaacaacacaagacggtacacaaaggttcgcca

SEQ ID NO: 72967 - DNA, 75 bp, Artificial Sequence
  Synthetic
cccaacatgtatatcccagtgggacaagtcacggactacggctttctaaacctgggtggcacgcccactaagaga

SEQ ID NO: 72968 - DNA, 75 bp, Artificial Sequence
  Synthetic
tggaggtgacttttgtgataactagtgtgatcgaaactacaaaagggaaagtaccggcaccagcagtcacacacc

SEQ ID NO: 72969 - DNA, 75 bp, Artificial Sequence
  Synthetic
tgtgatcgaaactacaaaagggaaagtaccggcaccagcagtcacacaccaagtaatgtacattccaccaggcgg

SEQ ID NO: 72970 - DNA, 75 bp, Artificial Sequence
  Synthetic
gagcaggtcagtgtggtggagtgctcatgtccaccggcaaagttttgggaattcatgttggggggaatggccatc

SEQ ID NO: 72971 - DNA, 75 bp, Artificial Sequence
  Synthetic
tgctcccccacgcatgtctataccatttatcggcattggtaatgcctacagcatgttctatgacggatgggccag

SEQ ID NO: 72972 - DNA, 75 bp, Artificial Sequence
  Synthetic
tttatcggcattggtaatgcctacagcatgttctatgacggatgggccagtttcagacaatcgggtggatatgga

SEQ ID NO: 72973 - DNA, 75 bp, Artificial Sequence
  Synthetic
aggaagcaggattcccagtcatcaacacacctaacaagaccaaactagagccgagcgtcttccaccaggtttttg

SEQ ID NO: 72974 - DNA, 75 bp, Artificial Sequence
  Synthetic
gtcaggatatatttcaagcccaagcacgttagggcttggattcctagaccgcccagggtgtgtcagtacatttac

SEQ ID NO: 72975 - DNA, 75 bp, Artificial Sequence
  Synthetic
ccaaatacatcggaaatgtcaacacacacgtggatgagtacatgctggaagctgtcgaccattacgctgggcaat

SEQ ID NO: 72976 - DNA, 75 bp, Artificial Sequence
  Synthetic
acacgtggatgagtacatgctggaagctgtcgaccattacgctgggcaattggttactttagacatcagcactga

SEQ ID NO: 72977 - DNA, 75 bp, Artificial Sequence
  Synthetic
acgttagggcttggattcctagaccgcccagggtgtgtcagtacatttacaaggcaaatgtagactacgcagtgt

SEQ ID NO: 72978 - DNA, 75 bp, Artificial Sequence
  Synthetic
ttggtcaccagtccggagccgtctacgtaggcaactacagggtggttaacagacacttagcgacacacaccgatt

SEQ ID NO: 72979 - DNA, 75 bp, Artificial Sequence
  Synthetic
cccctatgtcgcactaggcatcaagaagagagacattctctcaaagaagaccaaggacttgaccaagctaaaaga

SEQ ID NO: 72980 - DNA, 75 bp, Artificial Sequence
  Synthetic
cgtaggcaactacagggtggttaacagacacttagcgacacacaccgattggcaaaattgtgtgtgggaggatta

SEQ ID NO: 72981 - DNA, 75 bp, Artificial Sequence
  Synthetic
tgtgtatttttgtgcctcaaagaacaagcactacccaatcagcttcgaaggaccaggcttggtggaagtccagga

SEQ ID NO: 72982 - DNA, 75 bp, Artificial Sequence
  Synthetic
agcaaaaggaaaatctaggctgattgaagcatccagtctgaatgattcagtggcaatgagacagacatttggcaa

SEQ ID NO: 72983 - DNA, 75 bp, Artificial Sequence
  Synthetic
aagcactacccaatcagcttcgaaggaccaggcttggtggaagtccaggagagtgagtactacccaaaaagatat

SEQ ID NO: 72984 - DNA, 75 bp, Artificial Sequence
  Synthetic
ttgggtgcgacccagacctcttttggagcaaaataccagtgatgttggatggacatctcatagcatttgattact

SEQ ID NO: 72985 - DNA, 75 bp, Artificial Sequence
  Synthetic
gtcatcggtctcgtcactatgggtggcgagggcgtggttggttttgccgacgtccgtgatctactgtggttggag

SEQ ID NO: 72986 - DNA, 75 bp, Artificial Sequence
  Synthetic
ggacatctcatagcatttgattactctgggtatgatgctagtttaagtcctgtctggtttgcttgtttaaaaatg

SEQ ID NO: 72987 - DNA, 75 bp, Artificial Sequence
  Synthetic
gcgagggcgtggttggttttgccgacgtccgtgatctactgtggttggaggatgacgcaatggagcagggagtca

SEQ ID NO: 72988 - DNA, 75 bp, Artificial Sequence
  Synthetic
tgaaggagtcccttgtcggtcaagactccatactcgagaagtccctcaaagccttggtcaaaatcatctcggcac

SEQ ID NO: 72989 - DNA, 75 bp, Artificial Sequence
  Synthetic
aacaatatcattatcaggacattaatgctgaaagtgtacaagggaattgacttagaccagttcaggatgatcgca

SEQ ID NO: 72990 - DNA, 75 bp, Artificial Sequence
  Synthetic
cgatcttatcacagtgaccgctacactagcactgattggatgcaccacatccccctggcgatggctcaagcgaaa

SEQ ID NO: 72991 - DNA, 75 bp, Artificial Sequence
  Synthetic
gggttgatcatgacaccagcagataagggagagtgctttaatgaagtcacctggaccaatgttacttttctaaag

SEQ ID NO: 72992 - DNA, 75 bp, Artificial Sequence
  Synthetic
agggagagtgctttaatgaagtcacctggaccaatgttacttttctaaagaggtacttcagagcagatgaacaat

SEQ ID NO: 72993 - DNA, 75 bp, Artificial Sequence
  Synthetic
acactcaggatcatgtgcgctcactgtgtctactagcatggcacaacggagagcatgagtatgaggagttcattc

SEQ ID NO: 72994 - DNA, 75 bp, Artificial Sequence
  Synthetic
gtgtctactagcatggcacaacggagagcatgagtatgaggagttcattcgcaaaattagaagcgtcccagtcgg

SEQ ID NO: 72995 - DNA, 75 bp, Artificial Sequence
  Synthetic
ttaaaacagcctgtgggttgttcccacccacagggcccattgggcgctagcacactggtatcacggtacccttgt

SEQ ID NO: 72996 - DNA, 75 bp, Artificial Sequence
  Synthetic
ctagctgagaaattgaatagttcagtgtattctttgccaccagacccagaccactttgatggatacaagcaacag

SEQ ID NO: 72997 - DNA, 75 bp, Artificial Sequence
  Synthetic
tgtattctttgccaccagacccagaccactttgatggatacaagcaacaggctgttgtgatcatggatgatttgt

SEQ ID NO: 72998 - DNA, 75 bp, Artificial Sequence
  Synthetic
ggctgctcacgcggccgaaggagaaaatgttcgttacccggccaattacttcgagaaacctagtaccaccatgaa

SEQ ID NO: 72999 - DNA, 75 bp, Artificial Sequence
  Synthetic
cgccaacagtgtcagacagccgggctttggctagaaggttccattttgatatgaacattgaagttatttccatgt

SEQ ID NO: 73000 - DNA, 75 bp, Artificial Sequence
  Synthetic
tttggctagaaggttccattttgatatgaacattgaagttatttccatgtacagccaaaatgggaagatcaacat

SEQ ID NO: 73001 - DNA, 75 bp, Artificial Sequence
  Synthetic
caaggctattcaatttattgacagaagaacccaagtcagatattctttagatatgttggtcacagagatgtttag

SEQ ID NO: 73002 - DNA, 75 bp, Artificial Sequence
  Synthetic
aactctgcagcggaaccgactactttgggtgtccgtgtttccttttattcttgtactggctgcttatggtgacaa

SEQ ID NO: 73003 - DNA, 75 bp, Artificial Sequence
  Synthetic
agaacccaagtcagatattctttagatatgttggtcacagagatgtttagggaatacaaccacaggcacagtgtc

SEQ ID NO: 73004 - DNA, 75 bp, Artificial Sequence
  Synthetic
ttgagagattgttaccatatagctattggattggccatccagtgtcaaacagagcgattgtctacttgttcattg

SEQ ID NO: 73005 - DNA, 75 bp, Artificial Sequence
  Synthetic
ccaccaccaccagcaattgctgatttattgaaatcagtggacagtgaagcagtcagggagtattgtaaagagaaa

SEQ ID NO: 73006 - DNA, 75 bp, Artificial Sequence
  Synthetic
tattgaaatcagtggacagtgaagcagtcagggagtattgtaaagagaaaggatggctagttcctgaaattaatt

SEQ ID NO: 73007 - DNA, 75 bp, Artificial Sequence
  Synthetic
tcaggtgtcaacgcagaaaacaggagcgcacgaaactggactgaacgctagcggaaattccatcattcactacac

SEQ ID NO: 73008 - DNA, 75 bp, Artificial Sequence
  Synthetic
gcgcacgaaactggactgaacgctagcggaaattccatcattcactacacgaatattaattactacaaggactcc

SEQ ID NO: 73009 - DNA, 75 bp, Artificial Sequence
  Synthetic
ctggaatcatttatattatttacaagttgtttgcaggattccagggcgcatacacggggatgcccaaccagaaac

SEQ ID NO: 73010 - DNA, 75 bp, Artificial Sequence
  Synthetic
attaaaaccttgcccgcactaaattcaccatctgctgaggagtgcgggtttagcgatagagtgaggtcaatcact

SEQ ID NO: 73011 - DNA, 75 bp, Artificial Sequence
  Synthetic
caccatctgctgaggagtgcgggtttagcgatagagtgaggtcaatcactatagggaactctactattaccactc

SEQ ID NO: 73012 - DNA, 75 bp, Artificial Sequence
  Synthetic
tatgacaggtgggctgtcttaccacgccacgctaaacctgggccaaccattctcatgaatgatcaagaagttggc

SEQ ID NO: 73013 - DNA, 75 bp, Artificial Sequence
  Synthetic
atcaacctacacaaccggatgttgcgacatgtagattctacactctggagtcagtgcagtggcaagagaattcag

SEQ ID NO: 73014 - DNA, 75 bp, Artificial Sequence
  Synthetic
cagggtggtggtggaaatttcctgatgcacttagtaacatgggcctctttggtcagaacatgttgtaccactatc

SEQ ID NO: 73015 - DNA, 75 bp, Artificial Sequence
  Synthetic
ttcctgtggggcaggtcacagactatggtttcctaaacctaggtggcactcctactaagagaatgttgatgtaca

SEQ ID NO: 73016 - DNA, 75 bp, Artificial Sequence
  Synthetic
gcgttcctgaagctgagatggggtgttcaaaagtagacggagttgttaacgctcaaggattgtctaagggcgaaa

SEQ ID NO: 73017 - DNA, 75 bp, Artificial Sequence
  Synthetic
ctcccattgagtttgaaagaacgagcacaacagcagaggttggggtggtgcaaaaggcggtgtacaatgcaggca

SEQ ID NO: 73018 - DNA, 75 bp, Artificial Sequence
  Synthetic
ggaatggtcatcagggtttctcggcagctctccttaagcattacttcaacgatgagcaaggcgagattgagttca

SEQ ID NO: 73019 - DNA, 75 bp, Artificial Sequence
  Synthetic
tagtaataccatacataaattgtgtgcccatggacaatatgttcagacacaacaatttcaccctcatggttaccc

SEQ ID NO: 73020 - DNA, 75 bp, Artificial Sequence
  Synthetic
gcccatggacaatatgttcagacacaacaatttcaccctcatggttaccccatttgcaccactaaaaagcagtgg

SEQ ID NO: 73021 - DNA, 75 bp, Artificial Sequence
  Synthetic
acatcaaggtctgccgaccatgaacactccagggagtacacagttccttacgtccgatgattttcaatcaccttg

SEQ ID NO: 73022 - DNA, 75 bp, Artificial Sequence
  Synthetic
tgccatgcctgagtttgacgtgacgccgtgcatggacatccccggtgaggtgcacaacttaatggagatcgctga

SEQ ID NO: 73023 - DNA, 75 bp, Artificial Sequence
  Synthetic
ctaggtattaagaagagagacatcttgtccaagaagaccaaggacctaaccaaattaaaagaatgcatggataag

SEQ ID NO: 73024 - DNA, 75 bp, Artificial Sequence
  Synthetic
aacacctctacgcacatggaggggactgatgcattccagatcaaggtcaccgctgggaacgtgcaagataaaagt

SEQ ID NO: 73025 - DNA, 75 bp, Artificial Sequence
  Synthetic
caggcaacagcactgtgctacgccgcacattgttgggtgaaatactaaattattatgcacactggtcaggtagca

SEQ ID NO: 73026 - DNA, 75 bp, Artificial Sequence
  Synthetic
tctagactcattgaagcatccagcttgaacgattccgttgcaatgagacaaacgtttggcaacttgtacaagaca

SEQ ID NO: 73027 - DNA, 75 bp, Artificial Sequence
  Synthetic
tgaacgattccgttgcaatgagacaaacgtttggcaacttgtacaagacattccacctgaacccgggaattgtga

SEQ ID NO: 73028 - DNA, 75 bp, Artificial Sequence
  Synthetic
cgtccgtcccgaaatcccgcagagacgccatgctagggacccatgtcatctgggatgtgggcctacagtcgagtt

SEQ ID NO: 73029 - DNA, 75 bp, Artificial Sequence
  Synthetic
cgccatgctagggacccatgtcatctgggatgtgggcctacagtcgagttgtgtgttatgcgtaccatggatcag

SEQ ID NO: 73030 - DNA, 75 bp, Artificial Sequence
  Synthetic
cttttgattactccggatatgatgccagcttgagccctgtttggttcgcttgtctaaaactgttacttgaaaagc

SEQ ID NO: 73031 - DNA, 75 bp, Artificial Sequence
  Synthetic
tgtctaaaactgttacttgaaaagctcgggtatacacacaaggagacaaattatattgactacctgtgcaactct

SEQ ID NO: 73032 - DNA, 75 bp, Artificial Sequence
  Synthetic
catagtggtcccgcccgaaaccccatctgactgtgtggtattatgtttcgtgtccgcgtgcaatgatttctctgt

SEQ ID NO: 73033 - DNA, 75 bp, Artificial Sequence
  Synthetic
tctgactgtgtggtattatgtttcgtgtccgcgtgcaatgatttctctgtgcggatgctcaaagacactcctttt

SEQ ID NO: 73034 - DNA, 75 bp, Artificial Sequence
  Synthetic
atacgcagtgggccttctaactctgaagcggtcccggcactcacagctgctgagactggacacacctcacaagtg

SEQ ID NO: 73035 - DNA, 75 bp, Artificial Sequence
  Synthetic
aagcggtcccggcactcacagctgctgagactggacacacctcacaagtggtgcccagtgacactatgcaaacta

SEQ ID NO: 73036 - DNA, 75 bp, Artificial Sequence
  Synthetic
tggccaagtatgaagcaaggggtgaccctgagagcacagatcgctttgatgcatgggagataagcgtgcgtgaca

SEQ ID NO: 73037 - DNA, 75 bp, Artificial Sequence
  Synthetic
aatgttcacgtacctacgtttcgacgtagaggtcacgttcgtaattactagttaccagcatcaaggtaccattaa

SEQ ID NO: 73038 - DNA, 75 bp, Artificial Sequence
  Synthetic
tggcacaatggggaacatgaatatgaagagttcattcgaaagatcagaagcgttccggtcggacgctgtttgact

SEQ ID NO: 73039 - DNA, 75 bp, Artificial Sequence
  Synthetic
ttatgagtggcagacctcgaccaaccctagtatattttggactgaagggaatgctccacctaggatgtccattcc

SEQ ID NO: 73040 - DNA, 75 bp, Artificial Sequence
  Synthetic
cctagtatattttggactgaagggaatgctccacctaggatgtccattccgtttattagcattggcaatgcctac

SEQ ID NO: 73041 - DNA, 75 bp, Artificial Sequence
  Synthetic
aatgcaacatagaagcttagtccaaaaggtcaataggcagcccagtgcaccaactgggtccagaccaagcacttc

SEQ ID NO: 73042 - DNA, 75 bp, Artificial Sequence
  Synthetic
catatttactgcaggcacgtaaacaaagagacacccgctgaggtcaccagttacattaggatttacttcaagcct

SEQ ID NO: 73043 - DNA, 75 bp, Artificial Sequence
  Synthetic
aagagacacccgctgaggtcaccagttacattaggatttacttcaagcctaagcacatcagagcgtgggtaccaa

SEQ ID NO: 73044 - DNA, 75 bp, Artificial Sequence
  Synthetic
ataccatcaacactgtccctgtatcaaatcacgggagtggacgccgcggtgatttggccgcgctgagcacacatg

SEQ ID NO: 73045 - DNA, 75 bp, Artificial Sequence
  Synthetic
aaatcacgggagtggacgccgcggtgatttggccgcgctgagcacacatggcgcttttggccaacaatctggagc

SEQ ID NO: 73046 - DNA, 75 bp, Artificial Sequence
  Synthetic
gtctattgagctagttggtagtcctccggcccctgaatgcggctaatcctaactgcggagcgtgcgcttgcaacc

SEQ ID NO: 73047 - DNA, 75 bp, Artificial Sequence
  Synthetic
agattataacagagatctcctagtgagcacaacgaccgctcatgggtgtgacacgatagctagatgccaatgtaa

SEQ ID NO: 73048 - DNA, 75 bp, Artificial Sequence
  Synthetic
agcacaacgaccgctcatgggtgtgacacgatagctagatgccaatgtaaaacaggtgtatatttctgccaatcc

SEQ ID NO: 73049 - DNA, 75 bp, Artificial Sequence
  Synthetic
ttgagagattgttgccatatagctattggattggccatccggtatctaacagggcgatcatttacctgtttgttg

SEQ ID NO: 73050 - DNA, 75 bp, Artificial Sequence
  Synthetic
agataccagtcccatgtgttgctagcggcaggattttcagaacctggcgactgtggtggcattctaagatgtgat

SEQ ID NO: 73051 - DNA, 75 bp, Artificial Sequence
  Synthetic
acaagtatcaacacagaaaactggggcacacgaaactggcctgagtgccagcggaggctccattatccactacac

SEQ ID NO: 73052 - DNA, 75 bp, Artificial Sequence
  Synthetic
cggcaggattttcagaacctggcgactgtggtggcattctaagatgtgatcatggagtcattggtctagtgacca

SEQ ID NO: 73053 - DNA, 75 bp, Artificial Sequence
  Synthetic
gcacacgaaactggcctgagtgccagcggaggctccattatccactacacaaacatcaattactacaaggatgca

SEQ ID NO: 73054 - DNA, 75 bp, Artificial Sequence
  Synthetic
gggtcaaagactatgtggaacaacttgggaatgctttcggatcgggcttcaccaaccaaatatgcgaacaggtca

SEQ ID NO: 73055 - DNA, 75 bp, Artificial Sequence
  Synthetic
ataaagtcgatgccggcgctaaattcgccgtcggcagaggagtgtgggtatagcgatagggtgaggtctataaca

SEQ ID NO: 73056 - DNA, 75 bp, Artificial Sequence
  Synthetic
tgggaatgctttcggatcgggcttcaccaaccaaatatgcgaacaggtcaacctgctcaaggaatcactgattgg

SEQ ID NO: 73057 - DNA, 75 bp, Artificial Sequence
  Synthetic
cgccgtcggcagaggagtgtgggtatagcgatagggtgaggtctataacactgggaaattccactatcaccacgc

SEQ ID NO: 73058 - DNA, 75 bp, Artificial Sequence
  Synthetic
tcacgacgacctcatcacagtgacagccaccctcgcacttataggctgtacaacatcgccatggcgctggctcaa

SEQ ID NO: 73059 - DNA, 75 bp, Artificial Sequence
  Synthetic
accaaccaacgcagccagacgtcgcaacatgtagattttacacattatcatccgtgcagtggcagagagaatctg

SEQ ID NO: 73060 - DNA, 75 bp, Artificial Sequence
  Synthetic
gccaccctcgcacttataggctgtacaacatcgccatggcgctggctcaagcagaaggtatcacaatactatgga

SEQ ID NO: 73061 - DNA, 75 bp, Artificial Sequence
  Synthetic
aacatgtagattttacacattatcatccgtgcagtggcagagagaatctgctggttggtggtggaagtttcccga

SEQ ID NO: 73062 - DNA, 75 bp, Artificial Sequence
  Synthetic
gagtggatagccgtcaaaatccagaagttcatagaatggttgaaggtcaaaatcctaccggaggtcaaggagaaa

SEQ ID NO: 73063 - DNA, 75 bp, Artificial Sequence
  Synthetic
cgtacagtgcaacgcatccaagtttcatcagggatgcttgctggtcgtatgtgtgcctgaggctgaaatggggtg

SEQ ID NO: 73064 - DNA, 75 bp, Artificial Sequence
  Synthetic
catcagggatgcttgctggtcgtatgtgtgcctgaggctgaaatggggtgcactaacaaagaaaacacccctcta

SEQ ID NO: 73065 - DNA, 75 bp, Artificial Sequence
  Synthetic
aactgcccctattggaaagccagattgctaccattgagcagagcgcaccctcacagagcgatcaggagcaactat

SEQ ID NO: 73066 - DNA, 75 bp, Artificial Sequence
  Synthetic
gatgtccaaactgcagtatgcaatgctggcatgggagtgggggttggaaatttaacaatattcccacatcagtgg

SEQ ID NO: 73067 - DNA, 75 bp, Artificial Sequence
  Synthetic
ctggcatgggagtgggggttggaaatttaacaatattcccacatcagtggattaatttgcgcacgaacaatagcg

SEQ ID NO: 73068 - DNA, 75 bp, Artificial Sequence
  Synthetic
tctcacttgagaagaaaatgagcaactacatacagttcaagtccaaatgccgtattgaacctgtatgtttactcc

SEQ ID NO: 73069 - DNA, 75 bp, Artificial Sequence
  Synthetic
tcattccatttgtgccacttgactatgtcaacgggtcttctccgtacatacccatcaccgttaccgtggctccaa

SEQ ID NO: 73070 - DNA, 75 bp, Artificial Sequence
  Synthetic
tgtcaacgggtcttctccgtacatacccatcaccgttaccgtggctccaatgtctgctgaatataatgggttgcg

SEQ ID NO: 73071 - DNA, 75 bp, Artificial Sequence
  Synthetic
gctcagtatattcactaccaccagaccccgaccactttgacggctacaaacagcaagcagtcgtaatcatggatg

SEQ ID NO: 73072 - DNA, 75 bp, Artificial Sequence
  Synthetic
ccccgaccactttgacggctacaaacagcaagcagtcgtaatcatggatgatttatgtcaaaatccagatggaaa

SEQ ID NO: 73073 - DNA, 75 bp, Artificial Sequence
  Synthetic
gtcaccttcggctatgccacagtttgatgttacgcctgagatgaacattccaggacgagtacacaacttgatgga

SEQ ID NO: 73074 - DNA, 75 bp, Artificial Sequence
  Synthetic
gatgttacgcctgagatgaacattccaggacgagtacacaacttgatggaaatagcggaggttgactcagtagtc

SEQ ID NO: 73075 - DNA, 75 bp, Artificial Sequence
  Synthetic
aatcctatttacctccccattcgtgttggcatcaaccaacgctgggtccatcaatgcacccaccgtgtctgacag

SEQ ID NO: 73076 - DNA, 75 bp, Artificial Sequence
  Synthetic
ttggcatcaaccaacgctgggtccatcaatgcacccaccgtgtctgacagtagagcacttgctagaagattccac

SEQ ID NO: 73077 - DNA, 75 bp, Artificial Sequence
  Synthetic
ggagcacaagtatttgggttttcattgcaacctggcgcttcaagcgtgttgcaacgcacgctactcggtgagatt

SEQ ID NO: 73078 - DNA, 75 bp, Artificial Sequence
  Synthetic
tgcaacctggcgcttcaagcgtgttgcaacgcacgctactcggtgagattttaaattattatacacattggtctg

SEQ ID NO: 73079 - DNA, 75 bp, Artificial Sequence
  Synthetic
tgtgatgaagagtgttgtccagtcaactttaaaaggtgctgcccattggtgtgcggaaaagctatccaattcatt

SEQ ID NO: 73080 - DNA, 75 bp, Artificial Sequence
  Synthetic
actttaaaaggtgctgcccattggtgtgcggaaaagctatccaattcattgataggagaactcaagttaggtatt

SEQ ID NO: 73081 - DNA, 75 bp, Artificial Sequence
  Synthetic
cgggtgctggagtgccaccagataggaagaaggcaatgcttgggacccatgttatttgggacgtggggttgcagt

SEQ ID NO: 73082 - DNA, 75 bp, Artificial Sequence
  Synthetic
gaagaaggcaatgcttgggacccatgttatttgggacgtggggttgcagtccagttgcgttctatgtgtgccttg

SEQ ID NO: 73083 - DNA, 75 bp, Artificial Sequence
  Synthetic
tgttccaaggaccaccagtctacagagaaattaaaatcagtgttgccccagagacacccccgccaccagcaattg

SEQ ID NO: 73084 - DNA, 75 bp, Artificial Sequence
  Synthetic
agaaattaaaatcagtgttgccccagagacacccccgccaccagcaattgcagatttactgaaatcagtagacag

SEQ ID NO: 73085 - DNA, 75 bp, Artificial Sequence
  Synthetic
aactaatgtcatagcaccagctgatgcactgtctacatgttatatcatgtgcatggtgtccgcatgtaacgattt

SEQ ID NO: 73086 - DNA, 75 bp, Artificial Sequence
  Synthetic
gcactgtctacatgttatatcatgtgcatggtgtccgcatgtaacgatttctcggtgcgcatgttacgcgatacc

SEQ ID NO: 73087 - DNA, 75 bp, Artificial Sequence
  Synthetic
gcatgtgagtagagcattcatatgtttgcaagccctaaccacatttgtctcagttgctggtataatatacatcat

SEQ ID NO: 73088 - DNA, 75 bp, Artificial Sequence
  Synthetic
ttgcaagccctaaccacatttgtctcagttgctggtataatatacatcatctacaaattgtttgcaggtttccaa

SEQ ID NO: 73089 - DNA, 75 bp, Artificial Sequence
  Synthetic
gacaccattggtagtggaccatccaattcggaggcaataccggtactcacagcagtagaaacaggacacacatca

SEQ ID NO: 73090 - DNA, 75 bp, Artificial Sequence
  Synthetic
attcggaggcaataccggtactcacagcagtagaaacaggacacacatcacaggttacacctagtgacacgatgc

SEQ ID NO: 73091 - DNA, 75 bp, Artificial Sequence
  Synthetic
tttgaattcgccgtggcgatgatgaaaagaaacgccagtacagtgaaaaccgagtatggtgaattcaccacgctt

SEQ ID NO: 73092 - DNA, 75 bp, Artificial Sequence
  Synthetic
aaagaaacgccagtacagtgaaaaccgagtatggtgaattcaccacgcttggtatttatgacagatgggcggtgt

SEQ ID NO: 73093 - DNA, 75 bp, Artificial Sequence
  Synthetic
tgttttatacaacatacaccaacagtaaaaatgccgccaaagagaagaagtttgcaacgtggaaggtgagtgtta

SEQ ID NO: 73094 - DNA, 75 bp, Artificial Sequence
  Synthetic
taaaaatgccgccaaagagaagaagtttgcaacgtggaaggtgagtgttagacaagccgcccaactaagaagaaa

SEQ ID NO: 73095 - DNA, 75 bp, Artificial Sequence
  Synthetic
tggtcgataaagatgggataaacctagaactgacactcctgaagctcaaccgtaatgaaaagttcagagacatta

SEQ ID NO: 73096 - DNA, 75 bp, Artificial Sequence
  Synthetic
tgaagtgaatgaagctgtcctagcaataaacacaagtaaattccctaacatgtatatacccgtgggccaggtaac

SEQ ID NO: 73097 - DNA, 75 bp, Artificial Sequence
  Synthetic
cgctaccaacttggatgtgccagtgttgacccatcaaataatgtacgtcccacctggtggtccagtccctgaaac

SEQ ID NO: 73098 - DNA, 75 bp, Artificial Sequence
  Synthetic
ttgacccatcaaataatgtacgtcccacctggtggtccagtccctgaaaccgtggacgattacaactggcaaaca

SEQ ID NO: 73099 - DNA, 75 bp, Artificial Sequence
  Synthetic
acagggaaagtcctgggaatacacgtaggaggaaatggacaccaggggttctcagccgcactcctcaggcattac

SEQ ID NO: 73100 - DNA, 75 bp, Artificial Sequence
  Synthetic
aatgcctatagtatgttctatgatggttggtccgagtttaggcatgacggtgtgtacggcctgaatacccttaac

SEQ ID NO: 73101 - DNA, 75 bp, Artificial Sequence
  Synthetic
gttggtccgagtttaggcatgacggtgtgtacggcctgaatacccttaacaatatgggcacaatatatgctaggc

SEQ ID NO: 73102 - DNA, 75 bp, Artificial Sequence
  Synthetic
agtaagacaaaattggaaccaagtgtgttccaccaggtgtttgagggcaacaaagaaccagcagtccttagaaat

SEQ ID NO: 73103 - DNA, 75 bp, Artificial Sequence
  Synthetic
tgttccaccaggtgtttgagggcaacaaagaaccagcagtccttagaaatggggacccacgactcaaagcagatt

SEQ ID NO: 73104 - DNA, 75 bp, Artificial Sequence
  Synthetic
ggattcctcgcccgcctcgtttggcacagtatcttaaagccaataatgtgaattttaagatcaccgatgtgacag

SEQ ID NO: 73105 - DNA, 75 bp, Artificial Sequence
  Synthetic
acagtatcttaaagccaataatgtgaattttaagatcaccgatgtgacagaaaagagagatagtctcacgaccac

SEQ ID NO: 73106 - DNA, 75 bp, Artificial Sequence
  Synthetic
accattatgcagggcaattagccacactagatatcagcacagaacccatgaaattagaggatgctgtgtacggca

SEQ ID NO: 73107 - DNA, 75 bp, Artificial Sequence
  Synthetic
actagatatcagcacagaacccatgaaattagaggatgctgtgtacggcacggaggggctggaagcactagacct

SEQ ID NO: 73108 - DNA, 75 bp, Artificial Sequence
  Synthetic
catagattggcagaattgtgtttgggaagattataacagagacctgctggttagtactaccactgcccatgggtg

SEQ ID NO: 73109 - DNA, 75 bp, Artificial Sequence
  Synthetic
acgtcaggtgtatactactgtgcttcgaagaataagcactacccggtggtgttcgaggggccgggtatggtggaa

SEQ ID NO: 73110 - DNA, 75 bp, Artificial Sequence
  Synthetic
cctcaccaaattgaaagagtgtatggacaagtatggcctgaacttaccaatggtgacctatgtcaaagatgagtt

SEQ ID NO: 73111 - DNA, 75 bp, Artificial Sequence
  Synthetic
ggaaagtctagactcattgaagcctccagtcttaacgactcagtggcaatgaggcaaacgtttgggaatctatac

SEQ ID NO: 73112 - DNA, 75 bp, Artificial Sequence
  Synthetic
gattgtggtggtatattaaggtgtgaacatggtgtcattggtgtggtgactatggggggcgagggcgttgttggc

SEQ ID NO: 73113 - DNA, 75 bp, Artificial Sequence
  Synthetic
aacatggtgtcattggtgtggtgactatggggggcgagggcgttgttggctttgctgatgtgcgagatctcttgt

SEQ ID NO: 73114 - DNA, 75 bp, Artificial Sequence
  Synthetic
aaagtcttccatcttaatccaggtattgtcacaggcagtgctgttgggtgtgacccagacgtgttttggagcaag

SEQ ID NO: 73115 - DNA, 75 bp, Artificial Sequence
  Synthetic
ttgtcacaggcagtgctgttgggtgtgacccagacgtgttttggagcaagatccctgtcatgcttgatggtcacc

SEQ ID NO: 73116 - DNA, 75 bp, Artificial Sequence
  Synthetic
tcaccaaccaaatctgcgaacaggttaatctattaaaggaatccctggttggacaggattccatcctggagaagt

SEQ ID NO: 73117 - DNA, 75 bp, Artificial Sequence
  Synthetic
taatctattaaaggaatccctggttggacaggattccatcctggagaagtctttaaaagccctagtcagaattat

SEQ ID NO: 73118 - DNA, 75 bp, Artificial Sequence
  Synthetic
agaaactaggatactcaagcaaagaaacaaactatatagactatctttgcaactcacatcacctgtatagagaca

SEQ ID NO: 73119 - DNA, 75 bp, Artificial Sequence
  Synthetic
aacaaactatatagactatctttgcaactcacatcacctgtatagagacaaacactattttgtgagaggtgggat

SEQ ID NO: 73120 - DNA, 75 bp, Artificial Sequence
  Synthetic
cacctcatccccgtggcggtggcttaagcagaaagtgtcccaatattatggaatacctatggctgagcgccaaaa

SEQ ID NO: 73121 - DNA, 75 bp, Artificial Sequence
  Synthetic
ggtgtacaagggtatagatttggatcagttcaggatgatcgcttatggggacgacgtgattgcgtcttacccgtg

SEQ ID NO: 73122 - DNA, 75 bp, Artificial Sequence
  Synthetic
cagttcaggatgatcgcttatggggacgacgtgattgcgtcttacccgtggcccatcgatgcctcattgttagca

SEQ ID NO: 73123 - DNA, 75 bp, Artificial Sequence
  Synthetic
gaaatttattgagtggcttaaagtcaaaatcttgccagaggtcaaggagaaacacgaattcctgaacagacttaa

SEQ ID NO: 73124 - DNA, 75 bp, Artificial Sequence
  Synthetic
aaaatcttgccagaggtcaaggagaaacacgaattcctgaacagacttaaacagcttcccttattggaaagtcag

SEQ ID NO: 73125 - DNA, 75 bp, Artificial Sequence
  Synthetic
aacgtgacttttcttaaaaggtacttcagggccgacgagcaatacccattcctggttcatcctgtaatgccaatg

SEQ ID NO: 73126 - DNA, 75 bp, Artificial Sequence
  Synthetic
tcagggccgacgagcaatacccattcctggttcatcctgtaatgccaatgaaagatatacatgaatccattagat

SEQ ID NO: 73127 - DNA, 75 bp, Artificial Sequence
  Synthetic
aatatgaggagttcattcacaagatcagaagtgtgcctgtcggacgctgcttgaccctccctgcgttttcaactt

SEQ ID NO: 73128 - DNA, 75 bp, Artificial Sequence
  Synthetic
aagtcggtagcaacgaacctaattggaaggtcacttgccgagaaactcaatagctcagtgtattcactaccacca

SEQ ID NO: 73129 - DNA, 75 bp, Artificial Sequence
  Synthetic
acccacagggcccactgggcgctagcacactggtatcccggtacctttgtgcgcctgttttataccccctccccc

SEQ ID NO: 73130 - DNA, 75 bp, Artificial Sequence
  Synthetic
aaagatgtctcattgttctgccaaatggtttccagtgtggactttgtaccacctatggctgccttggaagagaaa

SEQ ID NO: 73131 - DNA, 75 bp, Artificial Sequence
  Synthetic
atatcgtaacatagaagcaatgcactcccggtcaatagctgacgtgacaaaccagttgcgttttgaccaagcact

SEQ ID NO: 73132 - DNA, 75 bp, Artificial Sequence
  Synthetic
agcagggccttggcaaggagattccacttcgatatgaacatcgaagttatttccatgtacagtcaaaatggtaaa

SEQ ID NO: 73133 - DNA, 75 bp, Artificial Sequence
  Synthetic
acttcccccgtgtagatcaggtcgatgagccaccgcattccccacgggcgaccgtggcggtggctgcgttggcgg

SEQ ID NO: 73134 - DNA, 75 bp, Artificial Sequence
  Synthetic
gtgtgtgggaaggccatacaattcattgatagaaggacacaggtcaggtattccttagacatgctagttaccgag

SEQ ID NO: 73135 - DNA, 75 bp, Artificial Sequence
  Synthetic
ttgatagaaggacacaggtcaggtattccttagacatgctagttaccgagatgttcagggaatacaatcacaggc

SEQ ID NO: 73136 - DNA, 75 bp, Artificial Sequence
  Synthetic
gagtctattgagctagttagtagtcctccggcccctgaatgcggctaatcctaactgcggagcacatacccctaa

SEQ ID NO: 73137 - DNA, 75 bp, Artificial Sequence
  Synthetic
cagagacaccaccaccgcccgccattgcagacctacttaaatcagtggatagtgaggttgtgagggagtactgta

SEQ ID NO: 73138 - DNA, 75 bp, Artificial Sequence
  Synthetic
gcgactctgcagcggaaccgactactttgggtgtccgtgtttccttttatcttttatattggctgcttatggtga

SEQ ID NO: 73139 - DNA, 75 bp, Artificial Sequence
  Synthetic
cttttatattggctgcttatggtgacaattgcagagttgttaccatatagcttttggattggccatccggtgagc

SEQ ID NO: 73140 - DNA, 75 bp, Artificial Sequence
  Synthetic
caattgcagagttgttaccatatagcttttggattggccatccggtgagcaatagagctgttatttatcaatttg

SEQ ID NO: 73141 - DNA, 75 bp, Artificial Sequence
  Synthetic
gcttgcaggcattgactacattcgtgtcagtagctggaatcatttatataatatacaagctctttgcgggttttc

SEQ ID NO: 73142 - DNA, 75 bp, Artificial Sequence
  Synthetic
cgctcaggtgtcgacgcaaaagaccggtgcgcacgagaccagtttgaatgctagtggtaaatccatcatccacta

SEQ ID NO: 73143 - DNA, 75 bp, Artificial Sequence
  Synthetic
ggtgcgcacgagaccagtttgaatgctagtggtaaatccatcatccactacactaacatcaatttttacaaggac

SEQ ID NO: 73144 - DNA, 75 bp, Artificial Sequence
  Synthetic
atggtcaaaacactcccagcacttaactcgcccaatgccgaagagtgtggctatagtgatagagtacgatccctc

SEQ ID NO: 73145 - DNA, 75 bp, Artificial Sequence
  Synthetic
ccaactatcctaatgaatgatcaggaagtgagtgtgttggatgcaaaagagttggtagacaaggatggcactaac

SEQ ID NO: 73146 - DNA, 75 bp, Artificial Sequence
  Synthetic
actcgcccaatgccgaagagtgtggctatagtgatagagtacgatccctcacgctgggcaactcgaccattacaa

SEQ ID NO: 73147 - DNA, 75 bp, Artificial Sequence
  Synthetic
aggaccaacccacacaaccagacgttgccacgtgtcgattttacaccctggactcaatacaatggcaaaatagct

SEQ ID NO: 73148 - DNA, 75 bp, Artificial Sequence
  Synthetic
tgccacgtgtcgattttacaccctggactcaatacaatggcaaaatagctcgccgggttggtggtggaaattccc

SEQ ID NO: 73149 - DNA, 75 bp, Artificial Sequence
  Synthetic
catgtacatcccagtaggacaagtcacagactatggctttctaaatctaggcggcacacccactaagagaatgct

SEQ ID NO: 73150 - DNA, 75 bp, Artificial Sequence
  Synthetic
acacgtgcagtgcaacgcctctaagtttcatcaggggtgtttactggtcgtgtgcgtccctgaggccgaaatggg

SEQ ID NO: 73151 - DNA, 75 bp, Artificial Sequence
  Synthetic
cgttgggggaaatggtcatcaaggcttttcagcagcactccttaagcactatttcaatgatgaacaaggagaaat

SEQ ID NO: 73152 - DNA, 75 bp, Artificial Sequence
  Synthetic
tttcatcaggggtgtttactggtcgtgtgcgtccctgaggccgaaatgggtggtcgcccaacgggccaggcattc

SEQ ID NO: 73153 - DNA, 75 bp, Artificial Sequence
  Synthetic
ctagcaggaccaaactggagccaagtgtcttccaccaagtctttgaaggcaataaagagccggcagtccttagga

SEQ ID NO: 73154 - DNA, 75 bp, Artificial Sequence
  Synthetic
atacaggctgcagtttgtaatgcaggaatgggcgtcggggttggtaacctgactatctatccacatcagtggata

SEQ ID NO: 73155 - DNA, 75 bp, Artificial Sequence
  Synthetic
gaatgggcgtcggggttggtaacctgactatctatccacatcagtggataaacttgcgcacaaacaactgtgcaa

SEQ ID NO: 73156 - DNA, 75 bp, Artificial Sequence
  Synthetic
tggatgaatacatgctggaagctgtcgaccattacgctggacaattggccaccctagacatcagcactgaaccaa

SEQ ID NO: 73157 - DNA, 75 bp, Artificial Sequence
  Synthetic
taccatttgttccactagatagtagtgggggcaccacttacgtcccaataactgtgacagtggcaccaatgtgcg

SEQ ID NO: 73158 - DNA, 75 bp, Artificial Sequence
  Synthetic
tgggggcaccacttacgtcccaataactgtgacagtggcaccaatgtgcgcagagtacaatggcttaagactatc

SEQ ID NO: 73159 - DNA, 75 bp, Artificial Sequence
  Synthetic
gcccagtgcaatgcccgagtatgatgttacacctgttttaaatatacctggggaagtgcgcaatttgatggagat

SEQ ID NO: 73160 - DNA, 75 bp, Artificial Sequence
  Synthetic
gttacacctgttttaaatatacctggggaagtgcgcaatttgatggagatagctgaggttgattcagtggtaccc

SEQ ID NO: 73161 - DNA, 75 bp, Artificial Sequence
  Synthetic
acaaggcctttcatctaaacccaggaattgtgacaggcagtgctgttgggtgtgacccggacatgttttggagca

SEQ ID NO: 73162 - DNA, 75 bp, Artificial Sequence
  Synthetic
gacggtgctattttcgcattccaactagacccggggcatagtagtgtactgagtagaactctacttggggaaata

SEQ ID NO: 73163 - DNA, 75 bp, Artificial Sequence
  Synthetic
aattgtgacaggcagtgctgttgggtgtgacccggacatgttttggagcaagataccagtgatgctggatggtca

SEQ ID NO: 73164 - DNA, 75 bp, Artificial Sequence
  Synthetic
tagacccggggcatagtagtgtactgagtagaactctacttggggaaatactgaactactacgcccactggtctg

SEQ ID NO: 73165 - DNA, 75 bp, Artificial Sequence
  Synthetic
tgagaagctaggttacacgcacaaggagacaaattacatcgactacctgtgtaattcccaccacctgtacagaga

SEQ ID NO: 73166 - DNA, 75 bp, Artificial Sequence
  Synthetic
ctggtgccaaagtaccagagaaaaggaaagacgcaatgttagggactcacatcatatgggatttgggactccagt

SEQ ID NO: 73167 - DNA, 75 bp, Artificial Sequence
  Synthetic
gaaagacgcaatgttagggactcacatcatatgggatttgggactccagtctagctgcgtgttgtgtgtgccatg

SEQ ID NO: 73168 - DNA, 75 bp, Artificial Sequence
  Synthetic
aacgaacatcatagtgcccccaaacactcccacagattgtcgcgttttgtgcttcgtctccgcctgcaacgactt

SEQ ID NO: 73169 - DNA, 75 bp, Artificial Sequence
  Synthetic
actcccacagattgtcgcgttttgtgcttcgtctccgcctgcaacgacttttctgtaagaatgctgcgcgacaca

SEQ ID NO: 73170 - DNA, 75 bp, Artificial Sequence
  Synthetic
ccgaggctggcaaagactatgggttgattatgacaccagcagataaaggggagtgcttcaacgaagttacctgga

SEQ ID NO: 73171 - DNA, 75 bp, Artificial Sequence
  Synthetic
ggaccagcgaattcggagcaggtaccagcactgacagcagtagaaactgggcacacgtcccaagtaacacctagt

SEQ ID NO: 73172 - DNA, 75 bp, Artificial Sequence
  Synthetic
cagcactgacagcagtagaaactgggcacacgtcccaagtaacacctagtgatactatccaaaccaggcatgtgg

SEQ ID NO: 73173 - DNA, 75 bp, Artificial Sequence
  Synthetic
ataatgcatcaggcggggatgaaggtgacgtgaaaagatatgccgtctgggacatcagtgtgaaggatatggtcc

SEQ ID NO: 73174 - DNA, 75 bp, Artificial Sequence
  Synthetic
tgacgtgaaaagatatgccgtctgggacatcagtgtgaaggatatggtccaaatgagaagaaagtgtgagatgtt

SEQ ID NO: 73175 - DNA, 75 bp, Artificial Sequence
  Synthetic
cttgcgcaggaagtggttggactctttttaaattagagacaatttgaactaatttgagttggcttaaccctactg

SEQ ID NO: 73176 - DNA, 75 bp, Artificial Sequence
  Synthetic
ttttaaattagagacaatttgaactaatttgagttggcttaaccctactgcatcaaccgaactagacaacggtgc

SEQ ID NO: 73177 - DNA, 75 bp, Artificial Sequence
  Synthetic
gattccagccgtaacacaccaggtcatgtatatcccacccgggggaccaattccaactaaggtagatgggtatga

SEQ ID NO: 73178 - DNA, 75 bp, Artificial Sequence
  Synthetic
atgtatatcccacccgggggaccaattccaactaaggtagatgggtatgagtggcaaacatcaacaaatccaagc

SEQ ID NO: 73179 - DNA, 75 bp, Artificial Sequence
  Synthetic
gccatgtctcgatcaagcactcctgtttccccgggccgagtatcaatagactgctcacgtggttgaaggagaaaa

SEQ ID NO: 73180 - DNA, 75 bp, Artificial Sequence
  Synthetic
ttttatgatgggtggtccaattttgagcaaaccggatcatatggctataataacctaaaccatatgggaaaattg

SEQ ID NO: 73181 - DNA, 75 bp, Artificial Sequence
  Synthetic
agcaaaccggatcatatggctataataacctaaaccatatgggaaaattgtacatcagacacgtgaatgcaaaca

SEQ ID NO: 73182 - DNA, 75 bp, Artificial Sequence
  Synthetic
ccccagtgtagatcaggccgatgagtcaccgcgttccccacgggtgaccgtggcggtggctgcgttggcggcctg

SEQ ID NO: 73183 - DNA, 75 bp, Artificial Sequence
  Synthetic
gattatgcaaatacttgtacaaggcaaaagtggattttgatgttgagcccgtcacagcagccagaaggaacataa

SEQ ID NO: 73184 - DNA, 75 bp, Artificial Sequence
  Synthetic
aaaagtggattttgatgttgagcccgtcacagcagccagaaggaacataacggacacaagcaaattgggcaacca

SEQ ID NO: 73185 - DNA, 75 bp, Artificial Sequence
  Synthetic
cgtaaacagacacttggccacacgcattgattggcaaaattgcgtgtgggaaaattataatagggatctccttgt

SEQ ID NO: 73186 - DNA, 75 bp, Artificial Sequence
  Synthetic
attgattggcaaaattgcgtgtgggaaaattataatagggatctccttgtgagcacaaccacagcacatgggtgc

SEQ ID NO: 73187 - DNA, 75 bp, Artificial Sequence
  Synthetic
gagagattgttaccatatagctattggattggccatccggtgactaacagagcagttatctaccagttcgttggt

SEQ ID NO: 73188 - DNA, 75 bp, Artificial Sequence
  Synthetic
ttcgaggggccaggcctggtggaggttcaggagagtgaatattaccctaagagatatcaatcccatgtcctcctt

SEQ ID NO: 73189 - DNA, 75 bp, Artificial Sequence
  Synthetic
aagtgtcaacacagaaaaccggtgcgcacgagactagtctgagtgctaagggtaactctatcatccactatacca

SEQ ID NO: 73190 - DNA, 75 bp, Artificial Sequence
  Synthetic
ttcaggagagtgaatattaccctaagagatatcaatcccatgtcctccttgctgcgggtttctctgaacctggtg

SEQ ID NO: 73191 - DNA, 75 bp, Artificial Sequence
  Synthetic
gcacgagactagtctgagtgctaagggtaactctatcatccactataccaacattaatttctataaagatgctgc

SEQ ID NO: 73192 - DNA, 75 bp, Artificial Sequence
  Synthetic
ttgccgacgtgcgagatctcctgtggctagaggatgatgcaatggagcagggtgtgaaggattacgtggaacagc

SEQ ID NO: 73193 - DNA, 75 bp, Artificial Sequence
  Synthetic
caaaacgctcccggctttgaattcacctagtgcagaagagtgtgggtatagtgatagagtccgatctatgaccct

SEQ ID NO: 73194 - DNA, 75 bp, Artificial Sequence
  Synthetic
gctagaggatgatgcaatggagcagggtgtgaaggattacgtggaacagctaggcaacgcctttggttctggatt

SEQ ID NO: 73195 - DNA, 75 bp, Artificial Sequence
  Synthetic
cctagtgcagaagagtgtgggtatagtgatagagtccgatctatgacccttgggaattcaacaataaccacccaa

SEQ ID NO: 73196 - DNA, 75 bp, Artificial Sequence
  Synthetic
tctaaaagctctagtcaaaatcatatcagccctagtgatcgtggtgagaaaccatgaagacctggtcacggtaac

SEQ ID NO: 73197 - DNA, 75 bp, Artificial Sequence
  Synthetic
caaccaacgcaaccggatgtggccacatgcaggttttacacattggagtctgtgcaatgggagaagacgtcgccc

SEQ ID NO: 73198 - DNA, 75 bp, Artificial Sequence
  Synthetic
tcagccctagtgatcgtggtgagaaaccatgaagacctggtcacggtaactgctacactggctctcattggctgc

SEQ ID NO: 73199 - DNA, 75 bp, Artificial Sequence
  Synthetic
catgcaggttttacacattggagtctgtgcaatgggagaagacgtcgcccgggtggtggtggaagttccctgaag

SEQ ID NO: 73200 - DNA, 75 bp, Artificial Sequence
  Synthetic
aatggatggctcaagaagtttactgaaatgacgaatgcttgcaagggcatggagtggatagccatcaagattcag

SEQ ID NO: 73201 - DNA, 75 bp, Artificial Sequence
  Synthetic
tgcaatgcaatgcatcaaaattccatcaaggttgtctgttagtggtgtgtgtacctgaagccgaaatgggttgcg

SEQ ID NO: 73202 - DNA, 75 bp, Artificial Sequence
  Synthetic
tcaaggttgtctgttagtggtgtgtgtacctgaagccgaaatgggttgcgctgacacagatacaacatttcctgc

SEQ ID NO: 73203 - DNA, 75 bp, Artificial Sequence
  Synthetic
cagctccctctattggaaagtcaaatcgccacaattgagcagagcgcaccatctcaaagcgatcaggagcagctg

SEQ ID NO: 73204 - DNA, 75 bp, Artificial Sequence
  Synthetic
tgtgtgcaatgcaggtatgggagttggtgtgggcaacctaacgattttcccacaccagtggatcaatctacggac

SEQ ID NO: 73205 - DNA, 75 bp, Artificial Sequence
  Synthetic
ggtgtgggcaacctaacgattttcccacaccagtggatcaatctacggaccaacaacagcgccaccattgtaata

SEQ ID NO: 73206 - DNA, 75 bp, Artificial Sequence
  Synthetic
attacatacagttcaagtccaaatgccgtattgagcctgtatgtttactcctacacgggagtcctggtgcaggca

SEQ ID NO: 73207 - DNA, 75 bp, Artificial Sequence
  Synthetic
ccattgaacttcactgatggtgctacagcatacgtgccaataacagtgacaatagctcctatgtatgctgaatat

SEQ ID NO: 73208 - DNA, 75 bp, Artificial Sequence
  Synthetic
cagcatacgtgccaataacagtgacaatagctcctatgtatgctgaatataatgggctgaggctggcgtcaacac

SEQ ID NO: 73209 - DNA, 75 bp, Artificial Sequence
  Synthetic
acccagatcacttcgacggttacaaacaacaggctgtggtgatcatggatgatctatgccagaatcctgatggta

SEQ ID NO: 73210 - DNA, 75 bp, Artificial Sequence
  Synthetic
acaacaggctgtggtgatcatggatgatctatgccagaatcctgatggtaaggacgtttccttattctgccaaat

SEQ ID NO: 73211 - DNA, 75 bp, Artificial Sequence
  Synthetic
tgccacagtttgatgaaaccccagagatgcacataccaggagaggttagaaacttgatggagattgctgaggttg

SEQ ID NO: 73212 - DNA, 75 bp, Artificial Sequence
  Synthetic
gatgcacataccaggagaggttagaaacttgatggagattgctgaggttgattcggttgtgccagtcaataatgt

SEQ ID NO: 73213 - DNA, 75 bp, Artificial Sequence
  Synthetic
cttggcatcaactaatgcgggatccatcaatgctccaaccgtatcagacagtagggccttagcgaggagattcca

SEQ ID NO: 73214 - DNA, 75 bp, Artificial Sequence
  Synthetic
atcaatgctccaaccgtatcagacagtagggccttagcgaggagattccactttgatatgaatattgaagtaatt

SEQ ID NO: 73215 - DNA, 75 bp, Artificial Sequence
  Synthetic
atttagctttcagatggacccagggtactcaagtgtgttgaaacgcacacttttgggagaaatgttgaactacta

SEQ ID NO: 73216 - DNA, 75 bp, Artificial Sequence
  Synthetic
tactcaagtgtgttgaaacgcacacttttgggagaaatgttgaactactacgcacactggtcagggagtgtgaag

SEQ ID NO: 73217 - DNA, 75 bp, Artificial Sequence
  Synthetic
aacttcaagaaatgttgcccgcttgtatgcgggaaggccatccaattcattgacaggagaactcaagttagatac

SEQ ID NO: 73218 - DNA, 75 bp, Artificial Sequence
  Synthetic
tatgcgggaaggccatccaattcattgacaggagaactcaagttagatactccttggatatgctagtgaccgaga

SEQ ID NO: 73219 - DNA, 75 bp, Artificial Sequence
  Synthetic
gtccccacgtcgcgtaaggatgcaatgttgggcacccacatcgtttgggacattggattgcagtcaagctgcgtg

SEQ ID NO: 73220 - DNA, 75 bp, Artificial Sequence
  Synthetic
tgttgggcacccacatcgtttgggacattggattgcagtcaagctgcgtgctgtgcgtcccatggatcagtcaat

SEQ ID NO: 73221 - DNA, 75 bp, Artificial Sequence
  Synthetic
gagaaatcaaaattagcgtagcaccagaggcaccaccaccaccagccattgcagacttgctcaagtcagtggaca

SEQ ID NO: 73222 - DNA, 75 bp, Artificial Sequence
  Synthetic
gcagacttgctcaagtcagtggacagtgaggctgtgagagagtactgcaaagaaaaaggatggttggtaccagag

SEQ ID NO: 73223 - DNA, 75 bp, Artificial Sequence
  Synthetic
ttgtaccaccaggggcgcccacaagttgtgatgtgctgtgctttgcatcagcgtgtaacgacttttccgtgcggc

SEQ ID NO: 73224 - DNA, 75 bp, Artificial Sequence
  Synthetic
ttgtgatgtgctgtgctttgcatcagcgtgtaacgacttttccgtgcggcttttaagagacacaccattcatggc

SEQ ID NO: 73225 - DNA, 75 bp, Artificial Sequence
  Synthetic
tcagtggcaggaattatctacataatctacaagctctttgcaggctttcaaggggcgtacacaggaatgcccaac

SEQ ID NO: 73226 - DNA, 75 bp, Artificial Sequence
  Synthetic
tctacaagctctttgcaggctttcaaggggcgtacacaggaatgcccaaccagaagcctaaagtacccaccctta

SEQ ID NO: 73227 - DNA, 75 bp, Artificial Sequence
  Synthetic
cacggaaattccagccttaacagcggtggaaacggggcacacctcacaagtggatcccagtgacactatccagac

SEQ ID NO: 73228 - DNA, 75 bp, Artificial Sequence
  Synthetic
gtggaaacggggcacacctcacaagtggatcccagtgacactatccagaccaggcacgtggtaaacttccactca

SEQ ID NO: 73229 - DNA, 75 bp, Artificial Sequence
  Synthetic
ctgagtacggcgagtttaccatgctgggcatctacgacaggtgggccgttctgccacgtcacgccaaacctggac

SEQ ID NO: 73230 - DNA, 75 bp, Artificial Sequence
  Synthetic
gggcatctacgacaggtgggccgttctgccacgtcacgccaaacctggaccgaccatactgatgaacgaccaaga

SEQ ID NO: 73231 - DNA, 75 bp, Artificial Sequence
  Synthetic
gaagagacgtccactgataggttcgcagtgtggaccataaacataagggagatggcccaattaagaaggaagtgt

SEQ ID NO: 73232 - DNA, 75 bp, Artificial Sequence
  Synthetic
cagtgtggaccataaacataagggagatggcccaattaagaaggaagtgtgaaatgttcacgtacatgcgttttg

SEQ ID NO: 73233 - DNA, 75 bp, Artificial Sequence
  Synthetic
ccggaatgaaaagttcagggacatcaggggtttcttggccaaggaagaagtggaagtcaatgaggctgtgctagc

SEQ ID NO: 73234 - DNA, 75 bp, Artificial Sequence
  Synthetic
aggggtttcttggccaaggaagaagtggaagtcaatgaggctgtgctagctattaacaccagcaagttcccaaac

SEQ ID NO: 73235 - DNA, 75 bp, Artificial Sequence
  Synthetic
cgcatcaaattatgtacgtcccaccagggggcccaatcccagccaaagtagatggttacgagtggcagacatcaa

SEQ ID NO: 73236 - DNA, 75 bp, Artificial Sequence
  Synthetic
agggggcccaatcccagccaaagtagatggttacgagtggcagacatcaacaaaccccagcgtcttctggacgga

SEQ ID NO: 73237 - DNA, 75 bp, Artificial Sequence
  Synthetic
atgtataacttccccacgagagcgggccagtgtggtggggtgctcatgtccactggtaaggtgctggggatacat

SEQ ID NO: 73238 - DNA, 75 bp, Artificial Sequence
  Synthetic
gccagtgtggtggggtgctcatgtccactggtaaggtgctggggatacatgttggtgggaatggtcaccagggct

SEQ ID NO: 73239 - DNA, 75 bp, Artificial Sequence
  Synthetic
gtcacacttcacacaggacggtacctatgggtatacaacccttaatgcaatggggaaactgtacattaggcatgt

SEQ ID NO: 73240 - DNA, 75 bp, Artificial Sequence
  Synthetic
tatgggtatacaacccttaatgcaatggggaaactgtacattaggcatgtgaataggagcagccctcatcagata

SEQ ID NO: 73241 - DNA, 75 bp, Artificial Sequence
  Synthetic
cgggatttccgatcatcaacacacctagcaagacaaaattggaaccaagtgtctttcaccaagtctttgaaggca

SEQ ID NO: 73242 - DNA, 75 bp, Artificial Sequence
  Synthetic
tagcaagacaaaattggaaccaagtgtctttcaccaagtctttgaaggcaataaagaaccagcagttctcaggaa

SEQ ID NO: 73243 - DNA, 75 bp, Artificial Sequence
  Synthetic
tatataaacaaaagggacgtaaactttgtagtcacggagataacagactcaaggacttccatcactgatacacca

SEQ ID NO: 73244 - DNA, 75 bp, Artificial Sequence
  Synthetic
ttgtagtcacggagataacagactcaaggacttccatcactgatacaccacacccagaacatagtgtcctggcaa

SEQ ID NO: 73245 - DNA, 75 bp, Artificial Sequence
  Synthetic
ggatgaatacatgctagaagcagttgaccattatgcaggacaattagccaccttggatatcagtactgaaccaat

SEQ ID NO: 73246 - DNA, 75 bp, Artificial Sequence
  Synthetic
gaccattatgcaggacaattagccaccttggatatcagtactgaaccaatgaaattggaggatgccgtatatgga

SEQ ID NO: 73247 - DNA, 75 bp, Artificial Sequence
  Synthetic
cacatgctgattggcagaactgcgtgtgggaagattataatagagatttgcttgtgagcactaccacagcacatg

SEQ ID NO: 73248 - DNA, 75 bp, Artificial Sequence
  Synthetic
gtgggaagattataatagagatttgcttgtgagcactaccacagcacatgggtgtgacacaatcgccagatgcca

SEQ ID NO: 73249 - DNA, 75 bp, Artificial Sequence
  Synthetic
gatatcctatcaaagaagaccaaggatttgaccaaactaaaagaatgcatggacaagtatgggctgaacctacca

SEQ ID NO: 73250 - DNA, 75 bp, Artificial Sequence
  Synthetic
atttgaccaaactaaaagaatgcatggacaagtatgggctgaacctaccaatggtaacttatgtgaaagatgaac

SEQ ID NO: 73251 - DNA, 75 bp, Artificial Sequence
  Synthetic
ggaagttcaggagagtgagtactacccaagaaggtaccagtcccacgtgttgcttgcggcagggttttccgagcc

SEQ ID NO: 73252 - DNA, 75 bp, Artificial Sequence
  Synthetic
ccaagaaggtaccagtcccacgtgttgcttgcggcagggttttccgagccgggagactgtggtgggattctcaga

SEQ ID NO: 73253 - DNA, 75 bp, Artificial Sequence
  Synthetic
tgagacaaacatttggtaacttgtacaagaccttccacttgaacccagggatcgtgacaggcagtgcagttgggt

SEQ ID NO: 73254 - DNA, 75 bp, Artificial Sequence
  Synthetic
caagaccttccacttgaacccagggatcgtgacaggcagtgcagttgggtgtgatccagacctcttttggagtaa

SEQ ID NO: 73255 - DNA, 75 bp, Artificial Sequence
  Synthetic
ctatggttggaagatgatgcgatggaacagggagtcaaagattatgtggaacagctcgggaatgcttttggatcg

SEQ ID NO: 73256 - DNA, 75 bp, Artificial Sequence
  Synthetic
aggtaagtcttctgaaagagtccctggtaggtcaagactccatcttggagaagtcattgaaagccctagtgaaga

SEQ ID NO: 73257 - DNA, 75 bp, Artificial Sequence
  Synthetic
gtttgcttgtttgaaaatgttactagagaagattggatattcacacaaggagacaaactacattgactatttatg

SEQ ID NO: 73258 - DNA, 75 bp, Artificial Sequence
  Synthetic
gagaagattggatattcacacaaggagacaaactacattgactatttatgcaattcccaccacctgtatagggac

SEQ ID NO: 73259 - DNA, 75 bp, Artificial Sequence
  Synthetic
attataattagaacattaatgctgaaagtgtacaaaggaattgacctagaccagttcagaatgatcgcatatggt

SEQ ID NO: 73260 - DNA, 75 bp, Artificial Sequence
  Synthetic
ggtcaaaatactaccagaggtcaaggaaaaacacgaatttcttaacaggctgaaacaactgccgcttttagagag

SEQ ID NO: 73261 - DNA, 75 bp, Artificial Sequence
  Synthetic
atcatgacaccagctgacaagggagaatgctttaacgaagtcacctggactaatgtcacgtttttgaagagatac

SEQ ID NO: 73262 - DNA, 75 bp, Artificial Sequence
  Synthetic
tggaccaaagatccaaagaacacccaagaccacgtgcgctcactgtgcttattggcttggcacaacggagagcat

SEQ ID NO: 73263 - DNA, 75 bp, Artificial Sequence
  Synthetic
gagtaattacatacagttcaagtccaaatgccgtattgagcctgtatgtttgctcctacatgggagtcctggtgc

SEQ ID NO: 73264 - DNA, 75 bp, Artificial Sequence
  Synthetic
ttacgcaggaaatggttggactccttctaaattagagacaatttgaaataatttgaattggctcgaccctactgc

SEQ ID NO: 73265 - DNA, 75 bp, Artificial Sequence
  Synthetic
tctaaattagagacaatttgaaataatttgaattggctcgaccctactgcgctaaccgaactagacaacggtgca

SEQ ID NO: 73266 - DNA, 75 bp, Artificial Sequence
  Synthetic
gcaccagagacaccaccaccaccagccattgcagatttgctcaaatcagtggacagtgaagccgtgagggactac

SEQ ID NO: 73267 - DNA, 75 bp, Artificial Sequence
  Synthetic
atctgtttgcaagcactaactactttcgtctcagtggctggaatcatttacataatctacaaactctttgcaggc

SEQ ID NO: 73268 - DNA, 75 bp, Artificial Sequence
  Synthetic
tgccagtggtaactctatcatccattacacaaatatcaactactacaaagatgctgcctccaactcagctaaccg

SEQ ID NO: 73269 - DNA, 75 bp, Artificial Sequence
  Synthetic
ggatacagcgaccgcgttagatctattacccttgggaactccacaataaccacacaggagtgtgctaatgtggtg

SEQ ID NO: 73270 - DNA, 75 bp, Artificial Sequence
  Synthetic
tggattcgattaaatgggaaaaaggatccgtggggtggtggtggaagttcccagaggcacttagcgacatggggc

SEQ ID NO: 73271 - DNA, 75 bp, Artificial Sequence
  Synthetic
gggtaacaaagagccggcggtcctcaggaatggtgatccacgtctcaaagccaactttgaggaggccatattttc

SEQ ID NO: 73272 - DNA, 75 bp, Artificial Sequence
  Synthetic
aggaatggtgatccacgtctcaaagccaactttgaggaggccatattttccaagtacatcggaaatgttaacaca

SEQ ID NO: 73273 - DNA, 75 bp, Artificial Sequence
  Synthetic
catagtgatgccatacataaatagtgtaccgatggacaatatgtttaggcactacaacttcacactgatggtgat

SEQ ID NO: 73274 - DNA, 75 bp, Artificial Sequence
  Synthetic
tgcatggacaagtatggtctaaacctgccaatggtaacctatgtgaaagatgagctcaggtcggcagagaaggtg

SEQ ID NO: 73275 - DNA, 75 bp, Artificial Sequence
  Synthetic
tgacacctagtatgaatataccaggggaggtgaaaaatctaatggaggtggcagaagtggactccgttgtgccgg

SEQ ID NO: 73276 - DNA, 75 bp, Artificial Sequence
  Synthetic
ctatacaaaacttttcacctaaacccagggattgtgactggcagtgccgtcgggtgtgatccggatctcttttgg

SEQ ID NO: 73277 - DNA, 75 bp, Artificial Sequence
  Synthetic
ttttgtaacatgttggtaccagactggtatgatcgtcccaccagggactcccaattccagctcgatcatgtgttt

SEQ ID NO: 73278 - DNA, 75 bp, Artificial Sequence
  Synthetic
aggagacgtggaggaagccgttgagagggcaatcgtacacgtggctgacacattacgcagtggacctagcaactc

SEQ ID NO: 73279 - DNA, 75 bp, Artificial Sequence
  Synthetic
aaattttgatcagaagggttcatacgggtataatacattaaacaatctaggtcacatatatgtgaggcacgtgag

SEQ ID NO: 73280 - DNA, 75 bp, Artificial Sequence
  Synthetic
gggtataatacattaaacaatctaggtcacatatatgtgaggcacgtgagtggaagcagtccacaccccattacg

SEQ ID NO: 73281 - DNA, 75 bp, Artificial Sequence
  Synthetic
gcggccccctcgactgtgccaatacaagaaagcatttagtgtggattttacaccaacacccatcacagacacccg

SEQ ID NO: 73282 - DNA, 75 bp, Artificial Sequence
  Synthetic
tgcgtttggacatcagtcaggtgctgtgtatgtagggaactacagagtggtgaataggcatcttgccactcgcag

SEQ ID NO: 73283 - DNA, 75 bp, Artificial Sequence
  Synthetic
attgagagattgttaccatatagctattggattggccatccggtgacaaacagggcggtcatttacctatttgtt

SEQ ID NO: 73284 - DNA, 75 bp, Artificial Sequence
  Synthetic
tgaataggcatcttgccactcgcagtgattggcaaaactgtgtgtgggaagactacaatagggacattctcgtga

SEQ ID NO: 73285 - DNA, 75 bp, Artificial Sequence
  Synthetic
ctcaagtatcgactcagaaaaccggggcacatgaaaccggtttgaatgctagcgggaactccattatccactata

SEQ ID NO: 73286 - DNA, 75 bp, Artificial Sequence
  Synthetic
ggaacaaacactacccagttagcttcgagggaccaggtttagtagaagtgcaggagagtgaatactaccctaaaa

SEQ ID NO: 73287 - DNA, 75 bp, Artificial Sequence
  Synthetic
ggcacatgaaaccggtttgaatgctagcgggaactccattatccactatacaaacatcaactactataaagatgc

SEQ ID NO: 73288 - DNA, 75 bp, Artificial Sequence
  Synthetic
tgtggaggaattctcaggtgtgaacatggtgtgatcgggctcgtcaccatggggggcgagggagttgttggattt

SEQ ID NO: 73289 - DNA, 75 bp, Artificial Sequence
  Synthetic
ggtgaaatcattaccagccttgaattccccatccgccgaagaatgtggctacagtgatagagtaaggtctatcac

SEQ ID NO: 73290 - DNA, 75 bp, Artificial Sequence
  Synthetic
tccccatccgccgaagaatgtggctacagtgatagagtaaggtctatcacccttggtaactcaactatcaccacc

SEQ ID NO: 73291 - DNA, 75 bp, Artificial Sequence
  Synthetic
gggaacgcttttggctcgggatttactagtcaaatctgtgaacaggttaatctcctcaaggagtcactggtgggc

SEQ ID NO: 73292 - DNA, 75 bp, Artificial Sequence
  Synthetic
gaccaacccacccaaccagatgtggcgacatgcagattctacacgctggattcagtatcatggatgaaagagtcg

SEQ ID NO: 73293 - DNA, 75 bp, Artificial Sequence
  Synthetic
cgacatgcagattctacacgctggattcagtatcatggatgaaagagtcgcaaggatggtggtggaagttccctg

SEQ ID NO: 73294 - DNA, 75 bp, Artificial Sequence
  Synthetic
catgatgatctaataacagtgactgccactctcgccctcattggatgcacgtcgtcaccatggcgttggctcaaa

SEQ ID NO: 73295 - DNA, 75 bp, Artificial Sequence
  Synthetic
atgtacagtgcaatgcctcaaaattccaccaaggatgtcttttggtggtgtgtgttccagaagctgagatgggtg

SEQ ID NO: 73296 - DNA, 75 bp, Artificial Sequence
  Synthetic
cagaaggtgtcccagtattacggaatacccatggctgtgcgccaaaacaatgggtggctcaagaagtttactgag

SEQ ID NO: 73297 - DNA, 75 bp, Artificial Sequence
  Synthetic
ccaccaaggatgtcttttggtggtgtgtgttccagaagctgagatgggtgcggctaaagtcaacgaaaaaatcaa

SEQ ID NO: 73298 - DNA, 75 bp, Artificial Sequence
  Synthetic
acaggcagtgtttattgctggcatgggtgtggcagtgggaaacttgaccatcttcccacatcagtggattaattt

SEQ ID NO: 73299 - DNA, 75 bp, Artificial Sequence
  Synthetic
gctcccccttttggaaagtcaaattgctaccattgagcaaagtgcaccctcccaaagtgatcaggagcagctctt

SEQ ID NO: 73300 - DNA, 75 bp, Artificial Sequence
  Synthetic
ggtgtggcagtgggaaacttgaccatcttcccacatcagtggattaatttgcgtactaacaattgtgctaccata

SEQ ID NO: 73301 - DNA, 75 bp, Artificial Sequence
  Synthetic
tttgctaaacttgactacgcagccggctcttcaacttatattcccattactgtcactgttgcaccaatgtgtgcc

SEQ ID NO: 73302 - DNA, 75 bp, Artificial Sequence
  Synthetic
gctcttcaacttatattcccattactgtcactgttgcaccaatgtgtgccgagtacaatggtttgaggctggccg

SEQ ID NO: 73303 - DNA, 75 bp, Artificial Sequence
  Synthetic
ctcccttgagaagaaaatgagcaactatatacagttcaagtccaaatgccgtattgaacctgtatgtcttttgct

SEQ ID NO: 73304 - DNA, 75 bp, Artificial Sequence
  Synthetic
ctctgtgtactcgctaccaccagacccagaccacttcgacggttataagcaacaggccgtcgtaatcatggatga

SEQ ID NO: 73305 - DNA, 75 bp, Artificial Sequence
  Synthetic
ctgccatgccgcaatttgacgtgacgccggaaatgaatataccaggtgaagtgagaaatctcatggagattgcag

SEQ ID NO: 73306 - DNA, 75 bp, Artificial Sequence
  Synthetic
aatggcggcacttgaggagaaaggtatcctcttcacgtcaccattcgtcctcgcctccaccaatgcagggtccat

SEQ ID NO: 73307 - DNA, 75 bp, Artificial Sequence
  Synthetic
ctggaggcatacaggataccagtgcattcggtgacggaaactgggtcacaagtctttggcttcacattacaaccc

SEQ ID NO: 73308 - DNA, 75 bp, Artificial Sequence
  Synthetic
ttgatatgaacatcgaagttatttcaatgtacagccagaatgggaagatcaacatgccaatggcagtgaagacct

SEQ ID NO: 73309 - DNA, 75 bp, Artificial Sequence
  Synthetic
cggcaatggcaactggaaagttccttctagcttactcacccccaggggcgggcgtgcccaaaaaccgcaaggagg

SEQ ID NO: 73310 - DNA, 75 bp, Artificial Sequence
  Synthetic
acaggaaaacacaggtaaggtattcattggacatgctcgtgaccgagatgtttagagagtacaaccacaggcaca

SEQ ID NO: 73311 - DNA, 75 bp, Artificial Sequence
  Synthetic
agacacactacagatttgtgtccagggatagttacactgatgctgggtttatcacctgttggtaccaaactagca

SEQ ID NO: 73312 - DNA, 75 bp, Artificial Sequence
  Synthetic
ggatagttacactgatgctgggtttatcacctgttggtaccaaactagcatagtcgtgcccgcggaggtacaaaa

SEQ ID NO: 73313 - DNA, 75 bp, Artificial Sequence
  Synthetic
tttccaaggcccacctgtgtatagagagatcaagattagtgttgcgccagaaattcccccaccaccagcaatagc

SEQ ID NO: 73314 - DNA, 75 bp, Artificial Sequence
  Synthetic
tagtcagacggcgttctaccagaatgatgtgcaaaatgcaatcgaccgtgccgtagtgcgtgtagccgacacaat

SEQ ID NO: 73315 - DNA, 75 bp, Artificial Sequence
  Synthetic
caactccaccctgcaaattgagaaacacgtgagtagagcttttatctgcctacaggcacttaccacttttgtttc

SEQ ID NO: 73316 - DNA, 75 bp, Artificial Sequence
  Synthetic
gatgtgcaaaatgcaatcgaccgtgccgtagtgcgtgtagccgacacaatgccaagtggtcccagtaactcagaa

SEQ ID NO: 73317 - DNA, 75 bp, Artificial Sequence
  Synthetic
cacgtgagtagagcttttatctgcctacaggcacttaccacttttgtttctgtggcagggatcatttacgtcatc

SEQ ID NO: 73318 - DNA, 75 bp, Artificial Sequence
  Synthetic
cacgtcaaaaacttccatgtcaggtcagagtcgtccgtggagaactttctcagtaggtctgcctgtgtttatatt

SEQ ID NO: 73319 - DNA, 75 bp, Artificial Sequence
  Synthetic
cagagtcgtccgtggagaactttctcagtaggtctgcctgtgtttatattgtggaatacaaaacgagagacgaca

SEQ ID NO: 73320 - DNA, 75 bp, Artificial Sequence
  Synthetic
caggctaaggttcaagggccagcttttgaatttgcggtggccatgatgaagagaaacgccagtaccgtaaaaact

SEQ ID NO: 73321 - DNA, 75 bp, Artificial Sequence
  Synthetic
accattctgatgaacgatcaggaagtgggtgtggtcgatgccaaagagttagtagacaaagatggcactaatttg

SEQ ID NO: 73322 - DNA, 75 bp, Artificial Sequence
  Synthetic
tcacatatgtgagatttgatgtggaagttacattcgtcattaccagtgtacaggatgattcaactaggcggaata

SEQ ID NO: 73323 - DNA, 75 bp, Artificial Sequence
  Synthetic
agtagacaaagatggcactaatttggagttaacactcttgaaactcaataggaatgagaagttcagagacattcg

SEQ ID NO: 73324 - DNA, 75 bp, Artificial Sequence
  Synthetic
agttacattcgtcattaccagtgtacaggatgattcaactaggcggaatactgatacgccagcacttacccacca

SEQ ID NO: 73325 - DNA, 75 bp, Artificial Sequence
  Synthetic
aagtgtcttttggactgaggggaatgccccacctaggatatccattccctttatgagtgtgggcaatgcatacag

SEQ ID NO: 73326 - DNA, 75 bp, Artificial Sequence
  Synthetic
gtacatcccagttggtcaagtgacagactatggattccttaacctgggtggtaccccaaccaagcgcatgttgat

SEQ ID NO: 73327 - DNA, 75 bp, Artificial Sequence
  Synthetic
gccccacctaggatatccattccctttatgagtgtgggcaatgcatacagtaacttctatgatgggtggtcacac

SEQ ID NO: 73328 - DNA, 75 bp, Artificial Sequence
  Synthetic
aaaacaattagtccaatcacaagcaaggtccgcatatatttcaaaccaaagcacgtgaaagcatgggtgccccgc

SEQ ID NO: 73329 - DNA, 75 bp, Artificial Sequence
  Synthetic
aggtccgcatatatttcaaaccaaagcacgtgaaagcatgggtgccccgcccacccagactgtgtgaatacaccc

SEQ ID NO: 73330 - DNA, 75 bp, Artificial Sequence
  Synthetic
gcaaaacaaagcttgagcctagcgtatttcaccacatctttgaggggagtaaggagccagcagtgttgaggaacg

SEQ ID NO: 73331 - DNA, 75 bp, Artificial Sequence
  Synthetic
acatggagaaccatggagccttcggccagcaatccggggcggtttatgtagggaattacaggctaattaataggc

SEQ ID NO: 73332 - DNA, 75 bp, Artificial Sequence
  Synthetic
ccagcaatccggggcggtttatgtagggaattacaggctaattaataggcatctggccacacacaatgattggca

SEQ ID NO: 73333 - DNA, 75 bp, Artificial Sequence
  Synthetic
atgagtatatgcaggaggctattgaccactatgcagggcaactagcaactctagacattagtacagaacccatgg

SEQ ID NO: 73334 - DNA, 75 bp, Artificial Sequence
  Synthetic
taggtgcaggtgcacaacaggtgtgtatttctgccagtccaagaacaaacactatccagttagttttgaagggcc

SEQ ID NO: 73335 - DNA, 75 bp, Artificial Sequence
  Synthetic
tgagggcttagaggctctagatctgaccacaagtgcggggtacccctatgttaccctcggtattaagaagagaga

SEQ ID NO: 73336 - DNA, 75 bp, Artificial Sequence
  Synthetic
tatttctgccagtccaagaacaaacactatccagttagttttgaagggccaggactggtggaagtccaggaaagt

SEQ ID NO: 73337 - DNA, 75 bp, Artificial Sequence
  Synthetic
atattgagatgtgagcatggagtcatcggcatcgtgaccatgggcggtgaaggtgttgttggtttcgccgacgtg

SEQ ID NO: 73338 - DNA, 75 bp, Artificial Sequence
  Synthetic
tcggcatcgtgaccatgggcggtgaaggtgttgttggtttcgccgacgtgcgggacctcttgtggttggaggatg

SEQ ID NO: 73339 - DNA, 75 bp, Artificial Sequence
  Synthetic
tttgtgagcaagttcatttgttgaaggaatccttagtgggccaagactccatcctcgaaaaatcactgaaagctc

SEQ ID NO: 73340 - DNA, 75 bp, Artificial Sequence
  Synthetic
gatcccgacctattctggagtaagatcccagtcatgctcgacggccacctcatcgcctttgattacagtggatat

SEQ ID NO: 73341 - DNA, 75 bp, Artificial Sequence
  Synthetic
ggaatccttagtgggccaagactccatcctcgaaaaatcactgaaagctctagtgaaaatcatatcagcactggt

SEQ ID NO: 73342 - DNA, 75 bp, Artificial Sequence
  Synthetic
actaattatatagattacttgtgcaactcccaccatttgtacaaagataagcactattttgtaagaggaggaatg

SEQ ID NO: 73343 - DNA, 75 bp, Artificial Sequence
  Synthetic
ttggcgctggctcaagcacaaggtgtctcagtactatggaatccccatggctgagagacaaaacaacaactggct

SEQ ID NO: 73344 - DNA, 75 bp, Artificial Sequence
  Synthetic
tctcagtactatggaatccccatggctgagagacaaaacaacaactggctaaagaaatttaccgaaatgaccaat

SEQ ID NO: 73345 - DNA, 75 bp, Artificial Sequence
  Synthetic
ccatccgggtgctctggaaccagcattttcaactcaatgattaacaacataattattagaacactgatgctgaag

SEQ ID NO: 73346 - DNA, 75 bp, Artificial Sequence
  Synthetic
gaggtgagagaaaagcatgaatttcttaatagactaaaacaactgccacttctagagagtcagattgccacaata

SEQ ID NO: 73347 - DNA, 75 bp, Artificial Sequence
  Synthetic
ttaatagactaaaacaactgccacttctagagagtcagattgccacaatagagcagagtgcgccatcacaaagcg

SEQ ID NO: 73348 - DNA, 75 bp, Artificial Sequence
  Synthetic
aagcaaagagagtgttttcactagaaaagaaaatgagcaattacatacagttcaagtccaaatgccgtattgaac

SEQ ID NO: 73349 - DNA, 75 bp, Artificial Sequence
  Synthetic
aaagaaaatgagcaattacatacagttcaagtccaaatgccgtattgaacccgtatgcttgctcctccacggtag

SEQ ID NO: 73350 - DNA, 75 bp, Artificial Sequence
  Synthetic
ctctttaccaccagacccagaccatttcgacgggtacaaacagcaggcagttgtgataatggacgacttgtgcca

SEQ ID NO: 73351 - DNA, 75 bp, Artificial Sequence
  Synthetic
ttcgacgggtacaaacagcaggcagttgtgataatggacgacttgtgccaaaaccctgatggaaaggatgtgtcg

SEQ ID NO: 73352 - DNA, 75 bp, Artificial Sequence
  Synthetic
acttctccattcgttctagcgtctactaacgccggatcaattaatgcccctactgtatctgacagcagagctctt

SEQ ID NO: 73353 - DNA, 75 bp, Artificial Sequence
  Synthetic
ctaacgccggatcaattaatgcccctactgtatctgacagcagagctcttgccagaagatttcactttgacatga

SEQ ID NO: 73354 - DNA, 75 bp, Artificial Sequence
  Synthetic
agtgctgtccagtcaactttaagaagtgttgcccactagtgtgtggcaaggccattcagttcattgacaggagaa

SEQ ID NO: 73355 - DNA, 75 bp, Artificial Sequence
  Synthetic
gtgttgcccactagtgtgtggcaaggccattcagttcattgacaggagaacccaagtcaggtactcgttggatat

SEQ ID NO: 73356 - DNA, 75 bp, Artificial Sequence
  Synthetic
accaccagtctacagggagattaaaattagtgttgctccagaaacgccccccccgccggcgattgctgatctgtt

SEQ ID NO: 73357 - DNA, 75 bp, Artificial Sequence
  Synthetic
attagtgttgctccagaaacgccccccccgccggcgattgctgatctgttgaaatcaatagacagcgaggctgtg

SEQ ID NO: 73358 - DNA, 75 bp, Artificial Sequence
  Synthetic
tgtcaggctattgaaggacactcctttcatttcgcagcaaaactttttccagggcccagtggaagacgcgataac

SEQ ID NO: 73359 - DNA, 75 bp, Artificial Sequence
  Synthetic
agagcattcatatgcctccaagctttgaccacatttgtatcagtagctggtataatatacattatctacaagttg

SEQ ID NO: 73360 - DNA, 75 bp, Artificial Sequence
  Synthetic
tgaccacatttgtatcagtagctggtataatatacattatctacaagttgtttgctggctttcagggtgcatacg

SEQ ID NO: 73361 - DNA, 75 bp, Artificial Sequence
  Synthetic
ccgtagccatgatgaaaagaaacgccagcacggtaaaaacagaatatggtgagttcaccatgctcggaatctatg

SEQ ID NO: 73362 - DNA, 75 bp, Artificial Sequence
  Synthetic
cagcacggtaaaaacagaatatggtgagttcaccatgctcggaatctatgacaggtgggcagtgttgccacgaca

SEQ ID NO: 73363 - DNA, 75 bp, Artificial Sequence
  Synthetic
agacggcaccaacttggagttgacgcttttgaagctcagtagaaatgagaaattcagagacatccgaggctttct

SEQ ID NO: 73364 - DNA, 75 bp, Artificial Sequence
  Synthetic
cttttgaagctcagtagaaatgagaaattcagagacatccgaggctttctagcaagagaggaggtggaggtcaat

SEQ ID NO: 73365 - DNA, 75 bp, Artificial Sequence
  Synthetic
ttcctaaaccttggagggacgcccaccaagaggatgctcatgtataacttccctaccagagcagggcagtgcggt

SEQ ID NO: 73366 - DNA, 75 bp, Artificial Sequence
  Synthetic
ctcctcaggcactatttcaatgaagaacagggacagatagagttcatagaatgctccaaagatgcaggattcccc

SEQ ID NO: 73367 - DNA, 75 bp, Artificial Sequence
  Synthetic
gcagtcctcagaaatggagacccgcgcctcaaggccaactttgaagaggcaattttctccaagtacatcggtaat

SEQ ID NO: 73368 - DNA, 75 bp, Artificial Sequence
  Synthetic
agtacagaacccatgaaactggaggacgctgtttatggtacagaggggctagaagccctagacctgaccaccagc

SEQ ID NO: 73369 - DNA, 75 bp, Artificial Sequence
  Synthetic
agattggcttaaccctactgtgctaaccgaaccagataacggtacagtaggggtaaattctccgcattcggtgcg

SEQ ID NO: 73370 - DNA, 75 bp, Artificial Sequence
  Synthetic
acgctgtttatggtacagaggggctagaagccctagacctgaccaccagcgcaggctacccatatgtagctctag

SEQ ID NO: 73371 - DNA, 75 bp, Artificial Sequence
  Synthetic
gtttaaatttaccgatggtgacgtatgtcaaggatgagctgagatccgctgaaaaggtggccaaaggaaaatcca

SEQ ID NO: 73372 - DNA, 75 bp, Artificial Sequence
  Synthetic
tgtcaaggatgagctgagatccgctgaaaaggtggccaaaggaaaatccagactcattgaggcctctagtctcaa

SEQ ID NO: 73373 - DNA, 75 bp, Artificial Sequence
  Synthetic
tctgttaccccggactgagtatcaataagctgctcacgcggctgaaggagaaaacgttcgttacccggccaatta

SEQ ID NO: 73374 - DNA, 75 bp, Artificial Sequence
  Synthetic
tagcgctgtagggtgcgatccagacgtgttttggagcaagatcccagtcatgcttgacggccatctcattgcttt

SEQ ID NO: 73375 - DNA, 75 bp, Artificial Sequence
  Synthetic
gtgttttggagcaagatcccagtcatgcttgacggccatctcattgcttttgactattctggttatgacgctagt

SEQ ID NO: 73376 - DNA, 75 bp, Artificial Sequence
  Synthetic
atagattatctttgcaactcccaccacttgtacagggacaaacactactttgtgaggggtggaatgccatcagga

SEQ ID NO: 73377 - DNA, 75 bp, Artificial Sequence
  Synthetic
accagtgggcagtctgtcgtaacgggcaactctgcagcggaaccgactactttgggtgtccgtgtttccttttat

SEQ ID NO: 73378 - DNA, 75 bp, Artificial Sequence
  Synthetic
acttgtacagggacaaacactactttgtgaggggtggaatgccatcaggatgctcagggaccagcatattcaact

SEQ ID NO: 73379 - DNA, 75 bp, Artificial Sequence
  Synthetic
tgattgcttatggtgatgatgtcattgcctcctacccatggcctattgatgcatccctgttagctgaagcgggga

SEQ ID NO: 73380 - DNA, 75 bp, Artificial Sequence
  Synthetic
tgcctcctacccatggcctattgatgcatccctgttagctgaagcggggaaaggttacggtttggtaatgacccc

SEQ ID NO: 73381 - DNA, 75 bp, Artificial Sequence
  Synthetic
gctcaagtgtcaacacagaaaactggagcgcatgaaactgggctaagggccagcgggcgctcagttatccactac

SEQ ID NO: 73382 - DNA, 75 bp, Artificial Sequence
  Synthetic
gagcgcatgaaactgggctaagggccagcgggcgctcagttatccactacaccaatataaattactacagggatg

SEQ ID NO: 73383 - DNA, 75 bp, Artificial Sequence
  Synthetic
tgagcaatacccattcttggtgcaccctgtcatgccaatgaaggacattcaagaatccattaggtggactaaaga

SEQ ID NO: 73384 - DNA, 75 bp, Artificial Sequence
  Synthetic
cctgtcatgccaatgaaggacattcaagaatccattaggtggactaaagatcctaaaaacacgcaggatcatgtg

SEQ ID NO: 73385 - DNA, 75 bp, Artificial Sequence
  Synthetic
tggtcaagactctgccagccctgaactctcccagtgcagaggagtgcgggtatagtgatcgcgtgcggtcgataa

SEQ ID NO: 73386 - DNA, 75 bp, Artificial Sequence
  Synthetic
ctctcccagtgcagaggagtgcgggtatagtgatcgcgtgcggtcgataacactggggaactccaccattacaac

SEQ ID NO: 73387 - DNA, 75 bp, Artificial Sequence
  Synthetic
cctgtcggacgatgcctaaccctccctgctttctcgtcgttgcgtaggaggtggttggactccttttagaattag

SEQ ID NO: 73388 - DNA, 75 bp, Artificial Sequence
  Synthetic
agcacaactgtagatttacaattggctaaccctaccgcatgaaccgaacttgatacaagtgcggtaggggtaaat

SEQ ID NO: 73389 - DNA, 75 bp, Artificial Sequence
  Synthetic
ggaccaaccaacccaaccggatgtggccacgtgcaggttctatacgctagaatcagtgcagtgggaaacgggatc

SEQ ID NO: 73390 - DNA, 75 bp, Artificial Sequence
  Synthetic
gccacgtgcaggttctatacgctagaatcagtgcagtgggaaacgggatcgcctggttggtggtggaagttccct

SEQ ID NO: 73391 - DNA, 75 bp, Artificial Sequence
  Synthetic
accagccgcattttggtcaagcacttctgtttccccggaccgagtatcaataagctgctcacgcggctgaaggag

SEQ ID NO: 73392 - DNA, 75 bp, Artificial Sequence
  Synthetic
catgtgcaatgcaacgcgtccaagttccatcaaggatgcgttttggtcgtctgtgtcccggaagccgagatgggg

SEQ ID NO: 73393 - DNA, 75 bp, Artificial Sequence
  Synthetic
tccatcaaggatgcgttttggtcgtctgtgtcccggaagccgagatggggtgcgccgacatagattccacttttg

SEQ ID NO: 73394 - DNA, 75 bp, Artificial Sequence
  Synthetic
cggcagtttgtaacgcaggaatgggcgtaggtgttggcaatctgacaatctttccgcatcagtggatcaatctgc

SEQ ID NO: 73395 - DNA, 75 bp, Artificial Sequence
  Synthetic
cgtaggtgttggcaatctgacaatctttccgcatcagtggatcaatctgcgcaccaacaatagtgccactattgt

SEQ ID NO: 73396 - DNA, 75 bp, Artificial Sequence
  Synthetic
gagtccattgagctagctggtagtcctccggcccctgaatgcggctaatcctaactgcggagcaggtgctcacag

SEQ ID NO: 73397 - DNA, 75 bp, Artificial Sequence
  Synthetic
tgcgccactgaaatatgacacgggggcaactccttatgtaccgatcaccgtcacggtggcccccatgtgctctga

SEQ ID NO: 73398 - DNA, 75 bp, Artificial Sequence
  Synthetic
gcaactccttatgtaccgatcaccgtcacggtggcccccatgtgctctgagtataacgggctgcgacttgcatcc

SEQ ID NO: 73399 - DNA, 75 bp, Artificial Sequence
  Synthetic
tcttatattggctgcttatggtgacaattaaagaattgttaccatatagctattggattggccatccggtgacga

SEQ ID NO: 73400 - DNA, 75 bp, Artificial Sequence
  Synthetic
aattaaagaattgttaccatatagctattggattggccatccggtgacgagcagagccattgtttacctctttgt

SEQ ID NO: 73401 - DNA, 75 bp, Artificial Sequence
  Synthetic
gctatgccacagttcgaccctacaccgttaatgcacatccctggtgaggtacataatttaatggaaattgcagag

SEQ ID NO: 73402 - DNA, 75 bp, Artificial Sequence
  Synthetic
cgttaatgcacatccctggtgaggtacataatttaatggaaattgcagaggttgattcagtgatccccataaata

SEQ ID NO: 73403 - DNA, 75 bp, Artificial Sequence
  Synthetic
atgggagcgcaagtgtcaacacaaaaaactggagcacatgagactggtttaagtgctagcgggaactccgttata

SEQ ID NO: 73404 - DNA, 75 bp, Artificial Sequence
  Synthetic
aaactggagcacatgagactggtttaagtgctagcgggaactccgttatacattatacaaacatcaattattaca

SEQ ID NO: 73405 - DNA, 75 bp, Artificial Sequence
  Synthetic
ccattttcagcttccaggtagaccctgggtttagtgaggtgctcaatcgcaccttgctgggtgagatgctcaatt

SEQ ID NO: 73406 - DNA, 75 bp, Artificial Sequence
  Synthetic
tgggtttagtgaggtgctcaatcgcaccttgctgggtgagatgctcaattattacgcacattggtcaggcagcat

SEQ ID NO: 73407 - DNA, 75 bp, Artificial Sequence
  Synthetic
acgtattgattaagaccttacccgctttaaattcacccactgtggaagagtgtggttacagtgatcgagtgcgct

SEQ ID NO: 73408 - DNA, 75 bp, Artificial Sequence
  Synthetic
tttaaattcacccactgtggaagagtgtggttacagtgatcgagtgcgctcgattacactgggaaattccacgat

SEQ ID NO: 73409 - DNA, 75 bp, Artificial Sequence
  Synthetic
ctcagttcccaccacccgaaaggacgcgatgctgggcacccacattatatgggacttgggattgcaatcaagctg

SEQ ID NO: 73410 - DNA, 75 bp, Artificial Sequence
  Synthetic
gcgatgctgggcacccacattatatgggacttgggattgcaatcaagctgcgtgctgtgcgtgccatggataagc

SEQ ID NO: 73411 - DNA, 75 bp, Artificial Sequence
  Synthetic
tgcggtggaccaaccgacacaacctgatgtcgcaacatgtcgtttctacactcttgaatcagtaaagtgggagag

SEQ ID NO: 73412 - DNA, 75 bp, Artificial Sequence
  Synthetic
gatgtcgcaacatgtcgtttctacactcttgaatcagtaaagtgggagagttcatcagcagggtggtggtggaag

SEQ ID NO: 73413 - DNA, 75 bp, Artificial Sequence
  Synthetic
attgtggtccccagtgggacaccgactgagtgtgtcgtgctcggctttgtttcggcttgcaatgatttctcagtg

SEQ ID NO: 73414 - DNA, 75 bp, Artificial Sequence
  Synthetic
ctgagtgtgtcgtgctcggctttgtttcggcttgcaatgatttctcagtgcgattgctgagggacaccccgttca

SEQ ID NO: 73415 - DNA, 75 bp, Artificial Sequence
  Synthetic
accatacacgtgcaatgcaacgcatcgaagttccaccaaggatgtctgctcgttgtgtgcgtccctgaagctgag

SEQ ID NO: 73416 - DNA, 75 bp, Artificial Sequence
  Synthetic
cgaagttccaccaaggatgtctgctcgttgtgtgcgtccctgaagctgagatgggtgcagccaccactgatcacg

SEQ ID NO: 73417 - DNA, 75 bp, Artificial Sequence
  Synthetic
cggcaaactccatgcaagtacccgctttgacagccgttgagactggtcacacatcacaagtggtacccggagata

SEQ ID NO: 73418 - DNA, 75 bp, Artificial Sequence
  Synthetic
tttgacagccgttgagactggtcacacatcacaagtggtacccggagataccatacaaacaagacatgtagtcaa

SEQ ID NO: 73419 - DNA, 75 bp, Artificial Sequence
  Synthetic
gaccgcaaactgcagttcacaacgcgggcatgggtgtggctgttgggaatttgacaatatacccccatcaatgga

SEQ ID NO: 73420 - DNA, 75 bp, Artificial Sequence
  Synthetic
gggcatgggtgtggctgttgggaatttgacaatatacccccatcaatggattaacctgcgcaccaacaatagcgc

SEQ ID NO: 73421 - DNA, 75 bp, Artificial Sequence
  Synthetic
agcaatgggagaaaacacaaacattgacagatacgccagctgggacataaacatcagggagatggtgcaactgcg

SEQ ID NO: 73422 - DNA, 75 bp, Artificial Sequence
  Synthetic
gacagatacgccagctgggacataaacatcagggagatggtgcaactgcgacgcaagtgcgagctgttcacatac

SEQ ID NO: 73423 - DNA, 75 bp, Artificial Sequence
  Synthetic
aatcccgtttgcaaagttagagcactcccctcaggcctccacatatgtgccaatcacagtcactgtagcccctat

SEQ ID NO: 73424 - DNA, 75 bp, Artificial Sequence
  Synthetic
tcccctcaggcctccacatatgtgccaatcacagtcactgtagcccctatgtgcgccgagtacaacgggctgcgc

SEQ ID NO: 73425 - DNA, 75 bp, Artificial Sequence
  Synthetic
ccagtgctaacccaccagatcatgtacattccacctggcggtcctgtgcccaataaagtggatgggtacgagtgg

SEQ ID NO: 73426 - DNA, 75 bp, Artificial Sequence
  Synthetic
acattccacctggcggtcctgtgcccaataaagtggatgggtacgagtggcagacatcgacaaacccaagtgtgt

SEQ ID NO: 73427 - DNA, 75 bp, Artificial Sequence
  Synthetic
tctccatctgcaatgccacagtttgacgtcaccccggagatacaaatccctggacaggtgaggaacctaatggaa

SEQ ID NO: 73428 - DNA, 75 bp, Artificial Sequence
  Synthetic
acgtcaccccggagatacaaatccctggacaggtgaggaacctaatggaaatagccgaggtagattcagttgtcc

SEQ ID NO: 73429 - DNA, 75 bp, Artificial Sequence
  Synthetic
atgatggttggtcacacttcagccaagctggggtgtacggatacacaacattgaacgcgatggggaagctttatg

SEQ ID NO: 73430 - DNA, 75 bp, Artificial Sequence
  Synthetic
agctggggtgtacggatacacaacattgaacgcgatggggaagctttatgtgcgccatgtcaatgcaagcagtcc

SEQ ID NO: 73431 - DNA, 75 bp, Artificial Sequence
  Synthetic
gtgagcaagtctttggattccaactgcaaccaggctatgatagcgtgctgaagcacactcttcttggtgaaatac

SEQ ID NO: 73432 - DNA, 75 bp, Artificial Sequence
  Synthetic
gcaaccaggctatgatagcgtgctgaagcacactcttcttggtgaaatactaaactattatgccaactggtcagg

SEQ ID NO: 73433 - DNA, 75 bp, Artificial Sequence
  Synthetic
gctgtgccagtacaaaaagaaagccaatgtcaactttgaagtgaccaacgtcactaacgagcgcacagacatcaa

SEQ ID NO: 73434 - DNA, 75 bp, Artificial Sequence
  Synthetic
aatgtcaactttgaagtgaccaacgtcactaacgagcgcacagacatcaacaaggtaccgacagaggagcacact

SEQ ID NO: 73435 - DNA, 75 bp, Artificial Sequence
  Synthetic
aggggctggagttcctgggagtaggaaggacgccatgctcgggacacatgttatatgggacgttggcctacaatc

SEQ ID NO: 73436 - DNA, 75 bp, Artificial Sequence
  Synthetic
aaggacgccatgctcgggacacatgttatatgggacgttggcctacaatccagctgtgtgctatgcgtaccgtgg

SEQ ID NO: 73437 - DNA, 75 bp, Artificial Sequence
  Synthetic
agacacctagccacacgcacagactggcaaaactgtgtgtgggaagactataacagggacctccttgtgagcacc

SEQ ID NO: 73438 - DNA, 75 bp, Artificial Sequence
  Synthetic
ggcaaaactgtgtgtgggaagactataacagggacctccttgtgagcaccaccacagcccatgggtgtgatgtct

SEQ ID NO: 73439 - DNA, 75 bp, Artificial Sequence
  Synthetic
acaagtatcgtgacgccaccagatatacctacaacaagtaccatattgtgcttcgtgtctgcatgtaatgatttt

SEQ ID NO: 73440 - DNA, 75 bp, Artificial Sequence
  Synthetic
tacctacaacaagtaccatattgtgcttcgtgtctgcatgtaatgatttttcagtgagactactgcgcgacacac

SEQ ID NO: 73441 - DNA, 75 bp, Artificial Sequence
  Synthetic
gtccggggcttgtcgaggtacaggagagtgaatattatcccaaaaggtaccaatctcacgtgctacttgctgcag

SEQ ID NO: 73442 - DNA, 75 bp, Artificial Sequence
  Synthetic
gagtgaatattatcccaaaaggtaccaatctcacgtgctacttgctgcaggtttctcagaaccaggggactgtgg

SEQ ID NO: 73443 - DNA, 75 bp, Artificial Sequence
  Synthetic
atactatagctagtgggcccgtcaatacagagcaaattcctgcattgacagcagtggagacagggcatacatctc

SEQ ID NO: 73444 - DNA, 75 bp, Artificial Sequence
  Synthetic
tacagagcaaattcctgcattgacagcagtggagacagggcatacatctcaagtggtacctagtgacacaatgca

SEQ ID NO: 73445 - DNA, 75 bp, Artificial Sequence
  Synthetic
cgtgcgagacctcctttggttggaggatgatgccatggaacagggtgttacagactatgtggaacaactgggcaa

SEQ ID NO: 73446 - DNA, 75 bp, Artificial Sequence
  Synthetic
gatgatgccatggaacagggtgttacagactatgtggaacaactgggcaatgcctttggtacaggtttcactaac

SEQ ID NO: 73447 - DNA, 75 bp, Artificial Sequence
  Synthetic
atatatcgcccactataccacagaaaaggctaatgatgatttggacagatacactaactgggagatcacaactag

SEQ ID NO: 73448 - DNA, 75 bp, Artificial Sequence
  Synthetic
aaggctaatgatgatttggacagatacactaactgggagatcacaactaggcaggtggcacagttgaggcgcaag

SEQ ID NO: 73449 - DNA, 75 bp, Artificial Sequence
  Synthetic
gcactagttaaaatcatatcagcattggtgatcgtagtcagaaaccatgatgatctgatcacagtaactgccaca

SEQ ID NO: 73450 - DNA, 75 bp, Artificial Sequence
  Synthetic
tggtgatcgtagtcagaaaccatgatgatctgatcacagtaactgccacactggctctcattggctgcacaacat

SEQ ID NO: 73451 - DNA, 75 bp, Artificial Sequence
  Synthetic
aggtatgcgtcagactcccccccattaacacatcagataatgtacgtgccgccggggggtccaattcccaagggt

SEQ ID NO: 73452 - DNA, 75 bp, Artificial Sequence
  Synthetic
taacacatcagataatgtacgtgccgccggggggtccaattcccaagggttatgaagactttgcctggcagacgt

SEQ ID NO: 73453 - DNA, 75 bp, Artificial Sequence
  Synthetic
ggttaaagaaattcaccgagatgaccaatgcctgcaagggtatggaatggattgctatcaagatccaaaagttta

SEQ ID NO: 73454 - DNA, 75 bp, Artificial Sequence
  Synthetic
caatgcctgcaagggtatggaatggattgctatcaagatccaaaagtttatcgagtggcttaaggtcaagatcct

SEQ ID NO: 73455 - DNA, 75 bp, Artificial Sequence
  Synthetic
acgcatattgtaacttttatgatggatggtcccatttcagtcagagcggtgtgtacgggtacactacattgaaca

SEQ ID NO: 73456 - DNA, 75 bp, Artificial Sequence
  Synthetic
atggtcccatttcagtcagagcggtgtgtacgggtacactacattgaacaacatggggcacttatattttagaca

SEQ ID NO: 73457 - DNA, 75 bp, Artificial Sequence
  Synthetic
cattgagcaaagtgcaccctcacaaagtgaccaagagcagctcttttcgaatgttcagtacttcgcacattattg

SEQ ID NO: 73458 - DNA, 75 bp, Artificial Sequence
  Synthetic
agtgaccaagagcagctcttttcgaatgttcagtacttcgcacattattgtaggaagtacgctcccttgtatgct

SEQ ID NO: 73459 - DNA, 75 bp, Artificial Sequence
  Synthetic
ggtacctcgcgcgccacgcttatgtccatatttgtatgctaaaaatgtcaattttgatgtgcaaggcgtgaccga

SEQ ID NO: 73460 - DNA, 75 bp, Artificial Sequence
  Synthetic
ccatatttgtatgctaaaaatgtcaattttgatgtgcaaggcgtgaccgagtcccggggtaagatcactctcgac

SEQ ID NO: 73461 - DNA, 75 bp, Artificial Sequence
  Synthetic
gaacctgtgtgtttactcctccacggtagtccgggagttggcaagtcagtggccaccaacctaataggaagatcc

SEQ ID NO: 73462 - DNA, 75 bp, Artificial Sequence
  Synthetic
gtagtccgggagttggcaagtcagtggccaccaacctaataggaagatcccttgcagagaagctcaacagctctg

SEQ ID NO: 73463 - DNA, 75 bp, Artificial Sequence
  Synthetic
agattggtcaataggcacctcgccacacacaccgattggcaaaactgcgtgtggaaggactacaatagagacttg

SEQ ID NO: 73464 - DNA, 75 bp, Artificial Sequence
  Synthetic
cacacaccgattggcaaaactgcgtgtggaaggactacaatagagacttgttagttagtaccaccacagcgcacg

SEQ ID NO: 73465 - DNA, 75 bp, Artificial Sequence
  Synthetic
gccaaaaccctgacggaaaggatgtgtcactgttttgccaaatggtctccagcgtagacttcgtaccacccatgg

SEQ ID NO: 73466 - DNA, 75 bp, Artificial Sequence
  Synthetic
gtcactgttttgccaaatggtctccagcgtagacttcgtaccacccatggcagctttggaagagaagggaattct

SEQ ID NO: 73467 - DNA, 75 bp, Artificial Sequence
  Synthetic
taacgtttgaagggcctgggctcgtggaggtgcaggaaagtgaatactacccaaagagatatcagtcccatgtgt

SEQ ID NO: 73468 - DNA, 75 bp, Artificial Sequence
  Synthetic
ggaggtgcaggaaagtgaatactacccaaagagatatcagtcccatgtgttgcttgctgcaggcttttcagagcc

SEQ ID NO: 73469 - DNA, 75 bp, Artificial Sequence
  Synthetic
gcttgccagaagattccattttgacatgaacattgaagttatctccatgtacagccagaatgggaagatcaacat

SEQ ID NO: 73470 - DNA, 75 bp, Artificial Sequence
  Synthetic
cggtttcgccgacgtgcgcgacctcctatggctagaagacgatgccatggagcagggtgtcaaggactatgtgga

SEQ ID NO: 73471 - DNA, 75 bp, Artificial Sequence
  Synthetic
gcccatgtctgtcaagacatgtgatgaggagtgttgcccagtcaactttaagagatgttgcccgctggtgtgtgg

SEQ ID NO: 73472 - DNA, 75 bp, Artificial Sequence
  Synthetic
ctatggctagaagacgatgccatggagcagggtgtcaaggactatgtggaacagctggggaacgcctttggctct

SEQ ID NO: 73473 - DNA, 75 bp, Artificial Sequence
  Synthetic
agagtacaaccacagacacagcgtgggtgccaccctcgaagccctattccaagggcctccagtctatagagagat

SEQ ID NO: 73474 - DNA, 75 bp, Artificial Sequence
  Synthetic
aaatccctcaaagcactagtcaagatcatttcagcactagtgattgtcgtgagaaatcacgatgatctcattaca

SEQ ID NO: 73475 - DNA, 75 bp, Artificial Sequence
  Synthetic
tcatttcagcactagtgattgtcgtgagaaatcacgatgatctcattacagtgacagctaccctcgctctcatag

SEQ ID NO: 73476 - DNA, 75 bp, Artificial Sequence
  Synthetic
ggtgccaccctcgaagccctattccaagggcctccagtctatagagagattaagatcagtgtcgctccggaaaca

SEQ ID NO: 73477 - DNA, 75 bp, Artificial Sequence
  Synthetic
ggttggcttgtgccagagaccaattccaccttgcagattgagaagcacgtcagcagagcatttatttgcttacaa

SEQ ID NO: 73478 - DNA, 75 bp, Artificial Sequence
  Synthetic
aaaataacaattggctcaaaaagttcacagagatgactaatgcctgtaaaggcatggagtggatagccatcaaga

SEQ ID NO: 73479 - DNA, 75 bp, Artificial Sequence
  Synthetic
ccaccttgcagattgagaagcacgtcagcagagcatttatttgcttacaagcactgacaacttttgtttcagtgg

SEQ ID NO: 73480 - DNA, 75 bp, Artificial Sequence
  Synthetic
taaaacaattgccactattggagagtcagattgctaccattgagcaaagcgcaccttcacaaagtgaccaagaac

SEQ ID NO: 73481 - DNA, 75 bp, Artificial Sequence
  Synthetic
ctaaagtgcccactctgagacaggctaaggtgcaaggcccagcatttgagtttgccgtagcgatgatgaaaagaa

SEQ ID NO: 73482 - DNA, 75 bp, Artificial Sequence
  Synthetic
taaggtgcaaggcccagcatttgagtttgccgtagcgatgatgaaaagaaacgcaagtacagtgaagactgagta

SEQ ID NO: 73483 - DNA, 75 bp, Artificial Sequence
  Synthetic
gagcaattacatacagttcaagtccaaatgccgtattgagcctgtatgtttactcctacatgggagccctggtgc

SEQ ID NO: 73484 - DNA, 75 bp, Artificial Sequence
  Synthetic
tttgatgaatgaccaagaagttggcgtgctggatgctaaggaattagtggataaggatgggaccaacctggaatt

SEQ ID NO: 73485 - DNA, 75 bp, Artificial Sequence
  Synthetic
gtgctggatgctaaggaattagtggataaggatgggaccaacctggaattaaccctactgaagctcaatcgcaat

SEQ ID NO: 73486 - DNA, 75 bp, Artificial Sequence
  Synthetic
cggaaagtccgtggcaactaacttgattgggcggtcacttgcagaaaaactcaacagctcagtgtactcgttgcc

SEQ ID NO: 73487 - DNA, 75 bp, Artificial Sequence
  Synthetic
acaagcaaattcccaaacatgtacatccctgtcggtcaagtcactgattacggtttcttaaacttgggaggcacc

SEQ ID NO: 73488 - DNA, 75 bp, Artificial Sequence
  Synthetic
tccctgtcggtcaagtcactgattacggtttcttaaacttgggaggcaccccaactaagaggatgcttatgtaca

SEQ ID NO: 73489 - DNA, 75 bp, Artificial Sequence
  Synthetic
tgggaaagacgtgtccctgttttgtcaaatggtatcaagtgttgattttgtcccaccaatggcggcgctcgagga

SEQ ID NO: 73490 - DNA, 75 bp, Artificial Sequence
  Synthetic
gaaatggacatcagggtttctctgctgctctccttaggcattacttcaatgaggagcagggcgagatagagttca

SEQ ID NO: 73491 - DNA, 75 bp, Artificial Sequence
  Synthetic
ggacagcagagctctagctagaagatttcacttcgacatgaacattgaagtcatctcaatgtacagtcaaaatgg

SEQ ID NO: 73492 - DNA, 75 bp, Artificial Sequence
  Synthetic
tttcacttcgacatgaacattgaagtcatctcaatgtacagtcaaaatggcaaaattaatatgccgatgtcagta

SEQ ID NO: 73493 - DNA, 75 bp, Artificial Sequence
  Synthetic
tgctctccttaggcattacttcaatgaggagcagggcgagatagagttcattgaaagctccaaagacgcaggtta

SEQ ID NO: 73494 - DNA, 75 bp, Artificial Sequence
  Synthetic
accggcagttcttaggaatggggacccacggctcaaagccaattttgaagaggcgatcttttctaaatacattgg

SEQ ID NO: 73495 - DNA, 75 bp, Artificial Sequence
  Synthetic
ttcatagacaggagaacacaggtaagatactcactggacatgcttgtgactgaaatgttcagggaatacaaccat

SEQ ID NO: 73496 - DNA, 75 bp, Artificial Sequence
  Synthetic
gatactcactggacatgcttgtgactgaaatgttcagggaatacaaccatagacatagcgtgggagcaacgcttg

SEQ ID NO: 73497 - DNA, 75 bp, Artificial Sequence
  Synthetic
ccacggctcaaagccaattttgaagaggcgatcttttctaaatacattgggaatgtcaacacgcatgtggatgag

SEQ ID NO: 73498 - DNA, 75 bp, Artificial Sequence
  Synthetic
gaggatgccgtgtatggcacagaggggttggaagcgctagatttaaccactagcgcaggttacccctacgtggct

SEQ ID NO: 73499 - DNA, 75 bp, Artificial Sequence
  Synthetic
caattgctgacctgttaaagtcagtggacagtgaggcagttagagaatactgcaaggaaaagggatggttggtgc

SEQ ID NO: 73500 - DNA, 75 bp, Artificial Sequence
  Synthetic
ggacagtgaggcagttagagaatactgcaaggaaaagggatggttggtgcccgagatcaattccaccctgcaaat

SEQ ID NO: 73501 - DNA, 75 bp, Artificial Sequence
  Synthetic
ggttggaagcgctagatttaaccactagcgcaggttacccctacgtggctttgggtatcaagaaaagagacattc

SEQ ID NO: 73502 - DNA, 75 bp, Artificial Sequence
  Synthetic
catatgttaaggatgagttgagatctgctgagaaagtagccaagggaaaatcccggctcatcgaagcctccagtc

SEQ ID NO: 73503 - DNA, 75 bp, Artificial Sequence
  Synthetic
catcatttacaagctgtttgcaggctttcaaggcgcttactctggaatgcccaaccaaaaatccaaagtgccaac

SEQ ID NO: 73504 - DNA, 75 bp, Artificial Sequence
  Synthetic
tttcaaggcgcttactctggaatgcccaaccaaaaatccaaagtgccaaccttaagacaagcgaaagttcagggg

SEQ ID NO: 73505 - DNA, 75 bp, Artificial Sequence
  Synthetic
tgctgagaaagtagccaagggaaaatcccggctcatcgaagcctccagtctcaatgattcagtggccatgagaca

SEQ ID NO: 73506 - DNA, 75 bp, Artificial Sequence
  Synthetic
agatgtgttttggagcaagatccctgttatgcttgacgggcacctcatagcctttgattactcgggttacgatgc

SEQ ID NO: 73507 - DNA, 75 bp, Artificial Sequence
  Synthetic
atgcttggcatttacgacagatgggcggtgttaccccgacatgccaagcctggaccaaccattataatgaatgac

SEQ ID NO: 73508 - DNA, 75 bp, Artificial Sequence
  Synthetic
cggtgttaccccgacatgccaagcctggaccaaccattataatgaatgaccaggaggtgggcgtggtggatgcca

SEQ ID NO: 73509 - DNA, 75 bp, Artificial Sequence
  Synthetic
gttatgcttgacgggcacctcatagcctttgattactcgggttacgatgccagtctcagcccagtgtggtttgcg

SEQ ID NO: 73510 - DNA, 75 bp, Artificial Sequence
  Synthetic
catcacttgtatcgagacaaacattacttcgtgaggggtgggatgccatcaggttgctcgggtaccagcatattc

SEQ ID NO: 73511 - DNA, 75 bp, Artificial Sequence
  Synthetic
atatccgaggtttcttggcacgagaggaggcagaggtcaatgaagctgtacttgctatcaacacaagcaaatttc

SEQ ID NO: 73512 - DNA, 75 bp, Artificial Sequence
  Synthetic
ggaggcagaggtcaatgaagctgtacttgctatcaacacaagcaaatttccaaatatgtacatcccagttggtca

SEQ ID NO: 73513 - DNA, 75 bp, Artificial Sequence
  Synthetic
acttcgtgaggggtgggatgccatcaggttgctcgggtaccagcatattcaactccatgattaacaacatcataa

SEQ ID NO: 73514 - DNA, 75 bp, Artificial Sequence
  Synthetic
tgatcgcctcgtacccatggcccattgatgcctcgttactagctgaggcagggaaggattatggcctgatcatga

SEQ ID NO: 73515 - DNA, 75 bp, Artificial Sequence
  Synthetic
tgcaggacagtgtggtggcgtcttaatgtcaacaggcaaggtccttggagtacatgttggagggaatgggcacca

SEQ ID NO: 73516 - DNA, 75 bp, Artificial Sequence
  Synthetic
atgtcaacaggcaaggtccttggagtacatgttggagggaatgggcaccagggattttcagcagccctgttgcgg

SEQ ID NO: 73517 - DNA, 75 bp, Artificial Sequence
  Synthetic
tgatgcctcgttactagctgaggcagggaaggattatggcctgatcatgactccggcggacaagggtgagtgttt

SEQ ID NO: 73518 - DNA, 75 bp, Artificial Sequence
  Synthetic
tcaccccgttatgcccatgaaagacatccatgagtccattagatggaccaaggatccgaaaaacacacaagatca

SEQ ID NO: 73519 - DNA, 75 bp, Artificial Sequence
  Synthetic
actcctagtaagacaaagcttgagcccagcgtttttcatcatgtatttgagggaaataaagagccagcagtgttg

SEQ ID NO: 73520 - DNA, 75 bp, Artificial Sequence
  Synthetic
ccagcgtttttcatcatgtatttgagggaaataaagagccagcagtgttgaggaatggtgaccctagactaaagg

SEQ ID NO: 73521 - DNA, 75 bp, Artificial Sequence
  Synthetic
tggcacaatggggagcacgaatatgaggagtttatccgcaaaatcagaagcgtgcccgttgggcgttgcttgaca

SEQ ID NO: 73522 - DNA, 75 bp, Artificial Sequence
  Synthetic
cagttgaccattatgcaggacaattagcaactctcgatatcagtacagagcccatgaaacttgaggatgcagtat

SEQ ID NO: 73523 - DNA, 75 bp, Artificial Sequence
  Synthetic
acggcaccgagggcttggaggctctagacctgaccactagtgcggggtacccctatgttgccctcggcatcaaaa

SEQ ID NO: 73524 - DNA, 75 bp, Artificial Sequence
  Synthetic
ttaaaacagcctgtgggttgcccccacccgcagggcccattgggcgctagcacactggtatcacggtacctttgt

SEQ ID NO: 73525 - DNA, 75 bp, Artificial Sequence
  Synthetic
cacactggtatcacggtacctttgtgcgcctgttttatcctccctccccaagtgcaacgtagaagcaagacacaa

SEQ ID NO: 73526 - DNA, 75 bp, Artificial Sequence
  Synthetic
agtgcaacgtagaagcaagacacaaaaggtcaacagatagcccagcacaccagttgggtttcgaccaagcacttc

SEQ ID NO: 73527 - DNA, 75 bp, Artificial Sequence
  Synthetic
ctggcatagtaactggcagcgcagttggctgcgatcccgacttgttctggagcaagatcccagttatgcttgacg

SEQ ID NO: 73528 - DNA, 75 bp, Artificial Sequence
  Synthetic
tggctgcgatcccgacttgttctggagcaagatcccagttatgcttgacggccatctcattgcttttgactacag

SEQ ID NO: 73529 - DNA, 75 bp, Artificial Sequence
  Synthetic
taaggagactaactacatagattacctgtgcaactcccaccatttatacagagacaaacactactttgtgagagg

SEQ ID NO: 73530 - DNA, 75 bp, Artificial Sequence
  Synthetic
ctgtgcaactcccaccatttatacagagacaaacactactttgtgagaggaggcatgccatctgggtgttctgga

SEQ ID NO: 73531 - DNA, 75 bp, Artificial Sequence
  Synthetic
aactctgcagcggaaccgactactttgggtgtccgtgtttccttttatctctttgttggctgcttatggtgacaa

SEQ ID NO: 73532 - DNA, 75 bp, Artificial Sequence
  Synthetic
ctggatcagttcaggatgatagcttatggtgatgacgttattgcatcatacccacatcccattgacgcttcatta

SEQ ID NO: 73533 - DNA, 75 bp, Artificial Sequence
  Synthetic
gatttgtaccacttgatcacatagtctttagaacacttgtctttattctaaatcttaacaaggcaagatgggagc

SEQ ID NO: 73534 - DNA, 75 bp, Artificial Sequence
  Synthetic
ctttagaacacttgtctttattctaaatcttaacaaggcaagatgggagcacaggtgtcgacgcagaaaactggc

SEQ ID NO: 73535 - DNA, 75 bp, Artificial Sequence
  Synthetic
atggtgatgacgttattgcatcatacccacatcccattgacgcttcattactagctgaagcaggaaaaggctatg

SEQ ID NO: 73536 - DNA, 75 bp, Artificial Sequence
  Synthetic
gatactttagggcagatgagcagtaccctttccttgttcatcctgtgatgccaatgaaggacattcatgaatcaa

SEQ ID NO: 73537 - DNA, 75 bp, Artificial Sequence
  Synthetic
gcatcgaattccgccaacagacaagacttcactcaggatcctgggaaatttactgaacctgtcaaggacataatg

SEQ ID NO: 73538 - DNA, 75 bp, Artificial Sequence
  Synthetic
acttcactcaggatcctgggaaatttactgaacctgtcaaggacataatggcgaagacactgccagcattgaact

SEQ ID NO: 73539 - DNA, 75 bp, Artificial Sequence
  Synthetic
agcaagaatatgaagagttcgtgtccaaaatcaggagcgttccagtggggcgctgtttgaccctaccagcgttct

SEQ ID NO: 73540 - DNA, 75 bp, Artificial Sequence
  Synthetic
aggaaagcgcaaatgtagtagtagggtatggagtgtggcccgattatttgaaggacgacgaggcaacggctgaag

SEQ ID NO: 73541 - DNA, 75 bp, Artificial Sequence
  Synthetic
aacatgtcgattctacactctagattcagtgtcttggatgaaagaatcacaagggtggtggtggaagttccctga

SEQ ID NO: 73542 - DNA, 75 bp, Artificial Sequence
  Synthetic
acccacagggcccactgggcgctagcacactggtattctggtacctttgtgcgcctgttttatacacccttcccc

SEQ ID NO: 73543 - DNA, 75 bp, Artificial Sequence
  Synthetic
cgccctacgcgacatggggctcttcggtcaaaacatgcagtaccactatctaggtaggtcagggtacactatcca

SEQ ID NO: 73544 - DNA, 75 bp, Artificial Sequence
  Synthetic
ggtcaaaacatgcagtaccactatctaggtaggtcagggtacactatccatgtgcaatgtaacgcatccaaattc

SEQ ID NO: 73545 - DNA, 75 bp, Artificial Sequence
  Synthetic
agagagcatctgagcaacggtgaagtggcgaatactttcaccggtaccaagtccagtaacaccaatggtgtacaa

SEQ ID NO: 73546 - DNA, 75 bp, Artificial Sequence
  Synthetic
caggcagtgttcaacgctggtatgggcgtggccgttggcaacctgactgtgttcccccatcagtggattaacttg

SEQ ID NO: 73547 - DNA, 75 bp, Artificial Sequence
  Synthetic
tcatgccatatataaacagcgtcccaatggacaatatgtacaggcactacaactttacgttgatgatcattccgt

SEQ ID NO: 73548 - DNA, 75 bp, Artificial Sequence
  Synthetic
aatggacaatatgtacaggcactacaactttacgttgatgatcattccgtttgccaagttggactatgcagcagg

SEQ ID NO: 73549 - DNA, 75 bp, Artificial Sequence
  Synthetic
gcaccaaggactcccagtcatgagcactcccgggagcaaccagttcctgacatctgatgactaccaatcacctac

SEQ ID NO: 73550 - DNA, 75 bp, Artificial Sequence
  Synthetic
agccatgccccaattcgatgtcacaccagagatgcacatcccaggcgaggtgaaaaacctaatggaaattgccga

SEQ ID NO: 73551 - DNA, 75 bp, Artificial Sequence
  Synthetic
ctcagttacagagacaggtgctcaggtgtttggtttcaccctacaaccgggtgcagacagtgtaatggagagaac

SEQ ID NO: 73552 - DNA, 75 bp, Artificial Sequence
  Synthetic
gtgtttggtttcaccctacaaccgggtgcagacagtgtaatggagagaactttgctaggcgagattctaaattac

SEQ ID NO: 73553 - DNA, 75 bp, Artificial Sequence
  Synthetic
ttagcctattcaccacctggtgccggggtgcccaaaaacaggaaagaagccatgttgggtacccacatgatatgg

SEQ ID NO: 73554 - DNA, 75 bp, Artificial Sequence
  Synthetic
gggtgcccaaaaacaggaaagaagccatgttgggtacccacatgatatgggacattggactgcaatccagctgtg

SEQ ID NO: 73555 - DNA, 75 bp, Artificial Sequence
  Synthetic
taacgtgctggtaccaaacaagcattgtagtccctgcagaagtgcaaaatcagagcgtcatcttgtgctttgtgt

SEQ ID NO: 73556 - DNA, 75 bp, Artificial Sequence
  Synthetic
tgtagtccctgcagaagtgcaaaatcagagcgtcatcttgtgctttgtgtctgcatgcaatgatttttcagtcag

SEQ ID NO: 73557 - DNA, 75 bp, Artificial Sequence
  Synthetic
aattgttcgtgtagcggacacattacccagtgggccaagcaactcagaaagcataccagcactcacagcagccga

SEQ ID NO: 73558 - DNA, 75 bp, Artificial Sequence
  Synthetic
cccagtgggccaagcaactcagaaagcataccagcactcacagcagccgagactggacatacctcgcaggtcgtc

SEQ ID NO: 73559 - DNA, 75 bp, Artificial Sequence
  Synthetic
agcaggtcagcttgcgtgtacatcgtggagtacaaaacccaggacacgactcccgacaagatgtatgatagctgg

SEQ ID NO: 73560 - DNA, 75 bp, Artificial Sequence
  Synthetic
tcccgacaagatgtatgatagctgggttatcaataccagacaagtggcgcagttgagaaggaagctggagttctt

SEQ ID NO: 73561 - DNA, 75 bp, Artificial Sequence
  Synthetic
aagatgactccacaagacagaacaccgacaccccagtgctaactcatcaaattatgtatgtgccgccaggagggc

SEQ ID NO: 73562 - DNA, 75 bp, Artificial Sequence
  Synthetic
cgacaccccagtgctaactcatcaaattatgtatgtgccgccaggagggcccataccacacgcggtggacgatta

SEQ ID NO: 73563 - DNA, 75 bp, Artificial Sequence
  Synthetic
catgagtgttggcaatgcatacagtaacttctacgacgggtggtcccacttttctcaaactggggtttacgggtt

SEQ ID NO: 73564 - DNA, 75 bp, Artificial Sequence
  Synthetic
aacttctacgacgggtggtcccacttttctcaaactggggtttacgggtttaacaccctaaacaacatgggtaag

SEQ ID NO: 73565 - DNA, 75 bp, Artificial Sequence
  Synthetic
cacgtgaaggcatgggtacccagaccgccgagattgtgtgagtacacccacaaggataacgtggactatgaacca

SEQ ID NO: 73566 - DNA, 75 bp, Artificial Sequence
  Synthetic
cgccgagattgtgtgagtacacccacaaggataacgtggactatgaaccaaagggggtcacaacatcacgcactt

SEQ ID NO: 73567 - DNA, 75 bp, Artificial Sequence
  Synthetic
gcaattatagagtggtaaacagacacttggcaacacacaccgactggcagaactgcgtgtgggaggactacaaca

SEQ ID NO: 73568 - DNA, 75 bp, Artificial Sequence
  Synthetic
aactgcgtgtgggaggactacaacagggacctcctagtcagcacaaccacagctcatgggtgtgataccattgcc

SEQ ID NO: 73569 - DNA, 75 bp, Artificial Sequence
  Synthetic
ggtctcgtagaggtacaggagagcggatattaccctaagaggtaccaatctcacgtgctgcttgcggcgggtctc

SEQ ID NO: 73570 - DNA, 75 bp, Artificial Sequence
  Synthetic
gatattaccctaagaggtaccaatctcacgtgctgcttgcggcgggtctctccgaaccaggagactgtggaggaa

SEQ ID NO: 73571 - DNA, 75 bp, Artificial Sequence
  Synthetic
gagatcttttgtggctggaggatgatgccatggaacaaggcgtcaaggactatgtggaacaactcggcaatgcct

SEQ ID NO: 73572 - DNA, 75 bp, Artificial Sequence
  Synthetic
tgccatggaacaaggcgtcaaggactatgtggaacaactcggcaatgcctttggttcaggtttcaccaatcaaat

SEQ ID NO: 73573 - DNA, 75 bp, Artificial Sequence
  Synthetic
ggtcaagatcatatcagctttggtgatcgtggtaaggaaccatgacgatctgatcacagtaacagccacactggc

SEQ ID NO: 73574 - DNA, 75 bp, Artificial Sequence
  Synthetic
atcgtggtaaggaaccatgacgatctgatcacagtaacagccacactggccctcatcggttgtacatcatctcca

SEQ ID NO: 73575 - DNA, 75 bp, Artificial Sequence
  Synthetic
aagaaatttactgaaatgactaacgcttgtaaaggaatggaatggatagctatcaaaatccagaagtttatagaa

SEQ ID NO: 73576 - DNA, 75 bp, Artificial Sequence
  Synthetic
ccaggtgtagggaaatcagtcgccactaatctaattgggcgttcactggctgagaagcttaacagctcaatatac

SEQ ID NO: 73577 - DNA, 75 bp, Artificial Sequence
  Synthetic
gaagaccgagtacggtgagttcacaatgcttgggatctatgacagatgggcggtgttgccccgccacgctaaacc

SEQ ID NO: 73578 - DNA, 75 bp, Artificial Sequence
  Synthetic
caatgctggctctattaatgctccaacagtttcagacagtagagcactggctaggaggtttcacttcgacatgaa

SEQ ID NO: 73579 - DNA, 75 bp, Artificial Sequence
  Synthetic
gtgctgtcccgtcaacttcaaaaagtgctgccctcttgtgtgcggcaaggccatccagttcatcgatagaagaac

SEQ ID NO: 73580 - DNA, 75 bp, Artificial Sequence
  Synthetic
acaagttagatactccctggacatgttggtcacagagatgtttagggagtacaaccatagacatagtgttggagc

SEQ ID NO: 73581 - DNA, 75 bp, Artificial Sequence
  Synthetic
acaaccatagacatagtgttggagcaactctagaagcgctctttcaaggaccaccagtgtacagggagatcaaaa

SEQ ID NO: 73582 - DNA, 75 bp, Artificial Sequence
  Synthetic
aacaacatttgtgtccgtggctggaatcatctacattatatacaagctgtttgcaggctttcaaggtgcgtacac

SEQ ID NO: 73583 - DNA, 75 bp, Artificial Sequence
  Synthetic
atcatctacattatatacaagctgtttgcaggctttcaaggtgcgtacacagggatgcctaatcagaaaccaaag

SEQ ID NO: 73584 - DNA, 75 bp, Artificial Sequence
  Synthetic
agcacagtgaagactgaatatggcgagtttactatgctgggcatttacgacagatgggccgttttaccacgccac

SEQ ID NO: 73585 - DNA, 75 bp, Artificial Sequence
  Synthetic
agtttactatgctgggcatttacgacagatgggccgttttaccacgccacgcaaagccagggcccaccatcttga

SEQ ID NO: 73586 - DNA, 75 bp, Artificial Sequence
  Synthetic
tgctcaagttaaaccgaaatgagaagttcagagacatcagaggtttcctagccaaagaagaagtggaggtaaatg

SEQ ID NO: 73587 - DNA, 75 bp, Artificial Sequence
  Synthetic
gttcagagacatcagaggtttcctagccaaagaagaagtggaggtaaatgaggctgtgctggcaatcaacactag

SEQ ID NO: 73588 - DNA, 75 bp, Artificial Sequence
  Synthetic
caaaaggatgctcatgtacaatttccccacgagagcgggccagtgtggtggggtgctcatgtcaactggcaaagt

SEQ ID NO: 73589 - DNA, 75 bp, Artificial Sequence
  Synthetic
gatttaattccaattggcttaaccctaccatactcaccgaactagacaacggtgtggtaggggtaaattctccgc

SEQ ID NO: 73590 - DNA, 75 bp, Artificial Sequence
  Synthetic
cccacgagagcgggccagtgtggtggggtgctcatgtcaactggcaaagtcttagggatccacgttggtggtaat

SEQ ID NO: 73591 - DNA, 75 bp, Artificial Sequence
  Synthetic
agctcaaaggatgcggggtatccagtcataaacacaccaagcagaaccaagttggagcctagtgtcttccatcag

SEQ ID NO: 73592 - DNA, 75 bp, Artificial Sequence
  Synthetic
tcataaacacaccaagcagaaccaagttggagcctagtgtcttccatcaggtctttgaaggaagtaaagagccag

SEQ ID NO: 73593 - DNA, 75 bp, Artificial Sequence
  Synthetic
tcaatacacatgtggacgagtacatgctggaagccatcgaccattacgctggacagctggccacccttgatatca

SEQ ID NO: 73594 - DNA, 75 bp, Artificial Sequence
  Synthetic
ggacagctggccacccttgatatcagcactgagccaatgaagctagaggacgcagtgtacggcacggagggtttg

SEQ ID NO: 73595 - DNA, 75 bp, Artificial Sequence
  Synthetic
aaaaagaccagggacctaactaagttgaaagaatgcatggataagtatggcttgaaccttccaatggtgacctat

SEQ ID NO: 73596 - DNA, 75 bp, Artificial Sequence
  Synthetic
tgaaagaatgcatggataagtatggcttgaaccttccaatggtgacctatgtgaaggatgagcttagatcagctg

SEQ ID NO: 73597 - DNA, 75 bp, Artificial Sequence
  Synthetic
ttggtaacctgtacaaggctttccaccaaaacccagggattgtgactggtagcgcggttggttgcgacccggatc

SEQ ID NO: 73598 - DNA, 75 bp, Artificial Sequence
  Synthetic
gttttaaaaaccctcaaccttgttttagcacttaacgcagcaaaatgggagctcaagtgtcgactcagaaaaccg

SEQ ID NO: 73599 - DNA, 75 bp, Artificial Sequence
  Synthetic
ggacttcacgcaagatccagggaaattcacagaaccagtcaaggacattatggtaaaatcattgccggctctaaa

SEQ ID NO: 73600 - DNA, 75 bp, Artificial Sequence
  Synthetic
gttctggcaccagtatcttcaactcaatgatcaacaacatcataatcaggacactgatgttgaaagtatacaagg

SEQ ID NO: 73601 - DNA, 75 bp, Artificial Sequence
  Synthetic
ccaggaaagtgctaatgtagtcgttgggtacggggtgtggcctgattacctcagcgatgaggaagccactgcgga

SEQ ID NO: 73602 - DNA, 75 bp, Artificial Sequence
  Synthetic
acactgatgttgaaagtatacaagggcattgacttggaccaattcaggatgattgcttatggtgatgatgtgatc

SEQ ID NO: 73603 - DNA, 75 bp, Artificial Sequence
  Synthetic
gcagataagggagagtgttttaatgaagtcacctggacaaatgtcaccttcctgaaaaggtactttagagcagat

SEQ ID NO: 73604 - DNA, 75 bp, Artificial Sequence
  Synthetic
gcaatttgaaataatttaaattagctcaaccctactgcacttaccgaactagataatggtgtagtaggggtaaat

SEQ ID NO: 73605 - DNA, 75 bp, Artificial Sequence
  Synthetic
cacccacagggcccattgggcgctagcacactggtattacggtacctttgtgcgcctgttttatataccctcccc

SEQ ID NO: 73606 - DNA, 75 bp, Artificial Sequence
  Synthetic
ccgtaaccgttgcaccgatgtgtgctgagtacaatggtttgaggctggccggacaccaaggcttacctgtgatga

SEQ ID NO: 73607 - DNA, 75 bp, Artificial Sequence
  Synthetic
aagttgcgcagtgtttcgctccgcacgaccccggtgtagatcaggtcgatgagccaccgcgttccccacgggcga

SEQ ID NO: 73608 - DNA, 75 bp, Artificial Sequence
  Synthetic
cgaccccggtgtagatcaggtcgatgagccaccgcgttccccacgggcgaccgtggcggtggctgcgctggcggc

SEQ ID NO: 73609 - DNA, 75 bp, Artificial Sequence
  Synthetic
agtctattgagctaattggtagtcctccggcccctgaatgcggctaatcctaactgcggagcaggcaccctcaag

SEQ ID NO: 73610 - DNA, 75 bp, Artificial Sequence
  Synthetic
ttgggtgccgtgtttccttttattcttgaactggctgcttagggtgacattcgaaagattgttaccatatagcta

SEQ ID NO: 73611 - DNA, 75 bp, Artificial Sequence
  Synthetic
acactattaggtgagatcctcaactactatgcaaactggtcaggcagcataaagctaacgtttatgtactgtgga

SEQ ID NO: 73612 - DNA, 75 bp, Artificial Sequence
  Synthetic
catcacctgttggtatcaaactagcatagttgtgcccgcggaggtgcaaaatcaaagtgtcatactgtgctttgt

SEQ ID NO: 73613 - DNA, 75 bp, Artificial Sequence
  Synthetic
actttacgcaggacccgagcaaattcactgaaccagtcaaggatgtcatgatcaagtcacttcccgcactcaact

SEQ ID NO: 73614 - DNA, 75 bp, Artificial Sequence
  Synthetic
cgtctgctgcgtgattcacccttcgttcgccagacagcattctatcagaatgacgtgcagaacgcaatcgaccgt

SEQ ID NO: 73615 - DNA, 75 bp, Artificial Sequence
  Synthetic
caccaactgtggaggagtgcggatacagcgaccgcgtcagatctattacccttgggaactccacaataaccacac

SEQ ID NO: 73616 - DNA, 75 bp, Artificial Sequence
  Synthetic
tgtggaatacaaaacaagagacgataccccagacaaaatgtacgatagctgggttataaacactaggcaagtggc

SEQ ID NO: 73617 - DNA, 75 bp, Artificial Sequence
  Synthetic
ggccagaacatgcagtaccactacctgggtcgcgcagggtacaccatacatgtgcagtgtaatgcatccaaattc

SEQ ID NO: 73618 - DNA, 75 bp, Artificial Sequence
  Synthetic
accccagacaaaatgtacgatagctgggttataaacactaggcaagtggctcagttgcgcaggaagctagagttc

SEQ ID NO: 73619 - DNA, 75 bp, Artificial Sequence
  Synthetic
agataatgtatgtgccaccagggggccccattccacaagccgtggatgactacaactggcaaacctccacaaacc

SEQ ID NO: 73620 - DNA, 75 bp, Artificial Sequence
  Synthetic
agcacaaggtttaccaaccatgaacacaccagggagtacgcaatttctgacctcggacgacttccagtcaccgtg

SEQ ID NO: 73621 - DNA, 75 bp, Artificial Sequence
  Synthetic
gggtaattacaggttagtcaataggcacttagccacacacgatgattggcaaaactgtgtgtgggaggactacaa

SEQ ID NO: 73622 - DNA, 75 bp, Artificial Sequence
  Synthetic
gattagacagcgtgttcaagcacactctactgggggagatcttaaactactatgcacactggtcaggcagtatga

SEQ ID NO: 73623 - DNA, 75 bp, Artificial Sequence
  Synthetic
atacttctgtgcttcaaggaacaagcattatccagttagctttgaaggcccaggcctggttgaggtgcaagaaag

SEQ ID NO: 73624 - DNA, 75 bp, Artificial Sequence
  Synthetic
caggcctggttgaggtgcaagaaagtgagtactaccccaagagatatcaatcacatgtcttgcttgcggcagggt

SEQ ID NO: 73625 - DNA, 75 bp, Artificial Sequence
  Synthetic
tgagtactaccccaagagatatcaatcacatgtcttgcttgcggcagggttctcagaaccaggcgattgcggtgg

SEQ ID NO: 73626 - DNA, 75 bp, Artificial Sequence
  Synthetic
atagcgtattcaccaccaggcgcaaacccaccaaagacccgcaaggatgcaatgcttggaacgcatatcatatgg

SEQ ID NO: 73627 - DNA, 75 bp, Artificial Sequence
  Synthetic
ttttggatcaggattcaccaaccagatatgtgaacaggtcaatatccttaaagagtcactaataggacaagactc

SEQ ID NO: 73628 - DNA, 75 bp, Artificial Sequence
  Synthetic
cattctagagaaatccctcaaggctcttgtaaagatcatttcagcactggtgattgtggtgagaaatcatgatga

SEQ ID NO: 73629 - DNA, 75 bp, Artificial Sequence
  Synthetic
cgtggcgttggcttaaacagaaagtatcacagtattatgggatacccacggctgagcgtcaaaacaacgggtggc

SEQ ID NO: 73630 - DNA, 75 bp, Artificial Sequence
  Synthetic
ttatccaggctcaaacagcttcccctcttggaaagccaaattgctaccattgagcaaagtgcaccatcccagagc

SEQ ID NO: 73631 - DNA, 75 bp, Artificial Sequence
  Synthetic
gaggccaagagagtgttctccctcgaaaagaaaatgagcaattatatacagttcaagtccaaatgccgcattgaa

SEQ ID NO: 73632 - DNA, 75 bp, Artificial Sequence
  Synthetic
ctctggaggagaagggaatcctgttcacctctcctttcgtcctggcttcgaccaacgctggctccatcaacgctc

SEQ ID NO: 73633 - DNA, 75 bp, Artificial Sequence
  Synthetic
caacagggacattctcgtgagcaccacaacggcccatggttgcgacaccatcgccagatgtcaatgcacgacagg

SEQ ID NO: 73634 - DNA, 75 bp, Artificial Sequence
  Synthetic
caatcccatgtgctgcttgcagcagggttctcagaaccgggagactgtggaggaattctcaggtgcgaacatggt

SEQ ID NO: 73635 - DNA, 75 bp, Artificial Sequence
  Synthetic
cactgcagattgagaaacatgtgagcagggcctttatctgcctacaggcactcactacttttgtctccgtggcag

SEQ ID NO: 73636 - DNA, 75 bp, Artificial Sequence
  Synthetic
aggattatgtggaacaacttgggaacgcttttggctcgggatttactaatcaaatctgtgaacaggtcaatctcc

SEQ ID NO: 73637 - DNA, 75 bp, Artificial Sequence
  Synthetic
ggtgtctcagtattatgggatacccatggctgtacgccaaaacaacgggtggctcaagaagtttactgagatgac

SEQ ID NO: 73638 - DNA, 75 bp, Artificial Sequence
  Synthetic
cccagaagtgaaggaaaaacatgagttcctaaccaggctcaggcagctcccccttttggaaagtcaaattgctac

SEQ ID NO: 73639 - DNA, 75 bp, Artificial Sequence
  Synthetic
gcagaggctaaaagagtgttctccctcgagaagaaaatgagcaactatatacagttcaagtccaaatgccgtatt

SEQ ID NO: 73640 - DNA, 75 bp, Artificial Sequence
  Synthetic
tcgattacagtgggtatgatgccagtttgagtccggtgtggtttgcctgtttgaaactattattggagaagctgg

SEQ ID NO: 73641 - DNA, 75 bp, Artificial Sequence
  Synthetic
gcaatggacaccaagggttctcggcagccttgctacgccactatttcaacgatgagcagggtgagattgagttca

SEQ ID NO: 73642 - DNA, 75 bp, Artificial Sequence
  Synthetic
aaagcttaaagagtgcatggacaaatatgggttaaacctccccatggtcacctatgtgaaagatgaattgaggtc

SEQ ID NO: 73643 - DNA, 75 bp, Artificial Sequence
  Synthetic
aggatgatcgcatatggcgacgacgtcattgcttcatatccacatccaattgacgcctcactgctggctgaagct

SEQ ID NO: 73644 - DNA, 75 bp, Artificial Sequence
  Synthetic
actttcctgaagagatacttcagagcagatgagcaataccccttcctcgtacacccagtaatgccaatgaaggac

SEQ ID NO: 73645 - DNA, 75 bp, Artificial Sequence
  Synthetic
ggtgaggtgaagaatttaatggagatagcggaggtcgactcagtagtgccggtgcaaaatattggtgaaaaggtc

SEQ ID NO: 73646 - DNA, 75 bp, Artificial Sequence
  Synthetic
tggcacaatggagagaaagaatatgaggaatttatatccaaaatcagaagtgtcccagtcgggcgctgcctgact

SEQ ID NO: 73647 - DNA, 75 bp, Artificial Sequence
  Synthetic
ggtgccggcgccccgacgaagagggtagatgcaatgctcggcacacacgttgtatgggacgtgggcctgcaatct

SEQ ID NO: 73648 - DNA, 75 bp, Artificial Sequence
  Synthetic
tcaattggcttaaccctaccacacccaccgaactagacaacggtgtggtaggggtaaattctccgcattcggtgc

SEQ ID NO: 73649 - DNA, 75 bp, Artificial Sequence
  Synthetic
ctaacattgtggtccctgctgatgcacagagctcttgctatatcatgtgttttgtgtcagcgtgcaatgatttct

SEQ ID NO: 73650 - DNA, 75 bp, Artificial Sequence
  Synthetic
tccccacccgcagggcccactgggcgttagcactctggtatcacggtacccttgtgcgcctgttttatacatccc

SEQ ID NO: 73651 - DNA, 75 bp, Artificial Sequence
  Synthetic
acttctgttaccccggactgagtatcaataagctgctaacgcggctgaaggagaaaacgttcgttatccgaccaa

SEQ ID NO: 73652 - DNA, 75 bp, Artificial Sequence
  Synthetic
gagaaaacgttcgttatccgaccaactacttcgggaagcctagtaccaccatgaaagttgcgcagcgtttcgttc

SEQ ID NO: 73653 - DNA, 75 bp, Artificial Sequence
  Synthetic
tactttgggtgtccgtgtttctttttattcttacattggctgcttatggtgacaattacagaattgttaccatat

SEQ ID NO: 73654 - DNA, 75 bp, Artificial Sequence
  Synthetic
acgaattttacaacactaaactacattctattattaaactcagcaaaatgggcgcgcaagtctccacgcagaaga

SEQ ID NO: 73655 - DNA, 75 bp, Artificial Sequence
  Synthetic
ttctattattaaactcagcaaaatgggcgcgcaagtctccacgcagaagaccggtgctcatgagactgggttgaa

SEQ ID NO: 73656 - DNA, 75 bp, Artificial Sequence
  Synthetic
gcaggacttcacccaagacccaggaaagttcactgaaccagtaaaagacattatgatcaagtccatgcccgcgct

SEQ ID NO: 73657 - DNA, 75 bp, Artificial Sequence
  Synthetic
aagttcactgaaccagtaaaagacattatgatcaagtccatgcccgcgctgaactcaccatccgctgaagagtgt

SEQ ID NO: 73658 - DNA, 75 bp, Artificial Sequence
  Synthetic
gttggatatggagtgtggccagaatacttaaaagacagtgaagccactgcggaggaccaacccacgcaaccggac

SEQ ID NO: 73659 - DNA, 75 bp, Artificial Sequence
  Synthetic
acttaaaagacagtgaagccactgcggaggaccaacccacgcaaccggacgtggctacatgtcgtttctacacct

SEQ ID NO: 73660 - DNA, 75 bp, Artificial Sequence
  Synthetic
tatttgggcagaacatgcagtatcactacctcggtaggacagggtacaccatacacgtccaatgcaacgcctcca

SEQ ID NO: 73661 - DNA, 75 bp, Artificial Sequence
  Synthetic
ctacctcggtaggacagggtacaccatacacgtccaatgcaacgcctccaaattccaccaaggatgcctgctcgt

SEQ ID NO: 73662 - DNA, 75 bp, Artificial Sequence
  Synthetic
ggacagtgctaggttgttcactgacacccaggttggagagtccaatgaaaagaaagtccagacggcagtgtggaa

SEQ ID NO: 73663 - DNA, 75 bp, Artificial Sequence
  Synthetic
acccaggttggagagtccaatgaaaagaaagtccagacggcagtgtggaatgcaggaatgggcgtcggcgtcggt

SEQ ID NO: 73664 - DNA, 75 bp, Artificial Sequence
  Synthetic
aacagtgtgccgatggataacatgtttaggcataataacctgacattgatgataattccatttgtaccacttaac

SEQ ID NO: 73665 - DNA, 75 bp, Artificial Sequence
  Synthetic
ttaggcataataacctgacattgatgataattccatttgtaccacttaactacagtgaaggatcgtcaccgtacg

SEQ ID NO: 73666 - DNA, 75 bp, Artificial Sequence
  Synthetic
ccgtcatgacaacaccagggagcacacagttcctgacttcggacgatttccagtcaccatcggcaatgccgcaat

SEQ ID NO: 73667 - DNA, 75 bp, Artificial Sequence
  Synthetic
aaatccagacttattgaagcatctagcctgaatgactctgtcgcaatgagacaaacatttggtaacttatacaag

SEQ ID NO: 73668 - DNA, 75 bp, Artificial Sequence
  Synthetic
acagttcctgacttcggacgatttccagtcaccatcggcaatgccgcaatttgatgtcacgccagagatgcaaat

SEQ ID NO: 73669 - DNA, 75 bp, Artificial Sequence
  Synthetic
tataaacagcctcaaggcatatcaaatcccagtgcagtcaaacagtgacaacgggaagcaggtttttgggttccc

SEQ ID NO: 73670 - DNA, 75 bp, Artificial Sequence
  Synthetic
atcccagtgcagtcaaacagtgacaacgggaagcaggtttttgggttcccgctgcagccaggtgccaacagtgtc

SEQ ID NO: 73671 - DNA, 75 bp, Artificial Sequence
  Synthetic
ttctgtgggtctgcaatggccacagggaaattcctactagcgtactcaccgcctggggcgggggttcctaagaac

SEQ ID NO: 73672 - DNA, 75 bp, Artificial Sequence
  Synthetic
ggaaattcctactagcgtactcaccgcctggggcgggggttcctaagaacaggaaagaagcaatgctgggtaccc

SEQ ID NO: 73673 - DNA, 75 bp, Artificial Sequence
  Synthetic
acgtggtggaagatgagtatacagcagctggatatgtcacctgctggtatcagaccaacattgttgtcccagcgg

SEQ ID NO: 73674 - DNA, 75 bp, Artificial Sequence
  Synthetic
agctggatatgtcacctgctggtatcagaccaacattgttgtcccagcggacgtacaaagttcatgcgacgtcct

SEQ ID NO: 73675 - DNA, 75 bp, Artificial Sequence
  Synthetic
ctaccagggtccagtggaagagtctgtagagcgtgcagtggcccgtgtggccgatactgtgagctcacggcccac

SEQ ID NO: 73676 - DNA, 75 bp, Artificial Sequence
  Synthetic
gcttggcacaatggagaacatgagtatgaggaattcattaagaagatcagaagtgtcccagtgggacgctgtctg

SEQ ID NO: 73677 - DNA, 75 bp, Artificial Sequence
  Synthetic
gtagagcgtgcagtggcccgtgtggccgatactgtgagctcacggcccacaaattcggaatccattcctgctctt

SEQ ID NO: 73678 - DNA, 75 bp, Artificial Sequence
  Synthetic
cattcaagatcggagtcttccgttgagaattttctgtgtcgatctgcttgtgtgtactacgcctcctacacaaac

SEQ ID NO: 73679 - DNA, 75 bp, Artificial Sequence
  Synthetic
agaattttctgtgtcgatctgcttgtgtgtactacgcctcctacacaaacaactcaaagaagggatacgcggaat

SEQ ID NO: 73680 - DNA, 75 bp, Artificial Sequence
  Synthetic
aactaacatttgtgataacgagtgcccaacagcccagcactgccaccagtgtggatgcacccgtccaaacccacc

SEQ ID NO: 73681 - DNA, 75 bp, Artificial Sequence
  Synthetic
ccaacagcccagcactgccaccagtgtggatgcacccgtccaaacccaccaaattatgtatgtacccccaggtgg

SEQ ID NO: 73682 - DNA, 75 bp, Artificial Sequence
  Synthetic
tgccccaccgcgcatgtccattccattcattagcatcggtaacgcttacagttgcttttatgacggatggacaca

SEQ ID NO: 73683 - DNA, 75 bp, Artificial Sequence
  Synthetic
ttcattagcatcggtaacgcttacagttgcttttatgacggatggacacaattctcaaggaatggagtctacggg

SEQ ID NO: 73684 - DNA, 75 bp, Artificial Sequence
  Synthetic
actgtgagagtttactttaaacccaagcacgttaaggcgtgggtgcctagaccacctaggttatgtcagtatgag

SEQ ID NO: 73685 - DNA, 75 bp, Artificial Sequence
  Synthetic
agcacgttaaggcgtgggtgcctagaccacctaggttatgtcagtatgagaaacagaaaaacgttaacttcaccc

SEQ ID NO: 73686 - DNA, 75 bp, Artificial Sequence
  Synthetic
taggcaattatagggtggtcaacaggcatctcgctacgcacaccgattggctaaactgcgtgtgggaagactaca

SEQ ID NO: 73687 - DNA, 75 bp, Artificial Sequence
  Synthetic
gcatctcgctacgcacaccgattggctaaactgcgtgtgggaagactacaacagggacctactagtcagcactac

SEQ ID NO: 73688 - DNA, 75 bp, Artificial Sequence
  Synthetic
gcattacccagtgtcttttgagggaccaggtcttgtggaagtccaagaaagtgaatactatcccaagagatacca

SEQ ID NO: 73689 - DNA, 75 bp, Artificial Sequence
  Synthetic
ccaggtcttgtggaagtccaagaaagtgaatactatcccaagagataccaatcccacgtgctcctcgctgcaggg

SEQ ID NO: 73690 - DNA, 75 bp, Artificial Sequence
  Synthetic
gagggagttgttggctttgctgacatacgcgacctcctgtggctggaagacgacgccatggagcaaggagtgaag

SEQ ID NO: 73691 - DNA, 75 bp, Artificial Sequence
  Synthetic
tacgcgacctcctgtggctggaagacgacgccatggagcaaggagtgaaggactacgtggagcaattgggaaatg

SEQ ID NO: 73692 - DNA, 75 bp, Artificial Sequence
  Synthetic
ccattttggagaaatccctcaaggcactggtaaagattatctcagctctcgtgattgtggtgagaaaccatgatg

SEQ ID NO: 73693 - DNA, 75 bp, Artificial Sequence
  Synthetic
actggtaaagattatctcagctctcgtgattgtggtgagaaaccatgatgatttgattactgtaaccgccaccct

SEQ ID NO: 73694 - DNA, 75 bp, Artificial Sequence
  Synthetic
ggccgaacgccaaaacaacgggtggcttaagaaattcacagaaatgacaaatgcttgcaaagggatggagtggat

SEQ ID NO: 73695 - DNA, 75 bp, Artificial Sequence
  Synthetic
cctcaacaggctcaaacagctccctcttttagaaagtcaaattgccaccattgaacaaagtgcaccctcccaaag

SEQ ID NO: 73696 - DNA, 75 bp, Artificial Sequence
  Synthetic
tgaggcaaaaagagtgttttcccttgagaagaagatgagcaattacatacagttcaagtccaaatgccgtattga

SEQ ID NO: 73697 - DNA, 75 bp, Artificial Sequence
  Synthetic
tactcactacctccagacccagatcacttcgacggctacaaacaacaggccgtggtgattatggatgacctgtgc

SEQ ID NO: 73698 - DNA, 75 bp, Artificial Sequence
  Synthetic
gccttagaagagaaaggcattttgttcacatctccgttcgttttggcatcaactaatgcagggtccataaatgct

SEQ ID NO: 73699 - DNA, 75 bp, Artificial Sequence
  Synthetic
gaacatcgaggttatctccatgtacagccaaaacggcaaaataaatatgccgatgtcagtgaagacgtgtgatga

SEQ ID NO: 73700 - DNA, 75 bp, Artificial Sequence
  Synthetic
cgatgtcagtgaagacgtgtgatgaagagtgttgtccagtcaactttaagaaatgctgtcccctagtgtgtggaa

SEQ ID NO: 73701 - DNA, 75 bp, Artificial Sequence
  Synthetic
accaccacctgccatcgcggatctgctcaagtcggtggacagtgaggctgtgagagagtactgcaaagaaaaggg

SEQ ID NO: 73702 - DNA, 75 bp, Artificial Sequence
  Synthetic
ctcaagtcggtggacagtgaggctgtgagagagtactgcaaagaaaagggatggttggttcctgaggtcaactcc

SEQ ID NO: 73703 - DNA, 75 bp, Artificial Sequence
  Synthetic
gggatcatctatataatatacaagctatttgctggctttcaaggcgcatatacaggattgcccaaccagaagccc

SEQ ID NO: 73704 - DNA, 75 bp, Artificial Sequence
  Synthetic
tatttgctggctttcaaggcgcatatacaggattgcccaaccagaagcccaaggtacccacccttaggcaagcaa

SEQ ID NO: 73705 - DNA, 75 bp, Artificial Sequence
  Synthetic
gtgaatttaccatgctgggcatctatgataggtgggccgtcttaccacgccacgccaaacctgggccaaccatcc

SEQ ID NO: 73706 - DNA, 75 bp, Artificial Sequence
  Synthetic
cacgccaaacctgggccaaccatcctgatgaatgaccagaaggtaggcgtgttggacgctaaagagttggtggat

SEQ ID NO: 73707 - DNA, 75 bp, Artificial Sequence
  Synthetic
ttagccaaggaggaggtggaagtcaacgaggccgtgctagcaattaacaccagcaaattccccaacatgtacatc

SEQ ID NO: 73708 - DNA, 75 bp, Artificial Sequence
  Synthetic
acgaggccgtgctagcaattaacaccagcaaattccccaacatgtacatcccagtgggacaggtcacggattacg

SEQ ID NO: 73709 - DNA, 75 bp, Artificial Sequence
  Synthetic
gtggggtgcttatgtccactggtaaagtcttaggaattcatgttggtggaaatggtcatcaaggcttctcggctg

SEQ ID NO: 73710 - DNA, 75 bp, Artificial Sequence
  Synthetic
agtcttaggaattcatgttggtggaaatggtcatcaaggcttctcggctgcacttctcaaacactatttcaatga

SEQ ID NO: 73711 - DNA, 75 bp, Artificial Sequence
  Synthetic
taaactggaaccaagcgtctttcaccaggtttttgaaggaaataaagagccagcagtccttagaaatggtgatcc

SEQ ID NO: 73712 - DNA, 75 bp, Artificial Sequence
  Synthetic
caggtttttgaaggaaataaagagccagcagtccttagaaatggtgatccacgcctcaaagccaacttcgaggag

SEQ ID NO: 73713 - DNA, 75 bp, Artificial Sequence
  Synthetic
gctggtcaattggccaccctagacatcagcaccgaaccaatgaaattggaggacgctgtatacggtactgaaggc

SEQ ID NO: 73714 - DNA, 75 bp, Artificial Sequence
  Synthetic
tcagcaccgaaccaatgaaattggaggacgctgtatacggtactgaaggccttgaagcgcttgatttaacaacga

SEQ ID NO: 73715 - DNA, 75 bp, Artificial Sequence
  Synthetic
agttgaaggaatgcatggacaagtacggtctaaacctaccaatggtgacttacgtgaaggatgaactcagatctg

SEQ ID NO: 73716 - DNA, 75 bp, Artificial Sequence
  Synthetic
cggtctaaacctaccaatggtgacttacgtgaaggatgaactcagatctgcagagaaggtggcaaaagggaagtc

SEQ ID NO: 73717 - DNA, 75 bp, Artificial Sequence
  Synthetic
ccatctgaacccaggggttgtaaccggtagtgctgtcggatgtgatccggatctcttttggagcaagataccagt

SEQ ID NO: 73718 - DNA, 75 bp, Artificial Sequence
  Synthetic
ggtagtgctgtcggatgtgatccggatctcttttggagcaagataccagtgatgttagacggacacctcatagcc

SEQ ID NO: 73719 - DNA, 75 bp, Artificial Sequence
  Synthetic
ggatactcgcgcaaggaaaccaattacattgattatttgtgtaactcccatcatctatacagggataaacactac

SEQ ID NO: 73720 - DNA, 75 bp, Artificial Sequence
  Synthetic
acattgattatttgtgtaactcccatcatctatacagggataaacactactttgtgcggggtggcatgccctcag

SEQ ID NO: 73721 - DNA, 75 bp, Artificial Sequence
  Synthetic
aagggattgacttggatcgatttaggatgatcgcatatggtgatgatgtgatcgcatcatacccatggcccatag

SEQ ID NO: 73722 - DNA, 75 bp, Artificial Sequence
  Synthetic
gatgatcgcatatggtgatgatgtgatcgcatcatacccatggcccatagatgcatccttacttgctgaagctgg

SEQ ID NO: 73723 - DNA, 75 bp, Artificial Sequence
  Synthetic
attcctgaagaggtactttagagcagatgagcaataccccttcttggtgcaccccgtcatgcccatgaaagacat

SEQ ID NO: 73724 - DNA, 75 bp, Artificial Sequence
  Synthetic
gcacaacggagagcacgagtatgaggagtttatccgcaaaatcaggagcgtcccagttggacgatgcttgaccct

SEQ ID NO: 73725 - DNA, 75 bp, Artificial Sequence
  Synthetic
cccacccacagggcccactgggcgctagcacactggtatcacggtacctttgtgcgcctgttttatccgcccccc

SEQ ID NO: 73726 - DNA, 75 bp, Artificial Sequence
  Synthetic
cacaaccccagtgtagatcaggtcgatgagtcaccgctttccccacgggcgaccgtggcggtggctgcgttggcg

SEQ ID NO: 73727 - DNA, 75 bp, Artificial Sequence
  Synthetic
cctccggcccctgaatgcggctaatcctaactgcggagcagatactcacaagccagtgagctgtctgtcgtaacg

SEQ ID NO: 73728 - DNA, 75 bp, Artificial Sequence
  Synthetic
acaattgaaaaattgttaccgtatagctattggattggccatccagtgacaaatagagcaataatttatttgttc

SEQ ID NO: 73729 - DNA, 75 bp, Artificial Sequence
  Synthetic
gctattggattggccatccagtgacaaatagagcaataatttatttgttcattggctttgtaccattaaaccata

SEQ ID NO: 73730 - DNA, 75 bp, Artificial Sequence
  Synthetic
tggggcccatgagaccgggttaaacgctagtggcaactccgtcatccactacaccaacattaactactataagga

SEQ ID NO: 73731 - DNA, 75 bp, Artificial Sequence
  Synthetic
gctagtggcaactccgtcatccactacaccaacattaactactataaggatgcggcatcaaactcagcaaacagg

SEQ ID NO: 73732 - DNA, 75 bp, Artificial Sequence
  Synthetic
aactcaccaagagctgaggaatgcggttatagtgacagggtcagatcaatcaccttgggcaactcaaccatcacg

SEQ ID NO: 73733 - DNA, 75 bp, Artificial Sequence
  Synthetic
gttatagtgacagggtcagatcaatcaccttgggcaactcaaccatcacgactcaagagtgcgcaaacgtagtag

SEQ ID NO: 73734 - DNA, 75 bp, Artificial Sequence
  Synthetic
tggcaacgtgccgtttctacaccttggattctgtgtcatggcaaaaatcgtctgacgggtggtggtggaagtttc

SEQ ID NO: 73735 - DNA, 75 bp, Artificial Sequence
  Synthetic
ggattctgtgtcatggcaaaaatcgtctgacgggtggtggtggaagtttccaaatgccttaaaggatatgggctt

SEQ ID NO: 73736 - DNA, 75 bp, Artificial Sequence
  Synthetic
gtttcatcaagggtgtttgcttgtagtgtgtgtgcctgaagcggaaatgggctgtgcaactgttggaaacaccct

SEQ ID NO: 73737 - DNA, 75 bp, Artificial Sequence
  Synthetic
gtgtgtgtgcctgaagcggaaatgggctgtgcaactgttggaaacaccctgaatgccaccgccctttgcaatggt

SEQ ID NO: 73738 - DNA, 75 bp, Artificial Sequence
  Synthetic
atgggggtcgccacaggcaacttgaccatattcccacaccagtggatcaacttgcgcaccaacaatagcgccact

SEQ ID NO: 73739 - DNA, 75 bp, Artificial Sequence
  Synthetic
ccatattcccacaccagtggatcaacttgcgcaccaacaatagcgccactatagtgatgccatacatcaatagtg

SEQ ID NO: 73740 - DNA, 75 bp, Artificial Sequence
  Synthetic
tcggggcatcctcgtacgtgcccatcacagtcaccatagccccaatgagtgcagagtacaatggtctcagactag

SEQ ID NO: 73741 - DNA, 75 bp, Artificial Sequence
  Synthetic
cacagtcaccatagccccaatgagtgcagagtacaatggtctcagactagctggaccacagggcctgccaactat

SEQ ID NO: 73742 - DNA, 75 bp, Artificial Sequence
  Synthetic
aacccctgagatgcatatacccggcgaggtaaaaaacttgatggagattgctgaggttgactctgtgatacctat

SEQ ID NO: 73743 - DNA, 75 bp, Artificial Sequence
  Synthetic
gaggtaaaaaacttgatggagattgctgaggttgactctgtgatacctatcaacaatttgcaaaataccgtgaat

SEQ ID NO: 73744 - DNA, 75 bp, Artificial Sequence
  Synthetic
ccgggagctagctcagtttttaaacgcacactcctaggggaaattttgaattattacacccactggtccggaagc

SEQ ID NO: 73745 - DNA, 75 bp, Artificial Sequence
  Synthetic
gcacactcctaggggaaattttgaattattacacccactggtccggaagcatcaaactcacattcgtcttctgtg

SEQ ID NO: 73746 - DNA, 75 bp, Artificial Sequence
  Synthetic
gcgctatgttaggcacacacgtgatctgggatgtcggtctgcaatccagctgtgttttgtgcgtaccatggataa

SEQ ID NO: 73747 - DNA, 75 bp, Artificial Sequence
  Synthetic
ctgggatgtcggtctgcaatccagctgtgttttgtgcgtaccatggataagtcagacacactacaggtttgttgc

SEQ ID NO: 73748 - DNA, 75 bp, Artificial Sequence
  Synthetic
aagtgcatgctacatccttggctttgtgtcagcttgcaatgatttttctgtccgcctgttgaaggacacaccatt

SEQ ID NO: 73749 - DNA, 75 bp, Artificial Sequence
  Synthetic
gtgtcagcttgcaatgatttttctgtccgcctgttgaaggacacaccattcataagccagcaaaacttctatcaa

SEQ ID NO: 73750 - DNA, 75 bp, Artificial Sequence
  Synthetic
acgttcgttacccggccaattacttcgagaaacctagtagcaccatggaggttgcgcggcgtttcgctccacaca

SEQ ID NO: 73751 - DNA, 75 bp, Artificial Sequence
  Synthetic
gagagtgtaccggcgttaacagctgttgagactggacacacgtcacaggtggtacctggggataccatgcagacc

SEQ ID NO: 73752 - DNA, 75 bp, Artificial Sequence
  Synthetic
ttgagactggacacacgtcacaggtggtacctggggataccatgcagaccagacacgttaaaaacttccacactc

SEQ ID NO: 73753 - DNA, 75 bp, Artificial Sequence
  Synthetic
accaagaggataaaaaatatgcctcttggaccataaatacacgacaggtggctcagttaaggaggaaaatagaat

SEQ ID NO: 73754 - DNA, 75 bp, Artificial Sequence
  Synthetic
ttggaccataaatacacgacaggtggctcagttaaggaggaaaatagaattgttcacttataccagatttgatgt

SEQ ID NO: 73755 - DNA, 75 bp, Artificial Sequence
  Synthetic
ttatactggctgcttatggtgacaattgaaagattgttaccatatagctattggattggccatccagtgacaaac

SEQ ID NO: 73756 - DNA, 75 bp, Artificial Sequence
  Synthetic
ccagattatgtatgtgccaccgggaggtccagtacccaatagtgccactgattactgctggcaatcctccaccaa

SEQ ID NO: 73757 - DNA, 75 bp, Artificial Sequence
  Synthetic
ggtccagtacccaatagtgccactgattactgctggcaatcctccaccaatcccagtatattctggacggagggt

SEQ ID NO: 73758 - DNA, 75 bp, Artificial Sequence
  Synthetic
ttgaaagattgttaccatatagctattggattggccatccagtgacaaacagagcgattgtttacctgttcattg

SEQ ID NO: 73759 - DNA, 75 bp, Artificial Sequence
  Synthetic
tcaagtgtcgacacaaaagactggggcgcatgagactggcctaaatgccagcggaaattccatcattcactacac

SEQ ID NO: 73760 - DNA, 75 bp, Artificial Sequence
  Synthetic
cacttcacacaaaacggtgtttatgggttcaatacgctaaacaatatgggaagactatacttcagacatgtaaac

SEQ ID NO: 73761 - DNA, 75 bp, Artificial Sequence
  Synthetic
ggttcaatacgctaaacaatatgggaagactatacttcagacatgtaaacgacaacaccgtggggccgtatgtca

SEQ ID NO: 73762 - DNA, 75 bp, Artificial Sequence
  Synthetic
gcgcatgagactggcctaaatgccagcggaaattccatcattcactacacaaacatcaattactacaaggacgcc

SEQ ID NO: 73763 - DNA, 75 bp, Artificial Sequence
  Synthetic
ataaaatcccttcctgcattgaactctccatctgctgaggaatgtgggtacagcgatagggttagatctatcact

SEQ ID NO: 73764 - DNA, 75 bp, Artificial Sequence
  Synthetic
acaaccgagccaacataaattttgaaccaaaaggagtcaccgacgctaggtctagcattacggccaccaccgaca

SEQ ID NO: 73765 - DNA, 75 bp, Artificial Sequence
  Synthetic
accaaaaggagtcaccgacgctaggtctagcattacggccaccaccgacaccattggtgaaagcagggcaatgca

SEQ ID NO: 73766 - DNA, 75 bp, Artificial Sequence
  Synthetic
ctccatctgctgaggaatgtgggtacagcgatagggttagatctatcactttgggtaactccacaattaccactc

SEQ ID NO: 73767 - DNA, 75 bp, Artificial Sequence
  Synthetic
accagcctacacagccagatgtagccacctgtaggttctataccatggaatcagtaaactgggagtccaactcat

SEQ ID NO: 73768 - DNA, 75 bp, Artificial Sequence
  Synthetic
cacccacgcagattggcaaaactgcgtgtgggaagactacaacagagacattcttgtgagcacgaccacagcaca

SEQ ID NO: 73769 - DNA, 75 bp, Artificial Sequence
  Synthetic
gtgtgggaagactacaacagagacattcttgtgagcacgaccacagcacaagggtgcgacatcattgccaggtgc

SEQ ID NO: 73770 - DNA, 75 bp, Artificial Sequence
  Synthetic
cacctgtaggttctataccatggaatcagtaaactgggagtccaactcatacggatggtggtggaaattccccga

SEQ ID NO: 73771 - DNA, 75 bp, Artificial Sequence
  Synthetic
cgtgcagtgtaatgcctcgaagttccatcagggatgcctgcttgtggtgtgtgtacctgaagctgaaatgggaag

SEQ ID NO: 73772 - DNA, 75 bp, Artificial Sequence
  Synthetic
gtggaggtccaagagagcgaatactacccaaagagataccaatcccacgtactgttagctgcagggttctctgaa

SEQ ID NO: 73773 - DNA, 75 bp, Artificial Sequence
  Synthetic
acccaaagagataccaatcccacgtactgttagctgcagggttctctgaaccaggggactgtggtggaattctta

SEQ ID NO: 73774 - DNA, 75 bp, Artificial Sequence
  Synthetic
catcagggatgcctgcttgtggtgtgtgtacctgaagctgaaatgggaagtgctgatgtcaccaccgtactgaac

SEQ ID NO: 73775 - DNA, 75 bp, Artificial Sequence
  Synthetic
aatgcggtatggaatgctggaatgggagtcggagtaggaaacctgacaatatacccacaccagtggatcaacttg

SEQ ID NO: 73776 - DNA, 75 bp, Artificial Sequence
  Synthetic
tgctgtggttggaagatgatgcaatggagcaaggggtcaaagaatatgtggagcagttaggcaatgctttcggct

SEQ ID NO: 73777 - DNA, 75 bp, Artificial Sequence
  Synthetic
ggagcaaggggtcaaagaatatgtggagcagttaggcaatgctttcggctccgggttcactaatcaaatctgtga

SEQ ID NO: 73778 - DNA, 75 bp, Artificial Sequence
  Synthetic
gagtcggagtaggaaacctgacaatatacccacaccagtggatcaacttgcgcacaaacaatagtgcgactatag

SEQ ID NO: 73779 - DNA, 75 bp, Artificial Sequence
  Synthetic
ttgttccacttacagtaaacgcagcggcatccaaccaggttcctatcacagttactgtagccccaatgtgtgctg

SEQ ID NO: 73780 - DNA, 75 bp, Artificial Sequence
  Synthetic
aatcatttcagcattagtaattgtggtgagaaatcatgatgacctaataacagtgactgccactctagccttagt

SEQ ID NO: 73781 - DNA, 75 bp, Artificial Sequence
  Synthetic
gtgagaaatcatgatgacctaataacagtgactgccactctagccttagttggctgtacctcgtcaccatggcgc

SEQ ID NO: 73782 - DNA, 75 bp, Artificial Sequence
  Synthetic
ggcatccaaccaggttcctatcacagttactgtagccccaatgtgtgctgagtacaacgggcttagaatggcagc

SEQ ID NO: 73783 - DNA, 75 bp, Artificial Sequence
  Synthetic
cgcaatgccacagttcgacgtaacgccaatgatgcacattcctggagaggtgaaaaaccttatggaaatagcaga

SEQ ID NO: 73784 - DNA, 75 bp, Artificial Sequence
  Synthetic
ttcacggagatgactaacgcctgcaaggggatggagtggattgctattaagattcaaaagttcatagagtggctc

SEQ ID NO: 73785 - DNA, 75 bp, Artificial Sequence
  Synthetic
aggggatggagtggattgctattaagattcaaaagttcatagagtggctcaagattaaaatcttaccagaggtga

SEQ ID NO: 73786 - DNA, 75 bp, Artificial Sequence
  Synthetic
ccaatgatgcacattcctggagaggtgaaaaaccttatggaaatagcagaagttgactcacttgtaccagtgaac

SEQ ID NO: 73787 - DNA, 75 bp, Artificial Sequence
  Synthetic
gccatatttgccttccaactcgacccgggcagtggatcagttctcaaacgcacactattgggagaaatactaaac

SEQ ID NO: 73788 - DNA, 75 bp, Artificial Sequence
  Synthetic
gcgcaccgtcccagggcgaccaggaacaactattttcaaatatccagtatttcgcccattattgcaggaagtacg

SEQ ID NO: 73789 - DNA, 75 bp, Artificial Sequence
  Synthetic
acaactattttcaaatatccagtatttcgcccattattgcaggaagtacgcccctctgtacgctgctgaagctaa

SEQ ID NO: 73790 - DNA, 75 bp, Artificial Sequence
  Synthetic
cgggcagtggatcagttctcaaacgcacactattgggagaaatactaaactactacgctcactggtctggcagtt

SEQ ID NO: 73791 - DNA, 75 bp, Artificial Sequence
  Synthetic
ctagtgtcccaggaaacaggaaggatgctatgcttggcacacacattatatgggatgttggcctacaatccagtt

SEQ ID NO: 73792 - DNA, 75 bp, Artificial Sequence
  Synthetic
tttgctcctacacgggagccccggagctggtaaatcagtcgccaccaatctaattggacgctcgttagctgagaa

SEQ ID NO: 73793 - DNA, 75 bp, Artificial Sequence
  Synthetic
gctggtaaatcagtcgccaccaatctaattggacgctcgttagctgagaagctcaatagttcagtatactcgcta

SEQ ID NO: 73794 - DNA, 75 bp, Artificial Sequence
  Synthetic
tgctatgcttggcacacacattatatgggatgttggcctacaatccagttgtgttctgtgtgtgccttggatcag

SEQ ID NO: 73795 - DNA, 75 bp, Artificial Sequence
  Synthetic
tatcgtcgttccccctgggacacccaccgagtgtaaaatactctgctttgtatcagcatgtaatgatttttctgt

SEQ ID NO: 73796 - DNA, 75 bp, Artificial Sequence
  Synthetic
gatggtaaggacgtgtccttgttctgtcaaatggtgtcgagtgtagactttgtaccaccaatggccgcgctagaa

SEQ ID NO: 73797 - DNA, 75 bp, Artificial Sequence
  Synthetic
accgagtgtaaaatactctgctttgtatcagcatgtaatgatttttctgtgcgtctactgaaagacactcccttc

SEQ ID NO: 73798 - DNA, 75 bp, Artificial Sequence
  Synthetic
ccttcgtcctggcttcgactaacgctggttatattaatgctcggacagtttcagatagcagggccttagctagga

SEQ ID NO: 73799 - DNA, 75 bp, Artificial Sequence
  Synthetic
tctgagcaggtacccgccttaactgctgccgagactgggcacacatcacaggtggaacctagtgatacagtccaa

SEQ ID NO: 73800 - DNA, 75 bp, Artificial Sequence
  Synthetic
ctgccgagactgggcacacatcacaggtggaacctagtgatacagtccaaaccagacacgtgaggaacatgcact

SEQ ID NO: 73801 - DNA, 75 bp, Artificial Sequence
  Synthetic
agaacgttgaggctcacgacacgtacgctagttgggatatctcagtaagagatatggtgcaattgcgcaggaagt

SEQ ID NO: 73802 - DNA, 75 bp, Artificial Sequence
  Synthetic
cgctagttgggatatctcagtaagagatatggtgcaattgcgcaggaagtgcgagatgttcacctacctccgctt

SEQ ID NO: 73803 - DNA, 75 bp, Artificial Sequence
  Synthetic
acaggcacagtgtgggggcaacactcgaggcacttttccaaggcccacccgtgtacagagagatcaaaattagtg

SEQ ID NO: 73804 - DNA, 75 bp, Artificial Sequence
  Synthetic
aacacaccagatcatgtatgtaccacccgggggcccagttcctgcaagtgctgacagttatgcatggcaaacgtc

SEQ ID NO: 73805 - DNA, 75 bp, Artificial Sequence
  Synthetic
cccgggggcccagttcctgcaagtgctgacagttatgcatggcaaacgtcaaccaaccccagcatcttttggaca

SEQ ID NO: 73806 - DNA, 75 bp, Artificial Sequence
  Synthetic
tggtcaaacttcaaccataccggggtttatgggtacaacacactaaaccacatgggtagactatatgttagacat

SEQ ID NO: 73807 - DNA, 75 bp, Artificial Sequence
  Synthetic
tttatgggtacaacacactaaaccacatgggtagactatatgttagacatgtcaataaacacagccccaacacta

SEQ ID NO: 73808 - DNA, 75 bp, Artificial Sequence
  Synthetic
gaccagcttttgagtttgcagtggccatgatgaagagaaacgccagtactgtaaaaaccgagtacggcgagttca

SEQ ID NO: 73809 - DNA, 75 bp, Artificial Sequence
  Synthetic
catacaaaaacaaaactaatgtgaactttgagaccgcgccagtgactgaaactaggggaaaaattacccactcac

SEQ ID NO: 73810 - DNA, 75 bp, Artificial Sequence
  Synthetic
ctttgagaccgcgccagtgactgaaactaggggaaaaattacccactcacacctcaccaactatggcgcctttgg

SEQ ID NO: 73811 - DNA, 75 bp, Artificial Sequence
  Synthetic
aaattgcgtgtgggaagattacagtagagaccttctcgtgagtacaacaactgctcacgggtgtgacaccatagc

SEQ ID NO: 73812 - DNA, 75 bp, Artificial Sequence
  Synthetic
agagaccttctcgtgagtacaacaactgctcacgggtgtgacaccatagccaggtgccagtgcacaacgggcgtg

SEQ ID NO: 73813 - DNA, 75 bp, Artificial Sequence
  Synthetic
acctgggtggtacccccaccaagcgcatgttgatgtacaactttccaacacgcgcaggtcaatgtggaggtgttc

SEQ ID NO: 73814 - DNA, 75 bp, Artificial Sequence
  Synthetic
gagtattaccccaagaggtaccagtcacatgtactacttgcagtaggtttttcagaaccaggagattgtggtggg

SEQ ID NO: 73815 - DNA, 75 bp, Artificial Sequence
  Synthetic
cacatgtactacttgcagtaggtttttcagaaccaggagattgtggtgggatcctcaggtgtgaacatggtgtga

SEQ ID NO: 73816 - DNA, 75 bp, Artificial Sequence
  Synthetic
tgagattgagttcatcgagagttccaaggaagcaggcttcccggtcattaacacgcccagcaaaacaaagctcga

SEQ ID NO: 73817 - DNA, 75 bp, Artificial Sequence
  Synthetic
atgctatggaacagggagtgagggattatgtcgaacaacttggcaacgcctttgggtcagggttcaccaaccaga

SEQ ID NO: 73818 - DNA, 75 bp, Artificial Sequence
  Synthetic
ttatgtcgaacaacttggcaacgcctttgggtcagggttcaccaaccagatatgtgaacaggtcaacctccttaa

SEQ ID NO: 73819 - DNA, 75 bp, Artificial Sequence
  Synthetic
gaagggaataaggagccagcagtgttgaggaacggagaccccaggctgaaggtcaactttgaggaggccatcttt

SEQ ID NO: 73820 - DNA, 75 bp, Artificial Sequence
  Synthetic
gattgtggttagaaaccatgatgacttaataacggtaactgccacccttgccctcatcggctgtacctcatcacc

SEQ ID NO: 73821 - DNA, 75 bp, Artificial Sequence
  Synthetic
ttaataacggtaactgccacccttgccctcatcggctgtacctcatcaccgtggcgatggcttaagcggaaggta

SEQ ID NO: 73822 - DNA, 75 bp, Artificial Sequence
  Synthetic
gcttgtaaagggatggagtggattgccgtcaaaatccaaaaattcatagagtggctcaaagttaaaattctacca

SEQ ID NO: 73823 - DNA, 75 bp, Artificial Sequence
  Synthetic
tggctaaaggcaaatccaggctgattgaggcgtccagcttgaacgactcagtggcaatgagacagactttcggca

SEQ ID NO: 73824 - DNA, 75 bp, Artificial Sequence
  Synthetic
gctggaaagccaaattgccactattgagcaaagcgcaccatctcagagcgaccaggaacaacttttctcaaatgt

SEQ ID NO: 73825 - DNA, 75 bp, Artificial Sequence
  Synthetic
gaagaaaatgagcaattacatacagttcaagtccaaatgccgtattgaaccagtatgtttgcttttgcatgggag

SEQ ID NO: 73826 - DNA, 75 bp, Artificial Sequence
  Synthetic
ttcaagtccaaatgccgtattgaaccagtatgtttgcttttgcatgggagccctggcgccggaaagtcggttgcc

SEQ ID NO: 73827 - DNA, 75 bp, Artificial Sequence
  Synthetic
tttgatggttataaacaacaagccgtcgtgatcatggatgatctatgccaaaatcccgatggaaaggatgtatct

SEQ ID NO: 73828 - DNA, 75 bp, Artificial Sequence
  Synthetic
tcgtgatcatggatgatctatgccaaaatcccgatggaaaggatgtatctttgttctgccagatggtgtccagtg

SEQ ID NO: 73829 - DNA, 75 bp, Artificial Sequence
  Synthetic
atatggcgacgacgtcattgcttcatatccacacccaattgatgcctcactgctggctgaagccggcaagggata

SEQ ID NO: 73830 - DNA, 75 bp, Artificial Sequence
  Synthetic
caaatgccggttccatcaatgcaccaacagtttcggacagtcgggctttagctagaaggttccatttcgatatga

SEQ ID NO: 73831 - DNA, 75 bp, Artificial Sequence
  Synthetic
aacagtttcggacagtcgggctttagctagaaggttccatttcgatatgaacatagaggtcatatcgatgtacag

SEQ ID NO: 73832 - DNA, 75 bp, Artificial Sequence
  Synthetic
gtgctgtcctcttgtgtgtggaaaggctatccagtttatcgatagaagaacccaagtgagatattccctagatat

SEQ ID NO: 73833 - DNA, 75 bp, Artificial Sequence
  Synthetic
gctatccagtttatcgatagaagaacccaagtgagatattccctagatatgttggtcaccgagatgttcagagaa

SEQ ID NO: 73834 - DNA, 75 bp, Artificial Sequence
  Synthetic
atcagtgttgcacctgaaacacctccaccaccagccattgcagacctgttgaaatcggtggacagcgaagcagtc

SEQ ID NO: 73835 - DNA, 75 bp, Artificial Sequence
  Synthetic
caccaccagccattgcagacctgttgaaatcggtggacagcgaagcagtcagggagtactgtaaggagatgggat

SEQ ID NO: 73836 - DNA, 75 bp, Artificial Sequence
  Synthetic
agttgagcctagatcaagcacttctgttaccccgggctgagtatcaataagctgttgacacggctgaaggagaaa

SEQ ID NO: 73837 - DNA, 75 bp, Artificial Sequence
  Synthetic
tgacaacctttgtatctgtagctggaattatttacatcatttacaaactgttcgctggattccagggcgcgtaca

SEQ ID NO: 73838 - DNA, 75 bp, Artificial Sequence
  Synthetic
aattatttacatcatttacaaactgttcgctggattccagggcgcgtacacgggaatgcccaaccaaaaacccaa

SEQ ID NO: 73839 - DNA, 75 bp, Artificial Sequence
  Synthetic
gtggcggtggctgcgttggcggcctgcccatggggttacccatgggacgcttcaatactgacatggtgtgaagag

SEQ ID NO: 73840 - DNA, 75 bp, Artificial Sequence
  Synthetic
tagcacagtaaaaacagaatatggtgagtttactatgctgggtatctacgacaggtgggctgttctcccacgcca

SEQ ID NO: 73841 - DNA, 75 bp, Artificial Sequence
  Synthetic
gcccatggggttacccatgggacgcttcaatactgacatggtgtgaagagttgactgagctagctggtagtcctc

SEQ ID NO: 73842 - DNA, 75 bp, Artificial Sequence
  Synthetic
gagtttactatgctgggtatctacgacaggtgggctgttctcccacgccacgctaaacctggaccaactattctt

SEQ ID NO: 73843 - DNA, 75 bp, Artificial Sequence
  Synthetic
ctgctcaaactcaaccggaatgagaaattcagagacatcagaggttttctcgccaaagaggaagtggaggtcaac

SEQ ID NO: 73844 - DNA, 75 bp, Artificial Sequence
  Synthetic
gggtgaccgtgtttctctttattcttatattggctgcttatggtgacaatctcagagttgttaccatatagctat

SEQ ID NO: 73845 - DNA, 75 bp, Artificial Sequence
  Synthetic
aattcagagacatcagaggttttctcgccaaagaggaagtggaggtcaacgaagctgttctggccataaatacta

SEQ ID NO: 73846 - DNA, 75 bp, Artificial Sequence
  Synthetic
tataccactttgtgttacattattggcttgaactcgaaaagatgggagcgcaagtatcaacacaaaaaactgggg

SEQ ID NO: 73847 - DNA, 75 bp, Artificial Sequence
  Synthetic
caaagagaatgctcatgtacaacttccccactagagcaggccagtgcggtggcgtccttatgtctactggtaagg

SEQ ID NO: 73848 - DNA, 75 bp, Artificial Sequence
  Synthetic
gcttgaactcgaaaagatgggagcgcaagtatcaacacaaaaaactggggcacacgagactggcctgagtgctag

SEQ ID NO: 73849 - DNA, 75 bp, Artificial Sequence
  Synthetic
ccccactagagcaggccagtgcggtggcgtccttatgtctactggtaaggtactgggaatacacgtcggtggaaa

SEQ ID NO: 73850 - DNA, 75 bp, Artificial Sequence
  Synthetic
tttcacccaagaccccgggaaattcaccgagccagtgaaggatatcatgataaaatcgatgcctgcgttaaactc

SEQ ID NO: 73851 - DNA, 75 bp, Artificial Sequence
  Synthetic
gaactcaaaagatgcggggtttccaatcatcaacatgccaagtaggacaaagttggaaccgagtgtgttccacca

SEQ ID NO: 73852 - DNA, 75 bp, Artificial Sequence
  Synthetic
accgagccagtgaaggatatcatgataaaatcgatgcctgcgttaaactccccaacagcagaagaatgtgggtac

SEQ ID NO: 73853 - DNA, 75 bp, Artificial Sequence
  Synthetic
atcatcaacatgccaagtaggacaaagttggaaccgagtgtgttccaccaagtgtttgagggtaccaaggaaccg

SEQ ID NO: 73854 - DNA, 75 bp, Artificial Sequence
  Synthetic
tatggcacgtggcctgattatctacatgatgatgaggccactgcagaggaccaaccaacacaaccggatgtggcg

SEQ ID NO: 73855 - DNA, 75 bp, Artificial Sequence
  Synthetic
gtaaacacgcatgtagatgaatacatgatggaggctgttgaccattatgcagggcaattagctactttggatatc

SEQ ID NO: 73856 - DNA, 75 bp, Artificial Sequence
  Synthetic
atgatgatgaggccactgcagaggaccaaccaacacaaccggatgtggcgacgtgtaggttttacacacttgaat

SEQ ID NO: 73857 - DNA, 75 bp, Artificial Sequence
  Synthetic
tgatggaggctgttgaccattatgcagggcaattagctactttggatatcagcacggaacccatgaagctggaag

SEQ ID NO: 73858 - DNA, 75 bp, Artificial Sequence
  Synthetic
gccaaaacatgcactatcattatcttggcaggtcgggttacaccatccacgtccaatgtaacgcgtctaaattcc

SEQ ID NO: 73859 - DNA, 75 bp, Artificial Sequence
  Synthetic
gcattaagaagagggacatcctatccaagaaaaccaaagacctcaccaagttaaaagagtgcatggataaatatg

SEQ ID NO: 73860 - DNA, 75 bp, Artificial Sequence
  Synthetic
tggcaggtcgggttacaccatccacgtccaatgtaacgcgtctaaattccaccagggttgtttgcttgtggtgtg

SEQ ID NO: 73861 - DNA, 75 bp, Artificial Sequence
  Synthetic
caagaaaaccaaagacctcaccaagttaaaagagtgcatggataaatatggactgaacctgccaatggtgaccta

SEQ ID NO: 73862 - DNA, 75 bp, Artificial Sequence
  Synthetic
ggcaaaatattttgcaaagactagtgcgacgggaacccacacagtgcaaagcatagtgacaaacgccggcatggg

SEQ ID NO: 73863 - DNA, 75 bp, Artificial Sequence
  Synthetic
tgactctgttgcaatgaggcagacatttggtaacctatacaaaacattccatttgaaccccgggatcgtcacagg

SEQ ID NO: 73864 - DNA, 75 bp, Artificial Sequence
  Synthetic
gcgacgggaacccacacagtgcaaagcatagtgacaaacgccggcatgggggtgggcgtgggcaatctgacaata

SEQ ID NO: 73865 - DNA, 75 bp, Artificial Sequence
  Synthetic
tttggtaacctatacaaaacattccatttgaaccccgggatcgtcacaggaagtgcagtcggatgtgatcctgac

SEQ ID NO: 73866 - DNA, 75 bp, Artificial Sequence
  Synthetic
atggataacatgttcagacactacaatttcaccctaatgatcatccccttcgtcccactggacttcacagctgag

SEQ ID NO: 73867 - DNA, 75 bp, Artificial Sequence
  Synthetic
ttaagccccgtgtggtttgcttgtctaaagctactgcttgagaaacttggatattcacataaagagacaaaatac

SEQ ID NO: 73868 - DNA, 75 bp, Artificial Sequence
  Synthetic
atttcaccctaatgatcatccccttcgtcccactggacttcacagctgaggcatctacgtatgtaccaatcactg

SEQ ID NO: 73869 - DNA, 75 bp, Artificial Sequence
  Synthetic
taaagctactgcttgagaaacttggatattcacataaagagacaaaatacattgatttcttgtgcaactctcatc

SEQ ID NO: 73870 - DNA, 75 bp, Artificial Sequence
  Synthetic
cccctggtagtaaccaattcctcacatcagatgactttcaatcaccatcagccatgccacaattcgatgtcacac

SEQ ID NO: 73871 - DNA, 75 bp, Artificial Sequence
  Synthetic
caatgatcaacaacatcataatcagaacactaatgttgaaggtatataaaggcattgacctggaccaatttagaa

SEQ ID NO: 73872 - DNA, 75 bp, Artificial Sequence
  Synthetic
atcagatgactttcaatcaccatcagccatgccacaattcgatgtcacacccgagctcaggattccaggggaggt

SEQ ID NO: 73873 - DNA, 75 bp, Artificial Sequence
  Synthetic
aacactaatgttgaaggtatataaaggcattgacctggaccaatttagaatgattgcgtacggtgacgatgtgat

SEQ ID NO: 73874 - DNA, 75 bp, Artificial Sequence
  Synthetic
ggatgtgtacaaaattcctgttagtggaggcaaccaactgtcaactcaagtcttcgggttccaaatgcaaccagg

SEQ ID NO: 73875 - DNA, 75 bp, Artificial Sequence
  Synthetic
agcggacaagggggaatgcttcaatgaagtcacctggactaatgtcacctttctaaagaggtatttcagagcaga

SEQ ID NO: 73876 - DNA, 75 bp, Artificial Sequence
  Synthetic
ggaggcaaccaactgtcaactcaagtcttcgggttccaaatgcaaccagggctaaatagtgtgttcaaaaggaca

SEQ ID NO: 73877 - DNA, 75 bp, Artificial Sequence
  Synthetic
ccagtcatgcctatgaaggacatccatgaatccatcaggtggacaaaagacccaaagaatacccaagatcatgtg

SEQ ID NO: 73878 - DNA, 75 bp, Artificial Sequence
  Synthetic
gccatggcactggccaaatttctgctggcatattcccctccaggcgcagaccccccaaagtctaggaaagaagca

SEQ ID NO: 73879 - DNA, 75 bp, Artificial Sequence
  Synthetic
tggcatattcccctccaggcgcagaccccccaaagtctaggaaagaagcaatgcttggtactcacgtgatatggg

SEQ ID NO: 73880 - DNA, 75 bp, Artificial Sequence
  Synthetic
atgaatatacgagtgcaggatatgtaacttgctggtatcaaactagtttggttgtcccgcccggcgctcccgcca

SEQ ID NO: 73881 - DNA, 75 bp, Artificial Sequence
  Synthetic
aacttgctggtatcaaactagtttggttgtcccgcccggcgctcccgccacgtgtggagtcttgtgcttagcatc

SEQ ID NO: 73882 - DNA, 75 bp, Artificial Sequence
  Synthetic
ttaaaacagctctggggttgtacccactcacagggcccactgggcgctagcacactggtatcacggtacctttgt

SEQ ID NO: 73883 - DNA, 75 bp, Artificial Sequence
  Synthetic
cacactggtatcacggtacctttgtgcgcctgttttataaccccttccccaaacgtaacgtagaagctacacaca

SEQ ID NO: 73884 - DNA, 75 bp, Artificial Sequence
  Synthetic
tgtggaggaggccgtgaacagagccgttgcacgggtggcggatacactacccacagggccgagaaattcagagag

SEQ ID NO: 73885 - DNA, 75 bp, Artificial Sequence
  Synthetic
cagttgtgtcccgatcaagcacttctgtctccccggaccgagtatcaatagactgctcacgcggttgaaggagaa

SEQ ID NO: 73886 - DNA, 75 bp, Artificial Sequence
  Synthetic
gttgcacgggtggcggatacactacccacagggccgagaaattcagagagcatccccgcactaacagcagcagaa

SEQ ID NO: 73887 - DNA, 75 bp, Artificial Sequence
  Synthetic
ttcccccgtgtagatcaggctgatgagtcactgcgttccccacgggtgaccgtggcagtgactgcgttggcggcc

SEQ ID NO: 73888 - DNA, 75 bp, Artificial Sequence
  Synthetic
gaatcgtctgttgaaaacttcttatgccgagcagcatgtgtgtgtattacaaagtacaagaccaaggacagtgat

SEQ ID NO: 73889 - DNA, 75 bp, Artificial Sequence
  Synthetic
gccgagcagcatgtgtgtgtattacaaagtacaagaccaaggacagtgatccagtgcaaaggtacgccaactggc

SEQ ID NO: 73890 - DNA, 75 bp, Artificial Sequence
  Synthetic
ttacttttgtgatcaccagttcacaagatgatggcacgcagttggcgcaggacatgccagtattaacacaccaag

SEQ ID NO: 73891 - DNA, 75 bp, Artificial Sequence
  Synthetic
agatgatggcacgcagttggcgcaggacatgccagtattaacacaccaagtcatgtatataccacctggagggcc

SEQ ID NO: 73892 - DNA, 75 bp, Artificial Sequence
  Synthetic
tccagctaggatgtccatcccctttatcagtataggcaacgcgtatagcaatttctatgatggttggtcacattt

SEQ ID NO: 73893 - DNA, 75 bp, Artificial Sequence
  Synthetic
atacttaatactgcaaaatgggagcacaagtgtcaacccaaaaaacaggagctaacgaaaccggcttaactgcca

SEQ ID NO: 73894 - DNA, 75 bp, Artificial Sequence
  Synthetic
atcagtataggcaacgcgtatagcaatttctatgatggttggtcacatttcacccaagatggagtatatggtttc

SEQ ID NO: 73895 - DNA, 75 bp, Artificial Sequence
  Synthetic
acaagtgtcaacccaaaaaacaggagctaacgaaaccggcttaactgccagtggcaattacaccatccattatac

SEQ ID NO: 73896 - DNA, 75 bp, Artificial Sequence
  Synthetic
gtcagagtctatttcaaaccaaaacacgtgcgggcctgggtgccaagaccacctaggctttgtgcatatgagaaa

SEQ ID NO: 73897 - DNA, 75 bp, Artificial Sequence
  Synthetic
cacagagcccatgaaagatgtgatgataaaatcactgcctgcgcttaactcgcctacagtggaagagtgtggttt

SEQ ID NO: 73898 - DNA, 75 bp, Artificial Sequence
  Synthetic
acgtgcgggcctgggtgccaagaccacctaggctttgtgcatatgagaaatcaagcaacgtgaatttcaaaccaa

SEQ ID NO: 73899 - DNA, 75 bp, Artificial Sequence
  Synthetic
ataaaatcactgcctgcgcttaactcgcctacagtggaagagtgtggtttttcagatagggtgcgatctattaca

SEQ ID NO: 73900 - DNA, 75 bp, Artificial Sequence
  Synthetic
tcggtcagcaatcaggagcggcttatgtgggaaactatagagtggttaatagacacctagccactcatgttgact

SEQ ID NO: 73901 - DNA, 75 bp, Artificial Sequence
  Synthetic
caagacaatgaggccacggctgaagaccaaccgacgcaaccagatgtcgccacatgtaggttttacactctggat

SEQ ID NO: 73902 - DNA, 75 bp, Artificial Sequence
  Synthetic
tgtgggaaactatagagtggttaatagacacctagccactcatgttgactggcagaactgtgtgtgggaggacta

SEQ ID NO: 73903 - DNA, 75 bp, Artificial Sequence
  Synthetic
accaaccgacgcaaccagatgtcgccacatgtaggttttacactctggattccatacagtggcagaaggagtccg

SEQ ID NO: 73904 - DNA, 75 bp, Artificial Sequence
  Synthetic
cgtgtacttctgtgcatcgaggaataaacactacccagtcagttttgaaggaccaggtctggtagaagtccagga

SEQ ID NO: 73905 - DNA, 75 bp, Artificial Sequence
  Synthetic
tgggcagatccgggtacactatacacgtgcagtgcaatgcatccaaatttcaccagggatgcttgctcgttgtgt

SEQ ID NO: 73906 - DNA, 75 bp, Artificial Sequence
  Synthetic
aaacactacccagtcagttttgaaggaccaggtctggtagaagtccaggagagcgagtactaccccaggaggtat

SEQ ID NO: 73907 - DNA, 75 bp, Artificial Sequence
  Synthetic
cgtgcagtgcaatgcatccaaatttcaccagggatgcttgctcgttgtgtgtgtaccagaggctgaaatggggtg

SEQ ID NO: 73908 - DNA, 75 bp, Artificial Sequence
  Synthetic
gtcatcggtctagttactatgggtggcgaaggcgttgtcggattcgctgatgtacgcgacctgttatggcttgaa

SEQ ID NO: 73909 - DNA, 75 bp, Artificial Sequence
  Synthetic
gtccaatgggcaacacactgtacaaacagtagtctacaatgctgggatgggtgtgggagttggaaacctcaccat

SEQ ID NO: 73910 - DNA, 75 bp, Artificial Sequence
  Synthetic
gcgaaggcgttgtcggattcgctgatgtacgcgacctgttatggcttgaagatgacgccatggaacaaggagtca

SEQ ID NO: 73911 - DNA, 75 bp, Artificial Sequence
  Synthetic
acagtagtctacaatgctgggatgggtgtgggagttggaaacctcaccattttcccgcaccaatggattaatttg

SEQ ID NO: 73912 - DNA, 75 bp, Artificial Sequence
  Synthetic
taaaagagtcactggtgggtcacgattccatcctagagaagtcccttaaagccctagtgaaaatcatatcagcac

SEQ ID NO: 73913 - DNA, 75 bp, Artificial Sequence
  Synthetic
aactttactctgatgataatcccttttgccaaattggagtacactgaacaggcttccaactacgttcctattact

SEQ ID NO: 73914 - DNA, 75 bp, Artificial Sequence
  Synthetic
ttccatcctagagaagtcccttaaagccctagtgaaaatcatatcagcactagtgatagtggtgaggaaccatga

SEQ ID NO: 73915 - DNA, 75 bp, Artificial Sequence
  Synthetic
ttgccaaattggagtacactgaacaggcttccaactacgttcctattactgtcactgtggcacctatgtgcgctg

SEQ ID NO: 73916 - DNA, 75 bp, Artificial Sequence
  Synthetic
ggtgtcacaatactacgggatacccatggcagagcgccaaagcaacgggtggctcaagaagttcacagagatgac

SEQ ID NO: 73917 - DNA, 75 bp, Artificial Sequence
  Synthetic
cttctgatgattttcagtcaccatccgccatgccccagtttgatgtaacgccagagatgaaaataccaggcgaag

SEQ ID NO: 73918 - DNA, 75 bp, Artificial Sequence
  Synthetic
atggcagagcgccaaagcaacgggtggctcaagaagttcacagagatgactaacgcctgcaaagggatggaatgg

SEQ ID NO: 73919 - DNA, 75 bp, Artificial Sequence
  Synthetic
cgccatgccccagtttgatgtaacgccagagatgaaaataccaggcgaagttcacaatttgatggaaattgctga

SEQ ID NO: 73920 - DNA, 75 bp, Artificial Sequence
  Synthetic
ttcctgaataggctcaagcaactcccactgttggagagtcaaatagcaaccatcgagcagagtgcaccgtcccag

SEQ ID NO: 73921 - DNA, 75 bp, Artificial Sequence
  Synthetic
aggaggtgatcaattgcacacacaagtttttggctttcaaatgcaacctggcctgaatagtgtttttaaacgcac

SEQ ID NO: 73922 - DNA, 75 bp, Artificial Sequence
  Synthetic
gtttttggctttcaaatgcaacctggcctgaatagtgtttttaaacgcaccctactaggagagattctgaactat

SEQ ID NO: 73923 - DNA, 75 bp, Artificial Sequence
  Synthetic
ctagcttactcacccccaggtgcttctccaccacaaaatcgcaagcaggcaatgctggggacgcacgtgatatgg

SEQ ID NO: 73924 - DNA, 75 bp, Artificial Sequence
  Synthetic
ctccaccacaaaatcgcaagcaggcaatgctggggacgcacgtgatatgggacgtggggctacaatctagttgtg

SEQ ID NO: 73925 - DNA, 75 bp, Artificial Sequence
  Synthetic
tcacgtgttggtaccagacgggcctcattgtaccaccaggtgcgcccccctcatgcaccatactgtgttttgcct

SEQ ID NO: 73926 - DNA, 75 bp, Artificial Sequence
  Synthetic
cattgtaccaccaggtgcgcccccctcatgcaccatactgtgttttgcctctgcatgcaacgacttttcagtgcg

SEQ ID NO: 73927 - DNA, 75 bp, Artificial Sequence
  Synthetic
tcaaccaatgcaggatccatcaacgcaccaacagtttcggacagcagagccctagctagaaggttccactttgac

SEQ ID NO: 73928 - DNA, 75 bp, Artificial Sequence
  Synthetic
tgttgcaagagttgcagatacaatgccgacaggaccgcgcaactccgaaagcgtacctgccctgacggcagtaga

SEQ ID NO: 73929 - DNA, 75 bp, Artificial Sequence
  Synthetic
ccgacaggaccgcgcaactccgaaagcgtacctgccctgacggcagtagagactggtcacacttcacaagtggtt

SEQ ID NO: 73930 - DNA, 75 bp, Artificial Sequence
  Synthetic
gaggagtgctgcccagtcaatttcaagagatgctgcccactggtgtgtggcaaggctattcagttcattgacaga

SEQ ID NO: 73931 - DNA, 75 bp, Artificial Sequence
  Synthetic
agagatgctgcccactggtgtgtggcaaggctattcagttcattgacagaagaacccaagtcagatattcactgg

SEQ ID NO: 73932 - DNA, 75 bp, Artificial Sequence
  Synthetic
tgtagagcagcatgtgtttacatcacaacctataagtcagctggtggtacccccacggaacgatatgccagttgg

SEQ ID NO: 73933 - DNA, 75 bp, Artificial Sequence
  Synthetic
caacctataagtcagctggtggtacccccacggaacgatatgccagttggaggattaatacccggcaaatggtgc

SEQ ID NO: 73934 - DNA, 75 bp, Artificial Sequence
  Synthetic
aaggtccaccggtcatcagggagatcaagatcagtgttgctccagaaacacctcccccaccagcaatcgctgatt

SEQ ID NO: 73935 - DNA, 75 bp, Artificial Sequence
  Synthetic
tattaaaatcagtagacagtgaagctgtgagagagtactgcaaggaaaaaggctggcttgtaccggaagttaact

SEQ ID NO: 73936 - DNA, 75 bp, Artificial Sequence
  Synthetic
aagacccaggaacacagctggcacaagatatgcctgtgttaacccaccagatcatgtatatcccgccaggaggtc

SEQ ID NO: 73937 - DNA, 75 bp, Artificial Sequence
  Synthetic
agatatgcctgtgttaacccaccagatcatgtatatcccgccaggaggtccggttccaaatagcgccacagactt

SEQ ID NO: 73938 - DNA, 75 bp, Artificial Sequence
  Synthetic
ctggcataatctacattatctacaagttgtttgccggctttcagggcgcgtatacggggatgccaaatcagaaac

SEQ ID NO: 73939 - DNA, 75 bp, Artificial Sequence
  Synthetic
tattagtattgggaatgcttatagtaatttctatgatgggtggtcacactttacccaggagggtgtttatggttt

SEQ ID NO: 73940 - DNA, 75 bp, Artificial Sequence
  Synthetic
aatttctatgatgggtggtcacactttacccaggagggtgtttatggttttaactctttgaataacatgggtcat

SEQ ID NO: 73941 - DNA, 75 bp, Artificial Sequence
  Synthetic
acgccagcacagtgaaaacggaatatggtgagttcaccatgctcggcatctatgacagatgggcagtgctaccac

SEQ ID NO: 73942 - DNA, 75 bp, Artificial Sequence
  Synthetic
tggtgagttcaccatgctcggcatctatgacagatgggcagtgctaccacaccacgccaagcctggaccgactat

SEQ ID NO: 73943 - DNA, 75 bp, Artificial Sequence
  Synthetic
catgtgcgtgcctgggtccctagaccgcctagacttagcccgtatgtgaaaagctcaaacgtgaacttcaaaccc

SEQ ID NO: 73944 - DNA, 75 bp, Artificial Sequence
  Synthetic
cgcctagacttagcccgtatgtgaaaagctcaaacgtgaacttcaaacccactgcagtgacaactgagcggaaag

SEQ ID NO: 73945 - DNA, 75 bp, Artificial Sequence
  Synthetic
gacccttttaaagctcaaccgcaatgagaagtttagggacatcagagggtttctggcgagagaggaagctgaagt

SEQ ID NO: 73946 - DNA, 75 bp, Artificial Sequence
  Synthetic
gagaagtttagggacatcagagggtttctggcgagagaggaagctgaagtgaatgaggctgttctggcaataaac

SEQ ID NO: 73947 - DNA, 75 bp, Artificial Sequence
  Synthetic
tctatgtgggtaactatagagtggtcaaccggcacttggcaacacacactgattggcaaaattgtgtgtgggaga

SEQ ID NO: 73948 - DNA, 75 bp, Artificial Sequence
  Synthetic
caaccggcacttggcaacacacactgattggcaaaattgtgtgtgggagaactacaatagagatctcttagtgag

SEQ ID NO: 73949 - DNA, 75 bp, Artificial Sequence
  Synthetic
cccacaaagaggatgctcatgtacaactttccaactagagcagggcaatgtggtggggtactcatgtcaacaggg

SEQ ID NO: 73950 - DNA, 75 bp, Artificial Sequence
  Synthetic
actttccaactagagcagggcaatgtggtggggtactcatgtcaacagggaaagttcttggtatacatgtagggg

SEQ ID NO: 73951 - DNA, 75 bp, Artificial Sequence
  Synthetic
gaacagacactacccagttgctttcgaagggccaggcttagttgaggtgcaggaaagtgagtactaccccaaaag

SEQ ID NO: 73952 - DNA, 75 bp, Artificial Sequence
  Synthetic
gaagggccaggcttagttgaggtgcaggaaagtgagtactaccccaaaaggtatcagtcgcacgtgttattagct

SEQ ID NO: 73953 - DNA, 75 bp, Artificial Sequence
  Synthetic
ttgagagctcaaaggatgcaggattccctgtgatcaacacccccagcaaaacaaaactggaaccaagcgtgtttc

SEQ ID NO: 73954 - DNA, 75 bp, Artificial Sequence
  Synthetic
ccctgtgatcaacacccccagcaaaacaaaactggaaccaagcgtgtttcatcaggtgtttgaaggcaataaaga

SEQ ID NO: 73955 - DNA, 75 bp, Artificial Sequence
  Synthetic
ggtggcgagggcgttgtcggttttgctgacgtgcgcgacctcctgtggttggaagatgatgccatggaacaagga

SEQ ID NO: 73956 - DNA, 75 bp, Artificial Sequence
  Synthetic
ctgacgtgcgcgacctcctgtggttggaagatgatgccatggaacaaggagttaaggactacgtagagcagcttg

SEQ ID NO: 73957 - DNA, 75 bp, Artificial Sequence
  Synthetic
gaacatcaacacacatgtggatgaatacatgctcgaagcagtggatcactacgcagggcaactggctactcttga

SEQ ID NO: 73958 - DNA, 75 bp, Artificial Sequence
  Synthetic
tacatgctcgaagcagtggatcactacgcagggcaactggctactcttgacattagcactgaacccatgaaacta

SEQ ID NO: 73959 - DNA, 75 bp, Artificial Sequence
  Synthetic
aagactccatactggagaaatctttgaaagcactggtaaagataatatcagctctggtcatcgtggtgagaaatc

SEQ ID NO: 73960 - DNA, 75 bp, Artificial Sequence
  Synthetic
gaaagcactggtaaagataatatcagctctggtcatcgtggtgagaaatcatgatgatttggtcactgtaactgc

SEQ ID NO: 73961 - DNA, 75 bp, Artificial Sequence
  Synthetic
ataggcatcaaaaagagagacatcctatccaaaaagactaaagatctgactaaattgaaggaatgcatggacaag

SEQ ID NO: 73962 - DNA, 75 bp, Artificial Sequence
  Synthetic
tatccaaaaagactaaagatctgactaaattgaaggaatgcatggacaagtacggtttgaacctgccgatggtga

SEQ ID NO: 73963 - DNA, 75 bp, Artificial Sequence
  Synthetic
acccatggccgagcgccagaactacggctggctaaagaaattcactgagatgaccaatgcttgtaaagggatgga

SEQ ID NO: 73964 - DNA, 75 bp, Artificial Sequence
  Synthetic
ggctggctaaagaaattcactgagatgaccaatgcttgtaaagggatggagtggattgccatcaaaattcagaag

SEQ ID NO: 73965 - DNA, 75 bp, Artificial Sequence
  Synthetic
taaatgactctgtcgcgatgaggcagacgtttggcaacttgtacaaaacattccatctgaacccgggcattgtga

SEQ ID NO: 73966 - DNA, 75 bp, Artificial Sequence
  Synthetic
gacgtttggcaacttgtacaaaacattccatctgaacccgggcattgtgacaggcagtgcagttggatgtgatcc

SEQ ID NO: 73967 - DNA, 75 bp, Artificial Sequence
  Synthetic
ctaccgctcttggaaagccaggttgctaccatagaacagagtgccccatcgcaaagtgaccaagaacagctcttt

SEQ ID NO: 73968 - DNA, 75 bp, Artificial Sequence
  Synthetic
ctaccatagaacagagtgccccatcgcaaagtgaccaagaacagctcttttccaacgttcagtattttgcccact

SEQ ID NO: 73969 - DNA, 75 bp, Artificial Sequence
  Synthetic
cagcctgagccctgtgtggttcgcttgtctaaaactgctactcgaaaaactcgggtacacgcacagagagacaaa

SEQ ID NO: 73970 - DNA, 75 bp, Artificial Sequence
  Synthetic
tgtctaaaactgctactcgaaaaactcgggtacacgcacagagagacaaactacatcgactacctatgcaactct

SEQ ID NO: 73971 - DNA, 75 bp, Artificial Sequence
  Synthetic
acatacagttcaagtccaaatgccgtattgaacctgtatgtttacttttgcacggtagcccaggggcaggcaagt

SEQ ID NO: 73972 - DNA, 75 bp, Artificial Sequence
  Synthetic
tattgaacctgtatgtttacttttgcacggtagcccaggggcaggcaagtcagtggccaccaatttgattggaag

SEQ ID NO: 73973 - DNA, 75 bp, Artificial Sequence
  Synthetic
aattcaatgatcaataatatcataatcaggacactgatgctcaaagtgtacaagggaattgacctggaccagttt

SEQ ID NO: 73974 - DNA, 75 bp, Artificial Sequence
  Synthetic
tcaggacactgatgctcaaagtgtacaagggaattgacctggaccagtttagaatgattgcatatggtgatgatg

SEQ ID NO: 73975 - DNA, 75 bp, Artificial Sequence
  Synthetic
acaagcggttgtgatcatggatgacctatgccagaatcccgatggaaaggatgtatccttgttttgtcagatggt

SEQ ID NO: 73976 - DNA, 75 bp, Artificial Sequence
  Synthetic
ctatgccagaatcccgatggaaaggatgtatccttgttttgtcagatggtgtccagtgtagactttgtgccacca

SEQ ID NO: 73977 - DNA, 75 bp, Artificial Sequence
  Synthetic
caccagcagacaaaggggagcgcttcaatgaggttacctggaccaatgtcaccttcctaaagaggtactttagag

SEQ ID NO: 73978 - DNA, 75 bp, Artificial Sequence
  Synthetic
caatgaggttacctggaccaatgtcaccttcctaaagaggtactttagagctgatgagcagtatcctttcctggt

SEQ ID NO: 73979 - DNA, 75 bp, Artificial Sequence
  Synthetic
aatgcacccactgtgtccgatagcagagcacttgccaggagatttcacttcgatatgaatattgaggtgatctcc

SEQ ID NO: 73980 - DNA, 75 bp, Artificial Sequence
  Synthetic
gagcacttgccaggagatttcacttcgatatgaatattgaggtgatctccatgtacagccaaaatggaaagatta

SEQ ID NO: 73981 - DNA, 75 bp, Artificial Sequence
  Synthetic
cgttcgatcgttgtgcttattggcttggcataacggagaacaagaatatgaggaattcatccgaaagatcagaag

SEQ ID NO: 73982 - DNA, 75 bp, Artificial Sequence
  Synthetic
gtggtaaggccatccagttcattgataggagaacccaggttagatattcactggacatgttagtcactgagatgt

SEQ ID NO: 73983 - DNA, 75 bp, Artificial Sequence
  Synthetic
taggagaacccaggttagatattcactggacatgttagtcactgagatgtttagagaatacaatcatagacacag

SEQ ID NO: 73984 - DNA, 75 bp, Artificial Sequence
  Synthetic
taaattctccgcattcggtgcgaaaaaaaaaaaaaaaaaaaaaaaaaaaaaaaaaaaaaaaaaaaaaaaaaaaaa

SEQ ID NO: 73985 - DNA, 75 bp, Artificial Sequence
  Synthetic
aacaccccctccaccggcaattgccgatcttctaaaatctgtagatagcgaggctgttagggagtactgcaagga

SEQ ID NO: 73986 - DNA, 75 bp, Artificial Sequence
  Synthetic
gatcttctaaaatctgtagatagcgaggctgttagggagtactgcaaggaaaagggctggcttgtgccagagatc

SEQ ID NO: 73987 - DNA, 75 bp, Artificial Sequence
  Synthetic
acccacagggcctactgggcgttagcacactggtattacggtacccttgtgcgcctgttttattcaccctacccc

SEQ ID NO: 73988 - DNA, 75 bp, Artificial Sequence
  Synthetic
acggtcattaggcagctcagtatgccaactgagttttgaccaagcacttctgttaccccggactgagtatcaata

SEQ ID NO: 73989 - DNA, 75 bp, Artificial Sequence
  Synthetic
gtagctggcataatttacatcatatacaagttatttgccggctttcagggtgcgtacactgggatgcctaatcag

SEQ ID NO: 73990 - DNA, 75 bp, Artificial Sequence
  Synthetic
acaagttatttgccggctttcagggtgcgtacactgggatgcctaatcagaaacccaaagtacccacgttaaggc

SEQ ID NO: 73991 - DNA, 75 bp, Artificial Sequence
  Synthetic
caactgagttttgaccaagcacttctgttaccccggactgagtatcaataggctgtttgcacggccgaaggagaa

SEQ ID NO: 73992 - DNA, 75 bp, Artificial Sequence
  Synthetic
aatacggtgaattcacaatgcttggcatttatgacaggtgggcagtgttgccgcgccatgccaaacctggaccaa

SEQ ID NO: 73993 - DNA, 75 bp, Artificial Sequence
  Synthetic
catttatgacaggtgggcagtgttgccgcgccatgccaaacctggaccaaccattttaatgaacgaccaggaggt

SEQ ID NO: 73994 - DNA, 75 bp, Artificial Sequence
  Synthetic
caacgagaaattcagggatattagagggtttcttgcaagggaagaggttgaggtgaacgaggcggtcctggcaat

SEQ ID NO: 73995 - DNA, 75 bp, Artificial Sequence
  Synthetic
gggtttcttgcaagggaagaggttgaggtgaacgaggcggtcctggcaataaacacaagtaagttcccgaacatg

SEQ ID NO: 73996 - DNA, 75 bp, Artificial Sequence
  Synthetic
tacaacttccccactagagcaggacagtgtggtggtatcctcatgtcaacaggaaaggtcctcggaatacacgtg

SEQ ID NO: 73997 - DNA, 75 bp, Artificial Sequence
  Synthetic
agtgtggtggtatcctcatgtcaacaggaaaggtcctcggaatacacgtgggaggtaatggtcatcaaggtttct

SEQ ID NO: 73998 - DNA, 75 bp, Artificial Sequence
  Synthetic
ccaagtgtcgacacagaaaaccggggcacatgagaccagcttgagtgctagcggaaactctatcattcattacac

SEQ ID NO: 73999 - DNA, 75 bp, Artificial Sequence
  Synthetic
gcacatgagaccagcttgagtgctagcggaaactctatcattcattacacaaacatcaactactataaagatgca

SEQ ID NO: 74000 - DNA, 75 bp, Artificial Sequence
  Synthetic
gctttcctgtgattaacacccccagcaaaactaagctggaaccaagtgtatttcatcaggtttttgaaggcaaca

SEQ ID NO: 74001 - DNA, 75 bp, Artificial Sequence
  Synthetic
caaaactaagctggaaccaagtgtatttcatcaggtttttgaaggcaacaaggagcctgcagtcctcagaaatgg

SEQ ID NO: 74002 - DNA, 75 bp, Artificial Sequence
  Synthetic
gtgaaatcactaccggccctaaactccccatctgccgaagagtgcggttacagtgatagagtaagatctataact

SEQ ID NO: 74003 - DNA, 75 bp, Artificial Sequence
  Synthetic
ccccatctgccgaagagtgcggttacagtgatagagtaagatctataactctcggtaattcgactatcaccaccc

SEQ ID NO: 74004 - DNA, 75 bp, Artificial Sequence
  Synthetic
cgagtacatgcaggaggccgtggaccactacgcagggcaattagctacactagatatcagcaccgagcccatgaa

SEQ ID NO: 74005 - DNA, 75 bp, Artificial Sequence
  Synthetic
cactacgcagggcaattagctacactagatatcagcaccgagcccatgaagctagaggatgccgtatatggcaca

SEQ ID NO: 74006 - DNA, 75 bp, Artificial Sequence
  Synthetic
atcaacccacccaaccagatgtggctacatgcaggttctacacgctagattcagtatcgtggatgaaggagtcgc

SEQ ID NO: 74007 - DNA, 75 bp, Artificial Sequence
  Synthetic
tacatgcaggttctacacgctagattcagtatcgtggatgaaggagtcgcaaggatggtggtggaagttccccga

SEQ ID NO: 74008 - DNA, 75 bp, Artificial Sequence
  Synthetic
tgccctgagggatatgggcctgtttgggcaaaacatgcagtaccattacctgggtaggtccggttataccataca

SEQ ID NO: 74009 - DNA, 75 bp, Artificial Sequence
  Synthetic
attctatcaaagaaaaccaaagacctcaccaaattgaaagaatgtatggacagatatggtcttaatttgccaatg

SEQ ID NO: 74010 - DNA, 75 bp, Artificial Sequence
  Synthetic
tcaccaaattgaaagaatgtatggacagatatggtcttaatttgccaatggtaacatacgtcaaagacgagttga

SEQ ID NO: 74011 - DNA, 75 bp, Artificial Sequence
  Synthetic
cgtgcagtgtaacgcttcaaaatttcaccaagggtgcctcttagtagtgtgtgttccagaagctgagatgggtgc

SEQ ID NO: 74012 - DNA, 75 bp, Artificial Sequence
  Synthetic
ggcagacatttggaaatttgtacaagaccttccacctcaacccgggcatagttacgggcagcgccgttggatgtg

SEQ ID NO: 74013 - DNA, 75 bp, Artificial Sequence
  Synthetic
gaccttccacctcaacccgggcatagttacgggcagcgccgttggatgtgatccagatgtgttttggagtaagat

SEQ ID NO: 74014 - DNA, 75 bp, Artificial Sequence
  Synthetic
tgcatgtctgaaactcctcttggaaaaattgggatacacacacaaggaaacaaactacatagattacctctgcaa

SEQ ID NO: 74015 - DNA, 75 bp, Artificial Sequence
  Synthetic
aaattgggatacacacacaaggaaacaaactacatagattacctctgcaactcccaccacttatacagggacaaa

SEQ ID NO: 74016 - DNA, 75 bp, Artificial Sequence
  Synthetic
aacttcacactaatgattatcccatttgccaaacttgattacgcagcaggctcgtcgacctatatccccattact

SEQ ID NO: 74017 - DNA, 75 bp, Artificial Sequence
  Synthetic
gtaaccgttgcaccgatgtgtgctgagtacaacggtttgaggctggccggacaccagggcttacctgtgatgaac

SEQ ID NO: 74018 - DNA, 75 bp, Artificial Sequence
  Synthetic
ataatcaggaccctaatgctaagagtctacaaaggcattgatctggaccagttcagaatgattgcatacggggat

SEQ ID NO: 74019 - DNA, 75 bp, Artificial Sequence
  Synthetic
tctacaaaggcattgatctggaccagttcagaatgattgcatacggggatgacgtgatcgcctcttacccgtggc

SEQ ID NO: 74020 - DNA, 75 bp, Artificial Sequence
  Synthetic
ggtggattcagtagtcccagtcaacaatgtgaacgagaatgtcaacagcctggaggcctataggataccagtgca

SEQ ID NO: 74021 - DNA, 75 bp, Artificial Sequence
  Synthetic
gtttcaacgaggtgacgtggacaaatgtgaccttcctgaaaaggtatttcagagcagacgagcagtacccattct

SEQ ID NO: 74022 - DNA, 75 bp, Artificial Sequence
  Synthetic
tgtgaccttcctgaaaaggtatttcagagcagacgagcagtacccattcttaatccaccctgtcatgcctatgaa

SEQ ID NO: 74023 - DNA, 75 bp, Artificial Sequence
  Synthetic
ggcctggcacaacggtgagcacgaatatgaggagttcacccgcaagattagaagcgtgcctgttgggcgctgctt

SEQ ID NO: 74024 - DNA, 75 bp, Artificial Sequence
  Synthetic
gaagcgtgcctgttgggcgctgcttgactcttcccgcgttttcaacactgcgcaggaagtggttggactctttct

SEQ ID NO: 74025 - DNA, 75 bp, Artificial Sequence
  Synthetic
aatgctaggtactcacattatttgggacatcgggttacaatccagttgtgtgctgtgcgtaccatggatcagcca

SEQ ID NO: 74026 - DNA, 75 bp, Artificial Sequence
  Synthetic
tgctgtgcgtaccatggatcagccaaacgcactatagatttgtgtccaaggatagttacaccgatgccgggttca

SEQ ID NO: 74027 - DNA, 75 bp, Artificial Sequence
  Synthetic
caaagtgtcatactgtgcttcgtgtcagcctgcaatgacttctcggtgcgtctgctgcgtgattcacccttcgtt

SEQ ID NO: 74028 - DNA, 75 bp, Artificial Sequence
  Synthetic
cagcctgcaatgacttctcggtgcgtctgctgcgtgattcacccttcgttcgccagacagcattctaccagaatg

SEQ ID NO: 74029 - DNA, 75 bp, Artificial Sequence
  Synthetic
tggaatataaaacaagagatgacaccccagacaaaatgtacgatagctgggttataaacaccaggcaagtggccc

SEQ ID NO: 74030 - DNA, 75 bp, Artificial Sequence
  Synthetic
cccagacaaaatgtacgatagctgggttataaacaccaggcaagtggcccagttacgtaggaagctggagttttt

SEQ ID NO: 74031 - DNA, 75 bp, Artificial Sequence
  Synthetic
cacatatgtgagatttgatgtggaagttacatttgttataaccagtgtgcaggatgactcaactaggcagaatac

SEQ ID NO: 74032 - DNA, 75 bp, Artificial Sequence
  Synthetic
cacgtgaaggcatgggtgcctcgtccgcccagactatgtgagtacacacacaaggacaacgtggactttgaaccc

SEQ ID NO: 74033 - DNA, 75 bp, Artificial Sequence
  Synthetic
gtaactacaggctagtcaataggcacttagctacacacaatgattggcaaaactgtgtgtgggaggactacaata

SEQ ID NO: 74034 - DNA, 75 bp, Artificial Sequence
  Synthetic
agatgccaatgcacagcgggcgtgtacttctgtgcatcaaggaacaagcattatccagttagctttgagggccca

SEQ ID NO: 74035 - DNA, 75 bp, Artificial Sequence
  Synthetic
tcagaaccaggcgattgcggtggtatccttagatgcgagcatggtgtgattgggctggtcactatgggtggcgag

SEQ ID NO: 74036 - DNA, 75 bp, Artificial Sequence
  Synthetic
tccttagatgcgagcatggtgtgattgggctggtcactatgggtggcgagggagttgtcggatttgccgacgttc

SEQ ID NO: 74037 - DNA, 75 bp, Artificial Sequence
  Synthetic
gagtcgctaataggacaagactccgtcctagagaagtctctcaaggcacttgtaaagatcatttcagcactggtg

SEQ ID NO: 74038 - DNA, 75 bp, Artificial Sequence
  Synthetic
tggctcaaaactaaaatcctaccggaggtgaaggaaaagcacgagtttctatccaggctcaaacaacttcccctc

SEQ ID NO: 74039 - DNA, 75 bp, Artificial Sequence
  Synthetic
aagaaaatgagcaactacatacagttcaagtccaaatgccgtattgaacctgtatgcttgcttttgcatggaagt

SEQ ID NO: 74040 - DNA, 75 bp, Artificial Sequence
  Synthetic
tcaagtccaaatgccgtattgaacctgtatgcttgcttttgcatggaagtccaggtgctggaaagtcggtggcaa

SEQ ID NO: 74041 - DNA, 75 bp, Artificial Sequence
  Synthetic
ccaggtgctggaaagtcggtggcaaccaacctgatcgggcgatcactagccgagaaacttaacagctcagtgtac

SEQ ID NO: 74042 - DNA, 75 bp, Artificial Sequence
  Synthetic
aacccagatggcaaagatgtatccctgttctgccagatggtgtccagtgtagattttgtaccgccaatggctgca

SEQ ID NO: 74043 - DNA, 75 bp, Artificial Sequence
  Synthetic
tgtcagtgaagacatgtgatgaagagtgctgcccggttaatttcaagaggtgttgccctctagtctgtggcaagg

SEQ ID NO: 74044 - DNA, 75 bp, Artificial Sequence
  Synthetic
acaatcatagacacagtgttggagcaaccctcgaagcattattccaaggtccaccaatgtacagggagatcaaaa

SEQ ID NO: 74045 - DNA, 75 bp, Artificial Sequence
  Synthetic
accgccagcaattgctgatttactaaaatcagtggatagcgaagcggtgagagagtactgcaaagagaaggggtg

SEQ ID NO: 74046 - DNA, 75 bp, Artificial Sequence
  Synthetic
gctgttgcccgaaattaattctactcttcagattgagaaacatgttagcagagctttcatatgcctccaagcact

SEQ ID NO: 74047 - DNA, 75 bp, Artificial Sequence
  Synthetic
cttcagattgagaaacatgttagcagagctttcatatgcctccaagcactaacaacctttgtatccgtggccggc

SEQ ID NO: 74048 - DNA, 75 bp, Artificial Sequence
  Synthetic
tgtggccatgatgaaaagaaactccagcacggtgaaaacagagtatggtgagttcaccatgctaggcatttatga

SEQ ID NO: 74049 - DNA, 75 bp, Artificial Sequence
  Synthetic
agcacggtgaaaacagagtatggtgagttcaccatgctaggcatttatgataggtgggccgtccttccgcggcac

SEQ ID NO: 74050 - DNA, 75 bp, Artificial Sequence
  Synthetic
tgaatgaacaagaagttggcgtgttggatgcaaaggagttagtggacaaggatggtacaaatcttgaactgacgc

SEQ ID NO: 74051 - DNA, 75 bp, Artificial Sequence
  Synthetic
ggatgcaaaggagttagtggacaaggatggtacaaatcttgaactgacgctgatgaaactcaaccggaatgagaa

SEQ ID NO: 74052 - DNA, 75 bp, Artificial Sequence
  Synthetic
caaattcccaaacatgtacatcccagtaggacaggtcacagactatggttttttgaatctaggtggtaccccaac

SEQ ID NO: 74053 - DNA, 75 bp, Artificial Sequence
  Synthetic
attggggatacatgttggagggaatggtcaccaaggcttctcagcagctctcttaaggcactacttcaatgatga

SEQ ID NO: 74054 - DNA, 75 bp, Artificial Sequence
  Synthetic
gttggaacccagcgtcttccaccaggtgtttgaaggcaacaaggaaccagcggttctcagaaatggggacccgcg

SEQ ID NO: 74055 - DNA, 75 bp, Artificial Sequence
  Synthetic
gtgtttgaaggcaacaaggaaccagcggttctcagaaatggggacccgcgactcaaagcagattttgaggaggca

SEQ ID NO: 74056 - DNA, 75 bp, Artificial Sequence
  Synthetic
ggacaactagctactctggatatcagcacagagcccatgaaattagaggatgcagtgtatggcacagaagggttg

SEQ ID NO: 74057 - DNA, 75 bp, Artificial Sequence
  Synthetic
tgcagtgtatggcacagaagggttggaagcacttgatttgaccaccagtgcaggatacccatacgtcgcattggg

SEQ ID NO: 74058 - DNA, 75 bp, Artificial Sequence
  Synthetic
caggatacccatacgtcgcattgggcattaagaagagggatattttgtctaagaagactaaggatctgaccaaat

SEQ ID NO: 74059 - DNA, 75 bp, Artificial Sequence
  Synthetic
gtgaaagatgagctcagatcagcagaaaaagtagccaggggcaagtccagacttatcgaagcatccagcttgaat

SEQ ID NO: 74060 - DNA, 75 bp, Artificial Sequence
  Synthetic
tttgaacccagggattgtaactggcagtgcagttgggtgtgatcctgacctcttctggagcaaaatacctgtaat

SEQ ID NO: 74061 - DNA, 75 bp, Artificial Sequence
  Synthetic
gattactccgggtacgatgccagtctgagccccgtgtggtttgcctgtttgaagctactacttgagaagcttggg

SEQ ID NO: 74062 - DNA, 75 bp, Artificial Sequence
  Synthetic
gtgcgtggtggaatgccatcaggttgctctggtaccagcattttcaattcaatgatcaacaacatcataatcagg

SEQ ID NO: 74063 - DNA, 75 bp, Artificial Sequence
  Synthetic
tttgaagaggtatttcagagcggatgagcaataccctttcctggtccatcctgttatgccaatgaaagacattca

SEQ ID NO: 74064 - DNA, 75 bp, Artificial Sequence
  Synthetic
caatggagagcacgactatgaggaattcatcaagaagatcagaagcgtcccagttggccgctgtctaacattacc

SEQ ID NO: 74065 - DNA, 75 bp, Artificial Sequence
  Synthetic
aattggcttaaccctaccacactcaccgaactagacaacggtgtggtaggggtaaattctccgcattcggtgcgg

SEQ ID NO: 74066 - DNA, 75 bp, Artificial Sequence
  Synthetic
ttaaaacagcctgtgggttgatcccacccacagggcccattgggcgtcagcaccctggtatcacggtacctttgt

SEQ ID NO: 74067 - DNA, 75 bp, Artificial Sequence
  Synthetic
tgtgctagatgccaaggagctagtagacaaggacggcaccaacttagaactgacactactcaaattgaaccggaa

SEQ ID NO: 74068 - DNA, 75 bp, Artificial Sequence
  Synthetic
ctattgaacaccgcaaaatgggagctcaggtgtccacccagaaaaccggagcccatgagactgggctgaatgcca

SEQ ID NO: 74069 - DNA, 75 bp, Artificial Sequence
  Synthetic
tcaggtgtccacccagaaaaccggagcccatgagactgggctgaatgccagtggaaactccatcatccactacac

SEQ ID NO: 74070 - DNA, 75 bp, Artificial Sequence
  Synthetic
taccgaacccgtcaaagatatcatgataaagacaatgccagccctcaactccccctccgctgaggaatgtggtta

SEQ ID NO: 74071 - DNA, 75 bp, Artificial Sequence
  Synthetic
ataaagacaatgccagccctcaactccccctccgctgaggaatgtggttacagtgatagagtcagatcactcacg

SEQ ID NO: 74072 - DNA, 75 bp, Artificial Sequence
  Synthetic
agagacgatgaggccactgcggaggaccagccgacccaacccgatgtagccacatgtaggttctacacattggaa

SEQ ID NO: 74073 - DNA, 75 bp, Artificial Sequence
  Synthetic
accagccgacccaacccgatgtagccacatgtaggttctacacattggaatctgtacaatgggagaagaactcag

SEQ ID NO: 74074 - DNA, 75 bp, Artificial Sequence
  Synthetic
tgggcagggcggggtataccattcacgtgcaatgcaatgcatctaaattccatcagggatgcttgttagtcgtct

SEQ ID NO: 74075 - DNA, 75 bp, Artificial Sequence
  Synthetic
cgtgcaatgcaatgcatctaaattccatcagggatgcttgttagtcgtctgtgtgcctgaggctgagatggggtg

SEQ ID NO: 74076 - DNA, 75 bp, Artificial Sequence
  Synthetic
aactaccggccaacacacagtgcagtcgattgtgtgtaatgcaggaatgggagtgggcgtaggcaatctaaccat

SEQ ID NO: 74077 - DNA, 75 bp, Artificial Sequence
  Synthetic
tcgattgtgtgtaatgcaggaatgggagtgggcgtaggcaatctaaccatttaccctcaccagtggattaacttg

SEQ ID NO: 74078 - DNA, 75 bp, Artificial Sequence
  Synthetic
aatttcaccctcatggtcataccttttgcaccactagattacgcagcacaagcttcggagtatgtaccagtgacg

SEQ ID NO: 74079 - DNA, 75 bp, Artificial Sequence
  Synthetic
ttgcaccactagattacgcagcacaagcttcggagtatgtaccagtgacggtcaccattgcacccatgtgtgcgg

SEQ ID NO: 74080 - DNA, 75 bp, Artificial Sequence
  Synthetic
cttccgatgatttccaatccccgtcggctatgccccaatttgatgtaacaccacacatggatattccaggcgaag

SEQ ID NO: 74081 - DNA, 75 bp, Artificial Sequence
  Synthetic
ggctatgccccaatttgatgtaacaccacacatggatattccaggcgaagtacacaacctaatggagattgcaga

SEQ ID NO: 74082 - DNA, 75 bp, Artificial Sequence
  Synthetic
taccgggaaccaccagggggaaaagatttttgcgttccaaatgcagccggggttagagtctgttttcaagagaac

SEQ ID NO: 74083 - DNA, 75 bp, Artificial Sequence
  Synthetic
atttttgcgttccaaatgcagccggggttagagtctgttttcaagagaacccttatgggggagattcttaattat

SEQ ID NO: 74084 - DNA, 75 bp, Artificial Sequence
  Synthetic
ttagcgtattcaccaccaggtgctgatgtgcccgcgaccaggaaacaggcgatgttaggcacacacatgatttgg

SEQ ID NO: 74085 - DNA, 75 bp, Artificial Sequence
  Synthetic
atgtgcccgcgaccaggaaacaggcgatgttaggcacacacatgatttgggatatcgggcttcagtcgagctgtg

SEQ ID NO: 74086 - DNA, 75 bp, Artificial Sequence
  Synthetic
tgacgtgttggtaccaaacaggaatagtggtgccccctggcactccaaataagtgtgtagtgctttgttttgcat

SEQ ID NO: 74087 - DNA, 75 bp, Artificial Sequence
  Synthetic
agtggtgccccctggcactccaaataagtgtgtagtgctttgttttgcatcagcttgtaatgatttctcagttcg

SEQ ID NO: 74088 - DNA, 75 bp, Artificial Sequence
  Synthetic
aatcgccagggtagcagatacggtggcgagcggtcctagtaattcgaccagtatcccagcactcacagcagttga

SEQ ID NO: 74089 - DNA, 75 bp, Artificial Sequence
  Synthetic
gcgagcggtcctagtaattcgaccagtatcccagcactcacagcagttgagacaggtcacacgtcacaagtcgag

SEQ ID NO: 74090 - DNA, 75 bp, Artificial Sequence
  Synthetic
agtcgctccgcttgtgtgtacatcgaagagtactacaccaaggaccaagacaatgttaataggtacatgtcgtgg

SEQ ID NO: 74091 - DNA, 75 bp, Artificial Sequence
  Synthetic
gtacttaacacgttgaaatgggggcacaggtctcaacacaaaagacgggtgcgcacgaaactggcttaactgcta

SEQ ID NO: 74092 - DNA, 75 bp, Artificial Sequence
  Synthetic
aagagtactacaccaaggaccaagacaatgttaataggtacatgtcgtggacaataaatgccagaagaatggtgc

SEQ ID NO: 74093 - DNA, 75 bp, Artificial Sequence
  Synthetic
acaggtctcaacacaaaagacgggtgcgcacgaaactggcttaactgctaatgggaattctgttatacactacac

SEQ ID NO: 74094 - DNA, 75 bp, Artificial Sequence
  Synthetic
aactacctgggactagcatagcacaagatatgccgccactcacccaccagatcatgtacataccaccaggtggcc

SEQ ID NO: 74095 - DNA, 75 bp, Artificial Sequence
  Synthetic
tacagaacctgtcaaggatataatgatcaagtccatgccagcactcaattcgcctacagcggaagagtgtgggta

SEQ ID NO: 74096 - DNA, 75 bp, Artificial Sequence
  Synthetic
agatatgccgccactcacccaccagatcatgtacataccaccaggtggcccggtaccaaacagcgtaacagattt

SEQ ID NO: 74097 - DNA, 75 bp, Artificial Sequence
  Synthetic
atcaagtccatgccagcactcaattcgcctacagcggaagagtgtgggtacagtgatagagtgcggtctattaca

SEQ ID NO: 74098 - DNA, 75 bp, Artificial Sequence
  Synthetic
catcagtattggcaatgcatatagcaacttctatgacgggtggtcacacttttcccaaaacggtgtgtacggata

SEQ ID NO: 74099 - DNA, 75 bp, Artificial Sequence
  Synthetic
aaggatgatgaagcgacagccgaagaccaaccaacacaaccagacgtggctacatgtaggttctataccctagaa

SEQ ID NO: 74100 - DNA, 75 bp, Artificial Sequence
  Synthetic
aacttctatgacgggtggtcacacttttcccaaaacggtgtgtacggatacaacgccctgaacaacatgggcaag

SEQ ID NO: 74101 - DNA, 75 bp, Artificial Sequence
  Synthetic
accaaccaacacaaccagacgtggctacatgtaggttctataccctagaatcagttcattgggagaaagagtcag

SEQ ID NO: 74102 - DNA, 75 bp, Artificial Sequence
  Synthetic
cacatccgagtatgggtcccacggccgcctcgactgagcccgtacatcaaatcaagtaatgtaaattttaacccc

SEQ ID NO: 74103 - DNA, 75 bp, Artificial Sequence
  Synthetic
tggggcggtccggatatactattcacgtgcaatgcaacgcgtccaagtttcaccaagggtgtctgttggtggttt

SEQ ID NO: 74104 - DNA, 75 bp, Artificial Sequence
  Synthetic
cgcctcgactgagcccgtacatcaaatcaagtaatgtaaattttaaccccacgaacctgacggacgagcggtcat

SEQ ID NO: 74105 - DNA, 75 bp, Artificial Sequence
  Synthetic
cgtgcaatgcaacgcgtccaagtttcaccaagggtgtctgttggtggtttgcgtccccgaggctgaaatggggtg

SEQ ID NO: 74106 - DNA, 75 bp, Artificial Sequence
  Synthetic
tgtatgttggcagttatagagtggtcaatagacacctagccacacacaatgactggcagaactgtgtgtgggaag

SEQ ID NO: 74107 - DNA, 75 bp, Artificial Sequence
  Synthetic
agtgtcaggtgaacacaaagtgcaagccaaggtctgtaacgctggcatgggtgtgggagtaggcaacctgactat

SEQ ID NO: 74108 - DNA, 75 bp, Artificial Sequence
  Synthetic
caatagacacctagccacacacaatgactggcagaactgtgtgtgggaagactacaacagagacctccttgtgag

SEQ ID NO: 74109 - DNA, 75 bp, Artificial Sequence
  Synthetic
gccaaggtctgtaacgctggcatgggtgtgggagtaggcaacctgactatatacccgcatcaatggatcaacctc

SEQ ID NO: 74110 - DNA, 75 bp, Artificial Sequence
  Synthetic
aaacaaacattacccagtaagctttgaggggccaggcctcgtggaagtccaggaaagtgagtactacccgaaaag

SEQ ID NO: 74111 - DNA, 75 bp, Artificial Sequence
  Synthetic
aacttcacccttatgatcatcccgttcgccaggctggactacactgacacggcctcgtatgtgcccatcacagtt

SEQ ID NO: 74112 - DNA, 75 bp, Artificial Sequence
  Synthetic
tcgccaggctggactacactgacacggcctcgtatgtgcccatcacagttacaattgcccccatgtgcgccgaat

SEQ ID NO: 74113 - DNA, 75 bp, Artificial Sequence
  Synthetic
gtggtgggatactcagatgtgaacacggtgtcgttggtatcgtcactatgggtggtgagggcgtggttggctttg

SEQ ID NO: 74114 - DNA, 75 bp, Artificial Sequence
  Synthetic
cctccgatgatttccaatcaccgtgtgccatgccccaattcgatgttacccccgaaatgcacattccaggagaag

SEQ ID NO: 74115 - DNA, 75 bp, Artificial Sequence
  Synthetic
tgccatgccccaattcgatgttacccccgaaatgcacattccaggagaagttcgcaacttaatggaaattgctga

SEQ ID NO: 74116 - DNA, 75 bp, Artificial Sequence
  Synthetic
gcaatgcctttggttcgggcttcaccaatcaaatatgtgagcaagtcaacctcttgaaagagtcactagtgggtc

SEQ ID NO: 74117 - DNA, 75 bp, Artificial Sequence
  Synthetic
gtgtttcaataaacagggtgggcaagtttttggcttccggatgcaaccgggcaaagagacagtgtttaagagaac

SEQ ID NO: 74118 - DNA, 75 bp, Artificial Sequence
  Synthetic
gtttttggcttccggatgcaaccgggcaaagagacagtgtttaagagaacactactaggagagatattaaactac

SEQ ID NO: 74119 - DNA, 75 bp, Artificial Sequence
  Synthetic
acgatgacttaatcacggtgactgccacactagccctcattggttgtacctcgtccccatggcggtggctcaaac

SEQ ID NO: 74120 - DNA, 75 bp, Artificial Sequence
  Synthetic
agaaagtgtcccaatattacggaatacccatggctgaacgccaaaataacggatggcttaagaagttcactgaga

SEQ ID NO: 74121 - DNA, 75 bp, Artificial Sequence
  Synthetic
ctggcgtactcaccccctggtgcgaacccaccctcaactcgcaaagaagcgatgcttggtactcatgttgtgtgg

SEQ ID NO: 74122 - DNA, 75 bp, Artificial Sequence
  Synthetic
acccaccctcaactcgcaaagaagcgatgcttggtactcatgttgtgtgggatgtgggactacagtctagttgtg

SEQ ID NO: 74123 - DNA, 75 bp, Artificial Sequence
  Synthetic
acccatggctgaacgccaaaataacggatggcttaagaagttcactgagatgacaaacgcctgcaagggcatgga

SEQ ID NO: 74124 - DNA, 75 bp, Artificial Sequence
  Synthetic
tgtatttttgaataggcttaaacagctccccttattggagagtcagattgctacaatcgaacaaagtgcgccatc

SEQ ID NO: 74125 - DNA, 75 bp, Artificial Sequence
  Synthetic
taacatgctggtaccaaacaggtatcgtcgtaccacccaacacaccaacacaatgcaccattttgtgtttcattt

SEQ ID NO: 74126 - DNA, 75 bp, Artificial Sequence
  Synthetic
cgtcgtaccacccaacacaccaacacaatgcaccattttgtgtttcatttcagcatgcaatgatttttccgtccg

SEQ ID NO: 74127 - DNA, 75 bp, Artificial Sequence
  Synthetic
ctccccttattggagagtcagattgctacaatcgaacaaagtgcgccatcccaaagtgatcaagaacaattgttt

SEQ ID NO: 74128 - DNA, 75 bp, Artificial Sequence
  Synthetic
tcccttgagaagaagatgagtaactacatacagttcaagtccaaatgccgtattgaacccgtatgtctgctcttg

SEQ ID NO: 74129 - DNA, 75 bp, Artificial Sequence
  Synthetic
cattgtgagggtagccgacaccatccagcgcggtcccagcaattcagagcagataccagccttaactgcgactga

SEQ ID NO: 74130 - DNA, 75 bp, Artificial Sequence
  Synthetic
cagcgcggtcccagcaattcagagcagataccagccttaactgcgactgaaacgggacacacatcacaggttacg

SEQ ID NO: 74131 - DNA, 75 bp, Artificial Sequence
  Synthetic
tcagtgtattcactacccccggatccggatcactttgacggttacaaacagcaagctgtggtaatcatggatgat

SEQ ID NO: 74132 - DNA, 75 bp, Artificial Sequence
  Synthetic
cggatcactttgacggttacaaacagcaagctgtggtaatcatggatgatctgtgccaaaaccccgatgggaaag

SEQ ID NO: 74133 - DNA, 75 bp, Artificial Sequence
  Synthetic
agcagatcagcgtgcgtgtatattgataattataccagcaatgatgtaaccaaagtggataagtttctgacatgg

SEQ ID NO: 74134 - DNA, 75 bp, Artificial Sequence
  Synthetic
ataattataccagcaatgatgtaaccaaagtggataagtttctgacatggacaataaacacaagacaaatggtac

SEQ ID NO: 74135 - DNA, 75 bp, Artificial Sequence
  Synthetic
ttctattcacctccccatttgtcttagcatcgaccaatgcagggtctataaacgccccgactgtgtcagacagta

SEQ ID NO: 74136 - DNA, 75 bp, Artificial Sequence
  Synthetic
agcatcgaccaatgcagggtctataaacgccccgactgtgtcagacagtagagccttggccaggaggtttcactt

SEQ ID NO: 74137 - DNA, 75 bp, Artificial Sequence
  Synthetic
agggccaaggaaccgaccacagccaggatgcccctgtgttcacgcaccaagtgatgtatgtaccaccaggtggtc

SEQ ID NO: 74138 - DNA, 75 bp, Artificial Sequence
  Synthetic
ggatgcccctgtgttcacgcaccaagtgatgtatgtaccaccaggtggtcccgtcccaaagagtgttgatgattt

SEQ ID NO: 74139 - DNA, 75 bp, Artificial Sequence
  Synthetic
tgatgaagagtgctgtccagtcaactttaagaggtgttgccccctagtgtgtggaaaggccattcagtttataga

SEQ ID NO: 74140 - DNA, 75 bp, Artificial Sequence
  Synthetic
cataagtataggcaatgcatatagcaacttctacgatggttggtcacacttctcgcaaaatggggtgtacggata

SEQ ID NO: 74141 - DNA, 75 bp, Artificial Sequence
  Synthetic
aacttctacgatggttggtcacacttctcgcaaaatggggtgtacggatacaacacattaaacaacatgggtaag

SEQ ID NO: 74142 - DNA, 75 bp, Artificial Sequence
  Synthetic
cttgacatgttagtgaccgagatgttcagggaatataaccacaggcacagtgtcggggccacccttgaagcgcta

SEQ ID NO: 74143 - DNA, 75 bp, Artificial Sequence
  Synthetic
cacattcgggcctgggtccccagacctccgagattgtgtgaatatgtgaagtcaagcaacgttggattcacccca

SEQ ID NO: 74144 - DNA, 75 bp, Artificial Sequence
  Synthetic
gatctgctcaaatcggtggacagtgaggctgtgagagagtactgcaaagaaaagggatggttggtccccgaggtc

SEQ ID NO: 74145 - DNA, 75 bp, Artificial Sequence
  Synthetic
ctccgagattgtgtgaatatgtgaagtcaagcaacgttggattcaccccagcaaatattacggatggaaggacca

SEQ ID NO: 74146 - DNA, 75 bp, Artificial Sequence
  Synthetic
gtagcaggaattatttacataatatacaaactttttgcaggctttcaaggagcatacacaggaatacctaaccaa

SEQ ID NO: 74147 - DNA, 75 bp, Artificial Sequence
  Synthetic
tgtatgtgggcaactacaaactggttaacaggcatcttgcaacgcacaatgactggcagaactgcgtgtgggagg

SEQ ID NO: 74148 - DNA, 75 bp, Artificial Sequence
  Synthetic
acaaactttttgcaggctttcaaggagcatacacaggaatacctaaccaaaaacccaaggtacctactcttaggc

SEQ ID NO: 74149 - DNA, 75 bp, Artificial Sequence
  Synthetic
taacaggcatcttgcaacgcacaatgactggcagaactgcgtgtgggaggattacaacagggacctactagttag

SEQ ID NO: 74150 - DNA, 75 bp, Artificial Sequence
  Synthetic
agtatggtgagtttactatgctgggcatctatgacaagtgggccgttttgccacgccatgctaaacctggaccaa

SEQ ID NO: 74151 - DNA, 75 bp, Artificial Sequence
  Synthetic
aaacaaacactacccggttgtctttgagggtccaggtctcgttgaagtccaagaaagtgaatactacccaaagag

SEQ ID NO: 74152 - DNA, 75 bp, Artificial Sequence
  Synthetic
catctatgacaagtgggccgttttgccacgccatgctaaacctggaccaaccatcctgatgaatgaccaagaggt

SEQ ID NO: 74153 - DNA, 75 bp, Artificial Sequence
  Synthetic
gagggtccaggtctcgttgaagtccaagaaagtgaatactacccaaagagataccagtcccatgtactacttgcc

SEQ ID NO: 74154 - DNA, 75 bp, Artificial Sequence
  Synthetic
gaatgagaagttcagagacatcagaggcttcttggctaaggaggaagtggaagtcaacgaggctgtgctggcaat

SEQ ID NO: 74155 - DNA, 75 bp, Artificial Sequence
  Synthetic
ggtggtgaaggcgtcgtcggcttcgctgatgtgcgagatctcctatggttagaagatgatgcaatggaacagggc

SEQ ID NO: 74156 - DNA, 75 bp, Artificial Sequence
  Synthetic
ggcttcttggctaaggaggaagtggaagtcaacgaggctgtgctggcaataaacactagcaagtttcctaacatg

SEQ ID NO: 74157 - DNA, 75 bp, Artificial Sequence
  Synthetic
ctgatgtgcgagatctcctatggttagaagatgatgcaatggaacagggcgttaaaggctacgtcgagcaattag

SEQ ID NO: 74158 - DNA, 75 bp, Artificial Sequence
  Synthetic
tataacttccccacaagagcaggccagtgtggcggggtactcatgtccactggcaaagttttgggaatccatgtt

SEQ ID NO: 74159 - DNA, 75 bp, Artificial Sequence
  Synthetic
aagattccatcttggaaaagtcgcttaaggccctagtaaaaatcatatcagcactagtcattgtggtaaggaatc

SEQ ID NO: 74160 - DNA, 75 bp, Artificial Sequence
  Synthetic
agtgtggcggggtactcatgtccactggcaaagttttgggaatccatgttggtggaaatggccatcaaggcttct

SEQ ID NO: 74161 - DNA, 75 bp, Artificial Sequence
  Synthetic
taaggccctagtaaaaatcatatcagcactagtcattgtggtaaggaatcatgacgacttaatcacagtgacagc

SEQ ID NO: 74162 - DNA, 75 bp, Artificial Sequence
  Synthetic
ggttcccaatcattaacacacccagtaaaaccaagctggagccaagtgtcttccaccaagtatttgaaggcaaca

SEQ ID NO: 74163 - DNA, 75 bp, Artificial Sequence
  Synthetic
tcccatggcagagaggcaaaataacggctggctaaaaaagttcacggaaatgacaaatgcatgcaagggcatgga

SEQ ID NO: 74164 - DNA, 75 bp, Artificial Sequence
  Synthetic
ttgggaatgtcaacacacacatagatgaatacatgttggaggctgttgaccattatgccggacaattggccaccc

SEQ ID NO: 74165 - DNA, 75 bp, Artificial Sequence
  Synthetic
cgaattcctgaacaggctaaaacagttgcccctgctggaaagccagattgccaccatcgagcagagtgcaccttc

SEQ ID NO: 74166 - DNA, 75 bp, Artificial Sequence
  Synthetic
gaaggccttgaagctcttgacttaacaacaagtgcaggctacccctatgtcgcactgggtatcaagaagagagac

SEQ ID NO: 74167 - DNA, 75 bp, Artificial Sequence
  Synthetic
caacaagtgcaggctacccctatgtcgcactgggtatcaagaagagagacatcctctcgaagaagaccaaggacc

SEQ ID NO: 74168 - DNA, 75 bp, Artificial Sequence
  Synthetic
tgccgctgaggcaaagagggttttctccctagagaagaagatgagcaactacatacagttcaagtccaaatgccg

SEQ ID NO: 74169 - DNA, 75 bp, Artificial Sequence
  Synthetic
tccctagagaagaagatgagcaactacatacagttcaagtccaaatgccgcattgaacctgtctgcttgctgctc

SEQ ID NO: 74170 - DNA, 75 bp, Artificial Sequence
  Synthetic
taagtatggcctgaatctaccaatggtgacatacgtgaaagatgaactcagatctgcagagaaagtagcaaaagg

SEQ ID NO: 74171 - DNA, 75 bp, Artificial Sequence
  Synthetic
gaaatccaggctcattgaagcgtccagcttgaacgactcagtggcgatgaggcagacattcggcaatctgtacaa

SEQ ID NO: 74172 - DNA, 75 bp, Artificial Sequence
  Synthetic
tcagtgtactccctaccaccagaccctgatcactttgatggctataaacaacaagctgttgtgatcatggatgat

SEQ ID NO: 74173 - DNA, 75 bp, Artificial Sequence
  Synthetic
gtgacaggtagtgccgttgggtgtgacccggatctattttggagcaagatacctgtgatgttggatgggcatctc

SEQ ID NO: 74174 - DNA, 75 bp, Artificial Sequence
  Synthetic
acgtgtcactgttctgccaaatggtatcaagtgtcgacttcgtcccgcccatggcggcgctagaagagaaaggca

SEQ ID NO: 74175 - DNA, 75 bp, Artificial Sequence
  Synthetic
gagccttggccagaaggttccactttgacatgaatattgaagtcatctcaatgtacagccagaatggaaagatca

SEQ ID NO: 74176 - DNA, 75 bp, Artificial Sequence
  Synthetic
atgtacagccagaatggaaagatcaatatgccaatgtcagtgaagacctgtgatgaggagtgttgcccagtcaac

SEQ ID NO: 74177 - DNA, 75 bp, Artificial Sequence
  Synthetic
cctcaggatgttccggtaccagtatatttaactcaatgataaataacatcatcattaggactctcatgctaaaag

SEQ ID NO: 74178 - DNA, 75 bp, Artificial Sequence
  Synthetic
atttaactcaatgataaataacatcatcattaggactctcatgctaaaagtgtataagggaattgacctggacca

SEQ ID NO: 74179 - DNA, 75 bp, Artificial Sequence
  Synthetic
ctagacatgctcgtaactgagatgttcagggagtacaatcacaggcatagtgtgggggcaacactcgaggcactc

SEQ ID NO: 74180 - DNA, 75 bp, Artificial Sequence
  Synthetic
ggccggcaaagactatggattggttatgacaccagcagataaaggggagtgcttcaacgaagtcacctggaccaa

SEQ ID NO: 74181 - DNA, 75 bp, Artificial Sequence
  Synthetic
gcttcaacgaagtcacctggaccaatgtcacatttctaaagaggtattttagagcagatgagcaatatcccttcc

SEQ ID NO: 74182 - DNA, 75 bp, Artificial Sequence
  Synthetic
accacgtgcgctcgctgtgtctattggcctggcacaatggggagcacgagtatgaggagttcatccgcaagatca

SEQ ID NO: 74183 - DNA, 75 bp, Artificial Sequence
  Synthetic
gtggcagggatcatatacatcatttacaagttatttgcaggattccagggagcttacactggtatgcccaaccaa

SEQ ID NO: 74184 - DNA, 75 bp, Artificial Sequence
  Synthetic
tgaattggcttaaccctactgcactaaccgaactagataacggcgcagtaggggtaaattctccgcattcggtgc

SEQ ID NO: 74185 - DNA, 75 bp, Artificial Sequence
  Synthetic
cggaacgccagtaccgtaaagactgagtatggggagtttacaatgcttggcatttatgatagatgggcagtgcta

SEQ ID NO: 74186 - DNA, 75 bp, Artificial Sequence
  Synthetic
catttatgatagatgggcagtgctaccccggcatgccaaacctggacctaccattctaatgaatgatcaggtagt

SEQ ID NO: 74187 - DNA, 75 bp, Artificial Sequence
  Synthetic
cacccacagggcccactgggcgctagcactctggtatcacggtacccttgtgcgcctgttttatatccccacccc

SEQ ID NO: 74188 - DNA, 75 bp, Artificial Sequence
  Synthetic
aaatgagaagttcagagacatccgaggcttcttgacacgtgaggaagctgaagttaatgaggctgtacttgccat

SEQ ID NO: 74189 - DNA, 75 bp, Artificial Sequence
  Synthetic
tgtgaccccggactgagtatcaatagactgctcacgcggttgaaggagaaaacgttcgttacccggccagttact

SEQ ID NO: 74190 - DNA, 75 bp, Artificial Sequence
  Synthetic
actatggcttcctcaacctgggtggtacccccaccaaacgcatgctgatgtacaacttcccaacacgcgcaggtc

SEQ ID NO: 74191 - DNA, 75 bp, Artificial Sequence
  Synthetic
cagcagccttgttacgtcactatttcaatgatgagcagggtgagattgagtttatcgagagctccaaggaagcag

SEQ ID NO: 74192 - DNA, 75 bp, Artificial Sequence
  Synthetic
caatgatgagcagggtgagattgagtttatcgagagctccaaggaagcaggttttccagtcattaacacacctag

SEQ ID NO: 74193 - DNA, 75 bp, Artificial Sequence
  Synthetic
aactctgcagcggaaccgactactttgggtgtccgtgtttctttttattctcatattggctgcttatggtgacaa

SEQ ID NO: 74194 - DNA, 75 bp, Artificial Sequence
  Synthetic
cgagtacatgttggaggccgtcgaccactacgcaggacaactggcaaccctagatatcagcacagaacccatgaa

SEQ ID NO: 74195 - DNA, 75 bp, Artificial Sequence
  Synthetic
agtcaatacactctcatatatcgttacactcaacacaacaaaatgggggcacaagtgtccacgcagaaaactgga

SEQ ID NO: 74196 - DNA, 75 bp, Artificial Sequence
  Synthetic
acactcaacacaacaaaatgggggcacaagtgtccacgcagaaaactggagcacatgaaactggcatcacagcaa

SEQ ID NO: 74197 - DNA, 75 bp, Artificial Sequence
  Synthetic
tgcccttggcattaagaagagagacattctatccaagaagaccaaggacctaacaaagctgaaagagtgcatgga

SEQ ID NO: 74198 - DNA, 75 bp, Artificial Sequence
  Synthetic
atttctcgcaagatcctagcaagttcactgaaccgatgaaagacctaatggttaaaaccctacccgctctcaatt

SEQ ID NO: 74199 - DNA, 75 bp, Artificial Sequence
  Synthetic
cactgaaccgatgaaagacctaatggttaaaaccctacccgctctcaattcgccaacagtggaggagtgtgggta

SEQ ID NO: 74200 - DNA, 75 bp, Artificial Sequence
  Synthetic
caaatccaggttgattgaggcatcgagtctgaatgactcagtggccatgagacaaacttttgggaacttgtacaa

SEQ ID NO: 74201 - DNA, 75 bp, Artificial Sequence
  Synthetic
agtctgaatgactcagtggccatgagacaaacttttgggaacttgtacaaaacaatccatttgaacccaggcata

SEQ ID NO: 74202 - DNA, 75 bp, Artificial Sequence
  Synthetic
atacggtatctggccctcatatctggcagataatgaggccactgccgaagatcaaccaacacaaccagacgtggc

SEQ ID NO: 74203 - DNA, 75 bp, Artificial Sequence
  Synthetic
gcagataatgaggccactgccgaagatcaaccaacacaaccagacgtggctacttgccgcttttataccctggac

SEQ ID NO: 74204 - DNA, 75 bp, Artificial Sequence
  Synthetic
attgcctttgactacagtgggtatgatgccagcctgagcccagtgtggtttgcttgcctgaaactactgttagag

SEQ ID NO: 74205 - DNA, 75 bp, Artificial Sequence
  Synthetic
atgccagcctgagcccagtgtggtttgcttgcctgaaactactgttagagaagttagggtactcgcacaaagaga

SEQ ID NO: 74206 - DNA, 75 bp, Artificial Sequence
  Synthetic
ggacagaacatgctttaccactacctggggcgtaccggttacactatacacgtacaatgcaatgcatcaaaattc

SEQ ID NO: 74207 - DNA, 75 bp, Artificial Sequence
  Synthetic
tggggcgtaccggttacactatacacgtacaatgcaatgcatcaaaattccatcaaggctgcttgcttgtcgtgt

SEQ ID NO: 74208 - DNA, 75 bp, Artificial Sequence
  Synthetic
catccggatgttcagggactagcatctttaattcaatgatcaacaacatcatcatcagaacactgatgttgaagg

SEQ ID NO: 74209 - DNA, 75 bp, Artificial Sequence
  Synthetic
ctttaattcaatgatcaacaacatcatcatcagaacactgatgttgaaggtgtacaaaggaatagacttggacca

SEQ ID NO: 74210 - DNA, 75 bp, Artificial Sequence
  Synthetic
acgcatccatgttcacacctgacgtaagcacgcaaggcattcaaacttatgtgtgcaacgcaggaatgggtgtgg

SEQ ID NO: 74211 - DNA, 75 bp, Artificial Sequence
  Synthetic
aagcacgcaaggcattcaaacttatgtgtgcaacgcaggaatgggtgtggctgttggcaacctcaccatatttcc

SEQ ID NO: 74212 - DNA, 75 bp, Artificial Sequence
  Synthetic
agccggtaaagagtatggcctgatcatgacaccagccgataagggggaatgcttcaatgaagtgacatggaccaa

SEQ ID NO: 74213 - DNA, 75 bp, Artificial Sequence
  Synthetic
atgacaccagccgataagggggaatgcttcaatgaagtgacatggaccaacgtcactttcttgaaaagatacttt

SEQ ID NO: 74214 - DNA, 75 bp, Artificial Sequence
  Synthetic
caatctataccgtcattacaacttcacactaatggtgatcccatttgccaacttagactatgcagccggctcatc

SEQ ID NO: 74215 - DNA, 75 bp, Artificial Sequence
  Synthetic
acactaatggtgatcccatttgccaacttagactatgcagccggctcatcaaccaaggtccccatcaccataaca

SEQ ID NO: 74216 - DNA, 75 bp, Artificial Sequence
  Synthetic
actaaagatcccaaaaatactcaggatcatgtgcgctccttatgcctattggcttggcataatggagagcaagaa

SEQ ID NO: 74217 - DNA, 75 bp, Artificial Sequence
  Synthetic
ggtagtaaccaatttttgacatcggatgactaccaatccccatctgctatgcctcagtttgacgtgactcctgag

SEQ ID NO: 74218 - DNA, 75 bp, Artificial Sequence
  Synthetic
atgactaccaatccccatctgctatgcctcagtttgacgtgactcctgagatgaggataccaggggaggtccgta

SEQ ID NO: 74219 - DNA, 75 bp, Artificial Sequence
  Synthetic
cgcaggaaatggctagattctttttgaattagagcacaatttgatttgattctaattggcttaaccctaccgcac

SEQ ID NO: 74220 - DNA, 75 bp, Artificial Sequence
  Synthetic
gaattagagcacaatttgatttgattctaattggcttaaccctaccgcactcaccgaaccagacaacagtgcggt

SEQ ID NO: 74221 - DNA, 75 bp, Artificial Sequence
  Synthetic
cctatgccatcccggtccaaacaggaaagacaaagaaacaggcatttggtttcaagttacaaccaggagctgact

SEQ ID NO: 74222 - DNA, 75 bp, Artificial Sequence
  Synthetic
aaagacaaagaaacaggcatttggtttcaagttacaaccaggagctgactcagtattcaagcacaccttactggg

SEQ ID NO: 74223 - DNA, 75 bp, Artificial Sequence
  Synthetic
accaactgggtttagaccaagcacttctgttaccccggaccgagtatcaataagctgctcgcgcggctgaaggag

SEQ ID NO: 74224 - DNA, 75 bp, Artificial Sequence
  Synthetic
cactggaaagtttctgttggcctattccccaccaggagcaggggtacctgggagcagaaaggaagccatgcttgg

SEQ ID NO: 74225 - DNA, 75 bp, Artificial Sequence
  Synthetic
tccccaccaggagcaggggtacctgggagcagaaaggaagccatgcttggaacacatgtagtttgggacataggg

SEQ ID NO: 74226 - DNA, 75 bp, Artificial Sequence
  Synthetic
aaaacgttcgttacccggccaattacttcgagaaacctagtaccaccatggaggttgcgcagcgtttcgctccgc

SEQ ID NO: 74227 - DNA, 75 bp, Artificial Sequence
  Synthetic
accgatgcaggatacataacgtgttggtaccaaactagcatagtggtaccagtggatgttgccaccaccagcaaa

SEQ ID NO: 74228 - DNA, 75 bp, Artificial Sequence
  Synthetic
ggtaccaaactagcatagtggtaccagtggatgttgccaccaccagcaaaattttgtgttttgtgtcagcgtgta

SEQ ID NO: 74229 - DNA, 75 bp, Artificial Sequence
  Synthetic
acagggaaactgtgactgacactgcaccaagtgggcaaacaaattcaacgcgaataccagcactgacggcagcag

SEQ ID NO: 74230 - DNA, 75 bp, Artificial Sequence
  Synthetic
accaagtgggcaaacaaattcaacgcgaataccagcactgacggcagcagagacaggacacacctctcaagttgt

SEQ ID NO: 74231 - DNA, 75 bp, Artificial Sequence
  Synthetic
aattgagaaattgttaccatatagctattggattggccatccagtgacaaacagagcaattgtttacctatttgt

SEQ ID NO: 74232 - DNA, 75 bp, Artificial Sequence
  Synthetic
tcttatactggctgcttatggtgacaattgagaaattgttaccatatagctattggattggccatccagtgacaa

SEQ ID NO: 74233 - DNA, 75 bp, Artificial Sequence
  Synthetic
gtgtagggcagcttgcgccacgattgtcacatacaacaccaatgtaagtgacaactttactagttggcgtattaa

SEQ ID NO: 74234 - DNA, 75 bp, Artificial Sequence
  Synthetic
gctcaggtatcgacacaaaagactggagcgcatgagactggtttgagcgctagtgggaactcaatcatccattac

SEQ ID NO: 74235 - DNA, 75 bp, Artificial Sequence
  Synthetic
gtcacatacaacaccaatgtaagtgacaactttactagttggcgtattaacacgagagaggtagctcaactcagg

SEQ ID NO: 74236 - DNA, 75 bp, Artificial Sequence
  Synthetic
actaacatcaattactacaaagactcagcctccaactcattgaaccggcaagatttcactcaagatcccagcaaa

SEQ ID NO: 74237 - DNA, 75 bp, Artificial Sequence
  Synthetic
gggaccaaccaagctgcggacaactcagtattgacccatcaaatcatgtatgtgccacctggaggcccaatccct

SEQ ID NO: 74238 - DNA, 75 bp, Artificial Sequence
  Synthetic
tgattaagaccttgccagctttaaattcacccaccgttgaagaatgcggttacagtgaccgggtgcgttcgatca

SEQ ID NO: 74239 - DNA, 75 bp, Artificial Sequence
  Synthetic
ttcacccaccgttgaagaatgcggttacagtgaccgggtgcgttcgatcactttggggaattctacaattaccac

SEQ ID NO: 74240 - DNA, 75 bp, Artificial Sequence
  Synthetic
cagtattgacccatcaaatcatgtatgtgccacctggaggcccaatccctaacaaggtcgacgattattgttggc

SEQ ID NO: 74241 - DNA, 75 bp, Artificial Sequence
  Synthetic
taggcaatgcatatagtatgttctatgacgggtggtcacacttctcccagactggcctgtatggatacacatccc

SEQ ID NO: 74242 - DNA, 75 bp, Artificial Sequence
  Synthetic
ggatcaaccgacacagcctgatgtggcgacatgccgcttttacacccttgagtcagtgaagtgggagagttcatc

SEQ ID NO: 74243 - DNA, 75 bp, Artificial Sequence
  Synthetic
tgacgggtggtcacacttctcccagactggcctgtatggatacacatccctcaataacatgggacaacttttttt

SEQ ID NO: 74244 - DNA, 75 bp, Artificial Sequence
  Synthetic
agcagggtggtggtggaagttcccggaagctcttagcgacatgggactgtttggtcaaaacatgcaataccacta

SEQ ID NO: 74245 - DNA, 75 bp, Artificial Sequence
  Synthetic
agcatgggttccgcgccctccacgcctatgtgattacatgtacaaggccaatgtggacttcaagacacaggcagt

SEQ ID NO: 74246 - DNA, 75 bp, Artificial Sequence
  Synthetic
ctatgtgattacatgtacaaggccaatgtggacttcaagacacaggcagtgacggaccaacgcggagaccaccgg

SEQ ID NO: 74247 - DNA, 75 bp, Artificial Sequence
  Synthetic
gtgtgtgcccgaggccgaaatgggagcagccaccactgatcacgccatgaaccacacgaaactaagtaatatcgg

SEQ ID NO: 74248 - DNA, 75 bp, Artificial Sequence
  Synthetic
gcaaactacagggtggtcaacaggcacctggccactcacactgattggcagaactgcgtatgggaggactacaac

SEQ ID NO: 74249 - DNA, 75 bp, Artificial Sequence
  Synthetic
acctggccactcacactgattggcagaactgcgtatgggaggactacaacagggacctattggtcagcactacca

SEQ ID NO: 74250 - DNA, 75 bp, Artificial Sequence
  Synthetic
gggcgtggctgtggggaacctgacaatattccctcatcagtggatcaacttgcgcaccaataacagcgcaacaat

SEQ ID NO: 74251 - DNA, 75 bp, Artificial Sequence
  Synthetic
tgcgcaccaataacagcgcaacaatagtgatgccctatataaatagtgtgcctatggacaacatgtacaggcatt

SEQ ID NO: 74252 - DNA, 75 bp, Artificial Sequence
  Synthetic
actatccagtttcatttgagggtccgggtcttgtcgaggtccaagaaagtgagtattaccctaaaagataccaat

SEQ ID NO: 74253 - DNA, 75 bp, Artificial Sequence
  Synthetic
gggtcttgtcgaggtccaagaaagtgagtattaccctaaaagataccaatcccacgtgctgctcgctgcggggtt

SEQ ID NO: 74254 - DNA, 75 bp, Artificial Sequence
  Synthetic
ccgttactgtggctcccatgtgcgccgagtataacgggctgcgcttagccggtcaccagggtctgcccacaatga

SEQ ID NO: 74255 - DNA, 75 bp, Artificial Sequence
  Synthetic
gggtgtggttggctttgctgatgtgcgtgatctcttgtggctagaggatgatgcaatggagcagggagtgaagga

SEQ ID NO: 74256 - DNA, 75 bp, Artificial Sequence
  Synthetic
cgtgatctcttgtggctagaggatgatgcaatggagcagggagtgaaggactatgtggaacaacttggtaatgct

SEQ ID NO: 74257 - DNA, 75 bp, Artificial Sequence
  Synthetic
ctccggagattcaaataccaggtcaagtgaggaatttaatggaaatagctgaggtggattcggttgttcccgtaa

SEQ ID NO: 74258 - DNA, 75 bp, Artificial Sequence
  Synthetic
attctggagaaatcactgaaagccttagtaaaaataatttcagccttagtgattgtagtgaggaatcacgatgat

SEQ ID NO: 74259 - DNA, 75 bp, Artificial Sequence
  Synthetic
aagtttttggttttcagttgcaaccaggccatgacagcgtgctgaagcgcaccctccttggtgagatattaaatt

SEQ ID NO: 74260 - DNA, 75 bp, Artificial Sequence
  Synthetic
aggccatgacagcgtgctgaagcgcaccctccttggtgagatattaaattattacgccaactggtcagggagcat

SEQ ID NO: 74261 - DNA, 75 bp, Artificial Sequence
  Synthetic
tagtaaaaataatttcagccttagtgattgtagtgaggaatcacgatgatttaatcacggtgactgccacactgg

SEQ ID NO: 74262 - DNA, 75 bp, Artificial Sequence
  Synthetic
ctgaacgccaaaacaatggatggctaaagaagttcactgagatgacaaatgcttgtaagggtatggagtggatag

SEQ ID NO: 74263 - DNA, 75 bp, Artificial Sequence
  Synthetic
tggcgttcccgggagtaggaaagatgccatgcttgggacacacgtcatatgggacgttggcttacaatccagctg

SEQ ID NO: 74264 - DNA, 75 bp, Artificial Sequence
  Synthetic
taaacagactcaagcaactccccctgttagagagtcaaatcgccacaattgagcaaagtgcaccttcccagagtg

SEQ ID NO: 74265 - DNA, 75 bp, Artificial Sequence
  Synthetic
cattacttgctggtaccagacaagcattgtgacaccaccagacatacccaccacaagtaccatattgtgttttgt

SEQ ID NO: 74266 - DNA, 75 bp, Artificial Sequence
  Synthetic
gtccgcgtgcaacgatttctctgtgagactgttgcgtgacacgccatttataacgcaacaagctttgtaccaaaa

SEQ ID NO: 74267 - DNA, 75 bp, Artificial Sequence
  Synthetic
aagcaaagagagtgttctcccttgaaaagaagatgagtaattacatacagttcaagtccaaatgccgtattgaac

SEQ ID NO: 74268 - DNA, 75 bp, Artificial Sequence
  Synthetic
gcggtgggcagggtggctgacactatagccagtggccccgttaacactgagcaaattcctgcgttaacagcagtg

SEQ ID NO: 74269 - DNA, 75 bp, Artificial Sequence
  Synthetic
tagccagtggccccgttaacactgagcaaattcctgcgttaacagcagtggaaacagggcacacgtcacaagtgg

SEQ ID NO: 74270 - DNA, 75 bp, Artificial Sequence
  Synthetic
ttcaagtccaaatgccgtattgaacctgtatgtttgctcctgcacgggagccccggagctggtaagtcggtggcg

SEQ ID NO: 74271 - DNA, 75 bp, Artificial Sequence
  Synthetic
tttgacggctacaagcagcaggccgtggtgatcatggatgacctgtgtcagaaccctgatggaaaggatgtctcc

SEQ ID NO: 74272 - DNA, 75 bp, Artificial Sequence
  Synthetic
tggggagggcggcgtgcgtgtatatcgctcagtacgctacagaaaaggtcaacgacgagttagacaggtacacca

SEQ ID NO: 74273 - DNA, 75 bp, Artificial Sequence
  Synthetic
cgctcagtacgctacagaaaaggtcaacgacgagttagacaggtacaccaactgggagataacaacaagacaagt

SEQ ID NO: 74274 - DNA, 75 bp, Artificial Sequence
  Synthetic
tggtgatcatggatgacctgtgtcagaaccctgatggaaaggatgtctccctgttttgtcaaatggtttccagtg

SEQ ID NO: 74275 - DNA, 75 bp, Artificial Sequence
  Synthetic
ccaatgcagggtccatcaacgctccgacagtatcagacagtagggccttggcaaggagattccatttcgacatga

SEQ ID NO: 74276 - DNA, 75 bp, Artificial Sequence
  Synthetic
ctcccagcgtacttcaaccgtgtatgcgtcagactcccccccactaacgcatcaagtgatgtatgtaccaccagg

SEQ ID NO: 74277 - DNA, 75 bp, Artificial Sequence
  Synthetic
gacagtatcagacagtagggccttggcaaggagattccatttcgacatgaacatcgaagtcatttccatgtacag

SEQ ID NO: 74278 - DNA, 75 bp, Artificial Sequence
  Synthetic
accctagtgtgttctggacagagggcaatgcccctcccaggatgtcgataccattcatgagtgttggtaacgcat

SEQ ID NO: 74279 - DNA, 75 bp, Artificial Sequence
  Synthetic
gtgctgcccgctggtgtgcgggaaggccatccaattcatagacagaaaaacccaagttaggcactcccttgatat

SEQ ID NO: 74280 - DNA, 75 bp, Artificial Sequence
  Synthetic
gccatccaattcatagacagaaaaacccaagttaggcactcccttgatatgctagtgactgagatgtttagggaa

SEQ ID NO: 74281 - DNA, 75 bp, Artificial Sequence
  Synthetic
gggtatactaccttgaacaacatggggcacctgtattttagacacgtgaacaaatcgactgcatatccagtcgac

SEQ ID NO: 74282 - DNA, 75 bp, Artificial Sequence
  Synthetic
attagtgtggcaccagaaacaccgccgccaccagccattgcagatttgcttaaatcagtggatagcgaggctgtg

SEQ ID NO: 74283 - DNA, 75 bp, Artificial Sequence
  Synthetic
cgccaccagccattgcagatttgcttaaatcagtggatagcgaggctgtgagggagtattgcaaagaaaagggat

SEQ ID NO: 74284 - DNA, 75 bp, Artificial Sequence
  Synthetic
ttgtatgcaagaaatgtcaattttgatgtgcaaggagtgactgagtctcggggcaaaatcactctagaccgatca

SEQ ID NO: 74285 - DNA, 75 bp, Artificial Sequence
  Synthetic
gggcaaaatcactctagaccgatcaacacacaatcccttgttgaacactggtgtttttgggcaacaatcaggggc

SEQ ID NO: 74286 - DNA, 75 bp, Artificial Sequence
  Synthetic
tgaccacttttgtttcagtggcagggatcatctatataatctacaagctcttcgcaggtttccaaggagcgtaca

SEQ ID NO: 74287 - DNA, 75 bp, Artificial Sequence
  Synthetic
gatcatctatataatctacaagctcttcgcaggtttccaaggagcgtacacgggaatgcctaaccagaagcctaa

SEQ ID NO: 74288 - DNA, 75 bp, Artificial Sequence
  Synthetic
agactataatagagacttgttagttagcactaccacagcccaagggtgtgacaccatagccaggtgccagtgctc

SEQ ID NO: 74289 - DNA, 75 bp, Artificial Sequence
  Synthetic
aagcacggtaaaaaccgagtacggtgagttcaccatgttgggcatttatgacaggtgggccgtcttaccgcgcca

SEQ ID NO: 74290 - DNA, 75 bp, Artificial Sequence
  Synthetic
gagttcaccatgttgggcatttatgacaggtgggccgtcttaccgcgccacgccaaacctggaccaaccatactc

SEQ ID NO: 74291 - DNA, 75 bp, Artificial Sequence
  Synthetic
tcaagagagtgattattaccctaaaaggtaccagtcacacgtactacttgctacaggcttctcagaaccaggtga

SEQ ID NO: 74292 - DNA, 75 bp, Artificial Sequence
  Synthetic
ctactcaagctaaaccggaatgagaagttcagggacatcagaggcttcctggccaaggaagaggtagaggttaat

SEQ ID NO: 74293 - DNA, 75 bp, Artificial Sequence
  Synthetic
agttcagggacatcagaggcttcctggccaaggaagaggtagaggttaatgaagccgtgcttgcaattaacacca

SEQ ID NO: 74294 - DNA, 75 bp, Artificial Sequence
  Synthetic
tgccgatgttcgcgacctcctgtggctggaagatgatgccatggagcagggcgttagagattatgtggaacaact

SEQ ID NO: 74295 - DNA, 75 bp, Artificial Sequence
  Synthetic
caaagagaatgcttatgtacaacttccccacgagagccggacagtgtggtggtgtgctcatgtccactggcaagg

SEQ ID NO: 74296 - DNA, 75 bp, Artificial Sequence
  Synthetic
gcaagactctatcctagagaaatcgctcaaagccctagtgaagatcatatcagcactggtaattgtagtgcgaaa

SEQ ID NO: 74297 - DNA, 75 bp, Artificial Sequence
  Synthetic
ccccacgagagccggacagtgtggtggtgtgctcatgtccactggcaaggttctaggaattcatgttgggggaaa

SEQ ID NO: 74298 - DNA, 75 bp, Artificial Sequence
  Synthetic
ctcaaagccctagtgaagatcatatcagcactggtaattgtagtgcgaaaccatgacgacctaatcacagtgacg

SEQ ID NO: 74299 - DNA, 75 bp, Artificial Sequence
  Synthetic
aaactcaaaagacgcgggattcccggttatcaatacacctagcaagaccaaattagagcccagtattttccacca

SEQ ID NO: 74300 - DNA, 75 bp, Artificial Sequence
  Synthetic
atccccatggccgagagacaaaataatggatggctcaagaaattcacggagatgaccaacgcctgtaaaggcatg

SEQ ID NO: 74301 - DNA, 75 bp, Artificial Sequence
  Synthetic
gttatcaatacacctagcaagaccaaattagagcccagtattttccaccaagtcttcgaaggcaacaaggaacca

SEQ ID NO: 74302 - DNA, 75 bp, Artificial Sequence
  Synthetic
aattttaccagaagttaaggagaaacacgagtttctaaacagattaaagcaactacctctgttggaaagccaaat

SEQ ID NO: 74303 - DNA, 75 bp, Artificial Sequence
  Synthetic
gtcaacacacacgtggatgagtacatgttggaagctgtcgaccattacgctggacaattggccaccctagacatc

SEQ ID NO: 74304 - DNA, 75 bp, Artificial Sequence
  Synthetic
aactacctctgttggaaagccaaattgccaccattgaacaaagcgcgccctcgcagagtgatcaagagcaattgt

SEQ ID NO: 74305 - DNA, 75 bp, Artificial Sequence
  Synthetic
tgttggaagctgtcgaccattacgctggacaattggccaccctagacatcagcaccgagccaatgaagttagagg

SEQ ID NO: 74306 - DNA, 75 bp, Artificial Sequence
  Synthetic
tctccctagagaagaagatgagcaattacatacagttcaagtccaaatgccgtattgaacctgtctgtcttttgc

SEQ ID NO: 74307 - DNA, 75 bp, Artificial Sequence
  Synthetic
gcatcaagaagagagacatcctctcaaaaaaaactagggatttgaccaaactgaaagagtgtatggacaagtatg

SEQ ID NO: 74308 - DNA, 75 bp, Artificial Sequence
  Synthetic
ttacatacagttcaagtccaaatgccgtattgaacctgtctgtcttttgcttcatggaagtccaggtgctggtaa

SEQ ID NO: 74309 - DNA, 75 bp, Artificial Sequence
  Synthetic
aaaaaaaactagggatttgaccaaactgaaagagtgtatggacaagtatggcttaaacttaccaatggtgaccta

SEQ ID NO: 74310 - DNA, 75 bp, Artificial Sequence
  Synthetic
ccctgatcattttgatgggtacaagcagcaggccgttgtgatcatggatgatctctgtcagaacccagatgggaa

SEQ ID NO: 74311 - DNA, 75 bp, Artificial Sequence
  Synthetic
cgattcagtagcaatgagacagacatttggcaatttgtacaagaccttccacttgaacccggggatcgtgactgg

SEQ ID NO: 74312 - DNA, 75 bp, Artificial Sequence
  Synthetic
gtctcaagcgttgacttcgtgccaccaatggcggcgctcgaggaaaagggcattctatttacatcaccatttgtc

SEQ ID NO: 74313 - DNA, 75 bp, Artificial Sequence
  Synthetic
tgattactctgggtatgatgctagcttaagtcccgtctggtttgcctgtctgaaaatgttacttgagaagcttgg

SEQ ID NO: 74314 - DNA, 75 bp, Artificial Sequence
  Synthetic
tttgacatgaacattgaagttatctccatgtacagccaaaatggtaagatcaacatgccaatgtcagtgaaaacg

SEQ ID NO: 74315 - DNA, 75 bp, Artificial Sequence
  Synthetic
ccatgtacagccaaaatggtaagatcaacatgccaatgtcagtgaaaacgtgcgatgatgaatgctgcccggcca

SEQ ID NO: 74316 - DNA, 75 bp, Artificial Sequence
  Synthetic
tgtgaggggtggcatgccttcagggtgttctggcaccagcatctttaactcaatgatcaacaacatcataatcag

SEQ ID NO: 74317 - DNA, 75 bp, Artificial Sequence
  Synthetic
tgttctggcaccagcatctttaactcaatgatcaacaacatcataatcaggacattgatgctgaaagtatacaag

SEQ ID NO: 74318 - DNA, 75 bp, Artificial Sequence
  Synthetic
cattggacatgctcgtaactgagatgttcagggagtacaaccacagacacagtgtgggcgcaacacttgaggcgc

SEQ ID NO: 74319 - DNA, 75 bp, Artificial Sequence
  Synthetic
gcatccttactcgccgaggctggcagggactacgggctgatcatgacaccagctgataagggggaacactttaac

SEQ ID NO: 74320 - DNA, 75 bp, Artificial Sequence
  Synthetic
gggactacgggctgatcatgacaccagctgataagggggaacactttaacgaagtcacctggaccaatgtcactt

SEQ ID NO: 74321 - DNA, 75 bp, Artificial Sequence
  Synthetic
ctgacttgttaaagtcagtggatagtgaggcagtcagggaatattgcaaggaaaagggttggttggtgcctgaaa

SEQ ID NO: 74322 - DNA, 75 bp, Artificial Sequence
  Synthetic
tgaggcagtcagggaatattgcaaggaaaagggttggttggtgcctgaaattaactccaccctgcaaatcgagaa

SEQ ID NO: 74323 - DNA, 75 bp, Artificial Sequence
  Synthetic
atgagtcaatcagatggaccaaagatccaaagaacacccaagaccacgtgcgctcactatgcttattggcctggc

SEQ ID NO: 74324 - DNA, 75 bp, Artificial Sequence
  Synthetic
acaacggagagcacgaatatgaggagttcattcgtaaaatcaggagcgtcccagtcgggcgttgcttgaccctcc

SEQ ID NO: 74325 - DNA, 75 bp, Artificial Sequence
  Synthetic
ttataaattatttgcaggtttccaaggagcttatactggcatgcccagtcagaagcccaaagtgccgaccctgag

SEQ ID NO: 74326 - DNA, 75 bp, Artificial Sequence
  Synthetic
acccacagggcccacgtggcgctagcacaccggtattccggtacccttgtgcgcctgttttatacacccttgccc

SEQ ID NO: 74327 - DNA, 75 bp, Artificial Sequence
  Synthetic
taccccggcatgctaaaccagggcccaccattctgatgaacgatcaagaggtaggagtggtagacgccaaagaac

SEQ ID NO: 74328 - DNA, 75 bp, Artificial Sequence
  Synthetic
aagctgctcgcgcggctgaaggagaaaacgttcgttacccggccaattacttcgagaaacccagtaacgccatgg

SEQ ID NO: 74329 - DNA, 75 bp, Artificial Sequence
  Synthetic
gaggtttcttagcacgtgaggaggttgaggtcaacgaagccgtacttgcgatcaacaccagcaaattcccaaaca

SEQ ID NO: 74330 - DNA, 75 bp, Artificial Sequence
  Synthetic
tgtacaattttcctactcgtgcggggcagtgtggtggtgtcctgatgtcaacaggtaaggtcctcgggatacacg

SEQ ID NO: 74331 - DNA, 75 bp, Artificial Sequence
  Synthetic
gtaactctgcagcggaaccgactactttgggtgtccgtgtttccttttattccttatttggctgcttatggtgac

SEQ ID NO: 74332 - DNA, 75 bp, Artificial Sequence
  Synthetic
tttgggtgtccgtgtttccttttattccttatttggctgcttatggtgacaattgagagattgttgccatatagc

SEQ ID NO: 74333 - DNA, 75 bp, Artificial Sequence
  Synthetic
agttcattgagagttctaaggaagctggctttccggtcattaacacccccagtaaaacgaagcttgagcccagtg

SEQ ID NO: 74334 - DNA, 75 bp, Artificial Sequence
  Synthetic
tggctttccggtcattaacacccccagtaaaacgaagcttgagcccagtgtgttccaccatgtgtttgaaggaaa

SEQ ID NO: 74335 - DNA, 75 bp, Artificial Sequence
  Synthetic
cattggcaatgtgaacacccacgtagatgagtacatgatggaagccgtagatcactatgcggggcagctggcaac

SEQ ID NO: 74336 - DNA, 75 bp, Artificial Sequence
  Synthetic
tccacttaaacacgcagaaatgggggcgcaggtctcaacacagaaaactggtgcgcatgaaacggggttaaacgc

SEQ ID NO: 74337 - DNA, 75 bp, Artificial Sequence
  Synthetic
ccgaaggcttggaggcattggacctaactactagtgcagggtatccctatgtcgctcttggtataaagaagagag

SEQ ID NO: 74338 - DNA, 75 bp, Artificial Sequence
  Synthetic
gtcgctcttggtataaagaagagagatatcttatccaagaaaactaaagatttgacaaagttaaaggaatgtatg

SEQ ID NO: 74339 - DNA, 75 bp, Artificial Sequence
  Synthetic
tttacagaaccagttaaggacattatgataaaatcattaccagccttaaattcccctacagttgaagagtgcggg

SEQ ID NO: 74340 - DNA, 75 bp, Artificial Sequence
  Synthetic
tttgacaaagttaaaggaatgtatggataagtatggactaaacctcccaatggtcacctatgtgaaggatgagct

SEQ ID NO: 74341 - DNA, 75 bp, Artificial Sequence
  Synthetic
tgataaaatcattaccagccttaaattcccctacagttgaagagtgcgggtatagtgatagggtgaggtccatca

SEQ ID NO: 74342 - DNA, 75 bp, Artificial Sequence
  Synthetic
gcaagagtgcgcaaacgtggttgtgggatacggcgtgtggccagattacctaaaggacagtgaagcaacagccga

SEQ ID NO: 74343 - DNA, 75 bp, Artificial Sequence
  Synthetic
caagcctaaatgactcagtggccatgagacagacttttgggaatctgtataagacattccacctgaatccaggta

SEQ ID NO: 74344 - DNA, 75 bp, Artificial Sequence
  Synthetic
atcccagtcatgctggacggccacctcatcgcttttgactacagtggatatgatgccagtctgagcccagtgtgg

SEQ ID NO: 74345 - DNA, 75 bp, Artificial Sequence
  Synthetic
gacgccttgtctaatttggggttgtttggtcagaacatgcagtatcactacttgggtcggactggatacaccata

SEQ ID NO: 74346 - DNA, 75 bp, Artificial Sequence
  Synthetic
tgtgcaactttagacaacacaccatcaagtgcggagctgctaggaggcgatgctgcaaaggagtttgcaggcgag

SEQ ID NO: 74347 - DNA, 75 bp, Artificial Sequence
  Synthetic
aactcccaccatctatatagagataaacactactttgtaagagggggaatgccatctgggtgttctgggaccagc

SEQ ID NO: 74348 - DNA, 75 bp, Artificial Sequence
  Synthetic
cagttcaggatgatagcatatggtgatgatgtcattgcatcatacccgcacccaattgatgcctcgctgctggct

SEQ ID NO: 74349 - DNA, 75 bp, Artificial Sequence
  Synthetic
tcttgtccacccagtaatgccaatgaaggacattcatgaatcaattaggtggactaaggatcccaaaaacactca

SEQ ID NO: 74350 - DNA, 75 bp, Artificial Sequence
  Synthetic
gtgtgccgagtacaacgggcttcgcttggcaggccaccaaggccttccaacaatgaacacaccaggaagctgcca

SEQ ID NO: 74351 - DNA, 75 bp, Artificial Sequence
  Synthetic
caatgaacacaccaggaagctgccaatttcttacatcagatgatttccaatccccgtctgccatgccacaatatg

SEQ ID NO: 74352 - DNA, 75 bp, Artificial Sequence
  Synthetic
ggaccatgtgcgatccttgtgtctattggcttggcacaatggagagcaagaatatgaagaatttgtatccaaaat

SEQ ID NO: 74353 - DNA, 75 bp, Artificial Sequence
  Synthetic
tccccgtctgccatgccacaatatgacgtcactccagagatgaggatacccggcgaagtgaagaatctaatggag

SEQ ID NO: 74354 - DNA, 75 bp, Artificial Sequence
  Synthetic
atttcttacatcagatgatttccaatccccgtctgccatgccacaatatgacgtcactccagagatgaggatacc

SEQ ID NO: 74355 - DNA, 75 bp, Artificial Sequence
  Synthetic
ttggcttggcacaatggagagcaagaatatgaagaatttgtatccaaaattagaagcgtccccgtgggccgctgc

SEQ ID NO: 74356 - DNA, 75 bp, Artificial Sequence
  Synthetic
ttgaaagttagagcacaattaggtttaattccaattggcttccccctaccacactcaccgaactagataacggtg

SEQ ID NO: 74357 - DNA, 75 bp, Artificial Sequence
  Synthetic
cagcataaagcttactttcatgttttgtggctcggctatggccactggaaaattcttgctggcgtactcaccacc

SEQ ID NO: 74358 - DNA, 75 bp, Artificial Sequence
  Synthetic
gcgcctgttttatactcccccccctaaggaaactttagaagcaaagcaattgtgatcaatagtgggtatggcaca

SEQ ID NO: 74359 - DNA, 75 bp, Artificial Sequence
  Synthetic
aaacgttcgttatccggccaactacttcgagaaacctagtagcaccatgaaagttgcggagtgtttcgctcagca

SEQ ID NO: 74360 - DNA, 75 bp, Artificial Sequence
  Synthetic
actaacattgtggtccctgctgatgcgcaaagctcttgctatatcatgtgttttgtgtcagcatgcaatgatttc

SEQ ID NO: 74361 - DNA, 75 bp, Artificial Sequence
  Synthetic
ccgtgacggtggctgcgttggcggcctgcccatggggtaacccatgggacgctctaaaacagacacggtgcgaag

SEQ ID NO: 74362 - DNA, 75 bp, Artificial Sequence
  Synthetic
acttcttgtgtagatctgcctgtgtctacttcactgagtatgagaattcagggtccaaacgatatgccgaatggg

SEQ ID NO: 74363 - DNA, 75 bp, Artificial Sequence
  Synthetic
ttttgagaacactcaactacatcttactgctaaacacatcaaaatgggagcacaggtatcaacacagaagaccgg

SEQ ID NO: 74364 - DNA, 75 bp, Artificial Sequence
  Synthetic
actgctaaacacatcaaaatgggagcacaggtatcaacacagaagaccggggcgcacgagactagcttgagcgct

SEQ ID NO: 74365 - DNA, 75 bp, Artificial Sequence
  Synthetic
gatttcacccaagaccctggtaagtttactgaaccaatgaaagatgtcatgataaaaaccctgccagcgctgaat

SEQ ID NO: 74366 - DNA, 75 bp, Artificial Sequence
  Synthetic
ttactgaaccaatgaaagatgtcatgataaaaaccctgccagcgctgaattctccaacggttgaagagtgcgggt

SEQ ID NO: 74367 - DNA, 75 bp, Artificial Sequence
  Synthetic
ctgagcattggtaacgcttattcaaacttttatgatggttggtcagaattctccagaaatggggtgtatggtatt

SEQ ID NO: 74368 - DNA, 75 bp, Artificial Sequence
  Synthetic
ggtacggtgaatggcctgagtatctgagtgataacgaggcaactgctgaggaccaaccaacgcagccggacgtgg

SEQ ID NO: 74369 - DNA, 75 bp, Artificial Sequence
  Synthetic
gagtgataacgaggcaactgctgaggaccaaccaacgcagccggacgtggccacttgccgtttttacaccctaga

SEQ ID NO: 74370 - DNA, 75 bp, Artificial Sequence
  Synthetic
attaggatttatttcaaaccaaagcacgttaaagcttggatacccaggcctcctaggttatgccagtacgagaag

SEQ ID NO: 74371 - DNA, 75 bp, Artificial Sequence
  Synthetic
tggccaaaatatgtactaccattacttaggcagagccgggtataccatccacgtacaatgcaatgcttccaagtt

SEQ ID NO: 74372 - DNA, 75 bp, Artificial Sequence
  Synthetic
ttaggcagagccgggtataccatccacgtacaatgcaatgcttccaagtttcatcaaggctgtatcctggtagtg

SEQ ID NO: 74373 - DNA, 75 bp, Artificial Sequence
  Synthetic
atcgcatcaaggttcactaccacgacaacagcagaagaccatggcgtgcaggccgcggtatggaatgctggtatg

SEQ ID NO: 74374 - DNA, 75 bp, Artificial Sequence
  Synthetic
caacagcagaagaccatggcgtgcaggccgcggtatggaatgctggtatgggcgttggagttgggaacttgacga

SEQ ID NO: 74375 - DNA, 75 bp, Artificial Sequence
  Synthetic
aaacaaacacttcccagttagctttgaaggcccaggcttggttgaagtgcaagagagtgaatactaccccaagag

SEQ ID NO: 74376 - DNA, 75 bp, Artificial Sequence
  Synthetic
caatggacaatatgtatagacatcacaactttacactaatgataataccctttgtgcctctggatttcagcgcgg

SEQ ID NO: 74377 - DNA, 75 bp, Artificial Sequence
  Synthetic
caactttacactaatgataataccctttgtgcctctggatttcagcgcgggtgcatccacatacgtgcccataac

SEQ ID NO: 74378 - DNA, 75 bp, Artificial Sequence
  Synthetic
gtggtgggatcctcaggtgcgagcacggtgtcattgggcttgtaaccatgggaggcgatggagtggtcggatttg

SEQ ID NO: 74379 - DNA, 75 bp, Artificial Sequence
  Synthetic
cacccctggcagcaaccaatttcttacatcggacgatttccaatccccgtcagcgatgcctcaatttgatgtaac

SEQ ID NO: 74380 - DNA, 75 bp, Artificial Sequence
  Synthetic
acatcggacgatttccaatccccgtcagcgatgcctcaatttgatgtaactccagaaatgcacatccctggtgag

SEQ ID NO: 74381 - DNA, 75 bp, Artificial Sequence
  Synthetic
caaagccctaatcaaaatcatttcggcactagtaatagtggttagaaaccacgatgatctggtgacgataactgc

SEQ ID NO: 74382 - DNA, 75 bp, Artificial Sequence
  Synthetic
tccatggaggcttatagagtcgaattgagcaccaacactaatgccgggactcaagtgtttggctttcaactgaac

SEQ ID NO: 74383 - DNA, 75 bp, Artificial Sequence
  Synthetic
tgagcaccaacactaatgccgggactcaagtgtttggctttcaactgaaccccggagcggaatcagtaatgaacc

SEQ ID NO: 74384 - DNA, 75 bp, Artificial Sequence
  Synthetic
ggaaagtgtctcaatattattgcatacccatggctgagcgccaaaacaatgggtggcttaagaaatttacagaga

SEQ ID NO: 74385 - DNA, 75 bp, Artificial Sequence
  Synthetic
gttctgccatgaccactggcaagtttctgctgtcttacgccccaccaggtgcaggtgcgccaaaaactcgcaagg

SEQ ID NO: 74386 - DNA, 75 bp, Artificial Sequence
  Synthetic
tctgctgtcttacgccccaccaggtgcaggtgcgccaaaaactcgcaaggatgccatgttaggcactcatgtggt

SEQ ID NO: 74387 - DNA, 75 bp, Artificial Sequence
  Synthetic
tcttaccagaggtgaaggagaaacatgaattcctaaccagactaaaacaactcccccttttggaaagccaaattg

SEQ ID NO: 74388 - DNA, 75 bp, Artificial Sequence
  Synthetic
aaaggatccatacaccaatgccgggtttgtgacatgttggtatcagaccagtgtagtgtccccagcgagcaacca

SEQ ID NO: 74389 - DNA, 75 bp, Artificial Sequence
  Synthetic
tttgtgacatgttggtatcagaccagtgtagtgtccccagcgagcaaccagccaaagtgttatatgatgtgcatg

SEQ ID NO: 74390 - DNA, 75 bp, Artificial Sequence
  Synthetic
ggtgatgtgcagaatgctgtcgaaggggctatggtcagggtggcagatacagtgcaaacttcagccacaaactca

SEQ ID NO: 74391 - DNA, 75 bp, Artificial Sequence
  Synthetic
gggctatggtcagggtggcagatacagtgcaaacttcagccacaaactcagagagggtgcctaacttgacagcag

SEQ ID NO: 74392 - DNA, 75 bp, Artificial Sequence
  Synthetic
tcagtgtattctctaccaccagacccggaccatttcgatggctacaaacaacaagccgtcgtgattatggatgac

SEQ ID NO: 74393 - DNA, 75 bp, Artificial Sequence
  Synthetic
ggtcagaatctacaattgagaacttccttgccagatcagcgtgtgttttctacctagagtacaagacagggacca

SEQ ID NO: 74394 - DNA, 75 bp, Artificial Sequence
  Synthetic
ccttgccagatcagcgtgtgttttctacctagagtacaagacagggaccaaagaggattccaatagcttcaacaa

SEQ ID NO: 74395 - DNA, 75 bp, Artificial Sequence
  Synthetic
tgacatgaatatcgaggttatatcaatgtacagccagaatggcaagattaacatgcctatgtcagtcaaaacatg

SEQ ID NO: 74396 - DNA, 75 bp, Artificial Sequence
  Synthetic
ggaaatcaccgtggtcattacaagctcgcaagatcagtctacatcacaaaaccagaatgcaccagtgctaacaca

SEQ ID NO: 74397 - DNA, 75 bp, Artificial Sequence
  Synthetic
tcgcaagatcagtctacatcacaaaaccagaatgcaccagtgctaacacaccagataatgtatgtaccaccaggg

SEQ ID NO: 74398 - DNA, 75 bp, Artificial Sequence
  Synthetic
taaaaggacccaaatgaggtactccttggacatgttggtcactgagatgtttagggagtacaaccataggcacag

SEQ ID NO: 74399 - DNA, 75 bp, Artificial Sequence
  Synthetic
ttggacatgttggtcactgagatgtttagggagtacaaccataggcacagcgtcggggcaaccctcgaggcgcta

SEQ ID NO: 74400 - DNA, 75 bp, Artificial Sequence
  Synthetic
aacgctccggcacgcatgtcaattccatttattagcataggcaatgcgtatagtaatttctacgatgggtggtct

SEQ ID NO: 74401 - DNA, 75 bp, Artificial Sequence
  Synthetic
catttattagcataggcaatgcgtatagtaatttctacgatgggtggtctcacttctcccaggctggcgtgtatg

SEQ ID NO: 74402 - DNA, 75 bp, Artificial Sequence
  Synthetic
gtgtggcgcgcatttacttcaaaccgaaacatgtacgcgcttgggtgcctagaccaccgcgcttgtgtccataca

SEQ ID NO: 74403 - DNA, 75 bp, Artificial Sequence
  Synthetic
gaaacatgtacgcgcttgggtgcctagaccaccgcgcttgtgtccatacatcaatagcacgaatgtcaactttga

SEQ ID NO: 74404 - DNA, 75 bp, Artificial Sequence
  Synthetic
cgtgggcaactacagagtggtcaataggcacttggcgactcacattgattggcaaaactgtgtatgggaggacta

SEQ ID NO: 74405 - DNA, 75 bp, Artificial Sequence
  Synthetic
aggcacttggcgactcacattgattggcaaaactgtgtatgggaggactataacagggatctactggtcagcaca

SEQ ID NO: 74406 - DNA, 75 bp, Artificial Sequence
  Synthetic
tgaatttgctgtggctatgatgaagagaaactccagcacagtgaagactgagtatggtgagtttacaatgttggg

SEQ ID NO: 74407 - DNA, 75 bp, Artificial Sequence
  Synthetic
aaacactacccagtgtcatttgaaggtccaggattggttgaggttcaagagagtgagtattacccaaaaaggtac

SEQ ID NO: 74408 - DNA, 75 bp, Artificial Sequence
  Synthetic
gtccaggattggttgaggttcaagagagtgagtattacccaaaaaggtaccaatcccacgtgcttcttgcagccg

SEQ ID NO: 74409 - DNA, 75 bp, Artificial Sequence
  Synthetic
ccatccttatgaatgaccaggaagttggcgtactagatgcaaaagaactggtggataaagatggcacaaaccttg

SEQ ID NO: 74410 - DNA, 75 bp, Artificial Sequence
  Synthetic
aactgacgctgttgaaacttaatcggaatgagaagttcagagacatcagaggcttcctggccaaagaagaggtgg

SEQ ID NO: 74411 - DNA, 75 bp, Artificial Sequence
  Synthetic
ggcttcctggccaaagaagaggtggaggttaatgaggctgttctggcagtaaacaccagcaagttcccgaacatg

SEQ ID NO: 74412 - DNA, 75 bp, Artificial Sequence
  Synthetic
gtgaaggtgtcgttggtttcgccgatgtgcgagaccttctatggctagaggatgacgccatggagcagggagtca

SEQ ID NO: 74413 - DNA, 75 bp, Artificial Sequence
  Synthetic
tgtgcgagaccttctatggctagaggatgacgccatggagcagggagtcaaggactacgtggaacagctcggcaa

SEQ ID NO: 74414 - DNA, 75 bp, Artificial Sequence
  Synthetic
tacaattttcccaccagagctggccaatgcggtggtgttctcatgtctactggtaaggtgttggggatacacgtt

SEQ ID NO: 74415 - DNA, 75 bp, Artificial Sequence
  Synthetic
aatgcggtggtgttctcatgtctactggtaaggtgttggggatacacgttggtggaaatggtcatcagggcttct

SEQ ID NO: 74416 - DNA, 75 bp, Artificial Sequence
  Synthetic
tggtaaggtgttggggatacacgttggtggaaatggtcatcagggcttctcagcagccctcctcaaacattattt

SEQ ID NO: 74417 - DNA, 75 bp, Artificial Sequence
  Synthetic
ctccatcttggaaaagtctttaaaagcactagtaaaaatcatatcagcattagtgatcgtggtaaggaaccacga

SEQ ID NO: 74418 - DNA, 75 bp, Artificial Sequence
  Synthetic
gcactagtaaaaatcatatcagcattagtgatcgtggtaaggaaccacgacgacttgatcacagtgactgctaca

SEQ ID NO: 74419 - DNA, 75 bp, Artificial Sequence
  Synthetic
caggactaaattggaaccaagtgtgttccaccaagtatttgagggcaacaaagagccagctgtcctcagaaatgg

SEQ ID NO: 74420 - DNA, 75 bp, Artificial Sequence
  Synthetic
atggccgagcgtcagaacaatggatggctcaagaaattcactgagatgactaacgcctgcaaaggcatggagtgg

SEQ ID NO: 74421 - DNA, 75 bp, Artificial Sequence
  Synthetic
ggctcaagaaattcactgagatgactaacgcctgcaaaggcatggagtggattgccattaaaattcagaaattta

SEQ ID NO: 74422 - DNA, 75 bp, Artificial Sequence
  Synthetic
tgagtacatgatggaggccgttgaccattacgcaggacaactagccactctggacattagcacggagcccatgaa

SEQ ID NO: 74423 - DNA, 75 bp, Artificial Sequence
  Synthetic
cacttcttgaaagtcagattgctaccatagaacagagcgcaccatcacaaggtgaccaagaacagctcttctcca

SEQ ID NO: 74424 - DNA, 75 bp, Artificial Sequence
  Synthetic
catagaacagagcgcaccatcacaaggtgaccaagaacagctcttctccaatgtgcagtattttgcccactattg

SEQ ID NO: 74425 - DNA, 75 bp, Artificial Sequence
  Synthetic
acagttcaagtccaaatgccgtattgagcctgtatgtttacttctccatggcagcccaggagcggggaaatccgt

SEQ ID NO: 74426 - DNA, 75 bp, Artificial Sequence
  Synthetic
gagcctgtatgtttacttctccatggcagcccaggagcggggaaatccgtggctacaaacctaattggtagatcc

SEQ ID NO: 74427 - DNA, 75 bp, Artificial Sequence
  Synthetic
gccgtagtgatcatggatgacctgtgccagaatccagatgggaaggatgtgtcactattctgtcaaatggtatcc

SEQ ID NO: 74428 - DNA, 75 bp, Artificial Sequence
  Synthetic
gccagaatccagatgggaaggatgtgtcactattctgtcaaatggtatccagcgtggacttcgtaccacccatgg

SEQ ID NO: 74429 - DNA, 75 bp, Artificial Sequence
  Synthetic
cacccactgtgtctgacagcagggcacttgccagaaggttccactttgatatgaacatcgaggtgatctccatgt

SEQ ID NO: 74430 - DNA, 75 bp, Artificial Sequence
  Synthetic
acttgccagaaggttccactttgatatgaacatcgaggtgatctccatgtatagccagaatgggaagattaacat

SEQ ID NO: 74431 - DNA, 75 bp, Artificial Sequence
  Synthetic
cttcaactcaatgatcaacaacatcataatcaggacattaatgttgaaagtttacaaaggcattgacctggatca

SEQ ID NO: 74432 - DNA, 75 bp, Artificial Sequence
  Synthetic
taaggccattcaatttattgacagaaagacccaagttaggtattcactggacatgttggtcaccgagatgttcag

SEQ ID NO: 74433 - DNA, 75 bp, Artificial Sequence
  Synthetic
aagacccaagttaggtattcactggacatgttggtcaccgagatgttcagggagtacaaccacagacacagcgtg

SEQ ID NO: 74434 - DNA, 75 bp, Artificial Sequence
  Synthetic
ccccctccaccagcaatcgctgacctgctaaaatcagtagacagtgaggcagtaagggagtactgcaaggaaaaa

SEQ ID NO: 74435 - DNA, 75 bp, Artificial Sequence
  Synthetic
ggatatccacgaatctatcaggtggacgaaagacccaaagaatactcaagaccatgtgcgatctttgtgcctatt

SEQ ID NO: 74436 - DNA, 75 bp, Artificial Sequence
  Synthetic
tgctaaaatcagtagacagtgaggcagtaagggagtactgcaaggaaaaaggctggcttgtgccggaaattagct

SEQ ID NO: 74437 - DNA, 75 bp, Artificial Sequence
  Synthetic
acccacagggcccactgggcgctagcacactggtattacggtacccttgtgcgcctgttttattcaccctacccc

SEQ ID NO: 74438 - DNA, 75 bp, Artificial Sequence
  Synthetic
tggtgagttcaccatgctcggcatctatgacagatgggcagtgttaccacgccacgccaagcccggaccgaccat

SEQ ID NO: 74439 - DNA, 75 bp, Artificial Sequence
  Synthetic
gactctcctaaagctcaatcgcaatgagaagtttagggatatcagagggtttctggcaagagaagaagctgaggt

SEQ ID NO: 74440 - DNA, 75 bp, Artificial Sequence
  Synthetic
gagaagtttagggatatcagagggtttctggcaagagaagaagctgaggtgaatgaggctgttttggcaataaac

SEQ ID NO: 74441 - DNA, 75 bp, Artificial Sequence
  Synthetic
cccacaaagaggatgctcatgtacaatttcccaactagagcaggccaatgtggcggtgtcctcatgtcaacaggg

SEQ ID NO: 74442 - DNA, 75 bp, Artificial Sequence
  Synthetic
atttcccaactagagcaggccaatgtggcggtgtcctcatgtcaacagggaaggttctaggaatacatgtaggcg

SEQ ID NO: 74443 - DNA, 75 bp, Artificial Sequence
  Synthetic
ttgagagattgttaccatatagctattggattggccatccggtgacaaacagagcgattgtttacctatttgttg

SEQ ID NO: 74444 - DNA, 75 bp, Artificial Sequence
  Synthetic
ttgagagctcaaaggacgcaggcttccctgtgatcaacacccccagcaaaaccaagctggaaccaagcgtgtttc

SEQ ID NO: 74445 - DNA, 75 bp, Artificial Sequence
  Synthetic
gtttcgtaccattgaattttaaagttttaaaaaccctcaatcttgttttagcacttaacgcagcaaaatgggagc

SEQ ID NO: 74446 - DNA, 75 bp, Artificial Sequence
  Synthetic
tttaaaaaccctcaatcttgttttagcacttaacgcagcaaaatgggagcccaagtgtcgactcagaaaactggg

SEQ ID NO: 74447 - DNA, 75 bp, Artificial Sequence
  Synthetic
ccctgtgatcaacacccccagcaaaaccaagctggaaccaagcgtgtttcaccaggtgtttgagggcaacaaaga

SEQ ID NO: 74448 - DNA, 75 bp, Artificial Sequence
  Synthetic
caatgttaacacccacgtggacgaatacatgcaagaggccgtggaccattatgcagggcagctagctacactgga

SEQ ID NO: 74449 - DNA, 75 bp, Artificial Sequence
  Synthetic
gcctccaattccgccaaccgacaagacttcacgcaagacccagggaaattcacggagccagtcaaggatataatg

SEQ ID NO: 74450 - DNA, 75 bp, Artificial Sequence
  Synthetic
tacatgcaagaggccgtggaccattatgcagggcagctagctacactggacatcagcacagagcccatgaaactg

SEQ ID NO: 74451 - DNA, 75 bp, Artificial Sequence
  Synthetic
ctaggtatcaagaaaagagacattctctctaagaagaccaaagaccttaccaagttgaaggaatgcatggacaag

SEQ ID NO: 74452 - DNA, 75 bp, Artificial Sequence
  Synthetic
tctctaagaagaccaaagaccttaccaagttgaaggaatgcatggacaagtatggcctaaacttaccaatggtaa

SEQ ID NO: 74453 - DNA, 75 bp, Artificial Sequence
  Synthetic
tcaatgactcagtagcaatgaggcaaacatttggaaacctgtacaaaacctttcatctcaatccgggcattgtca

SEQ ID NO: 74454 - DNA, 75 bp, Artificial Sequence
  Synthetic
aacatttggaaacctgtacaaaacctttcatctcaatccgggcattgtcacgggcagtgctgttgggtgtgaccc

SEQ ID NO: 74455 - DNA, 75 bp, Artificial Sequence
  Synthetic
gtgttccagaagctgagatgggtgctgctaacatcaacgaaaagatcaatagagaacatctgagcaatggtgagg

SEQ ID NO: 74456 - DNA, 75 bp, Artificial Sequence
  Synthetic
cagtctcagcccggtgtggtttgcatgtctgaaactcctcctagagaaactagggtatacgaataaggaaacaaa

SEQ ID NO: 74457 - DNA, 75 bp, Artificial Sequence
  Synthetic
tgtctgaaactcctcctagagaaactagggtatacgaataaggaaacaaactacatagattacctctgcaactct

SEQ ID NO: 74458 - DNA, 75 bp, Artificial Sequence
  Synthetic
gtgtggcagtaggaaacctgactattttcccacatcagtggatcaacttacgtaccaataattgtgccactatag

SEQ ID NO: 74459 - DNA, 75 bp, Artificial Sequence
  Synthetic
aattccatgattaacaacattataatcaggactctcatgctgaaagtttataaaggcattgatttggaccaattc

SEQ ID NO: 74460 - DNA, 75 bp, Artificial Sequence
  Synthetic
tcaggactctcatgctgaaagtttataaaggcattgatttggaccaattcagaatgatcgcttatggggatgatg

SEQ ID NO: 74461 - DNA, 75 bp, Artificial Sequence
  Synthetic
ccccagcagacaaaggtgagtgctttaatgaggtaacctggacaaatgtgacctttttgaaaaggtacttcagag

SEQ ID NO: 74462 - DNA, 75 bp, Artificial Sequence
  Synthetic
taatgaggtaacctggacaaatgtgacctttttgaaaaggtacttcagagcagatgaacagtacccattcctggt

SEQ ID NO: 74463 - DNA, 75 bp, Artificial Sequence
  Synthetic
tggcacaacggggagcacgaatatgaggagtttattcgcaagatcagaagcgtgcccgtcgggcgctgcttgacc

SEQ ID NO: 74464 - DNA, 75 bp, Artificial Sequence
  Synthetic
tggaggcctataggataccagtgcattcagtaacggaaactggtgcacaagtttttggcttcacgttacagcccg

SEQ ID NO: 74465 - DNA, 75 bp, Artificial Sequence
  Synthetic
cacttctgttaccccggactgagtatcaataggctactcacgtggctgaaggagaaaacgttcgttacccgacca

SEQ ID NO: 74466 - DNA, 75 bp, Artificial Sequence
  Synthetic
ggcgaccgtggcggtggctgcgttggcggcctgcccatggggcaacccatgggacgcttcaatactgacatggtg

SEQ ID NO: 74467 - DNA, 75 bp, Artificial Sequence
  Synthetic
tattcttatactggctgcttatggtgacaattgagagattgttaccatatagctattggattggccatccggtga

SEQ ID NO: 74468 - DNA, 75 bp, Artificial Sequence
  Synthetic
gacaattgagagattgttaccatatagctattggattggccatccggtgacgagcagagctattatttacctatt

SEQ ID NO: 74469 - DNA, 75 bp, Artificial Sequence
  Synthetic
ggagctcaagtatcaacacagaaaactggagcccacgaaactggattgagtgccagtggtaactctatcatacat

SEQ ID NO: 74470 - DNA, 75 bp, Artificial Sequence
  Synthetic
ctggagcccacgaaactggattgagtgccagtggtaactctatcatacattacacaaacatcaactattacaaag

SEQ ID NO: 74471 - DNA, 75 bp, Artificial Sequence
  Synthetic
ccattccacaagccgtggacgactataactggcaaacctccacaaacccaagtgttttctggaccgaaggaagtg

SEQ ID NO: 74472 - DNA, 75 bp, Artificial Sequence
  Synthetic
ttatgatcaaatcaatgccagcattgaattcaccaactgtggaggagtgtggatacagcgatagagtgaggtcta

SEQ ID NO: 74473 - DNA, 75 bp, Artificial Sequence
  Synthetic
gaattcaccaactgtggaggagtgtggatacagcgatagagtgaggtctataaccctcggaaactccaccattac

SEQ ID NO: 74474 - DNA, 75 bp, Artificial Sequence
  Synthetic
tctcacaaacaggtgtgtatggtttcaacaccctcaataatatgggaaagttatactttaggcatgtgaatgata

SEQ ID NO: 74475 - DNA, 75 bp, Artificial Sequence
  Synthetic
tgaggaccaacccacacaaccggatgtagcaacgtgtcggttttacaccctggactctgtgcaatggcaaaagac

SEQ ID NO: 74476 - DNA, 75 bp, Artificial Sequence
  Synthetic
gtagcaacgtgtcggttttacaccctggactctgtgcaatggcaaaagacatcaaacggttggtggtggaaattc

SEQ ID NO: 74477 - DNA, 75 bp, Artificial Sequence
  Synthetic
attcatgtgcagtgtaacgcgtctagatttcaccagggtgcactcttggttgtgtgcgtccccgaggcagagatg

SEQ ID NO: 74478 - DNA, 75 bp, Artificial Sequence
  Synthetic
gtaactacaggttagtcaataggcacttagctacacacaatgattggcaaaattgtgtgtgggaagactacaaca

SEQ ID NO: 74479 - DNA, 75 bp, Artificial Sequence
  Synthetic
gatttcaccagggtgcactcttggttgtgtgcgtccccgaggcagagatggggtgtgctaccatcgacaggacag

SEQ ID NO: 74480 - DNA, 75 bp, Artificial Sequence
  Synthetic
ttcaaaccgctgtatacaacgctgcaatgggtgtggcagttgggaatttgacgatcttcccacaccagtggatca

SEQ ID NO: 74481 - DNA, 75 bp, Artificial Sequence
  Synthetic
aatgggtgtggcagttgggaatttgacgatcttcccacaccagtggatcaatctgaggacaaacaacagcgccac

SEQ ID NO: 74482 - DNA, 75 bp, Artificial Sequence
  Synthetic
cccttttgtaccgcttgattactctaccggtgcatccacttacgttcccatcacagtcacggtggcccccatgag

SEQ ID NO: 74483 - DNA, 75 bp, Artificial Sequence
  Synthetic
accggtgcatccacttacgttcccatcacagtcacggtggcccccatgagtgcagaatacaatggattgagactc

SEQ ID NO: 74484 - DNA, 75 bp, Artificial Sequence
  Synthetic
gcgacctactgtggttagaagatgatgccatggagcagggtgtgagagactatgtcgaacaacttggaaacgctt

SEQ ID NO: 74485 - DNA, 75 bp, Artificial Sequence
  Synthetic
tgccatggagcagggtgtgagagactatgtcgaacaacttggaaacgcttttggatcaggattcaccaaccagat

SEQ ID NO: 74486 - DNA, 75 bp, Artificial Sequence
  Synthetic
ccctgtgcaatgcctcaatttgatgttacaccagaaatgtttattccaggagaagtacacaacctcatggagata

SEQ ID NO: 74487 - DNA, 75 bp, Artificial Sequence
  Synthetic
ttacaccagaaatgtttattccaggagaagtacacaacctcatggagatagcggaggttgactcagttgtacctg

SEQ ID NO: 74488 - DNA, 75 bp, Artificial Sequence
  Synthetic
tgtgaagatcatttcagcactggtgattgtggtgagaaatcatgatgacctaataacagtgactgccacactagc

SEQ ID NO: 74489 - DNA, 75 bp, Artificial Sequence
  Synthetic
tggcgttggcttaaacagaaagtgtcacagtactatgggatacccacagctgagcgtcaaaacaacgggtggctc

SEQ ID NO: 74490 - DNA, 75 bp, Artificial Sequence
  Synthetic
cacaagtatttggcttcccccttcaaccaggatttagctcagtattcaagagaacactactaggggagatactta

SEQ ID NO: 74491 - DNA, 75 bp, Artificial Sequence
  Synthetic
accaggatttagctcagtattcaagagaacactactaggggagatacttaattactatgcacactggagtggtag

SEQ ID NO: 74492 - DNA, 75 bp, Artificial Sequence
  Synthetic
tggctcaaaattaaaatcctaccggaggtgaaagaaaagcacgagtttttatccaggcttaaacagcttcccctc

SEQ ID NO: 74493 - DNA, 75 bp, Artificial Sequence
  Synthetic
tgccggcgcgcccaccgatcgcaaaggggcaatgctgggaacacatgtagtatgggatgtggggttgcaatctag

SEQ ID NO: 74494 - DNA, 75 bp, Artificial Sequence
  Synthetic
ggggcaatgctgggaacacatgtagtatgggatgtggggttgcaatctagctgcgtcttgtgcgttccgtggata

SEQ ID NO: 74495 - DNA, 75 bp, Artificial Sequence
  Synthetic
agcatagttgcaccagcggacgctcagagcaagtgttacatcatgtgcttcgtatccgcgtgcaatgacttctca

SEQ ID NO: 74496 - DNA, 75 bp, Artificial Sequence
  Synthetic
agagcaagtgttacatcatgtgcttcgtatccgcgtgcaatgacttctcagtcagattgctgcgcgacactccat

SEQ ID NO: 74497 - DNA, 75 bp, Artificial Sequence
  Synthetic
caattgccagtggaccgtccaactcaactgaagtgcctgctttaacagctgtggagacagggcacacatcacagg

SEQ ID NO: 74498 - DNA, 75 bp, Artificial Sequence
  Synthetic
aactgaagtgcctgctttaacagctgtggagacagggcacacatcacaggtcacaccgggggacacaatgcaaac

SEQ ID NO: 74499 - DNA, 75 bp, Artificial Sequence
  Synthetic
tgttctgtcagatggtgtccagtgtagattttgtaccgccaatggctgcattagaggagaaaggtattctgttca

SEQ ID NO: 74500 - DNA, 75 bp, Artificial Sequence
  Synthetic
cttcacctcatacaaaacacttgatcaaaaacaagagaacaggtactctagttggatcataacgacccgcaaggt

SEQ ID NO: 74501 - DNA, 75 bp, Artificial Sequence
  Synthetic
caaaaacaagagaacaggtactctagttggatcataacgacccgcaaggttgctcagctgaggaggaaaatggaa

SEQ ID NO: 74502 - DNA, 75 bp, Artificial Sequence
  Synthetic
tgtcagtgaagacatgcgatgaagagtgctgtccggttaatttcaagaggtgttgccctctcgtctgtggcaagg

SEQ ID NO: 74503 - DNA, 75 bp, Artificial Sequence
  Synthetic
agtcaggacacgccagtgttgacccaccagataatgtacgtccctcctggtggtccagtgccggcgtctgtagat

SEQ ID NO: 74504 - DNA, 75 bp, Artificial Sequence
  Synthetic
accagataatgtacgtccctcctggtggtccagtgccggcgtctgtagatagttacacctggcaatcctcgacca

SEQ ID NO: 74505 - DNA, 75 bp, Artificial Sequence
  Synthetic
acagtaatttttatgatggctggtcgcacttctcacaaactggagtatatgggttcaacacattgaacaatatgg

SEQ ID NO: 74506 - DNA, 75 bp, Artificial Sequence
  Synthetic
gcacttctcacaaactggagtatatgggttcaacacattgaacaatatgggccaattatacttcaggcatgtcaa

SEQ ID NO: 74507 - DNA, 75 bp, Artificial Sequence
  Synthetic
aagaccaccaaggctgtgcaattatgagaggtcagaaaatgtaaacttccaggtgatgggggtgactgacacccg

SEQ ID NO: 74508 - DNA, 75 bp, Artificial Sequence
  Synthetic
gagaggtcagaaaatgtaaacttccaggtgatgggggtgactgacacccgagactcaattacagcacaaccgggc

SEQ ID NO: 74509 - DNA, 75 bp, Artificial Sequence
  Synthetic
gtgcctacactaaggcaagccaaagtgcaaggccccgcttttgaatttgctgtggctatgatgaaaagaaactcc

SEQ ID NO: 74510 - DNA, 75 bp, Artificial Sequence
  Synthetic
gtcaatagacacctcgctacgcacactgattggcagaactgcgtgtgggaggactataacagggacctcttggta

SEQ ID NO: 74511 - DNA, 75 bp, Artificial Sequence
  Synthetic
ctgattggcagaactgcgtgtgggaggactataacagggacctcttggtaagcaccaccacagctcacgggtgtg

SEQ ID NO: 74512 - DNA, 75 bp, Artificial Sequence
  Synthetic
tgaatgagcaagaggttggcgtgttggatgcaaaggagttagtggacaaagatggcacaaatctcgagctgacac

SEQ ID NO: 74513 - DNA, 75 bp, Artificial Sequence
  Synthetic
gttcagggacatcagaggtttcttagctaaagaagaagttgaagttaacgaggctgtcctagcaataaacaccag

SEQ ID NO: 74514 - DNA, 75 bp, Artificial Sequence
  Synthetic
tcgaaggtcctggtttggtcgaggtgcaggagagtgagtactatcctaagagataccaatcgcacgttttactag

SEQ ID NO: 74515 - DNA, 75 bp, Artificial Sequence
  Synthetic
gcaggagagtgagtactatcctaagagataccaatcgcacgttttactagcggcaggattttcagaaccagggga

SEQ ID NO: 74516 - DNA, 75 bp, Artificial Sequence
  Synthetic
aaagagaatgcttatgtacaatttccccactagagcaggccaatgcggtggtgttatcatgtccactggcaaagt

SEQ ID NO: 74517 - DNA, 75 bp, Artificial Sequence
  Synthetic
tgctgacgtgcgagaccttctatggttggaagatgatgcaatggaacagggagtgaaagattatgttgaacaact

SEQ ID NO: 74518 - DNA, 75 bp, Artificial Sequence
  Synthetic
ttggaagatgatgcaatggaacagggagtgaaagattatgttgaacaactagggaacgcctttggctcaggcttc

SEQ ID NO: 74519 - DNA, 75 bp, Artificial Sequence
  Synthetic
attggggatacatgttggtgggaatggccagcaaggcttctcagcagctctcttaaggcactacttcaatgatga

SEQ ID NO: 74520 - DNA, 75 bp, Artificial Sequence
  Synthetic
ctcaaagccctagtaaagatcatatcagcactggtcattgtggtgagaaatcatgatgatttaattacagtgaca

SEQ ID NO: 74521 - DNA, 75 bp, Artificial Sequence
  Synthetic
cagcactggtcattgtggtgagaaatcatgatgatttaattacagtgacagcaacactggcccttattggctgca

SEQ ID NO: 74522 - DNA, 75 bp, Artificial Sequence
  Synthetic
atagttggctcaagaaattcaccgagatgaccaatgcatgcaagggcatggaatggatagccatcaaaattcaaa

SEQ ID NO: 74523 - DNA, 75 bp, Artificial Sequence
  Synthetic
gatgaccaatgcatgcaagggcatggaatggatagccatcaaaattcaaaagttcattgagtggttgaaagtcaa

SEQ ID NO: 74524 - DNA, 75 bp, Artificial Sequence
  Synthetic
gaagcacttgatttgaccaccagtgcaggatacccgtacgtcgcattgggcattaagaagagagatatcttgtct

SEQ ID NO: 74525 - DNA, 75 bp, Artificial Sequence
  Synthetic
tgccaccatcgaacaaagcgcaccctcacagagtgaccaggaacaactgttttcaaacgtccagtacttcgcgca

SEQ ID NO: 74526 - DNA, 75 bp, Artificial Sequence
  Synthetic
tcacagagtgaccaggaacaactgttttcaaacgtccagtacttcgcgcactattgcaggaagtacgctcctctg

SEQ ID NO: 74527 - DNA, 75 bp, Artificial Sequence
  Synthetic
cgtattgaacccgtatgtcttttactgcatggaagtcctggtgctggaaagtctgtggcgactaacctgattggc

SEQ ID NO: 74528 - DNA, 75 bp, Artificial Sequence
  Synthetic
tgcatggaagtcctggtgctggaaagtctgtggcgactaacctgattggccgttcactcgcagaaaagctcaaca

SEQ ID NO: 74529 - DNA, 75 bp, Artificial Sequence
  Synthetic
gattactccgggtacgatgccagtctgagccccgtgtggtttgcttgtttgaagctgctacttgaaaagcttggg

SEQ ID NO: 74530 - DNA, 75 bp, Artificial Sequence
  Synthetic
acctgtgtcaaaaccccgacggaaaagatgtgtccctgttctgccagatggtgtcgagtgttgactttgttccgc

SEQ ID NO: 74531 - DNA, 75 bp, Artificial Sequence
  Synthetic
agatgtgtccctgttctgccagatggtgtcgagtgttgactttgttccgccaatggcagctcttgaagaaaaagg

SEQ ID NO: 74532 - DNA, 75 bp, Artificial Sequence
  Synthetic
tagagcgcttgccagaaggttccactttgatatgaacattgaggtcatatccatgtacagtcagaacggaaagat

SEQ ID NO: 74533 - DNA, 75 bp, Artificial Sequence
  Synthetic
tttgatatgaacattgaggtcatatccatgtacagtcagaacggaaagatcaacatgccaatgtctgtgaagact

SEQ ID NO: 74534 - DNA, 75 bp, Artificial Sequence
  Synthetic
gacagaagaacacaggttaggtattcgttagatatgctagtgactgagatgttcagagagtacaaccacagacac

SEQ ID NO: 74535 - DNA, 75 bp, Artificial Sequence
  Synthetic
cgttagatatgctagtgactgagatgttcagagagtacaaccacagacacagtgtaggagcgacacttgaggcac

SEQ ID NO: 74536 - DNA, 75 bp, Artificial Sequence
  Synthetic
caatggggagcacgactacgaggaattcattaagaagatcagaagcgtcccagttggtcgctgtttaaccttacc

SEQ ID NO: 74537 - DNA, 75 bp, Artificial Sequence
  Synthetic
ctgacctgttgaaatcggtagatagtgaggcagtcagggaatactgtaaggaaagggggtggttagtacctgaga

SEQ ID NO: 74538 - DNA, 75 bp, Artificial Sequence
  Synthetic
tgaggcagtcagggaatactgtaaggaaagggggtggttagtacctgagaccaattccactctgcaaattgaaaa

SEQ ID NO: 74539 - DNA, 75 bp, Artificial Sequence
  Synthetic
ctacaagttgtttgctggcttccaaggtgcttacactgggatgcccaatcagaagcccaaggtgccaacattaag

SEQ ID NO: 74540 - DNA, 75 bp, Artificial Sequence
  Synthetic
ggtgcttacactgggatgcccaatcagaagcccaaggtgccaacattaagacaagcaaaagttcaagggcccgcc

SEQ ID NO: 74541 - DNA, 75 bp, Artificial Sequence
  Synthetic
aaaggtcaataggcgatccagtactccaactgggtttggaccaagcacttctgttaccccggaccgagtaccaat

SEQ ID NO: 74542 - DNA, 75 bp, Artificial Sequence
  Synthetic
gggatttatgatagatgggcggtattgccccggcacgccaaacctggacccactatcctaatgaatgatcaagag

SEQ ID NO: 74543 - DNA, 75 bp, Artificial Sequence
  Synthetic
tgccccggcacgccaaacctggacccactatcctaatgaatgatcaagaggtgggcgtggtggacgccaaagaac

SEQ ID NO: 74544 - DNA, 75 bp, Artificial Sequence
  Synthetic
ggggtttcctaacacgagaggaggctgaggtcaatgaagctgtgcttgccatcaacaccagcaagttcccaaaca

SEQ ID NO: 74545 - DNA, 75 bp, Artificial Sequence
  Synthetic
tgaggtcaatgaagctgtgcttgccatcaacaccagcaagttcccaaacatgtacattccagttggacaagtcac

SEQ ID NO: 74546 - DNA, 75 bp, Artificial Sequence
  Synthetic
gcagtgtggaggcgtcttgatgtcaacaggtaaggtgcttggaatccacgtcggtggtaatgggcaccaggggtt

SEQ ID NO: 74547 - DNA, 75 bp, Artificial Sequence
  Synthetic
acaggtaaggtgcttggaatccacgtcggtggtaatgggcaccaggggttttcagcagccttgttgcgccactac

SEQ ID NO: 74548 - DNA, 75 bp, Artificial Sequence
  Synthetic
ggttttgttccattaaattttaaagttctaagaacccttaactttatcttagtactcaatacggcaaaatgggag

SEQ ID NO: 74549 - DNA, 75 bp, Artificial Sequence
  Synthetic
agtaggacaaaactagaacccagtgttttccatcacatcttcgaaggaaacaaggagccagcagtgttgaggaat

SEQ ID NO: 74550 - DNA, 75 bp, Artificial Sequence
  Synthetic
caaatattaactattacaaagatgcagcttcgaactcagcaaatagacaagacttcgctcaagacccgggaaagt

SEQ ID NO: 74551 - DNA, 75 bp, Artificial Sequence
  Synthetic
ttgaggaagccatcttctccaaatacattggtaatgtaaacactcacgtagatgagtacatgatggaagctgtcg

SEQ ID NO: 74552 - DNA, 75 bp, Artificial Sequence
  Synthetic
tctccaacggttgaagagtgcggatacagtgacagggtaagatccatcacactaggcaactccaccattactaca

SEQ ID NO: 74553 - DNA, 75 bp, Artificial Sequence
  Synthetic
ctgaaggcctggaagcactggacctgaccacaagtgcagggtacccctacgttgcccttggcatcaaaaagagag

SEQ ID NO: 74554 - DNA, 75 bp, Artificial Sequence
  Synthetic
gaccacaagtgcagggtacccctacgttgcccttggcatcaaaaagagagatattttgtccaagaagaccaaaga

SEQ ID NO: 74555 - DNA, 75 bp, Artificial Sequence
  Synthetic
gagatcagctgagaaagtggctaaaggtaaatctaggctaattgaggcatcgagtctaaacgactcagtagctat

SEQ ID NO: 74556 - DNA, 75 bp, Artificial Sequence
  Synthetic
ggtaaatctaggctaattgaggcatcgagtctaaacgactcagtagctatgagacagaccttcgggaatctgtac

SEQ ID NO: 74557 - DNA, 75 bp, Artificial Sequence
  Synthetic
atgtacagtgcaatgcgtccaaattccaccaggggtgcctattggtagtgtgtgtaccagaggctgaaatgggat

SEQ ID NO: 74558 - DNA, 75 bp, Artificial Sequence
  Synthetic
tgtgtaccagaggctgaaatgggatgtgcgactctggacaatacaccatcgagcgaagaattgctagggggtgat

SEQ ID NO: 74559 - DNA, 75 bp, Artificial Sequence
  Synthetic
atcccagtcatgcttgacggccatctcattgcatttgattacagtgggtatgatgctagcttgagtccggtgtgg

SEQ ID NO: 74560 - DNA, 75 bp, Artificial Sequence
  Synthetic
tcattgcatttgattacagtgggtatgatgctagcttgagtccggtgtggtttgcatgtctgaaactgttgttag

SEQ ID NO: 74561 - DNA, 75 bp, Artificial Sequence
  Synthetic
ggcatggggataggagtggggaacctaaccatcttcccgcaccagtggatcaatttgcgcacgaacaacagcgcc

SEQ ID NO: 74562 - DNA, 75 bp, Artificial Sequence
  Synthetic
aacactacttcgtgagaggagggatgccatctgggtgctcaggaaccagcatttttaattcgatgatcaacaaca

SEQ ID NO: 74563 - DNA, 75 bp, Artificial Sequence
  Synthetic
caatttgcgcacgaacaacagcgccacaattgtgatgccgtacacgaatagtgtacctatggacaatatgttcag

SEQ ID NO: 74564 - DNA, 75 bp, Artificial Sequence
  Synthetic
gccatctgggtgctcaggaaccagcatttttaattcgatgatcaacaacataattatcaggacactgttgctgaa

SEQ ID NO: 74565 - DNA, 75 bp, Artificial Sequence
  Synthetic
aatcaccgtaacaatagcacccatgtgcgctgagtacaacgggctgcgactggcgggccatcaaggcttgccaac

SEQ ID NO: 74566 - DNA, 75 bp, Artificial Sequence
  Synthetic
ccctatagacgcctcactgctagctgaagctggcaaagggtatggtctgatcatgactccagctgataaggggga

SEQ ID NO: 74567 - DNA, 75 bp, Artificial Sequence
  Synthetic
tgcgctgagtacaacgggctgcgactggcgggccatcaaggcttgccaacgatgaacaccccggggagctgccaa

SEQ ID NO: 74568 - DNA, 75 bp, Artificial Sequence
  Synthetic
tcatgactccagctgataagggggagtgctttaatgaggtaacatggaccaacgttaccttcttgaaaagatact

SEQ ID NO: 74569 - DNA, 75 bp, Artificial Sequence
  Synthetic
ggtgaagtgaaaaatttaatggagatagcagaagttgactcagtggtgccggtgcaaaacattggagagaaagta

SEQ ID NO: 74570 - DNA, 75 bp, Artificial Sequence
  Synthetic
tagcagaagttgactcagtggtgccggtgcaaaacattggagagaaagtaaactctatggaagcctatcagatac

SEQ ID NO: 74571 - DNA, 75 bp, Artificial Sequence
  Synthetic
ggactaaagatcccaaaaacacccaagatcatgtgcgatccttgtgcctattggcttggcacaatggagagcaag

SEQ ID NO: 74572 - DNA, 75 bp, Artificial Sequence
  Synthetic
agatcatgtgcgatccttgtgcctattggcttggcacaatggagagcaagaatatgaagaatttgtgtccaagat

SEQ ID NO: 74573 - DNA, 75 bp, Artificial Sequence
  Synthetic
agcggacactattgggagaaatattgaattactacacacattggtcagggagtctgaagttgacattcgtgttct

SEQ ID NO: 74574 - DNA, 75 bp, Artificial Sequence
  Synthetic
agtctgaagttgacattcgtgttctgtggctcggccatggccactggaaagtttctgcttgcttattcaccacct

SEQ ID NO: 74575 - DNA, 75 bp, Artificial Sequence
  Synthetic
agttgtgtgctctgtgtgccatggatcagccaaacgcactacagatacgtggtggatgataaatacacagctagt

SEQ ID NO: 74576 - DNA, 75 bp, Artificial Sequence
  Synthetic
tcagccaaacgcactacagatacgtggtggatgataaatacacagctagtgggttcatatcatgttggtaccaga

SEQ ID NO: 74577 - DNA, 75 bp, Artificial Sequence
  Synthetic
ctgttcgcatgttgagggacacacaattcatcaaacaggacaacttttaccaagggccaacagaagattcagtgg

SEQ ID NO: 74578 - DNA, 75 bp, Artificial Sequence
  Synthetic
attcatcaaacaggacaacttttaccaagggccaacagaagattcagtggagcgcgcaatgggcagagtagcaga

SEQ ID NO: 74579 - DNA, 75 bp, Artificial Sequence
  Synthetic
agtggatccaagtgacaccatgcaaaccaggcacgtgcacaactatcacacaaggtctgagtcatcaatagaaaa

SEQ ID NO: 74580 - DNA, 75 bp, Artificial Sequence
  Synthetic
accaggcacgtgcacaactatcacacaaggtctgagtcatcaatagaaaacttcttgtgcaggtctgcatgtgtt

SEQ ID NO: 74581 - DNA, 75 bp, Artificial Sequence
  Synthetic
ttggattggccatccggtgacaaatagagcaattgtctatctgtttgttggttttattccactgaactttaaagt

SEQ ID NO: 74582 - DNA, 75 bp, Artificial Sequence
  Synthetic
gtggcacagctacgacggaaaatggaaatgttcacatatattcgctgtgacatggaattgacttttgtcataacc

SEQ ID NO: 74583 - DNA, 75 bp, Artificial Sequence
  Synthetic
aaatgttcacatatattcgctgtgacatggaattgacttttgtcataaccagccaccaggaaatgtctacagcta

SEQ ID NO: 74584 - DNA, 75 bp, Artificial Sequence
  Synthetic
gcgcacgaaactggggtgaatgcaagcggcaactctatagtccattatacaaatatcaactattataaagatgca

SEQ ID NO: 74585 - DNA, 75 bp, Artificial Sequence
  Synthetic
atgattatgtatggcaaacgtcaaccaaccccagcattttctggacagagggcaatgcaccacctagaatgtcaa

SEQ ID NO: 74586 - DNA, 75 bp, Artificial Sequence
  Synthetic
caaccccagcattttctggacagagggcaatgcaccacctagaatgtcaataccattcatgagtataggcaatgc

SEQ ID NO: 74587 - DNA, 75 bp, Artificial Sequence
  Synthetic
ataaaatcgctccctgccttgaactctccaacggttgaggagtgtggatatagtgacagggtaagatccatcacg

SEQ ID NO: 74588 - DNA, 75 bp, Artificial Sequence
  Synthetic
ctccaacggttgaggagtgtggatatagtgacagggtaagatccatcacgttaggcaactctaccatcactacac

SEQ ID NO: 74589 - DNA, 75 bp, Artificial Sequence
  Synthetic
ggggaccatctatgcgcgtcatgttaatgattccagcccaggcggtttaaccagtaccattcgcatctacttcaa

SEQ ID NO: 74590 - DNA, 75 bp, Artificial Sequence
  Synthetic
aatgattccagcccaggcggtttaaccagtaccattcgcatctacttcaaacccaaacatgtcaaggcatatgta

SEQ ID NO: 74591 - DNA, 75 bp, Artificial Sequence
  Synthetic
cgtgcaaacttggtaaccactggcccccgcggacaacagtctggagctgtgtatgtgggcaattacagaatcatt

SEQ ID NO: 74592 - DNA, 75 bp, Artificial Sequence
  Synthetic
cccgcggacaacagtctggagctgtgtatgtgggcaattacagaatcattaacagacacttagcgacaaattttg

SEQ ID NO: 74593 - DNA, 75 bp, Artificial Sequence
  Synthetic
cgtacaatgcaatgcatccaaattccaccaagggtgcttattggtagtgtgtgtaccggaggctgaaatgggatg

SEQ ID NO: 74594 - DNA, 75 bp, Artificial Sequence
  Synthetic
gtgtaccggaggctgaaatgggatgtgcgaccctagacaatacaccatcgagcgaagaattgctagggggtgaca

SEQ ID NO: 74595 - DNA, 75 bp, Artificial Sequence
  Synthetic
ctattgctaggtgccgatgcacatctggtgtttatttctgtgcatctagaaacaagcactaccccgtgatctttg

SEQ ID NO: 74596 - DNA, 75 bp, Artificial Sequence
  Synthetic
tggtgtttatttctgtgcatctagaaacaagcactaccccgtgatctttgaaggtccgggtttggtggaagttca

SEQ ID NO: 74597 - DNA, 75 bp, Artificial Sequence
  Synthetic
tggtggaatcttgaggtgtgaacatggtgtcattggtcttgtaaccatggggggagaaggagtcgtcggctttgc

SEQ ID NO: 74598 - DNA, 75 bp, Artificial Sequence
  Synthetic
ggtgtcattggtcttgtaaccatggggggagaaggagtcgtcggctttgctgatgtacgcgacctcctatggtta

SEQ ID NO: 74599 - DNA, 75 bp, Artificial Sequence
  Synthetic
gcgctgagtacaacgggctgcgactggcgggccatcaagggttgccaacgatgaatactccggggagttgccaat

SEQ ID NO: 74600 - DNA, 75 bp, Artificial Sequence
  Synthetic
aaccaaatttgtgagcaggtcaatctcctgaaagaatccctagtgggtcaagactccattttagagaaatccctg

SEQ ID NO: 74601 - DNA, 75 bp, Artificial Sequence
  Synthetic
tcctgaaagaatccctagtgggtcaagactccattttagagaaatccctgaaagcattggtcaagattatctcag

SEQ ID NO: 74602 - DNA, 75 bp, Artificial Sequence
  Synthetic
gtgaggtgaaaaatttaatggagatagcagaagttgattcagtggtaccggtgcaaaacattggagagaaagtga

SEQ ID NO: 74603 - DNA, 75 bp, Artificial Sequence
  Synthetic
cgtcaccatggcgttggctcaagcagaaagtgtctcagtattatggaattcctatggccgagagacaaaacaatg

SEQ ID NO: 74604 - DNA, 75 bp, Artificial Sequence
  Synthetic
gaaagtgtctcagtattatggaattcctatggccgagagacaaaacaatggatggctcaagaaattcactgaaat

SEQ ID NO: 74605 - DNA, 75 bp, Artificial Sequence
  Synthetic
cctaccagaagtgaaggaaaagcatgagtttctcagcaggttaaaacagctaccgctcttggagagtcagatcgc

SEQ ID NO: 74606 - DNA, 75 bp, Artificial Sequence
  Synthetic
taccgctcttggagagtcagatcgcaaccatagagcagagcgcaccatcacaaagtgatcaggagcaactctttt

SEQ ID NO: 74607 - DNA, 75 bp, Artificial Sequence
  Synthetic
ttgtgtcagcttgcaacgacttctctgtgagactactgaaagacacaccatttatatcgcagcaaaattttctcc

SEQ ID NO: 74608 - DNA, 75 bp, Artificial Sequence
  Synthetic
cagtatattcactaccgccagatcccgaccactttgacggctacaagcaacaggcagtagtgattatggatgact

SEQ ID NO: 74609 - DNA, 75 bp, Artificial Sequence
  Synthetic
cgaccactttgacggctacaagcaacaggcagtagtgattatggatgacttgtgccagaatcctgatgggaaaga

SEQ ID NO: 74610 - DNA, 75 bp, Artificial Sequence
  Synthetic
ctgaagctataccggcccttacagcagctgagactgggcacacatctcaagttgttccaggtgacaccatgcaaa

SEQ ID NO: 74611 - DNA, 75 bp, Artificial Sequence
  Synthetic
agctgagactgggcacacatctcaagttgttccaggtgacaccatgcaaacgcgccacgtaaaaaattatcactc

SEQ ID NO: 74612 - DNA, 75 bp, Artificial Sequence
  Synthetic
cctcttcacatcgccatttgttttggcttcaactaatgcaggatccattaacgctcctaccgtgtcagacagtag

SEQ ID NO: 74613 - DNA, 75 bp, Artificial Sequence
  Synthetic
gcttcaactaatgcaggatccattaacgctcctaccgtgtcagacagtagggcacttgccaggaggtttcacttt

SEQ ID NO: 74614 - DNA, 75 bp, Artificial Sequence
  Synthetic
gatgaagaatgctgtccagccaattttaataaatgttgtccactagtgtgtggcaaagctatccaatttattgac

SEQ ID NO: 74615 - DNA, 75 bp, Artificial Sequence
  Synthetic
ttaataaatgttgtccactagtgtgtggcaaagctatccaatttattgacagaagaacccaagttagatactcac

SEQ ID NO: 74616 - DNA, 75 bp, Artificial Sequence
  Synthetic
atgtatgtgccaccaggtggcccggtaccagataaggttgactcatatgtgtggcagacgtccactaatcccagt

SEQ ID NO: 74617 - DNA, 75 bp, Artificial Sequence
  Synthetic
taccagataaggttgactcatatgtgtggcagacgtccactaatcccagtgttttctggaccgaaggtaatgcgc

SEQ ID NO: 74618 - DNA, 75 bp, Artificial Sequence
  Synthetic
tccaagggccccctgtctatagggaaatcaagatcagcgtggccccggaaacgcctccccccccagcaattgctg

SEQ ID NO: 74619 - DNA, 75 bp, Artificial Sequence
  Synthetic
aatcaagatcagcgtggccccggaaacgcctccccccccagcaattgctgatctcctgaaatcagtggatagcga

SEQ ID NO: 74620 - DNA, 75 bp, Artificial Sequence
  Synthetic
ccagaagcggggtgtatggtataaacactttgaataacatggggactctttatgcaaggcatgtgaatgctggga

SEQ ID NO: 74621 - DNA, 75 bp, Artificial Sequence
  Synthetic
cactttgaataacatggggactctttatgcaaggcatgtgaatgctgggagcacaggaccaataaaaagcactat

SEQ ID NO: 74622 - DNA, 75 bp, Artificial Sequence
  Synthetic
cgttagcagagcattcatctgtctgcaagccctaaccacttttgtatcagtggctggcataatatatatcattta

SEQ ID NO: 74623 - DNA, 75 bp, Artificial Sequence
  Synthetic
caagccctaaccacttttgtatcagtggctggcataatatatatcatttataaactgtttgccggctttcagggt

SEQ ID NO: 74624 - DNA, 75 bp, Artificial Sequence
  Synthetic
ggtgtaacgacaaccagacagagcatcacagcaatgacaaacaccggggcatttgggcaacaatcgggggcaata

SEQ ID NO: 74625 - DNA, 75 bp, Artificial Sequence
  Synthetic
gaattcgctgtggcaatgatgaaaagaaatgccagcaccgtgaagacggagtatggtgagtacaccatgctaggc

SEQ ID NO: 74626 - DNA, 75 bp, Artificial Sequence
  Synthetic
gaaatgccagcaccgtgaagacggagtatggtgagtacaccatgctaggcatttatgacaggtgggcagtgctac

SEQ ID NO: 74627 - DNA, 75 bp, Artificial Sequence
  Synthetic
tacaacagggacctattaataagcactaccactgctcatggatgtgacactatagcaagatgccaatgcacaaca

SEQ ID NO: 74628 - DNA, 75 bp, Artificial Sequence
  Synthetic
ctaccactgctcatggatgtgacactatagcaagatgccaatgcacaacaggcgtgtacttttgcgcctcgagga

SEQ ID NO: 74629 - DNA, 75 bp, Artificial Sequence
  Synthetic
ttgacaaggatggaaccaacctgggaaattggacactttggaagctcaaccgtaatgagaaatttagagacatca

SEQ ID NO: 74630 - DNA, 75 bp, Artificial Sequence
  Synthetic
aaattggacactttggaagctcaaccgtaatgagaaatttagagacatcaggggatttctagcaagagaggaagt

SEQ ID NO: 74631 - DNA, 75 bp, Artificial Sequence
  Synthetic
atcagtctcatgtattactcgccgcaggctactccgaaccaggggattgcgggggcatcctgagatgcgaacatg

SEQ ID NO: 74632 - DNA, 75 bp, Artificial Sequence
  Synthetic
aggctactccgaaccaggggattgcgggggcatcctgagatgcgaacatggcgtcattggtatcgtgactatggg

SEQ ID NO: 74633 - DNA, 75 bp, Artificial Sequence
  Synthetic
cgactacggattcctgaatctggggggaacccccacgaagaggatgctcatgtacaatttcccaaccagagcagg

SEQ ID NO: 74634 - DNA, 75 bp, Artificial Sequence
  Synthetic
ggaacccccacgaagaggatgctcatgtacaatttcccaaccagagcaggtcaatgtggcggcgtactcatgtca

SEQ ID NO: 74635 - DNA, 75 bp, Artificial Sequence
  Synthetic
caaggactatgtggaacaattgggaaatgcctttggctcaggattcacaaaccaaatctgtgaacaggtcaacct

SEQ ID NO: 74636 - DNA, 75 bp, Artificial Sequence
  Synthetic
aatgcctttggctcaggattcacaaaccaaatctgtgaacaggtcaacctcctcaaggagtcccttgttgggcaa

SEQ ID NO: 74637 - DNA, 75 bp, Artificial Sequence
  Synthetic
ttcaatgaagagcaaggtgagattgaattcatcgagagctcaagggatgctggattccccgtgattaacacccct

SEQ ID NO: 74638 - DNA, 75 bp, Artificial Sequence
  Synthetic
aattcatcgagagctcaagggatgctggattccccgtgattaacacccctagtaaaaccaagttggaaccaagcg

SEQ ID NO: 74639 - DNA, 75 bp, Artificial Sequence
  Synthetic
gatgatctcattaccgtgaccgccacactggccctcatcggttgcacatcctcaccgtggcgctggctcaaacaa

SEQ ID NO: 74640 - DNA, 75 bp, Artificial Sequence
  Synthetic
cactggccctcatcggttgcacatcctcaccgtggcgctggctcaaacaaaaggtgtcacagtactacggcattc

SEQ ID NO: 74641 - DNA, 75 bp, Artificial Sequence
  Synthetic
ttgaagaagcaatcttttctaagtatattggtaatgttaacacccatgtggatgagtacatgttagaagccgtgg

SEQ ID NO: 74642 - DNA, 75 bp, Artificial Sequence
  Synthetic
tattggtaatgttaacacccatgtggatgagtacatgttagaagccgtggatcactacgctggacagttggccac

SEQ ID NO: 74643 - DNA, 75 bp, Artificial Sequence
  Synthetic
ggattgccgtcaaaattcaaaagtttatagaatggctgaaggtcaaaatcttgccggaggtcaaagagaaacacg

SEQ ID NO: 74644 - DNA, 75 bp, Artificial Sequence
  Synthetic
tatagaatggctgaaggtcaaaatcttgccggaggtcaaagagaaacacgagtttctgaacaggctaaagcaatt

SEQ ID NO: 74645 - DNA, 75 bp, Artificial Sequence
  Synthetic
gaccaccagtgcgggctatccctatgtagcattgggcatgaaaaagagagacatcctgtccaagaaaaccagaga

SEQ ID NO: 74646 - DNA, 75 bp, Artificial Sequence
  Synthetic
gtagcattgggcatgaaaaagagagacatcctgtccaagaaaaccagagatcttaccaagctgaaagaatgtatg

SEQ ID NO: 74647 - DNA, 75 bp, Artificial Sequence
  Synthetic
caatgtccagtactttgcacattattgcaggaagtatgcccccttgtatgctgctgaggcaaaaagagtgttctc

SEQ ID NO: 74648 - DNA, 75 bp, Artificial Sequence
  Synthetic
tgcaggaagtatgcccccttgtatgctgctgaggcaaaaagagtgttctccctagagaggaagatgagtaactac

SEQ ID NO: 74649 - DNA, 75 bp, Artificial Sequence
  Synthetic
gggaaatctaggctcatggaggcttctagtcttaacgactctgtggcaatgaggcaaacatttggaaacctgtac

SEQ ID NO: 74650 - DNA, 75 bp, Artificial Sequence
  Synthetic
ctagtcttaacgactctgtggcaatgaggcaaacatttggaaacctgtacaaaacctttcaccttaacccgggca

SEQ ID NO: 74651 - DNA, 75 bp, Artificial Sequence
  Synthetic
gtggcgaccaacttaatcgggcgttcacttgcagaaaaacttaacagttcagtgtactccctaccacccgatcct

SEQ ID NO: 74652 - DNA, 75 bp, Artificial Sequence
  Synthetic
cacttgcagaaaaacttaacagttcagtgtactccctaccacccgatcctgatcactttgatggttataaacaac

SEQ ID NO: 74653 - DNA, 75 bp, Artificial Sequence
  Synthetic
tcatagcatttgattactccggttacgatgccagtctcagtccggtgtggtttgcgtgcctaaagctcctccttg

SEQ ID NO: 74654 - DNA, 75 bp, Artificial Sequence
  Synthetic
cgatgccagtctcagtccggtgtggtttgcgtgcctaaagctcctccttgggaaactggggtacgcaaataagga

SEQ ID NO: 74655 - DNA, 75 bp, Artificial Sequence
  Synthetic
cgagtgttgacttcgttccaccaatggcggcgcttgaggaaaagggcattctgttcacatcaccgtttgtcctcg

SEQ ID NO: 74656 - DNA, 75 bp, Artificial Sequence
  Synthetic
ggcggcgcttgaggaaaagggcattctgttcacatcaccgtttgtcctcgcttctactaatgcaggatcgatcaa

SEQ ID NO: 74657 - DNA, 75 bp, Artificial Sequence
  Synthetic
gccatcaggatgttcaggcactagcatattcaattccatgatcaataacatcataattaggaccctcatgctaaa

SEQ ID NO: 74658 - DNA, 75 bp, Artificial Sequence
  Synthetic
atattcaattccatgatcaataacatcataattaggaccctcatgctaaaagtctacaaaggaattgacttggat

SEQ ID NO: 74659 - DNA, 75 bp, Artificial Sequence
  Synthetic
gtacagccaaaatggtaagatcaacatgccaatgtcagtaaaaacctgtgatgaggaatgctgtccagtcaactt

SEQ ID NO: 74660 - DNA, 75 bp, Artificial Sequence
  Synthetic
atgccaatgtcagtaaaaacctgtgatgaggaatgctgtccagtcaacttcaaaaagtgttgtccgctggtctgt

SEQ ID NO: 74661 - DNA, 75 bp, Artificial Sequence
  Synthetic
gaagcaggaaaagactacggcctgatcatgactccagctgacaagggtgagtgctttaatgaggtaacctgggca

SEQ ID NO: 74662 - DNA, 75 bp, Artificial Sequence
  Synthetic
tcatgactccagctgacaagggtgagtgctttaatgaggtaacctgggcaaatgtgacttttttgaagaggtatt

SEQ ID NO: 74663 - DNA, 75 bp, Artificial Sequence
  Synthetic
agagagtacaatcacaggcacagcgtgggcgctacgcttgaagcactctttcaaggcccaccagtatacagggag

SEQ ID NO: 74664 - DNA, 75 bp, Artificial Sequence
  Synthetic
tgggcgctacgcttgaagcactctttcaaggcccaccagtatacagggagattaaaatcagtgtcgctcctgaaa

SEQ ID NO: 74665 - DNA, 75 bp, Artificial Sequence
  Synthetic
ggaccaaggatccaaaaaacacacaagaccatgtgcgatcgctgtgcctattggcttggcacaatggagagcacg

SEQ ID NO: 74666 - DNA, 75 bp, Artificial Sequence
  Synthetic
ttggcttggcacaatggagagcacgaatatgaggagtttatccgcaagattagaagcgtgcccgttgggcgctgc

SEQ ID NO: 74667 - DNA, 75 bp, Artificial Sequence
  Synthetic
aggggtggttgatgcttgaaatcaattccaccctgcaaatcgagaagcacgtcagcagagccttcatctgcctgc

SEQ ID NO: 74668 - DNA, 75 bp, Artificial Sequence
  Synthetic
ggcgggcataatatacatcatctacaagttgttcgctggcttccagggcgcttacaccgggcttcccaatcaaag

SEQ ID NO: 74669 - DNA, 75 bp, Artificial Sequence
  Synthetic
ttaaaacagcctgtgggttgtacccacccacagggcccaatgggcgctagcacactggtattccggtacctttgt

SEQ ID NO: 74670 - DNA, 75 bp, Artificial Sequence
  Synthetic
ccagctgtgttttggccaagtacttctgtgtccccggactgagtatcaataagctgcttgcgcggctgaaggaga

SEQ ID NO: 74671 - DNA, 75 bp, Artificial Sequence
  Synthetic
ggataaggatggcaccaacctagagctgacactcttaaaactcaacaggaatgagaagtttagagacatccgagg

SEQ ID NO: 74672 - DNA, 75 bp, Artificial Sequence
  Synthetic
ctgacactcttaaaactcaacaggaatgagaagtttagagacatccgaggcttcttggcaagagaggaggttgag

SEQ ID NO: 74673 - DNA, 75 bp, Artificial Sequence
  Synthetic
ctgcctgtggggcaacccgcaggacgctctgatacagacatggtgtgaagagcctattgagctagttggtagtcc

SEQ ID NO: 74674 - DNA, 75 bp, Artificial Sequence
  Synthetic
tatggtttcctaaatttgggtggaactcccaccaaacgcatgctaatgtacaactttcctacacgtgcaggacag

SEQ ID NO: 74675 - DNA, 75 bp, Artificial Sequence
  Synthetic
ctcccaccaaacgcatgctaatgtacaactttcctacacgtgcaggacagtgtggtggtgtcttgatgtcaacag

SEQ ID NO: 74676 - DNA, 75 bp, Artificial Sequence
  Synthetic
atgaagagcagggcgaaattgaattcattgagagctccaaggaagccggtttcccggtcattaacactcccagta

SEQ ID NO: 74677 - DNA, 75 bp, Artificial Sequence
  Synthetic
cattgagagctccaaggaagccggtttcccggtcattaacactcccagtaaaacaaaactcgagcccagtgtctt

SEQ ID NO: 74678 - DNA, 75 bp, Artificial Sequence
  Synthetic
gagactcaatacgataaaatgggagcacaggtgtcaacacaaaagacaggggcacacgagactagtttgagcgcc

SEQ ID NO: 74679 - DNA, 75 bp, Artificial Sequence
  Synthetic
ggaagccattttctctaagtacattggaaatgtgaacacacatgtggatgagtacatgatggaagccgttgacca

SEQ ID NO: 74680 - DNA, 75 bp, Artificial Sequence
  Synthetic
cacaggtgtcaacacaaaagacaggggcacacgagactagtttgagcgccagtggaaactcgattattcattaca

SEQ ID NO: 74681 - DNA, 75 bp, Artificial Sequence
  Synthetic
ttatgccgggcagctagcaaccttagacatcagtacagaacccatgaagcttgaggacgctgtctatggcactga

SEQ ID NO: 74682 - DNA, 75 bp, Artificial Sequence
  Synthetic
tcacagaaccggtaaaggatgtgatgataaagtcgctgccagcgctcaattccccgactgtagaggagtgcggat

SEQ ID NO: 74683 - DNA, 75 bp, Artificial Sequence
  Synthetic
gataaagtcgctgccagcgctcaattccccgactgtagaggagtgcggatatagcgacagagttagatcaataac

SEQ ID NO: 74684 - DNA, 75 bp, Artificial Sequence
  Synthetic
tagcgacgaagaggcaacagcggaagaccagcccacccaacctgatgtggcaacgtgtaggttttacacgttgaa

SEQ ID NO: 74685 - DNA, 75 bp, Artificial Sequence
  Synthetic
gaccagcccacccaacctgatgtggcaacgtgtaggttttacacgttgaattcagtgaaatgggagatgcagtca

SEQ ID NO: 74686 - DNA, 75 bp, Artificial Sequence
  Synthetic
cctcaacgactcaatagccatgagacagactttcgggaacctgtataaaacattccacctcaatccaggtatagt

SEQ ID NO: 74687 - DNA, 75 bp, Artificial Sequence
  Synthetic
cagactttcgggaacctgtataaaacattccacctcaatccaggtatagtgacaggcagtgcagtcggttgcgat

SEQ ID NO: 74688 - DNA, 75 bp, Artificial Sequence
  Synthetic
ctaggcagatcagggtacacaattcatgtgcaatgcaacgcatccaaattccaccaaggttgtctgcttgtggtg

SEQ ID NO: 74689 - DNA, 75 bp, Artificial Sequence
  Synthetic
atgtgcaatgcaacgcatccaaattccaccaaggttgtctgcttgtggtgtgtgtgcctgaggctgagatgggat

SEQ ID NO: 74690 - DNA, 75 bp, Artificial Sequence
  Synthetic
gccagcctgagtccagtatggttcgcctgtctgaaactgttattagagaaactggggtacacacacaaagaaacc

SEQ ID NO: 74691 - DNA, 75 bp, Artificial Sequence
  Synthetic
cctgtctgaaactgttattagagaaactggggtacacacacaaagaaaccaattacatagattacctatgcaact

SEQ ID NO: 74692 - DNA, 75 bp, Artificial Sequence
  Synthetic
cagccacaggtaagacagctgtgcagacggctgtgtgcaatgcgggtatgggtgtgggggttggtaacttgacta

SEQ ID NO: 74693 - DNA, 75 bp, Artificial Sequence
  Synthetic
gacggctgtgtgcaatgcgggtatgggtgtgggggttggtaacttgactatataccctcaccaatggattaattt

SEQ ID NO: 74694 - DNA, 75 bp, Artificial Sequence
  Synthetic
ttaattccatgatcaataacataattattagaacactgatgttgaaggtgtacaaggggatagacttggatcagt

SEQ ID NO: 74695 - DNA, 75 bp, Artificial Sequence
  Synthetic
tattagaacactgatgttgaaggtgtacaaggggatagacttggatcagttcaggatgatagcgtatggagacga

SEQ ID NO: 74696 - DNA, 75 bp, Artificial Sequence
  Synthetic
taactttacattaatgataataccctttgcaccgttggactacgttacgggagcgtcctcttacatccctatcac

SEQ ID NO: 74697 - DNA, 75 bp, Artificial Sequence
  Synthetic
tttgcaccgttggactacgttacgggagcgtcctcttacatccctatcacagtgacagttgcccctatgagcgct

SEQ ID NO: 74698 - DNA, 75 bp, Artificial Sequence
  Synthetic
gacaccagctgataagggggagtgttttaacgaggtgacatggaccaacgtcaccttcttgaaaagatactttag

SEQ ID NO: 74699 - DNA, 75 bp, Artificial Sequence
  Synthetic
tttaacgaggtgacatggaccaacgtcaccttcttgaaaagatactttagggcagatgaacagtaccccttcctc

SEQ ID NO: 74700 - DNA, 75 bp, Artificial Sequence
  Synthetic
acgtcagatgattttcaatcaccatcagctatgccacagtttgatgtgaccccagagatgaacattccagggcaa

SEQ ID NO: 74701 - DNA, 75 bp, Artificial Sequence
  Synthetic
cagctatgccacagtttgatgtgaccccagagatgaacattccagggcaagtgaggaacctgatggaaattgcgg

SEQ ID NO: 74702 - DNA, 75 bp, Artificial Sequence
  Synthetic
catgtgcgatccttgtgcttgttggcttggcataatggagagcaagaatatgaagaatttgtatccaagatcagg

SEQ ID NO: 74703 - DNA, 75 bp, Artificial Sequence
  Synthetic
ggtccactgacgagatgggaggacagatatttggcttccccttacagccaggggcatcaagcgtgttacaaagaa

SEQ ID NO: 74704 - DNA, 75 bp, Artificial Sequence
  Synthetic
caggaggtggctagattctttttaagagcacaatttgatttaattccaattggcttaaccctaccacacttaccg

SEQ ID NO: 74705 - DNA, 75 bp, Artificial Sequence
  Synthetic
gatatttggcttccccttacagccaggggcatcaagcgtgttacaaagaacactactgggagagatattaaatta

SEQ ID NO: 74706 - DNA, 75 bp, Artificial Sequence
  Synthetic
actagcatactcaccacctggagcaggggcaccagacagcaggaagaacgctatgttagggacccacgtcatatg

SEQ ID NO: 74707 - DNA, 75 bp, Artificial Sequence
  Synthetic
cagctgggctctggtcaagtacttctgttaccccggactaagtatcaataagcggctaacgcggctgaaggagaa

SEQ ID NO: 74708 - DNA, 75 bp, Artificial Sequence
  Synthetic
ggggcaccagacagcaggaagaacgctatgttagggacccacgtcatatgggacgttggactgcaatccagctgt

SEQ ID NO: 74709 - DNA, 75 bp, Artificial Sequence
  Synthetic
atttcgtgctggtaccaaactaatgtcatagtcccagctgaagctcagaaatcgtgctacataatgtgctttgtg

SEQ ID NO: 74710 - DNA, 75 bp, Artificial Sequence
  Synthetic
tcatagtcccagctgaagctcagaaatcgtgctacataatgtgctttgtgtcagcatgcaacgatttctctgtac

SEQ ID NO: 74711 - DNA, 75 bp, Artificial Sequence
  Synthetic
caatggggagagttgcagacacgattgcccgcggcccatcgaactctgagcaaatcccagctctgacagctgtgg

SEQ ID NO: 74712 - DNA, 75 bp, Artificial Sequence
  Synthetic
tgcccgcggcccatcgaactctgagcaaatcccagctctgacagctgtggagactggacatacttcccaggtgga

SEQ ID NO: 74713 - DNA, 75 bp, Artificial Sequence
  Synthetic
gtgcagatctgcttgcgtaatttatataaaatactccagtgctgaatcaaacaacctgaagcggtatgcggagtg

SEQ ID NO: 74714 - DNA, 75 bp, Artificial Sequence
  Synthetic
ctatcgaatacaacaaaatgggagctcaggtgtcgacacagaagactggggctcatgagaccctgctggaagctg

SEQ ID NO: 74715 - DNA, 75 bp, Artificial Sequence
  Synthetic
ataaaatactccagtgctgaatcaaacaacctgaagcggtatgcggagtgggttatcaacacaaggcaggtggct

SEQ ID NO: 74716 - DNA, 75 bp, Artificial Sequence
  Synthetic
tcaggtgtcgacacagaagactggggctcatgagaccctgctggaagctgcacaaggcgccaccataaattacac

SEQ ID NO: 74717 - DNA, 75 bp, Artificial Sequence
  Synthetic
caggagatgtccaccgccactaactcagatgttccagtgcagacacaccaaataatgtacgtgccacctggcggc

SEQ ID NO: 74718 - DNA, 75 bp, Artificial Sequence
  Synthetic
cacagagccagtcaaagacatcatgattaagtccatgccagcactgaactcaccgtccgcagaggagtgcgggta

SEQ ID NO: 74719 - DNA, 75 bp, Artificial Sequence
  Synthetic
cagatgttccagtgcagacacaccaaataatgtacgtgccacctggcggccctgtaccaacgtcagtcaacgact

SEQ ID NO: 74720 - DNA, 75 bp, Artificial Sequence
  Synthetic
attaagtccatgccagcactgaactcaccgtccgcagaggagtgcgggtacagtgacagggtgagatccatcacc

SEQ ID NO: 74721 - DNA, 75 bp, Artificial Sequence
  Synthetic
tcatgagtattggcaatgcttacaccatgttttatgacgggtggtcaaacttctccagagacggcatatatggat

SEQ ID NO: 74722 - DNA, 75 bp, Artificial Sequence
  Synthetic
gaggatgatcaagctaccgctgaggaccaaccaacgcaaccagacgtcgcaacatgcagattttacaccctagaa

SEQ ID NO: 74723 - DNA, 75 bp, Artificial Sequence
  Synthetic
catgttttatgacgggtggtcaaacttctccagagacggcatatatggatataattcattaaacaacatggggac

SEQ ID NO: 74724 - DNA, 75 bp, Artificial Sequence
  Synthetic
accaaccaacgcaaccagacgtcgcaacatgcagattttacaccctagaatcagtacaatgggaagcaaactcgg

SEQ ID NO: 74725 - DNA, 75 bp, Artificial Sequence
  Synthetic
acacgtcaaagcatatgtgccacgccccccccgtttgtgtcaatacaagaaagccaagagtgtgaactttgatgt

SEQ ID NO: 74726 - DNA, 75 bp, Artificial Sequence
  Synthetic
taggtcgggctgggtacacaattcatgtgcaatgcaacgcatccaaattccaccaggggtgccttttggttgtgt

SEQ ID NO: 74727 - DNA, 75 bp, Artificial Sequence
  Synthetic
cccccccgtttgtgtcaatacaagaaagccaagagtgtgaactttgatgttgaggccgttacagcggagcgtgca

SEQ ID NO: 74728 - DNA, 75 bp, Artificial Sequence
  Synthetic
tgtgcaatgcaacgcatccaaattccaccaggggtgccttttggttgtgtgtgtcccagaggccgagatggggtg

SEQ ID NO: 74729 - DNA, 75 bp, Artificial Sequence
  Synthetic
cacttggccacgcacgtggattggcaaaattgcgtgtgggaggattataatagagaccttctagtgagtactacc

SEQ ID NO: 74730 - DNA, 75 bp, Artificial Sequence
  Synthetic
agcacctgccgagaaaggcaaggtccaaacagcagtgtgcaatgcgaccatgggtgttgcggttggaaacctcac

SEQ ID NO: 74731 - DNA, 75 bp, Artificial Sequence
  Synthetic
aaaattgcgtgtgggaggattataatagagaccttctagtgagtactaccacggcccacgggtgcgacaccattg

SEQ ID NO: 74732 - DNA, 75 bp, Artificial Sequence
  Synthetic
caaacagcagtgtgcaatgcgaccatgggtgttgcggttggaaacctcacaattttcccacaccagtggataaac

SEQ ID NO: 74733 - DNA, 75 bp, Artificial Sequence
  Synthetic
caggtttggtggaagtccaagaaagtgaatattacccaaaaagataccagtctcatgtgttgcttgctacagggt

SEQ ID NO: 74734 - DNA, 75 bp, Artificial Sequence
  Synthetic
tacaacttcacactgatggtaatacccttcgtccctctaaccagcatggggggctctacctatgtaccaatcaca

SEQ ID NO: 74735 - DNA, 75 bp, Artificial Sequence
  Synthetic
tgaatattacccaaaaagataccagtctcatgtgttgcttgctacagggttctccgaaccaggagattgcggtgg

SEQ ID NO: 74736 - DNA, 75 bp, Artificial Sequence
  Synthetic
ccttcgtccctctaaccagcatggggggctctacctatgtaccaatcacagttactatcgccccgatgtgtgctg

SEQ ID NO: 74737 - DNA, 75 bp, Artificial Sequence
  Synthetic
ccgtgacctgttgtggttggaagatgatgcaatggaacagggagtgaaagattacgttgagcaacttggtaatgc

SEQ ID NO: 74738 - DNA, 75 bp, Artificial Sequence
  Synthetic
tcacatcagatgacttccagtcaccatgtgctatgcctgagtacgacgtcaccccaccgctagacatacccggtg

SEQ ID NO: 74739 - DNA, 75 bp, Artificial Sequence
  Synthetic
gatgcaatggaacagggagtgaaagattacgttgagcaacttggtaatgcttttggctcaggattcaccaaccag

SEQ ID NO: 74740 - DNA, 75 bp, Artificial Sequence
  Synthetic
atgtgctatgcctgagtacgacgtcaccccaccgctagacatacccggtgaggttaataatctaatggaggttgc

SEQ ID NO: 74741 - DNA, 75 bp, Artificial Sequence
  Synthetic
ctagttaagatcatctctgccctggtgattgtagtaaggaatcatgatgacctgatcacagttacagctacactc

SEQ ID NO: 74742 - DNA, 75 bp, Artificial Sequence
  Synthetic
gagtgcaggagattcttcgagaccagaggcggtgttcaagtttcaactagacccaggtagtgactcagttctaaa

SEQ ID NO: 74743 - DNA, 75 bp, Artificial Sequence
  Synthetic
tgattgtagtaaggaatcatgatgacctgatcacagttacagctacactcgcccttattggctgcacctcgtctc

SEQ ID NO: 74744 - DNA, 75 bp, Artificial Sequence
  Synthetic
gaggcggtgttcaagtttcaactagacccaggtagtgactcagttctaaaacacacactgctgggggaaatcata

SEQ ID NO: 74745 - DNA, 75 bp, Artificial Sequence
  Synthetic
taaagaaatttacagagatgactaacgcatgcaaagggatggagtggatagccgtcaagattcagaaatttatag

SEQ ID NO: 74746 - DNA, 75 bp, Artificial Sequence
  Synthetic
cttcttattgcatattcaccacctggtgcgtccgccccagccacgcgtaaggatgccatgctgggtactcacata

SEQ ID NO: 74747 - DNA, 75 bp, Artificial Sequence
  Synthetic
gtgcgtccgccccagccacgcgtaaggatgccatgctgggtactcacataatatgggatttgggtttacaatcga

SEQ ID NO: 74748 - DNA, 75 bp, Artificial Sequence
  Synthetic
tcttggagagtcagattgccaccattgaacaaagtgcaccctctcaaagtgaccaggaacagctgttctcaaatg

SEQ ID NO: 74749 - DNA, 75 bp, Artificial Sequence
  Synthetic
gctacatttcgtgttggtaccaaaccaacataatagtccccccggatacaccgtcacaatgctacatgttgtgtt

SEQ ID NO: 74750 - DNA, 75 bp, Artificial Sequence
  Synthetic
caacataatagtccccccggatacaccgtcacaatgctacatgttgtgtttggcatcagcttgcaatgatttttc

SEQ ID NO: 74751 - DNA, 75 bp, Artificial Sequence
  Synthetic
aaaaaaaaatgagcaattacatacagttcaagtccaaatgccgtattgaacctgtatgcttgcttttgcatggta

SEQ ID NO: 74752 - DNA, 75 bp, Artificial Sequence
  Synthetic
gttcaagtccaaatgccgtattgaacctgtatgcttgcttttgcatggtagcccaggagcggggaagtcagttgc

SEQ ID NO: 74753 - DNA, 75 bp, Artificial Sequence
  Synthetic
gtccgcaatatctagagtggccgacaccataagtagtggccccacaaactcagaacaagtgccagcactcaccgc

SEQ ID NO: 74754 - DNA, 75 bp, Artificial Sequence
  Synthetic
accataagtagtggccccacaaactcagaacaagtgccagcactcaccgcagctgagacaggccacacatctcaa

SEQ ID NO: 74755 - DNA, 75 bp, Artificial Sequence
  Synthetic
tttcgatggctacaaacaacaagccgtcgtaattatggacgatctatgccaaaacccggatggcaaggacgtgtc

SEQ ID NO: 74756 - DNA, 75 bp, Artificial Sequence
  Synthetic
gtcgtaattatggacgatctatgccaaaacccggatggcaaggacgtgtctttgttctgccaaatggtgtctagt

SEQ ID NO: 74757 - DNA, 75 bp, Artificial Sequence
  Synthetic
tttctgtgtaggtccgcatgtgtacacatagcaaggtatgaagctggcgctaatgcaaacaatgaagataggttt

SEQ ID NO: 74758 - DNA, 75 bp, Artificial Sequence
  Synthetic
acatagcaaggtatgaagctggcgctaatgcaaacaatgaagataggtttgtgaggtgggaaataaacaacaaag

SEQ ID NO: 74759 - DNA, 75 bp, Artificial Sequence
  Synthetic
accaatgctgggtccatcaacgcgccgacagtctcagacagccgggctctggcaagaaggttccattttgacatg

SEQ ID NO: 74760 - DNA, 75 bp, Artificial Sequence
  Synthetic
cgacagtctcagacagccgggctctggcaagaaggttccattttgacatgaatattgaagttatctccatgtaca

SEQ ID NO: 74761 - DNA, 75 bp, Artificial Sequence
  Synthetic
caagccagcaagaccagggcaccgatctatcgcaagacatgccagtgctcactcaccaggtcatgtacgtaccac

SEQ ID NO: 74762 - DNA, 75 bp, Artificial Sequence
  Synthetic
tctatcgcaagacatgccagtgctcactcaccaggtcatgtacgtaccaccaggaggttcggtaccaagcaatgc

SEQ ID NO: 74763 - DNA, 75 bp, Artificial Sequence
  Synthetic
gatgctgccctctagtgtgtggaaaggctatccagtttatcgatagaaagactcaagtgaggtactccctagata

SEQ ID NO: 74764 - DNA, 75 bp, Artificial Sequence
  Synthetic
aatcccgtttataagtatagggaatgcctatagtagtttttatgatggctggtcacacttttctcaaaaaggggt

SEQ ID NO: 74765 - DNA, 75 bp, Artificial Sequence
  Synthetic
atacaaccacaggcacagtgtcggggcgacccttgaggcgctattccaaggcccgccagtgtacagagaaattaa

SEQ ID NO: 74766 - DNA, 75 bp, Artificial Sequence
  Synthetic
gcctatagtagtttttatgatggctggtcacacttttctcaaaaaggggtgtacggatacaacacactcaacaaa

SEQ ID NO: 74767 - DNA, 75 bp, Artificial Sequence
  Synthetic
tagagagtactgtaaggagaagggatggctagttcctgagatcgattctattctccaaattgagaagcatgtcag

SEQ ID NO: 74768 - DNA, 75 bp, Artificial Sequence
  Synthetic
aagccgaagcacatcagggcatggataccacggccccctcgactgtgcccctacaaatataaggcaaatgtcaac

SEQ ID NO: 74769 - DNA, 75 bp, Artificial Sequence
  Synthetic
taccacggccccctcgactgtgcccctacaaatataaggcaaatgtcaactttgatgtcactgcaattacggaca

SEQ ID NO: 74770 - DNA, 75 bp, Artificial Sequence
  Synthetic
gaattatttatatcatttacaaactgtttgcagggttccagggtgcatatacggggatgcctaaccaaaaaccta

SEQ ID NO: 74771 - DNA, 75 bp, Artificial Sequence
  Synthetic
gggcggtttacgtgggcaattacaggctggtaaacagacacctggctacgcacaacgactggcaaaactgtgtgt

SEQ ID NO: 74772 - DNA, 75 bp, Artificial Sequence
  Synthetic
gctggtaaacagacacctggctacgcacaacgactggcaaaactgtgtgtgggaggactacaacagagacctctt

SEQ ID NO: 74773 - DNA, 75 bp, Artificial Sequence
  Synthetic
ccagtacggtgaaaacagagtatggcgagttcaccatgttaggcatctatgacaggtgggctgtcctaccacgcc

SEQ ID NO: 74774 - DNA, 75 bp, Artificial Sequence
  Synthetic
gacaggtgggctgtcctaccacgccacgctaaacccgggccgactattcttatgaatgaccaggaggtcggtgtg

SEQ ID NO: 74775 - DNA, 75 bp, Artificial Sequence
  Synthetic
atcgaagaacacacactacccagttgtttttgaaggtccaggtctagtggaagtgcaagagagtgaatactaccc

SEQ ID NO: 74776 - DNA, 75 bp, Artificial Sequence
  Synthetic
gtttttgaaggtccaggtctagtggaagtgcaagagagtgaatactaccccaaaagataccaatcccatgtcctt

SEQ ID NO: 74777 - DNA, 75 bp, Artificial Sequence
  Synthetic
aaattcagggacatcagaggttttctagccaaggaggaagtggaggttaatgaagctgtcctagcaatcaacact

SEQ ID NO: 74778 - DNA, 75 bp, Artificial Sequence
  Synthetic
tagccaaggaggaagtggaggttaatgaagctgtcctagcaatcaacactagcaaatttccaaacatgtacatcc

SEQ ID NO: 74779 - DNA, 75 bp, Artificial Sequence
  Synthetic
accatgggtggggaaggtgttgtcggattcgccgacgttcgagacctgctttggttggaggatgacgccatggaa

SEQ ID NO: 74780 - DNA, 75 bp, Artificial Sequence
  Synthetic
gattcgccgacgttcgagacctgctttggttggaggatgacgccatggaacaaggagtgagagactatgtagaac

SEQ ID NO: 74781 - DNA, 75 bp, Artificial Sequence
  Synthetic
tccctacaagggctggacagtgtggcggtgttctcatgtccactggcaaggtgctagggatccacgttggtggga

SEQ ID NO: 74782 - DNA, 75 bp, Artificial Sequence
  Synthetic
cggtgttctcatgtccactggcaaggtgctagggatccacgttggtgggaatggtcaccagggtttctcagcagg

SEQ ID NO: 74783 - DNA, 75 bp, Artificial Sequence
  Synthetic
ttggccaggactcaattctcgaaaaatcactgaaagccctggtgaagattatttcagcgctggtgattgtggtga

SEQ ID NO: 74784 - DNA, 75 bp, Artificial Sequence
  Synthetic
atcactgaaagccctggtgaagattatttcagcgctggtgattgtggtgagaaatcatgacgacctgatcacagt

SEQ ID NO: 74785 - DNA, 75 bp, Artificial Sequence
  Synthetic
agtcatcaatacaccaagtagaactaagctagaaccaagcgtcttccatcacgtctttgaaggaaacaaggaacc

SEQ ID NO: 74786 - DNA, 75 bp, Artificial Sequence
  Synthetic
aagctagaaccaagcgtcttccatcacgtctttgaaggaaacaaggaaccagcagtcctcaggaacggcgacccg

SEQ ID NO: 74787 - DNA, 75 bp, Artificial Sequence
  Synthetic
cgggatccccatggctgaaaggcaaaacaatggctggttaaagaagttcaccgaaatgaccaatgcttgtaaagg

SEQ ID NO: 74788 - DNA, 75 bp, Artificial Sequence
  Synthetic
aacaatggctggttaaagaagttcaccgaaatgaccaatgcttgtaaaggtatggagtggatcgccattaagatt

SEQ ID NO: 74789 - DNA, 75 bp, Artificial Sequence
  Synthetic
atgctagaagctgtggatcactatgcagggcaattggccactcttgacattaacactgagccaatgaaactggaa

SEQ ID NO: 74790 - DNA, 75 bp, Artificial Sequence
  Synthetic
cagggcaattggccactcttgacattaacactgagccaatgaaactggaagatgcagtgtacggcacggaagggc

SEQ ID NO: 74791 - DNA, 75 bp, Artificial Sequence
  Synthetic
aagcaacttccactcttggaaagtcagattgccaccatcgaacagagtgccccatctcagagtgaccaggagcaa

SEQ ID NO: 74792 - DNA, 75 bp, Artificial Sequence
  Synthetic
ccaaaaagaccaaagacctgaccaaattgaaggaatgtatggacaagtacggattaaacttgccgatggtgacat

SEQ ID NO: 74793 - DNA, 75 bp, Artificial Sequence
  Synthetic
attgaaggaatgtatggacaagtacggattaaacttgccgatggtgacatacgtgaaggatgagcttagatcagc

SEQ ID NO: 74794 - DNA, 75 bp, Artificial Sequence
  Synthetic
gcaattacatacagttcaagtccaaatgccgtattgaaccagtatgcttgctcttacacgggagccccggtgcgg

SEQ ID NO: 74795 - DNA, 75 bp, Artificial Sequence
  Synthetic
atttggtaatttgtacaaggcattccacttaaacccggggattgtaacgggcagtgcagtcgggtgcgatccaga

SEQ ID NO: 74796 - DNA, 75 bp, Artificial Sequence
  Synthetic
cggacccagatcactttgacggttataaacagcaagctgttgtgatcatggacgacctgtgccaaaaccctgatg

SEQ ID NO: 74797 - DNA, 75 bp, Artificial Sequence
  Synthetic
cacttaaacccggggattgtaacgggcagtgcagtcgggtgcgatccagacgttttctggagtaaaatacctgtg

SEQ ID NO: 74798 - DNA, 75 bp, Artificial Sequence
  Synthetic
taaacagcaagctgttgtgatcatggacgacctgtgccaaaaccctgatgggaaagacgtgtccctattttgtca

SEQ ID NO: 74799 - DNA, 75 bp, Artificial Sequence
  Synthetic
ctaaagttgctgcttgaaaaactcgggtacacacataaagagacaaactacattgactacttatgcaactcccac

SEQ ID NO: 74800 - DNA, 75 bp, Artificial Sequence
  Synthetic
tgtactggcctccaccaacgcaggttctatcaacgcaccaacagtttctgacagtagagcccttgccaggaggtt

SEQ ID NO: 74801 - DNA, 75 bp, Artificial Sequence
  Synthetic
ggtacacacataaagagacaaactacattgactacttatgcaactcccaccacctatacagagacaaacactact

SEQ ID NO: 74802 - DNA, 75 bp, Artificial Sequence
  Synthetic
tctatcaacgcaccaacagtttctgacagtagagcccttgccaggaggtttcacttcgatatgaacattgaagtc

SEQ ID NO: 74803 - DNA, 75 bp, Artificial Sequence
  Synthetic
ggaccttaatgttgaaggtgtacaaaggtattgacttggatcaattcaggatgattgcatatggtgatgatgtga

SEQ ID NO: 74804 - DNA, 75 bp, Artificial Sequence
  Synthetic
gtcaactttaaaaagtgctgccctttagtgtgtggaaaggcaattcagttcattgacagaagaacccaagttaga

SEQ ID NO: 74805 - DNA, 75 bp, Artificial Sequence
  Synthetic
aggtattgacttggatcaattcaggatgattgcatatggtgatgatgtgattgcatcatatccttggcccataga

SEQ ID NO: 74806 - DNA, 75 bp, Artificial Sequence
  Synthetic
tagtgtgtggaaaggcaattcagttcattgacagaagaacccaagttagatactccctagacatgttggtcactg

SEQ ID NO: 74807 - DNA, 75 bp, Artificial Sequence
  Synthetic
cgaagtcacctggactaatgtcacctttctaaagaggtattttagagcagatgaacaataccctttcttggttca

SEQ ID NO: 74808 - DNA, 75 bp, Artificial Sequence
  Synthetic
atagggaaatcaaaattagtgtcgcgcccgaaactccgcctccaccggcaatcgcagacctattaaaatcagtgg

SEQ ID NO: 74809 - DNA, 75 bp, Artificial Sequence
  Synthetic
gcccgaaactccgcctccaccggcaatcgcagacctattaaaatcagtggacagtgaggcggttagagaatactg

SEQ ID NO: 74810 - DNA, 75 bp, Artificial Sequence
  Synthetic
gcgctccctgtgcttattggcttggcacaatggagagcacgaatatgaggagttcatccaaaagatcagaagcgt

SEQ ID NO: 74811 - DNA, 75 bp, Artificial Sequence
  Synthetic
atgtctccaagcactaacaacctttgtttccgttgctgggattatctacatcatatataagttgtttgcagggtt

SEQ ID NO: 74812 - DNA, 75 bp, Artificial Sequence
  Synthetic
gtttccgttgctgggattatctacatcatatataagttgtttgcagggttccaaggcgcatacacaggaatgccc

SEQ ID NO: 74813 - DNA, 75 bp, Artificial Sequence
  Synthetic
atgaagagaaattccagcactgtgaagaccgagtacggtgagtttacaatgctaggcatctatgataagtgggct

SEQ ID NO: 74814 - DNA, 75 bp, Artificial Sequence
  Synthetic
agaccgagtacggtgagtttacaatgctaggcatctatgataagtgggctgtcttaccgcgccacgctaaacctg

SEQ ID NO: 74815 - DNA, 75 bp, Artificial Sequence
  Synthetic
acctggagttgacacttctgaaactgaaccgtaatgagaaatttagagacatcagaggctttctagccaaggagg

SEQ ID NO: 74816 - DNA, 75 bp, Artificial Sequence
  Synthetic
gaaccgtaatgagaaatttagagacatcagaggctttctagccaaggaggaggtggaggttaatgaagctgttct

SEQ ID NO: 74817 - DNA, 75 bp, Artificial Sequence
  Synthetic
gggcggtactcccacaaagagaatgctcatgtacaatttccccacgagagcgggacagtgcggcggcgttctcat

SEQ ID NO: 74818 - DNA, 75 bp, Artificial Sequence
  Synthetic
ctcatgtacaatttccccacgagagcgggacagtgcggcggcgttctcatgtcaaccggtaaggtactagggatc

SEQ ID NO: 74819 - DNA, 75 bp, Artificial Sequence
  Synthetic
atagaatttattgagaattcaaaagacgcagggttcccagttatcaacacgccaagcaaaaccaagctggaacca

SEQ ID NO: 74820 - DNA, 75 bp, Artificial Sequence
  Synthetic
acgcagggttcccagttatcaacacgccaagcaaaaccaagctggaaccaagcgttttccaccaggtcttcgaag

SEQ ID NO: 74821 - DNA, 75 bp, Artificial Sequence
  Synthetic
agtatattggaaatgttaatacacatgtagatgattacatgcttgaagcagttgaccactacgctggacagctgg

SEQ ID NO: 74822 - DNA, 75 bp, Artificial Sequence
  Synthetic
tgtagatgattacatgcttgaagcagttgaccactacgctggacagctggccactctcgacatcagcaccgagcc

SEQ ID NO: 74823 - DNA, 75 bp, Artificial Sequence
  Synthetic
atatgttgcattgggcatcaagaaaagagacattctatccaaaaagactaaagatctgactaaactaaaagagtg

SEQ ID NO: 74824 - DNA, 75 bp, Artificial Sequence
  Synthetic
agagacattctatccaaaaagactaaagatctgactaaactaaaagagtgcatggacaagtatggtttaaaccta

SEQ ID NO: 74825 - DNA, 75 bp, Artificial Sequence
  Synthetic
gcatccagcttgaatgattcagtggcaatgaggcagacatttggcaacttatacaaaaccttccaccttaaccca

SEQ ID NO: 74826 - DNA, 75 bp, Artificial Sequence
  Synthetic
caatgaggcagacatttggcaacttatacaaaaccttccaccttaacccagggattgtgacaggcagcgcagtcg

SEQ ID NO: 74827 - DNA, 75 bp, Artificial Sequence
  Synthetic
ttacactggctgcttatggtgacaattgagaaattgttaccatatagctattggagtggccatccggtgactaac

SEQ ID NO: 74828 - DNA, 75 bp, Artificial Sequence
  Synthetic
ggtatgatgctagcttaagccctgtttggtttgcatgtctgaaactgctgctcgagaagctcgggtacactcaca

SEQ ID NO: 74829 - DNA, 75 bp, Artificial Sequence
  Synthetic
ttggtttgcatgtctgaaactgctgctcgagaagctcgggtacactcacaaggaaactaactacatagactatct

SEQ ID NO: 74830 - DNA, 75 bp, Artificial Sequence
  Synthetic
cagcatctttaactcaatgataaacaacattataatcaggacacttatgttgaaggtgtacaaaggcattgatct

SEQ ID NO: 74831 - DNA, 75 bp, Artificial Sequence
  Synthetic
aacattataatcaggacacttatgttgaaggtgtacaaaggcattgatctggaccaattcagaatgattgcctat

SEQ ID NO: 74832 - DNA, 75 bp, Artificial Sequence
  Synthetic
ctaattatgacaccagcagataagggtgagtgctttaatgaggtcacctggactaatgttactttcctgaagaga

SEQ ID NO: 74833 - DNA, 75 bp, Artificial Sequence
  Synthetic
gtgagtgctttaatgaggtcacctggactaatgttactttcctgaagagatactttagagcagacgaacaatacc

SEQ ID NO: 74834 - DNA, 75 bp, Artificial Sequence
  Synthetic
cccaagaccatgtgcgatcattatgcttattggcttggcataatggtgaacgcgaatatgaggagttcgtcagaa

SEQ ID NO: 74835 - DNA, 75 bp, Artificial Sequence
  Synthetic
cgcgaatatgaggagttcgtcagaaagatcaggagcgtcccagtcgggcgctgcttgactttacctgcgttttca

SEQ ID NO: 74836 - DNA, 75 bp, Artificial Sequence
  Synthetic
gccagtgggcagtctgtcgtaacgggcaactctgcagcggaaccgactactttgggtgtccgtgtttccttttat

SEQ ID NO: 74837 - DNA, 75 bp, Artificial Sequence
  Synthetic
tgcgcactaataacagcgcaacaatagtgatgccctatgtaaatagtgtgcccatggacaatatgtacaggcatt

SEQ ID NO: 74838 - DNA, 75 bp, Artificial Sequence
  Synthetic
ctgaagccaaaagggtgttctctcttgaaaagaaaatgagtaattacatacagttcaagtccaaatgccgtattg

SEQ ID NO: 74839 - DNA, 75 bp, Artificial Sequence
  Synthetic
ttcacctctccattcgttctagcctcaaccaatgcaggatccattaacgcaccaacagtttcagacagcagagcc

SEQ ID NO: 74840 - DNA, 75 bp, Artificial Sequence
  Synthetic
gggcaaaatcactctagaccgatcaacacacaatcccttgtcaaatactggtgcttttgggcaacaatcaggagc

SEQ ID NO: 74841 - DNA, 75 bp, Artificial Sequence
  Synthetic
tcaagaaagtggttattaccccaaaaggtaccagtcacacgtactacttgctgcaggcttctcagaaccaggtga

SEQ ID NO: 74842 - DNA, 75 bp, Artificial Sequence
  Synthetic
gcaagactccatcctagagaaatcgctcaaagccctagtaaagatcatatcagcactagtaattgtagtgcgaaa

SEQ ID NO: 74843 - DNA, 75 bp, Artificial Sequence
  Synthetic
ctcaaagccctagtaaagatcatatcagcactagtaattgtagtgcgaaaccatgacgacctaattacagtgaca

SEQ ID NO: 74844 - DNA, 75 bp, Artificial Sequence
  Synthetic
aactacctctgttggaaagtcaaattgccactattgaacaaagcgcgccctcgcagggtgatcaagagcaattgt

SEQ ID NO: 74845 - DNA, 75 bp, Artificial Sequence
  Synthetic
taccccggcatgccaaaccagggcccaccatcctgatgaacgatcaagaagtgggagtggtggacgccaaggagc

SEQ ID NO: 74846 - DNA, 75 bp, Artificial Sequence
  Synthetic
agttcattgagaattctaaggaagctggcttcccggtcattaacacccccagtaaaacgaagcttgagcctagtg

SEQ ID NO: 74847 - DNA, 75 bp, Artificial Sequence
  Synthetic
tggcttcccggtcattaacacccccagtaaaacgaagcttgagcctagtgtgttccaccacgtgtttgaagggaa

SEQ ID NO: 74848 - DNA, 75 bp, Artificial Sequence
  Synthetic
acccacagggcccactgggcgccagcacactggtatcttggtacctttgtgcgcctgttttatccaccctgcccc

SEQ ID NO: 74849 - DNA, 75 bp, Artificial Sequence
  Synthetic
gtggcggtggctgcgttggcggcctgcccatggggcaacccatgggacgcttcaatactgacatggtgcgaagag

SEQ ID NO: 74850 - DNA, 75 bp, Artificial Sequence
  Synthetic
gggtgtccgtgtttccttttattactacattggctgcttatggtgacaattgagagattgttaccatatagctat

SEQ ID NO: 74851 - DNA, 75 bp, Artificial Sequence
  Synthetic
ctaaacactctcaatttcattatattacttaactcagcgaaatgggagcacaagtctcaacacaaaagaccggag

SEQ ID NO: 74852 - DNA, 75 bp, Artificial Sequence
  Synthetic
tacttaactcagcgaaatgggagcacaagtctcaacacaaaagaccggagctcatgagaccagtttgagcgccag

SEQ ID NO: 74853 - DNA, 75 bp, Artificial Sequence
  Synthetic
cccaattgatgcctcactgctagctgaagccggcaagggatatggtctgattatgacgccagcggacaagggaga

SEQ ID NO: 74854 - DNA, 75 bp, Artificial Sequence
  Synthetic
ctttacacaggacccaggtaagtttaccgaaccagtcaaagacataatgatcaagtcaatgcccgctttaaactc

SEQ ID NO: 74855 - DNA, 75 bp, Artificial Sequence
  Synthetic
accgaaccagtcaaagacataatgatcaagtcaatgcccgctttaaactcgccatctgcagaggaatgtggatat

SEQ ID NO: 74856 - DNA, 75 bp, Artificial Sequence
  Synthetic
tatggtagatggccagaatatttgaaagatgaagaagccaccgctgaagatcaaccaacgcagcctgatgtggct

SEQ ID NO: 74857 - DNA, 75 bp, Artificial Sequence
  Synthetic
aagatgaagaagccaccgctgaagatcaaccaacgcagcctgatgtggctacatgcaggttctacacgctagagt

SEQ ID NO: 74858 - DNA, 75 bp, Artificial Sequence
  Synthetic
gtcagaacatgctataccactacttaggtagggcggggtacactatacatgtccagtgtaatgcatccaagttcc

SEQ ID NO: 74859 - DNA, 75 bp, Artificial Sequence
  Synthetic
aggtagggcggggtacactatacatgtccagtgtaatgcatccaagttccaccagggatgtttgcttgttgtttg

SEQ ID NO: 74860 - DNA, 75 bp, Artificial Sequence
  Synthetic
actcacagggcccactgggcgctagcacactggtatcacggtacccttgtgcgcctgttttattcacccccccca

SEQ ID NO: 74861 - DNA, 75 bp, Artificial Sequence
  Synthetic
agcacatgtgtttgcatcgaccaagactacgggtgagcatacggtacaatcgatagtatgcaacgcgggcatggg

SEQ ID NO: 74862 - DNA, 75 bp, Artificial Sequence
  Synthetic
actacgggtgagcatacggtacaatcgatagtatgcaacgcgggcatgggcgttggcgttggtaatctgaccata

SEQ ID NO: 74863 - DNA, 75 bp, Artificial Sequence
  Synthetic
atggacaacatgttcaggcattacaattttactctcatggtgattccattcgctcccctggactatactgcccaa

SEQ ID NO: 74864 - DNA, 75 bp, Artificial Sequence
  Synthetic
attttactctcatggtgattccattcgctcccctggactatactgcccaagcgtctgaatatgtgccagtgactg

SEQ ID NO: 74865 - DNA, 75 bp, Artificial Sequence
  Synthetic
gttttgttccattaaactatagagttttgaatactctagaatttattataacactcaacacaacaaaatgggggc

SEQ ID NO: 74866 - DNA, 75 bp, Artificial Sequence
  Synthetic
ctccagggagtaatcagttcatgacatcggacgattttcaatctccctcggcaatgccacagtttgatgtgacgc

SEQ ID NO: 74867 - DNA, 75 bp, Artificial Sequence
  Synthetic
atcggacgattttcaatctccctcggcaatgccacagtttgatgtgacgccacacatggacataccaggcgaggt

SEQ ID NO: 74868 - DNA, 75 bp, Artificial Sequence
  Synthetic
tttgaatactctagaatttattataacactcaacacaacaaaatgggggcacaagtttcaacacaaaagaccggt

SEQ ID NO: 74869 - DNA, 75 bp, Artificial Sequence
  Synthetic
gcctcgaggtcttcaaaccgtcaagacttcgcgcaagatcctggtaagttcactgagccagtcaaggatatcatg

SEQ ID NO: 74870 - DNA, 75 bp, Artificial Sequence
  Synthetic
ggatgcataccatatagaagtgaatacaggcaaccaccagggtgacaaaatatttgcctttcaaatacaacccgg

SEQ ID NO: 74871 - DNA, 75 bp, Artificial Sequence
  Synthetic
acaggcaaccaccagggtgacaaaatatttgcctttcaaatacaacccggcctggactcagtgttcaagagaacg

SEQ ID NO: 74872 - DNA, 75 bp, Artificial Sequence
  Synthetic
acttcgcgcaagatcctggtaagttcactgagccagtcaaggatatcatgataaagactttaccagcactgaact

SEQ ID NO: 74873 - DNA, 75 bp, Artificial Sequence
  Synthetic
aagagggtgcgaacgtggtggtggcatacggtgaatggccacaatatctgtccgataaagaggctacagcagaag

SEQ ID NO: 74874 - DNA, 75 bp, Artificial Sequence
  Synthetic
gcaatggctacagggaagttgcttctggcttactcccctcctggtgctgatgtaccagccagcaggaaacaggca

SEQ ID NO: 74875 - DNA, 75 bp, Artificial Sequence
  Synthetic
atacggtgaatggccacaatatctgtccgataaagaggctacagcagaagatcaacccacacaacctgacgtggc

SEQ ID NO: 74876 - DNA, 75 bp, Artificial Sequence
  Synthetic
gatgctgaaggatatggggctgtttgggcagaacatgcactatcattacctaggaagggcagggtataccataca

SEQ ID NO: 74877 - DNA, 75 bp, Artificial Sequence
  Synthetic
acacactaccgcctagtgcaacaagatgagtatacgagtgctggcaatgtcacctgctggtaccaaacaggcata

SEQ ID NO: 74878 - DNA, 75 bp, Artificial Sequence
  Synthetic
gggcagaacatgcactatcattacctaggaagggcagggtataccatacacgtgcaatgcaacgcatctaaattt

SEQ ID NO: 74879 - DNA, 75 bp, Artificial Sequence
  Synthetic
atgctacgtgacactccattcatcggacagacagcgttactgcaaggtgacacagatgtggccatcaataatgcg

SEQ ID NO: 74880 - DNA, 75 bp, Artificial Sequence
  Synthetic
tacacagcactgaccaaccaggacacaccgcaccaattcactgagggaaaggcgactgggaaacaggtgcagacg

SEQ ID NO: 74881 - DNA, 75 bp, Artificial Sequence
  Synthetic
gacagacagcgttactgcaaggtgacacagatgtggccatcaataatgcggtggccagggtggcggacacaatcg

SEQ ID NO: 74882 - DNA, 75 bp, Artificial Sequence
  Synthetic
caccgcaccaattcactgagggaaaggcgactgggaaacaggtgcagacggcagtatgcaatgcgggaatgggtg

SEQ ID NO: 74883 - DNA, 75 bp, Artificial Sequence
  Synthetic
cgagcgatacaatgcaaactcggcatgtgaaaaactaccattcccgatctgagtcgacaatagagaacttcctca

SEQ ID NO: 74884 - DNA, 75 bp, Artificial Sequence
  Synthetic
tgccttatataaacagcgtgcctatggataacatgttcagacattacaacttcaccctcatgataatccctttcg

SEQ ID NO: 74885 - DNA, 75 bp, Artificial Sequence
  Synthetic
tgtgaaaaactaccattcccgatctgagtcgacaatagagaacttcctcagtcggtctgcctgcgtgtatatcga

SEQ ID NO: 74886 - DNA, 75 bp, Artificial Sequence
  Synthetic
ggataacatgttcagacattacaacttcaccctcatgataatccctttcgcacccttggcgtactccactggggc

SEQ ID NO: 74887 - DNA, 75 bp, Artificial Sequence
  Synthetic
actgaggcgaaagttcgagttgttcacctacatgcggtttgacatggaagtcacatttgtcatcaccagcaggca

SEQ ID NO: 74888 - DNA, 75 bp, Artificial Sequence
  Synthetic
acaagggctacctgtaatggcaaccccgggcagcaatcagtttctaacgtcagataactttcaatcgccatcagc

SEQ ID NO: 74889 - DNA, 75 bp, Artificial Sequence
  Synthetic
ccgggcagcaatcagtttctaacgtcagataactttcaatcgccatcagcaatgccacagttcgatgtcacgccc

SEQ ID NO: 74890 - DNA, 75 bp, Artificial Sequence
  Synthetic
gacatgccaccactgacacaccaaattatgtacattccacctgggggccccgtaccaaacagtgtgacagacttt

SEQ ID NO: 74891 - DNA, 75 bp, Artificial Sequence
  Synthetic
acgccaggtaaatgtgacaagatggatgcgtatcaaattgaagtgaatgctggcaataccaacactacgactgcc

SEQ ID NO: 74892 - DNA, 75 bp, Artificial Sequence
  Synthetic
atgcgtatcaaattgaagtgaatgctggcaataccaacactacgactgccatttttagctttcaagtggatccag

SEQ ID NO: 74893 - DNA, 75 bp, Artificial Sequence
  Synthetic
ataagcatagggaatgcatatagtaatttttatgatgggtggtcgcacttctcacaaaatggtgtgtacgggtac

SEQ ID NO: 74894 - DNA, 75 bp, Artificial Sequence
  Synthetic
atttttatgatgggtggtcgcacttctcacaaaatggtgtgtacgggtacaacgcattaaacaacatgggcaaat

SEQ ID NO: 74895 - DNA, 75 bp, Artificial Sequence
  Synthetic
aactaacgttcctattttgcggctcagcgatggccactggtaagttgttgttggcgtattcgccgccaggcgcta

SEQ ID NO: 74896 - DNA, 75 bp, Artificial Sequence
  Synthetic
agcgatggccactggtaagttgttgttggcgtattcgccgccaggcgctagcgtgccgactagtagaaaacaagc

SEQ ID NO: 74897 - DNA, 75 bp, Artificial Sequence
  Synthetic
acattagagtctgggtgccacgaccaccacgcctgtgcccctacattaaatctagtaatgtaaattttgatccaa

SEQ ID NO: 74898 - DNA, 75 bp, Artificial Sequence
  Synthetic
accacgcctgtgcccctacattaaatctagtaatgtaaattttgatccaactaacctaactgaaaaaagagaaag

SEQ ID NO: 74899 - DNA, 75 bp, Artificial Sequence
  Synthetic
gtcgcattaccgcatggtgtacaaggatccatacactgcagctggatatgtcacctgctggtatcaaacaaacat

SEQ ID NO: 74900 - DNA, 75 bp, Artificial Sequence
  Synthetic
gatccatacactgcagctggatatgtcacctgctggtatcaaacaaacatcgtcgtacccgctgacacaccacag

SEQ ID NO: 74901 - DNA, 75 bp, Artificial Sequence
  Synthetic
atacgtagggaattacagggtggtaaatagacatctcgccacgcacaacgactggcaaaactgtgtgtgggaaga

SEQ ID NO: 74902 - DNA, 75 bp, Artificial Sequence
  Synthetic
aatagacatctcgccacgcacaacgactggcaaaactgtgtgtgggaagactattacagagatcttttagttagc

SEQ ID NO: 74903 - DNA, 75 bp, Artificial Sequence
  Synthetic
gaacagaagaccaaattgcaaggggaagagcatgacagtcatgtggcaaacactgaggctacaggaccaacaaac

SEQ ID NO: 74904 - DNA, 75 bp, Artificial Sequence
  Synthetic
aagagcatgacagtcatgtggcaaacactgaggctacaggaccaacaaactcaatgcaagtccctgctctcaccg

SEQ ID NO: 74905 - DNA, 75 bp, Artificial Sequence
  Synthetic
aacaagcattacccagtttgttttgaaggtccaggcttggtggaggttcaggaaaatgaatattacccaagaagg

SEQ ID NO: 74906 - DNA, 75 bp, Artificial Sequence
  Synthetic
taccagtcccatgtgcttctagctgcagggttctccgaaccaggggactgtggtggtattctcaggtgcgaacat

SEQ ID NO: 74907 - DNA, 75 bp, Artificial Sequence
  Synthetic
ctcgttccgaatctaccctggagaacttcatggggagagcagcttgcgtgtttatgtccacataccaatcaatgg

SEQ ID NO: 74908 - DNA, 75 bp, Artificial Sequence
  Synthetic
cttcatggggagagcagcttgcgtgtttatgtccacataccaatcaatggattccactgataagacaaaacgcta

SEQ ID NO: 74909 - DNA, 75 bp, Artificial Sequence
  Synthetic
gaagatgatgccatggaacagggtgtgagggattatgttgagcagctaggaaatgcctttggctcgggttttacc

SEQ ID NO: 74910 - DNA, 75 bp, Artificial Sequence
  Synthetic
tgatatagaagtgacattcgtaatcaccagcagacaggacccaggaacaaacctagaacaggatatgcccgtgtt

SEQ ID NO: 74911 - DNA, 75 bp, Artificial Sequence
  Synthetic
accagcagacaggacccaggaacaaacctagaacaggatatgcccgtgttaacacaccaaataatgtacataccg

SEQ ID NO: 74912 - DNA, 75 bp, Artificial Sequence
  Synthetic
agactctatactggagaagtcactcaaagccctagtgaagatcatatcagcactggtcatcgtagtgagaaatca

SEQ ID NO: 74913 - DNA, 75 bp, Artificial Sequence
  Synthetic
aaagccctagtgaagatcatatcagcactggtcatcgtagtgagaaatcatgatgatttgatcacggtgacggcc

SEQ ID NO: 74914 - DNA, 75 bp, Artificial Sequence
  Synthetic
gagggcaacgccccggctcgcatgtccattccattcatcagcgtggggaacgcatacagcacattctatgatggg

SEQ ID NO: 74915 - DNA, 75 bp, Artificial Sequence
  Synthetic
ccattccattcatcagcgtggggaacgcatacagcacattctatgatgggtggtcgcacttctctcaaaccggag

SEQ ID NO: 74916 - DNA, 75 bp, Artificial Sequence
  Synthetic
cccatggcggaaaagcaaaacaatggctggctgaagaaattcacagagatgacaaatgcctgcaaaggcatggag

SEQ ID NO: 74917 - DNA, 75 bp, Artificial Sequence
  Synthetic
ttaccagcgcagtgcgtgtctatttcaaacccaagcatgtgagggcttgggtaccacgcccaccgcgattgtgtc

SEQ ID NO: 74918 - DNA, 75 bp, Artificial Sequence
  Synthetic
cctaccagaagtcaaggaaaaacacgagtttctaaacagactaaaacaattacccttgctagagagccaaatagc

SEQ ID NO: 74919 - DNA, 75 bp, Artificial Sequence
  Synthetic
caaacccaagcatgtgagggcttgggtaccacgcccaccgcgattgtgtcagtacaaggctaaggctagtgtaga

SEQ ID NO: 74920 - DNA, 75 bp, Artificial Sequence
  Synthetic
ttgcaggaagtatgcccctttatacgccgccgaggctaagagagtgtttaccttggagaagaaaatgagcaacta

SEQ ID NO: 74921 - DNA, 75 bp, Artificial Sequence
  Synthetic
acgcggtgcatttggacagcaatctggcgctgtgtatgtgggcaactacagggtggttaataggcatttagccac

SEQ ID NO: 74922 - DNA, 75 bp, Artificial Sequence
  Synthetic
gccgccgaggctaagagagtgtttaccttggagaagaaaatgagcaactacatacagttcaagtccaaatgccgc

SEQ ID NO: 74923 - DNA, 75 bp, Artificial Sequence
  Synthetic
ggcgctgtgtatgtgggcaactacagggtggttaataggcatttagccactcacagtgactggcagaactgtgtc

SEQ ID NO: 74924 - DNA, 75 bp, Artificial Sequence
  Synthetic
tcattggctgaaaaactcaatagctcagtgtactcgttaccacctgacccagatcatttcgacgggtacaagcaa

SEQ ID NO: 74925 - DNA, 75 bp, Artificial Sequence
  Synthetic
tgcacagcgggagtgtacttttgtgcctccatgaacaaacactacgcagttgcctttgaagggccaggcttagtg

SEQ ID NO: 74926 - DNA, 75 bp, Artificial Sequence
  Synthetic
agatcatttcgacgggtacaagcaacaagctgtcgtgattatggatgacttgtgccagaatccagatggcaaaga

SEQ ID NO: 74927 - DNA, 75 bp, Artificial Sequence
  Synthetic
caagctgtcgtgattatggatgacttgtgccagaatccagatggcaaagatgtctctctcttctgccaaatggta

SEQ ID NO: 74928 - DNA, 75 bp, Artificial Sequence
  Synthetic
cctccatgaacaaacactacgcagttgcctttgaagggccaggcttagtggaagtgcaagagagtgagtattatc

SEQ ID NO: 74929 - DNA, 75 bp, Artificial Sequence
  Synthetic
gcgaacatggtgtgattggcattgttaccatgggtggtgaaggtgttgtcggttttgccgacgtgcgagatctcc

SEQ ID NO: 74930 - DNA, 75 bp, Artificial Sequence
  Synthetic
gcgtcgactaatgccggatccatcaacgcaccaacggtttcagatagtcgggccttggctagaagatttcacttc

SEQ ID NO: 74931 - DNA, 75 bp, Artificial Sequence
  Synthetic
taccatgggtggtgaaggtgttgtcggttttgccgacgtgcgagatctcctgtggctagaggatgatgcaatgga

SEQ ID NO: 74932 - DNA, 75 bp, Artificial Sequence
  Synthetic
agtcaacctcctcaaggaatcccttgtggggcaggactccatcttagaaaaatccctaaaagcactagttaaaat

SEQ ID NO: 74933 - DNA, 75 bp, Artificial Sequence
  Synthetic
gatgaggaatgttgcccagttaacttcaaaaagtgttgcccccttgtgtgcgggaaggctatccaatttattgac

SEQ ID NO: 74934 - DNA, 75 bp, Artificial Sequence
  Synthetic
gtggggcaggactccatcttagaaaaatccctaaaagcactagttaaaatcatatcagccttggtgatcgtagtt

SEQ ID NO: 74935 - DNA, 75 bp, Artificial Sequence
  Synthetic
gtaggagcgacccttgaggcgctattccagggtccaccaatttacagagagatcaagatcagtgttgcacctgaa

SEQ ID NO: 74936 - DNA, 75 bp, Artificial Sequence
  Synthetic
ctcaaacaaaaggtgtctcaatactatggaatccccatggctgaaaggcagaacaacggctggttgaagaagttt

SEQ ID NO: 74937 - DNA, 75 bp, Artificial Sequence
  Synthetic
tccagggtccaccaatttacagagagatcaagatcagtgttgcacctgaaacaccaccaccaccagcgattgcag

SEQ ID NO: 74938 - DNA, 75 bp, Artificial Sequence
  Synthetic
atggaatccccatggctgaaaggcagaacaacggctggttgaagaagtttacagagatgaccaatgcctgtaagg

SEQ ID NO: 74939 - DNA, 75 bp, Artificial Sequence
  Synthetic
actcaacccttcaaattgaaaaacatgtcagcagagccttcatctgtcttcaagctttgaccacattcgtgtccg

SEQ ID NO: 74940 - DNA, 75 bp, Artificial Sequence
  Synthetic
aaaagcatgaatttctgaacagattgaagcaactgcctttattagaaagccagattgccaccattgaacagagtg

SEQ ID NO: 74941 - DNA, 75 bp, Artificial Sequence
  Synthetic
tgtcagcagagccttcatctgtcttcaagctttgaccacattcgtgtccgtggctggtattatttacatcatcta

SEQ ID NO: 74942 - DNA, 75 bp, Artificial Sequence
  Synthetic
gaagcaactgcctttattagaaagccagattgccaccattgaacagagtgccccatcccagaccgatcaggaaca

SEQ ID NO: 74943 - DNA, 75 bp, Artificial Sequence
  Synthetic
agccaaggtgcaaggccctgcctttgagttcgcagtggctatgatgaagagaaactccagtacagtgaagacaga

SEQ ID NO: 74944 - DNA, 75 bp, Artificial Sequence
  Synthetic
agtgttctccctagagaagaagatgagcaactacatacagttcaagtccaaatgtcgtattgaacctgtatgtct

SEQ ID NO: 74945 - DNA, 75 bp, Artificial Sequence
  Synthetic
gaaactccagtacagtgaagacagagtatggggagttcaccatgttggggatttacgacagatgggccgttctcc

SEQ ID NO: 74946 - DNA, 75 bp, Artificial Sequence
  Synthetic
agcaactacatacagttcaagtccaaatgtcgtattgaacctgtatgtctcttgcttcatgggagccctggtgct

SEQ ID NO: 74947 - DNA, 75 bp, Artificial Sequence
  Synthetic
tggataaggatggcacaaacctcgagctgaccttactaaaacttaaccgcaatgagaagtttagggacatcagag

SEQ ID NO: 74948 - DNA, 75 bp, Artificial Sequence
  Synthetic
ccagacccagatcactttgatggctataaacagcaggccgtcgtgatcatggatgacctgtgccaaaacccagac

SEQ ID NO: 74949 - DNA, 75 bp, Artificial Sequence
  Synthetic
gctgaccttactaaaacttaaccgcaatgagaagtttagggacatcagaggtttcttggctaaggaagaggcgga

SEQ ID NO: 74950 - DNA, 75 bp, Artificial Sequence
  Synthetic
ataaacagcaggccgtcgtgatcatggatgacctgtgccaaaacccagacgggaaagatgtgtccttattctgcc

SEQ ID NO: 74951 - DNA, 75 bp, Artificial Sequence
  Synthetic
ctatggctttctaaatctgggtggcacccccacaaaaagaatgctcatgtataacttccccactagggcaggcca

SEQ ID NO: 74952 - DNA, 75 bp, Artificial Sequence
  Synthetic
ttgtgctcgcatccaccaatgcaggatctatcaacgcccccactgtgtcagacagcagagcccttgctaggcgat

SEQ ID NO: 74953 - DNA, 75 bp, Artificial Sequence
  Synthetic
acccccacaaaaagaatgctcatgtataacttccccactagggcaggccaatgtggcggtgtccttatgtccact

SEQ ID NO: 74954 - DNA, 75 bp, Artificial Sequence
  Synthetic
atctatcaacgcccccactgtgtcagacagcagagcccttgctaggcgattccactttgatatgaacatcgaagt

SEQ ID NO: 74955 - DNA, 75 bp, Artificial Sequence
  Synthetic
aacgatgaacaaggggagattgagttcattgagagctccaaggaagcagggttcccggtcattaatacaccaggc

SEQ ID NO: 74956 - DNA, 75 bp, Artificial Sequence
  Synthetic
agtcaatttcaagaagtgctgcccacttgtctgtggaaaagcaatccagtttattgacagaaggacacagatgag

SEQ ID NO: 74957 - DNA, 75 bp, Artificial Sequence
  Synthetic
tcattgagagctccaaggaagcagggttcccggtcattaatacaccaggcaagactaagctggaaccaagtgttt

SEQ ID NO: 74958 - DNA, 75 bp, Artificial Sequence
  Synthetic
cttgtctgtggaaaagcaatccagtttattgacagaaggacacagatgaggtactcattagatatgcttgtaact

SEQ ID NO: 74959 - DNA, 75 bp, Artificial Sequence
  Synthetic
aagaggctatcttctccaaatatataggaaatgtcaatacgcacgtagatgagtacatgctagaagcagtagacc

SEQ ID NO: 74960 - DNA, 75 bp, Artificial Sequence
  Synthetic
tacagggagatcaagatcagtgttgcaccagaaaccccccctccaccagcgattgctgacttattgaaatcagtg

SEQ ID NO: 74961 - DNA, 75 bp, Artificial Sequence
  Synthetic
aggaaatgtcaatacgcacgtagatgagtacatgctagaagcagtagaccattatgcagggcagctggccaccct

SEQ ID NO: 74962 - DNA, 75 bp, Artificial Sequence
  Synthetic
caccagaaaccccccctccaccagcgattgctgacttattgaaatcagtggacagtgaggccgttagagagtact

SEQ ID NO: 74963 - DNA, 75 bp, Artificial Sequence
  Synthetic
caccagtgcagggtacccatatgtggcattgggcatcaagaaaagagacatcctatccaagaaaaccagggattt

SEQ ID NO: 74964 - DNA, 75 bp, Artificial Sequence
  Synthetic
tctgcttgcaagcacttaccacttttgtttcagtggcagggataatatacatcatctacaagttgtttgcaggct

SEQ ID NO: 74965 - DNA, 75 bp, Artificial Sequence
  Synthetic
tcctatccaagaaaaccagggatttaaccaaactaaaggagtgcatggacaaatacggcctgaatttaccaatgg

SEQ ID NO: 74966 - DNA, 75 bp, Artificial Sequence
  Synthetic
tgtttcagtggcagggataatatacatcatctacaagttgtttgcaggcttccagggggcctatactggaatgcc

SEQ ID NO: 74967 - DNA, 75 bp, Artificial Sequence
  Synthetic
gatgaaaagaaacgctagtaccgtgaaaactgagtacggcgagttcacaatgcttggcatatacgacaggtgggc

SEQ ID NO: 74968 - DNA, 75 bp, Artificial Sequence
  Synthetic
gcttaaacgattcagttgcaatgagacaaacgtttggcaacctgtacaagacattccaccaaaatccagggattg

SEQ ID NO: 74969 - DNA, 75 bp, Artificial Sequence
  Synthetic
acaaacgtttggcaacctgtacaagacattccaccaaaatccagggattgtgacaggcagtgcggttgggtgcga

SEQ ID NO: 74970 - DNA, 75 bp, Artificial Sequence
  Synthetic
aaaactgagtacggcgagttcacaatgcttggcatatacgacaggtgggcggtgttgccccggcacgccaggccc

SEQ ID NO: 74971 - DNA, 75 bp, Artificial Sequence
  Synthetic
aacttagagctaacactcttaaaactcaacaggaacgaaaagttcagggacatccgaggattcttggcgcgtgag

SEQ ID NO: 74972 - DNA, 75 bp, Artificial Sequence
  Synthetic
tgccagtctaagtcccgtgtggtttgcttgtttgaagctgctgcttgagaaactcgggtacacacataaagagac

SEQ ID NO: 74973 - DNA, 75 bp, Artificial Sequence
  Synthetic
gcttgtttgaagctgctgcttgagaaactcgggtacacacataaagagactaattatattgattatttgtgcaat

SEQ ID NO: 74974 - DNA, 75 bp, Artificial Sequence
  Synthetic
tcaacaggaacgaaaagttcagggacatccgaggattcttggcgcgtgaggaagtcgaggtcaatgaagccgtgc

SEQ ID NO: 74975 - DNA, 75 bp, Artificial Sequence
  Synthetic
tgggtggtacccccaccaagcgcatgctgatgtacaacttccccactcgcgcaggacagtgtggaggggtcctga

SEQ ID NO: 74976 - DNA, 75 bp, Artificial Sequence
  Synthetic
ttcaattcgatgatcaacaacatcataattagggctctaatgctgaaggtgtataaaggtattgaccttgaccaa

SEQ ID NO: 74977 - DNA, 75 bp, Artificial Sequence
  Synthetic
taattagggctctaatgctgaaggtgtataaaggtattgaccttgaccaattcaggatgattgcttatggtgatg

SEQ ID NO: 74978 - DNA, 75 bp, Artificial Sequence
  Synthetic
gctgatgtacaacttccccactcgcgcaggacagtgtggaggggtcctgatgtcgacaggtaaagtgcttggaat

SEQ ID NO: 74979 - DNA, 75 bp, Artificial Sequence
  Synthetic
gatcgagttcatcgagagctccaaagaagccggttttccagtcatcaacactcccagtaagacgaaacttgagcc

SEQ ID NO: 74980 - DNA, 75 bp, Artificial Sequence
  Synthetic
tgacaccagcagacaagggggagtgctttaatgaagtgacatggaccaacgttacctttctaaaaaggtatttta

SEQ ID NO: 74981 - DNA, 75 bp, Artificial Sequence
  Synthetic
ctttaatgaagtgacatggaccaacgttacctttctaaaaaggtattttagagcggatgagcaataccccttcct

SEQ ID NO: 74982 - DNA, 75 bp, Artificial Sequence
  Synthetic
gaagccggttttccagtcatcaacactcccagtaagacgaaacttgagcctagcgttttccatcacgtatttgag

SEQ ID NO: 74983 - DNA, 75 bp, Artificial Sequence
  Synthetic
aaatacattggtaatgtgaacacccatgtggatgagtacatgatggaggctgttgaccactacgctgggcaacta

SEQ ID NO: 74984 - DNA, 75 bp, Artificial Sequence
  Synthetic
tcatgtgcgctcactgtgtctattggcttggcacaatggagagcgcgagtatgaggaattcatccgtaaaatcag

SEQ ID NO: 74985 - DNA, 75 bp, Artificial Sequence
  Synthetic
atgtggatgagtacatgatggaggctgttgaccactacgctgggcaactagcaactctcgatatcagtacggaac

SEQ ID NO: 74986 - DNA, 75 bp, Artificial Sequence
  Synthetic
cttacgtcgcccttggtataaaaaagagagacattttgtccaagaaaaccaaagatctaactaaattgaaggaat

SEQ ID NO: 74987 - DNA, 75 bp, Artificial Sequence
  Synthetic
aactagagacaatttgatacaatttgaattggcttaaccctactacacttaccgaactagacagcggtgtagtgg

SEQ ID NO: 74988 - DNA, 75 bp, Artificial Sequence
  Synthetic
gagagacattttgtccaagaaaaccaaagatctaactaaattgaaggaatgtatggacaagtatgggctaaatct

SEQ ID NO: 74989 - DNA, 75 bp, Artificial Sequence
  Synthetic
agcatcaagtttgaatgattcagtggcaatgaggcaaacttttgggaacctgtacaaaacttttcacttgaaccc

SEQ ID NO: 74990 - DNA, 75 bp, Artificial Sequence
  Synthetic
gcaatgaggcaaacttttgggaacctgtacaaaacttttcacttgaacccaggcatagtaactggcagtgcagtc

SEQ ID NO: 74991 - DNA, 75 bp, Artificial Sequence
  Synthetic
ggatatgatgccagtttgagcccggtgtggttcgcttgcctgaaaatgttgttagaaaagctggggtattcccac

SEQ ID NO: 74992 - DNA, 75 bp, Artificial Sequence
  Synthetic
tgtggttcgcttgcctgaaaatgttgttagaaaagctggggtattcccacaaggaaaccaattacatagactact

SEQ ID NO: 74993 - DNA, 75 bp, Artificial Sequence
  Synthetic
ctagcattttcaactcaatgattaacaacataatcattagaactttgatgctaaaggtttacaagggcatagatc

SEQ ID NO: 74994 - DNA, 75 bp, Artificial Sequence
  Synthetic
caacataatcattagaactttgatgctaaaggtttacaagggcatagatctagatcagttcagaatgatagccta

SEQ ID NO: 74995 - DNA, 75 bp, Artificial Sequence
  Synthetic
tctgattatgacaccggctgataaaggggagtgcttcaacgaggtaacgtggactaatgtcacttttctgaaaag

SEQ ID NO: 74996 - DNA, 75 bp, Artificial Sequence
  Synthetic
ggggagtgcttcaacgaggtaacgtggactaatgtcacttttctgaaaagatactttagagcagatgagcagtac

SEQ ID NO: 74997 - DNA, 75 bp, Artificial Sequence
  Synthetic
acccaagatcatgtgcgatccctgtgcttattggcttggcacaacggggaacaagaatatgaagagttcgtgtcc

SEQ ID NO: 74998 - DNA, 75 bp, Artificial Sequence
  Synthetic
acaagaatatgaagagttcgtgtccaaaatcaggagcgttccagtggggcgctgcttgaccctacctgcattttc

SEQ ID NO: 74999 - DNA, 75 bp, Artificial Sequence
  Synthetic
acccacagggcccactgggcgctagcactctggtatcacggtacccttgtgcgcctgttttatcccccccttccc

SEQ ID NO: 75000 - DNA, 75 bp, Artificial Sequence
  Synthetic
ttgaaagattgttaccatatagctattggattggccatccggtgacaaatagagcaattatttaccaatttgttg

SEQ ID NO: 75001 - DNA, 75 bp, Artificial Sequence
  Synthetic
acaagtatcaactcagaaaactggcgcgcacgaaactggcctgaatgccagtgggagctctatcatacactacac

SEQ ID NO: 75002 - DNA, 75 bp, Artificial Sequence
  Synthetic
gcgcacgaaactggcctgaatgccagtgggagctctatcatacactacaccaatatcaactattacaaagatgcg

SEQ ID NO: 75003 - DNA, 75 bp, Artificial Sequence
  Synthetic
atcaagtcaatgcccgccttgaactcaccatctgcggaggagtgtggatacagtgatagagttagatccttgaca

SEQ ID NO: 75004 - DNA, 75 bp, Artificial Sequence
  Synthetic
caccatctgcggaggagtgtggatacagtgatagagttagatccttgacactgggaaattcgactatcaccacac

SEQ ID NO: 75005 - DNA, 75 bp, Artificial Sequence
  Synthetic
accaaccaacacagcctgacgtggccacgtgcagattttacacactagagtctgtgcagtgggagaagaacagcg

SEQ ID NO: 75006 - DNA, 75 bp, Artificial Sequence
  Synthetic
cacgtgcagattttacacactagagtctgtgcagtgggagaagaacagcgctgggtggtggtggaagttccctga

SEQ ID NO: 75007 - DNA, 75 bp, Artificial Sequence
  Synthetic
cgtacagtgcaatgcatctaaattccaccaggggtgcctactcgttgtctgcgtgcccgaggctgaaatgggctg

SEQ ID NO: 75008 - DNA, 75 bp, Artificial Sequence
  Synthetic
caccaggggtgcctactcgttgtctgcgtgcccgaggctgaaatgggctgctcacaaacggacaaggaagttgcc

SEQ ID NO: 75009 - DNA, 75 bp, Artificial Sequence
  Synthetic
tcgatagtatgcaatgcaggcatgggtgttggtgtcggtaatctaactatttatccacatcagtggataaatctg

SEQ ID NO: 75010 - DNA, 75 bp, Artificial Sequence
  Synthetic
gtgttggtgtcggtaatctaactatttatccacatcagtggataaatctgcgcaccaataattgtgctactatcg

SEQ ID NO: 75011 - DNA, 75 bp, Artificial Sequence
  Synthetic
ttgctcccctggattacactgctcaagcgtccgagtatgtcccagtgactgtcacgatcgccccaatgtgtgctg

SEQ ID NO: 75012 - DNA, 75 bp, Artificial Sequence
  Synthetic
agcgtccgagtatgtcccagtgactgtcacgatcgccccaatgtgtgctgaatacaacggtctaaggttggcgta

SEQ ID NO: 75013 - DNA, 75 bp, Artificial Sequence
  Synthetic
ggcaatgccacagtttgatgtgacaccgcatatggacataccaggtgaggtgcacaacctcatggagatagcaga

SEQ ID NO: 75014 - DNA, 75 bp, Artificial Sequence
  Synthetic
ccgcatatggacataccaggtgaggtgcacaacctcatggagatagcagaggtcgactctgtagtcccagttaat

SEQ ID NO: 75015 - DNA, 75 bp, Artificial Sequence
  Synthetic
atctttgccttccagatacaacccggtttggactcagtattcaagagaacgttactaggggaagtgctcaattat

SEQ ID NO: 75016 - DNA, 75 bp, Artificial Sequence
  Synthetic
gtttggactcagtattcaagagaacgttactaggggaagtgctcaattattatgcacactggtcgggaagcatca

SEQ ID NO: 75017 - DNA, 75 bp, Artificial Sequence
  Synthetic
atgtgccagccagcagaaaacaggcaatgcttggaacccacataatttgggacataggactacaatctagttgtg

SEQ ID NO: 75018 - DNA, 75 bp, Artificial Sequence
  Synthetic
aatgcttggaacccacataatttgggacataggactacaatctagttgtgttttgtgcattccgtggattagtca

SEQ ID NO: 75019 - DNA, 75 bp, Artificial Sequence
  Synthetic
agtagttccccctggcacgcccaacaagtgtgtggtgctgtgctttgtgtcagcgtgtaatgacttctcagtgcg

SEQ ID NO: 75020 - DNA, 75 bp, Artificial Sequence
  Synthetic
aagtgtgtggtgctgtgctttgtgtcagcgtgtaatgacttctcagtgcgtatgctacgtgacaccccattcatt

SEQ ID NO: 75021 - DNA, 75 bp, Artificial Sequence
  Synthetic
gccagcggacctagtaactccactagcataccagctcttaccgcggtcgaaaccgggcacacgtcacaggtggaa

SEQ ID NO: 75022 - DNA, 75 bp, Artificial Sequence
  Synthetic
gcataccagctcttaccgcggtcgaaaccgggcacacgtcacaggtggaaccgagtgacacaatgcagacacgac

SEQ ID NO: 75023 - DNA, 75 bp, Artificial Sequence
  Synthetic
aggaatattttaccaaggaccaggacagtgccaacagatacatgtcatggaccattaacgccagaaggatggtgc

SEQ ID NO: 75024 - DNA, 75 bp, Artificial Sequence
  Synthetic
cagtgccaacagatacatgtcatggaccattaacgccagaaggatggtgcaactgaggcggaagtttgaattgtt

SEQ ID NO: 75025 - DNA, 75 bp, Artificial Sequence
  Synthetic
ggacatgccaccgttaacacaccaaattatgtacattccacctgggggccctgtgccaaacagcgtgaccgattt

SEQ ID NO: 75026 - DNA, 75 bp, Artificial Sequence
  Synthetic
attatgtacattccacctgggggccctgtgccaaacagcgtgaccgattttgcatggcagacatctaccaaccca

SEQ ID NO: 75027 - DNA, 75 bp, Artificial Sequence
  Synthetic
aatttttatgatggttggtcacacttctcacagaacggtgtgtatgggtacaatgcgttaaacaacatgggcaaa

SEQ ID NO: 75028 - DNA, 75 bp, Artificial Sequence
  Synthetic
tctcacagaacggtgtgtatgggtacaatgcgttaaacaacatgggcaaattgtacgcacgccacgtaaataaag

SEQ ID NO: 75029 - DNA, 75 bp, Artificial Sequence
  Synthetic
caccacgcttgtgtccctatattaaatctagcaatgttaactttgacccgaccaacctaactgacaaaagagaaa

SEQ ID NO: 75030 - DNA, 75 bp, Artificial Sequence
  Synthetic
gatcttaccagaggtgagggagaaacatgagtttctcaacagattgaaacagctaccactcctggagaatcagat

SEQ ID NO: 75031 - DNA, 75 bp, Artificial Sequence
  Synthetic
atctagcaatgttaactttgacccgaccaacctaactgacaaaagagaaagcataacatatgtgcccgacaccat

SEQ ID NO: 75032 - DNA, 75 bp, Artificial Sequence
  Synthetic
gaacaggcacttggccacgcatgcggattggcaaagttgcgtgtgggaagactacaacagggatctcctcgtgag

SEQ ID NO: 75033 - DNA, 75 bp, Artificial Sequence
  Synthetic
gattggcaaagttgcgtgtgggaagactacaacagggatctcctcgtgagtactaccgccgctcacgggtgtgat

SEQ ID NO: 75034 - DNA, 75 bp, Artificial Sequence
  Synthetic
gaggggcccggtttggtggaagttcaggagagtgaatactaccccaagagataccaatcccatgtgctgctcgct

SEQ ID NO: 75035 - DNA, 75 bp, Artificial Sequence
  Synthetic
aggagagtgaatactaccccaagagataccaatcccatgtgctgctcgctgcaggtttctcagagccaggcgatt

SEQ ID NO: 75036 - DNA, 75 bp, Artificial Sequence
  Synthetic
ccgatgtccgcgacctcctgtggctggaagacgatgccatggaacagggtgttaaagattacgtggaacagcttg

SEQ ID NO: 75037 - DNA, 75 bp, Artificial Sequence
  Synthetic
ggaagacgatgccatggaacagggtgttaaagattacgtggaacagcttgggaatgcttttgggtctggttttac

SEQ ID NO: 75038 - DNA, 75 bp, Artificial Sequence
  Synthetic
caaagctctagtaaagattatatcagcactagttattgtggttagaaaccacgacgacctcattacagtgacagc

SEQ ID NO: 75039 - DNA, 75 bp, Artificial Sequence
  Synthetic
gcactagttattgtggttagaaaccacgacgacctcattacagtgacagccactctcgcccttatcggctgcacc

SEQ ID NO: 75040 - DNA, 75 bp, Artificial Sequence
  Synthetic
gggtggcttaagaagttcaccgaaatgacaaatgcttgcaagggcatggagtggattgcgatcaagatccaaaaa

SEQ ID NO: 75041 - DNA, 75 bp, Artificial Sequence
  Synthetic
tgacaaatgcttgcaagggcatggagtggattgcgatcaagatccaaaaatttatagaatggttgaaggtcaaga

SEQ ID NO: 75042 - DNA, 75 bp, Artificial Sequence
  Synthetic
ctacgattgagcagagcgcaccttcacagagtgaccaagagcaactattctccaatgtgcagtatttcgcacatt

SEQ ID NO: 75043 - DNA, 75 bp, Artificial Sequence
  Synthetic
acagagtgaccaagagcaactattctccaatgtgcagtatttcgcacattactgcaggaagtatgcccctttgta

SEQ ID NO: 75044 - DNA, 75 bp, Artificial Sequence
  Synthetic
tattgaacctgtctgtttactgctccacggaaaccccggggctgggaaatccgtggcgaccaacctaattgggcg

SEQ ID NO: 75045 - DNA, 75 bp, Artificial Sequence
  Synthetic
cacggaaaccccggggctgggaaatccgtggcgaccaacctaattgggcgttcactcgcagagaaactcaacagt

SEQ ID NO: 75046 - DNA, 75 bp, Artificial Sequence
  Synthetic
ctgtgtcagaacccagacggaaaggacgtatcactgttttgtcaaatggtgtccagcgtggactttgtcccacca

SEQ ID NO: 75047 - DNA, 75 bp, Artificial Sequence
  Synthetic
acgtatcactgttttgtcaaatggtgtccagcgtggactttgtcccaccaatggcagcactggaggagaagggta

SEQ ID NO: 75048 - DNA, 75 bp, Artificial Sequence
  Synthetic
gagccctggcaaggaggttccactttgacatgaatattgaagtcatctcgatgtatagccagaatggtaagatca

SEQ ID NO: 75049 - DNA, 75 bp, Artificial Sequence
  Synthetic
tgatgatgagtgctgcccagtcaatttcaagaagtgttgcccactcgtatgtggtaaggccatccaattcattga

SEQ ID NO: 75050 - DNA, 75 bp, Artificial Sequence
  Synthetic
tgtgggggcaacactcgaggcacttttccaaggcccaccagtgtacagggagatcaaaattagtgtagcacccga

SEQ ID NO: 75051 - DNA, 75 bp, Artificial Sequence
  Synthetic
gagggggtggctggtgcccgagattaattccaccttgcaaatcgaaaaacacgtgagtagggcttctatttgtct

SEQ ID NO: 75052 - DNA, 75 bp, Artificial Sequence
  Synthetic
aattccaccttgcaaatcgaaaaacacgtgagtagggcttctatttgtctgcaagcactcaccacctttgtatca

SEQ ID NO: 75053 - DNA, 75 bp, Artificial Sequence
  Synthetic
aagcccaaagtgccaaccttgagacaagcaaaagttcaggggcctgcatttgaatttgcggtggccatgatgaag

SEQ ID NO: 75054 - DNA, 75 bp, Artificial Sequence
  Synthetic
aagcaaaagttcaggggcctgcatttgaatttgcggtggccatgatgaagcgaaatgccagtactgtgaaaactg

SEQ ID NO: 75055 - DNA, 75 bp, Artificial Sequence
  Synthetic
ccattctgatgaatgatcaagaagtgggagtggtagatgccaaggagctggtggataaggatggcaccaatttgg

SEQ ID NO: 75056 - DNA, 75 bp, Artificial Sequence
  Synthetic
gggagtggtagatgccaaggagctggtggataaggatggcaccaatttggagctgacactcctgaaactcaacag

SEQ ID NO: 75057 - DNA, 75 bp, Artificial Sequence
  Synthetic
caacaccagcaagtttccaaacatgtacattccagttggtcaagtgacagactacggcttcctcaacctgggtgg

SEQ ID NO: 75058 - DNA, 75 bp, Artificial Sequence
  Synthetic
tacattccagttggtcaagtgacagactacggcttcctcaacctgggtgggacccctactaagcgcatgctaatg

SEQ ID NO: 75059 - DNA, 75 bp, Artificial Sequence
  Synthetic
ggtggcaatgggcatcaagggttttcagcagccctgttacgtcactacttcaatgacgagcagggtgaaattgag

SEQ ID NO: 75060 - DNA, 75 bp, Artificial Sequence
  Synthetic
cagcagccctgttacgtcactacttcaatgacgagcagggtgaaattgagtacattgaaagctccaaggtagctg

SEQ ID NO: 75061 - DNA, 75 bp, Artificial Sequence
  Synthetic
aagagccagcggtgttgagaaatggggaccccagattgaaagctaactttgaggaggccattttctccaagtaca

SEQ ID NO: 75062 - DNA, 75 bp, Artificial Sequence
  Synthetic
ggaccccagattgaaagctaactttgaggaggccattttctccaagtacattggaaatgtgaatacacatgtgga

SEQ ID NO: 75063 - DNA, 75 bp, Artificial Sequence
  Synthetic
gctggaggatgcggtctatggcaccgaaggcctggaagcgctggatctgaccacaagcgcagggtacccatatgt

SEQ ID NO: 75064 - DNA, 75 bp, Artificial Sequence
  Synthetic
gaaggcctggaagcgctggatctgaccacaagcgcagggtacccatatgtcgctcttggcatcaaaaagagagac

SEQ ID NO: 75065 - DNA, 75 bp, Artificial Sequence
  Synthetic
gtcacctttgtgaaagatgagttgaggtcagcagagaaagtggccaagggcaaatccaggttaatcgaggcatcg

SEQ ID NO: 75066 - DNA, 75 bp, Artificial Sequence
  Synthetic
ggtcagcagagaaagtggccaagggcaaatccaggttaatcgaggcatcgagcttgaacgactcggtggcaatga

SEQ ID NO: 75067 - DNA, 75 bp, Artificial Sequence
  Synthetic
acccacagggcccactgggcgttagcacactggtatcccggtacctttgtgcgcctgttttatatccccttcccc

SEQ ID NO: 75068 - DNA, 75 bp, Artificial Sequence
  Synthetic
atcctgacctattttggagcaaaatcccagtcatgcttgatggccaccttatagccttcgactacagtgggtatg

SEQ ID NO: 75069 - DNA, 75 bp, Artificial Sequence
  Synthetic
tctgtgaccccggaccgagtatcaataagctgcttgcgcggctgaaggagaaaccgttcgttacccggctaacta

SEQ ID NO: 75070 - DNA, 75 bp, Artificial Sequence
  Synthetic
cccagtcatgcttgatggccaccttatagccttcgactacagtgggtatgatgccagtttgagccctgtgtggtt

SEQ ID NO: 75071 - DNA, 75 bp, Artificial Sequence
  Synthetic
ctctcatcatctgtacagagacaaacactactttgttagaggagggatgccatctgggtgctctgggaccagcat

SEQ ID NO: 75072 - DNA, 75 bp, Artificial Sequence
  Synthetic
cactactttgttagaggagggatgccatctgggtgctctgggaccagcatttttaattcgatgataaacaacata

SEQ ID NO: 75073 - DNA, 75 bp, Artificial Sequence
  Synthetic
gatgtgattgcatcatacccgcacccaattgatgcctcactgttagccgaagccggcaaagggtatggtctgatc

SEQ ID NO: 75074 - DNA, 75 bp, Artificial Sequence
  Synthetic
gttttaatgaggtgacatggaccaacgtcaccttcttgaaaagatacttcagggcagatgaacaataccccttcc

SEQ ID NO: 75075 - DNA, 75 bp, Artificial Sequence
  Synthetic
aattgagagattgttgccatatagctattggattggccatccggtgtcgaatagagcaattatttacctatttgt

SEQ ID NO: 75076 - DNA, 75 bp, Artificial Sequence
  Synthetic
gctcaagtttcaacacaaaagacaggggcacacgagaccagtctgagcgccacgggcaattcaatcatccattac

SEQ ID NO: 75077 - DNA, 75 bp, Artificial Sequence
  Synthetic
gggcacacgagaccagtctgagcgccacgggcaattcaatcatccattacaccaatatcaactattacaaagatg

SEQ ID NO: 75078 - DNA, 75 bp, Artificial Sequence
  Synthetic
ggcttggcacaatggagagcaagaatatgaagaatttgtgtccaagatcaggagcgtcccagttggacgctgttt

SEQ ID NO: 75079 - DNA, 75 bp, Artificial Sequence
  Synthetic
tgataaagtcgctaccggcacttaattcaccaactgtagaagagtgtgggtatagtgacagggttagatcgataa

SEQ ID NO: 75080 - DNA, 75 bp, Artificial Sequence
  Synthetic
ttcaccaactgtagaagagtgtgggtatagtgacagggttagatcgataacactgggaaattcaacaataacaac

SEQ ID NO: 75081 - DNA, 75 bp, Artificial Sequence
  Synthetic
gcacactggtatcacggtacctttgtgcgcctgttttatatccccccccccaagtaaaccttagaagcaatacac

SEQ ID NO: 75082 - DNA, 75 bp, Artificial Sequence
  Synthetic
ggaccaacccacccaaccagacgttgcaacatgcaggttttacacactgaagtcagtgaaatgggagatgcagtc

SEQ ID NO: 75083 - DNA, 75 bp, Artificial Sequence
  Synthetic
gcaacatgcaggttttacacactgaagtcagtgaaatgggagatgcagtcagcggggtggtggtggaagttccca

SEQ ID NO: 75084 - DNA, 75 bp, Artificial Sequence
  Synthetic
taggctgctcacgcggctgaaggagaaagcgttcgttacccggccagctacttcgagaagcctagtaacaccatg

SEQ ID NO: 75085 - DNA, 75 bp, Artificial Sequence
  Synthetic
cacgtacaatgcaacgcgtctaagttccatcagggctgcttgctagtagtgtgcgtgcctgaggccgagatgggg

SEQ ID NO: 75086 - DNA, 75 bp, Artificial Sequence
  Synthetic
tccatcagggctgcttgctagtagtgtgcgtgcctgaggccgagatggggtgcactaacgcggaaaatgcgccca

SEQ ID NO: 75087 - DNA, 75 bp, Artificial Sequence
  Synthetic
cgctctaataccgacatggtgcgaagagtctattgagctagctggtagtcctccggcccctgaatgcggctaatc

SEQ ID NO: 75088 - DNA, 75 bp, Artificial Sequence
  Synthetic
aaacagctgtgtgtaacgcgggcatgggtgtaggagttggcaacctgaccatatacccacaccagtggattaacc

SEQ ID NO: 75089 - DNA, 75 bp, Artificial Sequence
  Synthetic
gggtgtaggagttggcaacctgaccatatacccacaccagtggattaacctgagaactaacaacagtgccactat

SEQ ID NO: 75090 - DNA, 75 bp, Artificial Sequence
  Synthetic
tcttacattggctgcttatggtgacaattgagagattgttaccatatagctattggattggccatccggtgacaa

SEQ ID NO: 75091 - DNA, 75 bp, Artificial Sequence
  Synthetic
aattgagagattgttaccatatagctattggattggccatccggtgacaaacaaagctatcatatatttattcat

SEQ ID NO: 75092 - DNA, 75 bp, Artificial Sequence
  Synthetic
atttgctccgttagattacgttacgggagcgtcctcctacattcccatcactgtgacagttgctccaatgagcgc

SEQ ID NO: 75093 - DNA, 75 bp, Artificial Sequence
  Synthetic
ggagcgtcctcctacattcccatcactgtgacagttgctccaatgagcgctgaatacaatggcttgcgattggct

SEQ ID NO: 75094 - DNA, 75 bp, Artificial Sequence
  Synthetic
gcacaagtatcaacccagaaaacaggtgcccacgagaccagtttaagtgctagtggaagttctatcatccattac

SEQ ID NO: 75095 - DNA, 75 bp, Artificial Sequence
  Synthetic
gtgcccacgagaccagtttaagtgctagtggaagttctatcatccattacacgaacattaattattacaaggatg

SEQ ID NO: 75096 - DNA, 75 bp, Artificial Sequence
  Synthetic
tcagccatgccgcaatttgatgtgacccctgagatgaacatcccagggcaggtaaggaacttgatggaaatagcg

SEQ ID NO: 75097 - DNA, 75 bp, Artificial Sequence
  Synthetic
cccctgagatgaacatcccagggcaggtaaggaacttgatggaaatagcggaggttgattctgtagtgccgatca

SEQ ID NO: 75098 - DNA, 75 bp, Artificial Sequence
  Synthetic
tggtcaagacgctacccgctctcaattcaccaactgttgaggaatgcgggtatagtgatagggtgcgctccatca

SEQ ID NO: 75099 - DNA, 75 bp, Artificial Sequence
  Synthetic
ttcaccaactgttgaggaatgcgggtatagtgatagggtgcgctccatcacactaggcaactcaaccatcaccac

SEQ ID NO: 75100 - DNA, 75 bp, Artificial Sequence
  Synthetic
aaatatttgggtttcccttgcaacctggagcatcaagtgtgctgcagaggacactattgggagagatattaaact

SEQ ID NO: 75101 - DNA, 75 bp, Artificial Sequence
  Synthetic
tggagcatcaagtgtgctgcagaggacactattgggagagatattaaactactatacacactggtcagggagtct

SEQ ID NO: 75102 - DNA, 75 bp, Artificial Sequence
  Synthetic
ggaccaacccacacagccggacgtggccacgtgtcgattttacacgctcgaatcagttaattggcaaaaagagag

SEQ ID NO: 75103 - DNA, 75 bp, Artificial Sequence
  Synthetic
gccacgtgtcgattttacacgctcgaatcagttaattggcaaaaagagagcgcagggtggtggtggaagttccca

SEQ ID NO: 75104 - DNA, 75 bp, Artificial Sequence
  Synthetic
aggagctccagatagtagaaagaatgccatgttggggactcatgtcatatgggatgttggattgcaatccagctg

SEQ ID NO: 75105 - DNA, 75 bp, Artificial Sequence
  Synthetic
gccatgttggggactcatgtcatatgggatgttggattgcaatccagctgcgtgctatgcgtgccatggattagt

SEQ ID NO: 75106 - DNA, 75 bp, Artificial Sequence
  Synthetic
catgtgcaatgcaatgcctccaagttccatcagggtgcgttacttgttgtgtgtgttccagaagcgcagatgggt

SEQ ID NO: 75107 - DNA, 75 bp, Artificial Sequence
  Synthetic
tccatcagggtgcgttacttgttgtgtgtgttccagaagcgcagatgggttcagccaaagtaaaggaagcgttca

SEQ ID NO: 75108 - DNA, 75 bp, Artificial Sequence
  Synthetic
gtcatcgtcccagcagaggcgcagaagtcatgttatataatgtgtttcgtgtcagcgtgcaatgatttctcagta

SEQ ID NO: 75109 - DNA, 75 bp, Artificial Sequence
  Synthetic
agtcatgttatataatgtgtttcgtgtcagcgtgcaatgatttctcagtacgcatgttgagggacacacaattca

SEQ ID NO: 75110 - DNA, 75 bp, Artificial Sequence
  Synthetic
cagtccacaatgcggccatgggggtggctgttggcaacttgacaatcttcccacaccagtggataaacttgcgca

SEQ ID NO: 75111 - DNA, 75 bp, Artificial Sequence
  Synthetic
ggctgttggcaacttgacaatcttcccacaccagtggataaacttgcgcacgaacaatagtgctaccattgtgat

SEQ ID NO: 75112 - DNA, 75 bp, Artificial Sequence
  Synthetic
ttgccagaggtccatcaaactccgagcagatccctgccttaacggctgtggaaactgggcacacttctcaagtag

SEQ ID NO: 75113 - DNA, 75 bp, Artificial Sequence
  Synthetic
gcagatccctgccttaacggctgtggaaactgggcacacttctcaagtagaccctagtgacactatgcaaacaag

SEQ ID NO: 75114 - DNA, 75 bp, Artificial Sequence
  Synthetic
caagcttgaatacacgagcgggtcctcgagtgtggtgcctataaccgtgactgttgctccaatgtgtgccgagta

SEQ ID NO: 75115 - DNA, 75 bp, Artificial Sequence
  Synthetic
tcgagtgtggtgcctataaccgtgactgttgctccaatgtgtgccgagtacaatggcctacggctggccggtcac

SEQ ID NO: 75116 - DNA, 75 bp, Artificial Sequence
  Synthetic
tataaaatattctagtgctgaatcaaacaacttgaagcgctatgcagaatgggtcattaatacaagacaagtggc

SEQ ID NO: 75117 - DNA, 75 bp, Artificial Sequence
  Synthetic
aacaacttgaagcgctatgcagaatgggtcattaatacaagacaagtggcgcagttgcggcggaagatggaaatg

SEQ ID NO: 75118 - DNA, 75 bp, Artificial Sequence
  Synthetic
atgccacagtttgatgtgacaccggagatgagcataccaggggaggtgaagaacttgatggagatcgcagaggtg

SEQ ID NO: 75119 - DNA, 75 bp, Artificial Sequence
  Synthetic
agatgagcataccaggggaggtgaagaacttgatggagatcgcagaggtggactcactggtaccggtgaacaaca

SEQ ID NO: 75120 - DNA, 75 bp, Artificial Sequence
  Synthetic
tctgtcgttccagtccaaacacatcaaataatgtacgtgccacctggtggtcccgtaccaacatcagttaatgat

SEQ ID NO: 75121 - DNA, 75 bp, Artificial Sequence
  Synthetic
aaataatgtacgtgccacctggtggtcccgtaccaacatcagttaatgattatgtgtggcaaacgtccaccaacc

SEQ ID NO: 75122 - DNA, 75 bp, Artificial Sequence
  Synthetic
gttttaaattgcaaccagggtatgactccgtgtttaaacacacactgttgggtgaaatattaaactactacgcaa

SEQ ID NO: 75123 - DNA, 75 bp, Artificial Sequence
  Synthetic
ctccgtgtttaaacacacactgttgggtgaaatattaaactactacgcaaattggtctggtagcataaaactcac

SEQ ID NO: 75124 - DNA, 75 bp, Artificial Sequence
  Synthetic
ccatgttctatgacggttggtcgaatttttccagggacggcatatatggctacaattcactgaacaatatgggga

SEQ ID NO: 75125 - DNA, 75 bp, Artificial Sequence
  Synthetic
tacaattcactgaacaatatggggaccatttacgcacgccatgttaacgattctagtccaggagggttgaccagc

SEQ ID NO: 75126 - DNA, 75 bp, Artificial Sequence
  Synthetic
agggacgcgaaaagacgccatgttaggcacccatgtagtatgggacttgggattacaatctagctgtgtcttatg

SEQ ID NO: 75127 - DNA, 75 bp, Artificial Sequence
  Synthetic
ggcacccatgtagtatgggacttgggattacaatctagctgtgtcttatgtgtgccatggattagtcaaactcac

SEQ ID NO: 75128 - DNA, 75 bp, Artificial Sequence
  Synthetic
aaagccaagaacgtgaattttgatgttgaggctgtcaccaccgagcgtgcaagtctggtaaccactggacctcat

SEQ ID NO: 75129 - DNA, 75 bp, Artificial Sequence
  Synthetic
ttgaggctgtcaccaccgagcgtgcaagtctggtaaccactggacctcatggtcagcagtctggcgcagtatatg

SEQ ID NO: 75130 - DNA, 75 bp, Artificial Sequence
  Synthetic
cccacgggagtagtcacacagagcactattctgtgttttgtttcagcctgtaacgatttttcagtgagactactg

SEQ ID NO: 75131 - DNA, 75 bp, Artificial Sequence
  Synthetic
ctattctgtgttttgtttcagcctgtaacgatttttcagtgagactactgcgcgacactccgttcatcacacaga

SEQ ID NO: 75132 - DNA, 75 bp, Artificial Sequence
  Synthetic
atagggatctccttgtcagcacaactaccgctcacggatgtgataccatcgccagatgccagtgtacatctggtg

SEQ ID NO: 75133 - DNA, 75 bp, Artificial Sequence
  Synthetic
taccgctcacggatgtgataccatcgccagatgccagtgtacatctggtgtttacttctgtgtatcaagaaacaa

SEQ ID NO: 75134 - DNA, 75 bp, Artificial Sequence
  Synthetic
gaccagccaattcgaccagcataccggcattgactgcagcggaaactgggcacacctcgcaagttgtcccaagtg

SEQ ID NO: 75135 - DNA, 75 bp, Artificial Sequence
  Synthetic
ggcattgactgcagcggaaactgggcacacctcgcaagttgtcccaagtgatacaatgcagacccgatgtgtcaa

SEQ ID NO: 75136 - DNA, 75 bp, Artificial Sequence
  Synthetic
gtctcatgtgctgcttgcacggggcttctccgagccaggggattgtggtggaatattaaggtgtgagcatggtgt

SEQ ID NO: 75137 - DNA, 75 bp, Artificial Sequence
  Synthetic
caacacgcaaggggaagatcaatttaacaactggcacataaatacccaccaggttgcacagctcaggcgcaagct

SEQ ID NO: 75138 - DNA, 75 bp, Artificial Sequence
  Synthetic
aacaactggcacataaatacccaccaggttgcacagctcaggcgcaagctggagatgtttacttatgccagattt

SEQ ID NO: 75139 - DNA, 75 bp, Artificial Sequence
  Synthetic
gaaggtgttgttggctttgctgatgtgcgcgaccttctgtggttggaggatgacgcgatggagcagggcgtcaaa

SEQ ID NO: 75140 - DNA, 75 bp, Artificial Sequence
  Synthetic
cgttcggctctggcttcaccaaccagatctgtgagcaggtcaatctcctcaaagagtcactagtggggcaggact

SEQ ID NO: 75141 - DNA, 75 bp, Artificial Sequence
  Synthetic
acccaccaaatcatgtacgtgccaccagggggtccaatacccacgtctgtggatgatttcagctggcaaacatcc

SEQ ID NO: 75142 - DNA, 75 bp, Artificial Sequence
  Synthetic
gatctgtgagcaggtcaatctcctcaaagagtcactagtggggcaggactccattctagagaagtcactcaaggc

SEQ ID NO: 75143 - DNA, 75 bp, Artificial Sequence
  Synthetic
cagggggtccaatacccacgtctgtggatgatttcagctggcaaacatccacgaaccctagcgtgttctggaccg

SEQ ID NO: 75144 - DNA, 75 bp, Artificial Sequence
  Synthetic
ggctctaataggctgtactacatcaccgtggcgctggctcaagcggaaagtgtcccagtactacggaatccccat

SEQ ID NO: 75145 - DNA, 75 bp, Artificial Sequence
  Synthetic
ggtcaaacttttcacaagcaggttcgtatgggttcacaacccttaacaacatggggcagctatactttaggcacg

SEQ ID NO: 75146 - DNA, 75 bp, Artificial Sequence
  Synthetic
ccgtggcgctggctcaagcggaaagtgtcccagtactacggaatccccatggctgaaaggcaaaataacaactgg

SEQ ID NO: 75147 - DNA, 75 bp, Artificial Sequence
  Synthetic
gtatgggttcacaacccttaacaacatggggcagctatactttaggcacgtgaataaaactactgtggggaagta

SEQ ID NO: 75148 - DNA, 75 bp, Artificial Sequence
  Synthetic
gaatggctgaaagtcaaaatactcccggaagtcaaagaaaagcatgaattcttaaacaggctaaagcaactgccc

SEQ ID NO: 75149 - DNA, 75 bp, Artificial Sequence
  Synthetic
gtacgagagtaaggcgagtgtggacttcaagacagagcctgtcactgatatacgggccaccattacgctagctag

SEQ ID NO: 75150 - DNA, 75 bp, Artificial Sequence
  Synthetic
cttaaacaggctaaagcaactgcccttgttggaaagtcaaatagccaccatagaacaaagcgcaccctcacaaag

SEQ ID NO: 75151 - DNA, 75 bp, Artificial Sequence
  Synthetic
ttcaagacagagcctgtcactgatatacgggccaccattacgctagctagagatgaacacctgccagatatgcac

SEQ ID NO: 75152 - DNA, 75 bp, Artificial Sequence
  Synthetic
tgaagcaaaaagggtcttctccttagagaagaaaatgagcaattacatacagttcaagtccaaatgccgtattga

SEQ ID NO: 75153 - DNA, 75 bp, Artificial Sequence
  Synthetic
actcacagtgactggcaggattgcgtatgggaggattacaacagagatcttttagttagcaccactaccgctcat

SEQ ID NO: 75154 - DNA, 75 bp, Artificial Sequence
  Synthetic
tatgggaggattacaacagagatcttttagttagcaccactaccgctcatgggtgtgacaccatagctaggtgcc

SEQ ID NO: 75155 - DNA, 75 bp, Artificial Sequence
  Synthetic
agccctggtgctgggaagtctgtagcgaccaacttgattgggcgttcacttgcagaaaaactaaatagctctgtg

SEQ ID NO: 75156 - DNA, 75 bp, Artificial Sequence
  Synthetic
tggaagtccaggagagtgagtattaccccaagcggtatcaatcccatgtgcttctagcggcgggcttttctgaac

SEQ ID NO: 75157 - DNA, 75 bp, Artificial Sequence
  Synthetic
ccccaagcggtatcaatcccatgtgcttctagcggcgggcttttctgaaccaggggattgtggaggcatactaag

SEQ ID NO: 75158 - DNA, 75 bp, Artificial Sequence
  Synthetic
cagaaccctgatgggaaagatgtgtccctgttttgtcaaatggtatcaagtgttgattttgtcccaccaatggcg

SEQ ID NO: 75159 - DNA, 75 bp, Artificial Sequence
  Synthetic
ccctgttttgtcaaatggtatcaagtgttgattttgtcccaccaatggcggcacttgaggaaaaaggcatcctct

SEQ ID NO: 75160 - DNA, 75 bp, Artificial Sequence
  Synthetic
cctgtggttggaagacgatgcaatggaacagggggtgagagactatgtagaacagcttggaagcgcctttggctc

SEQ ID NO: 75161 - DNA, 75 bp, Artificial Sequence
  Synthetic
gaacagggggtgagagactatgtagaacagcttggaagcgcctttggctcaggtttcaccaaccagatttgtgag

SEQ ID NO: 75162 - DNA, 75 bp, Artificial Sequence
  Synthetic
ttgccagaaggtttcacttcgacatgaacattgaagtcatctcaatgtacagccaaaatggtaaaataaacatgc

SEQ ID NO: 75163 - DNA, 75 bp, Artificial Sequence
  Synthetic
gaacattgaagtcatctcaatgtacagccaaaatggtaaaataaacatgccgatgtcagtaaagacatgtgacga

SEQ ID NO: 75164 - DNA, 75 bp, Artificial Sequence
  Synthetic
ataatatcagccttagtaattgtggtgaggaaccacgatgacctaatcacggtgaccgctacgctagctctcatt

SEQ ID NO: 75165 - DNA, 75 bp, Artificial Sequence
  Synthetic
aacacaagtgagatactcactggacatgcttgtgactgaaatgtttagagaatacaaccacagacacagcgtggg

SEQ ID NO: 75166 - DNA, 75 bp, Artificial Sequence
  Synthetic
atgcttgtgactgaaatgtttagagaatacaaccacagacacagcgtgggagcaacacttgaggcgctcttccag

SEQ ID NO: 75167 - DNA, 75 bp, Artificial Sequence
  Synthetic
ttacggaatacccatggccgaacgccaaaacaatagctggctcaagaaattcactgaaatgactaatgcttgtaa

SEQ ID NO: 75168 - DNA, 75 bp, Artificial Sequence
  Synthetic
ttgagatcggtggatagtgaggcagttagggagtactgcaaagagaagggatggttagtgcctgagataagttcc

SEQ ID NO: 75169 - DNA, 75 bp, Artificial Sequence
  Synthetic
ttagggagtactgcaaagagaagggatggttagtgcctgagataagttccaccctacaaatcgagaaacacgtga

SEQ ID NO: 75170 - DNA, 75 bp, Artificial Sequence
  Synthetic
ctcaaacagctccccctgttagagagtcaaatcgccacaattgagcaaagcgcaccatctcagagtgaccaggag

SEQ ID NO: 75171 - DNA, 75 bp, Artificial Sequence
  Synthetic
tgtttgcaggcttccaaggagcttatactggaatgcccaatcaaaagcccaaagtgccaacttttagacaagcta

SEQ ID NO: 75172 - DNA, 75 bp, Artificial Sequence
  Synthetic
tactggaatgcccaatcaaaagcccaaagtgccaacttttagacaagctaaagtgcagggacccgcctttgagtt

SEQ ID NO: 75173 - DNA, 75 bp, Artificial Sequence
  Synthetic
tgacaggtgggcagtgctaccccggcatgccaaacctggacctaccatcttgatgaacgatcaggaagtgggcgt

SEQ ID NO: 75174 - DNA, 75 bp, Artificial Sequence
  Synthetic
ccccagacccagatcacttcgatggctataaacaacaggccgtagtgatcatggatgatctatgtcagaaccctg

SEQ ID NO: 75175 - DNA, 75 bp, Artificial Sequence
  Synthetic
catgccaaacctggacctaccatcttgatgaacgatcaggaagtgggcgtagtagatgctaaggaactagtagac

SEQ ID NO: 75176 - DNA, 75 bp, Artificial Sequence
  Synthetic
ttggcccgagaagaggccgaggtcaatgaagctgtgctcgccattaacaccagcaaattcccaaacatgtatatt

SEQ ID NO: 75177 - DNA, 75 bp, Artificial Sequence
  Synthetic
agaaaggcattttgttcacttctccgttcgttttggcatcaaccaatgcagggtccataaatgctccaactgtgt

SEQ ID NO: 75178 - DNA, 75 bp, Artificial Sequence
  Synthetic
atgaagctgtgctcgccattaacaccagcaaattcccaaacatgtatattccagttggccaagttacagagtatg

SEQ ID NO: 75179 - DNA, 75 bp, Artificial Sequence
  Synthetic
gtggcgtcctaatgtcaacaggcaaggttcttggaatacacgttggtggaaatggacaccaaggattctcggcat

SEQ ID NO: 75180 - DNA, 75 bp, Artificial Sequence
  Synthetic
ggttcttggaatacacgttggtggaaatggacaccaaggattctcggcatccctattgcggcactacttcaatga

SEQ ID NO: 75181 - DNA, 75 bp, Artificial Sequence
  Synthetic
ctgagatgtttagagaatacaaccacaggcacagtgtcggggccaccctcgaggcactgttccagggtccgccag

SEQ ID NO: 75182 - DNA, 75 bp, Artificial Sequence
  Synthetic
caggcacagtgtcggggccaccctcgaggcactgttccagggtccgccagtatacagagagattaagattagcgt

SEQ ID NO: 75183 - DNA, 75 bp, Artificial Sequence
  Synthetic
aaaacttgagcccagcgtcttccatcacatatttgaggggaataaagagccggcggtgctaaggaatggtgacac

SEQ ID NO: 75184 - DNA, 75 bp, Artificial Sequence
  Synthetic
cacatatttgaggggaataaagagccggcggtgctaaggaatggtgacaccagattaaaggtcaactttgaggag

SEQ ID NO: 75185 - DNA, 75 bp, Artificial Sequence
  Synthetic
ttgtaaagaaaagggatggctggttccagagattacctccaccctgcaaatcgaaaagcacgtcagtagggcctt

SEQ ID NO: 75186 - DNA, 75 bp, Artificial Sequence
  Synthetic
gcagggcaattggcaaccctcgatattagtacagaacccatgagacttgaggatgcagtgtatggcactgaaggc

SEQ ID NO: 75187 - DNA, 75 bp, Artificial Sequence
  Synthetic
ggatgcagtgtatggcactgaaggcctagaggctctagatttaaccacgagcgcggggtatccctatgtcaccct

SEQ ID NO: 75188 - DNA, 75 bp, Artificial Sequence
  Synthetic
cttccaaggagcgtacacaggaatgcccaaccagaagcccaaggtacccactctcagacaagcaagagtgcaagg

SEQ ID NO: 75189 - DNA, 75 bp, Artificial Sequence
  Synthetic
cccaaccagaagcccaaggtacccactctcagacaagcaagagtgcaaggaccagcatttgagtttgctgtagcc

SEQ ID NO: 75190 - DNA, 75 bp, Artificial Sequence
  Synthetic
tggactaaacctccccatggtcacttatgtaaaagatgagctgagatcagcagagaaagtggccaaaggcaaatc

SEQ ID NO: 75191 - DNA, 75 bp, Artificial Sequence
  Synthetic
tatgtaaaagatgagctgagatcagcagagaaagtggccaaaggcaaatccaggctgattgaggcatcgagtcta

SEQ ID NO: 75192 - DNA, 75 bp, Artificial Sequence
  Synthetic
ctggaccaaccattctgatgaatgaccaagaggttggtgtgttagacgccaaggagttagtggataaggacggca

SEQ ID NO: 75193 - DNA, 75 bp, Artificial Sequence
  Synthetic
ggcagtgcagttggttgtgatcccgacttgttctggagcaagatcccggtcatgcttgacggccatctcagagct

SEQ ID NO: 75194 - DNA, 75 bp, Artificial Sequence
  Synthetic
acttgttctggagcaagatcccggtcatgcttgacggccatctcagagcttttgattacagtggatatgatgcca

SEQ ID NO: 75195 - DNA, 75 bp, Artificial Sequence
  Synthetic
acatagattacttgtgcaattcccatcatctatacagagacaaacactactttgtgagagggggtatgccatctg

SEQ ID NO: 75196 - DNA, 75 bp, Artificial Sequence
  Synthetic
tcatctatacagagacaaacactactttgtgagagggggtatgccatctgggtgttctggaactagcatctttaa

SEQ ID NO: 75197 - DNA, 75 bp, Artificial Sequence
  Synthetic
gatgatagcttacggtgatgatgtcattgcgtcatacccactacctattgacgcctcactgctagcagaagctgg

SEQ ID NO: 75198 - DNA, 75 bp, Artificial Sequence
  Synthetic
attgcgtcatacccactacctattgacgcctcactgctagcagaagctggaaaaggctatggcttgattatgaca

SEQ ID NO: 75199 - DNA, 75 bp, Artificial Sequence
  Synthetic
ccaagtgtcttccatcaagtctttgaaggcaataaagagccagcagttctcaggaatggtgatccacgcctcaaa

SEQ ID NO: 75200 - DNA, 75 bp, Artificial Sequence
  Synthetic
aaggcaataaagagccagcagttctcaggaatggtgatccacgcctcaaagttaatttcgaggaagcaatctttt

SEQ ID NO: 75201 - DNA, 75 bp, Artificial Sequence
  Synthetic
gatgagcagtaccctttccttgttcacccagtgatgccaatcaaagatatccatgaatcaatcaggtggactaag

SEQ ID NO: 75202 - DNA, 75 bp, Artificial Sequence
  Synthetic
acccagtgatgccaatcaaagatatccatgaatcaatcaggtggactaaggatcctaaaaacacccaataccacg

SEQ ID NO: 75203 - DNA, 75 bp, Artificial Sequence
  Synthetic
tggccacccttgacatcagcactgagccaatgaagttggaagatgctgtgtacggaactgaaggtctcgaagctc

SEQ ID NO: 75204 - DNA, 75 bp, Artificial Sequence
  Synthetic
ttccagtggggcgctgtttgaccctgcctgcgttctctactctacgcaggaagtggctagacgctttttaaatta

SEQ ID NO: 75205 - DNA, 75 bp, Artificial Sequence
  Synthetic
gacacaatttggtttaattccaattggcttaaccctactgcactcaccgaagtagataacggtgtggtcggggta

SEQ ID NO: 75206 - DNA, 75 bp, Artificial Sequence
  Synthetic
ttaaaacagcctgtgggttgttcccacccacagggcccatggggcgcaagcacactggtattgcggtacctttgt

SEQ ID NO: 75207 - DNA, 75 bp, Artificial Sequence
  Synthetic
acccacagggcccatggggcgcaagcacactggtattgcggtacctttgtgcgcctgttttatccacccttcccc

SEQ ID NO: 75208 - DNA, 75 bp, Artificial Sequence
  Synthetic
tgtttccccggactgagtatcaataggctgcttgcgcggctgaaggagaaaacgttcgttacccggccaattact

SEQ ID NO: 75209 - DNA, 75 bp, Artificial Sequence
  Synthetic
cttgtgtaactcccatcacctgtacagagataagcattactttgtaaggggtggtatgccctcagggtgttctgg

SEQ ID NO: 75210 - DNA, 75 bp, Artificial Sequence
  Synthetic
aacaatgtcataatcaggacactaatgctgaaagtgtacaaggggattgacttagaccaattcaggatgatcgca

SEQ ID NO: 75211 - DNA, 75 bp, Artificial Sequence
  Synthetic
ttacaacaccttgctatacgtcattcatttaaacacgagaaaatgggagcacaagtgtcaacacagaaaactggc

SEQ ID NO: 75212 - DNA, 75 bp, Artificial Sequence
  Synthetic
catttaaacacgagaaaatgggagcacaagtgtcaacacagaaaactggcgcgcacgaggccagcctaagcgcta

SEQ ID NO: 75213 - DNA, 75 bp, Artificial Sequence
  Synthetic
acttcacccaagacccgagcaaatttactgaaccagttaaagacgtgatgattaagtctttgcctgcgcttaact

SEQ ID NO: 75214 - DNA, 75 bp, Artificial Sequence
  Synthetic
tactgaaccagttaaagacgtgatgattaagtctttgcctgcgcttaactcaccctctgcagaggagtgtggata

SEQ ID NO: 75215 - DNA, 75 bp, Artificial Sequence
  Synthetic
ttatggaaggtggcccgcctatttgagagatgatgaagcgactgcagaggaccagccgacacaaccagacgtagc

SEQ ID NO: 75216 - DNA, 75 bp, Artificial Sequence
  Synthetic
agagatgatgaagcgactgcagaggaccagccgacacaaccagacgtagcaacgtgtagattctacaccctagag

SEQ ID NO: 75217 - DNA, 75 bp, Artificial Sequence
  Synthetic
ggtcagaacatgttataccactatttaggaagaacgggttacacaatacacgtacaatgcaatgcgtccaagttc

SEQ ID NO: 75218 - DNA, 75 bp, Artificial Sequence
  Synthetic
taggaagaacgggttacacaatacacgtacaatgcaatgcgtccaagttccaccagggatgcttgctggttgtgt

SEQ ID NO: 75219 - DNA, 75 bp, Artificial Sequence
  Synthetic
ctcccattgaatttgacagaacaagcacaacgccagaagttggagtggtacaaaaggcagtgtacaacgcaggta

SEQ ID NO: 75220 - DNA, 75 bp, Artificial Sequence
  Synthetic
cacaacgccagaagttggagtggtacaaaaggcagtgtacaacgcaggtatgggagttggtgttgggaatttaac

SEQ ID NO: 75221 - DNA, 75 bp, Artificial Sequence
  Synthetic
gcccatggacaatatgtttaggcacaacaacttcacccttatggttatcccgttcgcacctttaaaaagcagtgg

SEQ ID NO: 75222 - DNA, 75 bp, Artificial Sequence
  Synthetic
aacaacttcacccttatggttatcccgttcgcacctttaaaaagcagtggtggaaccaactatgtcccaattaca

SEQ ID NO: 75223 - DNA, 75 bp, Artificial Sequence
  Synthetic
ttgaaagattgttaccatatagctattggattggccatccagtgacaaacagagcgattatatatttgtttgttg

SEQ ID NO: 75224 - DNA, 75 bp, Artificial Sequence
  Synthetic
gttttgttccattaaactgtaaagttttaaacacacttaaatttgtcttactactcaactcagcaaaatgggagc

SEQ ID NO: 75225 - DNA, 75 bp, Artificial Sequence
  Synthetic
tttaaacacacttaaatttgtcttactactcaactcagcaaaatgggagctcaagtatcgacacagaaaaccgga

SEQ ID NO: 75226 - DNA, 75 bp, Artificial Sequence
  Synthetic
ctactcaactcagcaaaatgggagctcaagtatcgacacagaaaaccggagcccacgaaactgggctgaatgcca

SEQ ID NO: 75227 - DNA, 75 bp, Artificial Sequence
  Synthetic
actccaggaagtacgcaatttctcacgtctgatgattttcaatcaccttgcgccatgcctgaatttgacgtgaca

SEQ ID NO: 75228 - DNA, 75 bp, Artificial Sequence
  Synthetic
cgtctgatgattttcaatcaccttgcgccatgcctgaatttgacgtgacaccgtgtatggacatccctggtgaag

SEQ ID NO: 75229 - DNA, 75 bp, Artificial Sequence
  Synthetic
ccgatgcatttcagatcaaggtcactgctggcaatgtgcaggataaaaacgcaatattttctttccagctaaacc

SEQ ID NO: 75230 - DNA, 75 bp, Artificial Sequence
  Synthetic
tgctggcaatgtgcaggataaaaacgcaatattttctttccagctaaacccaggcaatagcaccgtgttgcgccg

SEQ ID NO: 75231 - DNA, 75 bp, Artificial Sequence
  Synthetic
atcagccatggccactggtaagcttttgcttgcatattcaccacctggagcatctgttccgaaatcccgcagaga

SEQ ID NO: 75232 - DNA, 75 bp, Artificial Sequence
  Synthetic
ttgcttgcatattcaccacctggagcatctgttccgaaatcccgcagagatgccatgttagggactcatgtgatt

SEQ ID NO: 75233 - DNA, 75 bp, Artificial Sequence
  Synthetic
ggcacttagcgacatggggctgttcggccagaacatgcagtaccactacctgggtcgcgcagggtacaccataca

SEQ ID NO: 75234 - DNA, 75 bp, Artificial Sequence
  Synthetic
caagatgagtacacgtctgcaggttacatcacatgctggtaccagaccaacatagtagtcccaccagaaacaccg

SEQ ID NO: 75235 - DNA, 75 bp, Artificial Sequence
  Synthetic
tctgactgtgtagtgttgtgttttgtatctgcatgtaacgacttctcagtgcggatgcccaaggatactccattc

SEQ ID NO: 75236 - DNA, 75 bp, Artificial Sequence
  Synthetic
cgcacgaacaacagtgccaccatagtgatgccatacataaatagtgtaccgatggacaatatgtttaggcactac

SEQ ID NO: 75237 - DNA, 75 bp, Artificial Sequence
  Synthetic
atacgcagtgggccttccaattctgaggcaattcccgcgctcacagccgctgaaactggacacacctcacaagta

SEQ ID NO: 75238 - DNA, 75 bp, Artificial Sequence
  Synthetic
gtccgaatccaccatagaaaacttcctgtgtagggcggcttgtgtgcgtatggctaaatatgaggcaaagggcaa

SEQ ID NO: 75239 - DNA, 75 bp, Artificial Sequence
  Synthetic
gatgtttacatacttgcgctttgacgtggaagtcacatttgtaataactagttaccaacatcaagggaccattaa

SEQ ID NO: 75240 - DNA, 75 bp, Artificial Sequence
  Synthetic
aacgtacaagatactaccgaccaaatggaaatgttcaggattccagtgaccattaatgccccattacaacagcag

SEQ ID NO: 75241 - DNA, 75 bp, Artificial Sequence
  Synthetic
caaataatgtacataccacccggcggccccatccctaagaaggtggatggctatgagtggcagacatcaactaac

SEQ ID NO: 75242 - DNA, 75 bp, Artificial Sequence
  Synthetic
cccagcatattttggaccgaagggaatgccccgcctaggatgtccatcccatttattagcattggcaatgcttac

SEQ ID NO: 75243 - DNA, 75 bp, Artificial Sequence
  Synthetic
atgccccgcctaggatgtccatcccatttattagcattggcaatgcttacagcagcttttatgacgggtggtctc

SEQ ID NO: 75244 - DNA, 75 bp, Artificial Sequence
  Synthetic
aggaaacccccgctgaggtcaccagttacatcaggatttacttcaaacccaaacatgtcagggcgtgggtaccaa

SEQ ID NO: 75245 - DNA, 75 bp, Artificial Sequence
  Synthetic
gatgagtacaccagtgcaggttttgtaacatgttggtaccagactggtatgattgtcccaccggggactcccaat

SEQ ID NO: 75246 - DNA, 75 bp, Artificial Sequence
  Synthetic
aaataaagcgaatgtgaactttgacgcaactgcagtcaccgaaacacgggaaactataaacactgtccctgtgtc

SEQ ID NO: 75247 - DNA, 75 bp, Artificial Sequence
  Synthetic
tgtgtatgtagggaattacagattggtgaataggcatcttgcaacacacactgattggcagaactgtgtgtggga

SEQ ID NO: 75248 - DNA, 75 bp, Artificial Sequence
  Synthetic
acgtgaagaattaccatactcgttctgagtccaccgtggaaaactttcttggcagatcagcctgtgtttatatgg

SEQ ID NO: 75249 - DNA, 75 bp, Artificial Sequence
  Synthetic
aaccggcgtgtacttctgtgcatcgaggaacaagcattacccagtcagctttgagggcccaggcctggttgaagt

SEQ ID NO: 75250 - DNA, 75 bp, Artificial Sequence
  Synthetic
gtaaccttcgtgatcacaagtcggcaagatcttggaaccacactagcacaagacatgccagtgctgacgcaccag

SEQ ID NO: 75251 - DNA, 75 bp, Artificial Sequence
  Synthetic
ctgtggtggaattcttaggtgtgagcacggtgtgattggactggtcactatggggggtgagggagtcgttgggtt

SEQ ID NO: 75252 - DNA, 75 bp, Artificial Sequence
  Synthetic
ccattccagccaaagttgacgactacgcttggcaaacctccaccaatcccagcatcttctggacagagggaaacg

SEQ ID NO: 75253 - DNA, 75 bp, Artificial Sequence
  Synthetic
tggtaatgctttcggttctggattcactaaccaaatttgtgaacagatcagcctcttgaaagagtcgttggtggg

SEQ ID NO: 75254 - DNA, 75 bp, Artificial Sequence
  Synthetic
agcatcttctggacagagggaaacgcaccagcacgcatgtcaatcccattcatcagtataggaaatgcatacagc

SEQ ID NO: 75255 - DNA, 75 bp, Artificial Sequence
  Synthetic
actaaccaaatttgtgaacagatcagcctcttgaaagagtcgttggtggggcaggactcaatcttggaaaaatcc

SEQ ID NO: 75256 - DNA, 75 bp, Artificial Sequence
  Synthetic
gccacccttgcactcattggatgcacctcatcaccgtggcgatggctcaaacagaaagtgtcacaatactacggc

SEQ ID NO: 75257 - DNA, 75 bp, Artificial Sequence
  Synthetic
cctcatcaccgtggcgatggctcaaacagaaagtgtcacaatactacggcatacccatggctgagcgtcaaaaca

SEQ ID NO: 75258 - DNA, 75 bp, Artificial Sequence
  Synthetic
aattcatagattggcttaaggttaagattctgccagaagtaaaggagaagcacgaatttctaactagactcaaac

SEQ ID NO: 75259 - DNA, 75 bp, Artificial Sequence
  Synthetic
agctcccccttctggaaagtcaaattgccactatcgaacaaagtgcgccgtctcagagcgaccaggaacagctct

SEQ ID NO: 75260 - DNA, 75 bp, Artificial Sequence
  Synthetic
ctacatacagttcaagtccaaatgccgtattgaacctgtatgcttgcttttgcacggaagccctggagccggaaa

SEQ ID NO: 75261 - DNA, 75 bp, Artificial Sequence
  Synthetic
ggttctcagagccgggagactgtggaggaattcttaggtgtgaacatggtgtgattgggctcgtcaccatggggg

SEQ ID NO: 75262 - DNA, 75 bp, Artificial Sequence
  Synthetic
aggaattcttaggtgtgaacatggtgtgattgggctcgtcaccatggggggcgagggagttgttgggtttgctga

SEQ ID NO: 75263 - DNA, 75 bp, Artificial Sequence
  Synthetic
tccagaccactttgatggttacaaacaacaatccgtcgtgatcatggacgacctttgccaaaatccagatggtaa

SEQ ID NO: 75264 - DNA, 75 bp, Artificial Sequence
  Synthetic
caacaatccgtcgtgatcatggacgacctttgccaaaatccagatggtaaggacgtgtccttgttctgccaaatg

SEQ ID NO: 75265 - DNA, 75 bp, Artificial Sequence
  Synthetic
cgcttttggctcgggattcactaatcaaatctgtgaacaggtcaatctcctcaaggagtcactggtgggccagga

SEQ ID NO: 75266 - DNA, 75 bp, Artificial Sequence
  Synthetic
ctagcatctacaaatgctggctccatcaatgcgccaacagtctcggacagccgggctttagccaggaggttccat

SEQ ID NO: 75267 - DNA, 75 bp, Artificial Sequence
  Synthetic
ttccatcctggagaagtctcttaaagcgttggtaagaatcatttcggcactggtgatcgtggtgagaaaccatga

SEQ ID NO: 75268 - DNA, 75 bp, Artificial Sequence
  Synthetic
tcaatgcgccaacagtctcggacagccgggctttagccaggaggttccattttgacatgaatatagaggtcatct

SEQ ID NO: 75269 - DNA, 75 bp, Artificial Sequence
  Synthetic
gcgttggtaagaatcatttcggcactggtgatcgtggtgagaaaccatgatgacttaataacggtgacggctact

SEQ ID NO: 75270 - DNA, 75 bp, Artificial Sequence
  Synthetic
atttcaaaaagtgctgccctctcgtgtgcggaaaagccatccagttcattgacagaaggactcaagtgaggtact

SEQ ID NO: 75271 - DNA, 75 bp, Artificial Sequence
  Synthetic
atggccgagcgccaaaataacgggtggcttaagaagttcacagagatgaccaacgcctgcaaggggatggagtgg

SEQ ID NO: 75272 - DNA, 75 bp, Artificial Sequence
  Synthetic
gtgcggaaaagccatccagttcattgacagaaggactcaagtgaggtactctttggacatgttggttaccgagat

SEQ ID NO: 75273 - DNA, 75 bp, Artificial Sequence
  Synthetic
attgctataaagatccagaagttcatagagtggctcaaagttaagatcttgccagaggttagagaaaaacacgag

SEQ ID NO: 75274 - DNA, 75 bp, Artificial Sequence
  Synthetic
ggaaatcaaaattagtgtcgcacctgaaaccccaccgccaccagcaatcgcggacttgctgaaatcagtagacaa

SEQ ID NO: 75275 - DNA, 75 bp, Artificial Sequence
  Synthetic
agtgaccaagaacaacttttctcaaatgtccagtactttgcacactactgtagaaaatatgcccccctgtatgct

SEQ ID NO: 75276 - DNA, 75 bp, Artificial Sequence
  Synthetic
gagaaggggtggcttgttcctgagatcaactccactcttcagatcgagaaacatgtcagccgagcctttatctgt

SEQ ID NO: 75277 - DNA, 75 bp, Artificial Sequence
  Synthetic
gctgaggcaaaaagggtgttctcccttgagaagaaaatgagcaattacatacagttcaagtccaaatgccgtatt

SEQ ID NO: 75278 - DNA, 75 bp, Artificial Sequence
  Synthetic
tgctactaacctgatcgggcggtcattggctgagaagctcaacagttcagtgtactccttaccgcctgatccaga

SEQ ID NO: 75279 - DNA, 75 bp, Artificial Sequence
  Synthetic
taccacgccacgctaaacccgggccaaccatcctcatgaatgaccaggaagttggcgtgctggatgcaaaagaac

SEQ ID NO: 75280 - DNA, 75 bp, Artificial Sequence
  Synthetic
atccctgttctgccaaatggtttccagcgtggactttgtaccaccaatggccgcactcgaagagaaggggattct

SEQ ID NO: 75281 - DNA, 75 bp, Artificial Sequence
  Synthetic
atgaatatagaagtcatttcaatgtatagtcagaatggcaaaatcaatatgcccatgtctgtaaaagcatgcgat

SEQ ID NO: 75282 - DNA, 75 bp, Artificial Sequence
  Synthetic
atagtcagaatggcaaaatcaatatgcccatgtctgtaaaagcatgcgatgatgagtgttgcccatccaatttta

SEQ ID NO: 75283 - DNA, 75 bp, Artificial Sequence
  Synthetic
agactatggtttcctgaacctgggtggcacccccacgaagagaatgcttatgtacaacttccctaccagagctgg

SEQ ID NO: 75284 - DNA, 75 bp, Artificial Sequence
  Synthetic
ctcagcagctctccttaaacattatttcaatgatgaacaaggcgagattgaattcattgaaagctcaaaggaggc

SEQ ID NO: 75285 - DNA, 75 bp, Artificial Sequence
  Synthetic
aaggcccgccagtatatagagaaatcaaaatcagtgttgcgcctgagactccaccgccaccagcaatcgcagatc

SEQ ID NO: 75286 - DNA, 75 bp, Artificial Sequence
  Synthetic
agcagaacaaaattggaaccaagcgtgttccaccaggtgtttgagggcaacaaggaaccggcagtcctcagaaat

SEQ ID NO: 75287 - DNA, 75 bp, Artificial Sequence
  Synthetic
cagaagggttggaagcgcttgacctgaccaccagtgcaggatacccatacgtcgcgttaggcatcaagaagagag

SEQ ID NO: 75288 - DNA, 75 bp, Artificial Sequence
  Synthetic
tggtgacctacgtgaaggatgagctcagatcagcagaaaaagtggctaaagggaagtctaggcttattgaagcat

SEQ ID NO: 75289 - DNA, 75 bp, Artificial Sequence
  Synthetic
catcatgaatgaccaagaggttggtgtgctggatgcaaaagagctggtggacaaagatggcacaaatcttgaact

SEQ ID NO: 75290 - DNA, 75 bp, Artificial Sequence
  Synthetic
cagatcagcagaaaaagtggctaaagggaagtctaggcttattgaagcatccagcttgaatgattctgttgcaat

SEQ ID NO: 75291 - DNA, 75 bp, Artificial Sequence
  Synthetic
tgaccccgatctgttctggagcaaaatacctgtaatgctagatggacatcttatagcctttgactactccggata

SEQ ID NO: 75292 - DNA, 75 bp, Artificial Sequence
  Synthetic
atacctgtaatgctagatggacatcttatagcctttgactactccggatatgacgctagcctgagccccgtgtgg

SEQ ID NO: 75293 - DNA, 75 bp, Artificial Sequence
  Synthetic
cggttttctgaatttgggtggtacccctacaaagagaatgcttatgtataactttcccactagggcaggtcagtg

SEQ ID NO: 75294 - DNA, 75 bp, Artificial Sequence
  Synthetic
actttcccactagggcaggtcagtgtggtggtgtcctcatgtccaccggcaaggtgttgggaatacacgttggtg

SEQ ID NO: 75295 - DNA, 75 bp, Artificial Sequence
  Synthetic
aactcccaccacctgtacagggataaacactactttgtgcgcggtggcatgccctcaggatgttctggtaccagt

SEQ ID NO: 75296 - DNA, 75 bp, Artificial Sequence
  Synthetic
gccctcaggatgttctggtaccagtatcttcaactcaatgattaacaacatcataatcaggacattaatgttgaa

SEQ ID NO: 75297 - DNA, 75 bp, Artificial Sequence
  Synthetic
ttgaaaactcaagggatgcgggattcccagtcattaacacaccaagtaaaaccaaattggaaccgagtgtcttcc

SEQ ID NO: 75298 - DNA, 75 bp, Artificial Sequence
  Synthetic
gccaattgacgcctctctgttagccgaagctggcaagggatatgggctgattatgacgcctgcggataaagggga

SEQ ID NO: 75299 - DNA, 75 bp, Artificial Sequence
  Synthetic
gaagctggcaagggatatgggctgattatgacgcctgcggataaaggggaatgtttcaacgaagtcacctgggct

SEQ ID NO: 75300 - DNA, 75 bp, Artificial Sequence
  Synthetic
aaatgtcaatacacatgtagatgagtacatgatggaagctgtggaccactatgcagggcagttagccacgctgga

SEQ ID NO: 75301 - DNA, 75 bp, Artificial Sequence
  Synthetic
tacatgatggaagctgtggaccactatgcagggcagttagccacgctggatatcagcacggaacctatgaagtta

SEQ ID NO: 75302 - DNA, 75 bp, Artificial Sequence
  Synthetic
aaggacatccatgaatctatcaggtggacgaaagatccaaagaacacccaagatcatgtgcgatccttgtgccaa

SEQ ID NO: 75303 - DNA, 75 bp, Artificial Sequence
  Synthetic
ttgggcatcaagaagagagacatactgtccaagaagaccaaagatttgactaaactgaaggagtgcatggacaaa

SEQ ID NO: 75304 - DNA, 75 bp, Artificial Sequence
  Synthetic
ttggcttggcacaatggagagcacgaatacgaagagtttgtccgaaagattagaagcatcccagttgggcgctgt

SEQ ID NO: 75305 - DNA, 75 bp, Artificial Sequence
  Synthetic
tgtccaagaagaccaaagatttgactaaactgaaggagtgcatggacaaatatggattgaacttaccaatggtga

SEQ ID NO: 75306 - DNA, 75 bp, Artificial Sequence
  Synthetic
tgaatgattctgtcgcaatgagacaaacatttggtaacctatacaagacatttcaccagaaccccgggattgtga

SEQ ID NO: 75307 - DNA, 75 bp, Artificial Sequence
  Synthetic
gtaatgctggatggacatctcatagcctttgactactctggatatgatgccagcctgagccctgtgtggtttgcc

SEQ ID NO: 75308 - DNA, 75 bp, Artificial Sequence
  Synthetic
gcgcctgttttattcaccctttcccaatgaaacttagaagcttaactcaaccggtcgatagacagcccagtacac

SEQ ID NO: 75309 - DNA, 75 bp, Artificial Sequence
  Synthetic
aggatgattgcatatggtgacgatgtgattgcatcctacccctggccgattgatgcatctttgcttgctgaggcg

SEQ ID NO: 75310 - DNA, 75 bp, Artificial Sequence
  Synthetic
acctttctgaaaagatacttcagagcagatgagcaataccccttcctagtccatccggtcatgcccatgaaggac

SEQ ID NO: 75311 - DNA, 75 bp, Artificial Sequence
  Synthetic
cagatgagcaataccccttcctagtccatccggtcatgcccatgaaggacattcatgaatccattaggtggacaa

SEQ ID NO: 75312 - DNA, 75 bp, Artificial Sequence
  Synthetic
ttgaaagattgttgccatatagctattggattggccatccggtgtctaatagagcaattatatatctctttgttg

SEQ ID NO: 75313 - DNA, 75 bp, Artificial Sequence
  Synthetic
aggagttcattaaaaagatcagaagtgtcccagtgggacgctgtttaactttacctgcgttctcaaccctgcgca

SEQ ID NO: 75314 - DNA, 75 bp, Artificial Sequence
  Synthetic
tcaagtgtcgacacaaaagaccggggcacatgagactagtttgaatgccagtggaagctcagttatacattacac

SEQ ID NO: 75315 - DNA, 75 bp, Artificial Sequence
  Synthetic
ggaaatggttagactccttttgaattagagccaattcgatttaattcaattggcttaaccctaccgcactcaccg

SEQ ID NO: 75316 - DNA, 75 bp, Artificial Sequence
  Synthetic
gcacatgagactagtttgaatgccagtggaagctcagttatacattacaccaacataaacttttacaaagatgct

SEQ ID NO: 75317 - DNA, 75 bp, Artificial Sequence
  Synthetic
gtaaaatccctccctgcgcttaactccccctctgctgaagaatgtggatacagcgacagggtgagaacactcaca

SEQ ID NO: 75318 - DNA, 75 bp, Artificial Sequence
  Synthetic
ccccctctgctgaagaatgtggatacagcgacagggtgagaacactcacattggggaactccaccatcaccaccc

SEQ ID NO: 75319 - DNA, 75 bp, Artificial Sequence
  Synthetic
atcagcccacccagccagacgttgcgacatgcaggttttacacactagattctgtgaattgggaaaaacagtcgc

SEQ ID NO: 75320 - DNA, 75 bp, Artificial Sequence
  Synthetic
gacatgcaggttttacacactagattctgtgaattgggaaaaacagtcgccaggatggtggtggaagttcccgga

SEQ ID NO: 75321 - DNA, 75 bp, Artificial Sequence
  Synthetic
cgttcaatgtaacgcatctcgctttcaccaggggtgcttacttgtggcatgtgtgcccgaagcagagatgggaag

SEQ ID NO: 75322 - DNA, 75 bp, Artificial Sequence
  Synthetic
caccaggggtgcttacttgtggcatgtgtgcccgaagcagagatgggaagctccatacctgggacagcattcact

SEQ ID NO: 75323 - DNA, 75 bp, Artificial Sequence
  Synthetic
cagacagctgtttgtaacgctggaatgggagtgggcgtaggtaatctaacgatatttccacaccagtggatcaac

SEQ ID NO: 75324 - DNA, 75 bp, Artificial Sequence
  Synthetic
tgggagtgggcgtaggtaatctaacgatatttccacaccagtggatcaacttgaggacgaacaactgtgcaacca

SEQ ID NO: 75325 - DNA, 75 bp, Artificial Sequence
  Synthetic
cttttgtggaattggactatgcaggagggaccacctacgttccaatcactgtgactgtggccccaatgtgtgcag

SEQ ID NO: 75326 - DNA, 75 bp, Artificial Sequence
  Synthetic
agggaccacctacgttccaatcactgtgactgtggccccaatgtgtgcagaatataatggtttaagactttcagc

SEQ ID NO: 75327 - DNA, 75 bp, Artificial Sequence
  Synthetic
ttgcgcaatgcctgaatacgatgtgacacccgccctccgtatccctggagaagtttccaacttgatggaaatagc

SEQ ID NO: 75328 - DNA, 75 bp, Artificial Sequence
  Synthetic
acacccgccctccgtatccctggagaagtttccaacttgatggaaatagcagaggtggactcagttgttccagtg

SEQ ID NO: 75329 - DNA, 75 bp, Artificial Sequence
  Synthetic
actgcaatcttcacattccaactggacccaggcagaagctcggttttaaagagaaccttgttgggggagatcctc

SEQ ID NO: 75330 - DNA, 75 bp, Artificial Sequence
  Synthetic
acccaggcagaagctcggttttaaagagaaccttgttgggggagatcctcaactactacgcccactggtctggca

SEQ ID NO: 75331 - DNA, 75 bp, Artificial Sequence
  Synthetic
gggcaggggtgccaaagaaccgaaaggaggcgatgttgggcacgcatgtgatatgggacatcgggttgcagtcta

SEQ ID NO: 75332 - DNA, 75 bp, Artificial Sequence
  Synthetic
ggaggcgatgttgggcacgcatgtgatatgggacatcgggttgcagtctagttgtgtgttgtgtgtgccatggat

SEQ ID NO: 75333 - DNA, 75 bp, Artificial Sequence
  Synthetic
aaacatcatcgtaccgccgagcacccccacaagttgtaaggtcttgtgttttgtgtctgcatgcaatgacttctc

SEQ ID NO: 75334 - DNA, 75 bp, Artificial Sequence
  Synthetic
cccacaagttgtaaggtcttgtgttttgtgtctgcatgcaatgacttctcagtacgcatgttgcgtgacacgcca

SEQ ID NO: 75335 - DNA, 75 bp, Artificial Sequence
  Synthetic
aacacacaaaggagcggaccagcaaatacggagcgtgtgcctgcgttgacagcagctgagacaggtcacacctca

SEQ ID NO: 75336 - DNA, 75 bp, Artificial Sequence
  Synthetic
atacggagcgtgtgcctgcgttgacagcagctgagacaggtcacacctcacaagtggaaccaagcgacaccatac

SEQ ID NO: 75337 - DNA, 75 bp, Artificial Sequence
  Synthetic
tttacctcggggaataccgggccacaggggtggaagaaggggacacggagcagtttgcagtgtggaacataagcg

SEQ ID NO: 75338 - DNA, 75 bp, Artificial Sequence
  Synthetic
aggggtggaagaaggggacacggagcagtttgcagtgtggaacataagcgtgaaagacatggttcaaatgcgtag

SEQ ID NO: 75339 - DNA, 75 bp, Artificial Sequence
  Synthetic
caccggctcaacaagtgacacccccatcacccatcaagtaatgtacgtaccacctggcggccctattcctaggaa

SEQ ID NO: 75340 - DNA, 75 bp, Artificial Sequence
  Synthetic
atcacccatcaagtaatgtacgtaccacctggcggccctattcctaggaaagtggacagctatgcctggcaaact

SEQ ID NO: 75341 - DNA, 75 bp, Artificial Sequence
  Synthetic
aatgcttatagcatgttctacgatgggtggtccagctttgagtccaagggtctgtatggttattcaaatcttaat

SEQ ID NO: 75342 - DNA, 75 bp, Artificial Sequence
  Synthetic
ggtggtccagctttgagtccaagggtctgtatggttattcaaatcttaatcacatgggtaaattgtacatcaggc

SEQ ID NO: 75343 - DNA, 75 bp, Artificial Sequence
  Synthetic
tccctaggccacctaggttgtgccagtacaagaggaaggccaccgtggattttgacgtgactccagtcacgtcac

SEQ ID NO: 75344 - DNA, 75 bp, Artificial Sequence
  Synthetic
gtacaagaggaaggccaccgtggattttgacgtgactccagtcacgtcacacagacccgacattaacaacgtgtc

SEQ ID NO: 75345 - DNA, 75 bp, Artificial Sequence
  Synthetic
acaccttgccacacacaacgactggcagaactgtgtgtgggaagactacaatagggatctacttgtgagcaccac

SEQ ID NO: 75346 - DNA, 75 bp, Artificial Sequence
  Synthetic
cagaactgtgtgtgggaagactacaatagggatctacttgtgagcaccaccacagcccatgggtgcgatatcatc

SEQ ID NO: 75347 - DNA, 75 bp, Artificial Sequence
  Synthetic
cctggtcttgtggaggtccaagcgagtgagtattaccctaaaagataccagtcccacgtactacttgcagcaggg

SEQ ID NO: 75348 - DNA, 75 bp, Artificial Sequence
  Synthetic
gtgagtattaccctaaaagataccagtcccacgtactacttgcagcagggttctccgagcctggggattgcggtg

SEQ ID NO: 75349 - DNA, 75 bp, Artificial Sequence
  Synthetic
tgcgcgaccttttgtggttggaggatgatgccatggagcaaggggtcagggattatgttgaacaacttggtaatg

SEQ ID NO: 75350 - DNA, 75 bp, Artificial Sequence
  Synthetic
tgatgccatggagcaaggggtcagggattatgttgaacaacttggtaatgccttcggttctgggttcactaacca

SEQ ID NO: 75351 - DNA, 75 bp, Artificial Sequence
  Synthetic
cctggttaaaattatctcagctctggtgatcgtggtgaggaaccatgatgacctgataacggtaaccgccactct

SEQ ID NO: 75352 - DNA, 75 bp, Artificial Sequence
  Synthetic
gtgatcgtggtgaggaaccatgatgacctgataacggtaaccgccactctggctctcattggttgtgcctcatcg

SEQ ID NO: 75353 - DNA, 75 bp, Artificial Sequence
  Synthetic
ctcaagaaatttacagaaatgaccaatgcctgtaaagggatggagtggatcgccattaaaattcagaaattcata

SEQ ID NO: 75354 - DNA, 75 bp, Artificial Sequence
  Synthetic
ttattagagagccagattgccaccattgagcagagtgcgccatctcaaagcgatcaagaacagcttttctcaaat

SEQ ID NO: 75355 - DNA, 75 bp, Artificial Sequence
  Synthetic
ttgagcagagtgcgccatctcaaagcgatcaagaacagcttttctcaaatgtccagtacttcgcacattattgca

SEQ ID NO: 75356 - DNA, 75 bp, Artificial Sequence
  Synthetic
agctgaaaagctcaacagttcagtgtattccttgccacctgacccggatcacttcgatggttacaaacaacaagc

SEQ ID NO: 75357 - DNA, 75 bp, Artificial Sequence
  Synthetic
caaaatccagacggcaaggatgtatccctgttctgccaaatggtttccagtgtggactttgtaccaccaatggcc

SEQ ID NO: 75358 - DNA, 75 bp, Artificial Sequence
  Synthetic
tgtggactttgtaccaccaatggccgcactcgaggagaaggggattcttttcacctccccttttgttctagcatc

SEQ ID NO: 75359 - DNA, 75 bp, Artificial Sequence
  Synthetic
tcacctccccttttgttctagcatccacgaatgctggctccattaacgcaccaacagtttcggacagccgagctt

SEQ ID NO: 75360 - DNA, 75 bp, Artificial Sequence
  Synthetic
agtacaaccatagacacagtgtaggggcaacccttgaggcacttttccaaggtccgccagtatatagagagatca

SEQ ID NO: 75361 - DNA, 75 bp, Artificial Sequence
  Synthetic
ggtccgccagtatatagagagatcaagattagtgttgcacctgaaaccccaccgccactggcaatcgcagatctg

SEQ ID NO: 75362 - DNA, 75 bp, Artificial Sequence
  Synthetic
actattcagattgagaagcatgttagcagggcattcatatgcctccaagcgctaacaacctttgtctctgtggcc

SEQ ID NO: 75363 - DNA, 75 bp, Artificial Sequence
  Synthetic
aaggtaccgacattgaggcaagcaaaagtgcagggtcctgcctttgagtttgcggtggccatgatgaagaggaac

SEQ ID NO: 75364 - DNA, 75 bp, Artificial Sequence
  Synthetic
aagtgcagggtcctgcctttgagtttgcggtggccatgatgaagaggaactccagtacggtgaaaacagagtatg

SEQ ID NO: 75365 - DNA, 75 bp, Artificial Sequence
  Synthetic
tcatgaatgaccaagaggttggtgtgttggacgcaaaggagctggtggacaaagaaggcacaaatcttgaattaa

SEQ ID NO: 75366 - DNA, 75 bp, Artificial Sequence
  Synthetic
cttgccaaagaagaggtggaggctaaagaagctgtcctggcaataaatactagcaaattcccaaacatgtacatc

SEQ ID NO: 75367 - DNA, 75 bp, Artificial Sequence
  Synthetic
ttccccaccagagctggccaatgtggtggcgttctcatgtccacgggcaaagtgttagggatacatgttggggga

SEQ ID NO: 75368 - DNA, 75 bp, Artificial Sequence
  Synthetic
gaaagctcgaaggatgctggattcccagtcattaacacaccaagtaggacgagattggaaccaagcgtcttccat

SEQ ID NO: 75369 - DNA, 75 bp, Artificial Sequence
  Synthetic
cagtcattaacacaccaagtaggacgagattggaaccaagcgtcttccatcaagtgtttgaaggcaacaaggaac

SEQ ID NO: 75370 - DNA, 75 bp, Artificial Sequence
  Synthetic
atgtgaacacacatgtagatgagtacatgatggaagccgtggatcattacgcaggacaactggccactcttgata

SEQ ID NO: 75371 - DNA, 75 bp, Artificial Sequence
  Synthetic
catgatggaagccgtggatcattacgcaggacaactggccactcttgatatcaacacggagcctatgagattaga

SEQ ID NO: 75372 - DNA, 75 bp, Artificial Sequence
  Synthetic
ttccccacgcgcgcaggacagtgcggcggcgtcttgatgtcaacaggcaaagtccttggaatacacgttggtggc

SEQ ID NO: 75373 - DNA, 75 bp, Artificial Sequence
  Synthetic
gggcatcaagaagagagacattttatccaagaagaccagagatctgaccaaattaaaggagtgcatggacaagta

SEQ ID NO: 75374 - DNA, 75 bp, Artificial Sequence
  Synthetic
tccaagaagaccagagatctgaccaaattaaaggagtgcatggacaagtatggactaaacctcccaatggtgacc

SEQ ID NO: 75375 - DNA, 75 bp, Artificial Sequence
  Synthetic
aacgattctgttgcgatgagacaaacttttggaaatctatacaaagcattccatttgaatccggggattgtaact

SEQ ID NO: 75376 - DNA, 75 bp, Artificial Sequence
  Synthetic
cttttggaaatctatacaaagcattccatttgaatccggggattgtaactggcagcgcagtcgggtgtgatccag

SEQ ID NO: 75377 - DNA, 75 bp, Artificial Sequence
  Synthetic
gtttgagccccgtgtggtttgcttgtttgaagctactactggaaaaacttgggtattcacacaaagaaacaaatt

SEQ ID NO: 75378 - DNA, 75 bp, Artificial Sequence
  Synthetic
tttgaagctactactggaaaaacttgggtattcacacaaagaaacaaattacattgactacttgtgcaactccca

SEQ ID NO: 75379 - DNA, 75 bp, Artificial Sequence
  Synthetic
ttcaatgatcaataacatcataatcaggacgctaatgctgaaggtgtataagggtattgacctggatcagttcag

SEQ ID NO: 75380 - DNA, 75 bp, Artificial Sequence
  Synthetic
attgcatcctacccctggccaatcgatgcctctttgcttgctgaggccggtaaggggtacgggctgatcatgaca

SEQ ID NO: 75381 - DNA, 75 bp, Artificial Sequence
  Synthetic
tgcgctccttgtgcctattggcctggcacaatggggaacacgagtatgaggaattcatcaaaaggatcagaagcg

SEQ ID NO: 75382 - DNA, 75 bp, Artificial Sequence
  Synthetic
acccatagggcccactgggcgctagcacactggtattgtggtacctttgtgcgcctgttttatctacccctcccc

SEQ ID NO: 75383 - DNA, 75 bp, Artificial Sequence
  Synthetic
tattaaagactatcaacttgatcatactacttaatacagcaaaatgggagctcatgtgtcaacgcagaaaaccgg

SEQ ID NO: 75384 - DNA, 75 bp, Artificial Sequence
  Synthetic
actacttaatacagcaaaatgggagctcatgtgtcaacgcagaaaaccggagcgcatgagactggtttgagcgcc

SEQ ID NO: 75385 - DNA, 75 bp, Artificial Sequence
  Synthetic
acttttcacaagaccccagcaaatttaccgaaccctatgaaggatgtcatgattaaatcactcccggcgttaaat

SEQ ID NO: 75386 - DNA, 75 bp, Artificial Sequence
  Synthetic
taccgaaccctatgaaggatgtcatgattaaatcactcccggcgttaaattcacccactgtggaggaatgtggct

SEQ ID NO: 75387 - DNA, 75 bp, Artificial Sequence
  Synthetic
gctatggtgtctggccggagtatttgagggatgaggaagccacggcacaagaccaacccactcaaccagatgttg

SEQ ID NO: 75388 - DNA, 75 bp, Artificial Sequence
  Synthetic
gcgggctggtggtggaagtttccagatgctcttgcagagatgggcctattcggtcaaaatatgctataccattat

SEQ ID NO: 75389 - DNA, 75 bp, Artificial Sequence
  Synthetic
tgtgtgccagaagccgagatgggttctgcacagcttgataggacattgaatcataccaaacttagcaacacagaa

SEQ ID NO: 75390 - DNA, 75 bp, Artificial Sequence
  Synthetic
ctgcacagcttgataggacattgaatcataccaaacttagcaacacagaacacgccagcacattcgggtccatga

SEQ ID NO: 75391 - DNA, 75 bp, Artificial Sequence
  Synthetic
tctaccctcatcagtggattaatcttagaaccaacaattgtgccaccatagtaatgccgtacataaacagtgtgc

SEQ ID NO: 75392 - DNA, 75 bp, Artificial Sequence
  Synthetic
gtaatgccgtacataaacagtgtgccaatggataatatgtttaggcattacaatttcacccttatggtgattcca

SEQ ID NO: 75393 - DNA, 75 bp, Artificial Sequence
  Synthetic
gtaaacagggcttaccaacaatgctcactccaggtagcaaccagttcctcacgtctgatgatttccagtccccat

SEQ ID NO: 75394 - DNA, 75 bp, Artificial Sequence
  Synthetic
aagttgattctgtggtcccagtgaataatctggatgataaggtaaattcaattgaagcttatacaatccccgtca

SEQ ID NO: 75395 - DNA, 75 bp, Artificial Sequence
  Synthetic
taatctggatgataaggtaaattcaattgaagcttatacaatccccgtcaaatcaatgagtggtattgcgacaca

SEQ ID NO: 75396 - DNA, 75 bp, Artificial Sequence
  Synthetic
ctttgcaaattggtcgggaattatcaaactgacattcccatactgcggtgcggcgatgaccactggcacattcct

SEQ ID NO: 75397 - DNA, 75 bp, Artificial Sequence
  Synthetic
ggcttccctgctaaccgcaaggactcaatgttgggcactcacattgtctgggacataggattgcaatcgagttgt

SEQ ID NO: 75398 - DNA, 75 bp, Artificial Sequence
  Synthetic
agacagtacaatcctatgttttgtttcagcttgtaatgatttctcggtgcgcttgttaagggacacgccattcat

SEQ ID NO: 75399 - DNA, 75 bp, Artificial Sequence
  Synthetic
agacgggtcacacatctcaagttgttcccagtgatactatgcaaaccaggcatgttgttaaccatcacattagat

SEQ ID NO: 75400 - DNA, 75 bp, Artificial Sequence
  Synthetic
tcccagtgatactatgcaaaccaggcatgttgttaaccatcacattagatcggaatcttcaatagagaattttct

SEQ ID NO: 75401 - DNA, 75 bp, Artificial Sequence
  Synthetic
gaagatcaacacacgccaggttgttcagctgaggcgcaagctggagatgttcacttacatcagatttgatgtgga

SEQ ID NO: 75402 - DNA, 75 bp, Artificial Sequence
  Synthetic
caagggacatcaacccaaacaagcactggcaccccagtgctcacacatcaagtgatgtatgtgccacccggaggc

SEQ ID NO: 75403 - DNA, 75 bp, Artificial Sequence
  Synthetic
gcaccggctcgcatgtcaataccctttatgagtgtgggcaatgcctattgcaacttttatgatggctggtcacat

SEQ ID NO: 75404 - DNA, 75 bp, Artificial Sequence
  Synthetic
gacacacttggcccttacaacagcacagtgcgtgtctatttcaaaccaaagcacatcaaagcatgggtgcccaga

SEQ ID NO: 75405 - DNA, 75 bp, Artificial Sequence
  Synthetic
cagtgcgtgtctatttcaaaccaaagcacatcaaagcatgggtgcccagaccaccgcgtctatgcgattatgtgt

SEQ ID NO: 75406 - DNA, 75 bp, Artificial Sequence
  Synthetic
acacgccttcgatggtaaaccacggtgcttttggacagcagtctggcgccatttacgtgggtaactacagagtgg

SEQ ID NO: 75407 - DNA, 75 bp, Artificial Sequence
  Synthetic
tgcttttggacagcagtctggcgccatttacgtgggtaactacagagtggtaaataggcacctggccacctatgc

SEQ ID NO: 75408 - DNA, 75 bp, Artificial Sequence
  Synthetic
caccatcgctaggtgtcaatgctgcacgggtgtctacttttgtgcctcaaggaacaagcactacccagttagctt

SEQ ID NO: 75409 - DNA, 75 bp, Artificial Sequence
  Synthetic
acgggtgtctacttttgtgcctcaaggaacaagcactacccagttagctttgaagggccaggcctagtggaagtt

SEQ ID NO: 75410 - DNA, 75 bp, Artificial Sequence
  Synthetic
tgtggtggaattctcaggtgcgagcatggtgttatcggactagttaccatgggtggcgaaggcgtagtcggcttt

SEQ ID NO: 75411 - DNA, 75 bp, Artificial Sequence
  Synthetic
atggtgttatcggactagttaccatgggtggcgaaggcgtagtcggctttgctgatgtgcgcgacctgctgtggt

SEQ ID NO: 75412 - DNA, 75 bp, Artificial Sequence
  Synthetic
ccaatcaaatctgcgaacaagtcaacctcctcaaagaatcactagtgggccaagattccatactagagaagtccc

SEQ ID NO: 75413 - DNA, 75 bp, Artificial Sequence
  Synthetic
cctcctcaaagaatcactagtgggccaagattccatactagagaagtcccttaaagctcttgtgaaaatcatttc

SEQ ID NO: 75414 - DNA, 75 bp, Artificial Sequence
  Synthetic
ctcatcgccgtggcggtggcttaaacagaaggtgtcacagtattacgggatacccatggctgagcgacaaaacaa

SEQ ID NO: 75415 - DNA, 75 bp, Artificial Sequence
  Synthetic
tacccatggctgagcgacaaaacaacgggtggctcaaaaagtttacagagatgaccaatgcctgcaaagggatgg

SEQ ID NO: 75416 - DNA, 75 bp, Artificial Sequence
  Synthetic
atgagttcctaaccagacttaaacaactcccccttctggaaagccaaattgccaccattgaacaaagtgcaccgt

SEQ ID NO: 75417 - DNA, 75 bp, Artificial Sequence
  Synthetic
ttcagtgtattctctaccaccagaccctgaccacttcgatggctataaacaacaagccgttgtgattatggacga

SEQ ID NO: 75418 - DNA, 75 bp, Artificial Sequence
  Synthetic
tgtcgagtgttgactttgtcccaccaatggctgccttggaagaaaaaggaattttgtttacctctccctttgtct

SEQ ID NO: 75419 - DNA, 75 bp, Artificial Sequence
  Synthetic
aatgtacagccagaatggcaagattaacatgcccatgtcagtcaaaacatgcgacgaagagtgctgtccagttaa

SEQ ID NO: 75420 - DNA, 75 bp, Artificial Sequence
  Synthetic
tttagggagtacaaccataggcacagcgtcggggcaacccttgaggcactatttcaaggtccaccagtatacagg

SEQ ID NO: 75421 - DNA, 75 bp, Artificial Sequence
  Synthetic
gaagcagttagggagtactgtaaagagaatggatggctcgttcctgaaattagctctacccttcatattgaaaaa

SEQ ID NO: 75422 - DNA, 75 bp, Artificial Sequence
  Synthetic
agaatggatggctcgttcctgaaattagctctacccttcatattgaaaaacatgtaagccgagcctttatctgtc

SEQ ID NO: 75423 - DNA, 75 bp, Artificial Sequence
  Synthetic
gcgcctacacagggatgcccaaccaaaagccaaaaatacccacactaaggcaagccaaggtgcagggacctgctt

SEQ ID NO: 75424 - DNA, 75 bp, Artificial Sequence
  Synthetic
gcatctacgacaggtgggccgtactaccacgccatgcaaaacccgggccaaccatccttatgaatgaccaggaag

SEQ ID NO: 75425 - DNA, 75 bp, Artificial Sequence
  Synthetic
gaggtcaatgaagctgttctagcaataaacaccagcaagttcccgaacatgtacataccagttgggcaagtaaca

SEQ ID NO: 75426 - DNA, 75 bp, Artificial Sequence
  Synthetic
taaacaccagcaagttcccgaacatgtacataccagttgggcaagtaacagactacggtttcctgaacctggggg

SEQ ID NO: 75427 - DNA, 75 bp, Artificial Sequence
  Synthetic
cagccgtgtctcgatcaagcacttctgttttcccggactgagtatcaatagactgctcacgcggttgaaggagaa

SEQ ID NO: 75428 - DNA, 75 bp, Artificial Sequence
  Synthetic
tggtggaaatggccaccagggcttctcagcagctctccttaaacactacttcaatgatgaacaaggtgagattga

SEQ ID NO: 75429 - DNA, 75 bp, Artificial Sequence
  Synthetic
cttccaccaagtgtttgaaggcaacaaggaacctgcagttctcaggaatggtgatccacgactcaaagcaaattt

SEQ ID NO: 75430 - DNA, 75 bp, Artificial Sequence
  Synthetic
ccggcccctgaatgcggctaatcctaactgcggagcatgtgccctcaatccagagggtagcgtgtcgtaacgggc

SEQ ID NO: 75431 - DNA, 75 bp, Artificial Sequence
  Synthetic
tcactacgcaggacaattggccacactggacattaatacggaacctatgaaattggaggatgcagtgtatggcac

SEQ ID NO: 75432 - DNA, 75 bp, Artificial Sequence
  Synthetic
atacttaataccacaaaatgggagcacaggtgtcgacccaaaagactggagctcacgaaaccggtttgactgcca

SEQ ID NO: 75433 - DNA, 75 bp, Artificial Sequence
  Synthetic
acaaatatggtctaaaccttccgatggtgacctatgtgaaggatgagctcagatcagcagaaaaagtggctaaag

SEQ ID NO: 75434 - DNA, 75 bp, Artificial Sequence
  Synthetic
acaggtgtcgacccaaaagactggagctcacgaaaccggtttgactgccagcggtaattccaccatccattatac

SEQ ID NO: 75435 - DNA, 75 bp, Artificial Sequence
  Synthetic
ggtgacctatgtgaaggatgagctcagatcagcagaaaaagtggctaaaggcaagtctagacttattgaggcatc

SEQ ID NO: 75436 - DNA, 75 bp, Artificial Sequence
  Synthetic
cacagaacccatgaaggatgtgatgataaaatcgctacccgcgcttaactcgcccacagtggaggagtgtggttt

SEQ ID NO: 75437 - DNA, 75 bp, Artificial Sequence
  Synthetic
ataaaatcgctacccgcgcttaactcgcccacagtggaggagtgtggtttttcagatagggtacgatccattaca

SEQ ID NO: 75438 - DNA, 75 bp, Artificial Sequence
  Synthetic
gatgccagtttgagccccgtgtggtttgcttgtttgaagctattgctagaaaaactaggatactcacacaaagaa

SEQ ID NO: 75439 - DNA, 75 bp, Artificial Sequence
  Synthetic
caagataatgaggctacggctgaagatcaaccgacgcaaccagatgttgccacatgtagattttacactctagat

SEQ ID NO: 75440 - DNA, 75 bp, Artificial Sequence
  Synthetic
atcaaccgacgcaaccagatgttgccacatgtagattttacactctagattccatacaatggcagaaggagtccg

SEQ ID NO: 75441 - DNA, 75 bp, Artificial Sequence
  Synthetic
ccatcaggttgctccggtaccagcatcttcaactcaatgatcaacaacatcataatcaggacgctaatgttgaag

SEQ ID NO: 75442 - DNA, 75 bp, Artificial Sequence
  Synthetic
tgggcaggtccgggtacacgatacacgtgcaatgcaatgcatccaagttccaccagggatgtttgcttgttgtgt

SEQ ID NO: 75443 - DNA, 75 bp, Artificial Sequence
  Synthetic
cgtgcaatgcaatgcatccaagttccaccagggatgtttgcttgttgtgtgcgtaccggaggctgaaatggggtg

SEQ ID NO: 75444 - DNA, 75 bp, Artificial Sequence
  Synthetic
ccaatcgatgcctctttacttgctgaagccggcaaggggtatgggctgatcatgacaccagcagataaaggggag

SEQ ID NO: 75445 - DNA, 75 bp, Artificial Sequence
  Synthetic
gtccaatgggcaacatactgtacaaactgtggtctataatgctgggatgggtgtgggggttgggaacctaactat

SEQ ID NO: 75446 - DNA, 75 bp, Artificial Sequence
  Synthetic
atgtcacctttttgaagagatatttcagagcagatgagcaatacccctttgtggtccatcctgttatcccaatga

SEQ ID NO: 75447 - DNA, 75 bp, Artificial Sequence
  Synthetic
actgtggtctataatgctgggatgggtgtgggggttgggaacctaactatcttcccacaccagtggattaatttg

SEQ ID NO: 75448 - DNA, 75 bp, Artificial Sequence
  Synthetic
tggcctggcacaatggggagcacgaatatgaggaattcatcaagaagatcagaagcgtcccagtcgggcgctgtc

SEQ ID NO: 75449 - DNA, 75 bp, Artificial Sequence
  Synthetic
aattttactttaatgataattccctttgccaagttggagtacactgagcaagcttccaactatgtccctattacg

SEQ ID NO: 75450 - DNA, 75 bp, Artificial Sequence
  Synthetic
ttgccaagttggagtacactgagcaagcttccaactatgtccctattacggttactgtggcgcccatgtgtgctg

SEQ ID NO: 75451 - DNA, 75 bp, Artificial Sequence
  Synthetic
ttgaattggcttaaccctaccacactcaccgaactagacaacggtgtggtaggggtaaattctccgcattcggtg

SEQ ID NO: 75452 - DNA, 75 bp, Artificial Sequence
  Synthetic
cttcagatgattttcagtcgccatctgctatgccccagtttgacgtaacgccagagatgaagataccaggtgaag

SEQ ID NO: 75453 - DNA, 75 bp, Artificial Sequence
  Synthetic
tgctatgccccagtttgacgtaacgccagagatgaagataccaggtgaagtccacaatttgatggaaattgcgga

SEQ ID NO: 75454 - DNA, 75 bp, Artificial Sequence
  Synthetic
acccacagggcccactgggcgctagcacactggtatcacggtacccttgtgcgcctgttttatacacccttcccc

SEQ ID NO: 75455 - DNA, 75 bp, Artificial Sequence
  Synthetic
ccagctgtgtttcggtcaagcacttctgtttccccggactgagtatcaataggccactcacgtggccgaaggaga

SEQ ID NO: 75456 - DNA, 75 bp, Artificial Sequence
  Synthetic
agggggtgatcaactgcacacacaagtctttggctttcaaatgcaacctggcctgaacagcgtttttaaacgcac

SEQ ID NO: 75457 - DNA, 75 bp, Artificial Sequence
  Synthetic
gtctttggctttcaaatgcaacctggcctgaacagcgtttttaaacgcaccctgttaggggagattctaaactat

SEQ ID NO: 75458 - DNA, 75 bp, Artificial Sequence
  Synthetic
ttagcctactcacccccgggtgcttctccaccacaaaaccgtaagcaggcgatgctgggaacgcacgtgatatgg

SEQ ID NO: 75459 - DNA, 75 bp, Artificial Sequence
  Synthetic
ctccaccacaaaaccgtaagcaggcgatgctgggaacgcacgtgatatgggatgtggggctacaatctagttgcg

SEQ ID NO: 75460 - DNA, 75 bp, Artificial Sequence
  Synthetic
ccagtgggcagtctgtcgtaacgggtaactctgcagcggaaccgactactttgggtgtccgtgtttccttttatt

SEQ ID NO: 75461 - DNA, 75 bp, Artificial Sequence
  Synthetic
ttgggtgtccgtgtttccttttattcttatattggctgcttatggtgacaattgaaagattgttaccatatagct

SEQ ID NO: 75462 - DNA, 75 bp, Artificial Sequence
  Synthetic
tcacgtgttggtaccagacaggcctcatagtgccaccaggcgcgcccccctcatgcaccatattgtgctttgttt

SEQ ID NO: 75463 - DNA, 75 bp, Artificial Sequence
  Synthetic
attgaaagattgttaccatatagctattggattggccatccggtgtctaatagagcaattatattcctgtttgtt

SEQ ID NO: 75464 - DNA, 75 bp, Artificial Sequence
  Synthetic
catagtgccaccaggcgcgcccccctcatgcaccatattgtgctttgtttctgcgtgcaatgacttctcagtgcg

SEQ ID NO: 75465 - DNA, 75 bp, Artificial Sequence
  Synthetic
ctcaagtatcaacacagaagacaggagctcacgaaaccagcctcagtgccagcggcacctccacaatccactaca

SEQ ID NO: 75466 - DNA, 75 bp, Artificial Sequence
  Synthetic
tgttgcaagagtcgctgacacgctgccaacaggaccgcgcaataccgagagtgtacctgccttgacggcggtaga

SEQ ID NO: 75467 - DNA, 75 bp, Artificial Sequence
  Synthetic
agctcacgaaaccagcctcagtgccagcggcacctccacaatccactacaccaatataaacttctataaggatgc

SEQ ID NO: 75468 - DNA, 75 bp, Artificial Sequence
  Synthetic
ccaacaggaccgcgcaataccgagagtgtacctgccttgacggcggtagagactggacacacctcacaggtggtt

SEQ ID NO: 75469 - DNA, 75 bp, Artificial Sequence
  Synthetic
gatcaagaccttaccagccctcaactcaccgtctgcagaagagtgtggttatagcgatcgtgtccggtctatcac

SEQ ID NO: 75470 - DNA, 75 bp, Artificial Sequence
  Synthetic
tgtagagcagcatgtgtttacattacaacctataaatcggctggtggcactcccacagagcgatatgctagctgg

SEQ ID NO: 75471 - DNA, 75 bp, Artificial Sequence
  Synthetic
tcaccgtctgcagaagagtgtggttatagcgatcgtgtccggtctatcactctgggaaattccacaattacaacc

SEQ ID NO: 75472 - DNA, 75 bp, Artificial Sequence
  Synthetic
caacctataaatcggctggtggcactcccacagagcgatatgctagctggaggatcaacacccggcaaatggtgc

SEQ ID NO: 75473 - DNA, 75 bp, Artificial Sequence
  Synthetic
gataagccaacacaaccagacgtggcaacatgtagattctatacactagagtcagtaaactggcagaagggatcc

SEQ ID NO: 75474 - DNA, 75 bp, Artificial Sequence
  Synthetic
aagacccaggaacgcagttggcacaagacatgcccgtgctaacccatcagattatgtatatcccaccaggcggtc

SEQ ID NO: 75475 - DNA, 75 bp, Artificial Sequence
  Synthetic
caacatgtagattctatacactagagtcagtaaactggcagaagggatccgctgggtggtggtggaaatttccga

SEQ ID NO: 75476 - DNA, 75 bp, Artificial Sequence
  Synthetic
agacatgcccgtgctaacccatcagattatgtatatcccaccaggcggtccggttccaaatagcgctacagattt

SEQ ID NO: 75477 - DNA, 75 bp, Artificial Sequence
  Synthetic
acgtccaatgcaacgcctcaaagttccatcagggatgtttattggttgtgtgtgtacccgaagcagaaatggggt

SEQ ID NO: 75478 - DNA, 75 bp, Artificial Sequence
  Synthetic
cattagtattgggaacgcctatagtaacttctatgatgggtggtcgcattttacccaggagggtgtttatgggtt

SEQ ID NO: 75479 - DNA, 75 bp, Artificial Sequence
  Synthetic
ccatcagggatgtttattggttgtgtgtgtacccgaagcagaaatggggtgcgccaaggtggataggaccgtagt

SEQ ID NO: 75480 - DNA, 75 bp, Artificial Sequence
  Synthetic
atctacgtgaggcacgtcaatgaacaaaatttaggtgtgtctaccagcacgttgcgcgtgtactttaaacctaaa

SEQ ID NO: 75481 - DNA, 75 bp, Artificial Sequence
  Synthetic
acgagtcgtccacaatgcagctatgggggtggctgtggggaacttaaccatctacccacaccaatggattaattt

SEQ ID NO: 75482 - DNA, 75 bp, Artificial Sequence
  Synthetic
ggggtggctgtggggaacttaaccatctacccacaccaatggattaatttacgcactaataacagcgcaaccatt

SEQ ID NO: 75483 - DNA, 75 bp, Artificial Sequence
  Synthetic
actgccgtgacaactgagcggaaagacattaatgatatggggacgctccgccccatgggttataccagccatggg

SEQ ID NO: 75484 - DNA, 75 bp, Artificial Sequence
  Synthetic
tttgtgccgttggacatgcaagcgggcgcatcgacaatagtgcccataactgtgacagtggcacctatgtgtgct

SEQ ID NO: 75485 - DNA, 75 bp, Artificial Sequence
  Synthetic
gcgcatcgacaatagtgcccataactgtgacagtggcacctatgtgtgctgagtataatgggttgcggttggcgt

SEQ ID NO: 75486 - DNA, 75 bp, Artificial Sequence
  Synthetic
gactggagcaattgtgtctgggaggactataacagagatttactaatcagcaccactacggccctaggatgcgac

SEQ ID NO: 75487 - DNA, 75 bp, Artificial Sequence
  Synthetic
actataacagagatttactaatcagcaccactacggccctaggatgcgacaccattgccagatgccagtgcaatg

SEQ ID NO: 75488 - DNA, 75 bp, Artificial Sequence
  Synthetic
cggccatgcctcagtttgatgctaccccgctgatgcacataccaggtgaggttaagaatttgatggaaatagcag

SEQ ID NO: 75489 - DNA, 75 bp, Artificial Sequence
  Synthetic
cccgctgatgcacataccaggtgaggttaagaatttgatggaaatagcagaggtggactcagtggttcctgtaaa

SEQ ID NO: 75490 - DNA, 75 bp, Artificial Sequence
  Synthetic
aggagagtgaatactaccccaagaagtatcaatcccacgtcttgctcgcagcgggcttttcagaaccaggtgact

SEQ ID NO: 75491 - DNA, 75 bp, Artificial Sequence
  Synthetic
gtatcaatcccacgtcttgctcgcagcgggcttttcagaaccaggtgactgtggcggcattttgagatgcgagca

SEQ ID NO: 75492 - DNA, 75 bp, Artificial Sequence
  Synthetic
agcaatctttagcttccaattagaccctggcaatagcacagtaatgagtaaaacgatcttgggtgaaatattgaa

SEQ ID NO: 75493 - DNA, 75 bp, Artificial Sequence
  Synthetic
cctggcaatagcacagtaatgagtaaaacgatcttgggtgaaatattgaattactatgcacactggtcagggagc

SEQ ID NO: 75494 - DNA, 75 bp, Artificial Sequence
  Synthetic
ggaagatgacgctatggaacagggtgtgaaggactatgttgaacagctaggaaacgcttttggctcgggcttcac

SEQ ID NO: 75495 - DNA, 75 bp, Artificial Sequence
  Synthetic
gtgaaggactatgttgaacagctaggaaacgcttttggctcgggcttcaccaatcagatttgtgagcaggttaat

SEQ ID NO: 75496 - DNA, 75 bp, Artificial Sequence
  Synthetic
gcctcagtcccagcagataggaaacaagccatgctaggcacgcatgtgatatgggatgtgggcttacagtctagt

SEQ ID NO: 75497 - DNA, 75 bp, Artificial Sequence
  Synthetic
aagccatgctaggcacgcatgtgatatgggatgtgggcttacagtctagttgtgtgttgtgtgtgccttggatta

SEQ ID NO: 75498 - DNA, 75 bp, Artificial Sequence
  Synthetic
gctttagttatagtggtggggaaccacgatgacctgattacggtgaccgccacactagctcttatagggtgtacc

SEQ ID NO: 75499 - DNA, 75 bp, Artificial Sequence
  Synthetic
acgatgacctgattacggtgaccgccacactagctcttatagggtgtacctcatcgccatggcgttggctcaaac

SEQ ID NO: 75500 - DNA, 75 bp, Artificial Sequence
  Synthetic
caatcgtagtaccacccagcactcccacaaacagcaagatactatgcttcacgtcagcgtgcaatgacttctccg

SEQ ID NO: 75501 - DNA, 75 bp, Artificial Sequence
  Synthetic
cacaaacagcaagatactatgcttcacgtcagcgtgcaatgacttctccgttcgcatgttgcgagatacgccaca

SEQ ID NO: 75502 - DNA, 75 bp, Artificial Sequence
  Synthetic
tgaccaacgcctgcaagggtatggagtggattgctgttaaaatccagaagttcattgaatggctcaaggtgaaga

SEQ ID NO: 75503 - DNA, 75 bp, Artificial Sequence
  Synthetic
gtggattgctgttaaaatccagaagttcattgaatggctcaaggtgaagattttgcccgaggtgaaggaaaaaca

SEQ ID NO: 75504 - DNA, 75 bp, Artificial Sequence
  Synthetic
agcccggaacacagagcaagtgccagcccttacggcggctgaaacgggacacacatcacaagttgagccaagtga

SEQ ID NO: 75505 - DNA, 75 bp, Artificial Sequence
  Synthetic
gcccttacggcggctgaaacgggacacacatcacaagttgagccaagtgacaccgttcagacgaggcatgtgtgt

SEQ ID NO: 75506 - DNA, 75 bp, Artificial Sequence
  Synthetic
ccagaatgaccaagaacaattgttctctaatgtgcagtacttcgcccactactgcaggaaatatgcacctttgta

SEQ ID NO: 75507 - DNA, 75 bp, Artificial Sequence
  Synthetic
tctaatgtgcagtacttcgcccactactgcaggaaatatgcacctttgtatgccgccgaggctaagagagtgttt

SEQ ID NO: 75508 - DNA, 75 bp, Artificial Sequence
  Synthetic
cgcatagggtcgagtgccgatctgactgacaagtacacggggtggacaatttcagtgcgtgatttggtacagctt

SEQ ID NO: 75509 - DNA, 75 bp, Artificial Sequence
  Synthetic
ctgacaagtacacggggtggacaatttcagtgcgtgatttggtacagcttaggcggaaatttgagatgttcactt

SEQ ID NO: 75510 - DNA, 75 bp, Artificial Sequence
  Synthetic
cacggtagcccaggcgctggaaaatctgtagccactaatctaattggcaggtcactcgcagaaaaactcaacagt

SEQ ID NO: 75511 - DNA, 75 bp, Artificial Sequence
  Synthetic
ctgtagccactaatctaattggcaggtcactcgcagaaaaactcaacagttctgtgtactcactaccaccagacc

SEQ ID NO: 75512 - DNA, 75 bp, Artificial Sequence
  Synthetic
tgcctgtgcttactcaccaaataatgtatgtcccacctgggggtccagttcctgagagtgtggatagctttgcat

SEQ ID NO: 75513 - DNA, 75 bp, Artificial Sequence
  Synthetic
gtatgtcccacctgggggtccagttcctgagagtgtggatagctttgcatggcagacttctaccaaccccagtgt

SEQ ID NO: 75514 - DNA, 75 bp, Artificial Sequence
  Synthetic
acgtgtctctattttgtcagatggtatcaagtgttgactttgtcccaccgatggctgctcttgaggagaaaggta

SEQ ID NO: 75515 - DNA, 75 bp, Artificial Sequence
  Synthetic
atcaagtgttgactttgtcccaccgatggctgctcttgaggagaaaggtatcctcttcacttcaccatttgtgct

SEQ ID NO: 75516 - DNA, 75 bp, Artificial Sequence
  Synthetic
ttacgacggttggtcccatttcacacaaaacggggtgtatgggtacagtaccttgaataacatggggaaactgtt

SEQ ID NO: 75517 - DNA, 75 bp, Artificial Sequence
  Synthetic
caaaacggggtgtatgggtacagtaccttgaataacatggggaaactgtttatgagacacgttaacaagcaaagt

SEQ ID NO: 75518 - DNA, 75 bp, Artificial Sequence
  Synthetic
tgacatgaacattgaggtcatttccatgtacagtcaaaatggcaagatcaacatgcccatgtcagttaaaacatg

SEQ ID NO: 75519 - DNA, 75 bp, Artificial Sequence
  Synthetic
atgtacagtcaaaatggcaagatcaacatgcccatgtcagttaaaacatgcgatgaggagtgttgcccggtcaac

SEQ ID NO: 75520 - DNA, 75 bp, Artificial Sequence
  Synthetic
cggttgtgcccatacctgtacaaggccaacaccaatttcaacccagcacccgtggcggagcaccggcgcgattta

SEQ ID NO: 75521 - DNA, 75 bp, Artificial Sequence
  Synthetic
ccaacaccaatttcaacccagcacccgtggcggagcaccggcgcgatttaaatgacgtgcctgggttggcgcacc

SEQ ID NO: 75522 - DNA, 75 bp, Artificial Sequence
  Synthetic
ctagatatgctggtcactgagatgtttagggaatacaatcatagacacagcgtgggagccacacttgaagccctg

SEQ ID NO: 75523 - DNA, 75 bp, Artificial Sequence
  Synthetic
ttagggaatacaatcatagacacagcgtgggagccacacttgaagccctgttccaaggaccaccagtctataggg

SEQ ID NO: 75524 - DNA, 75 bp, Artificial Sequence
  Synthetic
gacaccttgcaacccacaccgattggcaaaactgtgtgtgggaggattacaacagggatttgctagtcagcacaa

SEQ ID NO: 75525 - DNA, 75 bp, Artificial Sequence
  Synthetic
gcaaaactgtgtgtgggaggattacaacagggatttgctagtcagcacaaccacggcccatgggtgtgataccat

SEQ ID NO: 75526 - DNA, 75 bp, Artificial Sequence
  Synthetic
aggctgtcagggaatactgtaaggaaaagggatggcttgtgccggaaattaactccaccttacagattgaaaaac

SEQ ID NO: 75527 - DNA, 75 bp, Artificial Sequence
  Synthetic
aaagggatggcttgtgccggaaattaactccaccttacagattgaaaaacatgttagcagggcatttatctgtct

SEQ ID NO: 75528 - DNA, 75 bp, Artificial Sequence
  Synthetic
gccgggactagtagaagtccaagaaagtgaatactaccctaaaagatatcaatcccacgtgctgcttgccgcggg

SEQ ID NO: 75529 - DNA, 75 bp, Artificial Sequence
  Synthetic
agtgaatactaccctaaaagatatcaatcccacgtgctgcttgccgcgggcttctccgaaccaggggattggggt

SEQ ID NO: 75530 - DNA, 75 bp, Artificial Sequence
  Synthetic
cgcgtacacagggatgcccaaccagaagcccaaggttcccactctaagacaggctaaagtgcagggtccggcatt

SEQ ID NO: 75531 - DNA, 75 bp, Artificial Sequence
  Synthetic
aagcccaaggttcccactctaagacaggctaaagtgcagggtccggcattcgaattcgccgtagcaatgatgaaa

SEQ ID NO: 75532 - DNA, 75 bp, Artificial Sequence
  Synthetic
gtgcgcgacctcttgtggttggaggatgacgcaatggaacagggcgtccgagactatgtcgagcagctaggaaat

SEQ ID NO: 75533 - DNA, 75 bp, Artificial Sequence
  Synthetic
atgacgcaatggaacagggcgtccgagactatgtcgagcagctaggaaatgcctttggctcgggctttaccaacc

SEQ ID NO: 75534 - DNA, 75 bp, Artificial Sequence
  Synthetic
ccacgtcacgccaaacctggccccaccatcttaatgaatgatcaggaagttggcgtgttggatgctaaggaacta

SEQ ID NO: 75535 - DNA, 75 bp, Artificial Sequence
  Synthetic
ccatcttaatgaatgatcaggaagttggcgtgttggatgctaaggaactagtcgacaaagatgggacaaacctgg

SEQ ID NO: 75536 - DNA, 75 bp, Artificial Sequence
  Synthetic
ctttagttaaaattatttcagcactagtcatagtagtaaggaaccatgatgacctcatcacagtgacagccaccc

SEQ ID NO: 75537 - DNA, 75 bp, Artificial Sequence
  Synthetic
agtcatagtagtaaggaaccatgatgacctcatcacagtgacagccacccttgctctcataggttgcaccacatc

SEQ ID NO: 75538 - DNA, 75 bp, Artificial Sequence
  Synthetic
aggtgaacgaagctgttctggcaataaacacaagtaagtttcccaacatgtacatacccgtaggccaggtgaccg

SEQ ID NO: 75539 - DNA, 75 bp, Artificial Sequence
  Synthetic
aaacacaagtaagtttcccaacatgtacatacccgtaggccaggtgaccgactacggattcctaaacctgggagg

SEQ ID NO: 75540 - DNA, 75 bp, Artificial Sequence
  Synthetic
gctaaaaaagttcacggagatgaccaatgcctgtaaagggatggagtggatagccgtcaagatccagaagtttat

SEQ ID NO: 75541 - DNA, 75 bp, Artificial Sequence
  Synthetic
aggaaaagttctaggaatacacgtagggggaaatgggcaccaagggttctcagcagcactcctcaggcactattt

SEQ ID NO: 75542 - DNA, 75 bp, Artificial Sequence
  Synthetic
gggggaaatgggcaccaagggttctcagcagcactcctcaggcactatttcaatgaggagcagggtgaaattgag

SEQ ID NO: 75543 - DNA, 75 bp, Artificial Sequence
  Synthetic
ccttctggagagccagattgctacaattgagcagagtgccccctcacagagcgaccaggagcaactgttctcaaa

SEQ ID NO: 75544 - DNA, 75 bp, Artificial Sequence
  Synthetic
tttcaccaagtgtttgaaggaaacaaggaaccagcagtcctcagaaatggcgacccacggctcaaagctaacttt

SEQ ID NO: 75545 - DNA, 75 bp, Artificial Sequence
  Synthetic
aggaaccagcagtcctcagaaatggcgacccacggctcaaagctaactttgaggaagcaattttctccaagtata

SEQ ID NO: 75546 - DNA, 75 bp, Artificial Sequence
  Synthetic
agaaaagaaaatgagcaactacatacagttcaagtccaaatgccgtattgaacctgtctgtcttttgctccacgg

SEQ ID NO: 75547 - DNA, 75 bp, Artificial Sequence
  Synthetic
tagacatcagcacagagcctatgaggttggaagatgctgtgtatggcacagaggggctggaggcactcgatttga

SEQ ID NO: 75548 - DNA, 75 bp, Artificial Sequence
  Synthetic
gttggaagatgctgtgtatggcacagaggggctggaggcactcgatttgaccactagtgcaggttacccctatgt

SEQ ID NO: 75549 - DNA, 75 bp, Artificial Sequence
  Synthetic
cattttgatggctacaagcaacaagctgttgtgattatggatgacttgtgccaaaacccagacgggaaggacgtg

SEQ ID NO: 75550 - DNA, 75 bp, Artificial Sequence
  Synthetic
ctgttgtgattatggatgacttgtgccaaaacccagacgggaaggacgtgtcactgttctgccaaatggtatcta

SEQ ID NO: 75551 - DNA, 75 bp, Artificial Sequence
  Synthetic
taagtatggccttaacttaccaatggtcacctacgttaaggatgaactaaggtctgctgaaaaagtggccagggg

SEQ ID NO: 75552 - DNA, 75 bp, Artificial Sequence
  Synthetic
gtcacctacgttaaggatgaactaaggtctgctgaaaaagtggccaggggaaaatccagactcattgaggcttct

SEQ ID NO: 75553 - DNA, 75 bp, Artificial Sequence
  Synthetic
ctaccaatgcgggatccattaacgctcctactgtgtcagacagcagagccctagcaaggaggttccacttcgata

SEQ ID NO: 75554 - DNA, 75 bp, Artificial Sequence
  Synthetic
tcctactgtgtcagacagcagagccctagcaaggaggttccacttcgatatgaatatcgaagttatttcaatgta

SEQ ID NO: 75555 - DNA, 75 bp, Artificial Sequence
  Synthetic
gtcacgggtagtgctgttgggtgcgatccagatgtgttttggagcaaaatacctgtcatgcttgatggaaatctc

SEQ ID NO: 75556 - DNA, 75 bp, Artificial Sequence
  Synthetic
atccagatgtgttttggagcaaaatacctgtcatgcttgatggaaatctcatagcctttgattactcaggttatg

SEQ ID NO: 75557 - DNA, 75 bp, Artificial Sequence
  Synthetic
aaagtgctgccctctagtgtgtggtaaagccatccagtttattgacaggagaacacaagtgcgctactcactgga

SEQ ID NO: 75558 - DNA, 75 bp, Artificial Sequence
  Synthetic
aaagccatccagtttattgacaggagaacacaagtgcgctactcactggacatgctcgtgactgagatgttcaga

SEQ ID NO: 75559 - DNA, 75 bp, Artificial Sequence
  Synthetic
caaattacatagattacctctgcaactcccatcatttgtacagagataaacactactttgtgaggggtggtatgc

SEQ ID NO: 75560 - DNA, 75 bp, Artificial Sequence
  Synthetic
ctcccatcatttgtacagagataaacactactttgtgaggggtggtatgccatcggggtgttcaggcactagcat

SEQ ID NO: 75561 - DNA, 75 bp, Artificial Sequence
  Synthetic
aagatcagtgttacaccggaaacccctccaccaccggcaattgcagatctattaaagtcagtggacagtgaggca

SEQ ID NO: 75562 - DNA, 75 bp, Artificial Sequence
  Synthetic
ctccaccaccggcaattgcagatctattaaagtcagtggacagtgaggcagttagagaatattgcaaggaaaggg

SEQ ID NO: 75563 - DNA, 75 bp, Artificial Sequence
  Synthetic
gttcaggatgattgcttacggagatgatgtgatcgcttcatacccgtggcctattgacgcctcgctcttggctga

SEQ ID NO: 75564 - DNA, 75 bp, Artificial Sequence
  Synthetic
gatgtgatcgcttcatacccgtggcctattgacgcctcgctcttggctgaagcggggaaggattatggcttgatt

SEQ ID NO: 75565 - DNA, 75 bp, Artificial Sequence
  Synthetic
cgctcaccacatttgtttcagtggcaggaattatatacatcatttacaagctgtttgccggcttccaaggcgctt

SEQ ID NO: 75566 - DNA, 75 bp, Artificial Sequence
  Synthetic
aggaattatatacatcatttacaagctgtttgccggcttccaaggcgcttacaccgggttgcccaaccaaaaacc

SEQ ID NO: 75567 - DNA, 75 bp, Artificial Sequence
  Synthetic
agagcagatgagcagtacccattcctggtgcaccctgtcatgccaatgaaggatatacatgagtccatcagatgg

SEQ ID NO: 75568 - DNA, 75 bp, Artificial Sequence
  Synthetic
tgccagcactgcgaaaacagagtatggtgagttcaccatgcttgggatctatgatagatgggcagtattaccccg

SEQ ID NO: 75569 - DNA, 75 bp, Artificial Sequence
  Synthetic
ggtgagttcaccatgcttgggatctatgatagatgggcagtattaccccgccacgccaaaccaggtcccaccatc

SEQ ID NO: 75570 - DNA, 75 bp, Artificial Sequence
  Synthetic
ggcttggcataatggagagcacgaatatgaggagtttattcgaaagatcagaagcgtacccgttgggcgctgttt

SEQ ID NO: 75571 - DNA, 75 bp, Artificial Sequence
  Synthetic
acacttttgaaactcaacaggaatgagaaattcagggacatccgaggcttcttggcgcgcgaggaagctgaagtt

SEQ ID NO: 75572 - DNA, 75 bp, Artificial Sequence
  Synthetic
agaaattcagggacatccgaggcttcttggcgcgcgaggaagctgaagttaacgaagctgtgcttgctattaaca

SEQ ID NO: 75573 - DNA, 75 bp, Artificial Sequence
  Synthetic
caaccaaacgtatgctgatgtacaactttcccactcgtgctggacaatgtggcggcgtcctgatgtcaacaggca

SEQ ID NO: 75574 - DNA, 75 bp, Artificial Sequence
  Synthetic
ctttcccactcgtgctggacaatgtggcggcgtcctgatgtcaacaggcaaggttctcggaatacacgttggtgg

SEQ ID NO: 75575 - DNA, 75 bp, Artificial Sequence
  Synthetic
ccagtcgtatctcgatcaagcacttctgtttccccggaccgagtatcaatagactgctagcgcggttgaaggaga

SEQ ID NO: 75576 - DNA, 75 bp, Artificial Sequence
  Synthetic
cgagagttctaaagaggctggattcccagtcatcaacactcccagtaagacaaaacttgaacccagtgttttcca

SEQ ID NO: 75577 - DNA, 75 bp, Artificial Sequence
  Synthetic
ccagtcatcaacactcccagtaagacaaaacttgaacccagtgttttccatcacgtatttgaggggaacaaggaa

SEQ ID NO: 75578 - DNA, 75 bp, Artificial Sequence
  Synthetic
aatgtgaacactcatgtggatgagtacatgatggaggctgtcgaccactatgcagggcaattggcaaccctagat

SEQ ID NO: 75579 - DNA, 75 bp, Artificial Sequence
  Synthetic
ttgggtgtccgtgtttccttttattcctacattggctgcttatggtgacaatcaaagagttgttaccatatagct

SEQ ID NO: 75580 - DNA, 75 bp, Artificial Sequence
  Synthetic
agtgcggggtacccctacgtggccctcggcatcaagaagagggacatcctgtccaggaagaccagggatttgacg

SEQ ID NO: 75581 - DNA, 75 bp, Artificial Sequence
  Synthetic
gcttcaccacattgtgttacatcattagactgaacaaggcaaaatgggagcacaggtctcgacacaaaagaccgg

SEQ ID NO: 75582 - DNA, 75 bp, Artificial Sequence
  Synthetic
atatgtcaaggatgaattgagatcagcagagaaggtggccaagggtaaatccaggcttattgaggcatcgagtct

SEQ ID NO: 75583 - DNA, 75 bp, Artificial Sequence
  Synthetic
tagactgaacaaggcaaaatgggagcacaggtctcgacacaaaagaccggggctcatgaaaccggtttgaacgcg

SEQ ID NO: 75584 - DNA, 75 bp, Artificial Sequence
  Synthetic
acctttgggaacctgtacaagacattccacttgaacccaggtatagtgacaggcagcgcagttggctgcgatcct

SEQ ID NO: 75585 - DNA, 75 bp, Artificial Sequence
  Synthetic
gatttcacacaggaccccagcaaatttacagagcctatgaaagacgtgatgattaagtcattgcctgctctcaac

SEQ ID NO: 75586 - DNA, 75 bp, Artificial Sequence
  Synthetic
gacttattctggagcaaaatcccagtcatgctcgacggccatcttatcgcctttgactatagtggttatgatgcc

SEQ ID NO: 75587 - DNA, 75 bp, Artificial Sequence
  Synthetic
ttacagagcctatgaaagacgtgatgattaagtcattgcctgctctcaactcaccaaccgtagaggagtgtggat

SEQ ID NO: 75588 - DNA, 75 bp, Artificial Sequence
  Synthetic
tcatgctcgacggccatcttatcgcctttgactatagtggttatgatgccagccttagtccagtatggtttgctt

SEQ ID NO: 75589 - DNA, 75 bp, Artificial Sequence
  Synthetic
ggtatggcgtgtggccaaactacctccaggacaatgaggctacggccgaggaccaaccaacgcaacccgatgtcg

SEQ ID NO: 75590 - DNA, 75 bp, Artificial Sequence
  Synthetic
ccaggacaatgaggctacggccgaggaccaaccaacgcaacccgatgtcgcgacatgcagattctatacgttaga

SEQ ID NO: 75591 - DNA, 75 bp, Artificial Sequence
  Synthetic
actcaatgatcaacaacattattatcagaacactaatgctgaaggtgtataaggggattgacctggaccaattca

SEQ ID NO: 75592 - DNA, 75 bp, Artificial Sequence
  Synthetic
tggtcaaaacatggaatatcactatctaggcagatcaggttacacaatccatgtccagtgtaatgcatccaagtt

SEQ ID NO: 75593 - DNA, 75 bp, Artificial Sequence
  Synthetic
ctaggcagatcaggttacacaatccatgtccagtgtaatgcatccaagtttcatcaaggatgtctactcgtggtg

SEQ ID NO: 75594 - DNA, 75 bp, Artificial Sequence
  Synthetic
ggaaaggatacggcctgatcatgacaccagccgacaagggagagtgcttcaacgaagtgacatggaccaacgtca

SEQ ID NO: 75595 - DNA, 75 bp, Artificial Sequence
  Synthetic
acagccaagagcttctcgcgcacagagtctaacggtcagcacaccgttcagacagctgtgtataacgcaggaatg

SEQ ID NO: 75596 - DNA, 75 bp, Artificial Sequence
  Synthetic
agtctaacggtcagcacaccgttcagacagctgtgtataacgcaggaatgggcgtgggcgttggtaatttaacca

SEQ ID NO: 75597 - DNA, 75 bp, Artificial Sequence
  Synthetic
agaccccaagaacacccaagaccatgtgcgttccttgtgcttactggcttggcacaatggagagcaagagtacga

SEQ ID NO: 75598 - DNA, 75 bp, Artificial Sequence
  Synthetic
ggcacaatggagagcaagagtacgaggagtttgtgtctaaaatcagaagcgtcccagttgggcgctgtttggctt

SEQ ID NO: 75599 - DNA, 75 bp, Artificial Sequence
  Synthetic
ctatggataacatgtttagacactacaacttcaccctgatgataattccgtttgctaaattggagtatacaaaac

SEQ ID NO: 75600 - DNA, 75 bp, Artificial Sequence
  Synthetic
caacttcaccctgatgataattccgtttgctaaattggagtatacaaaacaagcctcaaattacgttcccataac

SEQ ID NO: 75601 - DNA, 75 bp, Artificial Sequence
  Synthetic
aacacccggtagtaaccagttcctaacatccgatgatttccagtcaccatctgccatgccacaatttgacgttac

SEQ ID NO: 75602 - DNA, 75 bp, Artificial Sequence
  Synthetic
acatccgatgatttccagtcaccatctgccatgccacaatttgacgttacaccggaaatgaaaataccaggtgag

SEQ ID NO: 75603 - DNA, 75 bp, Artificial Sequence
  Synthetic
atggatgcttacagaataccggtcactggaggggatcagttgcgtacacaagtttttgggtttcagatgcaaccg

SEQ ID NO: 75604 - DNA, 75 bp, Artificial Sequence
  Synthetic
ctggaggggatcagttgcgtacacaagtttttgggtttcagatgcaaccgggtttgaacagtgtgttcaagcgca

SEQ ID NO: 75605 - DNA, 75 bp, Artificial Sequence
  Synthetic
cagcaatggcaacgggtaaatttttgttggcatactcaccaccaggtgcttctcccccccaaaaccgcaaacagg

SEQ ID NO: 75606 - DNA, 75 bp, Artificial Sequence
  Synthetic
gttggcatactcaccaccaggtgcttctcccccccaaaaccgcaaacaggcaatgctaggtacgcacgtcatatg

SEQ ID NO: 75607 - DNA, 75 bp, Artificial Sequence
  Synthetic
agatgagtacaccagtgcggggtatattacatgttggtaccaaaccgggttgattgtacctccaggagcaccttc

SEQ ID NO: 75608 - DNA, 75 bp, Artificial Sequence
  Synthetic
attacatgttggtaccaaaccgggttgattgtacctccaggagcaccttcttcgtgcaccatattgtgcttcgct

SEQ ID NO: 75609 - DNA, 75 bp, Artificial Sequence
  Synthetic
gacgtcgaagaggcaattgatagggcagttgcgagggtggctgacacaatgccaaccggtccacgaaacactgag

SEQ ID NO: 75610 - DNA, 75 bp, Artificial Sequence
  Synthetic
cagttgcgagggtggctgacacaatgccaaccggtccacgaaacactgagagcgtgcctgccctgacagcagtag

SEQ ID NO: 75611 - DNA, 75 bp, Artificial Sequence
  Synthetic
cagagtcatcaattgaaaacttcctgtgcagggctgcgtgcgtgtatataacaacatacaaatcagctggtggaa

SEQ ID NO: 75612 - DNA, 75 bp, Artificial Sequence
  Synthetic
gtgcagggctgcgtgcgtgtatataacaacatacaaatcagctggtggaacacccacagagcgatatgcaagttg

SEQ ID NO: 75613 - DNA, 75 bp, Artificial Sequence
  Synthetic
aatcacatttgtgatcacaagcacacaagatcctgggacacaattggcacaagatatgcctgtactaactcatca

SEQ ID NO: 75614 - DNA, 75 bp, Artificial Sequence
  Synthetic
caagatcctgggacacaattggcacaagatatgcctgtactaactcatcagctcatgtatatcccacctgggggc

SEQ ID NO: 75615 - DNA, 75 bp, Artificial Sequence
  Synthetic
gctccagcacgaatgtcggtgccgttcatcagcattggcaatgcctacaccaatttttacgatgggtggtcgcat

SEQ ID NO: 75616 - DNA, 75 bp, Artificial Sequence
  Synthetic
tcatcagcattggcaatgcctacaccaatttttacgatgggtggtcgcatttcacccaagaaggggtttatgggt

SEQ ID NO: 75617 - DNA, 75 bp, Artificial Sequence
  Synthetic
ccgttcgcgtgtattttaaacccaaacatgtgcgtgcttgggtaccaagaccacccagactgtgcccatacacta

SEQ ID NO: 75618 - DNA, 75 bp, Artificial Sequence
  Synthetic
acatgtgcgtgcttgggtaccaagaccacccagactgtgcccatacactaagagttcaaatgtgaatttcaaacc

SEQ ID NO: 75619 - DNA, 75 bp, Artificial Sequence
  Synthetic
cgcattcgggcagcagtctggtgcagtatacgtgggcaactacagagtggtgaacagacacttagcaactcaatt

SEQ ID NO: 75620 - DNA, 75 bp, Artificial Sequence
  Synthetic
gtatacgtgggcaactacagagtggtgaacagacacttagcaactcaatttgattggcataactgtgtgtgggag

SEQ ID NO: 75621 - DNA, 75 bp, Artificial Sequence
  Synthetic
aatggggtgtatttctgtgcctcaaggaacaaacactacccagtcgtttttgaaggcccaggtcttgtcgaggtc

SEQ ID NO: 75622 - DNA, 75 bp, Artificial Sequence
  Synthetic
ggaacaaacactacccagtcgtttttgaaggcccaggtcttgtcgaggtccaagaaagtgaatattaccctaaga

SEQ ID NO: 75623 - DNA, 75 bp, Artificial Sequence
  Synthetic
acggtgttattggcattgtgactatgggtggcgaaggcgttgtcggttttgctgatgtgagagaccttttatggt

SEQ ID NO: 75624 - DNA, 75 bp, Artificial Sequence
  Synthetic
caaatcagatctgtgagcaggtcacccttcttaaagaatcgctagttgggcaagattccatcctagaaaaatccc

SEQ ID NO: 75625 - DNA, 75 bp, Artificial Sequence
  Synthetic
atgaccaacgcctgtaagggaatggaatggatagctatcaaaatccagaaatttatagaatggctcaaagttaaa

SEQ ID NO: 75626 - DNA, 75 bp, Artificial Sequence
  Synthetic
cagaaggtatcacagtattacgggataccaatggccgagagacaaaataatgggtggctaaaaaagttcacggaa

SEQ ID NO: 75627 - DNA, 75 bp, Artificial Sequence
  Synthetic
gtttattgagtggcttaaagttaagatcttaccagaggtgagggagaaacatgagtttcttgacagattgagaca

SEQ ID NO: 75628 - DNA, 75 bp, Artificial Sequence
  Synthetic
tcagttgccactaatctgattgggcgctcactggccgagaaacttaatagctcagtatactccctaccaccagac

SEQ ID NO: 75629 - DNA, 75 bp, Artificial Sequence
  Synthetic
ttcattggaaaagaagatgagtaattacatacagttcaagtccaaatgccgtattgagcctgtatgtttgctact

SEQ ID NO: 75630 - DNA, 75 bp, Artificial Sequence
  Synthetic
gttccaaggaccaccggtctatagggaaattaagatcagtgttgctccagagacgccccccccaccggcgattgc

SEQ ID NO: 75631 - DNA, 75 bp, Artificial Sequence
  Synthetic
agacttattaaaatcagtggatagtgaggcagttagagagtactgcaaagaaaagggatggttggtaccagaggt

SEQ ID NO: 75632 - DNA, 75 bp, Artificial Sequence
  Synthetic
tgtggctggaatcatctacattatatacaagctgttcgcaggctttcaaggtgcgtacacagggatgcccaacca

SEQ ID NO: 75633 - DNA, 75 bp, Artificial Sequence
  Synthetic
aagaaactccagcacagtgaagactgaatatggtgagttcaccatgctaggcatctacgacagatgggccgtttt

SEQ ID NO: 75634 - DNA, 75 bp, Artificial Sequence
  Synthetic
gaatatggtgagttcaccatgctaggcatctacgacagatgggccgttttaccacgtcacgccaagccagggccc

SEQ ID NO: 75635 - DNA, 75 bp, Artificial Sequence
  Synthetic
gagttgacactgctcaagttgaatcgaaatgagaagttcagggatatcagaggcttcttagccaaagaggaagtg

SEQ ID NO: 75636 - DNA, 75 bp, Artificial Sequence
  Synthetic
gaaatgagaagttcagggatatcagaggcttcttagccaaagaggaagtggaggtgagtgaggctgtgctagcaa

SEQ ID NO: 75637 - DNA, 75 bp, Artificial Sequence
  Synthetic
gcactcccactaaaagaatgctcatgtacaacttccccacgagagcaggtcagtgcggtggggtgctcatgtcaa

SEQ ID NO: 75638 - DNA, 75 bp, Artificial Sequence
  Synthetic
gtacaacttccccacgagagcaggtcagtgcggtggggtgctcatgtcaactggcaaagtcttaggaatccacgt

SEQ ID NO: 75639 - DNA, 75 bp, Artificial Sequence
  Synthetic
attcattgaaagctcgaaagatgcagggtttccaatcataaacacaccaagtaaaaccaagttggagccaagtgt

SEQ ID NO: 75640 - DNA, 75 bp, Artificial Sequence
  Synthetic
gggtttccaatcataaacacaccaagtaaaaccaagttggagccaagtgtcttccaccaaatctttgagggtagc

SEQ ID NO: 75641 - DNA, 75 bp, Artificial Sequence
  Synthetic
attggaaatatcaacacgcacgtggacgagtacatgctggaggccattgaccattacgccggtcaattggccact

SEQ ID NO: 75642 - DNA, 75 bp, Artificial Sequence
  Synthetic
acgagtacatgctggaggccattgaccattacgccggtcaattggccactcttgacattagcactgagccaatga

SEQ ID NO: 75643 - DNA, 75 bp, Artificial Sequence
  Synthetic
ttgctttaggcatcaaaaagagagacatcctttccaagaagaccagggacctaactaagctgaaagaatgtatgg

SEQ ID NO: 75644 - DNA, 75 bp, Artificial Sequence
  Synthetic
acaagtatggcttgaaccttccaatggtgacttatgtgaaggatgagcttagatcagccgagaaagtggcaaaag

SEQ ID NO: 75645 - DNA, 75 bp, Artificial Sequence
  Synthetic
cagccatgttttgatcaagcacttctgttaccccggactgagtatcaatagactgctcacgcggttgaaggagaa

SEQ ID NO: 75646 - DNA, 75 bp, Artificial Sequence
  Synthetic
gatgccagccttagccctgtctggtttgcatgcttaaaactgttgctggagaagcttgggtatacacacaaggag

SEQ ID NO: 75647 - DNA, 75 bp, Artificial Sequence
  Synthetic
ttgagagattgttaccatatagctattggattggccatccggtgtctaatagagctattatatatctctttgttg

SEQ ID NO: 75648 - DNA, 75 bp, Artificial Sequence
  Synthetic
tggcttggcacaatggggagcaagaatatgaagagtttatccggaaaattagaagcgtcccagtcgggcgctgtt

SEQ ID NO: 75649 - DNA, 75 bp, Artificial Sequence
  Synthetic
gtgccgagtacaatggactacgtttggccgggcaccagggcttaccaaccatgaacactccggggagctgtcaat

SEQ ID NO: 75650 - DNA, 75 bp, Artificial Sequence
  Synthetic
gaatataatgggctgcgtctagccggtaagcaaggtttaccaacgctgtcgacacccgggagcaaccagtttctc

SEQ ID NO: 75651 - DNA, 75 bp, Artificial Sequence
  Synthetic
actccatggaagcgtaccagatacctgtgagatccaatgaaggatctggaacgcaagtattcggcttcccactgc

SEQ ID NO: 75652 - DNA, 75 bp, Artificial Sequence
  Synthetic
tgtcaggctattgaaggacactccttttatttcgcagcaaaactttttccagggccccgtggaagacgcgataac

SEQ ID NO: 75653 - DNA, 75 bp, Artificial Sequence
  Synthetic
cccagactatgtcaataccaaaaggctggcaacgtgaattttgaacccactggtgtgactgagggtaggacagat

SEQ ID NO: 75654 - DNA, 75 bp, Artificial Sequence
  Synthetic
aaggccctcgtcaagatagtgtcagcactcgtgatcgtggtgagaaatcacgatgacctcattacggtcaccgcc

SEQ ID NO: 75655 - DNA, 75 bp, Artificial Sequence
  Synthetic
cgccgcgtatgtccgtaccgtttttgagcattggcaacgcttattcaaatttctatgatgggtggtctgaatttt

SEQ ID NO: 75656 - DNA, 75 bp, Artificial Sequence
  Synthetic
cactagccctcattggttgtacctcgtccccatggcggtggcttaagcagaaagtgtcccaatattacggaatac

SEQ ID NO: 75657 - DNA, 75 bp, Artificial Sequence
  Synthetic
ccccctgttagagagtcaaattgccacaatcgagcaaagtgcaccgtcacagagtgaccaggagcaattgttttc

SEQ ID NO: 75658 - DNA, 75 bp, Artificial Sequence
  Synthetic
gcctcaacgactcagtagcaatgaggcagacgtttggaaacctatataagactttccacctcaacccgggcatcg

SEQ ID NO: 75659 - DNA, 75 bp, Artificial Sequence
  Synthetic
atacagttcaagtccaaatgccgtattgagcctgtatgtctgctcctgcatgggagtcccggtgcaggtaagtca

SEQ ID NO: 75660 - DNA, 75 bp, Artificial Sequence
  Synthetic
gttgcaacaaatctgatcggaagatcactcgcggaaaagttaaacagctcagtgtattcactacccccagaccca

SEQ ID NO: 75661 - DNA, 75 bp, Artificial Sequence
  Synthetic
ggccgccctggaagagaaaggcatcttgttcacctccccgttcgttttggcatcaaccaatgcgggatctattaa

SEQ ID NO: 75662 - DNA, 75 bp, Artificial Sequence
  Synthetic
gtacagccaaaatggcaagataaacatgccaatgtcagtgaagacgtgtgatgaagagtgttgcccagtcaactt

SEQ ID NO: 75663 - DNA, 75 bp, Artificial Sequence
  Synthetic
agatatgctggtaactgagatgtttagggaatacaaccacaggcacagtgtcggggctacccttgaggcactgtt

SEQ ID NO: 75664 - DNA, 75 bp, Artificial Sequence
  Synthetic
agggaatacaaccacaggcacagtgtcggggctacccttgaggcactgttccagggtccaccagtatacagagag

SEQ ID NO: 75665 - DNA, 75 bp, Artificial Sequence
  Synthetic
cttgcttaaatcagtggatagcgaagccgtgagagagtattgcaaagaaaagggatggttggttcctgaggtcaa

SEQ ID NO: 75666 - DNA, 75 bp, Artificial Sequence
  Synthetic
aggcaataactacgtttgtgtcagtagctggaatcatctatataatatacaagctctttgcaggctttcaaggtg

SEQ ID NO: 75667 - DNA, 75 bp, Artificial Sequence
  Synthetic
tttatgataggtgggccgttttgccacgtcatgccaaacccggaccaaccatcctgatgaatgaccaggaggtag

SEQ ID NO: 75668 - DNA, 75 bp, Artificial Sequence
  Synthetic
caccaggggtgtttgctggttgtgtgtgtgccagaggctgaaatggggtgcactaacaaggaaaatacccctttg

SEQ ID NO: 75669 - DNA, 75 bp, Artificial Sequence
  Synthetic
acgagaagttcagagacatcagaggcttcttagcaaaggaggaggtggaagtcaacgaggccgtgctagcaatta

SEQ ID NO: 75670 - DNA, 75 bp, Artificial Sequence
  Synthetic
cttcttagcaaaggaggaggtggaagtcaacgaggccgtgctagcaattaataccagtaaatttcccaacatgta

SEQ ID NO: 75671 - DNA, 75 bp, Artificial Sequence
  Synthetic
caacttccccacgagagcaggtcaatgtggcggagtactcatgtccaccggcaaagtcctggggatccatgttgg

SEQ ID NO: 75672 - DNA, 75 bp, Artificial Sequence
  Synthetic
tgtggcggagtactcatgtccaccggcaaagtcctggggatccatgttggtggaaatggtcatcaaggtttctca

SEQ ID NO: 75673 - DNA, 75 bp, Artificial Sequence
  Synthetic
ttccctattatcaacacacctagtaagactaagctggagccgagtgtcttccaccaggtttttgaaggtgacaaa

SEQ ID NO: 75674 - DNA, 75 bp, Artificial Sequence
  Synthetic
ccaccaggtttttgaaggtgacaaagagccagcggtcctcaggaatggtgatccacgcctcaaagtcaactttga

SEQ ID NO: 75675 - DNA, 75 bp, Artificial Sequence
  Synthetic
ttatgccggacaattggccaccctagacattagcactgaaccaatgaagttggaggatgctgtatacggtactga

SEQ ID NO: 75676 - DNA, 75 bp, Artificial Sequence
  Synthetic
agtccaggctcattgaggcgtccagtttgaatgactctgtggcaatgagacagacattcggcaacttgtacaaaa

SEQ ID NO: 75677 - DNA, 75 bp, Artificial Sequence
  Synthetic
acttggttactcgcacaaggagaccaattacattgattacctgtgcaactcccatcacctgtacagggacaaaca

SEQ ID NO: 75678 - DNA, 75 bp, Artificial Sequence
  Synthetic
agcagatgaacaatacccctttttagtgcaccccgttatgcccatgaaagacatacacgaatcaatcagatggac

SEQ ID NO: 75679 - DNA, 75 bp, Artificial Sequence
  Synthetic
cctggcacaacggggagcacgaatatgaggagtttatccgcaaaatcaggagcgtcccagttggacgttgtttga

SEQ ID NO: 75680 - DNA, 75 bp, Artificial Sequence
  Synthetic
tgagcaccaccacagcccacgggtgtgacaccattgccaggtgtcgatgtacaacaggcgtatacttctgcgcat

SEQ ID NO: 75681 - DNA, 75 bp, Artificial Sequence
  Synthetic
ctctggtattacggtacccttgtgcgcctgttttatccacccctcccgatgtaacttagaagttgatcaaagaaa

SEQ ID NO: 75682 - DNA, 75 bp, Artificial Sequence
  Synthetic
gtaacttagaagttgatcaaagaaaaggtcagtaggatgcccagtacaccaactgggttttgaccaagcacttct

SEQ ID NO: 75683 - DNA, 75 bp, Artificial Sequence
  Synthetic
aactgggttttgaccaagcacttctgttaccccggaccgagtatcaataggccactcacgtggctgaaggagaaa

SEQ ID NO: 75684 - DNA, 75 bp, Artificial Sequence
  Synthetic
actctgcagcggaaccgactactttgggtgtccgtgtttccttttattcttatactggctgcttatggtgacaat

SEQ ID NO: 75685 - DNA, 75 bp, Artificial Sequence
  Synthetic
tgggaaattgttaccatatagctattggattggccacccggtttgcaacagagcacttgtatttctgtttgttgg

SEQ ID NO: 75686 - DNA, 75 bp, Artificial Sequence
  Synthetic
tacagaactttactctacattgtccaattgaatacaaaaagatgggggcacaggtttcaacacagaaaactggtg

SEQ ID NO: 75687 - DNA, 75 bp, Artificial Sequence
  Synthetic
aattgaatacaaaaagatgggggcacaggtttcaacacagaaaactggtgcgcatgagacaggtctgaatgcaag

SEQ ID NO: 75688 - DNA, 75 bp, Artificial Sequence
  Synthetic
gttctcccttgagaagaagatgagcaattacatacagttcaagtccaaatgccgtattgaaccagtatgcctgct

SEQ ID NO: 75689 - DNA, 75 bp, Artificial Sequence
  Synthetic
aattacatacagttcaagtccaaatgccgtattgaaccagtatgcctgctcttgcacggaagccctggtgcggga

SEQ ID NO: 75690 - DNA, 75 bp, Artificial Sequence
  Synthetic
ctttgcacaggaccccggcaagtttaccgaacctgtcaaggacatcatgataaagtcgttgccggctctaaactc

SEQ ID NO: 75691 - DNA, 75 bp, Artificial Sequence
  Synthetic
accgaacctgtcaaggacatcatgataaagtcgttgccggctctaaactctccaagtgcagaggaatgtggttac

SEQ ID NO: 75692 - DNA, 75 bp, Artificial Sequence
  Synthetic
gatccggaccatttcgatggctataaacaacaagctgttgtgattatggatgacttatgtcaaaatccagatggc

SEQ ID NO: 75693 - DNA, 75 bp, Artificial Sequence
  Synthetic
aacaacaagctgttgtgattatggatgacttatgtcaaaatccagatggcaaggatgtatctttgttctgccaaa

SEQ ID NO: 75694 - DNA, 75 bp, Artificial Sequence
  Synthetic
tacggtgagtggccacaatacctatctgacaaagaagccacggcagaagaccaacccactcaacctgatgtggcc

SEQ ID NO: 75695 - DNA, 75 bp, Artificial Sequence
  Synthetic
ctgacaaagaagccacggcagaagaccaacccactcaacctgatgtggccacctgcaggttttacacactggaat

SEQ ID NO: 75696 - DNA, 75 bp, Artificial Sequence
  Synthetic
ttctggcatcgaccaacgccggatccatcaatgcccctacagtctcggacagtcgagcactggccaggagattcc

SEQ ID NO: 75697 - DNA, 75 bp, Artificial Sequence
  Synthetic
catcaatgcccctacagtctcggacagtcgagcactggccaggagattccactttgacatgaatattgaggtcat

SEQ ID NO: 75698 - DNA, 75 bp, Artificial Sequence
  Synthetic
gacagaacatgcactaccattacttgggcagggctgggtacaccattcatgtgcagtgtaatgcgtctaagtttc

SEQ ID NO: 75699 - DNA, 75 bp, Artificial Sequence
  Synthetic
gggcagggctgggtacaccattcatgtgcagtgtaatgcgtctaagtttcatcaagggtgtttgcttgtggtgtg

SEQ ID NO: 75700 - DNA, 75 bp, Artificial Sequence
  Synthetic
caactttaaaaagtgttgccccctagtatgtgggaaggccatccaattcatagacaggaggactcaagtgagata

SEQ ID NO: 75701 - DNA, 75 bp, Artificial Sequence
  Synthetic
tagacaggaggactcaagtgagatattcccttgatatgctagtcacagaaatgttcagagaatacaaccataggc

SEQ ID NO: 75702 - DNA, 75 bp, Artificial Sequence
  Synthetic
accacatacattcactgagggagcatccactggaaagcaggtacaaacagctgtgtgcaatgcgggcatgggtgt

SEQ ID NO: 75703 - DNA, 75 bp, Artificial Sequence
  Synthetic
tccactggaaagcaggtacaaacagctgtgtgcaatgcgggcatgggtgtaggtgtcggtaacctaaccatcttc

SEQ ID NO: 75704 - DNA, 75 bp, Artificial Sequence
  Synthetic
cgcagatctgctcaagtcagtggacagtgaagcggttagagagtactgcaaggaaaagggatggttggtgcccga

SEQ ID NO: 75705 - DNA, 75 bp, Artificial Sequence
  Synthetic
gacaacatgtttagacactacaacttcactctcatgattatcccatttgcgcccctggccttttccacgggggct

SEQ ID NO: 75706 - DNA, 75 bp, Artificial Sequence
  Synthetic
accacctatgtgccaataacagtcaccatcgccccaatgcatgcagagtacaatggtttgagacttgggtccacc

SEQ ID NO: 75707 - DNA, 75 bp, Artificial Sequence
  Synthetic
gtccgtggcaggtatcatatacattatttacaagctttttgcaggatttcagggtgcgtacacggggctgcctaa

SEQ ID NO: 75708 - DNA, 75 bp, Artificial Sequence
  Synthetic
atttacaagctttttgcaggatttcagggtgcgtacacggggctgcctaatcaaaaaccgaagataccaaccttg

SEQ ID NO: 75709 - DNA, 75 bp, Artificial Sequence
  Synthetic
atgccgcaatttgacgttacccctgagatgcacattcccggtgaggtgagaaacttaatggaaatcgctgaggtt

SEQ ID NO: 75710 - DNA, 75 bp, Artificial Sequence
  Synthetic
acggaatatggggagttcactatgttaggcatttatgacagatgggccgttctcccacgccatgccaagcctggg

SEQ ID NO: 75711 - DNA, 75 bp, Artificial Sequence
  Synthetic
agatgcacattcccggtgaggtgagaaacttaatggaaatcgctgaggttgattcagtgatgcccgtcaacaacg

SEQ ID NO: 75712 - DNA, 75 bp, Artificial Sequence
  Synthetic
taggcatttatgacagatgggccgttctcccacgccatgccaagcctgggccaactattctcatgaatgatcaag

SEQ ID NO: 75713 - DNA, 75 bp, Artificial Sequence
  Synthetic
tcttcagcttccaagtggacccaggttacagcacggtgctaaaccgcacactgatgggggaaatgctaaattact

SEQ ID NO: 75714 - DNA, 75 bp, Artificial Sequence
  Synthetic
accgtaatgagaaattcagggatatcagaggtttcttagctagagaagaagtggaagtcaacgaggctgttctgg

SEQ ID NO: 75715 - DNA, 75 bp, Artificial Sequence
  Synthetic
ttacagcacggtgctaaaccgcacactgatgggggaaatgctaaattactatgctcattggtcaggtagcatgaa

SEQ ID NO: 75716 - DNA, 75 bp, Artificial Sequence
  Synthetic
cagaggtttcttagctagagaagaagtggaagtcaacgaggctgttctggcaatcaacactagcaaattccccaa

SEQ ID NO: 75717 - DNA, 75 bp, Artificial Sequence
  Synthetic
cgtgccgactagcaggaagcaagccatgttgggcactcacataatatgggatctgggcttgcagtcaagttgtgt

SEQ ID NO: 75718 - DNA, 75 bp, Artificial Sequence
  Synthetic
catgtacaacttccccactagagcgggccaatgcggcggtgtcctcatgtccactggcaaggtgttaggcatcca

SEQ ID NO: 75719 - DNA, 75 bp, Artificial Sequence
  Synthetic
atgttgggcactcacataatatgggatctgggcttgcagtcaagttgtgtgttatgtgtaccatggatcagtcaa

SEQ ID NO: 75720 - DNA, 75 bp, Artificial Sequence
  Synthetic
ggccaatgcggcggtgtcctcatgtccactggcaaggtgttaggcatccatgtcggaggaaacggtcaccaaggc

SEQ ID NO: 75721 - DNA, 75 bp, Artificial Sequence
  Synthetic
gtcgtgcccgctgatactccgcaaaagtgcgtggtgttaggctttgcatctgcttgcaacgacttctctgtgcgc

SEQ ID NO: 75722 - DNA, 75 bp, Artificial Sequence
  Synthetic
gcagggttcccagttattaacacaccaagcaagaccaaactggaaccaagtgtctttcaccaggtttttgagggc

SEQ ID NO: 75723 - DNA, 75 bp, Artificial Sequence
  Synthetic
agtgcgtggtgttaggctttgcatctgcttgcaacgacttctctgtgcgcttgttgcgtgatactccattcatag

SEQ ID NO: 75724 - DNA, 75 bp, Artificial Sequence
  Synthetic
caagcaagaccaaactggaaccaagtgtctttcaccaggtttttgagggcaacaaggaaccggcggtactcagaa

SEQ ID NO: 75725 - DNA, 75 bp, Artificial Sequence
  Synthetic
cgatgcaagttcctgctctcaccgcggtagagacggggcacacctctcaggttgtacccggtgacactatacaga

SEQ ID NO: 75726 - DNA, 75 bp, Artificial Sequence
  Synthetic
tagacgagtacatgctagaagcagtggaccactatgcagggcaactggccaccctcgacatcagcactgaaccaa

SEQ ID NO: 75727 - DNA, 75 bp, Artificial Sequence
  Synthetic
ggtagagacggggcacacctctcaggttgtacccggtgacactatacagactagacatgtggttaacttccactc

SEQ ID NO: 75728 - DNA, 75 bp, Artificial Sequence
  Synthetic
ggaccactatgcagggcaactggccaccctcgacatcagcactgaaccaatgaaactggaagatgcagtgtatgg

SEQ ID NO: 75729 - DNA, 75 bp, Artificial Sequence
  Synthetic
cacaacagataaaacaaagcgctacaccaattgggatataaacatcagggagatggtccaattgagaagaaaatg

SEQ ID NO: 75730 - DNA, 75 bp, Artificial Sequence
  Synthetic
agacatcctatcaaagaaaaccaaggatctaaccaaactgaaggagtgcatggacaaatacggtctgaacctacc

SEQ ID NO: 75731 - DNA, 75 bp, Artificial Sequence
  Synthetic
accaattgggatataaacatcagggagatggtccaattgagaagaaaatgtgagctgtttacatacatgcgcttt

SEQ ID NO: 75732 - DNA, 75 bp, Artificial Sequence
  Synthetic
gatctaaccaaactgaaggagtgcatggacaaatacggtctgaacctaccaatggtaacttacgtgaaagatgag

SEQ ID NO: 75733 - DNA, 75 bp, Artificial Sequence
  Synthetic
acacaccagattatgtatataccgcctggaggccccataccccaagaagtgaacagttatgcgtggcaaacgtcc

SEQ ID NO: 75734 - DNA, 75 bp, Artificial Sequence
  Synthetic
atgagacaaacattcggtaacctgtataagacattccaccaaaatccagggattataacaggcagtgcagttgga

SEQ ID NO: 75735 - DNA, 75 bp, Artificial Sequence
  Synthetic
ctggaggccccataccccaagaagtgaacagttatgcgtggcaaacgtccaccaacccaagtgtattctggacag

SEQ ID NO: 75736 - DNA, 75 bp, Artificial Sequence
  Synthetic
ataagacattccaccaaaatccagggattataacaggcagtgcagttggatgcgaccctgacctcttctggagta

SEQ ID NO: 75737 - DNA, 75 bp, Artificial Sequence
  Synthetic
ggtcacacttctcccagaccggggtgtacgggtacacgacgctcaactcgatgggcaaactatacatcaggcatg

SEQ ID NO: 75738 - DNA, 75 bp, Artificial Sequence
  Synthetic
ggtttgcctgtttgaagctgctacttgagaaactcgggtacacacacaatgagacgaattacattgactacttgt

SEQ ID NO: 75739 - DNA, 75 bp, Artificial Sequence
  Synthetic
gtacgggtacacgacgctcaactcgatgggcaaactatacatcaggcatgtgaacgcgagcacacccactcaaat

SEQ ID NO: 75740 - DNA, 75 bp, Artificial Sequence
  Synthetic
tgagaaactcgggtacacacacaatgagacgaattacattgactacttgtgtaattctcaccatctgtacaggga

SEQ ID NO: 75741 - DNA, 75 bp, Artificial Sequence
  Synthetic
gtacaaaaccaaagctagtgtagattttgaagtcacgaaagtcacggaagagagagaaagtatcaactcagtgcc

SEQ ID NO: 75742 - DNA, 75 bp, Artificial Sequence
  Synthetic
catcatcattaggactctaatgctgaaggtgtacaaaggtattgaccttgaccaattcaggatgattgcttatgg

SEQ ID NO: 75743 - DNA, 75 bp, Artificial Sequence
  Synthetic
tttgaagtcacgaaagtcacggaagagagagaaagtatcaactcagtgccacaagtggatcactcgctacgaaca

SEQ ID NO: 75744 - DNA, 75 bp, Artificial Sequence
  Synthetic
aaggtgtacaaaggtattgaccttgaccaattcaggatgattgcttatggtgatgatgtgattgcatcatatcct

SEQ ID NO: 75745 - DNA, 75 bp, Artificial Sequence
  Synthetic
cacactgattggcaaaactgcgtgtgggaagattacaatagggacttgctagtcagtacgaccacagcccatggt

SEQ ID NO: 75746 - DNA, 75 bp, Artificial Sequence
  Synthetic
gagtgtttcaatgaggtgacatggaccaacgtcacctttctaaaaagatattttagagcagatgagcaatatccc

SEQ ID NO: 75747 - DNA, 75 bp, Artificial Sequence
  Synthetic
gggaagattacaatagggacttgctagtcagtacgaccacagcccatggttgcgacaccatagctagatgtcggt

SEQ ID NO: 75748 - DNA, 75 bp, Artificial Sequence
  Synthetic
ccaacgtcacctttctaaaaagatattttagagcagatgagcaatatcccttcctagtccaccctgtaatgccca

SEQ ID NO: 75749 - DNA, 75 bp, Artificial Sequence
  Synthetic
aagtccaagaaaatgaatactaccctaagaggtaccagtcacatgtgttgttggctgcgggcttttcagagccag

SEQ ID NO: 75750 - DNA, 75 bp, Artificial Sequence
  Synthetic
ttttggcttggcacaacggggagcacgaatatgaggaattcgtccgtaaaatcagaagcgttccagtcgggcgct

SEQ ID NO: 75751 - DNA, 75 bp, Artificial Sequence
  Synthetic
taagaggtaccagtcacatgtgttgttggctgcgggcttttcagagccaggggactgtggtggaatcctaaggtg

SEQ ID NO: 75752 - DNA, 75 bp, Artificial Sequence
  Synthetic
ttttaatatagagacaatttgatataatttaaattggcttaaccctactacaccaaccgaactagacagcggtgt

SEQ ID NO: 75753 - DNA, 75 bp, Artificial Sequence
  Synthetic
gtggctggaagatgacgctatggaacaaggtgtcaaggattatgtggagcagctcggaaacgctttcggttccgg

SEQ ID NO: 75754 - DNA, 75 bp, Artificial Sequence
  Synthetic
caaggtgtcaaggattatgtggagcagctcggaaacgctttcggttccggttttactaaccagatttgtgagcag

SEQ ID NO: 75755 - DNA, 75 bp, Artificial Sequence
  Synthetic
atttcagcattagttatcgtggtgagaaatcacgatgacttaatcacagtaaccgccacccttgcactgattggt

SEQ ID NO: 75756 - DNA, 75 bp, Artificial Sequence
  Synthetic
aaccgccacccttgcactgattggttgtacctcatcaccgtggcgttggcttaagcaaaaagtgtcacagtacta

SEQ ID NO: 75757 - DNA, 75 bp, Artificial Sequence
  Synthetic
ctgagatgacaaacgcctgtaagggcatggagtggatagcagttaaaattcaaaaattcattgagtggctgaagg

SEQ ID NO: 75758 - DNA, 75 bp, Artificial Sequence
  Synthetic
catggagtggatagcagttaaaattcaaaaattcattgagtggctgaaggtaaagatcctgccagaggttaagga

SEQ ID NO: 75759 - DNA, 75 bp, Artificial Sequence
  Synthetic
accttcacaggatgaccaagaacagttgttctcgaatgtccaatactttgcacattactgcagaaagtatgcgcc

SEQ ID NO: 75760 - DNA, 75 bp, Artificial Sequence
  Synthetic
ttgttctcgaatgtccaatactttgcacattactgcagaaagtatgcgcccctgtacgccactgaagcaaagaga

SEQ ID NO: 75761 - DNA, 75 bp, Artificial Sequence
  Synthetic
ttgctccatggaagtcccggtgccggaaaatccgtggcaaccaatttgatcggacgctcacttgctgagaagctc

SEQ ID NO: 75762 - DNA, 75 bp, Artificial Sequence
  Synthetic
caggtgtcgactcaaaaaaccggagcgcacgaaactagtgtgaatgcgaccgggagctctatagtccactacacc

SEQ ID NO: 75763 - DNA, 75 bp, Artificial Sequence
  Synthetic
gaaaatccgtggcaaccaatttgatcggacgctcacttgctgagaagctcaacagctcagtgtactcgttaccac

SEQ ID NO: 75764 - DNA, 75 bp, Artificial Sequence
  Synthetic
cgcacgaaactagtgtgaatgcgaccgggagctctatagtccactacaccaacataaatttctacaaggacgctg

SEQ ID NO: 75765 - DNA, 75 bp, Artificial Sequence
  Synthetic
ggaaagatgtatctctattttgtcagatggtgtctagtgtggattttgtacctcccatggcagccttggaagaga

SEQ ID NO: 75766 - DNA, 75 bp, Artificial Sequence
  Synthetic
tgaagactctcccagcgctgaattcaccgagtgcggaggagtgcggatatagcgacagggtgcgttcacttacat

SEQ ID NO: 75767 - DNA, 75 bp, Artificial Sequence
  Synthetic
gatggtgtctagtgtggattttgtacctcccatggcagccttggaagagaaagggatcctcttcacatcgccatt

SEQ ID NO: 75768 - DNA, 75 bp, Artificial Sequence
  Synthetic
accgagtgcggaggagtgcggatatagcgacagggtgcgttcacttacattgggtaactcaaccatcaccacaca

SEQ ID NO: 75769 - DNA, 75 bp, Artificial Sequence
  Synthetic
tcatttcgacatgaatatcgaggtaatctcgatgtacagtcaaaatgggaaaattaacatgcccatgtctgtcaa

SEQ ID NO: 75770 - DNA, 75 bp, Artificial Sequence
  Synthetic
tcaacccacacagcctgacgtggccacctgtcggttttacactctagattcgatacagtggcagaaaacatcgcc

SEQ ID NO: 75771 - DNA, 75 bp, Artificial Sequence
  Synthetic
atctcgatgtacagtcaaaatgggaaaattaacatgcccatgtctgtcaaaacttgtgatgaagaatgttgccct

SEQ ID NO: 75772 - DNA, 75 bp, Artificial Sequence
  Synthetic
acctgtcggttttacactctagattcgatacagtggcagaaaacatcgccaggatggtggtggaagtttccagac

SEQ ID NO: 75773 - DNA, 75 bp, Artificial Sequence
  Synthetic
tactcactagacatgctggtcactgaaatgttcagagaatacagccacaggcacagtgtgggtgccacccttgag

SEQ ID NO: 75774 - DNA, 75 bp, Artificial Sequence
  Synthetic
gtccaatgcaacgcatccaaattccaccaggggtgcttgttggttgtgtgtgtgcccgaggcggaaatgggagga

SEQ ID NO: 75775 - DNA, 75 bp, Artificial Sequence
  Synthetic
gcacagtgtgggtgccacccttgaggccctgtttcaaggaccacctatatataaagagatcaaaattagtgtggc

SEQ ID NO: 75776 - DNA, 75 bp, Artificial Sequence
  Synthetic
accaggggtgcttgttggttgtgtgtgtgcccgaggcggaaatgggaggacgacccacaggacaagcatttttga

SEQ ID NO: 75777 - DNA, 75 bp, Artificial Sequence
  Synthetic
atagtgaggttgtgagagagtactgcaaagagaggggctggattgtgccagagatcaactccactctgcaaattg

SEQ ID NO: 75778 - DNA, 75 bp, Artificial Sequence
  Synthetic
aagctgcagtgtgcaatgctgggatgggagtaggagttggcaacctaacaatatacccacaccagtggataaact

SEQ ID NO: 75779 - DNA, 75 bp, Artificial Sequence
  Synthetic
caaagagaggggctggattgtgccagagatcaactccactctgcaaattgaaaaacacgtcagcagggcttttat

SEQ ID NO: 75780 - DNA, 75 bp, Artificial Sequence
  Synthetic
gggagtaggagttggcaacctaacaatatacccacaccagtggataaacttgcgcaccaacaattgtgccacgat

SEQ ID NO: 75781 - DNA, 75 bp, Artificial Sequence
  Synthetic
ccagggtgcatacacagggatgccaaaccagaaacccaaagtgcccaccctaaggcaagccaaagtgcaaggtcc

SEQ ID NO: 75782 - DNA, 75 bp, Artificial Sequence
  Synthetic
ctttgtaccccttgacagcaatggtggcaccacttacgtgccaataacagtcacggtagcaccaatgtgcgcaga

SEQ ID NO: 75783 - DNA, 75 bp, Artificial Sequence
  Synthetic
aaccagaaacccaaagtgcccaccctaaggcaagccaaagtgcaaggtccagcatttgaattcgcagtggcaatg

SEQ ID NO: 75784 - DNA, 75 bp, Artificial Sequence
  Synthetic
ggcaccacttacgtgccaataacagtcacggtagcaccaatgtgcgcagagtacaacggcttacgcttgtctgcg

SEQ ID NO: 75785 - DNA, 75 bp, Artificial Sequence
  Synthetic
gtgctgccacggcacgccaagcctggtcctaccattctgatgaatgatcaagaggttggcgtgctggacgccaaa

SEQ ID NO: 75786 - DNA, 75 bp, Artificial Sequence
  Synthetic
agtgcaatgcccgagtacgacgttacacccgtcctccgcataccaggggaagtacacaatctgatggagatagcc

SEQ ID NO: 75787 - DNA, 75 bp, Artificial Sequence
  Synthetic
gtcctaccattctgatgaatgatcaagaggttggcgtgctggacgccaaagagctagtggacaaggatgggacaa

SEQ ID NO: 75788 - DNA, 75 bp, Artificial Sequence
  Synthetic
cacccgtcctccgcataccaggggaagtacacaatctgatggagatagccgaggttgattcggtggttcctgtga

SEQ ID NO: 75789 - DNA, 75 bp, Artificial Sequence
  Synthetic
aggttggagtgagtgaggcagtgctcgcaatcaacacaagcaaattcccaaacatgtacattccagtgggtcaag

SEQ ID NO: 75790 - DNA, 75 bp, Artificial Sequence
  Synthetic
aagcaatattcgcattccagcttgacccgggtcatagtagcgtgttaagcaggaccctattgggagagattttaa

SEQ ID NO: 75791 - DNA, 75 bp, Artificial Sequence
  Synthetic
cgcaatcaacacaagcaaattcccaaacatgtacattccagtgggtcaagtcactgattatggcttcttaaattt

SEQ ID NO: 75792 - DNA, 75 bp, Artificial Sequence
  Synthetic
cccgggtcatagtagcgtgttaagcaggaccctattgggagagattttaaattattatgctcattggtctggcag

SEQ ID NO: 75793 - DNA, 75 bp, Artificial Sequence
  Synthetic
gtcaacagggaaggtgcttgggatacatgtggggggtaacggccaccaaggcttcgcagcagcactccttaggca

SEQ ID NO: 75794 - DNA, 75 bp, Artificial Sequence
  Synthetic
ggctaaggtgccagaaaagagaaaggatgccatgttaggaacacacatcatatgggacctcgggttgcaatccag

SEQ ID NO: 75795 - DNA, 75 bp, Artificial Sequence
  Synthetic
gatgccatgttaggaacacacatcatatgggacctcgggttgcaatccagttgcgtgttatgtgtaccgtggatc

SEQ ID NO: 75796 - DNA, 75 bp, Artificial Sequence
  Synthetic
ttacttcaatgaggagcagggtgaaatagagttcattgaaagttcaaaagatgcaggattccccacaatcaatac

SEQ ID NO: 75797 - DNA, 75 bp, Artificial Sequence
  Synthetic
aacatcattgtgcctccaaaaacccccactgactgtcgtgtgttgtgcttcgtatccgcttgcaacgatttctct

SEQ ID NO: 75798 - DNA, 75 bp, Artificial Sequence
  Synthetic
aaacggggacccgagactcaaggtcaattttgaggaggcaatcttttccaaatacatcggcaatgtcaacactca

SEQ ID NO: 75799 - DNA, 75 bp, Artificial Sequence
  Synthetic
aattttgaggaggcaatcttttccaaatacatcggcaatgtcaacactcacgtggatgagtatatgcaagaggcc

SEQ ID NO: 75800 - DNA, 75 bp, Artificial Sequence
  Synthetic
ccactgactgtcgtgtgttgtgcttcgtatccgcttgcaacgatttctctgtgcggatgttgcgtgacacaccat

SEQ ID NO: 75801 - DNA, 75 bp, Artificial Sequence
  Synthetic
cttcaaactcagaacaagttccagcactgactgcagtggagacagggcacacctcccaagtgacacccagtgaca

SEQ ID NO: 75802 - DNA, 75 bp, Artificial Sequence
  Synthetic
ggtactgagggattggaagcactagacttaaccaccagcgcaggctacccttacgtggccctaggcatcaagaaa

SEQ ID NO: 75803 - DNA, 75 bp, Artificial Sequence
  Synthetic
acttaaccaccagcgcaggctacccttacgtggccctaggcatcaagaaaagggacattctttcaaagaaaacca

SEQ ID NO: 75804 - DNA, 75 bp, Artificial Sequence
  Synthetic
actgactgcagtggagacagggcacacctcccaagtgacacccagtgacaccatccagactaggcatgtggcgaa

SEQ ID NO: 75805 - DNA, 75 bp, Artificial Sequence
  Synthetic
cgcatcaggcggtgatgagggggatgtaaaaaggtacgctgtctgggacatcagcgtaaaagacatggttcaaat

SEQ ID NO: 75806 - DNA, 75 bp, Artificial Sequence
  Synthetic
agttgagatctgctgagaaggtagccaagggcaagtccagacttattgaggcttctagcctcaacgactcagtgg

SEQ ID NO: 75807 - DNA, 75 bp, Artificial Sequence
  Synthetic
caagggcaagtccagacttattgaggcttctagcctcaacgactcagtggccatgagacagacatttgggaatct

SEQ ID NO: 75808 - DNA, 75 bp, Artificial Sequence
  Synthetic
gtaaaaaggtacgctgtctgggacatcagcgtaaaagacatggttcaaatgagaaggaagtgtgagatgttcaca

SEQ ID NO: 75809 - DNA, 75 bp, Artificial Sequence
  Synthetic
ccagtcgtgacacaccagataatgtatattccacccggaggccccataccgaccaaagtcgatgggtatgaatgg

SEQ ID NO: 75810 - DNA, 75 bp, Artificial Sequence
  Synthetic
caaaattcctgttatgcttgacggacacctcatagcgtttgactactcaagttatgatgccagtttaagcccggt

SEQ ID NO: 75811 - DNA, 75 bp, Artificial Sequence
  Synthetic
cacctcatagcgtttgactactcaagttatgatgccagtttaagcccggtgtggtttgcatgcctgaagcttctt

SEQ ID NO: 75812 - DNA, 75 bp, Artificial Sequence
  Synthetic
atattccacccggaggccccataccgaccaaagtcgatgggtatgaatggcagacatcaaccaaccctagcgtct

SEQ ID NO: 75813 - DNA, 75 bp, Artificial Sequence
  Synthetic
acgacggatggtccaactttgagcaaacaggttcgtatggttataacaatttgaatcacatggggaaactgtata

SEQ ID NO: 75814 - DNA, 75 bp, Artificial Sequence
  Synthetic
gataagcactactttgtgaggggtgggatgccatcagggtgttcaggcaccagcatattcaattccatgattaat

SEQ ID NO: 75815 - DNA, 75 bp, Artificial Sequence
  Synthetic
aacaggttcgtatggttataacaatttgaatcacatggggaaactgtatattagacatgtgaatgcaaatatcac

SEQ ID NO: 75816 - DNA, 75 bp, Artificial Sequence
  Synthetic
aacattataattaggaccctcatgttaaaagtatacaaagggattgacttggaccaatttaggatgatcgcctac

SEQ ID NO: 75817 - DNA, 75 bp, Artificial Sequence
  Synthetic
atgtaagtacttatataaggcaaaggtggacttcgatgttgaacctgttaccacggctagacagaacataaggga

SEQ ID NO: 75818 - DNA, 75 bp, Artificial Sequence
  Synthetic
gtggacttcgatgttgaacctgttaccacggctagacagaacataagggatacaagcaagctagggagccgaact

SEQ ID NO: 75819 - DNA, 75 bp, Artificial Sequence
  Synthetic
ctgattatgaccccagctgacaagggtgaatgcttcaacgaggttacatggacaaacgtgacctttttgaagagg

SEQ ID NO: 75820 - DNA, 75 bp, Artificial Sequence
  Synthetic
gtgaatgcttcaacgaggttacatggacaaacgtgacctttttgaagaggtatttcagggccgacgaacagtatc

SEQ ID NO: 75821 - DNA, 75 bp, Artificial Sequence
  Synthetic
aatagacatctagctactcacagtgactggcaaaactgcgtgtgggaggactacaacagagacctcttagtcagt

SEQ ID NO: 75822 - DNA, 75 bp, Artificial Sequence
  Synthetic
actggcaaaactgcgtgtgggaggactacaacagagacctcttagtcagtacaacaacagcacacggctgtgata

SEQ ID NO: 75823 - DNA, 75 bp, Artificial Sequence
  Synthetic
cgcaagaccacgtgcgttcgctatgcctactggcttggcataatggcgagcacgaatatgaggagttcattcgta

SEQ ID NO: 75824 - DNA, 75 bp, Artificial Sequence
  Synthetic
agggaccaggtttagtggaagttcaggaaagcgaatattacccaaagagataccagtcccacgtactactcgcag

SEQ ID NO: 75825 - DNA, 75 bp, Artificial Sequence
  Synthetic
acattacgcaggaggtggctggactccttctaaaattagagtacaattaactacgattggcttaaccctaccgca

SEQ ID NO: 75826 - DNA, 75 bp, Artificial Sequence
  Synthetic
ggaaagcgaatattacccaaagagataccagtcccacgtactactcgcagcggggttttcagaacctggcgattg

SEQ ID NO: 75827 - DNA, 75 bp, Artificial Sequence
  Synthetic
cgatgtgcgcgacctcctatggttagaggatgatgcaatggagcagggcgtcaaggactatgttgagcaattggg

SEQ ID NO: 75828 - DNA, 75 bp, Artificial Sequence
  Synthetic
caactgagtctcgaccaagcacttctgtttccccggaccgagtatcaataggctgcttacgcggctgaaggagaa

SEQ ID NO: 75829 - DNA, 75 bp, Artificial Sequence
  Synthetic
gaggatgatgcaatggagcagggcgtcaaggactatgttgagcaattgggtaacgcctttggttcaggcttcacc

SEQ ID NO: 75830 - DNA, 75 bp, Artificial Sequence
  Synthetic
aaagctctggtcaagattatctcagctctagtcatcgtagtgagaaatcacgacgatctcatcactgtgacagcc

SEQ ID NO: 75831 - DNA, 75 bp, Artificial Sequence
  Synthetic
ctctagtcatcgtagtgagaaatcacgacgatctcatcactgtgacagccactcttgctcttataggttgcaccg

SEQ ID NO: 75832 - DNA, 75 bp, Artificial Sequence
  Synthetic
actggttaaagaaattcacggagatgaccaacgcctgcaaaggcatggagtggatagcggtcaaaatccagaaat

SEQ ID NO: 75833 - DNA, 75 bp, Artificial Sequence
  Synthetic
gaatttctaaccaggctgaagcaactacctttgttagaaagtcagattgccactatcgaacaaagtgccccttca

SEQ ID NO: 75834 - DNA, 75 bp, Artificial Sequence
  Synthetic
ccctggaaaagaaaatgagcaactacatacagttcaagtccaaatgccgtattgaacccgtctgtctcttgctcc

SEQ ID NO: 75835 - DNA, 75 bp, Artificial Sequence
  Synthetic
cagtgtattccctaccaccagaccctgaccattttgatggctacaagcagcaggctgtcgtcattatggatgacc

SEQ ID NO: 75836 - DNA, 75 bp, Artificial Sequence
  Synthetic
tgaccattttgatggctacaagcagcaggctgtcgtcattatggatgacctgtgccaaaatccagatggtaaaga

SEQ ID NO: 75837 - DNA, 75 bp, Artificial Sequence
  Synthetic
cctgttcacttcaccatttgttctcgcctcaaccaatgccgggtcaatcaacgcccctacagtgtcagacagtag

SEQ ID NO: 75838 - DNA, 75 bp, Artificial Sequence
  Synthetic
gcctcaaccaatgccgggtcaatcaacgcccctacagtgtcagacagtagggcgcttgccaggagattccacttt

SEQ ID NO: 75839 - DNA, 75 bp, Artificial Sequence
  Synthetic
gatgatgagtgttgtccagtcaattttaagaagtgttgtccgttagtgtgtggcaaagctatccagtttattgac

SEQ ID NO: 75840 - DNA, 75 bp, Artificial Sequence
  Synthetic
ttaagaagtgttgtccgttagtgtgtggcaaagctatccagtttattgacagaaggacacaagtgaggtactcgc

SEQ ID NO: 75841 - DNA, 75 bp, Artificial Sequence
  Synthetic
tccaaggtccgcctgtgtacagagagatcaaaatcagtgtcgcaccggaaactccccccccaccagcgatagcag

SEQ ID NO: 75842 - DNA, 75 bp, Artificial Sequence
  Synthetic
gatcaaaatcagtgtcgcaccggaaactccccccccaccagcgatagcagatctgttaaaatctgtagatagtga

SEQ ID NO: 75843 - DNA, 75 bp, Artificial Sequence
  Synthetic
tgtgagcagggccttcatctgcctgcaagcgctcaccacgtttgtctccgtggcggggataatatatatcatcta

SEQ ID NO: 75844 - DNA, 75 bp, Artificial Sequence
  Synthetic
caagcgctcaccacgtttgtctccgtggcggggataatatatatcatctacaaattgtttgctggctttcaggga

SEQ ID NO: 75845 - DNA, 75 bp, Artificial Sequence
  Synthetic
gaaatgccagtactgtgaaaactgagtacggcgagttcacaatgcttggaatctatgacagatgggcagtgttgc

SEQ ID NO: 75846 - DNA, 75 bp, Artificial Sequence
  Synthetic
tagataaagatggtaccaacctggaactgacacttttgaaactcaacagaaatgagaagttcagagacattcgag

SEQ ID NO: 75847 - DNA, 75 bp, Artificial Sequence
  Synthetic
actgacacttttgaaactcaacagaaatgagaagttcagagacattcgaggcttcttgacacgagaagaggctga

SEQ ID NO: 75848 - DNA, 75 bp, Artificial Sequence
  Synthetic
ttatggcttcctcaacttaggaggaacccccaccaagcgtatgctaatgtataacttccccactcgtgcagggca

SEQ ID NO: 75849 - DNA, 75 bp, Artificial Sequence
  Synthetic
acccccaccaagcgtatgctaatgtataacttccccactcgtgcagggcagtgtggcggtgtcctaatgtcaaca

SEQ ID NO: 75850 - DNA, 75 bp, Artificial Sequence
  Synthetic
atcgatgaacagggtgagatcgagttcatcgagagttccaaggaagcaggcttcccagtcattaatacacccagc

SEQ ID NO: 75851 - DNA, 75 bp, Artificial Sequence
  Synthetic
tcatcgagagttccaaggaagcaggcttcccagtcattaatacacccagcaaaacaaagcttgagcccagtgttt

SEQ ID NO: 75852 - DNA, 75 bp, Artificial Sequence
  Synthetic
aggaagccattttctctaagtacattggcaatgtaaacacccatgtagacgagtacatgatggaagctgtggatc

SEQ ID NO: 75853 - DNA, 75 bp, Artificial Sequence
  Synthetic
cattcagtgttgatttcacgccagagccagtcaccgaaaagcgtgccaccattaacacagtcacgaccattcaat

SEQ ID NO: 75854 - DNA, 75 bp, Artificial Sequence
  Synthetic
aaggcttggaagcactggatttgaccaccagtgcagggtatccttatgtcgcccttggcattaaaaagagagata

SEQ ID NO: 75855 - DNA, 75 bp, Artificial Sequence
  Synthetic
atcagcagagaaggtggccaagggtaaatccaggcttattgaggcatcgagtctaaatgactcagtggccatgag

SEQ ID NO: 75856 - DNA, 75 bp, Artificial Sequence
  Synthetic
tttaggatgatagcatatggagatgatgtcatcgcgtcatatccgcatcctattgatgcatcactgttagctgag

SEQ ID NO: 75857 - DNA, 75 bp, Artificial Sequence
  Synthetic
tgactccagctgataagggagaatgctttaatgaagtgacatggaccaacgtcactttcttgaaaagatacttca

SEQ ID NO: 75858 - DNA, 75 bp, Artificial Sequence
  Synthetic
gcttggcataatggagagcaggaatatgaagaatttgtgtccaaaatcaggagcgtcccagtagggcgctgcttg

SEQ ID NO: 75859 - DNA, 75 bp, Artificial Sequence
  Synthetic
acccactgtgtcagacagtagagcgctcgccaggaggttccacttcgatatgaacatagaggtcatctctatgta

SEQ ID NO: 75860 - DNA, 75 bp, Artificial Sequence
  Synthetic
ctcaggtgtcgacccaaaagactggggcacacgagaccaagttgaatgccaacggcagctcaaccatacattata

SEQ ID NO: 75861 - DNA, 75 bp, Artificial Sequence
  Synthetic
ggcacacgagaccaagttgaatgccaacggcagctcaaccatacattatactaatataaatttttacaaggatgc

SEQ ID NO: 75862 - DNA, 75 bp, Artificial Sequence
  Synthetic
ggttaagtctcttccagcactaaattcacccagtgcagaggagtgtggatacagtgatagagtgagatccataac

SEQ ID NO: 75863 - DNA, 75 bp, Artificial Sequence
  Synthetic
tcacccagtgcagaggagtgtggatacagtgatagagtgagatccataacgttaggtaattcaacgatcaccacg

SEQ ID NO: 75864 - DNA, 75 bp, Artificial Sequence
  Synthetic
gaccagcccacgcagccggatgtcgccacatgtaggttttacaccttggaatctgttgattggacaaagaactca

SEQ ID NO: 75865 - DNA, 75 bp, Artificial Sequence
  Synthetic
ccacatgtaggttttacaccttggaatctgttgattggacaaagaactcacagggatggtggtggaaatttccag

SEQ ID NO: 75866 - DNA, 75 bp, Artificial Sequence
  Synthetic
acgttcagtgcaatgcgtccaaattccatcaagggtgcttgcttgtggtgtgtgtgcctgaggcggagatgggct

SEQ ID NO: 75867 - DNA, 75 bp, Artificial Sequence
  Synthetic
ccatcaagggtgcttgcttgtggtgtgtgtgcctgaggcggagatgggctgcgccatgaaagacggcaaggtttc

SEQ ID NO: 75868 - DNA, 75 bp, Artificial Sequence
  Synthetic
gcagaatgctgtgtgtaatgccgcaatgggggtgggtgtgggtaacttgaccatttacccgcaccagtggatcaa

SEQ ID NO: 75869 - DNA, 75 bp, Artificial Sequence
  Synthetic
atgggggtgggtgtgggtaacttgaccatttacccgcaccagtggatcaatctacgcactaacaacagtgccact

SEQ ID NO: 75870 - DNA, 75 bp, Artificial Sequence
  Synthetic
cccttcgccccattaaattactcaaataccaccacatttgttccaataacggtaacagtggcccccatgaatgca

SEQ ID NO: 75871 - DNA, 75 bp, Artificial Sequence
  Synthetic
ataccaccacatttgttccaataacggtaacagtggcccccatgaatgcagagtacaacggcctcaggctggggg

SEQ ID NO: 75872 - DNA, 75 bp, Artificial Sequence
  Synthetic
ctgctttaccccagtacgatgttactcctcccatgaatattgcaggtgaggtgaggaatttaatggaaattgctg

SEQ ID NO: 75873 - DNA, 75 bp, Artificial Sequence
  Synthetic
tcctcccatgaatattgcaggtgaggtgaggaatttaatggaaattgctgaggtcgactccgttgtgccgttgaa

SEQ ID NO: 75874 - DNA, 75 bp, Artificial Sequence
  Synthetic
acccatattctcatttcagttaagtcctggcagtagtagcgtgctcaaacgcacccttctgggtgagatgctgaa

SEQ ID NO: 75875 - DNA, 75 bp, Artificial Sequence
  Synthetic
cctggcagtagtagcgtgctcaaacgcacccttctgggtgagatgctgaattactatgcacactggtcagggagc

SEQ ID NO: 75876 - DNA, 75 bp, Artificial Sequence
  Synthetic
gcatcagtgccaaaaagccgaaaagatgcgatgcttggcacacacgtgatctgggatgttggcttacaatctagt

SEQ ID NO: 75877 - DNA, 75 bp, Artificial Sequence
  Synthetic
atgcgatgcttggcacacacgtgatctgggatgttggcttacaatctagttgtgttctttgtgtgccgtggatca

SEQ ID NO: 75878 - DNA, 75 bp, Artificial Sequence
  Synthetic
gcatagtcgtgccgccaaaaacccctactcaatgcgatgtaatgtgtttcgtatcagcatgtaatgacttctccg

SEQ ID NO: 75879 - DNA, 75 bp, Artificial Sequence
  Synthetic
tactcaatgcgatgtaatgtgtttcgtatcagcatgtaatgacttctccgtgagaatgctcagagatacaccttt

SEQ ID NO: 75880 - DNA, 75 bp, Artificial Sequence
  Synthetic
cagtggtccgagcaactcactggaagtcccgatgttaacagctgtggagactggtcacacatctcaagtggtgcc

SEQ ID NO: 75881 - DNA, 75 bp, Artificial Sequence
  Synthetic
gtcccgatgttaacagctgtggagactggtcacacatctcaagtggtgccaagcgataccatacagactaggcac

SEQ ID NO: 75882 - DNA, 75 bp, Artificial Sequence
  Synthetic
gttttgttccattgaattttaaagttctaaaaactcttgaccttatcttagtactcaatacggcaaaatgggagc

SEQ ID NO: 75883 - DNA, 75 bp, Artificial Sequence
  Synthetic
acatacaatgccaaaggggatgaggggtcgtacaccaggtacgcatcatgggaaatttccacccgtgagctggta

SEQ ID NO: 75884 - DNA, 75 bp, Artificial Sequence
  Synthetic
ggtcgtacaccaggtacgcatcatgggaaatttccacccgtgagctggtacagatgcgcaggaagatggaattgt

SEQ ID NO: 75885 - DNA, 75 bp, Artificial Sequence
  Synthetic
aagacatgcctgtactaacccatcaaattatgtacgtgccgcctggtgggccaaccccaaacagcgcaaccagtt

SEQ ID NO: 75886 - DNA, 75 bp, Artificial Sequence
  Synthetic
ctccaacggttgaggagtgtggatacagtgacagggtaaggtctattacgctgggtaattccaccatcactacac

SEQ ID NO: 75887 - DNA, 75 bp, Artificial Sequence
  Synthetic
aattatgtacgtgccgcctggtgggccaaccccaaacagcgcaaccagttatgcttggcaaacgtccaccaaccc

SEQ ID NO: 75888 - DNA, 75 bp, Artificial Sequence
  Synthetic
accaaccaacgcaaccggatgttgctacgtgtaggttttacacgcttgattccgtgcaatggcaaaagacatcac

SEQ ID NO: 75889 - DNA, 75 bp, Artificial Sequence
  Synthetic
caatttttatgatgggtggtcgcacttcactcaggatggggcttatgggtatacagctctaaaccgcatgggaaa

SEQ ID NO: 75890 - DNA, 75 bp, Artificial Sequence
  Synthetic
tacgtgtaggttttacacgcttgattccgtgcaatggcaaaagacatcaccagggtggtggtggaaactacctga

SEQ ID NO: 75891 - DNA, 75 bp, Artificial Sequence
  Synthetic
ttcactcaggatggggcttatgggtatacagctctaaaccgcatgggaaagatatacgtcaggcatgtgaacaaa

SEQ ID NO: 75892 - DNA, 75 bp, Artificial Sequence
  Synthetic
tgtacaatgcaatgcatccaaattccaccaagggtgcctattagtagtgtgtgtaccggaggccgaaatggggtg

SEQ ID NO: 75893 - DNA, 75 bp, Artificial Sequence
  Synthetic
cctccgcgactgtgcccgtatctgaggactgcagatgtcaatttcgaggtcacacaggttactgatacacgagca

SEQ ID NO: 75894 - DNA, 75 bp, Artificial Sequence
  Synthetic
caccaagggtgcctattagtagtgtgtgtaccggaggccgaaatggggtgtgcaaccctggacaatacaccatcg

SEQ ID NO: 75895 - DNA, 75 bp, Artificial Sequence
  Synthetic
ggactgcagatgtcaatttcgaggtcacacaggttactgatacacgagcagatgtgaataccgtgccaacccctg

SEQ ID NO: 75896 - DNA, 75 bp, Artificial Sequence
  Synthetic
gtacagagagctgtgtacaacgcaggcatggggataggagtagggaacctaaccatcttcccacatcagtggatc

SEQ ID NO: 75897 - DNA, 75 bp, Artificial Sequence
  Synthetic
tcaacaggcacttggcgacgcacaatgattggcaaaattgtgtgtgggaggattacaacagagacctacttgtga

SEQ ID NO: 75898 - DNA, 75 bp, Artificial Sequence
  Synthetic
gcatggggataggagtagggaacctaaccatcttcccacatcagtggatcaatttgcgcacgaacaacagcgcca

SEQ ID NO: 75899 - DNA, 75 bp, Artificial Sequence
  Synthetic
tgattggcaaaattgtgtgtgggaggattacaacagagacctacttgtgagtactaccacggcacaagggtgtga

SEQ ID NO: 75900 - DNA, 75 bp, Artificial Sequence
  Synthetic
ttccatttgtgcccttagactattgccctggatccaccacatacgtgccaatcactgtaacaatagcacccatgt

SEQ ID NO: 75901 - DNA, 75 bp, Artificial Sequence
  Synthetic
cgaggggcctggtcttgtggaggtccaggagagtgagtattaccctaggagatatcaatcccacgttctccttgc

SEQ ID NO: 75902 - DNA, 75 bp, Artificial Sequence
  Synthetic
caggagagtgagtattaccctaggagatatcaatcccacgttctccttgctgcaggtttctccgagcctggtgac

SEQ ID NO: 75903 - DNA, 75 bp, Artificial Sequence
  Synthetic
gcgctgagtataacgggctacgactggcaggccaccaagggctgccaacgatgaacaccccggggagctgccaat

SEQ ID NO: 75904 - DNA, 75 bp, Artificial Sequence
  Synthetic
gccgatgtacgtgaccttctatggctagaagatgatgcaatggagcaaggcgtgagagattacgtggaacaactg

SEQ ID NO: 75905 - DNA, 75 bp, Artificial Sequence
  Synthetic
tagaagatgatgcaatggagcaaggcgtgagagattacgtggaacaactgggaaatgcctttggctcgggcttca

SEQ ID NO: 75906 - DNA, 75 bp, Artificial Sequence
  Synthetic
actcaagtgtttggctttccactgcaaccgggttactcaagcgtgttcagccgcacactcctgggggagatcctt

SEQ ID NO: 75907 - DNA, 75 bp, Artificial Sequence
  Synthetic
tgaaggctctagtgaaaataatatcagcattggtgatagtagtaagaaaccatgatgatctgattacggtgactg

SEQ ID NO: 75908 - DNA, 75 bp, Artificial Sequence
  Synthetic
ccgcacactcctgggggagatccttaactattatacacactggtcaggtagtataaaactcacttttatgttttg

SEQ ID NO: 75909 - DNA, 75 bp, Artificial Sequence
  Synthetic
aactattatacacactggtcaggtagtataaaactcacttttatgttttgtgggtccgcaatggccactggcaaa

SEQ ID NO: 75910 - DNA, 75 bp, Artificial Sequence
  Synthetic
agcattggtgatagtagtaagaaaccatgatgatctgattacggtgactgccacgctggctcttattggctgcac

SEQ ID NO: 75911 - DNA, 75 bp, Artificial Sequence
  Synthetic
tggatggctcaagaagtttacggagatgacaaatgcttgcaagggcatggaatggattgccgtcaagattcagaa

SEQ ID NO: 75912 - DNA, 75 bp, Artificial Sequence
  Synthetic
gtgtgggatgtaggtttacaatctagctgcgtcctatgcataccctggattagccaaacacattaccggtacgtg

SEQ ID NO: 75913 - DNA, 75 bp, Artificial Sequence
  Synthetic
gctgcgtcctatgcataccctggattagccaaacacattaccggtacgtggcttccgatgagtatacagcggggg

SEQ ID NO: 75914 - DNA, 75 bp, Artificial Sequence
  Synthetic
actccctttattggaaagtcaaattgccatgattgagcagagtgcaccatcccagagcgaccaagagcaattatt

SEQ ID NO: 75915 - DNA, 75 bp, Artificial Sequence
  Synthetic
ttgtatcagcttgcaacgacttttctgtgagactactgaaggacacaccctttatatcgcagcaaagttttcttc

SEQ ID NO: 75916 - DNA, 75 bp, Artificial Sequence
  Synthetic
tatatacagttcaagtccaaatgccgtattgaacctgtatgtttgctcctacacgggagtcctggcgccggtaaa

SEQ ID NO: 75917 - DNA, 75 bp, Artificial Sequence
  Synthetic
ctgaagctataccagctcttacagcagctgagacagggcacacatctcaggttgttccaggcgataccatgcaaa

SEQ ID NO: 75918 - DNA, 75 bp, Artificial Sequence
  Synthetic
agctgagacagggcacacatctcaggttgttccaggcgataccatgcaaacgcgccacgtaaaaaattatcactc

SEQ ID NO: 75919 - DNA, 75 bp, Artificial Sequence
  Synthetic
ccagatcacttcgacggttacaaacaacaagctgtagtgattatggatgacctgtgccagaatcctgatgggaag

SEQ ID NO: 75920 - DNA, 75 bp, Artificial Sequence
  Synthetic
gtctaatcggtatgccgaatgggtgataacaactcgccaggcagtgcaattgagaagaaagttagagttcttcac

SEQ ID NO: 75921 - DNA, 75 bp, Artificial Sequence
  Synthetic
ataacaactcgccaggcagtgcaattgagaagaaagttagagttcttcacatacatgaggtttgatctagagctt

SEQ ID NO: 75922 - DNA, 75 bp, Artificial Sequence
  Synthetic
tatggctgctctggaagagaagggcattctgttcacctctccattcgtcttagcgtcaaccaacgcagggtccat

SEQ ID NO: 75923 - DNA, 75 bp, Artificial Sequence
  Synthetic
atgtatgtgccaccaggtggcccagtgccagataaggttgattcatatgtgtggcagacatccactaatcccagt

SEQ ID NO: 75924 - DNA, 75 bp, Artificial Sequence
  Synthetic
aacatgccaatgtcagtgaagacgtgtgatgaagagtgttgcccagtcaacttcaagaaatgttgcccgctagtg

SEQ ID NO: 75925 - DNA, 75 bp, Artificial Sequence
  Synthetic
ttttatgatggctggtcggagtttgccagaagcggggtgtatggcataaacactttgaacaatatggggaccctt

SEQ ID NO: 75926 - DNA, 75 bp, Artificial Sequence
  Synthetic
ccagaagcggggtgtatggcataaacactttgaacaatatggggaccctttacgcaagacatgtgaacgctggga

SEQ ID NO: 75927 - DNA, 75 bp, Artificial Sequence
  Synthetic
tttagagagtacaaccacaggcacagtgttggggcaacccttgaggcactgttccagggtccaccagtgtataga

SEQ ID NO: 75928 - DNA, 75 bp, Artificial Sequence
  Synthetic
gtgttggggcaacccttgaggcactgttccagggtccaccagtgtatagagagataaagattagcgtgacaccag

SEQ ID NO: 75929 - DNA, 75 bp, Artificial Sequence
  Synthetic
aaagaatgtcaatttccaacccagtggtgtaacgacaaccagacagagcatcacagcaatgacaaacactggggc

SEQ ID NO: 75930 - DNA, 75 bp, Artificial Sequence
  Synthetic
ggtgtaacgacaaccagacagagcatcacagcaatgacaaacactggggcgttcgggcaacaatcgggggcaata

SEQ ID NO: 75931 - DNA, 75 bp, Artificial Sequence
  Synthetic
aaagggggtggctggttccagagatcaactccactctgcaaatcgagaagcacgtcagtagggctttcatttgtc

SEQ ID NO: 75932 - DNA, 75 bp, Artificial Sequence
  Synthetic
caactccactctgcaaatcgagaagcacgtcagtagggctttcatttgtctgcaagcactgactactttcgtctc

SEQ ID NO: 75933 - DNA, 75 bp, Artificial Sequence
  Synthetic
tataacagggacctacttgttagcaccactacggcccatggatgtgatgtcatagctagatgccagtgcacatca

SEQ ID NO: 75934 - DNA, 75 bp, Artificial Sequence
  Synthetic
ccactacggcccatggatgtgatgtcatagctagatgccagtgcacatcaggagtgtactactgtgcctcaagaa

SEQ ID NO: 75935 - DNA, 75 bp, Artificial Sequence
  Synthetic
gaaacccaaggtgcccacacttaggcaggcgaaagtgcaaggaccagcatttgagtttgccgtggccatgatgaa

SEQ ID NO: 75936 - DNA, 75 bp, Artificial Sequence
  Synthetic
caggcgaaagtgcaaggaccagcatttgagtttgccgtggccatgatgaagaggaactcaagcacggtgaaaact

SEQ ID NO: 75937 - DNA, 75 bp, Artificial Sequence
  Synthetic
accaatcccacgtgctcctggccgctggattttcagaaccaggagactgcggtggaattctgaggtgtgaacacg

SEQ ID NO: 75938 - DNA, 75 bp, Artificial Sequence
  Synthetic
tggattttcagaaccaggagactgcggtggaattctgaggtgtgaacacggtgttatcggcatcgtgaccatggg

SEQ ID NO: 75939 - DNA, 75 bp, Artificial Sequence
  Synthetic
actattctgatgaatgaccatgaagttggtgtattggatgccaaggaattggtggacaaggatggcaccaacctg

SEQ ID NO: 75940 - DNA, 75 bp, Artificial Sequence
  Synthetic
ttggtgtattggatgccaaggaattggtggacaaggatggcaccaacctggaattgacactacttaagctgagta

SEQ ID NO: 75941 - DNA, 75 bp, Artificial Sequence
  Synthetic
tagagattatgtggaacaactagggaacgcctttggctcaggtttcactaaccaaatttgcgagcaagtcaatct

SEQ ID NO: 75942 - DNA, 75 bp, Artificial Sequence
  Synthetic
aacgcctttggctcaggtttcactaaccaaatttgcgagcaagtcaatctcctcaaggaatcacttgtagggcaa

SEQ ID NO: 75943 - DNA, 75 bp, Artificial Sequence
  Synthetic
tcaacaccagcaagttccctaacatgtacatcccagtaggacaggtcacagattacggttttttaaacctggggg

SEQ ID NO: 75944 - DNA, 75 bp, Artificial Sequence
  Synthetic
gatgatctaatcacagtgacagctactcttgctctcattggttgttcctcatccccatggcgttggcttaagcag

SEQ ID NO: 75945 - DNA, 75 bp, Artificial Sequence
  Synthetic
ccgggaaagtcctggggatccatgtcgggggaaatggccaccaaggcttttcagctgcactccttaagcactact

SEQ ID NO: 75946 - DNA, 75 bp, Artificial Sequence
  Synthetic
ctcttgctctcattggttgttcctcatccccatggcgttggcttaagcagaaggtctcacaatactacggaatcc

SEQ ID NO: 75947 - DNA, 75 bp, Artificial Sequence
  Synthetic
cgggggaaatggccaccaaggcttttcagctgcactccttaagcactacttcaatgatgagcaaggggagatcga

SEQ ID NO: 75948 - DNA, 75 bp, Artificial Sequence
  Synthetic
ggatagccatcaaaattcagaaatttattgagtggctcaaagtgaagatcttacccgaagtgagggaaaaacacg

SEQ ID NO: 75949 - DNA, 75 bp, Artificial Sequence
  Synthetic
ctttcaccaagtttttgaaggcaacaaagagccagcagtcctcaggaatggtgatccacgcctcaaagctaattt

SEQ ID NO: 75950 - DNA, 75 bp, Artificial Sequence
  Synthetic
tattgagtggctcaaagtgaagatcttacccgaagtgagggaaaaacacgaattccttaacagattgaagcaact

SEQ ID NO: 75951 - DNA, 75 bp, Artificial Sequence
  Synthetic
caatgtccagtattttgcccattactgcaggaagtacgctcctctgtacgctgcagaggcgaagagagtgttctt

SEQ ID NO: 75952 - DNA, 75 bp, Artificial Sequence
  Synthetic
tgcaggaagtacgctcctctgtacgctgcagaggcgaagagagtgttcttccttgaaaagaagatgagcaattac

SEQ ID NO: 75953 - DNA, 75 bp, Artificial Sequence
  Synthetic
tgaaggtcttgaggctcttgacttaacaacaagtgcaggctacccttatgtcgcactgggcatcaagaagagaga

SEQ ID NO: 75954 - DNA, 75 bp, Artificial Sequence
  Synthetic
acaacaagtgcaggctacccttatgtcgcactgggcatcaagaagagagacattctatcgaagaagactaaggac

SEQ ID NO: 75955 - DNA, 75 bp, Artificial Sequence
  Synthetic
gtggccaccaatctaattggtagatctctcgcagaaaagcttaatagttctgtgtattccctgccaccagatcct

SEQ ID NO: 75956 - DNA, 75 bp, Artificial Sequence
  Synthetic
ctctcgcagaaaagcttaatagttctgtgtattccctgccaccagatcctgatcatttcgacggttataaacaac

SEQ ID NO: 75957 - DNA, 75 bp, Artificial Sequence
  Synthetic
aggtccgcggagaaagtggcaaaaggaaagtctaggttaattgaagcgtctagtctgaatgattcagtggcaatg

SEQ ID NO: 75958 - DNA, 75 bp, Artificial Sequence
  Synthetic
gaaagtctaggttaattgaagcgtctagtctgaatgattcagtggcaatgaggcagacatttggcaacctataca

SEQ ID NO: 75959 - DNA, 75 bp, Artificial Sequence
  Synthetic
ctagcgtggactttgtgccaccgatggctgcactagaggagaaagggattctgtttacctccccctttgtgctag

SEQ ID NO: 75960 - DNA, 75 bp, Artificial Sequence
  Synthetic
ggctgcactagaggagaaagggattctgtttacctccccctttgtgctagcatccactaatgctgggtctatcaa

SEQ ID NO: 75961 - DNA, 75 bp, Artificial Sequence
  Synthetic
taccagtgatgttggatgggcacctcatagcatttgattactctgggtatgatgctagtttaagccctgtctggt

SEQ ID NO: 75962 - DNA, 75 bp, Artificial Sequence
  Synthetic
catagcatttgattactctgggtatgatgctagtttaagccctgtctggttcgcctgtctaaaaatgttacttga

SEQ ID NO: 75963 - DNA, 75 bp, Artificial Sequence
  Synthetic
gtacagccaaaatgggaagatcaatatgcctatgtctgtcaaaacttgtgatgaggagtgctgcccagtcaactt

SEQ ID NO: 75964 - DNA, 75 bp, Artificial Sequence
  Synthetic
atgcctatgtctgtcaaaacttgtgatgaggagtgctgcccagtcaacttcaaaaagtgttgcccattagtgtgt

SEQ ID NO: 75965 - DNA, 75 bp, Artificial Sequence
  Synthetic
acattactttgtgaggggcggcatgccttcagggtgttctggtaccagtatcttcaactcaatgatcaataatat

SEQ ID NO: 75966 - DNA, 75 bp, Artificial Sequence
  Synthetic
agagagtataaccatagacacagcgtgggcgctacccttgaggccctgtttcaaggacctccagtttacagagag

SEQ ID NO: 75967 - DNA, 75 bp, Artificial Sequence
  Synthetic
tgggcgctacccttgaggccctgtttcaaggacctccagtttacagagagatcaagattagcgtggctccagaaa

SEQ ID NO: 75968 - DNA, 75 bp, Artificial Sequence
  Synthetic
cgatgtgatcgcgtcatacccatggcccatagatgcatcattactcgctgaggccggtaaggactacgggttgat

SEQ ID NO: 75969 - DNA, 75 bp, Artificial Sequence
  Synthetic
agggctggcttgtgccagagatcaactccactctgcaaattgagaagcatgtcagcagggccttcatttgtttgc

SEQ ID NO: 75970 - DNA, 75 bp, Artificial Sequence
  Synthetic
ctccactctgcaaattgagaagcatgtcagcagggccttcatttgtttgcaagccctaaccacatttgtctcagt

SEQ ID NO: 75971 - DNA, 75 bp, Artificial Sequence
  Synthetic
gaccacgtgcgctcactgtgcttactggcctggcacaatggagagcacgaatacgaggagttcattcgtaagatc

SEQ ID NO: 75972 - DNA, 75 bp, Artificial Sequence
  Synthetic
acctaaagtgcccactttgagacaagccaaagtgcaaggcccggcattcgagtttgctgtggcgatgatgaagag

SEQ ID NO: 75973 - DNA, 75 bp, Artificial Sequence
  Synthetic
gccaaagtgcaaggcccggcattcgagtttgctgtggcgatgatgaagagaaattctagtacagtcaagacagaa

SEQ ID NO: 75974 - DNA, 75 bp, Artificial Sequence
  Synthetic
attctgatgaatgaccaggaagtcggtgtgttggatgctaaagaactggttgacaaggatggaaccaacctggaa

SEQ ID NO: 75975 - DNA, 75 bp, Artificial Sequence
  Synthetic
gtgtgttggatgctaaagaactggttgacaaggatggaaccaacctggaattgacgctcttgaaactcaaccgca

SEQ ID NO: 75976 - DNA, 75 bp, Artificial Sequence
  Synthetic
tccccggactgagtatcaataagctgctcgcgcggctgaaggagaaaacgttcgttacccggccaattacttcga

SEQ ID NO: 75977 - DNA, 75 bp, Artificial Sequence
  Synthetic
acacaagcaagttccccaacatgtacattcccgtgggtcaggtcactgattatggcttcttgaatttagggggga

SEQ ID NO: 75978 - DNA, 75 bp, Artificial Sequence
  Synthetic
cattcccgtgggtcaggtcactgattatggcttcttgaatttaggggggaccccaacaaagagaatgctcatgta

SEQ ID NO: 75979 - DNA, 75 bp, Artificial Sequence
  Synthetic
gcgcagtgtttcgctccgcacaaccccagtgtagatcaggtcgatgagtcaccgcaatccccacgggcgaccgtg

SEQ ID NO: 75980 - DNA, 75 bp, Artificial Sequence
  Synthetic
agggaatggtcatcaaggcttctcagctgcccttctcagacactacttcaatgaggagcaaggggaaattgaatt

SEQ ID NO: 75981 - DNA, 75 bp, Artificial Sequence
  Synthetic
gctgcccttctcagacactacttcaatgaggagcaaggggaaattgaattcattgagagctcaaaggatgcaggc

SEQ ID NO: 75982 - DNA, 75 bp, Artificial Sequence
  Synthetic
gaaccagccgtgctcagaaatggggaccctcgactcaaagccaattttgaagaagcaatcttctccaagtacatt

SEQ ID NO: 75983 - DNA, 75 bp, Artificial Sequence
  Synthetic
accctcgactcaaagccaattttgaagaagcaatcttctccaagtacattgggaacgttaacacccacgtggacg

SEQ ID NO: 75984 - DNA, 75 bp, Artificial Sequence
  Synthetic
aacaccttactatacattatccatttgaacacgagaaaatgggtgcacaagtgtcaacacagaaaactggtgcgc

SEQ ID NO: 75985 - DNA, 75 bp, Artificial Sequence
  Synthetic
tgaacacgagaaaatgggtgcacaagtgtcaacacagaaaactggtgcgcacgagaccaacctaagtgccagtgg

SEQ ID NO: 75986 - DNA, 75 bp, Artificial Sequence
  Synthetic
tggaggacgccgtgtacggtacagaggggctagaagcactagatttgaccactagtgcaggttacccatatgtgg

SEQ ID NO: 75987 - DNA, 75 bp, Artificial Sequence
  Synthetic
ggggctagaagcactagatttgaccactagtgcaggttacccatatgtggccctaggcatcaagaagagagatat

SEQ ID NO: 75988 - DNA, 75 bp, Artificial Sequence
  Synthetic
tacccaggacccgggaaaattcacagaaccggtaaaggacataatgattaaatcaatgccggcattaaattctcc

SEQ ID NO: 75989 - DNA, 75 bp, Artificial Sequence
  Synthetic
gaaccggtaaaggacataatgattaaatcaatgccggcattaaattctccatcggcagaagagtgtgggtatagt

SEQ ID NO: 75990 - DNA, 75 bp, Artificial Sequence
  Synthetic
gacttacgtcaaggacgaactacggtctgctgagaaagtggccaagggaaaatccagacttatcgaggcttctag

SEQ ID NO: 75991 - DNA, 75 bp, Artificial Sequence
  Synthetic
tctgctgagaaagtggccaagggaaaatccagacttatcgaggcttctagtcttaatgactcagtggcaatgaga

SEQ ID NO: 75992 - DNA, 75 bp, Artificial Sequence
  Synthetic
ggtacatggccacagtacttgagtgacaaagaagcaacggcagaagaccaaccaactcagccagatgtcgctaca

SEQ ID NO: 75993 - DNA, 75 bp, Artificial Sequence
  Synthetic
acaaagaagcaacggcagaagaccaaccaactcagccagatgtcgctacatgcagattttatacgctttcatctg

SEQ ID NO: 75994 - DNA, 75 bp, Artificial Sequence
  Synthetic
ccagatgtattttggagtaagatcccagtcatgcttgacggacacctcatagcttttgactactcaggttacgat

SEQ ID NO: 75995 - DNA, 75 bp, Artificial Sequence
  Synthetic
cagtcatgcttgacggacacctcatagcttttgactactcaggttacgatgccagccttagtccggtttggtttg

SEQ ID NO: 75996 - DNA, 75 bp, Artificial Sequence
  Synthetic
agaacatgatgtaccattacctagggagaactgggtatacaatacacgttcaatgcaacgcatccaaattccacc

SEQ ID NO: 75997 - DNA, 75 bp, Artificial Sequence
  Synthetic
gagaactgggtatacaatacacgttcaatgcaacgcatccaaattccaccagggatgcttgctagtcgtgtgcgt

SEQ ID NO: 75998 - DNA, 75 bp, Artificial Sequence
  Synthetic
ctcatcacctgtacagagacaagcactacttcgtgaggggtggtatgccatcaggatgttcaggcaccagcatat

SEQ ID NO: 75999 - DNA, 75 bp, Artificial Sequence
  Synthetic
ctacttcgtgaggggtggtatgccatcaggatgttcaggcaccagcatatttaattccatgatcaacaacatcat

SEQ ID NO: 76000 - DNA, 75 bp, Artificial Sequence
  Synthetic
caaagagttttcaagagaaggacctactgtctcggaaggtgcaactgacgtccaaactgctgtgtgtaatgctgg

SEQ ID NO: 76001 - DNA, 75 bp, Artificial Sequence
  Synthetic
actgtctcggaaggtgcaactgacgtccaaactgctgtgtgtaatgctggtatgggggtgggagttgggaactta

SEQ ID NO: 76002 - DNA, 75 bp, Artificial Sequence
  Synthetic
cgtgatcgcttcttacccatggcccattgatgcttcactactagcagaggcaggaaaagattatggtctgattat

SEQ ID NO: 76003 - DNA, 75 bp, Artificial Sequence
  Synthetic
attgatgcttcactactagcagaggcaggaaaagattatggtctgattatgactccagctgacaaaggcgaatgt

SEQ ID NO: 76004 - DNA, 75 bp, Artificial Sequence
  Synthetic
gtgccaatggacagcatgattagacataacaacttcacactgatgatcatcccctttgtgccactcgattttgtc

SEQ ID NO: 76005 - DNA, 75 bp, Artificial Sequence
  Synthetic
ataacaacttcacactgatgatcatcccctttgtgccactcgattttgtcaacggttcctccccatatataccca

SEQ ID NO: 76006 - DNA, 75 bp, Artificial Sequence
  Synthetic
gtccatcctgttatgccaatgaaggacattcatgaatccattaggtggaccaaggatccaaagaacacacaagat

SEQ ID NO: 76007 - DNA, 75 bp, Artificial Sequence
  Synthetic
cttggcataatggagagcacgaatacgaggagttcatccgtaaaatcagaagcgtgcccgtcgggcgttgcttga

SEQ ID NO: 76008 - DNA, 75 bp, Artificial Sequence
  Synthetic
tgttaacaccagggagtaaccaatttctaacctcagatgacttccaatcaccttcggccatgccccagtttgacg

SEQ ID NO: 76009 - DNA, 75 bp, Artificial Sequence
  Synthetic
tctaacctcagatgacttccaatcaccttcggccatgccccagtttgacgttacgcctgagatggagatcccagg

SEQ ID NO: 76010 - DNA, 75 bp, Artificial Sequence
  Synthetic
aattggcttaaccctaccgcatgaaccgaacttgataaaagtgcggtaggggtaaattctccgcattcggtgcgg

SEQ ID NO: 76011 - DNA, 75 bp, Artificial Sequence
  Synthetic
gaagatggatgtctaccgagtacaagtgtcctctcaaacaagtcaaggggcacaagtgttcggcttttcactgca

SEQ ID NO: 76012 - DNA, 75 bp, Artificial Sequence
  Synthetic
gtgtcctctcaaacaagtcaaggggcacaagtgttcggcttttcactgcaaccaggcgcttccagcgttctgcaa

SEQ ID NO: 76013 - DNA, 75 bp, Artificial Sequence
  Synthetic
ggatcagcaatggcaaccggaaaatttctgctagcttactcaccaccaggtgccggggtgccaccagacagaaag

SEQ ID NO: 76014 - DNA, 75 bp, Artificial Sequence
  Synthetic
ttctgctagcttactcaccaccaggtgccggggtgccaccagacagaaagaaagctatgcttggaacgcatgtta

SEQ ID NO: 76015 - DNA, 75 bp, Artificial Sequence
  Synthetic
tgaaagatgagtatactgacagtggttatattacttgttggtaccaaacaaatgtcatagcaccagctgatgcac

SEQ ID NO: 76016 - DNA, 75 bp, Artificial Sequence
  Synthetic
ttatattacttgttggtaccaaacaaatgtcatagcaccagctgatgcactatccacgtgctatataatgtgcat

SEQ ID NO: 76017 - DNA, 75 bp, Artificial Sequence
  Synthetic
aagtccagtggaagagtctattgagaggagcataggtagagttgccgacactattggcagtgggccatccaactc

SEQ ID NO: 76018 - DNA, 75 bp, Artificial Sequence
  Synthetic
aggagcataggtagagttgccgacactattggcagtgggccatccaactcagaagccataccagcactcactgca

SEQ ID NO: 76019 - DNA, 75 bp, Artificial Sequence
  Synthetic
agatcagagtccagtgtggagaattttcttgcacgatcggcatgtgtgttttacacgacatacaccaacagcaaa

SEQ ID NO: 76020 - DNA, 75 bp, Artificial Sequence
  Synthetic
ttcttgcacgatcggcatgtgtgttttacacgacatacaccaacagcaaaaatgcagccaaagaaaagaagtttg

SEQ ID NO: 76021 - DNA, 75 bp, Artificial Sequence
  Synthetic
ggcacaagtgtcaacacaaaaaactggggcccatgaaactggattgagtgctagcaatggatcaatcatccacta

SEQ ID NO: 76022 - DNA, 75 bp, Artificial Sequence
  Synthetic
ggggcccatgaaactggattgagtgctagcaatggatcaatcatccactacaccaatattaactattacaaagac

SEQ ID NO: 76023 - DNA, 75 bp, Artificial Sequence
  Synthetic
acatcgagcttacgttcgtcataaccagcgcacaggatccatcaactgccactaacctagatgtaccagtgttaa

SEQ ID NO: 76024 - DNA, 75 bp, Artificial Sequence
  Synthetic
cagcgcacaggatccatcaactgccactaacctagatgtaccagtgttaacacaccaaataatgtatgtcccgcc

SEQ ID NO: 76025 - DNA, 75 bp, Artificial Sequence
  Synthetic
atggttaagtcgttaccagctctgaactcccctactgtagaagagtgtgggtatagcgacagagtccgctccata

SEQ ID NO: 76026 - DNA, 75 bp, Artificial Sequence
  Synthetic
actcccctactgtagaagagtgtgggtatagcgacagagtccgctccataaccctgggtaactctacaatcacga

SEQ ID NO: 76027 - DNA, 75 bp, Artificial Sequence
  Synthetic
ggggaatgcacccccacgcatgtcaatcccatttatgagcattggtaatgcatacagcatgttttatgatggctg

SEQ ID NO: 76028 - DNA, 75 bp, Artificial Sequence
  Synthetic
atcccatttatgagcattggtaatgcatacagcatgttttatgatggctggtctgagtttaggcatgatggcgta

SEQ ID NO: 76029 - DNA, 75 bp, Artificial Sequence
  Synthetic
aggaccagccaacgcaaccagacgtagctacgtgcaggttttacactctagaatcagtcaattgggaaaagacct

SEQ ID NO: 76030 - DNA, 75 bp, Artificial Sequence
  Synthetic
agctacgtgcaggttttacactctagaatcagtcaattgggaaaagacctccgcagggtggtggtggaagtttcc

SEQ ID NO: 76031 - DNA, 75 bp, Artificial Sequence
  Synthetic
accagtacagtgagaatatatttcaaacccaaacatgttaaggcatgggtcccacgtccacctcgtctagcccag

SEQ ID NO: 76032 - DNA, 75 bp, Artificial Sequence
  Synthetic
aacccaaacatgttaaggcatgggtcccacgtccacctcgtctagcccagtacctcaaagccagcaacgtgaact

SEQ ID NO: 76033 - DNA, 75 bp, Artificial Sequence
  Synthetic
ccatgtccaatgcaacgcctctaagtttcaccagggggccttattagtcgtgtgtgtgccggaggcccaaatggg

SEQ ID NO: 76034 - DNA, 75 bp, Artificial Sequence
  Synthetic
tttcaccagggggccttattagtcgtgtgtgtgccggaggcccaaatggggtctgccaccattaatcaagcattc

SEQ ID NO: 76035 - DNA, 75 bp, Artificial Sequence
  Synthetic
tgtacgtgggcaattacaaagtaataaacagacaccttgccacacacgcagattggcaaaactgcgtgtgggagg

SEQ ID NO: 76036 - DNA, 75 bp, Artificial Sequence
  Synthetic
aaacagacaccttgccacacacgcagattggcaaaactgcgtgtgggaggactacaatagagacctactggttag

SEQ ID NO: 76037 - DNA, 75 bp, Artificial Sequence
  Synthetic
gcggtgcacaacgccgctatgggtgttgcggtagggaacctcacgatcttccctcatcaatggatcaacctgcgc

SEQ ID NO: 76038 - DNA, 75 bp, Artificial Sequence
  Synthetic
ttgcggtagggaacctcacgatcttccctcatcaatggatcaacctgcgcacaaacaacagcgccacgatcgtga

SEQ ID NO: 76039 - DNA, 75 bp, Artificial Sequence
  Synthetic
gaacaagcattacccagttaattttgagggaccaggtttggtggaagttcaggaaagtgaatattaccccaggag

SEQ ID NO: 76040 - DNA, 75 bp, Artificial Sequence
  Synthetic
gagggaccaggtttggtggaagttcaggaaagtgaatattaccccaggaggtaccagtcccatgtgctactagca

SEQ ID NO: 76041 - DNA, 75 bp, Artificial Sequence
  Synthetic
ccaaacttgagtacaacaccggatcctccagcatggtgcccattacagtgactgtcgcacccatgtgcgcggaat

SEQ ID NO: 76042 - DNA, 75 bp, Artificial Sequence
  Synthetic
ctccagcatggtgcccattacagtgactgtcgcacccatgtgcgcggaatacaacgggctacgcttggcaggaca

SEQ ID NO: 76043 - DNA, 75 bp, Artificial Sequence
  Synthetic
ggcggcgaaggggtggttggattcgctgatgtccgtgacttactgtggcttgaagatgatgcgatggaacaggga

SEQ ID NO: 76044 - DNA, 75 bp, Artificial Sequence
  Synthetic
ctgatgtccgtgacttactgtggcttgaagatgatgcgatggaacagggagtcagggattatgtggaacaattag

SEQ ID NO: 76045 - DNA, 75 bp, Artificial Sequence
  Synthetic
catgccccagtttgatgtcacgccggagatgcaaatcccaggggaggtgcgaaatttgatggaaatagctgaggt

SEQ ID NO: 76046 - DNA, 75 bp, Artificial Sequence
  Synthetic
gagatgcaaatcccaggggaggtgcgaaatttgatggaaatagctgaggtcgattcactggttcctgtgaacaac

SEQ ID NO: 76047 - DNA, 75 bp, Artificial Sequence
  Synthetic
aagattctatcttggaaaaatcacttaaggcattagtgaaaatcatttcagcactggtgattgtggtgagaaacc

SEQ ID NO: 76048 - DNA, 75 bp, Artificial Sequence
  Synthetic
taaggcattagtgaaaatcatttcagcactggtgattgtggtgagaaaccatgatgacctaataacaattactgc

SEQ ID NO: 76049 - DNA, 75 bp, Artificial Sequence
  Synthetic
gggtttcgggtccaacccggctatgattcagtgtttaaacacacgctcttgggtgaggtgctcaactattacgct

SEQ ID NO: 76050 - DNA, 75 bp, Artificial Sequence
  Synthetic
attcagtgtttaaacacacgctcttgggtgaggtgctcaactattacgctaactggtctgggagtataaagctga

SEQ ID NO: 76051 - DNA, 75 bp, Artificial Sequence
  Synthetic
acccatggctgaacgccaaaataatgggtggctcaagaagttcactgaaatgaccaacgcctgcaaagggatgga

SEQ ID NO: 76052 - DNA, 75 bp, Artificial Sequence
  Synthetic
gggtggctcaagaagttcactgaaatgaccaacgcctgcaaagggatggagtggattgccgtcaaaattcaaaag

SEQ ID NO: 76053 - DNA, 75 bp, Artificial Sequence
  Synthetic
ctgattctaggaaaaacgccatgttgggcactcacgtggtgtgggacttaggtctacaatcaagttgtgtgttgt

SEQ ID NO: 76054 - DNA, 75 bp, Artificial Sequence
  Synthetic
gggcactcacgtggtgtgggacttaggtctacaatcaagttgtgtgttgtgcatcccgtggatcagtcagacaca

SEQ ID NO: 76055 - DNA, 75 bp, Artificial Sequence
  Synthetic
ctccctcttctggaaagtcaaattaccaccattgagcaaagcgcaccatcccagagcgatcaggaacaacttttc

SEQ ID NO: 76056 - DNA, 75 bp, Artificial Sequence
  Synthetic
ccaccattgagcaaagcgcaccatcccagagcgatcaggaacaacttttctcaaatgtccagtactttgcccatt

SEQ ID NO: 76057 - DNA, 75 bp, Artificial Sequence
  Synthetic
gccagttggcgtggtgacgcaaagcacgattctttgttttgtgtcggcttgcaacgacttctcagtacgattatt

SEQ ID NO: 76058 - DNA, 75 bp, Artificial Sequence
  Synthetic
acgattctttgttttgtgtcggcttgcaacgacttctcagtacgattattacgggacacccccttcatatcccaa

SEQ ID NO: 76059 - DNA, 75 bp, Artificial Sequence
  Synthetic
acatacagttcaagtccaaatgccgtattgagccagtatgcttgcttttacatggaagcccaggggcagggaagt

SEQ ID NO: 76060 - DNA, 75 bp, Artificial Sequence
  Synthetic
tattgagccagtatgcttgcttttacatggaagcccaggggcagggaagtcagtagccacaaatttaatcgggcg

SEQ ID NO: 76061 - DNA, 75 bp, Artificial Sequence
  Synthetic
ggtcccatgaactcaaccagcatccccgcactaacagctgctgaaacagggcatacgtcacaagtcgtgcctagt

SEQ ID NO: 76062 - DNA, 75 bp, Artificial Sequence
  Synthetic
ccgcactaacagctgctgaaacagggcatacgtcacaagtcgtgcctagtgacaccatgcagacacggtgtgtac

SEQ ID NO: 76063 - DNA, 75 bp, Artificial Sequence
  Synthetic
gcaggccgtggtgattatggatgacctgtgccaaaacccagacggtaaagatgtatccttgttctgccaaatggt

SEQ ID NO: 76064 - DNA, 75 bp, Artificial Sequence
  Synthetic
ctgtgccaaaacccagacggtaaagatgtatccttgttctgccaaatggtatcgagtgtggactttgtcccgcca

SEQ ID NO: 76065 - DNA, 75 bp, Artificial Sequence
  Synthetic
acagcacgcaaggtgaagatcagttcaacaattggcacataaacacccaccaggtcgcccagttgaggcggaagc

SEQ ID NO: 76066 - DNA, 75 bp, Artificial Sequence
  Synthetic
caacaattggcacataaacacccaccaggtcgcccagttgaggcggaagcttgagatgtttacctatgcacggtt

SEQ ID NO: 76067 - DNA, 75 bp, Artificial Sequence
  Synthetic
aacgcaccaacggtctcagatagtagggcactggctaggaggttccattttgacatgaacattgaggtcatctcc

SEQ ID NO: 76068 - DNA, 75 bp, Artificial Sequence
  Synthetic
gggcactggctaggaggttccattttgacatgaacattgaggtcatctccatgtatagccagaatggtaagatca

SEQ ID NO: 76069 - DNA, 75 bp, Artificial Sequence
  Synthetic
gacgcaccagataatgtacatccctccggggggtcctatccctacctcagtgaacgactttagttggcaaacatc

SEQ ID NO: 76070 - DNA, 75 bp, Artificial Sequence
  Synthetic
ccggggggtcctatccctacctcagtgaacgactttagttggcaaacatcaaccaatcctagtgtcttttggaca

SEQ ID NO: 76071 - DNA, 75 bp, Artificial Sequence
  Synthetic
gtggtaaggcaatccagttcattgacagaagaacacaagtgagatactccctagacatgttagtcactgaaatgt

SEQ ID NO: 76072 - DNA, 75 bp, Artificial Sequence
  Synthetic
cagaagaacacaagtgagatactccctagacatgttagtcactgaaatgtttagggaatataaccacaggcacag

SEQ ID NO: 76073 - DNA, 75 bp, Artificial Sequence
  Synthetic
tggtcaaatttctcacaggcgggatcatatggttttacaacactgaacaacatgggacagttgtttttcagacac

SEQ ID NO: 76074 - DNA, 75 bp, Artificial Sequence
  Synthetic
catatggttttacaacactgaacaacatgggacagttgtttttcagacacgtcaaccagtcgactgtgggcaagt

SEQ ID NO: 76075 - DNA, 75 bp, Artificial Sequence
  Synthetic
gactccgccaccaccagcaatagcagacttactgaaatcagtagatagtgaggctgttagggagtactgtaagga

SEQ ID NO: 76076 - DNA, 75 bp, Artificial Sequence
  Synthetic
gacttactgaaatcagtagatagtgaggctgttagggagtactgtaaggagaagggatggctagttcctgagatc

SEQ ID NO: 76077 - DNA, 75 bp, Artificial Sequence
  Synthetic
agtaccagagtaagtcaaacgtggactttaaaaccgagccacttacagacactagagcgaccatcactctagcga

SEQ ID NO: 76078 - DNA, 75 bp, Artificial Sequence
  Synthetic
ctttaaaaccgagccacttacagacactagagcgaccatcactctagcgagagatgaccacttaccagaactgca

SEQ ID NO: 76079 - DNA, 75 bp, Artificial Sequence
  Synthetic
gtggccggaatcatttacattatctacaaattgtttgcaggatttcaaggtgcttacacgggaatgcccaaccaa

SEQ ID NO: 76080 - DNA, 75 bp, Artificial Sequence
  Synthetic
acaaattgtttgcaggatttcaaggtgcttacacgggaatgcccaaccaaaagccaaaagtgcccacactaagac

SEQ ID NO: 76081 - DNA, 75 bp, Artificial Sequence
  Synthetic
tactcatgctgactggcagagctgtgtgtgggaagattacaatagagacctcctcgtgagtaccaccacggctca

SEQ ID NO: 76082 - DNA, 75 bp, Artificial Sequence
  Synthetic
gtgtgggaagattacaatagagacctcctcgtgagtaccaccacggctcacgggtgtgatgtcatagcaagatgt

SEQ ID NO: 76083 - DNA, 75 bp, Artificial Sequence
  Synthetic
agtatggtgagtttaccatgctgggcatttatgacagatgggctgttctcccacgccatgccaagcctgggccaa

SEQ ID NO: 76084 - DNA, 75 bp, Artificial Sequence
  Synthetic
catttatgacagatgggctgttctcccacgccatgccaagcctgggccaactattcttatgaatgaccaggaagt

SEQ ID NO: 76085 - DNA, 75 bp, Artificial Sequence
  Synthetic
gtggaggtgcaggaaagtgagtattatcccaagagatatcaatcgcacgttctcctggcggctggcttctctgag

SEQ ID NO: 76086 - DNA, 75 bp, Artificial Sequence
  Synthetic
atcccaagagatatcaatcgcacgttctcctggcggctggcttctctgagccaggcgactgtggtggcatcctga

SEQ ID NO: 76087 - DNA, 75 bp, Artificial Sequence
  Synthetic
gaatgaaaaattcagggacatcagaggcttcttagctaaagaagaggtggaagtcaatgaggctgtcctggcaat

SEQ ID NO: 76088 - DNA, 75 bp, Artificial Sequence
  Synthetic
ggcttcttagctaaagaagaggtggaagtcaatgaggctgtcctggcaataaacactagtaagttcccgaacatg

SEQ ID NO: 76089 - DNA, 75 bp, Artificial Sequence
  Synthetic
ttctgtggttggaggacgatgcaatggaacaaggggttagagactacgtggaacagcttggaaacgctttcggct

SEQ ID NO: 76090 - DNA, 75 bp, Artificial Sequence
  Synthetic
ggaacaaggggttagagactacgtggaacagcttggaaacgctttcggctccgggtttaccaaccaaatttgtga

SEQ ID NO: 76091 - DNA, 75 bp, Artificial Sequence
  Synthetic
tacaattttcctaccagagctggccaatgtggtggtgttctcatgtccactggtaaagtgttggggatacacgtt

SEQ ID NO: 76092 - DNA, 75 bp, Artificial Sequence
  Synthetic
aatgtggtggtgttctcatgtccactggtaaagtgttggggatacacgttggtggaaacggccaccaaggtttct

SEQ ID NO: 76093 - DNA, 75 bp, Artificial Sequence
  Synthetic
gatcatctcagcactggtgatcgtggtgagaaatcacgatgacttgataacggtgactgccacactcgccctcat

SEQ ID NO: 76094 - DNA, 75 bp, Artificial Sequence
  Synthetic
gtgagaaatcacgatgacttgataacggtgactgccacactcgccctcatcggctgtacttcatcaccgtggcgc

SEQ ID NO: 76095 - DNA, 75 bp, Artificial Sequence
  Synthetic
gttttccagtcatcaacacaccaagcaggacaaagttggaaccaagcgtgtttcaccagatatttgagggcgaca

SEQ ID NO: 76096 - DNA, 75 bp, Artificial Sequence
  Synthetic
caggacaaagttggaaccaagcgtgtttcaccagatatttgagggcgacaaggaaccggcagtcctcagaaacgg

SEQ ID NO: 76097 - DNA, 75 bp, Artificial Sequence
  Synthetic
ttcacagaaatgaccaacgcttgcaaagggatggaatggatcgccatcaagatccagaaatttatagagtggctc

SEQ ID NO: 76098 - DNA, 75 bp, Artificial Sequence
  Synthetic
tgagtacatgatggaggccgtcgaccattacgcgggacaactagccactctggacattagtacggagcccatgaa

SEQ ID NO: 76099 - DNA, 75 bp, Artificial Sequence
  Synthetic
acttaaacagctccctctcctggaaagccagatcgccactattgaacaaagtgcgccatctcagagtgatcagga

SEQ ID NO: 76100 - DNA, 75 bp, Artificial Sequence
  Synthetic
cattacgcgggacaactagccactctggacattagtacggagcccatgaaactagaggatgcagtgtacggtaca

SEQ ID NO: 76101 - DNA, 75 bp, Artificial Sequence
  Synthetic
atcctgtccaagaaaaccaaggatttaaccaaattgaaggagtgtatggacaaatacggtttgaacctgcctatg

SEQ ID NO: 76102 - DNA, 75 bp, Artificial Sequence
  Synthetic
taaccaaattgaaggagtgtatggacaaatacggtttgaacctgcctatggtaacctatgtgaaggatgaactta

SEQ ID NO: 76103 - DNA, 75 bp, Artificial Sequence
  Synthetic
atgagcaattacatacagttcaagtccaaatgccgtattgaacctgtatgtttactcttgcacggaagccccgga

SEQ ID NO: 76104 - DNA, 75 bp, Artificial Sequence
  Synthetic
ccaccagatccagatcactttgatggttacaagcaacaagccgtcgtgattatggatgatctatgccaaaaccca

SEQ ID NO: 76105 - DNA, 75 bp, Artificial Sequence
  Synthetic
ggcaaacctttggtaacctatacaagacatttcacctgaacccggggattgtgacaggcagtgcagttggttgtg

SEQ ID NO: 76106 - DNA, 75 bp, Artificial Sequence
  Synthetic
gttacaagcaacaagccgtcgtgattatggatgatctatgccaaaacccagatggtaaagatgtatctttgttct

SEQ ID NO: 76107 - DNA, 75 bp, Artificial Sequence
  Synthetic
gacatttcacctgaacccggggattgtgacaggcagtgcagttggttgtgaccctgacctgttttggagtaagat

SEQ ID NO: 76108 - DNA, 75 bp, Artificial Sequence
  Synthetic
ccttcgtcctggcctcaaccaatgctggttccatcaatgctccaacagtttcagacagtagggccttagctagga

SEQ ID NO: 76109 - DNA, 75 bp, Artificial Sequence
  Synthetic
cgcttgtttgaagctgctacttgaaaaacttggctatacacacaaggagacaaattacatcgattatctatgcaa

SEQ ID NO: 76110 - DNA, 75 bp, Artificial Sequence
  Synthetic
tggttccatcaatgctccaacagtttcagacagtagggccttagctaggagattccactttgacatgaacattga

SEQ ID NO: 76111 - DNA, 75 bp, Artificial Sequence
  Synthetic
aaacttggctatacacacaaggagacaaattacatcgattatctatgcaactcccaccacctgtacagagataag

SEQ ID NO: 76112 - DNA, 75 bp, Artificial Sequence
  Synthetic
cccagctaatttcaaaagatgctgtccccttgtgtgcggaaaggctatccaatttattgatagaaggacccaggt

SEQ ID NO: 76113 - DNA, 75 bp, Artificial Sequence
  Synthetic
ataatcaggactttaatgttgaaagtatacaaaggtattgacctagatcaattcagaatgattgcatatggtgat

SEQ ID NO: 76114 - DNA, 75 bp, Artificial Sequence
  Synthetic
ccccttgtgtgcggaaaggctatccaatttattgatagaaggacccaggtgaggtactccctagatatgctagtc

SEQ ID NO: 76115 - DNA, 75 bp, Artificial Sequence
  Synthetic
tatacaaaggtattgacctagatcaattcagaatgattgcatatggtgatgatgtgattgcatcctacccgtggc

SEQ ID NO: 76116 - DNA, 75 bp, Artificial Sequence
  Synthetic
gtttacagggaaatcaaaattagcgttgcgcccgagatcccaccgccaccagcaatcgcagacctactgaagtca

SEQ ID NO: 76117 - DNA, 75 bp, Artificial Sequence
  Synthetic
gtttcaacgaagttacttggactaacgtcacttttttgaagaggtactttagagcagatgaacaataccctttct

SEQ ID NO: 76118 - DNA, 75 bp, Artificial Sequence
  Synthetic
ttgcgcccgagatcccaccgccaccagcaatcgcagacctactgaagtcagtggacagcgaagcagtcagggatt

SEQ ID NO: 76119 - DNA, 75 bp, Artificial Sequence
  Synthetic
cgtcacttttttgaagaggtactttagagcagatgaacaataccctttcttagtgcacccagtaatgcccatgag

SEQ ID NO: 76120 - DNA, 75 bp, Artificial Sequence
  Synthetic
tcatttgcctccaggcactaacaacctttgtttctgttgctggaatcatctatatcatctacaaattgtttgcag

SEQ ID NO: 76121 - DNA, 75 bp, Artificial Sequence
  Synthetic
ggcttggcacaatggagagcgcgaatacgaggagttcatccaaaagattagaagcgtgccagttgggcgctgtct

SEQ ID NO: 76122 - DNA, 75 bp, Artificial Sequence
  Synthetic
ctttgtttctgttgctggaatcatctatatcatctacaaattgtttgcagggttccagggtgcctatacagggat

SEQ ID NO: 76123 - DNA, 75 bp, Artificial Sequence
  Synthetic
catgatgaagagaaactccagcacggtgaaaacagaatatggtgagttcaccatgctaggcatttatgatagatg

SEQ ID NO: 76124 - DNA, 75 bp, Artificial Sequence
  Synthetic
gaattggcttaaccctaccgcgcttaccgaactagacaacggtgcggtaggggtaaattctccgcattcggtgcg

SEQ ID NO: 76125 - DNA, 75 bp, Artificial Sequence
  Synthetic
acccacagggcccaccgggcgctagcacactggtatcacggtacccttgtgcgcctgttttatcaacccctcccc

SEQ ID NO: 76126 - DNA, 75 bp, Artificial Sequence
  Synthetic
aaaagaattggtggataaagatggcacaaatcttgaactaacactactgaaactcaatcggaatgagaagtttag

SEQ ID NO: 76127 - DNA, 75 bp, Artificial Sequence
  Synthetic
acaaatcttgaactaacactactgaaactcaatcggaatgagaagtttagggacatcagaggctttctcaccaaa

SEQ ID NO: 76128 - DNA, 75 bp, Artificial Sequence
  Synthetic
caagttacggactatgggttcctgaacctgggtggcacccctacaaagaggatgctcatgtacaattttccaacc

SEQ ID NO: 76129 - DNA, 75 bp, Artificial Sequence
  Synthetic
aaattgcgtagcgtttcgttcagcacaaccccagtgtagatcaggtcgatgagtcactgcattcctcacgggcga

SEQ ID NO: 76130 - DNA, 75 bp, Artificial Sequence
  Synthetic
acctgggtggcacccctacaaagaggatgctcatgtacaattttccaaccagagccgggcagtgtgggggcgtcc

SEQ ID NO: 76131 - DNA, 75 bp, Artificial Sequence
  Synthetic
agcactatttcaatgatgaacaaggtgagatagaatttattgagagctcaaaggatgcgggattcccggtcataa

SEQ ID NO: 76132 - DNA, 75 bp, Artificial Sequence
  Synthetic
tgagatagaatttattgagagctcaaaggatgcgggattcccggtcataaatacaccaagcaaaaccaaattaga

SEQ ID NO: 76133 - DNA, 75 bp, Artificial Sequence
  Synthetic
ccttacactggctgcttatggtgacaattgaagaattgttaccatatagctattggattggccatccggtgtcta

SEQ ID NO: 76134 - DNA, 75 bp, Artificial Sequence
  Synthetic
aattgaagaattgttaccatatagctattggattggccatccggtgtctaatagagcaattgtatacctctttgt

SEQ ID NO: 76135 - DNA, 75 bp, Artificial Sequence
  Synthetic
agtaaacttcgaggaagccatattctcaaagtatattgggaatgttaacacacatgtggatgaatacatgttgga

SEQ ID NO: 76136 - DNA, 75 bp, Artificial Sequence
  Synthetic
tcaaagtatattgggaatgttaacacacatgtggatgaatacatgttggaggcagtggaccactatgcaggacag

SEQ ID NO: 76137 - DNA, 75 bp, Artificial Sequence
  Synthetic
gctcaagtgtcgacacaaaagaccggtgcacacgagactgggctaagtgccagtggtaattctattatacactac

SEQ ID NO: 76138 - DNA, 75 bp, Artificial Sequence
  Synthetic
gtgcacacgagactgggctaagtgccagtggtaattctattatacactacacaaatattaattattacaaggatg

SEQ ID NO: 76139 - DNA, 75 bp, Artificial Sequence
  Synthetic
cttgacttgacaacgagtgcaggatacccgtacgttgcgctaggcatcaagaagagagacatattgtcgaaaaag

SEQ ID NO: 76140 - DNA, 75 bp, Artificial Sequence
  Synthetic
acccgtacgttgcgctaggcatcaagaagagagacatattgtcgaaaaagaccagagacctaaccaagttgaagg

SEQ ID NO: 76141 - DNA, 75 bp, Artificial Sequence
  Synthetic
tgatcaaatcgatgcctgccttaaattcaccatctgcagaagagtgtgggtacagtgatagagtgagatctctaa

SEQ ID NO: 76142 - DNA, 75 bp, Artificial Sequence
  Synthetic
ttcaccatctgcagaagagtgtgggtacagtgatagagtgagatctctaacattaggcaattccaccatcaccac

SEQ ID NO: 76143 - DNA, 75 bp, Artificial Sequence
  Synthetic
tggccaaagggaaatctagacttattgaagcatccagtttgaacgactctgttgcaatgagacaaacgtttggca

SEQ ID NO: 76144 - DNA, 75 bp, Artificial Sequence
  Synthetic
tgaagcatccagtttgaacgactctgttgcaatgagacaaacgtttggcaacctatacaagacatttcatctgaa

SEQ ID NO: 76145 - DNA, 75 bp, Artificial Sequence
  Synthetic
ggaccaaccaacacaacccgacgtagccacctgcaggttttacacgttagagtcagtacaatgggagaagaatag

SEQ ID NO: 76146 - DNA, 75 bp, Artificial Sequence
  Synthetic
gccacctgcaggttttacacgttagagtcagtacaatgggagaagaatagtgccgggtggtggtggaagtttccc

SEQ ID NO: 76147 - DNA, 75 bp, Artificial Sequence
  Synthetic
cgggcatctcatagcttttgattattctggatatgatgctagcttaagcccagtgtggttcgcttgtctgaagct

SEQ ID NO: 76148 - DNA, 75 bp, Artificial Sequence
  Synthetic
tctggatatgatgctagcttaagcccagtgtggttcgcttgtctgaagctgctgctagagaaacttgggtactca

SEQ ID NO: 76149 - DNA, 75 bp, Artificial Sequence
  Synthetic
cacgtccaatgcaacgcatccaagttccatcagggatgcctcctagtcgtctgtgttcccgaggctgagatggga

SEQ ID NO: 76150 - DNA, 75 bp, Artificial Sequence
  Synthetic
tccatcagggatgcctcctagtcgtctgtgttcccgaggctgagatgggatgctcccaaacagacaaggaagttg

SEQ ID NO: 76151 - DNA, 75 bp, Artificial Sequence
  Synthetic
ggtggcatgccctcaggatgctctggcaccagcatttttaactcaatgatcaataacattataatcagaacacta

SEQ ID NO: 76152 - DNA, 75 bp, Artificial Sequence
  Synthetic
gcaccagcatttttaactcaatgatcaataacattataatcagaacactaatgttgaaggtgtacaaaggcattg

SEQ ID NO: 76153 - DNA, 75 bp, Artificial Sequence
  Synthetic
aatcgatagtttgcaatgcaggcatgggcgtgggcgtgggaaatttaaccatttatccccatcagtggatcaact

SEQ ID NO: 76154 - DNA, 75 bp, Artificial Sequence
  Synthetic
gggcgtgggcgtgggaaatttaaccatttatccccatcagtggatcaacttacgcaccaacaattgtgcaacaat

SEQ ID NO: 76155 - DNA, 75 bp, Artificial Sequence
  Synthetic
tgctcgctgaagccgggaagggatatggactgattatgacaccagcagacaaaggagagtgctttaacgaagtca

SEQ ID NO: 76156 - DNA, 75 bp, Artificial Sequence
  Synthetic
atttgcacctttggattatactgcacaagcgtctgaatacgtgcctgtaactgtcacaattgctcctatgtgcgc

SEQ ID NO: 76157 - DNA, 75 bp, Artificial Sequence
  Synthetic
taccctttcctggttcacccagtcatgcctatgaaggatatccatgagtccatcagatggacgaaagatccaaag

SEQ ID NO: 76158 - DNA, 75 bp, Artificial Sequence
  Synthetic
caagcgtctgaatacgtgcctgtaactgtcacaattgctcctatgtgcgcagaatacaacggattgcggctagca

SEQ ID NO: 76159 - DNA, 75 bp, Artificial Sequence
  Synthetic
cgaaagattagaagcgtcccaattgggcgctgtttgaccttacctgcgttttcaactctgcgcaggaaatggttg

SEQ ID NO: 76160 - DNA, 75 bp, Artificial Sequence
  Synthetic
tcagccatgccacaattcgatgtgaccccacacatggacataccaggtgaagtgcataatcttatggaaatcgcg

SEQ ID NO: 76161 - DNA, 75 bp, Artificial Sequence
  Synthetic
ccccacacatggacataccaggtgaagtgcataatcttatggaaatcgcggaggtcgattcagtggttccagtta

SEQ ID NO: 76162 - DNA, 75 bp, Artificial Sequence
  Synthetic
gattctttctaaattggagacaatttaatgtaatttaaattggcttaaccctaccgcacccaccgaattagacaa

SEQ ID NO: 76163 - DNA, 75 bp, Artificial Sequence
  Synthetic
ttaaaacagtctgtgggttgttcccacccacagggcccacgtggcgccagcacactggtatctcggtacctttgt

SEQ ID NO: 76164 - DNA, 75 bp, Artificial Sequence
  Synthetic
cacactggtatctcggtacctttgtgcgcctgttttatccaccctaaaccccgttgtaacttagaagatgagcaa

SEQ ID NO: 76165 - DNA, 75 bp, Artificial Sequence
  Synthetic
agatatttgctttccaaatacaaccagggttggattcagtgttcaagagaacactactgggggaagtgcttaact

SEQ ID NO: 76166 - DNA, 75 bp, Artificial Sequence
  Synthetic
agggttggattcagtgttcaagagaacactactgggggaagtgcttaactactatgcacattggtcagggagtat

SEQ ID NO: 76167 - DNA, 75 bp, Artificial Sequence
  Synthetic
gccagttgcatcacgatcaagcacttctgtatccccggactgagtatcaataggctgctcacgcggctgaaggag

SEQ ID NO: 76168 - DNA, 75 bp, Artificial Sequence
  Synthetic
tgatgtaccggccagcagaaagcaagcaatgttgggaacccacatcatctgggatataggattacaatctagctg

SEQ ID NO: 76169 - DNA, 75 bp, Artificial Sequence
  Synthetic
gcaatgttgggaacccacatcatctgggatataggattacaatctagctgtgttctgtgtatcccgtggatcagc

SEQ ID NO: 76170 - DNA, 75 bp, Artificial Sequence
  Synthetic
atagtgatcccacccggcacgcctaacaaatgtgtggttctgtgttttgtatcagcctgcaatgacttctccgtg

SEQ ID NO: 76171 - DNA, 75 bp, Artificial Sequence
  Synthetic
atagtgttcccacccggcacgcctaacaaatgtgtggttctgtgttttgtatcagcctgcaatgacttctccgtg

SEQ ID NO: 76172 - DNA, 75 bp, Artificial Sequence
  Synthetic
atagtgctcccacccggcacgcctaacaaatgtgtggttctgtgttttgtatcagcctgcaatgacttctccgtg

SEQ ID NO: 76173 - DNA, 75 bp, Artificial Sequence
  Synthetic
atagtggtcccacccggcacgcctaacaaatgtgtggttctgtgttttgtatcagcctgcaatgacttctccgtg

SEQ ID NO: 76174 - DNA, 75 bp, Artificial Sequence
  Synthetic
acaaatgtgtggttctgtgttttgtatcagcctgcaatgacttctccgtgcgcatgctgcgcgacacgccattta

SEQ ID NO: 76175 - DNA, 75 bp, Artificial Sequence
  Synthetic
ttgccagtgggcctagcaattccaccagcattcctgcgctgactgcggttgaaaccgggcatacatcacaagtgg

SEQ ID NO: 76176 - DNA, 75 bp, Artificial Sequence
  Synthetic
cagcattcctgcgctgactgcggttgaaaccgggcatacatcacaagtggaacccagcgacaccatgcagacacg

SEQ ID NO: 76177 - DNA, 75 bp, Artificial Sequence
  Synthetic
aattgaaagattgttaccatatagctattggattggccatccggtgtcaaacagagcaatcatttatttgtttgt

SEQ ID NO: 76178 - DNA, 75 bp, Artificial Sequence
  Synthetic
gcacaggtatccacgcagaagactggggcacacgagaccggtttgaacgccagtaataattcggttatacactat

SEQ ID NO: 76179 - DNA, 75 bp, Artificial Sequence
  Synthetic
tgaggaatacttcaccaaggatgagaatagcgccaacaggtacatgtcatggcctataaatgccagaaggatggt

SEQ ID NO: 76180 - DNA, 75 bp, Artificial Sequence
  Synthetic
gggcacacgagaccggtttgaacgccagtaataattcggttatacactatacaaatattaattactacagggatg

SEQ ID NO: 76181 - DNA, 75 bp, Artificial Sequence
  Synthetic
aatagcgccaacaggtacatgtcatggcctataaatgccagaaggatggtacagctgaggcggaagtttgaattg

SEQ ID NO: 76182 - DNA, 75 bp, Artificial Sequence
  Synthetic
tgttaaaaactctaccagcgctgaattcaccaaaagcagaggagtgtgggtatagtgacagagttcgatcaataa

SEQ ID NO: 76183 - DNA, 75 bp, Artificial Sequence
  Synthetic
caagacatgccgccgctgacacaccaaataatgtacataccccccgggggcccagtgccgaacagtgtgactgac

SEQ ID NO: 76184 - DNA, 75 bp, Artificial Sequence
  Synthetic
ttcaccaaaagcagaggagtgtgggtatagtgacagagttcgatcaataaccttaggcaactccacaatcaccac

SEQ ID NO: 76185 - DNA, 75 bp, Artificial Sequence
  Synthetic
aaataatgtacataccccccgggggcccagtgccgaacagtgtgactgacttcgcatggcagacgtcaaccaatc

SEQ ID NO: 76186 - DNA, 75 bp, Artificial Sequence
  Synthetic
ggatcaaccgacacaacccgacgtggccacgtgtagattttacacactcgaatccgtgcaatgggagactgggtc

SEQ ID NO: 76187 - DNA, 75 bp, Artificial Sequence
  Synthetic
gcaacttttacgatgggtggtctcacttttcgcagaacggggtgtacggttacaatgccttgaacaatatgggca

SEQ ID NO: 76188 - DNA, 75 bp, Artificial Sequence
  Synthetic
gccacgtgtagattttacacactcgaatccgtgcaatgggagactgggtctgatgggtggtggtggaagttcccg

SEQ ID NO: 76189 - DNA, 75 bp, Artificial Sequence
  Synthetic
cttttcgcagaacggggtgtacggttacaatgccttgaacaatatgggcaagctgtatgcgcgacatgtgaacaa

SEQ ID NO: 76190 - DNA, 75 bp, Artificial Sequence
  Synthetic
cacgtacaatgcaatgcttcaaagttccaccagggatgcgtgctggtggtgtgtgtacctgaggctgagatgggg

SEQ ID NO: 76191 - DNA, 75 bp, Artificial Sequence
  Synthetic
accgccgcgtttgtgcccctatatcaaatccagtaacgttaactttaaccctactgatctaactgacaaaaggga

SEQ ID NO: 76192 - DNA, 75 bp, Artificial Sequence
  Synthetic
tccaccagggatgcgtgctggtggtgtgtgtacctgaggctgagatggggtgtgctcaaacggattccacattcg

SEQ ID NO: 76193 - DNA, 75 bp, Artificial Sequence
  Synthetic
aaatccagtaacgttaactttaaccctactgatctaactgacaaaagggagagcataacctacgtgcccgacacc

SEQ ID NO: 76194 - DNA, 75 bp, Artificial Sequence
  Synthetic
ctgcagtttgcaacgctgctatgggggttggagttggcaatctcacaatatttccccaccagtggataaacctaa

SEQ ID NO: 76195 - DNA, 75 bp, Artificial Sequence
  Synthetic
gtgaatagacacttagccactcacactgattggcaaaactgtgtgtgggaggactataatagagacctcctcgtg

SEQ ID NO: 76196 - DNA, 75 bp, Artificial Sequence
  Synthetic
ggttggagttggcaatctcacaatatttccccaccagtggataaacctaaggaccaacaacagtgccaccatcgt

SEQ ID NO: 76197 - DNA, 75 bp, Artificial Sequence
  Synthetic
ctgattggcaaaactgtgtgtgggaggactataatagagacctcctcgtgagcaccaccacagcacatgggtgtg

SEQ ID NO: 76198 - DNA, 75 bp, Artificial Sequence
  Synthetic
tgcaccattgaagtaccaacccggggcaacaccgtacgtgccaatcaccgtcactgtagcgcccatgtgcgctga

SEQ ID NO: 76199 - DNA, 75 bp, Artificial Sequence
  Synthetic
ttgaaggcccaggcctggttgaagtacaagaaagtgagtattaccccaagagataccaatcccatgtgctacttg

SEQ ID NO: 76200 - DNA, 75 bp, Artificial Sequence
  Synthetic
gcaacaccgtacgtgccaatcaccgtcactgtagcgcccatgtgcgctgagtacaatggattgcgattggcctct

SEQ ID NO: 76201 - DNA, 75 bp, Artificial Sequence
  Synthetic
acaagaaagtgagtattaccccaagagataccaatcccatgtgctacttgcaacaggattttcagagccaggaga

SEQ ID NO: 76202 - DNA, 75 bp, Artificial Sequence
  Synthetic
gcaatgccccagtttgaccccactccagagatgcgaatcccaggggaggtcaagaatctgatggagatagctgaa

SEQ ID NO: 76203 - DNA, 75 bp, Artificial Sequence
  Synthetic
tgctgatgtccgcgacctattatggttggaggatgatgccatggagcaaggggtaaaggattatgtagaacaact

SEQ ID NO: 76204 - DNA, 75 bp, Artificial Sequence
  Synthetic
cagagatgcgaatcccaggggaggtcaagaatctgatggagatagctgaagttgattctgtcatgccagtcaata

SEQ ID NO: 76205 - DNA, 75 bp, Artificial Sequence
  Synthetic
ttggaggatgatgccatggagcaaggggtaaaggattatgtagaacaacttggaaatgcctttggttctgggttc

SEQ ID NO: 76206 - DNA, 75 bp, Artificial Sequence
  Synthetic
cgattttcagcttccaagtggacccaggttatagttctgtgctaaataggacactactaggtgagatgctgaatt

SEQ ID NO: 76207 - DNA, 75 bp, Artificial Sequence
  Synthetic
ctcaaatcacttgtgaagatcatatcagcgttggttattgtggtgaggaaccatgatgacttgataactgtgacc

SEQ ID NO: 76208 - DNA, 75 bp, Artificial Sequence
  Synthetic
aggttatagttctgtgctaaataggacactactaggtgagatgctgaattattacgcacattggtctggcagcat

SEQ ID NO: 76209 - DNA, 75 bp, Artificial Sequence
  Synthetic
cagcgttggttattgtggtgaggaaccatgatgacttgataactgtgaccgccacccttgcccttatcgggtgca

SEQ ID NO: 76210 - DNA, 75 bp, Artificial Sequence
  Synthetic
atcagtcccagaaagtagaaaagacgccatgcttggcacacacataatatgggacctgggcttgcagtcaagctg

SEQ ID NO: 76211 - DNA, 75 bp, Artificial Sequence
  Synthetic
gccatgcttggcacacacataatatgggacctgggcttgcagtcaagctgtgtcttgtgtgtgccatggatcagt

SEQ ID NO: 76212 - DNA, 75 bp, Artificial Sequence
  Synthetic
gattctacctgaggttagggaaaagcatgagtttcttaacaggcttaaacaactccccctactggaaagccagat

SEQ ID NO: 76213 - DNA, 75 bp, Artificial Sequence
  Synthetic
atagtggttccgccagaaacaccggcagactgtaccatattgggttttgcttcagcctgcaatgacttttctgta

SEQ ID NO: 76214 - DNA, 75 bp, Artificial Sequence
  Synthetic
cagactgtaccatattgggttttgcttcagcctgcaatgacttttctgtaagactcctacgagacacccccttca

SEQ ID NO: 76215 - DNA, 75 bp, Artificial Sequence
  Synthetic
caacgaactcaactgcggtaccggcgcttactgcagtggaaactgggcacacatcgcaggttgtgcctggcgata

SEQ ID NO: 76216 - DNA, 75 bp, Artificial Sequence
  Synthetic
gcttactgcagtggaaactgggcacacatcgcaggttgtgcctggcgatactattcagaccagacacgttgtgaa

SEQ ID NO: 76217 - DNA, 75 bp, Artificial Sequence
  Synthetic
agctatgggggaagatactgataccagtaggtttgctgcatgggacatcaacataagggagatggtgcagttgag

SEQ ID NO: 76218 - DNA, 75 bp, Artificial Sequence
  Synthetic
agtaggtttgctgcatgggacatcaacataagggagatggtgcagttgagaagaaagtgtgagatgttcacctat

SEQ ID NO: 76219 - DNA, 75 bp, Artificial Sequence
  Synthetic
aattctgttcacctctcccttcgtcctggcttcgaccaacgctggttccatcaacgccccaacagtttcagacag

SEQ ID NO: 76220 - DNA, 75 bp, Artificial Sequence
  Synthetic
ccagtgctgacgcaccagattatgtatattccacctggcgggcccataccggacaaagtcaacagctatgcatgg

SEQ ID NO: 76221 - DNA, 75 bp, Artificial Sequence
  Synthetic
atattccacctggcgggcccataccggacaaagtcaacagctatgcatggcagacatccacgaaccctagtgtat

SEQ ID NO: 76222 - DNA, 75 bp, Artificial Sequence
  Synthetic
atgatggatggtcacacttcagtcaatccggggtgtatgggtacaccacactcaacgcaatgggcaagctgtacg

SEQ ID NO: 76223 - DNA, 75 bp, Artificial Sequence
  Synthetic
atccggggtgtatgggtacaccacactcaacgcaatgggcaagctgtacgttagacacgtcaatgccaagagccc

SEQ ID NO: 76224 - DNA, 75 bp, Artificial Sequence
  Synthetic
cctgtgtccatacctgcgaaaggccagcgtgaacttcgacgttaccaacataaccgaagagcgcaccactattaa

SEQ ID NO: 76225 - DNA, 75 bp, Artificial Sequence
  Synthetic
agcgtgaacttcgacgttaccaacataaccgaagagcgcaccactattaacaaagtccccactgaggaccattcg

SEQ ID NO: 76226 - DNA, 75 bp, Artificial Sequence
  Synthetic
catctggctacatatacggactggcagaattgtatatgggaggactacaacagggatctgcttgtgagcaccacg

SEQ ID NO: 76227 - DNA, 75 bp, Artificial Sequence
  Synthetic
agaattgtatatgggaggactacaacagggatctgcttgtgagcaccacgacagcccaaggatgtgacatcatag

SEQ ID NO: 76228 - DNA, 75 bp, Artificial Sequence
  Synthetic
ctggcctagtggaagttcaagagagtgaatattacccaaagagataccaatcccatgtactgctcgcggcaggtt

SEQ ID NO: 76229 - DNA, 75 bp, Artificial Sequence
  Synthetic
tgaatattacccaaagagataccaatcccatgtactgctcgcggcaggtttttcagaacctggcgactgtggtgg

SEQ ID NO: 76230 - DNA, 75 bp, Artificial Sequence
  Synthetic
ataggtgtggtagacgccaaagagttagtagataaagatggcactaatttagaactaacactcttgaaactcaat

SEQ ID NO: 76231 - DNA, 75 bp, Artificial Sequence
  Synthetic
gcgcgacctcttgtggttagaggatgatgcaatggaacagggtgttaaagactatgttgagcaattgggaaacgc

SEQ ID NO: 76232 - DNA, 75 bp, Artificial Sequence
  Synthetic
gatgcaatggaacagggtgttaaagactatgttgagcaattgggaaacgcctttggctcaggtttcaccaaccag

SEQ ID NO: 76233 - DNA, 75 bp, Artificial Sequence
  Synthetic
ttgattaaaattatatcagcactagttattgtggtgagaaaccatgatgacctcattaccgtgacagccactctt

SEQ ID NO: 76234 - DNA, 75 bp, Artificial Sequence
  Synthetic
ttattgtggtgagaaaccatgatgacctcattaccgtgacagccactcttgctcttataggatgtaccacctcac

SEQ ID NO: 76235 - DNA, 75 bp, Artificial Sequence
  Synthetic
taaagaagttcactgaaatgactaatgcctgcaagggcatggaatggattgccgtgaagattcaaaaatttatag

SEQ ID NO: 76236 - DNA, 75 bp, Artificial Sequence
  Synthetic
tattagagagtcagatcgccaccattgagcagagtgcaccctcacagagcgatcaggagcaactgttctccaatg

SEQ ID NO: 76237 - DNA, 75 bp, Artificial Sequence
  Synthetic
gttcaagtccaaatgccgtattgaacctgtctgtctcctgctccacgggtgtcccggtgctggcaagtccgtggc

SEQ ID NO: 76238 - DNA, 75 bp, Artificial Sequence
  Synthetic
tctgacaaagcttaaagagtgcatggacaagtatgggttgaacctccccatggtcacctatgtgaaagatgagtt

SEQ ID NO: 76239 - DNA, 75 bp, Artificial Sequence
  Synthetic
ttttgacggttacaaacagcaggctgtcgtgatcatggacgacttgtgccaaaatccagatggcaaggatgtgtc

SEQ ID NO: 76240 - DNA, 75 bp, Artificial Sequence
  Synthetic
gtcgtgatcatggacgacttgtgccaaaatccagatggcaaggatgtgtccttattttgccagatggtgtcgagt

SEQ ID NO: 76241 - DNA, 75 bp, Artificial Sequence
  Synthetic
accaatgcggggtcaatcaatgctcccacggtgtcagatagtagggcacttgctaggaggttccattttgacatg

SEQ ID NO: 76242 - DNA, 75 bp, Artificial Sequence
  Synthetic
ccacggtgtcagatagtagggcacttgctaggaggttccattttgacatgaacatcgaggtaatctcgatgtaca

SEQ ID NO: 76243 - DNA, 75 bp, Artificial Sequence
  Synthetic
agtgttgtcccctggtttgtggaaaggccatacagttcatagacaggcggacacaagtgaggtactcattagaca

SEQ ID NO: 76244 - DNA, 75 bp, Artificial Sequence
  Synthetic
ggccatacagttcatagacaggcggacacaagtgaggtactcattagacatgcttgtgaccgagatgttcagaga

SEQ ID NO: 76245 - DNA, 75 bp, Artificial Sequence
  Synthetic
aattagtgtggctccagagaccccccccccaccagcaatagcagatctattgaaatccgtggatagtgaggcagt

SEQ ID NO: 76246 - DNA, 75 bp, Artificial Sequence
  Synthetic
gtgtttcaatgaagtgacatggaccaacgtcactttcctgaaaagatacttcagagcagacgagcaatacccctt

SEQ ID NO: 76247 - DNA, 75 bp, Artificial Sequence
  Synthetic
aacgtcactttcctgaaaagatacttcagagcagacgagcaataccccttccttgttcacccagtaatgccaatg

SEQ ID NO: 76248 - DNA, 75 bp, Artificial Sequence
  Synthetic
tagggctttcatctgcctgcaagcactaactacatttgtctctgtggcggggataatatacattatctacaagtt

SEQ ID NO: 76249 - DNA, 75 bp, Artificial Sequence
  Synthetic
ctaactacatttgtctctgtggcggggataatatacattatctacaagttatttgctggtttccagggagcttac

SEQ ID NO: 76250 - DNA, 75 bp, Artificial Sequence
  Synthetic
ttggcctggcacaatggagagcaagaatatgaggaattcgtatccaaaatcagaagcgtcccagtcgggcgctgc

SEQ ID NO: 76251 - DNA, 75 bp, Artificial Sequence
  Synthetic
gcagtggccatgatgaaaagaaacgccagtactgtaaaaaccgagtacggcgagttcacaatgctcggcatctac

SEQ ID NO: 76252 - DNA, 75 bp, Artificial Sequence
  Synthetic
gttgatgccaaagagctggtggacaaagacggcactaacctggaactaacactcttgaaactcaatagaaatgag

SEQ ID NO: 76253 - DNA, 75 bp, Artificial Sequence
  Synthetic
aagacggcactaacctggaactaacactcttgaaactcaatagaaatgagaagttcagagacatccggggcttcc

SEQ ID NO: 76254 - DNA, 75 bp, Artificial Sequence
  Synthetic
cagttggtcaagtaacagactatggtttccttaacttgggtgggactcccaccaagcgcatgttaatgtataact

SEQ ID NO: 76255 - DNA, 75 bp, Artificial Sequence
  Synthetic
tttccttaacttgggtgggactcccaccaagcgcatgttaatgtataacttccccacacgcgcagggcaatgtgg

SEQ ID NO: 76256 - DNA, 75 bp, Artificial Sequence
  Synthetic
cctgttgcgccactacttcaatgatgaacagggcgaaattgagttcattgagagctctagggaagctggcttccc

SEQ ID NO: 76257 - DNA, 75 bp, Artificial Sequence
  Synthetic
gaacagggcgaaattgagttcattgagagctctagggaagctggcttcccggtcattaacactcccagtaaaaca

SEQ ID NO: 76258 - DNA, 75 bp, Artificial Sequence
  Synthetic
agattgaaggccaattttgaagaagcaatcttctccaaatatattggaaatgtgaacacacacgtggatgagtac

SEQ ID NO: 76259 - DNA, 75 bp, Artificial Sequence
  Synthetic
caatcttctccaaatatattggaaatgtgaacacacacgtggatgagtacatgatggaagctatcgaccattacg

SEQ ID NO: 76260 - DNA, 75 bp, Artificial Sequence
  Synthetic
tggaagcactggacctaactactagtgcagggtatccctatgttacccttggcatcaaaaagagagacatcttgt

SEQ ID NO: 76261 - DNA, 75 bp, Artificial Sequence
  Synthetic
tgcagggtatccctatgttacccttggcatcaaaaagagagacatcttgtccaagaagaccagggatttgacgaa

SEQ ID NO: 76262 - DNA, 75 bp, Artificial Sequence
  Synthetic
tttattctggagcaagattccagtcatgctcgacggccacctcatcgcctttgactatagtggttacgatgccag

SEQ ID NO: 76263 - DNA, 75 bp, Artificial Sequence
  Synthetic
catagactacttgtgcaactcccatcatctgtacagagacaaacactactttgtgagaggagggatgccatctgg

SEQ ID NO: 76264 - DNA, 75 bp, Artificial Sequence
  Synthetic
catctgtacagagacaaacactactttgtgagaggagggatgccatctgggtgttccggaactagcatctttaat

SEQ ID NO: 76265 - DNA, 75 bp, Artificial Sequence
  Synthetic
ttcatagacagaagaactcaagtcagatactccctcgatatgctggtaactgagatgtttagggaatacaaccac

SEQ ID NO: 76266 - DNA, 75 bp, Artificial Sequence
  Synthetic
atgatagcatacggggatgatgtcatcgcgtcgtatccgcatcccatcgatgcatcactgttggctgaggctggc

SEQ ID NO: 76267 - DNA, 75 bp, Artificial Sequence
  Synthetic
ggaggtggaagtcaatgaggctgtgctagcaattaacaccagcaagttccccaacatgtacatcccagtaggtca

SEQ ID NO: 76268 - DNA, 75 bp, Artificial Sequence
  Synthetic
ttcctgaagagatactttagggcagatgaacaatacccctttcttgttcacccagtgatgcctatgaaagatata

SEQ ID NO: 76269 - DNA, 75 bp, Artificial Sequence
  Synthetic
cataatggagagcaagagtatgaagagtttgtgactaagatcaggagcgttccagtagggcgctgtctggccttg

SEQ ID NO: 76270 - DNA, 75 bp, Artificial Sequence
  Synthetic
cacacgagaccagcttaagtgcaaccggcaattctatcatccactacacaaacattaactactacaaggatgctg

SEQ ID NO: 76271 - DNA, 75 bp, Artificial Sequence
  Synthetic
cggcaattctatcatccactacacaaacattaactactacaaggatgctgcttccaattcggcaaatcgtcagga

SEQ ID NO: 76272 - DNA, 75 bp, Artificial Sequence
  Synthetic
taaagtcacttccagcgctcaattccccaacggtggaggaatgtgggtacagtgatagagttagatcaataacac

SEQ ID NO: 76273 - DNA, 75 bp, Artificial Sequence
  Synthetic
ggcagaacatgcaataccattacctaggtagatcagggtatacaatccatgtgcaatgcaacgcatctaaattcc

SEQ ID NO: 76274 - DNA, 75 bp, Artificial Sequence
  Synthetic
gtgcaatgcaacgcatctaaattccaccaaggctgtctccttgtggtgtgtgtgcctgaggcagaaatggggtgt

SEQ ID NO: 76275 - DNA, 75 bp, Artificial Sequence
  Synthetic
agcgaaaagctttgagcagaacgcagccacgggtgaaacggctgtgcagacggctgtgtgcaatgcaggtatggg

SEQ ID NO: 76276 - DNA, 75 bp, Artificial Sequence
  Synthetic
caatgtccaatactttgcccactattgcagaaagtacgctcccctctatgcagctgaagcaaagagggtgttctc

SEQ ID NO: 76277 - DNA, 75 bp, Artificial Sequence
  Synthetic
tgcagaaagtacgctcccctctatgcagctgaagcaaagagggtgttctcccttgagaagaagatgagcaattac

SEQ ID NO: 76278 - DNA, 75 bp, Artificial Sequence
  Synthetic
ttgcatactctccacctggagcgggggcaccagatagcaggaagaacgctatgctgggaacccacgttatatggg

SEQ ID NO: 76279 - DNA, 75 bp, Artificial Sequence
  Synthetic
acccacagggcccactgggcgctagcacactggtattacggtacccttgtgcgcctgttttatttacccctcccc

SEQ ID NO: 76280 - DNA, 75 bp, Artificial Sequence
  Synthetic
atagtcccagccgaagcccagaagtcttgctacataatgtgcttcgtgtcagcatgtaacgacttctcagttcgt

SEQ ID NO: 76281 - DNA, 75 bp, Artificial Sequence
  Synthetic
atggggagggttgcggacactattgcccgcggtccatcaaactctgaacaaatcccagctttaacagccgttgaa

SEQ ID NO: 76282 - DNA, 75 bp, Artificial Sequence
  Synthetic
gcacttaacaccttaaaatgggagcacaagtttcaacacagaagacgggtgcgcatgagaccagcttgagcgcaa

SEQ ID NO: 76283 - DNA, 75 bp, Artificial Sequence
  Synthetic
acaagtttcaacacagaagacgggtgcgcatgagaccagcttgagcgcaaacggaagctcaactattcactacac

SEQ ID NO: 76284 - DNA, 75 bp, Artificial Sequence
  Synthetic
tgttttatgacggatggtcaaatttttctagggacggcatatatgggtacaactcgctgaacaacatgggaacca

SEQ ID NO: 76285 - DNA, 75 bp, Artificial Sequence
  Synthetic
cactgagccattgaaggatgtgatgatcaaatcattgccagcactgaactcaccatccgccgaagagtgtgggta

SEQ ID NO: 76286 - DNA, 75 bp, Artificial Sequence
  Synthetic
atcaaatcattgccagcactgaactcaccatccgccgaagagtgtgggtatagtgacagagttagatcgctaaca

SEQ ID NO: 76287 - DNA, 75 bp, Artificial Sequence
  Synthetic
tccgatgatcaagccactgcagaagatcaacccacacaacccgacgtggctacatgcagattctacaccttggag

SEQ ID NO: 76288 - DNA, 75 bp, Artificial Sequence
  Synthetic
atcaacccacacaacccgacgtggctacatgcagattctacaccttggagtcagtgaagtgggagaaagcatcag

SEQ ID NO: 76289 - DNA, 75 bp, Artificial Sequence
  Synthetic
tcggacgctctgggtacaccatacacgtacagtgcaacgcgtccaggtttcatcaggggtgtctactggttgtgt

SEQ ID NO: 76290 - DNA, 75 bp, Artificial Sequence
  Synthetic
cgtacagtgcaacgcgtccaggtttcatcaggggtgtctactggttgtgtgcgtaccagaagccgagatgggtaa

SEQ ID NO: 76291 - DNA, 75 bp, Artificial Sequence
  Synthetic
ctatccagttagctttgagggcccaggcctagttgaagtgcaagaaagtgaatattaccccaagagatatcagtc

SEQ ID NO: 76292 - DNA, 75 bp, Artificial Sequence
  Synthetic
agcacaaggtactggaaacggagtccaaacggcagtgtgcaatgctgcaatgggtgtgggagtgggaaacctgac

SEQ ID NO: 76293 - DNA, 75 bp, Artificial Sequence
  Synthetic
caaacggcagtgtgcaatgctgcaatgggtgtgggagtgggaaacctgacaatcttccctcaccagtggataaat

SEQ ID NO: 76294 - DNA, 75 bp, Artificial Sequence
  Synthetic
tacaacttcaccttaatggtgattccgtttgttccattagagacaacgggagggaccccttacgtgccaataacg

SEQ ID NO: 76295 - DNA, 75 bp, Artificial Sequence
  Synthetic
cgtttgttccattagagacaacgggagggaccccttacgtgccaataacggttaccatagcaccaatgtatgctg

SEQ ID NO: 76296 - DNA, 75 bp, Artificial Sequence
  Synthetic
cgagcgccagaataatgggtggctcaaaaagttcacagaaatgaccaacgcatgcaaggggatggaatggattgc

SEQ ID NO: 76297 - DNA, 75 bp, Artificial Sequence
  Synthetic
catccgatgattaccaatccccgtgcgccatgccggagtttgatgtgacgccccctatgcagatcccaggggagg

SEQ ID NO: 76298 - DNA, 75 bp, Artificial Sequence
  Synthetic
cgccatgccggagtttgatgtgacgccccctatgcagatcccaggggaggtgcgtaatcttatggagatcgctga

SEQ ID NO: 76299 - DNA, 75 bp, Artificial Sequence
  Synthetic
ggcacgcgatcatgaaacgactgaagcagtctttaaatttcagttagacccaggaaatgatagtgtgttgaaccg

SEQ ID NO: 76300 - DNA, 75 bp, Artificial Sequence
  Synthetic
gcagtctttaaatttcagttagacccaggaaatgatagtgtgttgaaccgcaccctgttgggtgagattttgaac

SEQ ID NO: 76301 - DNA, 75 bp, Artificial Sequence
  Synthetic
tgaaaaactgaatagctcagtgtattctctacctccagatccagaccattttgatggttataagcaacaagccgt

SEQ ID NO: 76302 - DNA, 75 bp, Artificial Sequence
  Synthetic
ttaatagcttactcgccccctggagcaaaccccccaacagacagaaagcaggcgatgctaggaacgcacattatt

SEQ ID NO: 76303 - DNA, 75 bp, Artificial Sequence
  Synthetic
caaaccccccaacagacagaaagcaggcgatgctaggaacgcacattatttgggacttgggtttacaatccagtt

SEQ ID NO: 76304 - DNA, 75 bp, Artificial Sequence
  Synthetic
ttatcacgtgctggtaccagacaaatataatagtgccccctgacacaccgaccaggtgtgcgatgttgtgttttg

SEQ ID NO: 76305 - DNA, 75 bp, Artificial Sequence
  Synthetic
tataatagtgccccctgacacaccgaccaggtgtgcgatgttgtgttttgtatctgcgtgcaacgacttttctgt

SEQ ID NO: 76306 - DNA, 75 bp, Artificial Sequence
  Synthetic
cacggttgcggatacgactagtagtggcccatctaattcagagcgcgttcctgcactgacagctgctgagactgg

SEQ ID NO: 76307 - DNA, 75 bp, Artificial Sequence
  Synthetic
ggcccatctaattcagagcgcgttcctgcactgacagctgctgagactgggcacacctcccaagttcaacccagt

SEQ ID NO: 76308 - DNA, 75 bp, Artificial Sequence
  Synthetic
tcagcatgcgcacgaatgttcacatatgaggcatttggtgaagataccagtgataagagatatgccaactgggcc

SEQ ID NO: 76309 - DNA, 75 bp, Artificial Sequence
  Synthetic
atgaggcatttggtgaagataccagtgataagagatatgccaactgggccataagtgtgaaagatatggttcaac

SEQ ID NO: 76310 - DNA, 75 bp, Artificial Sequence
  Synthetic
gggatatagaggtcgggcttccgctgacgcaccagataatgtacatcccccctggtggtcctatacctgaaagcg

SEQ ID NO: 76311 - DNA, 75 bp, Artificial Sequence
  Synthetic
gacgcaccagataatgtacatcccccctggtggtcctatacctgaaagcgttaccagttacgcgtggcaaacctc

SEQ ID NO: 76312 - DNA, 75 bp, Artificial Sequence
  Synthetic
cgcctatagttcattttacgatgggtggtcacacttcacccagagcgggggttatggatacagcaccttgaacaa

SEQ ID NO: 76313 - DNA, 75 bp, Artificial Sequence
  Synthetic
tggtcacacttcacccagagcgggggttatggatacagcaccttgaacaacctaggacagctgtatgtgaggcat

SEQ ID NO: 76314 - DNA, 75 bp, Artificial Sequence
  Synthetic
ccacgaccaccacgactatgccagtacaaaagaaaagccaatgtgaactttgaggtaactaaggttaccgaaacc

SEQ ID NO: 76315 - DNA, 75 bp, Artificial Sequence
  Synthetic
acaaaagaaaagccaatgtgaactttgaggtaactaaggttaccgaaaccagggtgagcataacaacgctcccat

SEQ ID NO: 76316 - DNA, 75 bp, Artificial Sequence
  Synthetic
ataggcacttggcaacgcacaatgactggcagaattgtgtgtgggaagattataatagggatcttcttgtaagca

SEQ ID NO: 76317 - DNA, 75 bp, Artificial Sequence
  Synthetic
ctggcagaattgtgtgtgggaagattataatagggatcttcttgtaagcactaccactgcacacggatgtgacac

SEQ ID NO: 76318 - DNA, 75 bp, Artificial Sequence
  Synthetic
gggcccaggcctagtggaggttcaagagagtgagtactatcctaagaggtaccaatcccatgtgctgcttgctgc

SEQ ID NO: 76319 - DNA, 75 bp, Artificial Sequence
  Synthetic
gagagtgagtactatcctaagaggtaccaatcccatgtgctgcttgctgcaggtttctcagagccaggcgattgt

SEQ ID NO: 76320 - DNA, 75 bp, Artificial Sequence
  Synthetic
gatgtccgcgatcttttgtggctggaagatgatgccatggaacaaggcgtcaaagactatgttgagcaactcggg

SEQ ID NO: 76321 - DNA, 75 bp, Artificial Sequence
  Synthetic
aagatgatgccatggaacaaggcgtcaaagactatgttgagcaactcgggaatgctttcgggtctggtttcacca

SEQ ID NO: 76322 - DNA, 75 bp, Artificial Sequence
  Synthetic
gagctctagtaaaaatcatatcagcattggttattgtggtgagaaaccacgatgacttgattacagtgacagcca

SEQ ID NO: 76323 - DNA, 75 bp, Artificial Sequence
  Synthetic
attggttattgtggtgagaaaccacgatgacttgattacagtgacagccacactagccctcataggctgcacctc

SEQ ID NO: 76324 - DNA, 75 bp, Artificial Sequence
  Synthetic
ttggctcaagagattcacagagatgaccaatgcttgcaagggcatggaatggattgcaatcaaaatccaaaaatt

SEQ ID NO: 76325 - DNA, 75 bp, Artificial Sequence
  Synthetic
ggggtatggtctgatcatgacaccagcagacaagggagagtgctttaatgaagtaacatggaccaacgtcacttt

SEQ ID NO: 76326 - DNA, 75 bp, Artificial Sequence
  Synthetic
gcccttgttagaaagtcaaattgctaccattgaacaaagcgccccttcacaaagcgatcaagaacaactattctc

SEQ ID NO: 76327 - DNA, 75 bp, Artificial Sequence
  Synthetic
gatccttgtgcttattggcctggcacaatggagagcaagaatatgaggaatttgtgtccaaaatcagaagcgtcc

SEQ ID NO: 76328 - DNA, 75 bp, Artificial Sequence
  Synthetic
atacagttcaagtccaaatgccgcattgaacccgtctgtctattgctccatgggagccctggtgctgggaaatca

SEQ ID NO: 76329 - DNA, 75 bp, Artificial Sequence
  Synthetic
gatcacttcgatggttacaaacaacaggcagttgtgatcatggatgacttatgtcagaacccagatgggaaagat

SEQ ID NO: 76330 - DNA, 75 bp, Artificial Sequence
  Synthetic
gtcaagcaacaccaatgacgtgcaacaggcggtgttcaacgctggcatgggtgtggcagtaggaaacctaactat

SEQ ID NO: 76331 - DNA, 75 bp, Artificial Sequence
  Synthetic
gtctctttgttttgccaaatggtgtccagtgttgactttgtcccaccaatggcggcactagaggaaaaaggcatc

SEQ ID NO: 76332 - DNA, 75 bp, Artificial Sequence
  Synthetic
acatgaatattgaagtcatctcaatgtacagccagaatggaaagatcaacatgccaatgtcagtgaagacctgtg

SEQ ID NO: 76333 - DNA, 75 bp, Artificial Sequence
  Synthetic
gaagaacacaggtgaggtattcactagatatgctcgtgactgagatgttcagggagtataaccacaggcatagtg

SEQ ID NO: 76334 - DNA, 75 bp, Artificial Sequence
  Synthetic
agatatgctcgtgactgagatgttcagggagtataaccacaggcatagtgtgggtgcaacactcgaggcactctt

SEQ ID NO: 76335 - DNA, 75 bp, Artificial Sequence
  Synthetic
cacccacagggcccactgggcgttagcacactggtatcacggtacccttgtgcgcctgttttatctaccctaccc

SEQ ID NO: 76336 - DNA, 75 bp, Artificial Sequence
  Synthetic
tctactgaagtcagtggatagtgaggctgtcagggaatactgcaaggaaaagggatggctagtgcccgaaattaa

SEQ ID NO: 76337 - DNA, 75 bp, Artificial Sequence
  Synthetic
gctgtcagggaatactgcaaggaaaagggatggctagtgcccgaaattaattccactttgcaaatcgagaaacat

SEQ ID NO: 76338 - DNA, 75 bp, Artificial Sequence
  Synthetic
aaattgtttgcgggtttccagggagcttacaccggcatgcccaaccagaagcccaaggtaccgactctgagacag

SEQ ID NO: 76339 - DNA, 75 bp, Artificial Sequence
  Synthetic
cttacaccggcatgcccaaccagaagcccaaggtaccgactctgagacaggcgaaagtacaaggaccagctttcg

SEQ ID NO: 76340 - DNA, 75 bp, Artificial Sequence
  Synthetic
ccagtgggcggtctgtcgtaacgggcaactctgcagcggaaccgactactttgggtgtccgtgtttccttttatc

SEQ ID NO: 76341 - DNA, 75 bp, Artificial Sequence
  Synthetic
tctatgacaggtgggcggtgttaccccgacacgccaaacctgggcctaccattctaatgaatgaccaggaagtga

SEQ ID NO: 76342 - DNA, 75 bp, Artificial Sequence
  Synthetic
ccgacacgccaaacctgggcctaccattctaatgaatgaccaggaagtgagcgtggttgatgccaaagagttagt

SEQ ID NO: 76343 - DNA, 75 bp, Artificial Sequence
  Synthetic
tttcttggcacgcgaggaagtggaagtcaatgaagctgtgcttgccattaacaccagcaaattcccaaatatgta

SEQ ID NO: 76344 - DNA, 75 bp, Artificial Sequence
  Synthetic
gtcaatgaagctgtgcttgccattaacaccagcaaattcccaaatatgtacatcccagtcggacaggtgacagac

SEQ ID NO: 76345 - DNA, 75 bp, Artificial Sequence
  Synthetic
tgtggaggtgttctgatgtcaacaggcaaagtgcttggaattcacgttggcggtaacggacatcaaggattctca

SEQ ID NO: 76346 - DNA, 75 bp, Artificial Sequence
  Synthetic
tcacagaaccagtcaaggacataatggtgaaatcattaccggctctgaactccccatctgccgaagagtgtggct

SEQ ID NO: 76347 - DNA, 75 bp, Artificial Sequence
  Synthetic
gcaaagtgcttggaattcacgttggcggtaacggacatcaaggattctcagcagctctattgcgtcattatttca

SEQ ID NO: 76348 - DNA, 75 bp, Artificial Sequence
  Synthetic
aaacgaagcttgagcctagcgtattccatcacgtttttgaggggaataaggagccagcagtgttgaggaatggag

SEQ ID NO: 76349 - DNA, 75 bp, Artificial Sequence
  Synthetic
ccatcacgtttttgaggggaataaggagccagcagtgttgaggaatggagaccccaggctgaaggtcaattttga

SEQ ID NO: 76350 - DNA, 75 bp, Artificial Sequence
  Synthetic
gatcaacctacccaacctgacgtggcaacatgcaggttttacacgctagattcagtgtcgtggatgaaggagtcg

SEQ ID NO: 76351 - DNA, 75 bp, Artificial Sequence
  Synthetic
ctatgcaggacaactggcaactctggacatttgcacagaacccatgaaattggaggacgcagtctatggtactga

SEQ ID NO: 76352 - DNA, 75 bp, Artificial Sequence
  Synthetic
gacatttgcacagaacccatgaaattggaggacgcagtctatggtactgagggcttagaggctctagatctgacc

SEQ ID NO: 76353 - DNA, 75 bp, Artificial Sequence
  Synthetic
atgtgcagtgtaacgcctcaaaattccaccaagggtgccttttagtagtgtgtgtcccagaagctgagatgggtg

SEQ ID NO: 76354 - DNA, 75 bp, Artificial Sequence
  Synthetic
acgaagcttaaagagtgcatggacaagtatggtctgaaccttcccatggtcacttatgtgaaagatgaactgaga

SEQ ID NO: 76355 - DNA, 75 bp, Artificial Sequence
  Synthetic
agtcaagcaacactaatgacgtgcaacaggcggtatttaatgctggcatgggtgtggcagtaggaaacctgacca

SEQ ID NO: 76356 - DNA, 75 bp, Artificial Sequence
  Synthetic
agtatggtctgaaccttcccatggtcacttatgtgaaagatgaactgagatcagcagagaaggtagccaaaggca

SEQ ID NO: 76357 - DNA, 75 bp, Artificial Sequence
  Synthetic
gtcatgccatacatcaatagtgtgcctatggacaacatgtttcgtcattacaacttcacgctaatgatcatccca

SEQ ID NO: 76358 - DNA, 75 bp, Artificial Sequence
  Synthetic
ctttccacctgaatccaggcatagtgacaggcagtgcagttgggtgtgaccctgatcttttctggagtaaaatcc

SEQ ID NO: 76359 - DNA, 75 bp, Artificial Sequence
  Synthetic
cctgatcttttctggagtaaaatcccagtcatgctcgacggccatctcattgctttcgactacagtggttatgat

SEQ ID NO: 76360 - DNA, 75 bp, Artificial Sequence
  Synthetic
cacaccgggtagcaatcaattcttaacctccgatgattaccaatctcctactgccatgccgcagtttgatgtgac

SEQ ID NO: 76361 - DNA, 75 bp, Artificial Sequence
  Synthetic
aactacatagattacctatgcaactcccaccatctatatagagacaaacactactttgtaagagggggaatgcca

SEQ ID NO: 76362 - DNA, 75 bp, Artificial Sequence
  Synthetic
cccaccatctatatagagacaaacactactttgtaagagggggaatgccatctggatgctcgggaaccagtattt

SEQ ID NO: 76363 - DNA, 75 bp, Artificial Sequence
  Synthetic
caatgtgaatgagaacgtcaacagtctggaggcttataggataccagtgcattcagtgacggaaactggatcgca

SEQ ID NO: 76364 - DNA, 75 bp, Artificial Sequence
  Synthetic
ctggaggcttataggataccagtgcattcagtgacggaaactggatcgcaagtttttggcttcacattgcagccc

SEQ ID NO: 76365 - DNA, 75 bp, Artificial Sequence
  Synthetic
ttaggatgatagcatatggtgatgacgtcattgcatcatatcctcatcctattgacgccgccctgctggcagaag

SEQ ID NO: 76366 - DNA, 75 bp, Artificial Sequence
  Synthetic
cgtcattgcatcatatcctcatcctattgacgccgccctgctggcagaagcagggaaagggtacggcctgatcat

SEQ ID NO: 76367 - DNA, 75 bp, Artificial Sequence
  Synthetic
aaactcacgttcatgtactgtggatcggcaatggcgactggaaagttccttctagcatactcacccccaggggcg

SEQ ID NO: 76368 - DNA, 75 bp, Artificial Sequence
  Synthetic
agcagatgagcagtacccgttccttgtccaccccgtgatgccaatgaaggatatccatgaatcgatcaggtggac

SEQ ID NO: 76369 - DNA, 75 bp, Artificial Sequence
  Synthetic
gtccaccccgtgatgccaatgaaggatatccatgaatcgatcaggtggaccaaagaccccaaaaacacccaagat

SEQ ID NO: 76370 - DNA, 75 bp, Artificial Sequence
  Synthetic
ggacatcgggttgcaatccagttgtgtattgtgcgtaccatggatcagccaaacgcactacagatttgtgtccaa

SEQ ID NO: 76371 - DNA, 75 bp, Artificial Sequence
  Synthetic
gtattgtgcgtaccatggatcagccaaacgcactacagatttgtgtccaaggatagttacaccgatgctgggttt

SEQ ID NO: 76372 - DNA, 75 bp, Artificial Sequence
  Synthetic
agcgtcccagttgggcgctgtttgaccttacctgcgttttcgaccttacgcaggagatggctggactccttttaa

SEQ ID NO: 76373 - DNA, 75 bp, Artificial Sequence
  Synthetic
tcggcctgcaatgatttctcggtgcgtctgctgcgtgattcacccttcgttcgccagacggcgttctaccagaat

SEQ ID NO: 76374 - DNA, 75 bp, Artificial Sequence
  Synthetic
gtctgctgcgtgattcacccttcgttcgccagacggcgttctaccagaatgacgtgcaaaacgcaatcgaccgtg

SEQ ID NO: 76375 - DNA, 75 bp, Artificial Sequence
  Synthetic
agacagggcacacatcacaagtggtaccaagcgacaccattcagacacgccatgtcaaaaacttccacgttaggt

SEQ ID NO: 76376 - DNA, 75 bp, Artificial Sequence
  Synthetic
ccaactgggtttagaccaagtacttctgttaccccggactgagtatcaataggctgctcacgcggctgaaggaga

SEQ ID NO: 76377 - DNA, 75 bp, Artificial Sequence
  Synthetic
aggctgctcacgcggctgaaggagaaaacgttcgttacccggccaactacttcgagaagcccagtaccgccatgg

SEQ ID NO: 76378 - DNA, 75 bp, Artificial Sequence
  Synthetic
cagaatcatccgtggagaacttccttagtaggtccgcttgcgtttatattgtggaatataaaacaagagatgaca

SEQ ID NO: 76379 - DNA, 75 bp, Artificial Sequence
  Synthetic
ttgggtgtccgtgtttccttttattcctacattgactgcttatggtgacaattgaaagattgttaccatatagct

SEQ ID NO: 76380 - DNA, 75 bp, Artificial Sequence
  Synthetic
caacttctatgacgggtggtcacacttttcacaaacaggtgtgtatggcttcaacaccctcaacaatatgggaaa

SEQ ID NO: 76381 - DNA, 75 bp, Artificial Sequence
  Synthetic
cagagctattatttacctttttattggctttgtgccattgaatttcaaagttataaaaaccataaactttatctt

SEQ ID NO: 76382 - DNA, 75 bp, Artificial Sequence
  Synthetic
gttatactttaggcatgtaaatgataaaacaatcagtccaattacaagcaaagttcgcatatatttcaaaccaaa

SEQ ID NO: 76383 - DNA, 75 bp, Artificial Sequence
  Synthetic
agtggaaactccatcatccactacacgaacataaactattataaggatgccgcctcgaactcggcaaatagacag

SEQ ID NO: 76384 - DNA, 75 bp, Artificial Sequence
  Synthetic
ccgcccagactatgtgagtacacacacaaggataatgtggattttgaacccaaaggtgtcaccacgtcccggact

SEQ ID NO: 76385 - DNA, 75 bp, Artificial Sequence
  Synthetic
tcacagagcctgtgaaggacatcatgatcaaatcgatgcccgctcttaactccccgtcagcagaggagtgcggtt

SEQ ID NO: 76386 - DNA, 75 bp, Artificial Sequence
  Synthetic
gggaattatagattggtgaataggcatcttgcaacacacactgattggcagaattgtgtgtgggaagattacaac

SEQ ID NO: 76387 - DNA, 75 bp, Artificial Sequence
  Synthetic
tacttctgtatatcaagaaacaagcattatccagtcagttttgagggcccaggcctggttgaggtacaagaaagt

SEQ ID NO: 76388 - DNA, 75 bp, Artificial Sequence
  Synthetic
attatccagtcagttttgagggcccaggcctggttgaggtacaagaaagtgaatattaccccaaaagataccaat

SEQ ID NO: 76389 - DNA, 75 bp, Artificial Sequence
  Synthetic
ttggactggtcactatgggaggtgagggagtcgttggattcgctgatgttcgcgacctgctgtggttggaggatg

SEQ ID NO: 76390 - DNA, 75 bp, Artificial Sequence
  Synthetic
gggagtcgttggattcgctgatgttcgcgacctgctgtggttggaggatgatgcaatggagcagggagtgaggga

SEQ ID NO: 76391 - DNA, 75 bp, Artificial Sequence
  Synthetic
tgtgtgccagaggcggaaatgggatgcgccacgttagccaataaacctgatcagaagagcctgagcaacggagag

SEQ ID NO: 76392 - DNA, 75 bp, Artificial Sequence
  Synthetic
agagtcgttggtggggcaggactcgatcttggaaaaatccctcaaagccttagtcaaaattatatcagcactagt

SEQ ID NO: 76393 - DNA, 75 bp, Artificial Sequence
  Synthetic
atcttggaaaaatccctcaaagccttagtcaaaattatatcagcactagtcatagtagtgaggaatcatgatgac

SEQ ID NO: 76394 - DNA, 75 bp, Artificial Sequence
  Synthetic
gcgcactaacaatagtgcgacgattgtcatgccatacataaatagtgtgcctatggacaatatgttcaggcacaa

SEQ ID NO: 76395 - DNA, 75 bp, Artificial Sequence
  Synthetic
tcacagtattacggtatccctatggctgagcgtcaaaacaacgggtggcttaagaaatttactgaaatgaccaat

SEQ ID NO: 76396 - DNA, 75 bp, Artificial Sequence
  Synthetic
ctgagcgtcaaaacaacgggtggcttaagaaatttactgaaatgaccaatgcttgcaagggaatggagtggatag

SEQ ID NO: 76397 - DNA, 75 bp, Artificial Sequence
  Synthetic
agtgacagtggcgccaatgtgtgctgaatacaatgggttgcgcttggctggtaaacagggcctgcccacaatgtt

SEQ ID NO: 76398 - DNA, 75 bp, Artificial Sequence
  Synthetic
gaatacaatgggttgcgcttggctggtaaacagggcctgcccacaatgttaacacctggtagtaaccagtttctc

SEQ ID NO: 76399 - DNA, 75 bp, Artificial Sequence
  Synthetic
tcaccaggcttaagcaacttccactccttgaaagccaaattgctactattgaacagagcgcaccctcccagagtg

SEQ ID NO: 76400 - DNA, 75 bp, Artificial Sequence
  Synthetic
ccttgaaagccaaattgctactattgaacagagcgcaccctcccagagtgaccaggaacaacttttttcaaatgt

SEQ ID NO: 76401 - DNA, 75 bp, Artificial Sequence
  Synthetic
gtaaacaacttgatggaaatcgcagaggtggattctgtggttcctgttaacaacaccgaggggaaagtgttgtcc

SEQ ID NO: 76402 - DNA, 75 bp, Artificial Sequence
  Synthetic
attgagtcgtaccaaatccctgttcaatcgaattcaacaaacggatcccaagtctttgggtttccattgacacca

SEQ ID NO: 76403 - DNA, 75 bp, Artificial Sequence
  Synthetic
gaagaagatgagcaactacatacagttcaagtccaaatgccgtattgagcctgtatgtctgctcctacatggaag

SEQ ID NO: 76404 - DNA, 75 bp, Artificial Sequence
  Synthetic
ctcgctaccgccagatccagatcacttcgatggttacaaacaacaagctgttgtaatcatggatgatctgtgcca

SEQ ID NO: 76405 - DNA, 75 bp, Artificial Sequence
  Synthetic
ttcgatggttacaaacaacaagctgttgtaatcatggatgatctgtgccaaaatccagatggtaaggatgtatct

SEQ ID NO: 76406 - DNA, 75 bp, Artificial Sequence
  Synthetic
acttcaccgtttgtcctggcatcgaccaatgctggatccatcaatgctcctacggtttcagatagccgagccttg

SEQ ID NO: 76407 - DNA, 75 bp, Artificial Sequence
  Synthetic
ccaatgctggatccatcaatgctcctacggtttcagatagccgagccttggctagaagattccactttgatatga

SEQ ID NO: 76408 - DNA, 75 bp, Artificial Sequence
  Synthetic
tgactgcaagattttgtgctttgtgtcggcctgcaatgatttctcagtcaggatgctcaaagacacaccctttat

SEQ ID NO: 76409 - DNA, 75 bp, Artificial Sequence
  Synthetic
aatgttgcccggtcaatttcaagaggtgctgtcccctcgtgtgtggaaaggctatccagttcattgacaggagaa

SEQ ID NO: 76410 - DNA, 75 bp, Artificial Sequence
  Synthetic
gtgctgtcccctcgtgtgtggaaaggctatccagttcattgacaggagaacccaagtgaggtactcccttgatat

SEQ ID NO: 76411 - DNA, 75 bp, Artificial Sequence
  Synthetic
cccacccatctacagggagatcaagatcagcgtagcacctgagacaccaccaccaccagcaattgcagatctgct

SEQ ID NO: 76412 - DNA, 75 bp, Artificial Sequence
  Synthetic
accacgtacaaaaatcatggtactgatggtgacaactttggttactgggtgatcaacacgcgccaggtggctcaa

SEQ ID NO: 76413 - DNA, 75 bp, Artificial Sequence
  Synthetic
atcagcgtagcacctgagacaccaccaccaccagcaattgcagatctgctcaagtcagtggacagcgaagcagtt

SEQ ID NO: 76414 - DNA, 75 bp, Artificial Sequence
  Synthetic
atggtgacaactttggttactgggtgatcaacacgcgccaggtggctcaactacggcgcaagcttgagatgttca

SEQ ID NO: 76415 - DNA, 75 bp, Artificial Sequence
  Synthetic
agggctttcatttgtcttcaagctctgaccacatttgtgtctgtggctggtattatttatatcatctacaagctc

SEQ ID NO: 76416 - DNA, 75 bp, Artificial Sequence
  Synthetic
attcaccagtgctcacccatcaaatcatgtatgtacccccaggtggcccagtgcccacgaaagtgaacagctaca

SEQ ID NO: 76417 - DNA, 75 bp, Artificial Sequence
  Synthetic
tgaccacatttgtgtctgtggctggtattatttatatcatctacaagctctttgcagggtttcagggtgcgtaca

SEQ ID NO: 76418 - DNA, 75 bp, Artificial Sequence
  Synthetic
cagtggccatgatgaagaggaactcaagtacagtgaagacagaatacggggagttcaccatgttgggcatttatg

SEQ ID NO: 76419 - DNA, 75 bp, Artificial Sequence
  Synthetic
aagtacagtgaagacagaatacggggagttcaccatgttgggcatttatgacagatgggccgttctcccacgcca

SEQ ID NO: 76420 - DNA, 75 bp, Artificial Sequence
  Synthetic
ggatggcacaaatcttgagctaaccttactgaaactcaaccgcaacgaaaagtttagggacatcagaggctttct

SEQ ID NO: 76421 - DNA, 75 bp, Artificial Sequence
  Synthetic
cgtcaagacatgggtcccaagaccacccaggttatgtcagtaccagaaggcaggtaacgtaaattttgagcctac

SEQ ID NO: 76422 - DNA, 75 bp, Artificial Sequence
  Synthetic
caggtaacgtaaattttgagcctactggtgtgactgagagtaggacagatataacaactatgcaaaccaccggtg

SEQ ID NO: 76423 - DNA, 75 bp, Artificial Sequence
  Synthetic
ttactgaaactcaaccgcaacgaaaagtttagggacatcagaggctttcttgctaaagaagaggtggaagttaat

SEQ ID NO: 76424 - DNA, 75 bp, Artificial Sequence
  Synthetic
tttctaaacctaggtggcacccctacaaagagaatgcttatgtacaacttccccaccagagctggccaatgtggt

SEQ ID NO: 76425 - DNA, 75 bp, Artificial Sequence
  Synthetic
aacaaacattacccagttgtctttgaaggcccgggtcttgtggaagtccaagagagtgagtactaccctaagaga

SEQ ID NO: 76426 - DNA, 75 bp, Artificial Sequence
  Synthetic
taccagacacatgtcttgcttgccatgggcttttcggaaccaggggactgtggaggcatcctaagatgcgaacat

SEQ ID NO: 76427 - DNA, 75 bp, Artificial Sequence
  Synthetic
gcagtcctcagaaacggagacccacgactcaaagcaaattttgaggaagcaattttctccaagtacattggcaat

SEQ ID NO: 76428 - DNA, 75 bp, Artificial Sequence
  Synthetic
gactcaaagcaaattttgaggaagcaattttctccaagtacattggcaatgtgaacacatacgtggatgaataca

SEQ ID NO: 76429 - DNA, 75 bp, Artificial Sequence
  Synthetic
tgaaagactacgtagaacagcttggaaatgcttttggctctggattcaccaaccaaatatgtgaacaggttaatc

SEQ ID NO: 76430 - DNA, 75 bp, Artificial Sequence
  Synthetic
gcatcaagaagagagacattttatctaagaagaccagagatctgactaaattaaaggagtgtatggacaaatatg

SEQ ID NO: 76431 - DNA, 75 bp, Artificial Sequence
  Synthetic
cactagtgattgtagtgagaaatcatgatgacctagtaacagtgactgccaccctggccctcattggctgcacat

SEQ ID NO: 76432 - DNA, 75 bp, Artificial Sequence
  Synthetic
tgatgacctagtaacagtgactgccaccctggccctcattggctgcacatcatcaccgtggcgctggcttaagca

SEQ ID NO: 76433 - DNA, 75 bp, Artificial Sequence
  Synthetic
caccatcgagcaaagtgccccatcccaaggtgaccaggagcagcttttctcaaatgtccaatacttcgctcacta

SEQ ID NO: 76434 - DNA, 75 bp, Artificial Sequence
  Synthetic
cgattactccgggtacgatgccagcttgagccccgtgtggtttgcttgcttgaagctactgctggaaaaacttgg

SEQ ID NO: 76435 - DNA, 75 bp, Artificial Sequence
  Synthetic
catacagttcaagtccaaatgccgtattgaacctgtatgcttgcttctgcatggtagccctggagctggaaaatc

SEQ ID NO: 76436 - DNA, 75 bp, Artificial Sequence
  Synthetic
cgtgcgtggcggcatgccatcaggttgctctggcaccagcatcttcaactcaatgatcaacaacatcataatcag

SEQ ID NO: 76437 - DNA, 75 bp, Artificial Sequence
  Synthetic
attgaacctgtatgcttgcttctgcatggtagccctggagctggaaaatcggttgccaccaacctaattgggcga

SEQ ID NO: 76438 - DNA, 75 bp, Artificial Sequence
  Synthetic
caggccgtcgtgatcatggatgacctgtgccaaaacccagatggcaaggatgtgtccttattttgtcaaatggtg

SEQ ID NO: 76439 - DNA, 75 bp, Artificial Sequence
  Synthetic
atgcgccgacagtatcagacagccgggctttagctaggaggttccattttgacatgaatattgaagtcatctcaa

SEQ ID NO: 76440 - DNA, 75 bp, Artificial Sequence
  Synthetic
cgttccttgtgcttattggcctggcacaatggggagcacgaatacgaggaattcatcaagaagattagaagcgtc

SEQ ID NO: 76441 - DNA, 75 bp, Artificial Sequence
  Synthetic
tcaagaggtgttgccctctcgtatgcggtaaggctattcagttcattgatagaaaaacccaaatgaggtattcac

SEQ ID NO: 76442 - DNA, 75 bp, Artificial Sequence
  Synthetic
ccactacagggcccacggcgcgcaagcacactggtatcacggtacttttgtgcgcctgttttatccaccctcccc

SEQ ID NO: 76443 - DNA, 75 bp, Artificial Sequence
  Synthetic
tccaaggtccaccaatatatagagaaattaaaattagtgttgcccctgaaacacccccgccgcctgcaattgcag

SEQ ID NO: 76444 - DNA, 75 bp, Artificial Sequence
  Synthetic
acacccccgccgcctgcaattgcagacttactaaaatcagtggacagtgaagcggtcagggagtattgcaaggag

SEQ ID NO: 76445 - DNA, 75 bp, Artificial Sequence
  Synthetic
caactctgcagcggaaccgactactttgggtgtccgtgtttccttttattctcatctggctgcttatggtgacaa

SEQ ID NO: 76446 - DNA, 75 bp, Artificial Sequence
  Synthetic
ggtttataccacttgattacaatagttacaataccttgctatacatcgttcatttgaacacaacaagatgggagc

SEQ ID NO: 76447 - DNA, 75 bp, Artificial Sequence
  Synthetic
ttacaataccttgctatacatcgttcatttgaacacaacaagatgggagcacaagtgtcaacacagaaaactggc

SEQ ID NO: 76448 - DNA, 75 bp, Artificial Sequence
  Synthetic
ggtcaatgaagccgtcctagcaataaacaccagcaaatttccaaatatgtacatccctgtagggcaggttacaga

SEQ ID NO: 76449 - DNA, 75 bp, Artificial Sequence
  Synthetic
gcatccaactctgccaatagacaggactttacccaagatccgagtaaattcaccgaaccagttaaagatgtgatg

SEQ ID NO: 76450 - DNA, 75 bp, Artificial Sequence
  Synthetic
actttacccaagatccgagtaaattcaccgaaccagttaaagatgtgatgatcaagtccttgcccgctcttaact

SEQ ID NO: 76451 - DNA, 75 bp, Artificial Sequence
  Synthetic
ttattgaaaactccaaagaggcaggctttcccgttatcaatacgccaagcaagactaaattggaaccgagtgtct

SEQ ID NO: 76452 - DNA, 75 bp, Artificial Sequence
  Synthetic
aagaatgcgccaacgtcgtggtggcttacggaaggtggcctgcctatttgagggataatgaagcgaccgcagagg

SEQ ID NO: 76453 - DNA, 75 bp, Artificial Sequence
  Synthetic
ttacggaaggtggcctgcctatttgagggataatgaagcgaccgcagaggaccagccaacacaaccagacgtggc

SEQ ID NO: 76454 - DNA, 75 bp, Artificial Sequence
  Synthetic
aggaggctatattttcaaagtacattgggaatgtcaacacacatgtggacgagtatatgctagaagccgtggacc

SEQ ID NO: 76455 - DNA, 75 bp, Artificial Sequence
  Synthetic
tgggaatgtcaacacacatgtggacgagtatatgctagaagccgtggaccactacgcagggcaattagccaccct

SEQ ID NO: 76456 - DNA, 75 bp, Artificial Sequence
  Synthetic
cgcacttagcaacatgggcctctttggtcagaacatgttgtaccattatctaggaagaacaggttatacaataca

SEQ ID NO: 76457 - DNA, 75 bp, Artificial Sequence
  Synthetic
ggtcagaacatgttgtaccattatctaggaagaacaggttatacaatacacgtacaatgcaatgcgtctaagttc

SEQ ID NO: 76458 - DNA, 75 bp, Artificial Sequence
  Synthetic
aacgagtgcgggatacccgtatgttgcattaggcatcaagaagagggacattttatccaaaaagactaaggactt

SEQ ID NO: 76459 - DNA, 75 bp, Artificial Sequence
  Synthetic
gcattaggcatcaagaagagggacattttatccaaaaagactaaggacttaaccaaattgaaggagtgcatggat

SEQ ID NO: 76460 - DNA, 75 bp, Artificial Sequence
  Synthetic
gcccaagggctgtccaatagtgaaactcccattgaatttgacagaacaagcacagcaccagaggttggagtggtg

SEQ ID NO: 76461 - DNA, 75 bp, Artificial Sequence
  Synthetic
ctcccattgaatttgacagaacaagcacagcaccagaggttggagtggtgcaaaaggcagtgtataacgcgggta

SEQ ID NO: 76462 - DNA, 75 bp, Artificial Sequence
  Synthetic
tagtgataccttacataaattgtgtacctatggataacatgtttaggcacaacaacttcactctcatggttatcc

SEQ ID NO: 76463 - DNA, 75 bp, Artificial Sequence
  Synthetic
acctatggataacatgtttaggcacaacaacttcactctcatggttatcccgtttgcacctttaaaaagcagtgg

SEQ ID NO: 76464 - DNA, 75 bp, Artificial Sequence
  Synthetic
tagcctttgattattctgggtatgatgccagtttgagccctgtgtggtttgcttgtctaaagctactgcttgaga

SEQ ID NO: 76465 - DNA, 75 bp, Artificial Sequence
  Synthetic
tgccagtttgagccctgtgtggtttgcttgtctaaagctactgcttgagaagctcggatactcgcataaagaaac

SEQ ID NO: 76466 - DNA, 75 bp, Artificial Sequence
  Synthetic
gcaccaagggttgccaaccatgaacactccagggagcacgcaatttcttacgtctgatgacttccaatcaccttg

SEQ ID NO: 76467 - DNA, 75 bp, Artificial Sequence
  Synthetic
actccagggagcacgcaatttcttacgtctgatgacttccaatcaccttgcgccatgcctgaatttgacgtgaca

SEQ ID NO: 76468 - DNA, 75 bp, Artificial Sequence
  Synthetic
ttcaggatgctctggaaccagtatcttcaactcaatgattaacaatattataatcagaacactaatgctgaaagt

SEQ ID NO: 76469 - DNA, 75 bp, Artificial Sequence
  Synthetic
aacaccaccacgcacatggaaggaactgatgcatttcagatcaaggttactgctggcaatgtgcaggataaaaac

SEQ ID NO: 76470 - DNA, 75 bp, Artificial Sequence
  Synthetic
gtacaaaggcatcgacctggatcaatttaggatgattgcttatggtgacgacgtaatcgcatcttacccctggcc

SEQ ID NO: 76471 - DNA, 75 bp, Artificial Sequence
  Synthetic
ctgatgcatttcagatcaaggttactgctggcaatgtgcaggataaaaacgcaatattttccttccagctgaacc

SEQ ID NO: 76472 - DNA, 75 bp, Artificial Sequence
  Synthetic
ttttaatgaagtcacctggactaatgtcacctttttgaaaaggtatttcagagcagatgagcaatatcctttctt

SEQ ID NO: 76473 - DNA, 75 bp, Artificial Sequence
  Synthetic
ttaagttgaccttcctcttttgtggatcagccatggccaccggtaagcttttgcttgcgtattcaccacctggag

SEQ ID NO: 76474 - DNA, 75 bp, Artificial Sequence
  Synthetic
gtcacctttttgaaaaggtatttcagagcagatgagcaatatcctttcttggtccatccagttatgcctatgaaa

SEQ ID NO: 76475 - DNA, 75 bp, Artificial Sequence
  Synthetic
atcagccatggccaccggtaagcttttgcttgcgtattcaccacctggagcatctgtgccgaaatcccgcagaga

SEQ ID NO: 76476 - DNA, 75 bp, Artificial Sequence
  Synthetic
gcttggcacaatggggagcgtgagtatgaggagttcatccaaaagattagaagcgtcccagttggacgctgtttg

SEQ ID NO: 76477 - DNA, 75 bp, Artificial Sequence
  Synthetic
ccaaacgcactacagactcgtggcacaagatgagtacacgtccgcaggctacatcacttgctggtatcagaccaa

SEQ ID NO: 76478 - DNA, 75 bp, Artificial Sequence
  Synthetic
tctgactgtgtggtgttgtgttttgtgtctgcatgcaatgacttctcagtgcggatgctcaaggataccccattc

SEQ ID NO: 76479 - DNA, 75 bp, Artificial Sequence
  Synthetic
aattggagacaatttaataatttaaattggcttaaccctaccgcactcaccgaactaaaaacggtgcgggtaggg

SEQ ID NO: 76480 - DNA, 75 bp, Artificial Sequence
  Synthetic
gtccgagtccaccatagaaaacttcctttgcagggcagcttgtgtgcgtatggctaaatatgaggcaaggggcga

SEQ ID NO: 76481 - DNA, 75 bp, Artificial Sequence
  Synthetic
gtcccatccctaagaaggtggatggctatgagtggcagacatcaactaaccctagcatattttggaccgaaggaa

SEQ ID NO: 76482 - DNA, 75 bp, Artificial Sequence
  Synthetic
actttgacagcaaaggcgcctatgggttcaacaccttaaacaagatgggacacatttattgcaggcacgtgaaca

SEQ ID NO: 76483 - DNA, 75 bp, Artificial Sequence
  Synthetic
gttcaacaccttaaacaagatgggacacatttattgcaggcacgtgaacaaggagactcctgctgaagtcaccag

SEQ ID NO: 76484 - DNA, 75 bp, Artificial Sequence
  Synthetic
aaacaaggcgaatgtgaacttcgacgcaactgcagtcaccgaaacacgaaaaactataaacactgttcctgtgtc

SEQ ID NO: 76485 - DNA, 75 bp, Artificial Sequence
  Synthetic
gcaactgcagtcaccgaaacacgaaaaactataaacactgttcctgtgtcaaaccatggtggcaaacgccgaggt

SEQ ID NO: 76486 - DNA, 75 bp, Artificial Sequence
  Synthetic
gtgaataggcaccttgcaacacacactgattggcaaaactgcatatgggaagattacaacagagatttgctagtc

SEQ ID NO: 76487 - DNA, 75 bp, Artificial Sequence
  Synthetic
ctgattggcaaaactgcatatgggaagattacaacagagatttgctagtcagtaccaccactgctcatggatgcg

SEQ ID NO: 76488 - DNA, 75 bp, Artificial Sequence
  Synthetic
ttgaagggcctggtttagtggaagttcaggagagtgaatactaccccaagagatatcagtcacacgtactacttg

SEQ ID NO: 76489 - DNA, 75 bp, Artificial Sequence
  Synthetic
tcaggagagtgaatactaccccaagagatatcagtcacacgtactacttgcagcaggtttttccgagccaggcga

SEQ ID NO: 76490 - DNA, 75 bp, Artificial Sequence
  Synthetic
tgctgacatgcgtgacctcctatggttggaagacgatgcaatggaacaaggtgttaaggattacgtggagcaact

SEQ ID NO: 76491 - DNA, 75 bp, Artificial Sequence
  Synthetic
ttggaagacgatgcaatggaacaaggtgttaaggattacgtggagcaactcgggaatgccttcggttcaggattc

SEQ ID NO: 76492 - DNA, 75 bp, Artificial Sequence
  Synthetic
ctcaaggccctagttaaaatcatttcagcactagttatagtggtgagaaaccatgatgacctgatcacaataact

SEQ ID NO: 76493 - DNA, 75 bp, Artificial Sequence
  Synthetic
cagcactagttatagtggtgagaaaccatgatgacctgatcacaataactgctacccttgcactaattggttgca

SEQ ID NO: 76494 - DNA, 75 bp, Artificial Sequence
  Synthetic
atggttggttaaagaagtttgcagaaatgaccaacgcctgcaagggcatggaatggattgccattaagattcaaa

SEQ ID NO: 76495 - DNA, 75 bp, Artificial Sequence
  Synthetic
cacgagtttttaatcaggctcaagcaactgccattgctagaaagtcagattgccactattgagcaaagtgcgcct

SEQ ID NO: 76496 - DNA, 75 bp, Artificial Sequence
  Synthetic
tctccctagaaaagaaaatgagcaattacatacaattcaagtccaaatgccgtattgaacctgtatgtctcttac

SEQ ID NO: 76497 - DNA, 75 bp, Artificial Sequence
  Synthetic
gttcagtatactcactgccaccagacccagaccacttcgacggttacaaacaacaagctgttgtgatcatggatg

SEQ ID NO: 76498 - DNA, 75 bp, Artificial Sequence
  Synthetic
cccagaccacttcgacggttacaaacaacaagctgttgtgatcatggatgacttgtgccagaacccagacgggaa

SEQ ID NO: 76499 - DNA, 75 bp, Artificial Sequence
  Synthetic
tatacttttcacatcaccgttcgtccttgcttccactaatgcaggatccatcaacgctcccaccgtttcagatag

SEQ ID NO: 76500 - DNA, 75 bp, Artificial Sequence
  Synthetic
cttgcttccactaatgcaggatccatcaacgctcccaccgtttcagatagtagagctcttgctagaagatttcac

SEQ ID NO: 76501 - DNA, 75 bp, Artificial Sequence
  Synthetic
tgtgacgaggagtgctgcccggctaacttcaagaggtgttgcccgttagtctgcggaaaggccatccagtttgtt

SEQ ID NO: 76502 - DNA, 75 bp, Artificial Sequence
  Synthetic
acttcaagaggtgttgcccgttagtctgcggaaaggccatccagtttgttgacagaagaacacagatgcgatact

SEQ ID NO: 76503 - DNA, 75 bp, Artificial Sequence
  Synthetic
ttaaaacagcctgtgggttgatcccacccgcagggcccactgggcgtaagcacactggtattacggtacctttgt

SEQ ID NO: 76504 - DNA, 75 bp, Artificial Sequence
  Synthetic
tgttccaaggaccgccggtgtatagggagatcaagattagcgtcgcaccagagacccctcctccaccagctattg

SEQ ID NO: 76505 - DNA, 75 bp, Artificial Sequence
  Synthetic
cacactggtattacggtacctttgtgcgcctgttttatacacccctcccccgatgtaacttagaagttcaatgca

SEQ ID NO: 76506 - DNA, 75 bp, Artificial Sequence
  Synthetic
ggagatcaagattagcgtcgcaccagagacccctcctccaccagctattgccgaccttctgaaatcagtggatag

SEQ ID NO: 76507 - DNA, 75 bp, Artificial Sequence
  Synthetic
ccagttgggttcagatcaagcacttctgttaccccggactgagtatcaataagctgctcacgtggctgaaagaga

SEQ ID NO: 76508 - DNA, 75 bp, Artificial Sequence
  Synthetic
gcatgtcagcagggccttcatttgcttgcaagcgctcactacttttgtctcagtggcgggcattatatacatcat

SEQ ID NO: 76509 - DNA, 75 bp, Artificial Sequence
  Synthetic
ttgcaagcgctcactacttttgtctcagtggcgggcattatatacatcatttacaagctgtttgcaggcttccaa

SEQ ID NO: 76510 - DNA, 75 bp, Artificial Sequence
  Synthetic
caaccccagtgtagatcaggtcgatgagtcaccgcattccccacaggcgactgtggcggtggctgcgttggcggc

SEQ ID NO: 76511 - DNA, 75 bp, Artificial Sequence
  Synthetic
tttgagtttgctgtggccatgatgaagagaaatgccagcaccgtgaagactgaatacggtgagtttacaatgctt

SEQ ID NO: 76512 - DNA, 75 bp, Artificial Sequence
  Synthetic
agagaaatgccagcaccgtgaagactgaatacggtgagtttacaatgcttgggatatatgacagatgggctgtgt

SEQ ID NO: 76513 - DNA, 75 bp, Artificial Sequence
  Synthetic
ctgcccatggggttacccatgggacgctacaatactgacatggtgcgaagagcctactgagctaactggtattcc

SEQ ID NO: 76514 - DNA, 75 bp, Artificial Sequence
  Synthetic
tggtggacaaggatggcactaatctggagttgacactcctgaaactaaataggaacgaaaagttcagagacatca

SEQ ID NO: 76515 - DNA, 75 bp, Artificial Sequence
  Synthetic
ggagttgacactcctgaaactaaataggaacgaaaagttcagagacatcagaggcttcttggcgcgagaggaggc

SEQ ID NO: 76516 - DNA, 75 bp, Artificial Sequence
  Synthetic
ttgggtgtccgtgtttccttttattcttgttatggctgcttatggtgacaatcacagaattgttaccatatagct

SEQ ID NO: 76517 - DNA, 75 bp, Artificial Sequence
  Synthetic
acctacgcacgctttgttatattattgaattaaatacagcaagatgggcgcgcaagtgtcaacacagaaaacagg

SEQ ID NO: 76518 - DNA, 75 bp, Artificial Sequence
  Synthetic
agactatggttttcttaatctgggaggaacccccaccaagcgcatgttaatgtacaacttccctacgcgtgcagg

SEQ ID NO: 76519 - DNA, 75 bp, Artificial Sequence
  Synthetic
tgaattaaatacagcaagatgggcgcgcaagtgtcaacacagaaaacaggtgctcacgaaactggcttgaatgct

SEQ ID NO: 76520 - DNA, 75 bp, Artificial Sequence
  Synthetic
ggaacccccaccaagcgcatgttaatgtacaacttccctacgcgtgcaggacaatgtggcggtgtcctgatgtca

SEQ ID NO: 76521 - DNA, 75 bp, Artificial Sequence
  Synthetic
gattttgcacaagatccgggcaaattcacggagccagtaaaagatataatgattaagtccctaccagccctgaat

SEQ ID NO: 76522 - DNA, 75 bp, Artificial Sequence
  Synthetic
ttcaatgatgaacagggtgagatcgagttcattgaaagttccaaggaggccggcttcccggtcatcaacaccccc

SEQ ID NO: 76523 - DNA, 75 bp, Artificial Sequence
  Synthetic
tcacggagccagtaaaagatataatgattaagtccctaccagccctgaattcccccactgtagaagagtgtgggt

SEQ ID NO: 76524 - DNA, 75 bp, Artificial Sequence
  Synthetic
agttcattgaaagttccaaggaggccggcttcccggtcatcaacacccccagtaaaacgaagctcgagcctagcg

SEQ ID NO: 76525 - DNA, 75 bp, Artificial Sequence
  Synthetic
gatatggagtgtggccggactatctcaaagataatgaggcaacagcagaagatcaaccaacccaaccggatgtcg

SEQ ID NO: 76526 - DNA, 75 bp, Artificial Sequence
  Synthetic
ttgaggaggccatcttctctaagtatattgggaatgtgaacacacatgtggatgaatacatgatggaagctgtag

SEQ ID NO: 76527 - DNA, 75 bp, Artificial Sequence
  Synthetic
caaagataatgaggcaacagcagaagatcaaccaacccaaccggatgtcgcgacatgcaggttttacactcttga

SEQ ID NO: 76528 - DNA, 75 bp, Artificial Sequence
  Synthetic
tattgggaatgtgaacacacatgtggatgaatacatgatggaagctgtagaccactatgctggacaactggcgac

SEQ ID NO: 76529 - DNA, 75 bp, Artificial Sequence
  Synthetic
tgggcaaaacatgcaatatcactacttaggccgaactgggtatactatccatgtacaatgcaacgcatccaagtt

SEQ ID NO: 76530 - DNA, 75 bp, Artificial Sequence
  Synthetic
gacaactagtgcaggatacccctatgttgctcttggcataaagaaaagggacattttgtccaagaagacaaaaga

SEQ ID NO: 76531 - DNA, 75 bp, Artificial Sequence
  Synthetic
ttaggccgaactgggtatactatccatgtacaatgcaacgcatccaagttccaccaaggatgcttgctcgtagtg

SEQ ID NO: 76532 - DNA, 75 bp, Artificial Sequence
  Synthetic
gttgctcttggcataaagaaaagggacattttgtccaagaagacaaaagatctgaccaaattaaaggaatgtatg

SEQ ID NO: 76533 - DNA, 75 bp, Artificial Sequence
  Synthetic
agtgcaatggagtttacagataaaccggtcgctgccggatcaaacaaactggtacaaagggtggtccacaatgcg

SEQ ID NO: 76534 - DNA, 75 bp, Artificial Sequence
  Synthetic
ggtaagtccagacttattgaagcatccagcttgaatgactctgttgcaatgagacagacttttggtaatttatat

SEQ ID NO: 76535 - DNA, 75 bp, Artificial Sequence
  Synthetic
cggtcgctgccggatcaaacaaactggtacaaagggtggtccacaatgcggggatgggagtgggtgttggaaacc

SEQ ID NO: 76536 - DNA, 75 bp, Artificial Sequence
  Synthetic
ccagcttgaatgactctgttgcaatgagacagacttttggtaatttatataaaacattccatctgaacccaggga

SEQ ID NO: 76537 - DNA, 75 bp, Artificial Sequence
  Synthetic
gtgtgcccatggataacatgtttaggcataataatgccacattaatggttattccattcgtaccgctggactact

SEQ ID NO: 76538 - DNA, 75 bp, Artificial Sequence
  Synthetic
ttatagcctttgattattccgggtatgatgccagtttgagccccgtatggtttgcttgtttgaagctactgcttg

SEQ ID NO: 76539 - DNA, 75 bp, Artificial Sequence
  Synthetic
gcataataatgccacattaatggttattccattcgtaccgctggactactgcactggctccaccacctacgtgcc

SEQ ID NO: 76540 - DNA, 75 bp, Artificial Sequence
  Synthetic
tgatgccagtttgagccccgtatggtttgcttgtttgaagctactgcttgaaaaacttgggtactcacacaaaga

SEQ ID NO: 76541 - DNA, 75 bp, Artificial Sequence
  Synthetic
tatgaacaccccaggaagttgccagttcctaacatcagatgattttcaatcgccctccgcgatgccacagtatga

SEQ ID NO: 76542 - DNA, 75 bp, Artificial Sequence
  Synthetic
ttcctaacatcagatgattttcaatcgccctccgcgatgccacagtatgatgtgacaccagagatgcgaataccc

SEQ ID NO: 76543 - DNA, 75 bp, Artificial Sequence
  Synthetic
aacaccatggaggcataccaaatacccgtgagatcaaaccaagggtcgggtacgcaagtgtttggatttccattg

SEQ ID NO: 76544 - DNA, 75 bp, Artificial Sequence
  Synthetic
ccgtgagatcaaaccaagggtcgggtacgcaagtgtttggatttccattgcaaccaggctactcaagtgtgttca

SEQ ID NO: 76545 - DNA, 75 bp, Artificial Sequence
  Synthetic
aatgtcacctttttgaaaagatacttcagagcagatgaacaatatcccttcctagtccatccggtcatgcccatg

SEQ ID NO: 76546 - DNA, 75 bp, Artificial Sequence
  Synthetic
tcagagcagatgaacaatatcccttcctagtccatccggtcatgcccatgaaggatatccatgaatctatcaggt

SEQ ID NO: 76547 - DNA, 75 bp, Artificial Sequence
  Synthetic
gtgggtcggccatggccactgggaaattccttctagcatactcaccaccaggggctggagcccctacgaagagag

SEQ ID NO: 76548 - DNA, 75 bp, Artificial Sequence
  Synthetic
attccttctagcatactcaccaccaggggctggagcccctacgaagagagtggacgctatgcttggtacgcatgt

SEQ ID NO: 76549 - DNA, 75 bp, Artificial Sequence
  Synthetic
aatatgaggagtttattgaaaagatcagaagtgtcccagtggggcgctgtttaactctacctgcgttttcaaccc

SEQ ID NO: 76550 - DNA, 75 bp, Artificial Sequence
  Synthetic
agcatccgatgagtacaccgcagggggctttatcacttgctggtatcaaacaaacatagtggtgcctgcagacgc

SEQ ID NO: 76551 - DNA, 75 bp, Artificial Sequence
  Synthetic
tgcgcaggaagtggctggactccttttaaattagagtcaatttgacaacaatttaaattggcttaaccctaccgc

SEQ ID NO: 76552 - DNA, 75 bp, Artificial Sequence
  Synthetic
ggctttatcacttgctggtatcaaacaaacatagtggtgcctgcagacgcccagagctcatgttatattatgtgc

SEQ ID NO: 76553 - DNA, 75 bp, Artificial Sequence
  Synthetic
caaggtcctgtagaggatgcattagcagccgctatagggagggttgcagacacagtgggaactggaccgaccaac

SEQ ID NO: 76554 - DNA, 75 bp, Artificial Sequence
  Synthetic
cagccgctatagggagggttgcagacacagtgggaactggaccgaccaactcagaggcaattccagcgcttactg

SEQ ID NO: 76555 - DNA, 75 bp, Artificial Sequence
  Synthetic
cgaggtctgagtctaccatcgagaactttctatgtagatcagcatgtgtgtattttacagaatacgagaactcag

SEQ ID NO: 76556 - DNA, 75 bp, Artificial Sequence
  Synthetic
ctttctatgtagatcagcatgtgtgtattttacagaatacgagaactcaggctcaaagcggtacgccgaatgggt

SEQ ID NO: 76557 - DNA, 75 bp, Artificial Sequence
  Synthetic
gacctttgtaatcactagcacccaacaaccctccaccacacaaaatcaggatgcgcagatactaacacaccaaat

SEQ ID NO: 76558 - DNA, 75 bp, Artificial Sequence
  Synthetic
caaccctccaccacacaaaatcaggatgcgcagatactaacacaccaaatcatgtatgtaccacctggtgggcca

SEQ ID NO: 76559 - DNA, 75 bp, Artificial Sequence
  Synthetic
ccaccacgcatgtccataccattcctgagcattggcaatgcatactcaaacttttatgatggatggtccgaattt

SEQ ID NO: 76560 - DNA, 75 bp, Artificial Sequence
  Synthetic
tgagcattggcaatgcatactcaaacttttatgatggatggtccgaattttcaaggaacggtgtctatggcatta

SEQ ID NO: 76561 - DNA, 75 bp, Artificial Sequence
  Synthetic
tcaggatctacttcaaacccaagcacgttaaggcgtggatacccagaccccctagactttgtcagtatgagaaag

SEQ ID NO: 76562 - DNA, 75 bp, Artificial Sequence
  Synthetic
cgttaaggcgtggatacccagaccccctagactttgtcagtatgagaaagcgaagaacgtaaacttccagcctag

SEQ ID NO: 76563 - DNA, 75 bp, Artificial Sequence
  Synthetic
ccagttggactccgaccaagtacttctgttaccccggactgagtatccttatgctgtccacacggctgaaggaga

SEQ ID NO: 76564 - DNA, 75 bp, Artificial Sequence
  Synthetic
gtatgtcggaaattacagggtggtcaatagacacttggccacacgcaacgattggcaaaactgtgtgtgggagaa

SEQ ID NO: 76565 - DNA, 75 bp, Artificial Sequence
  Synthetic
aatagacacttggccacacgcaacgattggcaaaactgtgtgtgggagaactataacagggatctactagttagt

SEQ ID NO: 76566 - DNA, 75 bp, Artificial Sequence
  Synthetic
agcaaacactacccagtgaactttgagggacccggcctagtggaagttcaagagagtgaatactaccccaagaga

SEQ ID NO: 76567 - DNA, 75 bp, Artificial Sequence
  Synthetic
agggacccggcctagtggaagttcaagagagtgaatactaccccaagagatatcagtctcatgtactcttagcag

SEQ ID NO: 76568 - DNA, 75 bp, Artificial Sequence
  Synthetic
gaggtgaaggtgtcgttggttttgctgacatacgtgacctgctatggttagaggatgatgtaatggagcagggtg

SEQ ID NO: 76569 - DNA, 75 bp, Artificial Sequence
  Synthetic
tgacatacgtgacctgctatggttagaggatgatgtaatggagcagggtgtcaaggcttatgtggaacaacttgg

SEQ ID NO: 76570 - DNA, 75 bp, Artificial Sequence
  Synthetic
ggactccattttggaaaaatctttaaaggcactggtcagaatcatatcagcactagtgatagtggtgagaaacca

SEQ ID NO: 76571 - DNA, 75 bp, Artificial Sequence
  Synthetic
aaggcactggtcagaatcatatcagcactagtgatagtggtgagaaaccatgacgacctaattacagtgactgcc

SEQ ID NO: 76572 - DNA, 75 bp, Artificial Sequence
  Synthetic
cccacggctgagcgccagaacaatgggtggctcaagaaattcaccgaaatgaccaatgcttgcaagggtatggag

SEQ ID NO: 76573 - DNA, 75 bp, Artificial Sequence
  Synthetic
ggtggctcaagaaattcaccgaaatgaccaatgcttgcaagggtatggagtggatagccattaaaattcagaaat

SEQ ID NO: 76574 - DNA, 75 bp, Artificial Sequence
  Synthetic
tccccctcctggaaagtcagattgccaccatcgagcagagtgcgccctctcaaagtgaccaagagcaattattct

SEQ ID NO: 76575 - DNA, 75 bp, Artificial Sequence
  Synthetic
caccatcgagcagagtgcgccctctcaaagtgaccaagagcaattattctccaatgtacagtattttgcccatta

SEQ ID NO: 76576 - DNA, 75 bp, Artificial Sequence
  Synthetic
cggccagaacatgcaataccactacttgggtcgtgcagggtacaccatacatgtgcagtgtaatgcgtccaaatt

SEQ ID NO: 76577 - DNA, 75 bp, Artificial Sequence
  Synthetic
tatacagttcaagtccaaatgccgtattgaacctgtatgcttgcttttgcacggaagtcctggtgcagggaaatc

SEQ ID NO: 76578 - DNA, 75 bp, Artificial Sequence
  Synthetic
agttgccaccaatctgattggacgttcactagccgaaaagctcaacagctcggtgtactccctaccaccagatcc

SEQ ID NO: 76579 - DNA, 75 bp, Artificial Sequence
  Synthetic
tctagtgtggatttcgtaccaccaatggcagcactagaggaaaaaggtatcctattcacctctccctttgtcctg

SEQ ID NO: 76580 - DNA, 75 bp, Artificial Sequence
  Synthetic
tggcagcactagaggaaaaaggtatcctattcacctctccctttgtcctggcttcgaccaatgctggttccataa

SEQ ID NO: 76581 - DNA, 75 bp, Artificial Sequence
  Synthetic
caacttcacactgatggtgataccttttgttaaactggattatgctgacaccgcatccacttatgtaccaatcac

SEQ ID NO: 76582 - DNA, 75 bp, Artificial Sequence
  Synthetic
tgtatagccagaacgggaagataaacatgcccatgtcagtcaagacttgtgatgaggaatgttgcccggtcaatt

SEQ ID NO: 76583 - DNA, 75 bp, Artificial Sequence
  Synthetic
cgtcactgttgccccgatgtgcgctgagtacaatggtctgcggttggcgcaggcacaaggtttaccgactatgaa

SEQ ID NO: 76584 - DNA, 75 bp, Artificial Sequence
  Synthetic
catgcccatgtcagtcaagacttgtgatgaggaatgttgcccggtcaatttcaagaagtgctgccccctcgtgtg

SEQ ID NO: 76585 - DNA, 75 bp, Artificial Sequence
  Synthetic
cagggagtataatcacaggcatagtgtcggggcgactctagaagcactctttcaaggtccaccagtatataggga

SEQ ID NO: 76586 - DNA, 75 bp, Artificial Sequence
  Synthetic
gtcggggcgactctagaagcactctttcaaggtccaccagtatatagggagatcaaaatcagtgttgcacctgag

SEQ ID NO: 76587 - DNA, 75 bp, Artificial Sequence
  Synthetic
ggactagacagcgtgttcaagcacactctactgggagagatcctaaactactacgcccactggtcaggcagcatg

SEQ ID NO: 76588 - DNA, 75 bp, Artificial Sequence
  Synthetic
aggggatggttgataccagaggtcaatcccactctccaaattgagaagcatgttagccgtgcttttatctgcctc

SEQ ID NO: 76589 - DNA, 75 bp, Artificial Sequence
  Synthetic
atcccactctccaaattgagaagcatgttagccgtgcttttatctgcctccaagcattaactacgtttgtgtccg

SEQ ID NO: 76590 - DNA, 75 bp, Artificial Sequence
  Synthetic
aaccaaaggtgcccacactgagacaagcaaaggtgcaagggcctgccttcgaattcgctgttgctatgatgaaaa

SEQ ID NO: 76591 - DNA, 75 bp, Artificial Sequence
  Synthetic
agcaaaggtgcaagggcctgccttcgaattcgctgttgctatgatgaaaagaaactccagtacagtgaagactga

SEQ ID NO: 76592 - DNA, 75 bp, Artificial Sequence
  Synthetic
cattttgatgaatgatcaggaggttggtgtagtggacgccaaagagctggtggacaaggatggtacaaacctgga

SEQ ID NO: 76593 - DNA, 75 bp, Artificial Sequence
  Synthetic
ggtgtagtggacgccaaagagctggtggacaaggatggtacaaacctggagttaacgctgctcaagctaaatcga

SEQ ID NO: 76594 - DNA, 75 bp, Artificial Sequence
  Synthetic
aataccagcaagttccctaatatgtacatcccagtggggcaagtcacagactacggcttcttgaatctgggtggc

SEQ ID NO: 76595 - DNA, 75 bp, Artificial Sequence
  Synthetic
acatcccagtggggcaagtcacagactacggcttcttgaatctgggtggcactcctacgaaaaggatgctcatgt

SEQ ID NO: 76596 - DNA, 75 bp, Artificial Sequence
  Synthetic
gtggcaatggccaccaaggcttctcagcggcacttctcaagcactacttcaatgatgagcaaggtgaaatcgaat

SEQ ID NO: 76597 - DNA, 75 bp, Artificial Sequence
  Synthetic
agcggcacttctcaagcactacttcaatgatgagcaaggtgaaatcgaattcattgaaagctcgaaggacgcggg

SEQ ID NO: 76598 - DNA, 75 bp, Artificial Sequence
  Synthetic
agaaccagcagtccttaggaatggcgacccacgtctcaaggccaatttcgaggaagccatattctcaaaatatat

SEQ ID NO: 76599 - DNA, 75 bp, Artificial Sequence
  Synthetic
gacccacgtctcaaggccaatttcgaggaagccatattctcaaaatatattggaaatgtcaatacacacgtggac

SEQ ID NO: 76600 - DNA, 75 bp, Artificial Sequence
  Synthetic
ctagaggacgcggtgtacggcacggagggcttggaagccctcgacctgacaacaagtgcagggtacccgtacgtc

SEQ ID NO: 76601 - DNA, 75 bp, Artificial Sequence
  Synthetic
agggcttggaagccctcgacctgacaacaagtgcagggtacccgtacgtcgctttgggcatcaagaagagggaca

SEQ ID NO: 76602 - DNA, 75 bp, Artificial Sequence
  Synthetic
tgacttacgtgaaggatgagctcagatcagctgagaaagtggcaaaagggaagtcgagactcattgaggcttcga

SEQ ID NO: 76603 - DNA, 75 bp, Artificial Sequence
  Synthetic
atcagctgagaaagtggcaaaagggaagtcgagactcattgaggcttcgagcttgaatgattccgtagcaatgag

SEQ ID NO: 76604 - DNA, 75 bp, Artificial Sequence
  Synthetic
tgcagagcaagcgcaggggtgacctggccgcactaaacactcatggtgcgtttggacaccagtcaggtgctgtgt

SEQ ID NO: 76605 - DNA, 75 bp, Artificial Sequence
  Synthetic
tccggatcttttttggagcaagatacctgtaatgttggatggacatctcatagcttttgattactcgggatatga

SEQ ID NO: 76606 - DNA, 75 bp, Artificial Sequence
  Synthetic
cctgtaatgttggatggacatctcatagcttttgattactcgggatatgatgccagccttagtcccgtctggttt

SEQ ID NO: 76607 - DNA, 75 bp, Artificial Sequence
  Synthetic
tcccatcacctgtatagagacaagcactactttgtacgagggggtatgccttcaggatgttctgggaccagtata

SEQ ID NO: 76608 - DNA, 75 bp, Artificial Sequence
  Synthetic
actactttgtacgagggggtatgccttcaggatgttctgggaccagtatattcaattcgatgataaacaacatca

SEQ ID NO: 76609 - DNA, 75 bp, Artificial Sequence
  Synthetic
atgtgattgcttcgtacccctggcccattgacgcctcgctactagctgaagccggtaaggattatgggttgacta

SEQ ID NO: 76610 - DNA, 75 bp, Artificial Sequence
  Synthetic
cattgacgcctcgctactagctgaagccggtaaggattatgggttgactatgacaccagcagacaagggagagtg

SEQ ID NO: 76611 - DNA, 75 bp, Artificial Sequence
  Synthetic
ggtgcaccctgtcatgcccatgaaggacatccacgagtccatcagatggaccaaggatccaaagaacactcaaga

SEQ ID NO: 76612 - DNA, 75 bp, Artificial Sequence
  Synthetic
ctggtgatcgtggtgagaaaccatgatgacctaataacagtgacagctaccctcgcccttattggatgtacatca

SEQ ID NO: 76613 - DNA, 75 bp, Artificial Sequence
  Synthetic
gacatccacgagtccatcagatggaccaaggatccaaagaacactcaagatcatgtgcgctcattgtgcctattg

SEQ ID NO: 76614 - DNA, 75 bp, Artificial Sequence
  Synthetic
acactacctgcattctcaacactacgcagaaaatggttggattctttctaatttagagacaattcgaagtaatta

SEQ ID NO: 76615 - DNA, 75 bp, Artificial Sequence
  Synthetic
tgcctgaagtcagggagaagcatgagtttctcaataggcttaaacaactccccctactggaaagccaaattgcca

SEQ ID NO: 76616 - DNA, 75 bp, Artificial Sequence
  Synthetic
gaattggcttaaccctactgcatcaaccgaactagataacggtgcagtaggggtaaattctccgctttcggtgcg

SEQ ID NO: 76617 - DNA, 75 bp, Artificial Sequence
  Synthetic
tgctgaagcaaagagggtgttctcccttgaaaagaagatgagcaactacatacaattcaagtgcgaaagccgtat

SEQ ID NO: 76618 - DNA, 75 bp, Artificial Sequence
  Synthetic
cctagcggagaagacgaatagttcaatgttctatatgccaccagaacccgaccacttagatggttacaagcaaca

SEQ ID NO: 76619 - DNA, 75 bp, Artificial Sequence
  Synthetic
atgttctatatgccaccagaacccgaccacttagatggttacaagcaacaggtggtcatgattatggatgatcta

SEQ ID NO: 76620 - DNA, 75 bp, Artificial Sequence
  Synthetic
gccgtcctggaggaaaagggtatcctgttcgcttctccgttggtgatggcatcaacgaatgatggttatatcaat

SEQ ID NO: 76621 - DNA, 75 bp, Artificial Sequence
  Synthetic
tgttcgcttctccgttggtgatggcatcaacgaatgatggttatatcaatgcttcaacggtttcaggtagtagag

SEQ ID NO: 76622 - DNA, 75 bp, Artificial Sequence
  Synthetic
tgtccatgtctgttaaaccatatgatgaggagtgttgtccaactaatttcaaaagatgctgcccccttgggtggg

SEQ ID NO: 76623 - DNA, 75 bp, Artificial Sequence
  Synthetic
tgaggagtgttgtccaactaatttcaaaagatgctgcccccttgggtggggaaaggctaaccagtttattgacag

SEQ ID NO: 76624 - DNA, 75 bp, Artificial Sequence
  Synthetic
gggggcaaccctcgaggcactgttccatggcacaccagtgtatagggagatcaagatcagtgtcgcgcctgaaac

SEQ ID NO: 76625 - DNA, 75 bp, Artificial Sequence
  Synthetic
catggcacaccagtgtatagggagatcaagatcagtgtcgcgcctgaaaccccaccaccaccagcgatcgcagac

SEQ ID NO: 76626 - DNA, 75 bp, Artificial Sequence
  Synthetic
tctactctccaaattgaaaaacacgttagcagggcgttcatatgtctccaagcactgacaaccttcgtttctgtg

SEQ ID NO: 76627 - DNA, 75 bp, Artificial Sequence
  Synthetic
ccaaggtacaaggtcccgctttcgaatttgctgtggctatgatgaaaagaaattccagcactgtgaaaacagagt

SEQ ID NO: 76628 - DNA, 75 bp, Artificial Sequence
  Synthetic
ttctcatgaatgatcaagaagttggagtgctggatgcaaaggaattggtagacaaggatggtacgaaccttgaac

SEQ ID NO: 76629 - DNA, 75 bp, Artificial Sequence
  Synthetic
gacaaggatggtacgaaccttgaactaacattactaaagctcaaccgcaatgaaaaattcagggatatcagaggt

SEQ ID NO: 76630 - DNA, 75 bp, Artificial Sequence
  Synthetic
ggaaacggtcaccaaggattctcagcagccctcctcaaacactacttcaatgatgaacaaggtgagattgaattc

SEQ ID NO: 76631 - DNA, 75 bp, Artificial Sequence
  Synthetic
cagccctcctcaaacactacttcaatgatgaacaaggtgagattgaattcatcgaaaattcaaaggacgcagggt

SEQ ID NO: 76632 - DNA, 75 bp, Artificial Sequence
  Synthetic
aaccggcagttctcaggaatggagacccgcgacttaaagtcaattttgaggaggcaatctttgccaagtatattg

SEQ ID NO: 76633 - DNA, 75 bp, Artificial Sequence
  Synthetic
cccgcgacttaaagtcaattttgaggaggcaatctttgccaagtatattggcaatgtaaatacacatgtggatga

SEQ ID NO: 76634 - DNA, 75 bp, Artificial Sequence
  Synthetic
agaagatgcagtgtacggtacagaagggttggaggcgctcgacctgaccaccagtgcaggatacccgtacgttgc

SEQ ID NO: 76635 - DNA, 75 bp, Artificial Sequence
  Synthetic
gctaggcatcaagaagagagacatcttatccaagaggaccaaggatttgaccaaattgaaggagtgcatggacaa

SEQ ID NO: 76636 - DNA, 75 bp, Artificial Sequence
  Synthetic
tgtaatgctagatggacatctcatagcctttgactactctggatatgacgctagcctcagccccgtgtggtttgc

SEQ ID NO: 76637 - DNA, 75 bp, Artificial Sequence
  Synthetic
ctagcctcagccccgtgtggtttgcttgtctgaaattgctactgggaaagcttggctactcacacaaggagacaa

SEQ ID NO: 76638 - DNA, 75 bp, Artificial Sequence
  Synthetic
tagacgcttccttgctcgctgaagccgggaaagggtatgggctaataatgacaccagcagataaaggagagtgtt

SEQ ID NO: 76639 - DNA, 75 bp, Artificial Sequence
  Synthetic
ttcacccagtcatgcctatgaaggacatccatgagtccatcagatggacaaaagatccaaagaacactcaagatc

SEQ ID NO: 76640 - DNA, 75 bp, Artificial Sequence
  Synthetic
gatgcctcattgttagctgaagctggtaaagggtatggtctgatcatgacaccagctgataagggagagtgtttt

SEQ ID NO: 76641 - DNA, 75 bp, Artificial Sequence
  Synthetic
ctgttttcccgcaccgagtatcaataaggtgctagcgtggatgaaggagaaaacgttagttacccgagtaattag

SEQ ID NO: 76642 - DNA, 75 bp, Artificial Sequence
  Synthetic
aaggtgctagcgtggatgaaggagaaaacgttagttacccgagtaattagttcgagaaagacagtaccaccatga

SEQ ID NO: 76643 - DNA, 75 bp, Artificial Sequence
  Synthetic
ccgtggcggtcctgtgttggcggcaaaaccatggggtaacccatagaacgataaaattaagacatggtgagaaga

SEQ ID NO: 76644 - DNA, 75 bp, Artificial Sequence
  Synthetic
ccggcccgggaatgcggctaatcttacatgcgcagcgggcacccacaaaccagtggaaacgtttgtcgtaacggg

SEQ ID NO: 76645 - DNA, 75 bp, Artificial Sequence
  Synthetic
caattgggtcaagatcaagcacttctgttaccccggactgagtatcaataagctgctagcgcggctgaaggagaa

SEQ ID NO: 76646 - DNA, 75 bp, Artificial Sequence
  Synthetic
tgagagattgttaccatatagctattggattggccatccggtgactaacagagctatcatatacctttttattgg

SEQ ID NO: 76647 - DNA, 75 bp, Artificial Sequence
  Synthetic
aaaagatgatgaagcaacatcggaagaccaacccacccagccagatgtggccaagtgcaggttttatacacttga

SEQ ID NO: 76648 - DNA, 75 bp, Artificial Sequence
  Synthetic
caagtgtcaacgcagaagactggggcccatgaaaccagcctgaatgctagtggtaattccgttattcactatacc

SEQ ID NO: 76649 - DNA, 75 bp, Artificial Sequence
  Synthetic
cccatgaaaccagcctgaatgctagtggtaattccgttattcactataccaacatcaactattacaaggattcag

SEQ ID NO: 76650 - DNA, 75 bp, Artificial Sequence
  Synthetic
acgcactgtccaacatgtgtttgttcgggcaaaacatgcaataccattaccttggaagggctgggtatacggttc

SEQ ID NO: 76651 - DNA, 75 bp, Artificial Sequence
  Synthetic
taaaatctctcccagcactcaactcaccaactgtggaggagtgcggatacagtgaccgtgtccggtcaatcacca

SEQ ID NO: 76652 - DNA, 75 bp, Artificial Sequence
  Synthetic
accaactgtggaggagtgcggatacagtgaccgtgtccggtcaatcaccattggtaactccacaatcacgacgca

SEQ ID NO: 76653 - DNA, 75 bp, Artificial Sequence
  Synthetic
tcaacctacccaaccggacgtggccacatgtaggttttacaccttggagtcggtgaagtgggagaaggagtcccc

SEQ ID NO: 76654 - DNA, 75 bp, Artificial Sequence
  Synthetic
acatgtaggttttacaccttggagtcggtgaagtgggagaaggagtccccaggctggtggtggaagttccctgat

SEQ ID NO: 76655 - DNA, 75 bp, Artificial Sequence
  Synthetic
gtgcagtgcaacgcatccaagttccaccaaggatgccttttagtggtgtgtgttcctgaggctgagatgggtgcc

SEQ ID NO: 76656 - DNA, 75 bp, Artificial Sequence
  Synthetic
accaaggatgccttttagtggtgtgtgttcctgaggctgagatgggtgccgctaagcctaatgtagcctttaacc

SEQ ID NO: 76657 - DNA, 75 bp, Artificial Sequence
  Synthetic
ccatagtgcataatgcggggatgggagtagcagccggtaatttaacaatatacccgcatcagtggattaatctca

SEQ ID NO: 76658 - DNA, 75 bp, Artificial Sequence
  Synthetic
agtagcagccggtaatttaacaatatacccgcatcagtggattaatctcagaaccaataacagcgcgaccatagt

SEQ ID NO: 76659 - DNA, 75 bp, Artificial Sequence
  Synthetic
tgcgaagctagactacgcagcgacagcatcgacgtacgtgccaataacagtcactgtggcacccatgtgcgccga

SEQ ID NO: 76660 - DNA, 75 bp, Artificial Sequence
  Synthetic
ggagctagcagtgtgttaaataggacattgttgggggaaatactgaattactacacccattggtcgggtagtatc

SEQ ID NO: 76661 - DNA, 75 bp, Artificial Sequence
  Synthetic
gcatcgacgtacgtgccaataacagtcactgtggcacccatgtgcgccgagtacaatgggctgcggctcgctggg

SEQ ID NO: 76662 - DNA, 75 bp, Artificial Sequence
  Synthetic
gcaatgccacagttcgatgtgactccggagatccagatacccggggaagtacgcaatctcatggagattgcagag

SEQ ID NO: 76663 - DNA, 75 bp, Artificial Sequence
  Synthetic
cggagatccagatacccggggaagtacgcaatctcatggagattgcagaggttgattctgtggttccagtgaata

SEQ ID NO: 76664 - DNA, 75 bp, Artificial Sequence
  Synthetic
tctttggatttaaactcgagcctggtgatggcaccgtgttcaagcgcacgctactaggggaaatattgaactact

SEQ ID NO: 76665 - DNA, 75 bp, Artificial Sequence
  Synthetic
tgatggcaccgtgttcaagcgcacgctactaggggaaatattgaactactacgccaactggtcaggaagcatcaa

SEQ ID NO: 76666 - DNA, 75 bp, Artificial Sequence
  Synthetic
cgtcccagcgaacaggaaacaagcaatgctaggcacgcacgtcatatgggacgttggattgcaatcaagttgtgt

SEQ ID NO: 76667 - DNA, 75 bp, Artificial Sequence
  Synthetic
gccagcagacactatgcaaaccagacatgtaaaaaactaccactcaagatcggagtcgacagtggagaactttct

SEQ ID NO: 76668 - DNA, 75 bp, Artificial Sequence
  Synthetic
atgctaggcacgcacgtcatatgggacgttggattgcaatcaagttgtgtactatgtgtgccttggataagtcaa

SEQ ID NO: 76669 - DNA, 75 bp, Artificial Sequence
  Synthetic
gtgataccgccagacgtccctacaactagcactattctttgttttgtgtctgcttgcaatgacttctctgtgagg

SEQ ID NO: 76670 - DNA, 75 bp, Artificial Sequence
  Synthetic
ctagcactattctttgttttgtgtctgcttgcaatgacttctctgtgaggcttctgcgcgacacccctttcgcca

SEQ ID NO: 76671 - DNA, 75 bp, Artificial Sequence
  Synthetic
ctagcgggccatcgaattcagagagagttccagttctaaccgctgcggagacaggtcatacctcacaggtggttc

SEQ ID NO: 76672 - DNA, 75 bp, Artificial Sequence
  Synthetic
agttccagttctaaccgctgcggagacaggtcatacctcacaggtggttcccagcgataccattcagacgcgcca

SEQ ID NO: 76673 - DNA, 75 bp, Artificial Sequence
  Synthetic
ccggtacggtactgaaaagcaaggggaacaaatatccagatacaccaagtggaagatcaccactaggcaggtggc

SEQ ID NO: 76674 - DNA, 75 bp, Artificial Sequence
  Synthetic
gaacaaatatccagatacaccaagtggaagatcaccactaggcaggtggcgcaactgcgcaggaagatggagatg

SEQ ID NO: 76675 - DNA, 75 bp, Artificial Sequence
  Synthetic
cgtcaagacatgggtcccaagaccacccaggttgtgccagtaccagaaagcaggcaatgtgaattttgaacctac

SEQ ID NO: 76676 - DNA, 75 bp, Artificial Sequence
  Synthetic
tcagacacaccagccctcacccaccaaataatgtacgtgccacctgggggcccggagccccgtcattatgaggat

SEQ ID NO: 76677 - DNA, 75 bp, Artificial Sequence
  Synthetic
aaataatgtacgtgccacctgggggcccggagccccgtcattatgaggatttcgcctggcagacatccacaaatc

SEQ ID NO: 76678 - DNA, 75 bp, Artificial Sequence
  Synthetic
gcaatttttatgatgggtggtctcacttttcacaaagtggagtgtatgggtttaccaccttaaataacatgggac

SEQ ID NO: 76679 - DNA, 75 bp, Artificial Sequence
  Synthetic
cttttcacaaagtggagtgtatgggtttaccaccttaaataacatgggacaactgttcatgcgccatgtcaataa

SEQ ID NO: 76680 - DNA, 75 bp, Artificial Sequence
  Synthetic
tgggcttttcagagccaggagactgtggaggtatcctgagatgcgaacatggtgtcgtaggcatcgtaaccatgg

SEQ ID NO: 76681 - DNA, 75 bp, Artificial Sequence
  Synthetic
acctccccggttgtgcccatacatctatgcaaggaacgtggattttgagccacaaggtgtcactgaatcaagaga

SEQ ID NO: 76682 - DNA, 75 bp, Artificial Sequence
  Synthetic
tatgcaaggaacgtggattttgagccacaaggtgtcactgaatcaagagaaaagataacactagatagggatact

SEQ ID NO: 76683 - DNA, 75 bp, Artificial Sequence
  Synthetic
aaagctctggtcaagattatttcagcattagtgattgtggtgagaaatcatgatgacctaataacagtaactgcc

SEQ ID NO: 76684 - DNA, 75 bp, Artificial Sequence
  Synthetic
aatagacacttggccactcacatggattgggacaattgtgtgtgggaagactacaacagggatctattggttagc

SEQ ID NO: 76685 - DNA, 75 bp, Artificial Sequence
  Synthetic
attgggacaattgtgtgtgggaagactacaacagggatctattggttagcactaccacagcacacgggtgtgata

SEQ ID NO: 76686 - DNA, 75 bp, Artificial Sequence
  Synthetic
ccgatggctgagaggcaaaacaacggatggctcaagaagtttacagaagcgaccaacgcctgcaagggtatggaa

SEQ ID NO: 76687 - DNA, 75 bp, Artificial Sequence
  Synthetic
aagggcccggtttggtggaggtgcaggagagtgagtactacccgaaaagatatcaatcccatgtgttgctagcag

SEQ ID NO: 76688 - DNA, 75 bp, Artificial Sequence
  Synthetic
ggagagtgagtactacccgaaaagatatcaatcccatgtgttgctagcagcagggttttccgagccaggagactg

SEQ ID NO: 76689 - DNA, 75 bp, Artificial Sequence
  Synthetic
gagttcctcaacaggctcaagcaacttcccttactggaaagccaaattgctactattgagcaaagtgcaccatcc

SEQ ID NO: 76690 - DNA, 75 bp, Artificial Sequence
  Synthetic
tactattgagcaaagtgcaccatcccaaagtgatcaggaacagctcttctcaaacgttcaatactttgcccacta

SEQ ID NO: 76691 - DNA, 75 bp, Artificial Sequence
  Synthetic
agacgtgcgtgacctcttgtggctagaagatgatgcaatggaacagggggtgaaagattatgtggaacaactcgg

SEQ ID NO: 76692 - DNA, 75 bp, Artificial Sequence
  Synthetic
gaagatgatgcaatggaacagggggtgaaagattatgtggaacaactcggaaatgcctttggttcaggctttacc

SEQ ID NO: 76693 - DNA, 75 bp, Artificial Sequence
  Synthetic
tatacagttcaagtccaaatgccgtattgaacctgtatgcctcttactccatgggagccctggcgccgggaaatc

SEQ ID NO: 76694 - DNA, 75 bp, Artificial Sequence
  Synthetic
aaagctctagtgaaaataatatcagccttagtaattgtagtgagaaaccacgatgatctgatcacggtgactgcc

SEQ ID NO: 76695 - DNA, 75 bp, Artificial Sequence
  Synthetic
cgtccccatggcgctggcttaagcagaaagtatcccagtattatggaatacccatggctgaacgccaaaacaatg

SEQ ID NO: 76696 - DNA, 75 bp, Artificial Sequence
  Synthetic
tgtgtccctattttgccagatggtctctagtgttgactttgttccacctatggcagcacttgaagaaaaaggcat

SEQ ID NO: 76697 - DNA, 75 bp, Artificial Sequence
  Synthetic
ccaatatccaatactttgctcactattgcagaaagtatgctcccctctatgcatcagaggcaaaaagagtgttct

SEQ ID NO: 76698 - DNA, 75 bp, Artificial Sequence
  Synthetic
cccttgagaagaagatgagcaattacatacagttcaagtccaaatgccgtattgagcctgtatgtctgctcttac

SEQ ID NO: 76699 - DNA, 75 bp, Artificial Sequence
  Synthetic
agatcacttcgatggctataaacaacaggccgtagtgatcatggacgatctatgccagaatcctgatgggaaaga

SEQ ID NO: 76700 - DNA, 75 bp, Artificial Sequence
  Synthetic
acctactgaaatcagtggacagtgaggcagttagagagtactgcaaagaaagggggtggttagtgcccgaaatta

SEQ ID NO: 76701 - DNA, 75 bp, Artificial Sequence
  Synthetic
tttgttcacctccccgttcgttttggcatcaaccaatgcagggtctattaatgctccaactgtgtcagacagcag

SEQ ID NO: 76702 - DNA, 75 bp, Artificial Sequence
  Synthetic
gaatttgcggtggccatgatgaagagaaacgctagcactgtaaaaaccgagtacggcgagttcacaatgcttggc

SEQ ID NO: 76703 - DNA, 75 bp, Artificial Sequence
  Synthetic
tcgatatgctggtgactgaaatgtttagggaatacaaccacaggcacagtgttggggctacccttgaagcactgt

SEQ ID NO: 76704 - DNA, 75 bp, Artificial Sequence
  Synthetic
atttatgataggtgggccgtcctgccacgtcatgccaaacctggaccaaccatcctgatgaatgaccaggaggtg

SEQ ID NO: 76705 - DNA, 75 bp, Artificial Sequence
  Synthetic
gcttcttagctaaggaggaggtggaagtcaacgaggccgtgctagcaattaacaccagcaaatttcctaatatgt

SEQ ID NO: 76706 - DNA, 75 bp, Artificial Sequence
  Synthetic
acaacttccccacaagagcaggtcagtgtggcggagtgctcatgtccactggcaaagtcttggggatccatgttg

SEQ ID NO: 76707 - DNA, 75 bp, Artificial Sequence
  Synthetic
gtgtggcggagtgctcatgtccactggcaaagtcttggggatccatgttggcggaaatggccatcaaggtttctc

SEQ ID NO: 76708 - DNA, 75 bp, Artificial Sequence
  Synthetic
tgactggcagtgcagttgggtgtgatcccgacctattctggagtaagatcccagtcatgctcgacggccacctca

SEQ ID NO: 76709 - DNA, 75 bp, Artificial Sequence
  Synthetic
gtttccgattatcaacacacctagtaaaaccaagctggagccgagcgtcttccaccaggtttttgaaggtagcaa

SEQ ID NO: 76710 - DNA, 75 bp, Artificial Sequence
  Synthetic
tccaccaggtttttgaaggtagcaaagaaccagcggtcctcaggaatggtgatccacgcctcaaagctaactttg

SEQ ID NO: 76711 - DNA, 75 bp, Artificial Sequence
  Synthetic
ccagtcatgctcgacggccacctcattgcctttgactacagtgggtatgatgctagcttgagcccggtgtggttt

SEQ ID NO: 76712 - DNA, 75 bp, Artificial Sequence
  Synthetic
aacgagtgcaggttacccttatgtcgctctgggtatcaagaagagagacatcctctcaaagaagaccagggacct

SEQ ID NO: 76713 - DNA, 75 bp, Artificial Sequence
  Synthetic
gtacaaagggatagatttagaccaattcaggatgattgcatatggcgacgacgtcattgcttcatatccacaccc

SEQ ID NO: 76714 - DNA, 75 bp, Artificial Sequence
  Synthetic
atctgcagagaaggtggcaaagggaaagtccaggctcattgaggcgtccagtttgaatgactccgtggcaatgag

SEQ ID NO: 76715 - DNA, 75 bp, Artificial Sequence
  Synthetic
ccagtgatgttggacggtcacctcatagcctttgattattctggatatgatgctagcttgagtcccgtatggttt

SEQ ID NO: 76716 - DNA, 75 bp, Artificial Sequence
  Synthetic
aaatttgagcgtaatttaatttgatttaattggcttaaccctaccacatttaccgaactagacaacggtgtggta

SEQ ID NO: 76717 - DNA, 75 bp, Artificial Sequence
  Synthetic
tcccatcacttgtacagggacaagcattattttgtgcggggtggcatgccatcggggtgttccggcacaagcatc

SEQ ID NO: 76718 - DNA, 75 bp, Artificial Sequence
  Synthetic
gcatggcacaacggggagcacgaatatgaggagttcatccgcaagatcaggagcgtcccagttggacgttgtttg

SEQ ID NO: 76719 - DNA, 75 bp, Artificial Sequence
  Synthetic
ttaaaacagcctgtgggttgttcccacccacagggcccactgggcgctagcacactggtattgcggtacctttgt

SEQ ID NO: 76720 - DNA, 75 bp, Artificial Sequence
  Synthetic
acccacagggcccactgggcgctagcacactggtattgcggtacctttgtgcgcctgttttatccgccctcccca

SEQ ID NO: 76721 - DNA, 75 bp, Artificial Sequence
  Synthetic
gcgcatgaaacagggctaaaagccagtggaaattccataatacactatacaaacatcaattactacaaggatgct

SEQ ID NO: 76722 - DNA, 75 bp, Artificial Sequence
  Synthetic
aaggacagtgaagcaacagccgaggatcagccgacacaaccagacgtcgccacatgtagattctatacacttgat

SEQ ID NO: 76723 - DNA, 75 bp, Artificial Sequence
  Synthetic
caccagggatgcttactggttgtgtgtgtacctgaggccgaaatgggctgtgcaactttagacaacacaccatca

SEQ ID NO: 76724 - DNA, 75 bp, Artificial Sequence
  Synthetic
gtgtacctgaggccgaaatgggctgtgcaactttagacaacacaccatcaagtgcagagttactaggaggcgatg

SEQ ID NO: 76725 - DNA, 75 bp, Artificial Sequence
  Synthetic
tgcaactttagacaacacaccatcaagtgcagagttactaggaggcgatgctgcaaaggagttcgcaggtgagcc

SEQ ID NO: 76726 - DNA, 75 bp, Artificial Sequence
  Synthetic
aacttgcgcaccaataatagcgccacaattgttatgccatacacaaacagcgtgccgatggataatatgttcaga

SEQ ID NO: 76727 - DNA, 75 bp, Artificial Sequence
  Synthetic
tttaaaacagcctgtgggttgtttccacccacagggcccacagggcgctagcactttggtatcacggtacctttg

SEQ ID NO: 76728 - DNA, 75 bp, Artificial Sequence
  Synthetic
agccagggtactcgagtgttttcagtcgaacgctcctgggtgagatcctcaattactacacccactggtcgggta

SEQ ID NO: 76729 - DNA, 75 bp, Artificial Sequence
  Synthetic
gcactttggtatcacggtacctttgtgcgcctgttttataacccttcccccccacagaaacttagaagcaccaca

SEQ ID NO: 76730 - DNA, 75 bp, Artificial Sequence
  Synthetic
accagccatgtcttgatcaagcacttctgtttccccggaccgagtatcaatagactgctcgcgcggtcgaaggag

SEQ ID NO: 76731 - DNA, 75 bp, Artificial Sequence
  Synthetic
aagtcaaacacactatcggtacgtggcttccgatgagtacacagctggcggttttattacttgctggtaccaaac

SEQ ID NO: 76732 - DNA, 75 bp, Artificial Sequence
  Synthetic
agccgcaattggtagagttgctgacacagtgggaactggaccaactaactctgaggccataccagcgctcaccgc

SEQ ID NO: 76733 - DNA, 75 bp, Artificial Sequence
  Synthetic
cattacattggctgcttatggtgacaattgaaaggttgttaccatatagctattggattggccacccggtgtcta

SEQ ID NO: 76734 - DNA, 75 bp, Artificial Sequence
  Synthetic
aattgaaaggttgttaccatatagctattggattggccacccggtgtctaatagagcgattgtgtacctttttgt

SEQ ID NO: 76735 - DNA, 75 bp, Artificial Sequence
  Synthetic
aagatctgagtcaacagttgagaacttcctgtgtaggtctgcctgtgtctacttcaccgagtatgagaattcagg

SEQ ID NO: 76736 - DNA, 75 bp, Artificial Sequence
  Synthetic
gcgcaagtgtctacacaaaagactggagcgcatgaaactggcttgaatgctagcggtaactcgattatacactac

SEQ ID NO: 76737 - DNA, 75 bp, Artificial Sequence
  Synthetic
gagcgcatgaaactggcttgaatgctagcggtaactcgattatacactacacaaacattaactactataaagatg

SEQ ID NO: 76738 - DNA, 75 bp, Artificial Sequence
  Synthetic
tgataaagtccatgccagctctgaactccccaactgtggaagagtgtggatacagtgatagagtgaggtctataa

SEQ ID NO: 76739 - DNA, 75 bp, Artificial Sequence
  Synthetic
ctccccaactgtggaagagtgtggatacagtgatagagtgaggtctataaccctgggcaattcgaccataaccac

SEQ ID NO: 76740 - DNA, 75 bp, Artificial Sequence
  Synthetic
gagtattggcaacgcttactcaaatttttacgatggttggtcagaattctccagaaatggggtgtatggcattaa

SEQ ID NO: 76741 - DNA, 75 bp, Artificial Sequence
  Synthetic
agaccagcccacacaaccagatgtggcgacgtgcaggttttacaccttggattccgtgcaatggcagaagacctc

SEQ ID NO: 76742 - DNA, 75 bp, Artificial Sequence
  Synthetic
gcgacgtgcaggttttacaccttggattccgtgcaatggcagaagacctcaaatggatggtggtggaaatttcca

SEQ ID NO: 76743 - DNA, 75 bp, Artificial Sequence
  Synthetic
taggatttactttaaaccaaagcacgttaaagcttggatacccaggcctcctaggttatgccagtatgagaaggc

SEQ ID NO: 76744 - DNA, 75 bp, Artificial Sequence
  Synthetic
cacgtccagtgtaacgcatcacgattccatcaaggtgcacttctggtcgtttgtgtacctgaggctgaaatggga

SEQ ID NO: 76745 - DNA, 75 bp, Artificial Sequence
  Synthetic
tccatcaaggtgcacttctggtcgtttgtgtacctgaggctgaaatgggatgtgccactatagatcgcacagtga

SEQ ID NO: 76746 - DNA, 75 bp, Artificial Sequence
  Synthetic
ctttgggcaacaatccggagcagtgtatgtggggaactacagagtggtgaacagacacttagcaacacacactga

SEQ ID NO: 76747 - DNA, 75 bp, Artificial Sequence
  Synthetic
aaacagccgtgtacaacgcggcaatgggtgtagcagtgggcaatttgacaatattcccacatcaatggataaacc

SEQ ID NO: 76748 - DNA, 75 bp, Artificial Sequence
  Synthetic
gggtgtagcagtgggcaatttgacaatattcccacatcaatggataaaccttagaacaaacaatagtgccaccat

SEQ ID NO: 76749 - DNA, 75 bp, Artificial Sequence
  Synthetic
tatagccaggtgtcgatgcaccaccggggtgtatttttgtgcttcaagaaacaagcacttcccggttagctttga

SEQ ID NO: 76750 - DNA, 75 bp, Artificial Sequence
  Synthetic
ggggtgtatttttgtgcttcaagaaacaagcacttcccggttagctttgaaggcccaggcttggttgaagtgcaa

SEQ ID NO: 76751 - DNA, 75 bp, Artificial Sequence
  Synthetic
tttcgtgccacttgattattcaactggggcatcaacgtatgtcccaataacggtgacagtggcacctatgaatgc

SEQ ID NO: 76752 - DNA, 75 bp, Artificial Sequence
  Synthetic
ggggcatcaacgtatgtcccaataacggtgacagtggcacctatgaatgcagagtataacgggcttcgactggcc

SEQ ID NO: 76753 - DNA, 75 bp, Artificial Sequence
  Synthetic
gacgtccgtgacctactatggctggaggatgatgcaatggagcaaggggtcaaagattacgtggaacaactggga

SEQ ID NO: 76754 - DNA, 75 bp, Artificial Sequence
  Synthetic
tgtgcaatgcctcagtttgatgtaacaccggagatgttcataccaggtgaggtgcacaatttgatggaggtcgct

SEQ ID NO: 76755 - DNA, 75 bp, Artificial Sequence
  Synthetic
caccggagatgttcataccaggtgaggtgcacaatttgatggaggtcgctgaagtggactcagttgtcccagtaa

SEQ ID NO: 76756 - DNA, 75 bp, Artificial Sequence
  Synthetic
aagtttttggttttcctttacaaccggggttcagctctgtttttaaaagaacactactaggagagatcttgaatt

SEQ ID NO: 76757 - DNA, 75 bp, Artificial Sequence
  Synthetic
ggggttcagctctgtttttaaaagaacactactaggagagatcttgaattactacgcacactggagtggcagtat

SEQ ID NO: 76758 - DNA, 75 bp, Artificial Sequence
  Synthetic
gtggctcaagaaatttacagagatgactaatgcatgtaaagggatggagtggattgccattaagatccagaagtt

SEQ ID NO: 76759 - DNA, 75 bp, Artificial Sequence
  Synthetic
cggagcccccactgaccgaaagggagctatgctgggcacgcatgtagtatgggatgtagggttgcagtccagctg

SEQ ID NO: 76760 - DNA, 75 bp, Artificial Sequence
  Synthetic
gctatgctgggcacgcatgtagtatgggatgtagggttgcagtccagctgtgtcctgtgcgtgccttggattagc

SEQ ID NO: 76761 - DNA, 75 bp, Artificial Sequence
  Synthetic
attgtagcaccagcagacgctcaaagcaagtgctatatcatgtgttttgtgtccgcctgcaacgatttttcagtg

SEQ ID NO: 76762 - DNA, 75 bp, Artificial Sequence
  Synthetic
gcaagtgctatatcatgtgttttgtgtccgcctgcaacgatttttcagtgaggctcctacgtgacaccccattta

SEQ ID NO: 76763 - DNA, 75 bp, Artificial Sequence
  Synthetic
ccttgaaaagaagatgagcaattacatacagttcaagtccaaatgccgtattgaacctgtatgtttgctattgca

SEQ ID NO: 76764 - DNA, 75 bp, Artificial Sequence
  Synthetic
tagccagcgggccatccaactccacagaagtcccagcgttaacagcagtggaaacgggacacacctcgcaagtca

SEQ ID NO: 76765 - DNA, 75 bp, Artificial Sequence
  Synthetic
agaagtcccagcgttaacagcagtggaaacgggacacacctcgcaagtcacccccgctgacacaatgcaaaccag

SEQ ID NO: 76766 - DNA, 75 bp, Artificial Sequence
  Synthetic
cacctcgtataaaacgttggacgctgaaccagagaacaggtatgctagctggaccatcaccaccagaaaggtcgc

SEQ ID NO: 76767 - DNA, 75 bp, Artificial Sequence
  Synthetic
gaaccagagaacaggtatgctagctggaccatcaccaccagaaaggtcgcgcaactgaggagaaaaatggagatg

SEQ ID NO: 76768 - DNA, 75 bp, Artificial Sequence
  Synthetic
gctttagctagaaggtttcactttgatatgaacatagaagtgatatccatgtacagccaaaatggcaagattaac

SEQ ID NO: 76769 - DNA, 75 bp, Artificial Sequence
  Synthetic
caagacacccctgtgttgacgcatcaagtcatgtatgtcccacctggcggtccagtgccagcgtccgtggacagt

SEQ ID NO: 76770 - DNA, 75 bp, Artificial Sequence
  Synthetic
aagtcatgtatgtcccacctggcggtccagtgccagcgtccgtggacagttacagttggcaatcatccaccaacc

SEQ ID NO: 76771 - DNA, 75 bp, Artificial Sequence
  Synthetic
gcaacttttatgatgggtggtcacacttttcgcagactggggtatatgggtttaacaccctaaacaacatggggc

SEQ ID NO: 76772 - DNA, 75 bp, Artificial Sequence
  Synthetic
cttttcgcagactggggtatatgggtttaacaccctaaacaacatggggcagctatacttcagacatgtaaacag

SEQ ID NO: 76773 - DNA, 75 bp, Artificial Sequence
  Synthetic
atcaaaatcagtgtggctcctgaaaccccaccaccaccagcaattgcagacctgttaaagtcagtggacagcgag

SEQ ID NO: 76774 - DNA, 75 bp, Artificial Sequence
  Synthetic
accacctagactgtgcaattatgaaagggcagaaaatgttaatttccaagtgatgggcgtaacagacacccgcga

SEQ ID NO: 76775 - DNA, 75 bp, Artificial Sequence
  Synthetic
agggcagaaaatgttaatttccaagtgatgggcgtaacagacacccgcgattcaattacagctcagcctgggact

SEQ ID NO: 76776 - DNA, 75 bp, Artificial Sequence
  Synthetic
aacaggcacttggcaacctacacagattggcaaaactgcgtatgggaagactacaacagagacctcctcgtgagc

SEQ ID NO: 76777 - DNA, 75 bp, Artificial Sequence
  Synthetic
attggcaaaactgcgtatgggaagactacaacagagacctcctcgtgagcaccaccacggctcacggatgcgaca

SEQ ID NO: 76778 - DNA, 75 bp, Artificial Sequence
  Synthetic
agggcccaggtctggttgaagtgcaagagagtgaatactatcccaagagataccaatcccacgtgctcctcgcag

SEQ ID NO: 76779 - DNA, 75 bp, Artificial Sequence
  Synthetic
agagagtgaatactatcccaagagataccaatcccacgtgctcctcgcagcagggttttcagagccaggagattg

SEQ ID NO: 76780 - DNA, 75 bp, Artificial Sequence
  Synthetic
tgacgtccgcgacctgctgtggttggaagatgatgcgatggaacagggggtgagagattacgtcgaacaacttgg

SEQ ID NO: 76781 - DNA, 75 bp, Artificial Sequence
  Synthetic
gaagatgatgcgatggaacagggggtgagagattacgtcgaacaacttggtaacgcttttggcacaggtttcacc

SEQ ID NO: 76782 - DNA, 75 bp, Artificial Sequence
  Synthetic
aaagccctggttaaaatcatctcagcactggtgattgtggtgaggaaccacgatgacttgataacagtgactgcc

SEQ ID NO: 76783 - DNA, 75 bp, Artificial Sequence
  Synthetic
cactggtgattgtggtgaggaaccacgatgacttgataacagtgactgccacccttgcactcattgggtgttcct

SEQ ID NO: 76784 - DNA, 75 bp, Artificial Sequence
  Synthetic
aaacaaaattggaaccgagtgtgttccatcaggtgtttgagggcaataaggaacccgcagtgctcagaaatggtg

SEQ ID NO: 76785 - DNA, 75 bp, Artificial Sequence
  Synthetic
gatggctcaagaaattcacagagatgaccaatgcctgtaaagggatggagtggattgcaatcaaaatccagaagt

SEQ ID NO: 76786 - DNA, 75 bp, Artificial Sequence
  Synthetic
atccgcgacttaaagccaactttgaggaggcaatcttctcgaagtacatcggcaatgtgaacacacatgtggacg

SEQ ID NO: 76787 - DNA, 75 bp, Artificial Sequence
  Synthetic
gagtttcttaccaggctcaaacaactcccccttttggaaagccaaattgccactatcgaacaaagtgcaccgtca

SEQ ID NO: 76788 - DNA, 75 bp, Artificial Sequence
  Synthetic
accaaattgaaggagtgcatggataagtatggattaaatttaccaatggtgacctatgtgaaggacgagctcaga

SEQ ID NO: 76789 - DNA, 75 bp, Artificial Sequence
  Synthetic
agatcactttgatggttacaaacaacaagcagtcgtgatcatggacgacctatgccaaaacccagatggtaagga

SEQ ID NO: 76790 - DNA, 75 bp, Artificial Sequence
  Synthetic
cccgacctcttttggagtaaaataccggtgatgctagatggacatctcatagcctttgattactccggttatgat

SEQ ID NO: 76791 - DNA, 75 bp, Artificial Sequence
  Synthetic
agcctttgattactccggttatgatgctagcctgagtcccgtgtggttcgcttgtctgaaaatgctactcgagaa

SEQ ID NO: 76792 - DNA, 75 bp, Artificial Sequence
  Synthetic
tctgttcacctccccttttgtcctagcatccacaaatgctggctccattaatgcaccaacggtttcggacagccg

SEQ ID NO: 76793 - DNA, 75 bp, Artificial Sequence
  Synthetic
gcatccacaaatgctggctccattaatgcaccaacggtttcggacagccgggctttagctagaagattccatttc

SEQ ID NO: 76794 - DNA, 75 bp, Artificial Sequence
  Synthetic
gatgaagaatgctgtccagttaatttcaagaagtgctgccctcttgtgtgtggaaaggctatccagttcattgat

SEQ ID NO: 76795 - DNA, 75 bp, Artificial Sequence
  Synthetic
tcaagaagtgctgccctcttgtgtgtggaaaggctatccagttcattgatagaaggactcaggtaagatactcct

SEQ ID NO: 76796 - DNA, 75 bp, Artificial Sequence
  Synthetic
ttcaaggcccaccagtatacagggaaatcaaaattagcgtcgcgcccgaaactccaccaccaccagccattgcag

SEQ ID NO: 76797 - DNA, 75 bp, Artificial Sequence
  Synthetic
aatcaaaattagcgtcgcgcccgaaactccaccaccaccagccattgcagacttgctgaggtcagtggacagtga

SEQ ID NO: 76798 - DNA, 75 bp, Artificial Sequence
  Synthetic
catgtgcgatccttgtgcttattggcgtggcacaatggggaacatgaatatgaagaattcattaagaagatcaga

SEQ ID NO: 76799 - DNA, 75 bp, Artificial Sequence
  Synthetic
cgtcagtcgggcatttatatgcctacaagcactgacaacctttgtgtccgtggctgggatcatttacatcatcta

SEQ ID NO: 76800 - DNA, 75 bp, Artificial Sequence
  Synthetic
caagcactgacaacctttgtgtccgtggctgggatcatttacatcatctacaagttatttgcaggattccagggt

SEQ ID NO: 76801 - DNA, 75 bp, Artificial Sequence
  Synthetic
gaattcgccgtggccatgatgaaaaggaactctagcacagtaaaaacagagtatggtgagttcactatgctaggt

SEQ ID NO: 76802 - DNA, 75 bp, Artificial Sequence
  Synthetic
acccgcagggcccactgggcgctagcacactggtatcccggtacccttgtgcgcctgttttatataccctccccc

SEQ ID NO: 76803 - DNA, 75 bp, Artificial Sequence
  Synthetic
ggaactctagcacagtaaaaacagagtatggtgagttcactatgctaggtatttatgacaggtgggctgttctcc

SEQ ID NO: 76804 - DNA, 75 bp, Artificial Sequence
  Synthetic
ctgttaccccggactgagtatcaataagctgttcacacggctgaaggagaaaacgttcgttacccggccaattac

SEQ ID NO: 76805 - DNA, 75 bp, Artificial Sequence
  Synthetic
tggataaggatggcacaaatcttgaactgacattgttgaaactcaatcggaatgaaaaatttagagacatcagag

SEQ ID NO: 76806 - DNA, 75 bp, Artificial Sequence
  Synthetic
actgacattgttgaaactcaatcggaatgaaaaatttagagacatcagaggctttcttgccaaggaggaagtaga

SEQ ID NO: 76807 - DNA, 75 bp, Artificial Sequence
  Synthetic
ttatggtttcttgaacctgggtggcacccccacgaagagaatgcttatgtacaacttcccaactagggcgggcca

SEQ ID NO: 76808 - DNA, 75 bp, Artificial Sequence
  Synthetic
acccccacgaagagaatgcttatgtacaacttcccaactagggcgggccagtgcggtggtgtcctcatgtctacc

SEQ ID NO: 76809 - DNA, 75 bp, Artificial Sequence
  Synthetic
aacgatgagcaaggtgagatcgagttcattgaaagttcaaaagacgcagggttcccggtcatcaatacaccaagc

SEQ ID NO: 76810 - DNA, 75 bp, Artificial Sequence
  Synthetic
tcattgaaagttcaaaagacgcagggttcccggtcatcaatacaccaagcaagaccaaactagagccgagcgttt

SEQ ID NO: 76811 - DNA, 75 bp, Artificial Sequence
  Synthetic
attgacaaattgttaccatatagctattggattggccatccggtgacaaacagagctattgtttacttgtttgtt

SEQ ID NO: 76812 - DNA, 75 bp, Artificial Sequence
  Synthetic
aggaagctatattctcaaaatacatcgggaatgtcaatacacatgtggacgagtacatgttggaagcagtggacc

SEQ ID NO: 76813 - DNA, 75 bp, Artificial Sequence
  Synthetic
ctcaagtatcaacgcagaagactggggcacatgagactagcttgaacgccaacgggagttcggtcattcactaca

SEQ ID NO: 76814 - DNA, 75 bp, Artificial Sequence
  Synthetic
ggcacatgagactagcttgaacgccaacgggagttcggtcattcactacaccaacatcaactactacaaggatgc

SEQ ID NO: 76815 - DNA, 75 bp, Artificial Sequence
  Synthetic
cgggaatgtcaatacacatgtggacgagtacatgttggaagcagtggaccattacgcggggcagctagccactct

SEQ ID NO: 76816 - DNA, 75 bp, Artificial Sequence
  Synthetic
aacaagtgcgggatacccgtacgttgcactaggcatcaagaagagggatattttgtctaagaagaccaaggacct

SEQ ID NO: 76817 - DNA, 75 bp, Artificial Sequence
  Synthetic
gataaaatcgctcccggcgctcaattcaccgacggtggaggagtgcgggttcagcgacagggtgcgctctatcac

SEQ ID NO: 76818 - DNA, 75 bp, Artificial Sequence
  Synthetic
tcaccgacggtggaggagtgcgggttcagcgacagggtgcgctctatcacgctaggcaattctaccataacaacg

SEQ ID NO: 76819 - DNA, 75 bp, Artificial Sequence
  Synthetic
gcactaggcatcaagaagagggatattttgtctaagaagaccaaggacctgaccaaattaaaagagtgtatggac

SEQ ID NO: 76820 - DNA, 75 bp, Artificial Sequence
  Synthetic
aagtccagacttatcgaggcatctagcttgaatgactctgttgcaatgaggcagacgtttggtaacctatacagg

SEQ ID NO: 76821 - DNA, 75 bp, Artificial Sequence
  Synthetic
gatcaaccaacacaaccagatgttgcaacatgcagattctacaccttagattcagtgcagtgggaaaagaactct

SEQ ID NO: 76822 - DNA, 75 bp, Artificial Sequence
  Synthetic
caacatgcagattctacaccttagattcagtgcagtgggaaaagaactctgcaggatggtggtggaaattccctg

SEQ ID NO: 76823 - DNA, 75 bp, Artificial Sequence
  Synthetic
gcttgaatgactctgttgcaatgaggcagacgtttggtaacctatacaggacatttcatctgaatcccggaattg

SEQ ID NO: 76824 - DNA, 75 bp, Artificial Sequence
  Synthetic
tagcttttgattactccggatacgatgccagcctgagccccgtgtggtttgcttgtctgaagctgctgcttgaga

SEQ ID NO: 76825 - DNA, 75 bp, Artificial Sequence
  Synthetic
acgtgcaatgcaatgcttcaaagttccatcaagggtgtttgcttgtggtctgcgttcctgaggcggagatgggtg

SEQ ID NO: 76826 - DNA, 75 bp, Artificial Sequence
  Synthetic
ccatcaagggtgtttgcttgtggtctgcgttcctgaggcggagatgggtggtgctaaagtcggacaggcattcga

SEQ ID NO: 76827 - DNA, 75 bp, Artificial Sequence
  Synthetic
tgccagcctgagccccgtgtggtttgcttgtctgaagctgctgcttgagaaacttgggtactcacacaaggagac

SEQ ID NO: 76828 - DNA, 75 bp, Artificial Sequence
  Synthetic
ctcaggttgctctggtaccagtatcttcaattcaatgatcaataacatcataatcagaacactaatgttgaaggt

SEQ ID NO: 76829 - DNA, 75 bp, Artificial Sequence
  Synthetic
aagcgtggtgcacaacgcaggtatgggagtaggagttggtaacctgacaatcttccctcaccagtggataaactt

SEQ ID NO: 76830 - DNA, 75 bp, Artificial Sequence
  Synthetic
ggagtaggagttggtaacctgacaatcttccctcaccagtggataaacttacggactaacaacagcgccacgata

SEQ ID NO: 76831 - DNA, 75 bp, Artificial Sequence
  Synthetic
gtacaaaggcatcgacctggaccaattcagaatgatcgcttatggtgacgatgtgattgcgtcctacccctggcc

SEQ ID NO: 76832 - DNA, 75 bp, Artificial Sequence
  Synthetic
tttgtgaagctagactatacagaggcaacatcatatgtaccaatcacagttacggtggccccaatgtgtgcagag

SEQ ID NO: 76833 - DNA, 75 bp, Artificial Sequence
  Synthetic
caacatcatatgtaccaatcacagttacggtggccccaatgtgtgcagagtacaatgggctccggttgggtcaag

SEQ ID NO: 76834 - DNA, 75 bp, Artificial Sequence
  Synthetic
cactaccgcaatttgatgtcacaccacccatgaaaattcccggtgaagtccacaatttaatggagatagcagagg

SEQ ID NO: 76835 - DNA, 75 bp, Artificial Sequence
  Synthetic
tcatgtgcgatccttgtgcctattggcttggcataatggggaacatgaatacgaggagttcattcaaaagattag

SEQ ID NO: 76836 - DNA, 75 bp, Artificial Sequence
  Synthetic
acccatgaaaattcccggtgaagtccacaatttaatggagatagcagaggttgactcggtcgtgccggtaaacaa

SEQ ID NO: 76837 - DNA, 75 bp, Artificial Sequence
  Synthetic
gcttggcataatggggaacatgaatacgaggagttcattcaaaagattagaagcgtctcagtagggcgctgcttg

SEQ ID NO: 76838 - DNA, 75 bp, Artificial Sequence
  Synthetic
atttggagtgagattgcagcctggactagacagtgtcttcaaacacacactacttggagagatcctgaattatta

SEQ ID NO: 76839 - DNA, 75 bp, Artificial Sequence
  Synthetic
ctagacagtgtcttcaaacacacactacttggagagatcctgaattattatgctcattggtccgggagcataaaa

SEQ ID NO: 76840 - DNA, 75 bp, Artificial Sequence
  Synthetic
ccaccgactaacagaaaaggggccatgctgggcaaaaatatagtatgggacatcggactgcaatccagttgcgta

SEQ ID NO: 76841 - DNA, 75 bp, Artificial Sequence
  Synthetic
tgctgggcaaaaatatagtatgggacatcggactgcaatccagttgcgtactgtgtatgccgtggatcagccaaa

SEQ ID NO: 76842 - DNA, 75 bp, Artificial Sequence
  Synthetic
tcattccaccaggcacaccatccacttgctccattttgtgctttgtgtctgcatgcaacgacttctctgttagga

SEQ ID NO: 76843 - DNA, 75 bp, Artificial Sequence
  Synthetic
ttgctccattttgtgctttgtgtctgcatgcaacgacttctctgttaggatgctgagggacactccgttcactag

SEQ ID NO: 76844 - DNA, 75 bp, Artificial Sequence
  Synthetic
cagtggcccaagtaactccgaaagtgtgccagccctgacggcagctgagaccggacacacctcgcaggtgactcc

SEQ ID NO: 76845 - DNA, 75 bp, Artificial Sequence
  Synthetic
gtgccagccctgacggcagctgagaccggacacacctcgcaggtgactcctagtgacaacatacaaactaggcat

SEQ ID NO: 76846 - DNA, 75 bp, Artificial Sequence
  Synthetic
gactataagaacaaagataatgacatgacaaacaaatacgtcgcatggacaatcaacacaagacagatggtacaa

SEQ ID NO: 76847 - DNA, 75 bp, Artificial Sequence
  Synthetic
tgacaaacaaatacgtcgcatggacaatcaacacaagacagatggtacaaatgaggcgtaagttggagatgttca

SEQ ID NO: 76848 - DNA, 75 bp, Artificial Sequence
  Synthetic
acatgccagtgctgacacatcaaataatgtacataccgccaggtggaccaataccaacaaaggtggacgattatg

SEQ ID NO: 76849 - DNA, 75 bp, Artificial Sequence
  Synthetic
aatgtacataccgccaggtggaccaataccaacaaaggtggacgattatgcctggcaaacatcaacaaaccccag

SEQ ID NO: 76850 - DNA, 75 bp, Artificial Sequence
  Synthetic
cttttatgatgggtggtctcactttgatcagaaagggtcatatggctacaatacgttaaacaacttgggccacat

SEQ ID NO: 76851 - DNA, 75 bp, Artificial Sequence
  Synthetic
gatcagaaagggtcatatggctacaatacgttaaacaacttgggccacatttatgttaggcatgtaagtggggac

SEQ ID NO: 76852 - DNA, 75 bp, Artificial Sequence
  Synthetic
cctaggctatgtccctacgagaaagcagggagcgtggactttaaaccgactgcaattacctcaaccagagcaacc

SEQ ID NO: 76853 - DNA, 75 bp, Artificial Sequence
  Synthetic
cagggagcgtggactttaaaccgactgcaattacctcaaccagagcaaccatcaacactgttcacagcaccactc

SEQ ID NO: 76854 - DNA, 75 bp, Artificial Sequence
  Synthetic
ggcacctggcaacccattctgattggcaaaattgcgtgtgggaggattccaacagggacctcttggttagtacaa

SEQ ID NO: 76855 - DNA, 75 bp, Artificial Sequence
  Synthetic
gcaaaattgcgtgtgggaggattccaacagggacctcttggttagtacaacaacggcgcacggctgtgacaccat

SEQ ID NO: 76856 - DNA, 75 bp, Artificial Sequence
  Synthetic
accgggacttgtagaagtccaggagagtgagtactaccccagaagataccagtcccatgtactcctcgcagcagg

SEQ ID NO: 76857 - DNA, 75 bp, Artificial Sequence
  Synthetic
agtgagtactaccccagaagataccagtcccatgtactcctcgcagcaggcttttccgagcccggggattgtggt

SEQ ID NO: 76858 - DNA, 75 bp, Artificial Sequence
  Synthetic
gtaagggaccttttgtggttagaggatgatgccatggagcaaggggttagagattatgttgagcaacttggcaac

SEQ ID NO: 76859 - DNA, 75 bp, Artificial Sequence
  Synthetic
atgatgccatggagcaaggggttagagattatgttgagcaacttggcaacgcctttggttcgggcttcaccaatc

SEQ ID NO: 76860 - DNA, 75 bp, Artificial Sequence
  Synthetic
ctttggtgaaaatcatatcagcactggtcatcgtagtaagaaaccatgatgatctcatcacagtaaccgcaaccc

SEQ ID NO: 76861 - DNA, 75 bp, Artificial Sequence
  Synthetic
ggtcatcgtagtaagaaaccatgatgatctcatcacagtaaccgcaaccctagctctgattggttgcaccacctc

SEQ ID NO: 76862 - DNA, 75 bp, Artificial Sequence
  Synthetic
gctaaagaagttcacagaaatgaccaacgcctgtaagggcatggagtggattgcagttaaaatccaaaaatttat

SEQ ID NO: 76863 - DNA, 75 bp, Artificial Sequence
  Synthetic
cctgttggaaagccagattgccaccattgaacaaagcgccccttcacagagtgatcaagagcaactgttctccaa

SEQ ID NO: 76864 - DNA, 75 bp, Artificial Sequence
  Synthetic
cactttgacggttacaaacaacaagccgtcgtgatcatggatgacctgtgccaaaatccagacggtaaggacgtg

SEQ ID NO: 76865 - DNA, 75 bp, Artificial Sequence
  Synthetic
ccgtcgtgatcatggatgacctgtgccaaaatccagacggtaaggacgtgtccttattttgccagatggtgtcaa

SEQ ID NO: 76866 - DNA, 75 bp, Artificial Sequence
  Synthetic
cgaccaatgctggctctatcaatgctcccactgtgtcagacagtagagcacttgcaaggaggttccactttgaca

SEQ ID NO: 76867 - DNA, 75 bp, Artificial Sequence
  Synthetic
tcccactgtgtcagacagtagagcacttgcaaggaggttccactttgacatgaacatcgaggttatctctatgta

SEQ ID NO: 76868 - DNA, 75 bp, Artificial Sequence
  Synthetic
gaggtgttgcccattggtttgtggtaaagctatccaattcattgacaggagaacacaagtgaggtactcattgga

SEQ ID NO: 76869 - DNA, 75 bp, Artificial Sequence
  Synthetic
aaagctatccaattcattgacaggagaacacaagtgaggtactcattggacatgcttgtgactgaaatgtttagg

SEQ ID NO: 76870 - DNA, 75 bp, Artificial Sequence
  Synthetic
aaaattagcgtggcaccagaaacccccccccccccggccatagcagacctgttgaagtcagtagacagtgaggcg

SEQ ID NO: 76871 - DNA, 75 bp, Artificial Sequence
  Synthetic
ccccccccccggccatagcagacctgttgaagtcagtagacagtgaggcggttagagagtactgcaaggaaaagg

SEQ ID NO: 76872 - DNA, 75 bp, Artificial Sequence
  Synthetic
cactcaccacatttgtttcagtggcaggaataatatacatcatttacaagttatttgctggcttccaaggagcgt

SEQ ID NO: 76873 - DNA, 75 bp, Artificial Sequence
  Synthetic
aggaataatatacatcatttacaagttatttgctggcttccaaggagcgtacactgggatgcccaaccaaaaacc

SEQ ID NO: 76874 - DNA, 75 bp, Artificial Sequence
  Synthetic
atacgtaccaatcactgtcactgtggcacccatgtgcgccgaatataatgggctgcgcctagctggccatcaagg

SEQ ID NO: 76875 - DNA, 75 bp, Artificial Sequence
  Synthetic
tgctagtaccgtaaagactgagtacggcgagttcacaatgcttgggatctacgacagatgggcggtgttgccccg

SEQ ID NO: 76876 - DNA, 75 bp, Artificial Sequence
  Synthetic
ggcgagttcacaatgcttgggatctacgacagatgggcggtgttgccccgccacgccaaacccggacccactatc

SEQ ID NO: 76877 - DNA, 75 bp, Artificial Sequence
  Synthetic
acacttttgaaactcaacaggaatgagaaattcagagacatccgaggcttcctggcaagagaagaagcggaagtt

SEQ ID NO: 76878 - DNA, 75 bp, Artificial Sequence
  Synthetic
agaaattcagagacatccgaggcttcctggcaagagaagaagcggaagttaatgaggctgtacttgctattaaca

SEQ ID NO: 76879 - DNA, 75 bp, Artificial Sequence
  Synthetic
ctaccaagcgcatgctaatgtataatttccccacgcgcgcaggacagtgtggtggcgtcctaatgtcaacaggta

SEQ ID NO: 76880 - DNA, 75 bp, Artificial Sequence
  Synthetic
tttccccacgcgcgcaggacagtgtggtggcgtcctaatgtcaacaggtaaagtcctcggaatacacgttggtgg

SEQ ID NO: 76881 - DNA, 75 bp, Artificial Sequence
  Synthetic
cgagagctccaaggaggctggtttcccagttattaacacccccagcaaaacaaagcttgaacccagtgtattcca

SEQ ID NO: 76882 - DNA, 75 bp, Artificial Sequence
  Synthetic
ccagttattaacacccccagcaaaacaaagcttgaacccagtgtattccatcacgtatttgagggaaataaggag

SEQ ID NO: 76883 - DNA, 75 bp, Artificial Sequence
  Synthetic
aatgtgaacacgaacgtggatgagtacatgatggaagccgttgaccattatgctggacagttggcaactttggac

SEQ ID NO: 76884 - DNA, 75 bp, Artificial Sequence
  Synthetic
acatgatggaagccgttgaccattatgctggacagttggcaactttggacatcagcacagaaccaatgaagctcg

SEQ ID NO: 76885 - DNA, 75 bp, Artificial Sequence
  Synthetic
ggtagctgacactgtagccagtgggcctgtcaacactgagcaaattcctgccttaacagcagtggagacagggca

SEQ ID NO: 76886 - DNA, 75 bp, Artificial Sequence
  Synthetic
ttggtatcaaaaagagagacattttgtccaagaaaaccaaggacctgacaaagctgaagggatgtatggacaagt

SEQ ID NO: 76887 - DNA, 75 bp, Artificial Sequence
  Synthetic
gtccaagaaaaccaaggacctgacaaagctgaagggatgtatggacaagtacgggctaaatctcccgatggtcac

SEQ ID NO: 76888 - DNA, 75 bp, Artificial Sequence
  Synthetic
gaatgattcagtggccatgaggcagacctttggaaacctgtacaaaacatttcacctaaaccctggcatagtgac

SEQ ID NO: 76889 - DNA, 75 bp, Artificial Sequence
  Synthetic
acctttggaaacctgtacaaaacatttcacctaaaccctggcatagtgacaggcagtgcagttggctgtgacccc

SEQ ID NO: 76890 - DNA, 75 bp, Artificial Sequence
  Synthetic
agcttgagtccggtgtggtttgcttgtttgaagttgttgttagagaagttggggtactcacacaaggaaaccaac

SEQ ID NO: 76891 - DNA, 75 bp, Artificial Sequence
  Synthetic
gtttgaagttgttgttagagaagttggggtactcacacaaggaaaccaactacatagactacttgtgcaactccc

SEQ ID NO: 76892 - DNA, 75 bp, Artificial Sequence
  Synthetic
attcaatgatcaacaacatcattatcaggacattgatgttgaaggtatacaaggggatagacctagatcaattca

SEQ ID NO: 76893 - DNA, 75 bp, Artificial Sequence
  Synthetic
caggacattgatgttgaaggtatacaaggggatagacctagatcaattcagaatgatagcatatggagatgacgt

SEQ ID NO: 76894 - DNA, 75 bp, Artificial Sequence
  Synthetic
accagctgacaagggggagtgctttaatgaagtgacatggaccaacgtcacctttctgaagagatacttcagggc

SEQ ID NO: 76895 - DNA, 75 bp, Artificial Sequence
  Synthetic
aatgaagtgacatggaccaacgtcacctttctgaagagatacttcagggcagacgagcaatacccttttctagtt

SEQ ID NO: 76896 - DNA, 75 bp, Artificial Sequence
  Synthetic
gtgcgatctttgtgcttattggcctggcacaatggagagcaagaatatgaagaatttgtgtcaaaaatcaggagc

SEQ ID NO: 76897 - DNA, 75 bp, Artificial Sequence
  Synthetic
ggcacaatggagagcaagaatatgaagaatttgtgtcaaaaatcaggagcgtcccagtagggcgctgcttgacct

SEQ ID NO: 76898 - DNA, 75 bp, Artificial Sequence
  Synthetic
ggtctagtagaagttcaggagagtgaatactaccccaagagataccaatctcacgtgctacttgctgcaggcttc

SEQ ID NO: 76899 - DNA, 75 bp, Artificial Sequence
  Synthetic
aatactaccccaagagataccaatctcacgtgctacttgctgcaggcttctccgaaccaggcgactgtggtggtg

SEQ ID NO: 76900 - DNA, 75 bp, Artificial Sequence
  Synthetic
tacgtggaacagctcggaaatgcttttgggtctggcttcaccaatcaaatctgcgaacaagtcaaccttctcaag

SEQ ID NO: 76901 - DNA, 75 bp, Artificial Sequence
  Synthetic
ctgcgaacaagtcaaccttctcaaggagtcacttgtcgggcaagactccattctggaaaaatcgctcaaagccct

SEQ ID NO: 76902 - DNA, 75 bp, Artificial Sequence
  Synthetic
tgactttgtaccaccaatggcggcacttgaggagaaaggtatactattcacatcaccattcgtccttgcttcaac

SEQ ID NO: 76903 - DNA, 75 bp, Artificial Sequence
  Synthetic
gccaactgggtcttgaccaagcacttctgttaccccggactgagtatcaataggctgctcacgcggctgaaggag

SEQ ID NO: 76904 - DNA, 75 bp, Artificial Sequence
  Synthetic
ttagcgttgcgccagaaactccccccccgccagcaatagcggatctactgaaatctgtggacagtgaggcagtca

SEQ ID NO: 76905 - DNA, 75 bp, Artificial Sequence
  Synthetic
cactacctttgtctccgtggcagggatcatatacattatttacaaattatttgcaggattccagggagcttacac

SEQ ID NO: 76906 - DNA, 75 bp, Artificial Sequence
  Synthetic
ctcaggtgtcaacgcaaaaaaccggagcgcatgagactggcttgagcgccagcgggaattcggtcatccattaca

SEQ ID NO: 76907 - DNA, 75 bp, Artificial Sequence
  Synthetic
ttaccgaacccatgaaggatgtcatgatcaaatcactcccggcgttaaattcacccactgtggaggagtgtggct

SEQ ID NO: 76908 - DNA, 75 bp, Artificial Sequence
  Synthetic
acacgtgaggaagctgaagtcaatgaggctgtactcgccattaacaccagcaagtttccaaacatgtacattcca

SEQ ID NO: 76909 - DNA, 75 bp, Artificial Sequence
  Synthetic
atgcactcgcagagatgggcctattcggtcaaaacatgttgtaccattacctaggaagatcaggctacaccatac

SEQ ID NO: 76910 - DNA, 75 bp, Artificial Sequence
  Synthetic
cacgccagcacattcgggtccatgaactccaatgaggctggggccgtccaaaatgtagtgcacaatgctggaatg

SEQ ID NO: 76911 - DNA, 75 bp, Artificial Sequence
  Synthetic
cagggtatccttatgttgcccttggcattaagaagagagacattctatctaagaagaccaaggatctaacaaagc

SEQ ID NO: 76912 - DNA, 75 bp, Artificial Sequence
  Synthetic
gtaatgccgtacataaacagtgtaccaatggataacatgtttaggcattacaacttcacccttatggtgattcca

SEQ ID NO: 76913 - DNA, 75 bp, Artificial Sequence
  Synthetic
gagtacaacgggctaagattggcagggaaacagggcttaccaacaatgctcactccaggtagcaaccagttcctc

SEQ ID NO: 76914 - DNA, 75 bp, Artificial Sequence
  Synthetic
aggttgattccgtggtcccagtgaataatctggaggataaggtaaattcaatcgaagcttataggatccctgtca

SEQ ID NO: 76915 - DNA, 75 bp, Artificial Sequence
  Synthetic
taatctggaggataaggtaaattcaatcgaagcttataggatccctgtcaaatcaatgagtggcagtgcaacaca

SEQ ID NO: 76916 - DNA, 75 bp, Artificial Sequence
  Synthetic
gtgaggggaggaatgccttctgggtgctcaggaactagcatctttaactcaatgattaacaacataatcattaga

SEQ ID NO: 76917 - DNA, 75 bp, Artificial Sequence
  Synthetic
ctttgcaaactggtctggaagtatcaaactgacattcacgtactgtggtgcagcgatgactactggtaaattcct

SEQ ID NO: 76918 - DNA, 75 bp, Artificial Sequence
  Synthetic
acactattgctgaaggtgtacaaggggatagacctagaccagttcaggatgatagcatacggtgatgatgtcatc

SEQ ID NO: 76919 - DNA, 75 bp, Artificial Sequence
  Synthetic
gcctgttgagggacacaccatttatatctcaaaatgcacttctccaaaatgacccggctactgccattgtcagat

SEQ ID NO: 76920 - DNA, 75 bp, Artificial Sequence
  Synthetic
gacgtgtatggcacaaaagagaatggtgacatcaaacgctttaccaactggaagatcaacacacgccaggtcgtt

SEQ ID NO: 76921 - DNA, 75 bp, Artificial Sequence
  Synthetic
aataacatttgtgattacaagcacccaagggacttcaacccaaacaagcatagacaccccagtgctcacacatca

SEQ ID NO: 76922 - DNA, 75 bp, Artificial Sequence
  Synthetic
cagcgttttctggacagaggggaatgctccggctcgcatgtcaataccctttatgagtgtgggcaatgcctattg

SEQ ID NO: 76923 - DNA, 75 bp, Artificial Sequence
  Synthetic
ttatgagtgtgggcaatgcctattgcaacttttatgatggatggtcacacttctcgcaatccggcgtgtacggct

SEQ ID NO: 76924 - DNA, 75 bp, Artificial Sequence
  Synthetic
ttgagagattgttaccatatagctattggattggccatccagtgactagcagagctattatatacctctttgttg

SEQ ID NO: 76925 - DNA, 75 bp, Artificial Sequence
  Synthetic
gcacatcaaagcgtgggtgcccagaccaccgcgtctgtgcgattatgtgtatgcacataatgttgatttcacccc

SEQ ID NO: 76926 - DNA, 75 bp, Artificial Sequence
  Synthetic
tcaagtctcaacacaaaagactggggcacacgagaccgggctgaatgccagtggcaattccatcattcactacac

SEQ ID NO: 76927 - DNA, 75 bp, Artificial Sequence
  Synthetic
gcacacgagaccgggctgaatgccagtggcaattccatcattcactacacaaacatcaattactacaaagacgcc

SEQ ID NO: 76928 - DNA, 75 bp, Artificial Sequence
  Synthetic
taaataggcacctggctactcacgccgattggcagaattgtgtgtgggaagattacaatagagacctcttagtga

SEQ ID NO: 76929 - DNA, 75 bp, Artificial Sequence
  Synthetic
atgaagtccctgccggcccttaattcaccaacagtggaggagtgtggatacagtgacagggtccgtgccataacc

SEQ ID NO: 76930 - DNA, 75 bp, Artificial Sequence
  Synthetic
caccaacagtggaggagtgtggatacagtgacagggtccgtgccataaccctaggaaattccaccatcacaaccc

SEQ ID NO: 76931 - DNA, 75 bp, Artificial Sequence
  Synthetic
ggaacaggcactacccagttagctttgaagggccaggcctagtggaagtccaggagagtgagtattacccaaaga

SEQ ID NO: 76932 - DNA, 75 bp, Artificial Sequence
  Synthetic
atcaaccaacccaacccgatgtggccacatgtcgtttttacacactagaatctgtagtgtggcaaaaatctagta

SEQ ID NO: 76933 - DNA, 75 bp, Artificial Sequence
  Synthetic
tgtggtggaatcctcaggtgcgagcatggtgtcatcgggctagttaccatgggcggcgaaggcgttgtcggcttt

SEQ ID NO: 76934 - DNA, 75 bp, Artificial Sequence
  Synthetic
cacatgtcgtttttacacactagaatctgtagtgtggcaaaaatctagtaatgggtggtggtggaaattcccaga

SEQ ID NO: 76935 - DNA, 75 bp, Artificial Sequence
  Synthetic
ggcaatgccttcggttccgggttcaccaatcagatctgcgaacaagttaacctccttaaagaatcgttagtgggc

SEQ ID NO: 76936 - DNA, 75 bp, Artificial Sequence
  Synthetic
cgtgcaatgcaacgcctctcgtttccaccagggatgtctgatggtggtctgtgtaccagaagcagaaatgggttg

SEQ ID NO: 76937 - DNA, 75 bp, Artificial Sequence
  Synthetic
ccaatcagatctgcgaacaagttaacctccttaaagaatcgttagtgggccaagattccatactagagaagtccc

SEQ ID NO: 76938 - DNA, 75 bp, Artificial Sequence
  Synthetic
caccagggatgtctgatggtggtctgtgtaccagaagcagaaatgggttgtgctgacataactagagtggtgaac

SEQ ID NO: 76939 - DNA, 75 bp, Artificial Sequence
  Synthetic
ccaccctcgccctaattggttgtacttcatcgccgtggcggtggcccaaacagaaggtgtcacagtattacggga

SEQ ID NO: 76940 - DNA, 75 bp, Artificial Sequence
  Synthetic
gcggcggcacataacgcaggtatgggagtagccgttggtaatttgaccatatacccgcaccaatggatcaacctg

SEQ ID NO: 76941 - DNA, 75 bp, Artificial Sequence
  Synthetic
gagtagccgttggtaatttgaccatatacccgcaccaatggatcaacctgcgaacaaacaacagcgccaccattg

SEQ ID NO: 76942 - DNA, 75 bp, Artificial Sequence
  Synthetic
taccaatggctgagcgtcaaaacaatgggtggctcaagaagtttacagagatgactaatgcctgcaaagggatgg

SEQ ID NO: 76943 - DNA, 75 bp, Artificial Sequence
  Synthetic
ttgtgcccttggattatagcgacggagcatctacgtatgtcccaatcaccatcacaatagcacccatggatgcag

SEQ ID NO: 76944 - DNA, 75 bp, Artificial Sequence
  Synthetic
agcatctacgtatgtcccaatcaccatcacaatagcacccatggatgcagaatacaatggactacggctgggagg

SEQ ID NO: 76945 - DNA, 75 bp, Artificial Sequence
  Synthetic
tgcaatgcctcaatttgatgtcaccccagaactgagcatcccaggccaggtgaagaacctgatggagatagccga

SEQ ID NO: 76946 - DNA, 75 bp, Artificial Sequence
  Synthetic
ccagaactgagcatcccaggccaggtgaagaacctgatggagatagccgaagtagactcggttgtacctctaaac

SEQ ID NO: 76947 - DNA, 75 bp, Artificial Sequence
  Synthetic
ttcccttgaaaagaaaatgagcaattacatacagttcaagtccaaatgccgtattgaacccgtatgtttgctatt

SEQ ID NO: 76948 - DNA, 75 bp, Artificial Sequence
  Synthetic
gtatttgggtttcagttacaaccagggtccagctctgtattgatgaggactctgttgggggagatcttaaactac

SEQ ID NO: 76949 - DNA, 75 bp, Artificial Sequence
  Synthetic
ggtccagctctgtattgatgaggactctgttgggggagatcttaaactactacacacactggagcggtagcatca

SEQ ID NO: 76950 - DNA, 75 bp, Artificial Sequence
  Synthetic
gcaaacctatgagccgcaaggatgcaatgttgggcacacatgtagtgtgggacgtgggtttgcaatccagctgtg

SEQ ID NO: 76951 - DNA, 75 bp, Artificial Sequence
  Synthetic
aatgttgggcacacatgtagtgtgggacgtgggtttgcaatccagctgtgtgttgtgtgtaccatggatcagcca

SEQ ID NO: 76952 - DNA, 75 bp, Artificial Sequence
  Synthetic
cgtaactccaccatcgacccagagcaagtgctttatcatgtgcttggtgtcagcgtgtaatgatttctcggtgag

SEQ ID NO: 76953 - DNA, 75 bp, Artificial Sequence
  Synthetic
aagtgctttatcatgtgcttggtgtcagcgtgtaatgatttctcggtgagattactcaaagatactccatttatt

SEQ ID NO: 76954 - DNA, 75 bp, Artificial Sequence
  Synthetic
gcaagtggccctgcaaactctgagagcgtgcctgctctcactgcggtagaaactggacacacgtcacaggtgaca

SEQ ID NO: 76955 - DNA, 75 bp, Artificial Sequence
  Synthetic
gcgtgcctgctctcactgcggtagaaactggacacacgtcacaggtgacaccaagtgatacaatgcagaccagac

SEQ ID NO: 76956 - DNA, 75 bp, Artificial Sequence
  Synthetic
caactccactctccagattgagaagcatgtcagtagagccttcatatgcctccaggcactaacaacctttgtctc

SEQ ID NO: 76957 - DNA, 75 bp, Artificial Sequence
  Synthetic
catgtcagtagagccttcatatgcctccaggcactaacaacctttgtctccgtggccgggattatatatataatt

SEQ ID NO: 76958 - DNA, 75 bp, Artificial Sequence
  Synthetic
caacgtacaaaacaacagccagcagacccgaagaccaattcgttaggtggtccatttcataccgccaggtggccc

SEQ ID NO: 76959 - DNA, 75 bp, Artificial Sequence
  Synthetic
acccgaagaccaattcgttaggtggtccatttcataccgccaggtggcccaactgcgcaggaaaatggaaatgtt

SEQ ID NO: 76960 - DNA, 75 bp, Artificial Sequence
  Synthetic
ggatgctcctgtactcacacatcagttaatgtacgtaccccccgggggtccagtgcccaaaaattcaagagacta

SEQ ID NO: 76961 - DNA, 75 bp, Artificial Sequence
  Synthetic
ttaatgtacgtaccccccgggggtccagtgcccaaaaattcaagagactatgcatggcaaacatccaccaacccg

SEQ ID NO: 76962 - DNA, 75 bp, Artificial Sequence
  Synthetic
gcatttatgataggtgggctgtccttccgcgccacgccaagcccggaccaactatcctcatgaacgatcaagaag

SEQ ID NO: 76963 - DNA, 75 bp, Artificial Sequence
  Synthetic
tgcttttatgatggatggtcccactactcacagacgggggtgtatggttacaacaccttaaacgacatgggccaa

SEQ ID NO: 76964 - DNA, 75 bp, Artificial Sequence
  Synthetic
actcacagacgggggtgtatggttacaacaccttaaacgacatgggccaattatttgtcaggcacgtgaatgagg

SEQ ID NO: 76965 - DNA, 75 bp, Artificial Sequence
  Synthetic
gaggtcagcgaggccgtcctggctataaacaccagcaagttcccaaacatgtacatcccagtaggacaggtcaca

SEQ ID NO: 76966 - DNA, 75 bp, Artificial Sequence
  Synthetic
caccacggttgtgccaatatgttaacgcagcaacggtgaacttcactcctgaaggggtcactaaggcacgtactg

SEQ ID NO: 76967 - DNA, 75 bp, Artificial Sequence
  Synthetic
cgcagcaacggtgaacttcactcctgaaggggtcactaaggcacgtactgatctcatgacaacaggtgcgttcgg

SEQ ID NO: 76968 - DNA, 75 bp, Artificial Sequence
  Synthetic
gaactgtgtatgggaagattacaacagagatttactggtgagcaccactacagcacacggctgtgataacatagc

SEQ ID NO: 76969 - DNA, 75 bp, Artificial Sequence
  Synthetic
ttaatgacgagcaaggtgagatagagttcatcgaaagctcgaaggatgcagggttccctgtcatcaacacaccaa

SEQ ID NO: 76970 - DNA, 75 bp, Artificial Sequence
  Synthetic
agagatttactggtgagcaccactacagcacacggctgtgataacatagccagatgccagtgcacgacaggcgtg

SEQ ID NO: 76971 - DNA, 75 bp, Artificial Sequence
  Synthetic
gaatattaccccaagagataccaatcccatgttctcctagcggcaggtttctccgagcctggtgactgcggtggg

SEQ ID NO: 76972 - DNA, 75 bp, Artificial Sequence
  Synthetic
cccatgttctcctagcggcaggtttctccgagcctggtgactgcggtgggattctgaggtgcgagcacggtgtca

SEQ ID NO: 76973 - DNA, 75 bp, Artificial Sequence
  Synthetic
atgccatggagcagggagtgaaggactacgtcgaacaacttggcaacgccttcggatcaggattcaccaatcaaa

SEQ ID NO: 76974 - DNA, 75 bp, Artificial Sequence
  Synthetic
tatgcgaacaggtcaatctcttgaaagattcactagtgggccaagactctattctagagaaatctctaaaagccc

SEQ ID NO: 76975 - DNA, 75 bp, Artificial Sequence
  Synthetic
tcccaatattacggaatacccatggctgaacgccaaaataacgggtggcttaagaagtttactgagatgacaaat

SEQ ID NO: 76976 - DNA, 75 bp, Artificial Sequence
  Synthetic
gaagtcaaggaaaaacatgagttcctgaacaggcttaaacagctccccctattagaaagtcagattgccacaatc

SEQ ID NO: 76977 - DNA, 75 bp, Artificial Sequence
  Synthetic
tgaacaggcttaaacagctccccctattagaaagtcagattgccacaatcgagcagagtgcaccatcccagagcg

SEQ ID NO: 76978 - DNA, 75 bp, Artificial Sequence
  Synthetic
gaagaagatgagtaattacatacagttcaagtccaaatgccgtattgagcctgtatgtttacttttgcatggaag

SEQ ID NO: 76979 - DNA, 75 bp, Artificial Sequence
  Synthetic
aggcgggtaaggggtatggattgatcatgacaccagcggataaaggggagtgtttcaatgaggtcacctggacca

SEQ ID NO: 76980 - DNA, 75 bp, Artificial Sequence
  Synthetic
ctcgctacccccagacccagaccacttcgatggttataagcagcaggctgtggtgatcatggatgatctatgtca

SEQ ID NO: 76981 - DNA, 75 bp, Artificial Sequence
  Synthetic
cagggcagatgaacaataccctttcctggtccatccagttatgcccatgaaggacattcatgaatctatcaggtg

SEQ ID NO: 76982 - DNA, 75 bp, Artificial Sequence
  Synthetic
tctggaagagaaaggcattctattcacctctccatttgtcctggcatcaaccaacgcagggtccattaatgctcc

SEQ ID NO: 76983 - DNA, 75 bp, Artificial Sequence
  Synthetic
taaattagagacaatttgagaataattcaaattggcttaaccctaccgcactcaccgaacttgataacggtgcgg

SEQ ID NO: 76984 - DNA, 75 bp, Artificial Sequence
  Synthetic
ttcaaattggcttaaccctaccgcactcaccgaacttgataacggtgcggtaggggtaaattctccgcttccggt

SEQ ID NO: 76985 - DNA, 75 bp, Artificial Sequence
  Synthetic
ccagaatggcaagataaacatgccaatgtcagtgaagacgtgtgatgaagaatgttgcccagtcaactttaagaa

SEQ ID NO: 76986 - DNA, 75 bp, Artificial Sequence
  Synthetic
ttccctcccacagggcccaatgggcgccagcacactggtatcatggtacctttgtgcgcctgttttattcacccc

SEQ ID NO: 76987 - DNA, 75 bp, Artificial Sequence
  Synthetic
gctggtaactgaaatgttcagagaatataatcacaggcatagtgtcggggccacccttgaggctctgttccaggg

SEQ ID NO: 76988 - DNA, 75 bp, Artificial Sequence
  Synthetic
tataatcacaggcatagtgtcggggccacccttgaggctctgttccagggcccgccggtatacagagatattaag

SEQ ID NO: 76989 - DNA, 75 bp, Artificial Sequence
  Synthetic
acttctgttaccccggaccgagtatcaataggctgctcacgcggctgaaggagaaaacgttcgttacccggccaa

SEQ ID NO: 76990 - DNA, 75 bp, Artificial Sequence
  Synthetic
agagagtattgtaaagaaaagggatggctgattccagagatcaactccaccctgcagatcgaaaaacacgtcagc

SEQ ID NO: 76991 - DNA, 75 bp, Artificial Sequence
  Synthetic
tttgcaggttttcaaggagcgtacacaggattgcctaaccagaagcccaaagtacccactctcagacaggcgaaa

SEQ ID NO: 76992 - DNA, 75 bp, Artificial Sequence
  Synthetic
caggattgcctaaccagaagcccaaagtacccactctcagacaggcgaaagtgcaaggtcctgcgtttgagtttg

SEQ ID NO: 76993 - DNA, 75 bp, Artificial Sequence
  Synthetic
acaagtgggccgttttgccgcgtcatgctaaacctggaccaaccattctgatgaatgaccaagaggttggtgtgt

SEQ ID NO: 76994 - DNA, 75 bp, Artificial Sequence
  Synthetic
tattcttatattggctgcttatggtgacaattgaaagattgttgccatatagctattggattggccatccggtaa

SEQ ID NO: 76995 - DNA, 75 bp, Artificial Sequence
  Synthetic
tgctaaacctggaccaaccattctgatgaatgaccaagaggttggtgtgttggacgctaaggagctagtggataa

SEQ ID NO: 76996 - DNA, 75 bp, Artificial Sequence
  Synthetic
agctaaagaagaggtggaggttaacgaggctgtgttagcaattaataccagcaagttccccaacatgtatatccc

SEQ ID NO: 76997 - DNA, 75 bp, Artificial Sequence
  Synthetic
gaggctgtgttagcaattaataccagcaagttccccaacatgtatatcccagtaggacaggtcacagattacggc

SEQ ID NO: 76998 - DNA, 75 bp, Artificial Sequence
  Synthetic
tatacaaatataaattattataaggacgccgcctcgaactcagcaaatagacaggatttcacccaagatccaggg

SEQ ID NO: 76999 - DNA, 75 bp, Artificial Sequence
  Synthetic
ggagtgctcatgtccaccggtaaagttttgggaatacatgttggtgggaacggtcatcaaggcttttcagcggca

SEQ ID NO: 77000 - DNA, 75 bp, Artificial Sequence
  Synthetic
ggttacagtgatagggtaaggtccattaccttgggtaactcaactataacaactcaggagtgtgcaaatgtggta

SEQ ID NO: 77001 - DNA, 75 bp, Artificial Sequence
  Synthetic
aacaaggggaaatcgagttcatcgagagttcaaaggatgcggggttcccagtcatcaatacacctagcaaaacca

SEQ ID NO: 77002 - DNA, 75 bp, Artificial Sequence
  Synthetic
ggaagaccaacccacccaaccagacgtggccacgtgtaggttttacacgcttgaatccgtaatgtggcaacagag

SEQ ID NO: 77003 - DNA, 75 bp, Artificial Sequence
  Synthetic
cccgacgcactgtccaacatgggtttgttcgggcaaaacatgcaataccattaccttgggagggccgggtatacg

SEQ ID NO: 77004 - DNA, 75 bp, Artificial Sequence
  Synthetic
gtcaacacacacgtggatgagtacatgctggaggctgtcgaccattacgctggacaattggccactttagacatc

SEQ ID NO: 77005 - DNA, 75 bp, Artificial Sequence
  Synthetic
gagaaggtagcaaaaggaaagtctaggctgattgaagcatctagtctaaatgattcagtggcaatgagacagaca

SEQ ID NO: 77006 - DNA, 75 bp, Artificial Sequence
  Synthetic
gattgtcatgccatacataaatagtgtgcccatggataacatgttcaggcataataacttcacccttatgatcat

SEQ ID NO: 77007 - DNA, 75 bp, Artificial Sequence
  Synthetic
ccttcagctatgccacagtttgatgttacccctgaaatggatatcccaggacaggtcaacaacttgatggaaatc

SEQ ID NO: 77008 - DNA, 75 bp, Artificial Sequence
  Synthetic
ggaattgatttggaccagttcaggatgatcgcatatggtgatgatgtaattgcatcatacccatggcccatagat

SEQ ID NO: 77009 - DNA, 75 bp, Artificial Sequence
  Synthetic
accaggagctagcagtgtattaaataggacactgttgggggaaatactgaattactacactcattggtcgggtag

SEQ ID NO: 77010 - DNA, 75 bp, Artificial Sequence
  Synthetic
gaagtcacctggaccaacgtcactttcctaaagaggtactttagagcagatgaacaataccccttcttagtgcac

SEQ ID NO: 77011 - DNA, 75 bp, Artificial Sequence
  Synthetic
agctggtgcaccgactacacgaaaggaagcaatgttgggcactcacgtgatctgggatgtggggttgcaatcgag

SEQ ID NO: 77012 - DNA, 75 bp, Artificial Sequence
  Synthetic
tgaacaataccccttcttagtgcaccctgtcatgcccatgaaagacatacatgagtcaatcagatggaccaaaga

SEQ ID NO: 77013 - DNA, 75 bp, Artificial Sequence
  Synthetic
acaagaacagtccactatacaaggtcaggattcaccagtacttacgcatcaaatcatgtatgtgcccccaggtgg

SEQ ID NO: 77014 - DNA, 75 bp, Artificial Sequence
  Synthetic
caggattcaccagtacttacgcatcaaatcatgtatgtgcccccaggtggcccggtgcccacgaaagtgaatagt

SEQ ID NO: 77015 - DNA, 75 bp, Artificial Sequence
  Synthetic
tacagctggcagacgtccaccaatcctagcgtgttctggacagaagggagtgcaccaccccgcatgtcaatacct

SEQ ID NO: 77016 - DNA, 75 bp, Artificial Sequence
  Synthetic
ggcgcctatggacagcaatcaggtgccgtgtacattggcaactacagaatagtaaacagacatctcgcaactcac

SEQ ID NO: 77017 - DNA, 75 bp, Artificial Sequence
  Synthetic
gacaccatagccagatgccaatgcacaaccggggtgtacttttgtgcctcaaggaacaaacattaccctgtcgtc

SEQ ID NO: 77018 - DNA, 75 bp, Artificial Sequence
  Synthetic
atgggtggcgagggcgttgtcggctttgccgacgtgcgtgaccttctatggttggaggatgatgcaatggagcag

SEQ ID NO: 77019 - DNA, 75 bp, Artificial Sequence
  Synthetic
acttcatcaccgtggcgctggcttaagcaaaaggtgtcacaatattacgggatacccatggctgagcgtcaaaac

SEQ ID NO: 77020 - DNA, 75 bp, Artificial Sequence
  Synthetic
aaatttatagattggctcaaggttaaaatcctgccggaggtgagggagaagcatgaatttttgaccagactcaag

SEQ ID NO: 77021 - DNA, 75 bp, Artificial Sequence
  Synthetic
agctcagtgtattctctacctccagatccagaccactttgatggttataagcaacaagccgtcgtgatcatggat

SEQ ID NO: 77022 - DNA, 75 bp, Artificial Sequence
  Synthetic
ccaatggctgctctggaggagaagggaatccttttcacctctcccttcgtcctggcttcgaccaacgctggttcc

SEQ ID NO: 77023 - DNA, 75 bp, Artificial Sequence
  Synthetic
atcaatgctccgacagtctcagacagcagggccctggctaggagatttcacttcgatatgaacattgaggttatt

SEQ ID NO: 77024 - DNA, 75 bp, Artificial Sequence
  Synthetic
cttcgatatgaacattgaggttatttcaatgtatagtcagaatgggaagatcaatatgccaatgtcagtgaagac

SEQ ID NO: 77025 - DNA, 75 bp, Artificial Sequence
  Synthetic
tcaatatgccaatgtcagtgaagacctgtgatgaggagtgtagcccagtcaacttcaagaaatgttgcccgctgg

SEQ ID NO: 77026 - DNA, 75 bp, Artificial Sequence
  Synthetic
aacatgtgagcagggcctttatctgcctacaggcactcaccacttttgtctctgtggcagggatcatttacatca

SEQ ID NO: 77027 - DNA, 75 bp, Artificial Sequence
  Synthetic
gatgtaagagacttgttgtggctggaggacgacgccatggagcaaggagttagggattatgtggaacaactcggc

SEQ ID NO: 77028 - DNA, 75 bp, Artificial Sequence
  Synthetic
ctctggacatcagcacagaacctatgaaattggaggacgcagtttatggtactgagggcttagaggctctagatc

SEQ ID NO: 77029 - DNA, 75 bp, Artificial Sequence
  Synthetic
tgaggtcagcagataaagtggcaaatggcaaatccaggctgattgaggcgtccagcttaaatgactcagtggcat

SEQ ID NO: 77030 - DNA, 75 bp, Artificial Sequence
  Synthetic
attggcctggcacaatggggagcaagaatatgaagaatttgtatccaaaatcagaagcgtcccagttgggcgctg

SEQ ID NO: 77031 - DNA, 75 bp, Artificial Sequence
  Synthetic
gccccacaggggcccactgggcgctagcacactggtattgcggtacccttgtgcgcctgttttatccaccctccc

SEQ ID NO: 77032 - DNA, 75 bp, Artificial Sequence
  Synthetic
agcacaggtctcaacgcagaaaaccggagcacatgaaacagggctaaatgctagcggtaattctgtaatacacta

SEQ ID NO: 77033 - DNA, 75 bp, Artificial Sequence
  Synthetic
ggagcacatgaaacagggctaaatgctagcggtaattctgtaatacactacacaaacattaattactacaaggat

SEQ ID NO: 77034 - DNA, 75 bp, Artificial Sequence
  Synthetic
atgataaaatcactaccagccttaaattcccccacagttgaagagtgcggatatagtgacagggtgaggtccatc

SEQ ID NO: 77035 - DNA, 75 bp, Artificial Sequence
  Synthetic
attcccccacagttgaagagtgcggatatagtgacagggtgaggtccatcacgctaggcaactccaccattacta

SEQ ID NO: 77036 - DNA, 75 bp, Artificial Sequence
  Synthetic
aggatcaaccgacacagccagatgttgccacgtgtagattttacacacttgattctgtgcagtggcagaagacat

SEQ ID NO: 77037 - DNA, 75 bp, Artificial Sequence
  Synthetic
tgccacgtgtagattttacacacttgattctgtgcagtggcagaagacatcaccaggttggtggtggaagctacc

SEQ ID NO: 77038 - DNA, 75 bp, Artificial Sequence
  Synthetic
acacgtgcagtgcaacgcatcaaaatttcaccagggatgtttgctggttgtgtgtgtgcctgaagccgaaatggg

SEQ ID NO: 77039 - DNA, 75 bp, Artificial Sequence
  Synthetic
ctgtgcgacattagacaatacaccttcaagtgcggagttgctaggaggtgatgctgcaaaggagtttgcagacaa

SEQ ID NO: 77040 - DNA, 75 bp, Artificial Sequence
  Synthetic
aactacatagactacctctgtaattcccaccacctgtacagggacaaacactactttgtgaggggcggcatgcca

SEQ ID NO: 77041 - DNA, 75 bp, Artificial Sequence
  Synthetic
tgaccttcctgaaaaggtacttcagggcagatgaacagtacccatttttggtccatcctgtcatgccaatgaagg

SEQ ID NO: 77042 - DNA, 75 bp, Artificial Sequence
  Synthetic
tcaactccatggaggcataccaaatacccgtcagatccaatgaggggtctggcacccaagtatttggcttcccat

SEQ ID NO: 77043 - DNA, 75 bp, Artificial Sequence
  Synthetic
gcagtataaagcttactttcatgttttgtggctcggctatggccactggaaaatttttgctggcgtactcaccgc

SEQ ID NO: 77044 - DNA, 75 bp, Artificial Sequence
  Synthetic
ttgtggctcggctatggccactggaaaatttttgctggcgtactcaccgccaggtgccggagctccgacaaagag

SEQ ID NO: 77045 - DNA, 75 bp, Artificial Sequence
  Synthetic
ccccggactgagtatcaataagctgctcacgcggctgaaggagaaaacgttcgttacccggccaattacttcgag

SEQ ID NO: 77046 - DNA, 75 bp, Artificial Sequence
  Synthetic
gataagtcaaacacactaccgatatgtggcctctgacgaatataccgctggtggattcatcacttgctggtatca

SEQ ID NO: 77047 - DNA, 75 bp, Artificial Sequence
  Synthetic
gtggcctctgacgaatataccgctggtggattcatcacttgctggtatcaaaccaacattgtagtccctgctgac

SEQ ID NO: 77048 - DNA, 75 bp, Artificial Sequence
  Synthetic
ccctttatatcccaggacaactttttccaaggcccagttgaggatgcagtaacagctgcaatcggtagagttgct

SEQ ID NO: 77049 - DNA, 75 bp, Artificial Sequence
  Synthetic
tccaaggcccagttgaggatgcagtaacagctgcaatcggtagagttgctgatacagtgggaactggaccgacta

SEQ ID NO: 77050 - DNA, 75 bp, Artificial Sequence
  Synthetic
ctggctgcttatggtgacaattgagagattgttgccatatagctattggattggccatccggtgtctaacagagc

SEQ ID NO: 77051 - DNA, 75 bp, Artificial Sequence
  Synthetic
aaacgcgacatgtgaaaaactaccactcaaggtctgaatcaacggtcgagaactttttgtgtagatctgcttgtg

SEQ ID NO: 77052 - DNA, 75 bp, Artificial Sequence
  Synthetic
ctcaaggtctgaatcaacggtcgagaactttttgtgtagatctgcttgtgtctacttcactgagtatgagaactc

SEQ ID NO: 77053 - DNA, 75 bp, Artificial Sequence
  Synthetic
agattgttgccatatagctattggattggccatccggtgtctaacagagcaatcatttatctgtttgttgggttc

SEQ ID NO: 77054 - DNA, 75 bp, Artificial Sequence
  Synthetic
tctcaacccaaaagacaggggcacacgagaccagtctgagtgctagtggtaattcaattatccactacaccaaca

SEQ ID NO: 77055 - DNA, 75 bp, Artificial Sequence
  Synthetic
cacgtacataaggttcgatttggagctcaccttcgtcattacgagcacacagcaaccctccacaacccagaatca

SEQ ID NO: 77056 - DNA, 75 bp, Artificial Sequence
  Synthetic
ctcaccttcgtcattacgagcacacagcaaccctccacaacccagaatcaggatgctcagatcctcacccatcag

SEQ ID NO: 77057 - DNA, 75 bp, Artificial Sequence
  Synthetic
cgagaccagtctgagtgctagtggtaattcaattatccactacaccaacataaattactataaagatgctgcatc

SEQ ID NO: 77058 - DNA, 75 bp, Artificial Sequence
  Synthetic
gtcactaccagcactcaactcgccgactgtggaggagtgtgggtatagtgacagggttaggtcaataacactagg

SEQ ID NO: 77059 - DNA, 75 bp, Artificial Sequence
  Synthetic
agtgtgttttggacagagggcaatgcgccgccacgcatgtccatacctttcttgagcattggcaacgcttattca

SEQ ID NO: 77060 - DNA, 75 bp, Artificial Sequence
  Synthetic
cgccgccacgcatgtccatacctttcttgagcattggcaacgcttattcaaacttttacgatggttggtcagagt

SEQ ID NO: 77061 - DNA, 75 bp, Artificial Sequence
  Synthetic
actgtggaggagtgtgggtatagtgacagggttaggtcaataacactaggaaattcaaccataacaacacaagaa

SEQ ID NO: 77062 - DNA, 75 bp, Artificial Sequence
  Synthetic
cccacccagccggatgtcgcaacatgcaggttctacacattgaactcagtgaaatgggagatgcaatcagcaggg

SEQ ID NO: 77063 - DNA, 75 bp, Artificial Sequence
  Synthetic
gaagcactggacccataaagagcacaattaggatttatttcaaaccaaaacacgttaaagcatggatacccagac

SEQ ID NO: 77064 - DNA, 75 bp, Artificial Sequence
  Synthetic
gcaggttctacacattgaactcagtgaaatgggagatgcaatcagcagggtggtggtggaagttcccagatgcat

SEQ ID NO: 77065 - DNA, 75 bp, Artificial Sequence
  Synthetic
cacgttaaagcatggatacccagacctcccaggttatgccagtatgagaaggcaaaaaatgtcaattttcaaccc

SEQ ID NO: 77066 - DNA, 75 bp, Artificial Sequence
  Synthetic
agtgtaacgcttccaaatttcaccagggatgcttactagtagtgtgtgtgccagaagctgaaatgggatgcacca

SEQ ID NO: 77067 - DNA, 75 bp, Artificial Sequence
  Synthetic
gggatgcttactagtagtgtgtgtgccagaagctgaaatgggatgcaccaatgttgaaaatgcacccacgtatgg

SEQ ID NO: 77068 - DNA, 75 bp, Artificial Sequence
  Synthetic
gtgtatgtggggagttacagggtggtgaacagacacttagcaacacacactgattggcagaattgcgtgtgggaa

SEQ ID NO: 77069 - DNA, 75 bp, Artificial Sequence
  Synthetic
agtgtgcaatgcaggtatgggcgtgggagttggtaatctgaccatattcccacaccaatggatcaacctgaggac

SEQ ID NO: 77070 - DNA, 75 bp, Artificial Sequence
  Synthetic
actggggtgtacttttgtgcctcaaggaacaagcactacccggttagctttgagggtccaggcctagttgaggtg

SEQ ID NO: 77071 - DNA, 75 bp, Artificial Sequence
  Synthetic
ggaacaagcactacccggttagctttgagggtccaggcctagttgaggtgcaagagagtgaatactaccccaaga

SEQ ID NO: 77072 - DNA, 75 bp, Artificial Sequence
  Synthetic
ggagttggtaatctgaccatattcccacaccaatggatcaacctgaggactaacaacagtgccaccattgtaatg

SEQ ID NO: 77073 - DNA, 75 bp, Artificial Sequence
  Synthetic
ccattggattatgtcaccggagcatcctcttacatccctatcaccgtgacagtcgccccgatgagcgctgaatat

SEQ ID NO: 77074 - DNA, 75 bp, Artificial Sequence
  Synthetic
acggtgtcattgggcttgtcaccatgggaggcgatggagtagtcggatttgctgacgtccgcgatctactatggt

SEQ ID NO: 77075 - DNA, 75 bp, Artificial Sequence
  Synthetic
gggaggcgatggagtagtcggatttgctgacgtccgcgatctactatggttggaggatgacgcaatggagcaagg

SEQ ID NO: 77076 - DNA, 75 bp, Artificial Sequence
  Synthetic
cctcttacatccctatcaccgtgacagtcgccccgatgagcgctgaatataacgggttgcggctagccggtcatc

SEQ ID NO: 77077 - DNA, 75 bp, Artificial Sequence
  Synthetic
tgccacagtttgacgtgactcccgaaatgaacatcccagggcaagtaagaaacttgatggaaatggcagaagttg

SEQ ID NO: 77078 - DNA, 75 bp, Artificial Sequence
  Synthetic
tctccttaaggagtcacttgtgggtcaggattccatcctagagaagtccctcaaggcacttgtgaagattatttc

SEQ ID NO: 77079 - DNA, 75 bp, Artificial Sequence
  Synthetic
caggattccatcctagagaagtccctcaaggcacttgtgaagattatttcagcactggtaattgtggtgagaaac

SEQ ID NO: 77080 - DNA, 75 bp, Artificial Sequence
  Synthetic
aatgaacatcccagggcaagtaagaaacttgatggaaatggcagaagttgattctgtggtgccacttaacaatct

SEQ ID NO: 77081 - DNA, 75 bp, Artificial Sequence
  Synthetic
tggattccccttacaaccaggagcatcaagtgtgctgcagcggacattactgggagaaatattgaattactacac

SEQ ID NO: 77082 - DNA, 75 bp, Artificial Sequence
  Synthetic
cagaaagtatcacagtactatggtatacccatggcggaacgccagaacaatgggtggctcaagaaatttactgaa

SEQ ID NO: 77083 - DNA, 75 bp, Artificial Sequence
  Synthetic
tacccatggcggaacgccagaacaatgggtggctcaagaaatttactgaaatgaccaatgcttgcaaagggatgg

SEQ ID NO: 77084 - DNA, 75 bp, Artificial Sequence
  Synthetic
acgttcgtgttctgtggttcagccatggctactgggaagttcttgcttgcctattcaccacctggtgcaggagcc

SEQ ID NO: 77085 - DNA, 75 bp, Artificial Sequence
  Synthetic
acgagttcctaaccaggctcaagcagcttccctttttggaaagtcaaatagctaccattgaacagagtgcaccat

SEQ ID NO: 77086 - DNA, 75 bp, Artificial Sequence
  Synthetic
gctaccattgaacagagtgcaccatcccagagtgatcaggaacaacttttctcgaatgtccaatattttgcccat

SEQ ID NO: 77087 - DNA, 75 bp, Artificial Sequence
  Synthetic
tgcaacgacttttctgttcgcatgttaagggacacacaatttatcaaacaggataacttttaccaaggaccaaca

SEQ ID NO: 77088 - DNA, 75 bp, Artificial Sequence
  Synthetic
taagggacacacaatttatcaaacaggataacttttaccaaggaccaacagaagactcagtggagcgtgcgatgg

SEQ ID NO: 77089 - DNA, 75 bp, Artificial Sequence
  Synthetic
ccagatcactttgatggttacaaacagcaagctgtcgtgattatggacgatctgtgtcaaaacccagatggtaaa

SEQ ID NO: 77090 - DNA, 75 bp, Artificial Sequence
  Synthetic
gacacacatcgcaggttgatccaagtgacaccatgcaaaccaggcacgtgcacaactatcattcaaggtctgagt

SEQ ID NO: 77091 - DNA, 75 bp, Artificial Sequence
  Synthetic
agcaagctgtcgtgattatggacgatctgtgtcaaaacccagatggtaaagatgtatccctgttctgccagatgg

SEQ ID NO: 77092 - DNA, 75 bp, Artificial Sequence
  Synthetic
tgacaccatgcaaaccaggcacgtgcacaactatcattcaaggtctgagtcatcaatagagaactttttgtgtag

SEQ ID NO: 77093 - DNA, 75 bp, Artificial Sequence
  Synthetic
tagcatcaactaatgcaggctccattaacgcaccaaccgtatcagacagcagagccttggccaggaggttccact

SEQ ID NO: 77094 - DNA, 75 bp, Artificial Sequence
  Synthetic
taacacaagacaggtggcacagctgcgacggaaaatggaaatgttcacatacattcgctgtgacatggaattgac

SEQ ID NO: 77095 - DNA, 75 bp, Artificial Sequence
  Synthetic
taacgcaccaaccgtatcagacagcagagccttggccaggaggttccactttgatatgaacattgaggtcatctc

SEQ ID NO: 77096 - DNA, 75 bp, Artificial Sequence
  Synthetic
cgacggaaaatggaaatgttcacatacattcgctgtgacatggaattgacatttgtcataaccagccaccaggaa

SEQ ID NO: 77097 - DNA, 75 bp, Artificial Sequence
  Synthetic
ctttaagaggtgttgtcctctcgtctgtggcaaggcaattcagtttatcgatagaagaacccacgtcagatactc

SEQ ID NO: 77098 - DNA, 75 bp, Artificial Sequence
  Synthetic
ccaacgtcagtaaatgattatgtgtggcaaacgtcaactaaccccagtattttctggacggaaggcaatgcacca

SEQ ID NO: 77099 - DNA, 75 bp, Artificial Sequence
  Synthetic
tgtggcaaggcaattcagtttatcgatagaagaacccacgtcagatactcattagacatgttagtcactgaaatg

SEQ ID NO: 77100 - DNA, 75 bp, Artificial Sequence
  Synthetic
ggcaaacgtcaactaaccccagtattttctggacggaaggcaatgcaccaccaagaatgtcaataccatttatga

SEQ ID NO: 77101 - DNA, 75 bp, Artificial Sequence
  Synthetic
gagatcaaaattagtgttgcacctgaaacccctccaccgccagcgattgcagatttactaaagtcagtggatagc

SEQ ID NO: 77102 - DNA, 75 bp, Artificial Sequence
  Synthetic
cactaaataatatgggaaccatctatgcacgccatgtcaatgattccagcccaggtggcttgaccagtaccatcc

SEQ ID NO: 77103 - DNA, 75 bp, Artificial Sequence
  Synthetic
aaacccctccaccgccagcgattgcagatttactaaagtcagtggatagcgaagcagtgagagagtactgtaaag

SEQ ID NO: 77104 - DNA, 75 bp, Artificial Sequence
  Synthetic
tgcacgccatgtcaatgattccagcccaggtggcttgaccagtaccatccgcatttacttcaaaccaaaacatgt

SEQ ID NO: 77105 - DNA, 75 bp, Artificial Sequence
  Synthetic
tccaagcactaacaacctttgtctccgtggccggtatcatatacattatttacaaactatttgcaggattccagg

SEQ ID NO: 77106 - DNA, 75 bp, Artificial Sequence
  Synthetic
cgtcaccactgaacgtgcaaacttagttaccactggcccgtttggacaacaatctggagctgtgtatgtgggcaa

SEQ ID NO: 77107 - DNA, 75 bp, Artificial Sequence
  Synthetic
cgtggccggtatcatatacattatttacaaactatttgcaggattccagggcgcatatacaggaatgcccaatca

SEQ ID NO: 77108 - DNA, 75 bp, Artificial Sequence
  Synthetic
gttaccactggcccgtttggacaacaatctggagctgtgtatgtgggcaattacagaatcataaatagacaccta

SEQ ID NO: 77109 - DNA, 75 bp, Artificial Sequence
  Synthetic
aagaaactccagtacggtaaaaacagagtacggtgagtttaccatgctaggcatttacgatagatgggctgtcct

SEQ ID NO: 77110 - DNA, 75 bp, Artificial Sequence
  Synthetic
cacgggtgtgacattattgcacggtgccaatgcacatctggtgtttatttctgtgcgtccagaaacaagcactat

SEQ ID NO: 77111 - DNA, 75 bp, Artificial Sequence
  Synthetic
gagtacggtgagtttaccatgctaggcatttacgatagatgggctgtccttccgcgtcacgccaaacccggacca

SEQ ID NO: 77112 - DNA, 75 bp, Artificial Sequence
  Synthetic
gccaatgcacatctggtgtttatttctgtgcgtccagaaacaagcactatcccgtggttttcgaaggcccaggct

SEQ ID NO: 77113 - DNA, 75 bp, Artificial Sequence
  Synthetic
gaactaacactgctgaagctcaaccggaatgagaagtttagagacatcagaggtttcctagctaaagaggaagtg

SEQ ID NO: 77114 - DNA, 75 bp, Artificial Sequence
  Synthetic
agccaggagactgtggtggaatattgaggtgtgaacatggcgtcatcggcatagtgacaatgggtggtgagggcg

SEQ ID NO: 77115 - DNA, 75 bp, Artificial Sequence
  Synthetic
aggtttcctagctaaagaggaagtggaagttggcgaggccgttctggcaataaacaccagcaaattcccaaacat

SEQ ID NO: 77116 - DNA, 75 bp, Artificial Sequence
  Synthetic
gaggtgtgaacatggcgtcatcggcatagtgacaatgggtggtgagggcgtagtcggtttcgccgacgtgcgcga

SEQ ID NO: 77117 - DNA, 75 bp, Artificial Sequence
  Synthetic
gtctggcttcactaaccagatttgcgagcaagtcaacctccttaaggaatcgcttgtcgggcaagattccatcct

SEQ ID NO: 77118 - DNA, 75 bp, Artificial Sequence
  Synthetic
gagcaagtcaacctccttaaggaatcgcttgtcgggcaagattccatcctagagaagtcgctcaaagctctggtt

SEQ ID NO: 77119 - DNA, 75 bp, Artificial Sequence
  Synthetic
gtacaatttccccactagagcaggccaatgcggtggtgttctcatgtccactggcaaagtattgggaatacacgt

SEQ ID NO: 77120 - DNA, 75 bp, Artificial Sequence
  Synthetic
atttattgagaactcaagggatgcggggttcccagtcatcaacacaccaagcaaaacaaaattagaacccagcgt

SEQ ID NO: 77121 - DNA, 75 bp, Artificial Sequence
  Synthetic
attggttgcacctcgtccccatggcgatggctcaagcaaaaagtgtcacagtactatggaatccccatggctgag

SEQ ID NO: 77122 - DNA, 75 bp, Artificial Sequence
  Synthetic
gggttcccagtcatcaacacaccaagcaaaacaaaattagaacccagcgtcttccaccaggtatttgacggaaac

SEQ ID NO: 77123 - DNA, 75 bp, Artificial Sequence
  Synthetic
gatggctcaagcaaaaagtgtcacagtactatggaatccccatggctgagaggcaaaacaacagttggctgaaga

SEQ ID NO: 77124 - DNA, 75 bp, Artificial Sequence
  Synthetic
attggaaatgttaacacacatgtggatgagtacatgctagaggcagtggaccactatgcagggcaactggccacc

SEQ ID NO: 77125 - DNA, 75 bp, Artificial Sequence
  Synthetic
tgaaggtgaaaattttaccggaggtaaaggaaaagcatgagtttttaaatagactaaaacaactgcctctgttgg

SEQ ID NO: 77126 - DNA, 75 bp, Artificial Sequence
  Synthetic
agactaaaacaactgcctctgttggaaagccagattgccaccattgagcagagcgcaccctcacaaagcgatcag

SEQ ID NO: 77127 - DNA, 75 bp, Artificial Sequence
  Synthetic
cgaagggttagaggctctcgatttgacaacaagtgcggggtacccatacgtagcactaggcatcaagaagagaga

SEQ ID NO: 77128 - DNA, 75 bp, Artificial Sequence
  Synthetic
aaaagagtgttctccctagaaaagaaaatgagtaattacatacagttcaagtccaaatgccgtattgaacctgtc

SEQ ID NO: 77129 - DNA, 75 bp, Artificial Sequence
  Synthetic
aaatgagtaattacatacagttcaagtccaaatgccgtattgaacctgtctgtttattactacacggaagccctg

SEQ ID NO: 77130 - DNA, 75 bp, Artificial Sequence
  Synthetic
ggtgacatatgtgaaagatgaactcagatcagcagagaaggtggctgcggggaaatccaggcttattgaggcgtc

SEQ ID NO: 77131 - DNA, 75 bp, Artificial Sequence
  Synthetic
tgccgccggatcctgaccactttgatggttacaagcagcaggctgttgtgatcatggatgatctgtgtcaaaacc

SEQ ID NO: 77132 - DNA, 75 bp, Artificial Sequence
  Synthetic
tggttacaagcagcaggctgttgtgatcatggatgatctgtgtcaaaacccggacgggaaggacgtgtcactctt

SEQ ID NO: 77133 - DNA, 75 bp, Artificial Sequence
  Synthetic
ttgcttgcttgaaactactgcttgagaagcttgggtattcacacaaggagacgagttacatcgattacttatgca

SEQ ID NO: 77134 - DNA, 75 bp, Artificial Sequence
  Synthetic
gccctttgtcctcgcctccaccaatgcaggatccatcaatgctcctactgtgtcagacagcagggctctcgccag

SEQ ID NO: 77135 - DNA, 75 bp, Artificial Sequence
  Synthetic
gcaggatccatcaatgctcctactgtgtcagacagcagggctctcgccagaagattccattttgatatgaatatc

SEQ ID NO: 77136 - DNA, 75 bp, Artificial Sequence
  Synthetic
tcttcaattcaatgatcaacaacattataatcagaacactgatgctgaaggtgtacaaaggtatcgacttggacc

SEQ ID NO: 77137 - DNA, 75 bp, Artificial Sequence
  Synthetic
tgtccagtcaattttaaaaagtgctgtccgttggtgtgtggtaaggcaattcagtttattgatagaaaaactcaa

SEQ ID NO: 77138 - DNA, 75 bp, Artificial Sequence
  Synthetic
gtgtacaaaggtatcgacttggaccaattcagaatgattgcatatggtgatgatgtaattgcctcatacccgtgg

SEQ ID NO: 77139 - DNA, 75 bp, Artificial Sequence
  Synthetic
gtccgttggtgtgtggtaaggcaattcagtttattgatagaaaaactcaagtgaggtactcactagacatgcttg

SEQ ID NO: 77140 - DNA, 75 bp, Artificial Sequence
  Synthetic
tgctttaatgaggtgacttggaccaacgttaccttcctgaagagatattttagagcagatgagcaataccctttc

SEQ ID NO: 77141 - DNA, 75 bp, Artificial Sequence
  Synthetic
ctgtgtatagagagataaagatcagtgtgacaccggaaactccccccccaccagcaatagcagatctactgaagt

SEQ ID NO: 77142 - DNA, 75 bp, Artificial Sequence
  Synthetic
tgtgacaccggaaactccccccccaccagcaatagcagatctactgaagtctgtagacagtgaagtggtcagaga

SEQ ID NO: 77143 - DNA, 75 bp, Artificial Sequence
  Synthetic
aggacatccatgagtccatcagatggacaaaagatccaaagaacactcaggatcacgtgcgatccctgtgcctac

SEQ ID NO: 77144 - DNA, 75 bp, Artificial Sequence
  Synthetic
cttcatttgcctgcaagcgctaactacgtttgtctccgtggcgggggtaatttacattatatacaaattgtttgc

SEQ ID NO: 77145 - DNA, 75 bp, Artificial Sequence
  Synthetic
acgtttgtctccgtggcgggggtaatttacattatatacaaattgtttgctggcttccagggggcctacactggc

SEQ ID NO: 77146 - DNA, 75 bp, Artificial Sequence
  Synthetic
tgaccttacctgcattctcaaccctgcgcaggaaatggctggactctttctaaattagagacaatttaacacgat

SEQ ID NO: 77147 - DNA, 75 bp, Artificial Sequence
  Synthetic
gcgcaggaaatggctggactctttctaaattagagacaatttaacacgatttgaattggcttaaccctaccgcac

SEQ ID NO: 77148 - DNA, 75 bp, Artificial Sequence
  Synthetic
gcaatgatgaagagaaatgccagtactgtgaaaaccgagtacggcgagttcacaatgcttggaatctatgacaga

SEQ ID NO: 77149 - DNA, 75 bp, Artificial Sequence
  Synthetic
ctgtgaaaaccgagtacggcgagttcacaatgcttggaatctatgacagatgggcagtgctaccccgtcacgcca

SEQ ID NO: 77150 - DNA, 75 bp, Artificial Sequence
  Synthetic
tagacaggatttcactcaagatccagggaagttcacagaacccgtgaaggacattatgattaaatcgatgcctgc

SEQ ID NO: 77151 - DNA, 75 bp, Artificial Sequence
  Synthetic
gggaagttcacagaacccgtgaaggacattatgattaaatcgatgcctgctctcaattctccgtcagcagaggag

SEQ ID NO: 77152 - DNA, 75 bp, Artificial Sequence
  Synthetic
gcactaatctggagctgacgcttttaaagctcaacagaaatgaaaagttcagggacattcgaggcttcctggcaa

SEQ ID NO: 77153 - DNA, 75 bp, Artificial Sequence
  Synthetic
aaagctcaacagaaatgaaaagttcagggacattcgaggcttcctggcaagggaagaggctgaggtcaatgaggc

SEQ ID NO: 77154 - DNA, 75 bp, Artificial Sequence
  Synthetic
gttgtaggatatggagtgtggcctacctatttaaaggatgatgaagcaacagcagaagaccaacccactcaacca

SEQ ID NO: 77155 - DNA, 75 bp, Artificial Sequence
  Synthetic
caatttaggtggaacccccactaagcgcatgctaatgtacaacttccccacacgcgcgggacagtgtggtggtgt

SEQ ID NO: 77156 - DNA, 75 bp, Artificial Sequence
  Synthetic
cgcatgctaatgtacaacttccccacacgcgcgggacagtgtggtggtgtcctaatgtcaaccggtaaagtcctt

SEQ ID NO: 77157 - DNA, 75 bp, Artificial Sequence
  Synthetic
ggagaaattgaattcatcgagagctccaaggatgcaggcttcccggtcatcaatactcccagcaaaacgaagctt

SEQ ID NO: 77158 - DNA, 75 bp, Artificial Sequence
  Synthetic
ccaaggatgcaggcttcccggtcatcaatactcccagcaaaacgaagcttgagcctagcgtgttccatcacgtct

SEQ ID NO: 77159 - DNA, 75 bp, Artificial Sequence
  Synthetic
tttcaaagtatattggcaacgtcaacactcatgtggatgagtacatgctggaagccgttgaccactacgcaggac

SEQ ID NO: 77160 - DNA, 75 bp, Artificial Sequence
  Synthetic
cactcatgtggatgagtacatgctggaagccgttgaccactacgcaggacagctggcaaccctagatatcagcac

SEQ ID NO: 77161 - DNA, 75 bp, Artificial Sequence
  Synthetic
gtatccttatgtcgcccttggcatcaagaagagagacattttatccaagaagaccaaggatgtaacgaagcttaa

SEQ ID NO: 77162 - DNA, 75 bp, Artificial Sequence
  Synthetic
aagaagagagacattttatccaagaagaccaaggatgtaacgaagcttaaagagtgcatggataagtatggactg

SEQ ID NO: 77163 - DNA, 75 bp, Artificial Sequence
  Synthetic
gtttctcacatccgatgatttccaatctccttcagctatgccacagtttgacgttacccctgaaatggatatccc

SEQ ID NO: 77164 - DNA, 75 bp, Artificial Sequence
  Synthetic
tctccttcagctatgccacagtttgacgttacccctgaaatggatatcccaggacaggttaacaacttgatggaa

SEQ ID NO: 77165 - DNA, 75 bp, Artificial Sequence
  Synthetic
attgaagcatcgagcctaaacgactcagtggccatgagacagacatttggaaacctgtataaaactttccacctg

SEQ ID NO: 77166 - DNA, 75 bp, Artificial Sequence
  Synthetic
cagtggccatgagacagacatttggaaacctgtataaaactttccacctgaatccgggcatagtgacaggcagtg

SEQ ID NO: 77167 - DNA, 75 bp, Artificial Sequence
  Synthetic
cctgttcaatcgaactcaacaaatggttcccaggtctttggatttccactgatgccaggagctagtagtgtattg

SEQ ID NO: 77168 - DNA, 75 bp, Artificial Sequence
  Synthetic
atagtggttatgatgccagtttaagtccggtgtggttcgcatgtctgaagttgttgctggagaagttgggatatt

SEQ ID NO: 77169 - DNA, 75 bp, Artificial Sequence
  Synthetic
tccggtgtggttcgcatgtctgaagttgttgctggagaagttgggatattcacacagagaaactaactacataga

SEQ ID NO: 77170 - DNA, 75 bp, Artificial Sequence
  Synthetic
aaggaggcaatgttgggcactcatgtgatctgggacgtggggttacaatcaagctgcgtgctgtgcattccatgg

SEQ ID NO: 77171 - DNA, 75 bp, Artificial Sequence
  Synthetic
gggaactagcattttcaactcgatgatcaacaacattatcattagaacactaatgctgaaggtgtataaggggat

SEQ ID NO: 77172 - DNA, 75 bp, Artificial Sequence
  Synthetic
agacctggatcagtttaggatgatagcatatggtgatgatgtcatcgcgtcatatccgcatcctattgacgccgc

SEQ ID NO: 77173 - DNA, 75 bp, Artificial Sequence
  Synthetic
gacatggaccaacgtcactttcctgaaaagatacttcagagcagatgagcaataccccttccttgtccatcctgt

SEQ ID NO: 77174 - DNA, 75 bp, Artificial Sequence
  Synthetic
cttgtgcttattggcctggcacaatggagagcaaaaatatgaggagtttgtgtctaaaatcagaagcgtcccagt

SEQ ID NO: 77175 - DNA, 75 bp, Artificial Sequence
  Synthetic
tgtctaaaatcagaagcgtcccagttgggcgctgtttgaccctacctgcgttttcaactttacgcaggaaatggc

SEQ ID NO: 77176 - DNA, 75 bp, Artificial Sequence
  Synthetic
ttaaaaccaggctgtgggttgttcccacccacagggcccactgggcgctagcacactggtattgcggtacctttg

SEQ ID NO: 77177 - DNA, 75 bp, Artificial Sequence
  Synthetic
ttgagctgacctttgtgatcacgagcactcaagagcagtccactatacaaggccaggattcaccagtgctcacgc

SEQ ID NO: 77178 - DNA, 75 bp, Artificial Sequence
  Synthetic
tgagtcaccgcattccccacgggcgaccgtggcggtggctgcgttggcggcctgcccatggggtaacccatggga

SEQ ID NO: 77179 - DNA, 75 bp, Artificial Sequence
  Synthetic
attggattggccatccagtgacaaacagagcgattgtttatctatttgttggtttcataccattaaattttaaag

SEQ ID NO: 77180 - DNA, 75 bp, Artificial Sequence
  Synthetic
cagagcgattgtttatctatttgttggtttcataccattaaattttaaagtcttaaaaactattaacttgatcat

SEQ ID NO: 77181 - DNA, 75 bp, Artificial Sequence
  Synthetic
cctgggtaattcaaccatcactacgcaggaaggtgcaaatgtagtagttggttatggcgtctggccggagtattt

SEQ ID NO: 77182 - DNA, 75 bp, Artificial Sequence
  Synthetic
ttggtcaagattccatcctggagaagtcccttaaagccctggtcaaaattatttcagcactagtgattgtggtga

SEQ ID NO: 77183 - DNA, 75 bp, Artificial Sequence
  Synthetic
cacgccagcacatttggatccatgaactccaatgaagctggggccgtccaaaatgtggtgcacaatgccggaatg

SEQ ID NO: 77184 - DNA, 75 bp, Artificial Sequence
  Synthetic
gaagcatgaattcttgaccaggcttaagcaactcccacttttggaaagccaaattgccaccattgagcaaagtgc

SEQ ID NO: 77185 - DNA, 75 bp, Artificial Sequence
  Synthetic
tcactttgatatgaacatagaagtgatatccatgtacagccaaaatggtaagatcaacatgcccatgtcagtcaa

SEQ ID NO: 77186 - DNA, 75 bp, Artificial Sequence
  Synthetic
agatgtttagggaatacaatcacagacacagcgtaggggcaaccctggaagccttgttccaaggaccaccagtgt

SEQ ID NO: 77187 - DNA, 75 bp, Artificial Sequence
  Synthetic
agcaagtggcccaatgaattccgagagagtcccagcattaacagccgtcgagacgggtcacacatctcaagttgt

SEQ ID NO: 77188 - DNA, 75 bp, Artificial Sequence
  Synthetic
ccccagtgataccatgcaaaccaggcatgttgtcaatcatcacattagatcggaatcatcaatagagaatttcct

SEQ ID NO: 77189 - DNA, 75 bp, Artificial Sequence
  Synthetic
taagacaggctaaggtgcaaggtcccgcttttgaatttgccgtagcaatgatgaagagaaattccagcacggtaa

SEQ ID NO: 77190 - DNA, 75 bp, Artificial Sequence
  Synthetic
cagacaccccagtgctcacacatcaggtgatgtatgtgccacccggaggccccatacctgcatcatacgaagatt

SEQ ID NO: 77191 - DNA, 75 bp, Artificial Sequence
  Synthetic
caaccggaatgaaaagtttagagacattagaggctttctggctaaagaagaagtggaggtcagcgaggctgtcct

SEQ ID NO: 77192 - DNA, 75 bp, Artificial Sequence
  Synthetic
acgtgccttcaatggtaagccatggtgctttcggtcagcaatctggtgccatttacgtgggtaactacagagtgg

SEQ ID NO: 77193 - DNA, 75 bp, Artificial Sequence
  Synthetic
tgctttcggtcagcaatctggtgccatttacgtgggtaactacagagtggtgaataggcacctggccacgcaaac

SEQ ID NO: 77194 - DNA, 75 bp, Artificial Sequence
  Synthetic
caccatcgccaggtgtcaatgctgcacgggtgtctacttttgtgcttcgaggaacaggcactacccagtcagctt

SEQ ID NO: 77195 - DNA, 75 bp, Artificial Sequence
  Synthetic
acgggtgtctacttttgtgcttcgaggaacaggcactacccagtcagcttcgaaggaccaggcttagtggaagtt

SEQ ID NO: 77196 - DNA, 75 bp, Artificial Sequence
  Synthetic
ccaccctcgacatcaacactgaaccaatgaaactggaggaagctgtgtatggtaccgaagggttagaggccctcg

SEQ ID NO: 77197 - DNA, 75 bp, Artificial Sequence
  Synthetic
tgtggtggaattcttagatgtgagcatggtgtcatcgggctagtcaccatgggtggcgaaggcgtggtcggcttt

SEQ ID NO: 77198 - DNA, 75 bp, Artificial Sequence
  Synthetic
agagacattttatccaagaagaccaaagatctaaccaaattgaaggagtgtatggacaagtatggattaaattta

SEQ ID NO: 77199 - DNA, 75 bp, Artificial Sequence
  Synthetic
ggtcagagattatgtagaacagctgggcaatgccttcggttccgggttcaccaatcaaatctgcgaacaagtcaa

SEQ ID NO: 77200 - DNA, 75 bp, Artificial Sequence
  Synthetic
catgatgacttaataacagtgactgctaccctcgcccttattggctgcacttcatcgccatggcggtggctcaag

SEQ ID NO: 77201 - DNA, 75 bp, Artificial Sequence
  Synthetic
catctcatagcctttgattactccggatatgatgctagcctgagtcccgtgtggttcgcttgtctgaaaatgcta

SEQ ID NO: 77202 - DNA, 75 bp, Artificial Sequence
  Synthetic
atgaccaacgcctgcaaagggatggagtggattgccgtcaaaatccaaaagtttatagagtggctcaagaacaaa

SEQ ID NO: 77203 - DNA, 75 bp, Artificial Sequence
  Synthetic
agtggattgccgtcaaaatccaaaagtttatagagtggctcaagaacaaaatcttaccagaggtgaaggagagac

SEQ ID NO: 77204 - DNA, 75 bp, Artificial Sequence
  Synthetic
tgtcgagtgtagactttgtcccaccaatggctgcactagaggagaagggtatcctattcacatcccctttcgtgc

SEQ ID NO: 77205 - DNA, 75 bp, Artificial Sequence
  Synthetic
cacgagtatgaggaattcataaagaagatcagaagtgtcccagtgggacgctgtctggccttacctgcgttttcg

SEQ ID NO: 77206 - DNA, 75 bp, Artificial Sequence
  Synthetic
acccacagggcccactgggcgccagcactctggtatcgcggtacctttgtgcgcctgttttgtttccctttaccc

SEQ ID NO: 77207 - DNA, 75 bp, Artificial Sequence
  Synthetic
gtgacgaagaatgctgcccagttaacttcaagaggtgctgtcctcttgtgtgtgggaaggctatccagttcattg

SEQ ID NO: 77208 - DNA, 75 bp, Artificial Sequence
  Synthetic
gtttccccggaccgagtatcaatagactgcttgcgcggttgaaggagaaaacgttcgttatccggctaactactt

SEQ ID NO: 77209 - DNA, 75 bp, Artificial Sequence
  Synthetic
actgcttgcgcggttgaaggagaaaacgttcgttatccggctaactacttcgagaaacccagtaacaccatgaag

SEQ ID NO: 77210 - DNA, 75 bp, Artificial Sequence
  Synthetic
gttccaaggcccgccagtgtacagggagatcaagattagtgtagcacctgaaaccccgccaccaccagcgattgc

SEQ ID NO: 77211 - DNA, 75 bp, Artificial Sequence
  Synthetic
tggcggtggctgcgttggcggcctgcctatggggtaacccataggacgctctaatacggacatggtgcgaagagt

SEQ ID NO: 77212 - DNA, 75 bp, Artificial Sequence
  Synthetic
caactccacccttcagattgagaagcatgtcagcagagctttcatatgccttcaagcactaacaacttttgtttc

SEQ ID NO: 77213 - DNA, 75 bp, Artificial Sequence
  Synthetic
catgtcagcagagctttcatatgccttcaagcactaacaacttttgtttctgtggccggaataatatacatcatt

SEQ ID NO: 77214 - DNA, 75 bp, Artificial Sequence
  Synthetic
tccgcagcggaaccgactactttgggtgtccgtgtttccttttattcttacattggctgcttatggtgacaattg

SEQ ID NO: 77215 - DNA, 75 bp, Artificial Sequence
  Synthetic
cattggctgcttatggtgacaattgagagattgttgccatatagctattggattggccatccggtgtctaataga

SEQ ID NO: 77216 - DNA, 75 bp, Artificial Sequence
  Synthetic
agagattgttgccatatagctattggattggccatccggtgtctaatagagcgataatctaccagtttgttggat

SEQ ID NO: 77217 - DNA, 75 bp, Artificial Sequence
  Synthetic
caagccaaggtgcaaggccctgcttttgaatttgccgtagccatgatgaaaagaaactccagcacggtgaaaaca

SEQ ID NO: 77218 - DNA, 75 bp, Artificial Sequence
  Synthetic
ttgaatttgccgtagccatgatgaaaagaaactccagcacggtgaaaacagaatatggcgagttcactatgctag

SEQ ID NO: 77219 - DNA, 75 bp, Artificial Sequence
  Synthetic
agtgtccacgcagaagactggagcacacgaagccagcctgagcgctacaggaagttccataattcactacacaaa

SEQ ID NO: 77220 - DNA, 75 bp, Artificial Sequence
  Synthetic
cacgaagccagcctgagcgctacaggaagttccataattcactacacaaacatcaattattataaggattccgca

SEQ ID NO: 77221 - DNA, 75 bp, Artificial Sequence
  Synthetic
tcggtgtgttagatgcaaaagagctggtagataaggatggcacgaaccttgagctgacattgctgaagctcaatc

SEQ ID NO: 77222 - DNA, 75 bp, Artificial Sequence
  Synthetic
aaatccctacccgcgctaaactcgccctcagctgaggagtgcggattcagtgatagagttaggtcaatcaccatc

SEQ ID NO: 77223 - DNA, 75 bp, Artificial Sequence
  Synthetic
aggcttcttagctaaagaagaagtagaggttaatgaggctgtcctggcaataaacaccagcaagtttccgaacat

SEQ ID NO: 77224 - DNA, 75 bp, Artificial Sequence
  Synthetic
cctcagctgaggagtgcggattcagtgatagagttaggtcaatcaccatcgggaattctacgataaccacgcagg

SEQ ID NO: 77225 - DNA, 75 bp, Artificial Sequence
  Synthetic
aacccacacaaccggatgttgcaacatgcaggttttacaccctggagtcggttcagtggcaggagaactcggctg

SEQ ID NO: 77226 - DNA, 75 bp, Artificial Sequence
  Synthetic
atgcaggttttacaccctggagtcggttcagtggcaggagaactcggctggttggtggtggaagtttcctgacgc

SEQ ID NO: 77227 - DNA, 75 bp, Artificial Sequence
  Synthetic
caatgtggtggcgttctcatgtccacaggcaaagtgttagggatacatgtcggcgggaacggccaccaaggcttc

SEQ ID NO: 77228 - DNA, 75 bp, Artificial Sequence
  Synthetic
ggatttccaatcattaatacgccaagtaaaacgaaattggaaccaagcgtcttccaccaagtgtttgaaggtacc

SEQ ID NO: 77229 - DNA, 75 bp, Artificial Sequence
  Synthetic
acaatgcaatgcatccaaattccaccaagggtgtttgctggttgtatgcgtccctgaagcggagatgggatgctc

SEQ ID NO: 77230 - DNA, 75 bp, Artificial Sequence
  Synthetic
caagggtgtttgctggttgtatgcgtccctgaagcggagatgggatgctccaaagtggacggtgtagtgaatgca

SEQ ID NO: 77231 - DNA, 75 bp, Artificial Sequence
  Synthetic
gtaaaacgaaattggaaccaagcgtcttccaccaagtgtttgaaggtaccaaggagcctgcagtcctcaggaatg

SEQ ID NO: 77232 - DNA, 75 bp, Artificial Sequence
  Synthetic
atgaatacatgatggaagcagtggaccactatgcagggcaactggccacattggacatcagtacggaacctatga

SEQ ID NO: 77233 - DNA, 75 bp, Artificial Sequence
  Synthetic
aaagcagtgtacaacgcagggatgggaattggtgttggaaacttaacgatcttcccccaccagtggattaaccta

SEQ ID NO: 77234 - DNA, 75 bp, Artificial Sequence
  Synthetic
gaattggtgttggaaacttaacgatcttcccccaccagtggattaacctacgcaccaacaatagtgcaactatag

SEQ ID NO: 77235 - DNA, 75 bp, Artificial Sequence
  Synthetic
ccactatgcagggcaactggccacattggacatcagtacggaacctatgaagctggaagatgctgtgtatggcac

SEQ ID NO: 77236 - DNA, 75 bp, Artificial Sequence
  Synthetic
catactgtccaagaagaccaaggacttgactaagctgaaggagtgtatggacaagtatgggttgaatctgccaat

SEQ ID NO: 77237 - DNA, 75 bp, Artificial Sequence
  Synthetic
ttgcaccactgaagagtagcggcggtacaaactacgtaccagtcacgatcaccgtcgcacctatggatgccgaat

SEQ ID NO: 77238 - DNA, 75 bp, Artificial Sequence
  Synthetic
tacaaactacgtaccagtcacgatcaccgtcgcacctatggatgccgaatataatgggctacggctagcaggaca

SEQ ID NO: 77239 - DNA, 75 bp, Artificial Sequence
  Synthetic
ttgactaagctgaaggagtgtatggacaagtatgggttgaatctgccaatggtgacctacgtgaaggatgagctc

SEQ ID NO: 77240 - DNA, 75 bp, Artificial Sequence
  Synthetic
aggcaaacgtttggcaacctatataaaacattccatctaaacccagggattgtgaccggcagtgcagttgggtgt

SEQ ID NO: 77241 - DNA, 75 bp, Artificial Sequence
  Synthetic
tatgcctgagtttgatgtcactccttgcatggatatcccagggaaggttcacaacttaatggagatagcagaagt

SEQ ID NO: 77242 - DNA, 75 bp, Artificial Sequence
  Synthetic
tgcatggatatcccagggaaggttcacaacttaatggagatagcagaagttgacatcggcgtgccggtcaacaac

SEQ ID NO: 77243 - DNA, 75 bp, Artificial Sequence
  Synthetic
aaacattccatctaaacccagggattgtgaccggcagtgcagttgggtgtgatcccgatctcttttggagcaaaa

SEQ ID NO: 77244 - DNA, 75 bp, Artificial Sequence
  Synthetic
tcgcttgtctgaagctattgcttgggaagcttgggtattcacataaagagacaaattatatcgactacttgtgca

SEQ ID NO: 77245 - DNA, 75 bp, Artificial Sequence
  Synthetic
atcttctcatttcaattaaacccaggtaatagcactgtcttgcgacgcaccttgctgggtgagatcctaaactat

SEQ ID NO: 77246 - DNA, 75 bp, Artificial Sequence
  Synthetic
gtaatagcactgtcttgcgacgcaccttgctgggtgagatcctaaactattacgcacactggtcaggcagtatta

SEQ ID NO: 77247 - DNA, 75 bp, Artificial Sequence
  Synthetic
gaagcttgggtattcacataaagagacaaattatatcgactacttgtgcaactcccatcacttgtacagggataa

SEQ ID NO: 77248 - DNA, 75 bp, Artificial Sequence
  Synthetic
cattatcagaacactaatgctcaaagtgtacaagggcattgacttggatcaattcaggatgattgcatacggtga

SEQ ID NO: 77249 - DNA, 75 bp, Artificial Sequence
  Synthetic
cagttcccaaggcacgcagggatgctatgcttggtacccatgtgatttgggatgtgggattgcaatcaagttgtg

SEQ ID NO: 77250 - DNA, 75 bp, Artificial Sequence
  Synthetic
tatgcttggtacccatgtgatttgggatgtgggattgcaatcaagttgtgtattgtgcgtcccttggattagtca

SEQ ID NO: 77251 - DNA, 75 bp, Artificial Sequence
  Synthetic
gtgtacaagggcattgacttggatcaattcaggatgattgcatacggtgatgacgtaattgcctcatacccgtgg

SEQ ID NO: 77252 - DNA, 75 bp, Artificial Sequence
  Synthetic
agtggtaccacctgaaacaccatctgactgtgtcgtgctgtgctttgtgtctgcctgcaatgatttctctgtacg

SEQ ID NO: 77253 - DNA, 75 bp, Artificial Sequence
  Synthetic
gactgtgtcgtgctgtgctttgtgtctgcctgcaatgatttctctgtacggatgcttaaggataccccctttata

SEQ ID NO: 77254 - DNA, 75 bp, Artificial Sequence
  Synthetic
acgttacctttctgaagaggtattttagagcagatgagcaataccctttcctggttcatccagttatgcccatga

SEQ ID NO: 77255 - DNA, 75 bp, Artificial Sequence
  Synthetic
tggcttggcacaatggggagcacgagtatgaggagttcatccgcaagattaggagcgtcccggttgggcgttgtt

SEQ ID NO: 77256 - DNA, 75 bp, Artificial Sequence
  Synthetic
cgcagtggaccttccaactctgaggcagtgccagctctcacagctgccgagaccggacacacctcacaggtggtc

SEQ ID NO: 77257 - DNA, 75 bp, Artificial Sequence
  Synthetic
cagtgccagctctcacagctgccgagaccggacacacctcacaggtggtccctagcgacactatgcaaacgaggc

SEQ ID NO: 77258 - DNA, 75 bp, Artificial Sequence
  Synthetic
taaattagagacaatttagtacaactttaaattggcttaaccctaccgcgcttaccgaactagataacggcacgg

SEQ ID NO: 77259 - DNA, 75 bp, Artificial Sequence
  Synthetic
caaagtatgaggcaaggggcaacctgaaagcactgacgcttgacgcatgggagataagcgtgcgcgacatggtac

SEQ ID NO: 77260 - DNA, 75 bp, Artificial Sequence
  Synthetic
gaaagcactgacgcttgacgcatgggagataagcgtgcgcgacatggtacaactgcgacgcaagtgcgagatgtt

SEQ ID NO: 77261 - DNA, 75 bp, Artificial Sequence
  Synthetic
gatatgcccctatgacgcccaccagataatgtacatcccgcctggtggtcctatcccaaagaaggtggatggtta

SEQ ID NO: 77262 - DNA, 75 bp, Artificial Sequence
  Synthetic
ataatgtacatcccgcctggtggtcctatcccaaagaaggtggatggttacgagtggcaaacatcaaccaatcca

SEQ ID NO: 77263 - DNA, 75 bp, Artificial Sequence
  Synthetic
agtttctacgatggttggtcacactttgacagcaagggagcttatggattcaacaccctaaataaaatgggacac

SEQ ID NO: 77264 - DNA, 75 bp, Artificial Sequence
  Synthetic
ttgacagcaagggagcttatggattcaacaccctaaataaaatgggacacatctattgcaggcatgttaacaaag

SEQ ID NO: 77265 - DNA, 75 bp, Artificial Sequence
  Synthetic
cgccacgactgtgtcaatacatgaacaaggccaatgtgaactttgaagccaccgcagtcacagacacccgtgata

SEQ ID NO: 77266 - DNA, 75 bp, Artificial Sequence
  Synthetic
caaggccaatgtgaactttgaagccaccgcagtcacagacacccgtgataccatcaatacagtcccgctgtcaac

SEQ ID NO: 77267 - DNA, 75 bp, Artificial Sequence
  Synthetic
gcacttggctacacacacggactggcaaaagtgcgtgtgggaagactacaacagggacctgctggtcagcaccac

SEQ ID NO: 77268 - DNA, 75 bp, Artificial Sequence
  Synthetic
caaaagtgcgtgtgggaagactacaacagggacctgctggtcagcaccactacagctcatgggtgtgacaccatt

SEQ ID NO: 77269 - DNA, 75 bp, Artificial Sequence
  Synthetic
ccaggattggtggaggttcaagcaagtgagtactatccaaaaaggtatcaatcccacgtgttacttgctgcagga

SEQ ID NO: 77270 - DNA, 75 bp, Artificial Sequence
  Synthetic
gtgagtactatccaaaaaggtatcaatcccacgtgttacttgctgcaggattctctgaaccgggcgattgtggtg

SEQ ID NO: 77271 - DNA, 75 bp, Artificial Sequence
  Synthetic
gcacactggtatcacggtacctttgtgcgcctgttttatcttcccttccccaatgcaacttagaagcataaattg

SEQ ID NO: 77272 - DNA, 75 bp, Artificial Sequence
  Synthetic
tgcgcctgttttatcttcccttccccaatgcaacttagaagcataaattgaacggtcaataggtagcccagtgcg

SEQ ID NO: 77273 - DNA, 75 bp, Artificial Sequence
  Synthetic
ttaaaacaggcctgtgggttgttcccacccacagggcctactgggcgccagcacactggtatcacggtacctttg

SEQ ID NO: 77274 - DNA, 75 bp, Artificial Sequence
  Synthetic
tacgtgatttgttgtggttggaagacgatgcaatggagcaaggggttaaggattatgtggaacaacttggaaacg

SEQ ID NO: 77275 - DNA, 75 bp, Artificial Sequence
  Synthetic
cgatgcaatggagcaaggggttaaggattatgtggaacaacttggaaacgccttcggctcaggattcaccaacca

SEQ ID NO: 77276 - DNA, 75 bp, Artificial Sequence
  Synthetic
cctagtaaaaataatttcagccctggtgattgtggtgagaaaccatgatgatttaatcacagtgaccgccgttct

SEQ ID NO: 77277 - DNA, 75 bp, Artificial Sequence
  Synthetic
gtgattgtggtgagaaaccatgatgatttaatcacagtgaccgccgttcttgctctcatcggctgcaccacgtcc

SEQ ID NO: 77278 - DNA, 75 bp, Artificial Sequence
  Synthetic
aactctgcagcggaaccgactactttgggtgtccgtgtttccttttattcttacattggctgcttatggtgacaa

SEQ ID NO: 77279 - DNA, 75 bp, Artificial Sequence
  Synthetic
ctcaagaagtttaccgagatgacaaacgcctgtaagggcatggaatggatagccattaaaattcagaaattcata

SEQ ID NO: 77280 - DNA, 75 bp, Artificial Sequence
  Synthetic
cttgaatagactcaaacaactcccattattagagagtcaaattgccacgattgaacagagcgcaccatctcaggg

SEQ ID NO: 77281 - DNA, 75 bp, Artificial Sequence
  Synthetic
tcaagtatcaacacagaagaccggcgctcatgaaaccgagctgaatgctagtggaaactccatcattcactacac

SEQ ID NO: 77282 - DNA, 75 bp, Artificial Sequence
  Synthetic
gctcatgaaaccgagctgaatgctagtggaaactccatcattcactacacgaatatcaattattataaggacgcc

SEQ ID NO: 77283 - DNA, 75 bp, Artificial Sequence
  Synthetic
agaggcaaagagagtgttctcccttgagaagaagatgagcaattacatacagttcaagtccaaatgccgtattga

SEQ ID NO: 77284 - DNA, 75 bp, Artificial Sequence
  Synthetic
gtgaagtctttaccagctttgaattcgccctcggccgaagaatgtggatatagtgacagagttagatccatcacg

SEQ ID NO: 77285 - DNA, 75 bp, Artificial Sequence
  Synthetic
cgacaaacctgatcggaagatcacttgctgaaaagcttaacagctcagtgtattcactacccccagatccagatc

SEQ ID NO: 77286 - DNA, 75 bp, Artificial Sequence
  Synthetic
cgccctcggccgaagaatgtggatatagtgacagagttagatccatcacgttagggaattcaacgattacaacgc

SEQ ID NO: 77287 - DNA, 75 bp, Artificial Sequence
  Synthetic
ccttattctgtcagatggtttccagtgtggattttgtaccacccatggccgccctggaagagaaaggcattttgt

SEQ ID NO: 77288 - DNA, 75 bp, Artificial Sequence
  Synthetic
atcaaccaagcgagccagatgtgttgacatgtcggttctatacattagagtcagtgtcatggatgacggagtctc

SEQ ID NO: 77289 - DNA, 75 bp, Artificial Sequence
  Synthetic
gacatgtcggttctatacattagagtcagtgtcatggatgacggagtctcagggcaggtggtggaagttcactga

SEQ ID NO: 77290 - DNA, 75 bp, Artificial Sequence
  Synthetic
aaccaatgcagggtctattaatgctccaactgtgtcagatagcagggccttagcaaggagattccactttgacat

SEQ ID NO: 77291 - DNA, 75 bp, Artificial Sequence
  Synthetic
ccaactgtgtcagatagcagggccttagcaaggagattccactttgacatgaacattgaagttatttccatgtac

SEQ ID NO: 77292 - DNA, 75 bp, Artificial Sequence
  Synthetic
tgtgcagggcaatgcgtccaagtttcaccaggggtgcctttcagttgtgtgtgtgccagatgcagagatgggcgc

SEQ ID NO: 77293 - DNA, 75 bp, Artificial Sequence
  Synthetic
caccaggggtgcctttcagttgtgtgtgtgccagatgcagagatgggcgcagctaaaataaaccaaaagataaac

SEQ ID NO: 77294 - DNA, 75 bp, Artificial Sequence
  Synthetic
aagtgttgcccactagtgtgtggaaaagctatccagttcatagacagaagaacccaagtcagatactcccttgac

SEQ ID NO: 77295 - DNA, 75 bp, Artificial Sequence
  Synthetic
caagcagtgcccaacgcttgcatgggtgtggcggttgggaacttgaccatttttccacaccagtggattaacttg

SEQ ID NO: 77296 - DNA, 75 bp, Artificial Sequence
  Synthetic
gtgtggcggttgggaacttgaccatttttccacaccagtggattaacttgcgcacaaataactgcgccactattg

SEQ ID NO: 77297 - DNA, 75 bp, Artificial Sequence
  Synthetic
ttgccaaactaaactacgcagctggttcatcgacctacatacccatcactgtcacagtggaaagtatgtgcgcgg

SEQ ID NO: 77298 - DNA, 75 bp, Artificial Sequence
  Synthetic
ttcatcgacctacatacccatcactgtcacagtggaaagtatgtgcgcggagtacaatgggttgaggctggcagg

SEQ ID NO: 77299 - DNA, 75 bp, Artificial Sequence
  Synthetic
tgccaagtcacaatttgaggtcacacgtgagatgcacataccgggcgaggtgagaaatttaatggaaatagctga

SEQ ID NO: 77300 - DNA, 75 bp, Artificial Sequence
  Synthetic
cgtgagatgcacataccgggcgaggtgagaaatttaatggaaatagctgaagtagatttggtggtgccagtcaac

SEQ ID NO: 77301 - DNA, 75 bp, Artificial Sequence
  Synthetic
tgccgttgcaatgatgaagaggaactcaagcacagtgaagactgagtatggtgagttcaccatgttaggcattta

SEQ ID NO: 77302 - DNA, 75 bp, Artificial Sequence
  Synthetic
tcaagcacagtgaagactgagtatggtgagttcaccatgttaggcatttatgataggtgggctgttttgccacgc

SEQ ID NO: 77303 - DNA, 75 bp, Artificial Sequence
  Synthetic
gtatttgggttcaccttgcaaccgggagcagacactgtgatggaaagaacactcctgggggagatcttgaattac

SEQ ID NO: 77304 - DNA, 75 bp, Artificial Sequence
  Synthetic
catgccaagcctggaccaaccatcctgatgaatgaccaggaagtgggcgtgttggacgccaaagaattagtggat

SEQ ID NO: 77305 - DNA, 75 bp, Artificial Sequence
  Synthetic
gagcagacactgtgatggaaagaacactcctgggggagatcttgaattactatgctaattggtctggcagcataa

SEQ ID NO: 77306 - DNA, 75 bp, Artificial Sequence
  Synthetic
gagtgcccaagaatcgcaaggaagcaatgctgggcacacacatcatctgggatattggtttgcaatccagctgcg

SEQ ID NO: 77307 - DNA, 75 bp, Artificial Sequence
  Synthetic
aatgctgggcacacacatcatctgggatattggtttgcaatccagctgcgtgctgtgtgtgccttggatcagcca

SEQ ID NO: 77308 - DNA, 75 bp, Artificial Sequence
  Synthetic
cactaagagaatgctcatgtacaacttccccacaagagcaggtcagtgtggtggagtgctcatgtccactggcaa

SEQ ID NO: 77309 - DNA, 75 bp, Artificial Sequence
  Synthetic
tgtggtgcccgcggaggtgcagaaccagagtatcatactgtgcttcgtttcggcgtgtaacgacttctctgtgcg

SEQ ID NO: 77310 - DNA, 75 bp, Artificial Sequence
  Synthetic
aatggtcatcaaggcttttcagcagcactccttaagcactacttcaatgatgaacaaggagaaatcgagttcatc

SEQ ID NO: 77311 - DNA, 75 bp, Artificial Sequence
  Synthetic
cagagtatcatactgtgcttcgtttcggcgtgtaacgacttctctgtgcgcctattacgtgattcaccattcgtc

SEQ ID NO: 77312 - DNA, 75 bp, Artificial Sequence
  Synthetic
cactccttaagcactacttcaatgatgaacaaggagaaatcgagttcatcgaaagctctaaggaagcaggattcc

SEQ ID NO: 77313 - DNA, 75 bp, Artificial Sequence
  Synthetic
ccgagtggaccgagcaactctgaaagtattccagcacttactgcagcagataccgggcatacctctcaggttgtg

SEQ ID NO: 77314 - DNA, 75 bp, Artificial Sequence
  Synthetic
gtattccagcacttactgcagcagataccgggcatacctctcaggttgtgcccagtgacaccattcaaacgaggc

SEQ ID NO: 77315 - DNA, 75 bp, Artificial Sequence
  Synthetic
ttagcactgaaccaatgagattggaggacgctgtgtatggtactgaaggccttgaggctcttgatttaacaacga

SEQ ID NO: 77316 - DNA, 75 bp, Artificial Sequence
  Synthetic
tggagtacaagaccagagatgatacccccgacaaaatgtatgacagctgggttataaacaccaggcaagttgcac

SEQ ID NO: 77317 - DNA, 75 bp, Artificial Sequence
  Synthetic
ccccgacaaaatgtatgacagctgggttataaacaccaggcaagttgcacagctgcggaggaagttagagttttt

SEQ ID NO: 77318 - DNA, 75 bp, Artificial Sequence
  Synthetic
ggacgctgtgtatggtactgaaggccttgaggctcttgatttaacaacgagtgcgggttacccttatgtcgctct

SEQ ID NO: 77319 - DNA, 75 bp, Artificial Sequence
  Synthetic
cgacacaccgactttgacacaccaaattatgtacgtacccccgggggggcctataccacaggccgtcgatgatta

SEQ ID NO: 77320 - DNA, 75 bp, Artificial Sequence
  Synthetic
attatgtacgtacccccgggggggcctataccacaggccgtcgatgattataactggcaaacatccacaaaccct

SEQ ID NO: 77321 - DNA, 75 bp, Artificial Sequence
  Synthetic
taggctcatcgaggcgtccagtttgaacgactccgtggcaatgagacaaacattcggcaacctatacaaaacttt

SEQ ID NO: 77322 - DNA, 75 bp, Artificial Sequence
  Synthetic
aacttttatgatgggtggtcgcacttctctcagacaggggtgtacggattcaacaccctcaacaacatgggcaag

SEQ ID NO: 77323 - DNA, 75 bp, Artificial Sequence
  Synthetic
tctctcagacaggggtgtacggattcaacaccctcaacaacatgggcaagttgtacttcagacatgtaaatgaca

SEQ ID NO: 77324 - DNA, 75 bp, Artificial Sequence
  Synthetic
cgccccgcctgtgcgaatacacacacaaagacaatgtggattttgaacctaagggagtgaccacatcccgcaccc

SEQ ID NO: 77325 - DNA, 75 bp, Artificial Sequence
  Synthetic
caaagacaatgtggattttgaacctaagggagtgaccacatcccgcacccagataacgatcactaactcgaccca

SEQ ID NO: 77326 - DNA, 75 bp, Artificial Sequence
  Synthetic
tttgtgcggggtggcatgccatcaggatgttctggcacaagcatctttaactcaatgataaataacatcataatc

SEQ ID NO: 77327 - DNA, 75 bp, Artificial Sequence
  Synthetic
cttagccacgcacactgattggcagaattgtgtatgggaagactacaacagagatctcctcgtgagcaccaccac

SEQ ID NO: 77328 - DNA, 75 bp, Artificial Sequence
  Synthetic
aatgattgcttatggtgacgatgtgatcgcatcatatccgtggcccatagatgcgtccctgcttgctgaagctgg

SEQ ID NO: 77329 - DNA, 75 bp, Artificial Sequence
  Synthetic
agatgtcaatgtgcaactggcgtgtacttctgtgcatcgaggaataagcactacccagtcagctttgagggccca

SEQ ID NO: 77330 - DNA, 75 bp, Artificial Sequence
  Synthetic
atttctaaagaggtattttagagcagatgaacaatacccctttttagtgcaccccgtcatgcccatgaaagacat

SEQ ID NO: 77331 - DNA, 75 bp, Artificial Sequence
  Synthetic
acatgaatcaatcagatggactaaggatccaaagaatactcaagatcatgtgcgctcgctatgtctattggcctg

SEQ ID NO: 77332 - DNA, 75 bp, Artificial Sequence
  Synthetic
tcagaaccaggagactgtggtggaattctcaggtgtgaacacggtgtgattggactggtcactatggggggtgag

SEQ ID NO: 77333 - DNA, 75 bp, Artificial Sequence
  Synthetic
ttctcaggtgtgaacacggtgtgattggactggtcactatggggggtgagggggttgttgggttcgctgacgttc

SEQ ID NO: 77334 - DNA, 75 bp, Artificial Sequence
  Synthetic
tcccagtaggacgatgtttgactctacctgcgttttcaaccctacgcaggaagtggttggactccttctaaagta

SEQ ID NO: 77335 - DNA, 75 bp, Artificial Sequence
  Synthetic
tcggttccggattcactaatcaaatttgtgaacagatcggccttttgaaggagtcgttggtggggcaagactcaa

SEQ ID NO: 77336 - DNA, 75 bp, Artificial Sequence
  Synthetic
ttgtgaacagatcggccttttgaaggagtcgttggtggggcaagactcaatcctggaaaaatccctcaaagcctt

SEQ ID NO: 77337 - DNA, 75 bp, Artificial Sequence
  Synthetic
ttaaaacagcctgtgggttgtacccacccacagggcccactgggcgctagcactctggtattacggtacccttgt

SEQ ID NO: 77338 - DNA, 75 bp, Artificial Sequence
  Synthetic
acccacagggcccactgggcgctagcactctggtattacggtacccttgtgcgcctgttttatataccccgcccc

SEQ ID NO: 77339 - DNA, 75 bp, Artificial Sequence
  Synthetic
gcttattggatgcacctcatcaccatggcgttggcttaagcagaaagagtcacagtattatggcatacccatggc

SEQ ID NO: 77340 - DNA, 75 bp, Artificial Sequence
  Synthetic
tggcgttggcttaagcagaaagagtcacagtattatggcatacccatggccgagagacaaagcaatggttggctt

SEQ ID NO: 77341 - DNA, 75 bp, Artificial Sequence
  Synthetic
ctgtctccccggaccgagtatcaatagactgctcacgcggtcgaaggagaaaacgttcgttacccgaccagctac

SEQ ID NO: 77342 - DNA, 75 bp, Artificial Sequence
  Synthetic
ttcgagaaacctagtaactccatggaggttgcagagtgtttcgttcagcacttcccccgtgtagatcaggctgat

SEQ ID NO: 77343 - DNA, 75 bp, Artificial Sequence
  Synthetic
tggcttaaagtcaagatcttgccagaggtgagagaaaaacacgagtttctcaaccgactcaagcaacttccacta

SEQ ID NO: 77344 - DNA, 75 bp, Artificial Sequence
  Synthetic
ttagaaagccaaatcgccaccattgagcaaagtgcaccatcccaaggtgatcaagaacaactcttctcaaatgtc

SEQ ID NO: 77345 - DNA, 75 bp, Artificial Sequence
  Synthetic
ccagggggcagtgtgtcgtaacgggtaactctgcagcggaaccgactactttgggtgtccgtgtttccttttatt

SEQ ID NO: 77346 - DNA, 75 bp, Artificial Sequence
  Synthetic
aagaagatgagcaattacatacagttcaagtccaaatgccgcattgagcctgtatgtctgctcttacacgggagt

SEQ ID NO: 77347 - DNA, 75 bp, Artificial Sequence
  Synthetic
attgagagattgttaccatatagctattggattggccatccagtgactaacagagctattatttacctttttgtt

SEQ ID NO: 77348 - DNA, 75 bp, Artificial Sequence
  Synthetic
ccaacttaattgggcgatctttagctgagaagctcaacagttcagtgtattccttgccacctgacccagaccact

SEQ ID NO: 77349 - DNA, 75 bp, Artificial Sequence
  Synthetic
cgcaggtgtctactcaaaaaactggagctcatgaaaccagcctgaatacaggaaatagttccatcatacattaca

SEQ ID NO: 77350 - DNA, 75 bp, Artificial Sequence
  Synthetic
agctcatgaaaccagcctgaatacaggaaatagttccatcatacattacaccaacataaactactacaaagatgc

SEQ ID NO: 77351 - DNA, 75 bp, Artificial Sequence
  Synthetic
aaatgctggctccattaacgcaccaacagtctcagacagccgagctttggccaggaggttccattttgacatgaa

SEQ ID NO: 77352 - DNA, 75 bp, Artificial Sequence
  Synthetic
acagtctcagacagccgagctttggccaggaggttccattttgacatgaacatagaggtcatttcaatgtatagt

SEQ ID NO: 77353 - DNA, 75 bp, Artificial Sequence
  Synthetic
ggttaaatcgctcccagcgttgaattcacccaacgcagaagaatgcggttatagtgatagggtgagatccatcac

SEQ ID NO: 77354 - DNA, 75 bp, Artificial Sequence
  Synthetic
tcacccaacgcagaagaatgcggttatagtgatagggtgagatccatcactcttgggaactctaccattaccacg

SEQ ID NO: 77355 - DNA, 75 bp, Artificial Sequence
  Synthetic
tgttgcccccttgtgtgtgggaaggccatccagttcattgacaggagaacacaggtgaggtactcattggatatg

SEQ ID NO: 77356 - DNA, 75 bp, Artificial Sequence
  Synthetic
gatcagccgactcagcccgacgtggcgacgtgtaggttttataccttagagtcagttacatgggagaagaactcg

SEQ ID NO: 77357 - DNA, 75 bp, Artificial Sequence
  Synthetic
cgacgtgtaggttttataccttagagtcagttacatgggagaagaactcggatgggtggtggtggaagttccctg

SEQ ID NO: 77358 - DNA, 75 bp, Artificial Sequence
  Synthetic
atgtgcaatgtaatgcttcaaagtttcaccaagggtgtctcttggtggcgtgtgtgcctgaagcagagatggggt

SEQ ID NO: 77359 - DNA, 75 bp, Artificial Sequence
  Synthetic
tcaccaagggtgtctcttggtggcgtgtgtgcctgaagcagagatggggtgtgcccaaaccgatgggacagtgct

SEQ ID NO: 77360 - DNA, 75 bp, Artificial Sequence
  Synthetic
acaaacggcagtgtgcaacgcagccatgggtgtgggagttgggaacctgaccatatatccgcaccaatggataaa

SEQ ID NO: 77361 - DNA, 75 bp, Artificial Sequence
  Synthetic
atgggtgtgggagttgggaacctgaccatatatccgcaccaatggataaacctgcgcactaataacagcgccacc

SEQ ID NO: 77362 - DNA, 75 bp, Artificial Sequence
  Synthetic
gtgcccacgctaaggcaagccaaagtgcaaggtcccgcttttgagtttgctgtggctatgatgaagagaaattcc

SEQ ID NO: 77363 - DNA, 75 bp, Artificial Sequence
  Synthetic
tgcaaggtcccgcttttgagtttgctgtggctatgatgaagagaaattccagcacagtgaaaacagaatacggcg

SEQ ID NO: 77364 - DNA, 75 bp, Artificial Sequence
  Synthetic
ccatttgtcccattggattacaacaattcagcgtccaatgtaccaataaccgtcacaatagcacccatgtttgcg

SEQ ID NO: 77365 - DNA, 75 bp, Artificial Sequence
  Synthetic
attcagcgtccaatgtaccaataaccgtcacaatagcacccatgtttgcggagtacaatggactgcgcctggggg

SEQ ID NO: 77366 - DNA, 75 bp, Artificial Sequence
  Synthetic
ggaatgaccaaaaggttggcgtacgggatgcaaaagagttgggggataaggatggtacaaacctggagctcacat

SEQ ID NO: 77367 - DNA, 75 bp, Artificial Sequence
  Synthetic
ggatgcaaaagagttgggggataaggatggtacaaacctggagctcacattgttgaaacttaaccggaaggagaa

SEQ ID NO: 77368 - DNA, 75 bp, Artificial Sequence
  Synthetic
gcgctctcccacagtatgatgtaaccccaccaatgcacataccaggagaggtgcgcaatctgatggaaatcgcgg

SEQ ID NO: 77369 - DNA, 75 bp, Artificial Sequence
  Synthetic
cccaccaatgcacataccaggagaggtgcgcaatctgatggaaatcgcggaagtggattcagtgatgcctatcaa

SEQ ID NO: 77370 - DNA, 75 bp, Artificial Sequence
  Synthetic
caagttcccaaatatgtactttccggtaggacaggttacagactatggtttcctaaatttgggtggcacccccac

SEQ ID NO: 77371 - DNA, 75 bp, Artificial Sequence
  Synthetic
gtaggacaggttacagactatggtttcctaaatttgggtggcacccccacaaaaagaaggttgatgtacaatttt

SEQ ID NO: 77372 - DNA, 75 bp, Artificial Sequence
  Synthetic
ccccatattcagcttccagctaaatccaggagggagctcagttatgaaacgtacgttactaggagagattttaaa

SEQ ID NO: 77373 - DNA, 75 bp, Artificial Sequence
  Synthetic
ccaggagggagctcagttatgaaacgtacgttactaggagagattttaaactattatgcccactggtcagggagt

SEQ ID NO: 77374 - DNA, 75 bp, Artificial Sequence
  Synthetic
ggacaccaagggttctcggcagccttgttacgtcattatttcaaggaggagcagggggagattgagttcatccaa

SEQ ID NO: 77375 - DNA, 75 bp, Artificial Sequence
  Synthetic
tgttacgtcattatttcaaggaggagcagggggagattgagttcatccaaaattccaaggaagcgggcttcccat

SEQ ID NO: 77376 - DNA, 75 bp, Artificial Sequence
  Synthetic
gcgagtgtcccaaaatcgcgtaaggacgccatgctgggcacccacatcatatgggacgtggggttgcaatccagc

SEQ ID NO: 77377 - DNA, 75 bp, Artificial Sequence
  Synthetic
acgccatgctgggcacccacatcatatgggacgtggggttgcaatccagctgcgtgttgtgtgtgccgtggatca

SEQ ID NO: 77378 - DNA, 75 bp, Artificial Sequence
  Synthetic
cagtgttgagaaccggggaccccaggctgaaggccacctttgaggaggccatcttctcaaagtacattgccaata

SEQ ID NO: 77379 - DNA, 75 bp, Artificial Sequence
  Synthetic
gtattgtcgtcccaccggaaaccccaacacagtgtgacatattaggctttgtgtctgcctgtaatgatttctctg

SEQ ID NO: 77380 - DNA, 75 bp, Artificial Sequence
  Synthetic
gcacagaacccatgaaattgaaggacgcagtttatggtactgaaggcttggaagcccttgatcttaccacagatg

SEQ ID NO: 77381 - DNA, 75 bp, Artificial Sequence
  Synthetic
aacacagtgtgacatattaggctttgtgtctgcctgtaatgatttctctgtgcggatgttaaaagacacaccatt

SEQ ID NO: 77382 - DNA, 75 bp, Artificial Sequence
  Synthetic
cccgtcaaattccgaacgcgtcccagccctcacagcagtggagactggccacacttcgcaggtcgtacccagcga

SEQ ID NO: 77383 - DNA, 75 bp, Artificial Sequence
  Synthetic
gccctcacagcagtggagactggccacacttcgcaggtcgtacccagcgacacagtgcaaactcgccacgtacgc

SEQ ID NO: 77384 - DNA, 75 bp, Artificial Sequence
  Synthetic
aaaaagtggctaaaggcaaatccagactgattgaggcgtccagcttaaacgactcagtggcaatgagacagactt

SEQ ID NO: 77385 - DNA, 75 bp, Artificial Sequence
  Synthetic
aaggctaagggtgaaaaaggatcttctgagaggtacgcgtcatgggagataactaacagggagatggtgcaattg

SEQ ID NO: 77386 - DNA, 75 bp, Artificial Sequence
  Synthetic
ctgagaggtacgcgtcatgggagataactaacagggagatggtgcaattgcgccgaaaatgtgagatgttcacat

SEQ ID NO: 77387 - DNA, 75 bp, Artificial Sequence
  Synthetic
tgttctggagcaagatcccagtcatgctcgatggccacctcattgcctttgattatagtggatatgatgccagcc

SEQ ID NO: 77388 - DNA, 75 bp, Artificial Sequence
  Synthetic
gattatagtggatatgatgccagcctgagtccggtgtggtttgcctgtctgaaactgttgttagagaagctgggc

SEQ ID NO: 77389 - DNA, 75 bp, Artificial Sequence
  Synthetic
tgcctgtactaacacaccaaatcatgtacgtgcccccgggtgggcctgtgccaacaagcacggagagctatgcat

SEQ ID NO: 77390 - DNA, 75 bp, Artificial Sequence
  Synthetic
gtacgtgcccccgggtgggcctgtgccaacaagcacggagagctatgcatggcagacctcaacgaaccctagcgt

SEQ ID NO: 77391 - DNA, 75 bp, Artificial Sequence
  Synthetic
gtaagaggaggaatgccatctgggtgttctggaaccagcattttcaattcaatgattaacaacataattattaga

SEQ ID NO: 77392 - DNA, 75 bp, Artificial Sequence
  Synthetic
ttatgatgggtggtcacatttctcacaagatgggtcctatggctacacagcgctcaatagaatggggaaaatata

SEQ ID NO: 77393 - DNA, 75 bp, Artificial Sequence
  Synthetic
caagatgggtcctatggctacacagcgctcaatagaatggggaaaatatatattagacatgtaaataaggagacc

SEQ ID NO: 77394 - DNA, 75 bp, Artificial Sequence
  Synthetic
cctcactgctggctgaagccggtaaggggtatggtctaatcatgacaccagcagacaagggagagtgctttactg

SEQ ID NO: 77395 - DNA, 75 bp, Artificial Sequence
  Synthetic
cggctgtgcaaatacctacactcaggcaacatgaacttcaacgtggaggacattacagaggagcggaacgatata

SEQ ID NO: 77396 - DNA, 75 bp, Artificial Sequence
  Synthetic
gcaacatgaacttcaacgtggaggacattacagaggagcggaacgatataaaccatgtacccacccccagccaca

SEQ ID NO: 77397 - DNA, 75 bp, Artificial Sequence
  Synthetic
cagtaatgccaatgaaggacattcatgagtccattatgtggaccaaagaccccaagaacacacaagatcacgtgc

SEQ ID NO: 77398 - DNA, 75 bp, Artificial Sequence
  Synthetic
acagagtggtgaatagacacttggcaacgcgcacagactggcacagctgcgtatgggaagactacaatagggacc

SEQ ID NO: 77399 - DNA, 75 bp, Artificial Sequence
  Synthetic
aacgcgcacagactggcacagctgcgtatgggaagactacaatagggacctccttgtgagcaccaccaccgcaca

SEQ ID NO: 77400 - DNA, 75 bp, Artificial Sequence
  Synthetic
ttaaaacagcctgtgggttgcccccacccgcagggccattgggcgctagcacactggtatcacggtacctttgtg

SEQ ID NO: 77401 - DNA, 75 bp, Artificial Sequence
  Synthetic
agtgagttttgaagggccagggcttgtggaagtccaagaaagtgagtactatcctaagaggtatcagtcacatgt

SEQ ID NO: 77402 - DNA, 75 bp, Artificial Sequence
  Synthetic
gtggaagtccaagaaagtgagtactatcctaagaggtatcagtcacatgtgctacttgcggctggcttttctgag

SEQ ID NO: 77403 - DNA, 75 bp, Artificial Sequence
  Synthetic
gttgggttctctgatgtgagagacttactgtggcttgaagacgatgccatggaacagggtgttaaaaactatgta

SEQ ID NO: 77404 - DNA, 75 bp, Artificial Sequence
  Synthetic
tactgtggcttgaagacgatgccatggaacagggtgttaaaaactatgtagaacaacttggaaatgcatttggtt

SEQ ID NO: 77405 - DNA, 75 bp, Artificial Sequence
  Synthetic
agaagtcattgaaagctctagtgaaaataatatcagccctggtaatcgtggtgagaaaccacgacgacttaatca

SEQ ID NO: 77406 - DNA, 75 bp, Artificial Sequence
  Synthetic
aataatatcagccctggtaatcgtggtgagaaaccacgacgacttaatcacggtgactgccacactagctctcat

SEQ ID NO: 77407 - DNA, 75 bp, Artificial Sequence
  Synthetic
ccaaagcaatggatggctcaagaagtttaccgagatgacaaatgcctgcaagggtatggaatggatagctattaa

SEQ ID NO: 77408 - DNA, 75 bp, Artificial Sequence
  Synthetic
tttaccgagatgacaaatgcctgcaagggtatggaatggatagctattaaaattcagaaattcatagagtggctc

SEQ ID NO: 77409 - DNA, 75 bp, Artificial Sequence
  Synthetic
agtcagattgccacaatcgagcagagcgcaccgtctcaaagtgaccaggagcaattgttttctaatgtccaatac

SEQ ID NO: 77410 - DNA, 75 bp, Artificial Sequence
  Synthetic
gcgcaccgtctcaaagtgaccaggagcaattgttttctaatgtccaatactttgctcactattgtaggaaatacg

SEQ ID NO: 77411 - DNA, 75 bp, Artificial Sequence
  Synthetic
ccaaatgccgtattgaacctgtatgcttgctcctacacgggagccccggtgccggcaagtcggtagcaacaaacc

SEQ ID NO: 77412 - DNA, 75 bp, Artificial Sequence
  Synthetic
cttgctcctacacgggagccccggtgccggcaagtcggtagcaacaaacctaatcggaaggtcgcttgccgagaa

SEQ ID NO: 77413 - DNA, 75 bp, Artificial Sequence
  Synthetic
catggacgatttgtgtcagaaccctgatggaaaagatgtctccttgttctgccaaatggtgtctagtgtagactt

SEQ ID NO: 77414 - DNA, 75 bp, Artificial Sequence
  Synthetic
gatggaaaagatgtctccttgttctgccaaatggtgtctagtgtagactttgtaccacccatggccgccttggaa

SEQ ID NO: 77415 - DNA, 75 bp, Artificial Sequence
  Synthetic
tcagacagcagggccttagcaaggagattccacttcgacatgaacatcgaagttatttccatgtacagtcaaaat

SEQ ID NO: 77416 - DNA, 75 bp, Artificial Sequence
  Synthetic
gattccacttcgacatgaacatcgaagttatttccatgtacagtcaaaatggtaagataaacatgcctatgtcag

SEQ ID NO: 77417 - DNA, 75 bp, Artificial Sequence
  Synthetic
aattcattgataggaagacacaggtcaggtattctttagacatgctggttaccgagatgttcagggaatacaatc

SEQ ID NO: 77418 - DNA, 75 bp, Artificial Sequence
  Synthetic
caggtattctttagacatgctggttaccgagatgttcagggaatacaatcacaggcacagtgtgggggcgacact

SEQ ID NO: 77419 - DNA, 75 bp, Artificial Sequence
  Synthetic
tgccattgcggacctacttaagtctgtggatagtgaagctgtgagagagtactgtaaagaaaaaggatggctagt

SEQ ID NO: 77420 - DNA, 75 bp, Artificial Sequence
  Synthetic
tcatctgcctgcaggcactgaccacatttgtgtctgtagctggaatcatttacataatatataagctctttgcgg

SEQ ID NO: 77421 - DNA, 75 bp, Artificial Sequence
  Synthetic
gccctgcatttgagttcgccgtcgcaatgatgaagaggaactcaagtacagtaaaaactgagtatggcgaattta

SEQ ID NO: 77422 - DNA, 75 bp, Artificial Sequence
  Synthetic
atcaggaagtgggcgtgttggatgccaaagagttggtagataaggatggcaccaacctggagctgacactactca

SEQ ID NO: 77423 - DNA, 75 bp, Artificial Sequence
  Synthetic
tgctagcaattaacaccagcaagttccccaacatgtacatcccagtaggacaagtcatagattatggctttctaa

SEQ ID NO: 77424 - DNA, 75 bp, Artificial Sequence
  Synthetic
caagtcatagattatggctttctaaacctaggtggcacacccactaagaggatgctaatgtacaacttccctaca

SEQ ID NO: 77425 - DNA, 75 bp, Artificial Sequence
  Synthetic
tccaaatatatcggaaatgtcaacacacacgtggatgaatacatgctggaggctgtcgaccattacgctgggcaa

SEQ ID NO: 77426 - DNA, 75 bp, Artificial Sequence
  Synthetic
acctgtgcaactcccatcacctgtacagggataaacattattttgtgcggggtggtatgccatcaggttgttctg

SEQ ID NO: 77427 - DNA, 75 bp, Artificial Sequence
  Synthetic
tacccgtggcccatagatgcgtctttgcttgctgaggctggcaaggattatggattgatcatgacaccagcagac

SEQ ID NO: 77428 - DNA, 75 bp, Artificial Sequence
  Synthetic
tcacattctgatcaagcacttctgtttccccggactgagtatcaataggctgttcacacggctgaaggagaaaac

SEQ ID NO: 77429 - DNA, 75 bp, Artificial Sequence
  Synthetic
tggagagtcagatcgccaccatcgagcaaagtgcaccctctcagagtgatcaagagcaattgttctccaatgtac

SEQ ID NO: 77430 - DNA, 75 bp, Artificial Sequence
  Synthetic
ccccgtgtagatcaggtcgatgagtcaccgcattccccacgggcgaccgtggcggtggctgcgttggcggcctgc

SEQ ID NO: 77431 - DNA, 75 bp, Artificial Sequence
  Synthetic
tattgagctagttggtagtcctccggcccctgaatgcggctaatcctaactgcggagcgagcgcttgtaatccaa

SEQ ID NO: 77432 - DNA, 75 bp, Artificial Sequence
  Synthetic
tactggctgcttatggtgacaatcacagagttgttaccatatagctattggattggccatccggtgtcaaataga

SEQ ID NO: 77433 - DNA, 75 bp, Artificial Sequence
  Synthetic
cagagttgttaccatatagctattggattggccatccggtgtcaaatagagcaattgtgtttctttttgttgggt

SEQ ID NO: 77434 - DNA, 75 bp, Artificial Sequence
  Synthetic
ggtttcgactcaaaagactggggcacacgagaacaccgtgagagccaatggtggatctactatcaattacactac

SEQ ID NO: 77435 - DNA, 75 bp, Artificial Sequence
  Synthetic
cacgagaacaccgtgagagccaatggtggatctactatcaattacactacaattaattactataaggactctgca

SEQ ID NO: 77436 - DNA, 75 bp, Artificial Sequence
  Synthetic
aaaacccttccggcactaaactcaccgtcagctgaggagtgcggatacagcgaccgcgttcgctcaatcacgctt

SEQ ID NO: 77437 - DNA, 75 bp, Artificial Sequence
  Synthetic
cgtcagctgaggagtgcggatacagcgaccgcgttcgctcaatcacgcttggtaattcaacaatcacaacgcagg

SEQ ID NO: 77438 - DNA, 75 bp, Artificial Sequence
  Synthetic
aaccaactcaacctgatgtggccacgtgtagattctatacacttgaatcaattaattgggaaaaaggttcggcgg

SEQ ID NO: 77439 - DNA, 75 bp, Artificial Sequence
  Synthetic
gtgtagattctatacacttgaatcaattaattgggaaaaaggttcggcgggctggtggtggaaatttcctatagc

SEQ ID NO: 77440 - DNA, 75 bp, Artificial Sequence
  Synthetic
tcagtgtaacgcatcaaaattccaccagggttgcctgttggtggtgtgtgtacccgaagcggagatggggtgtgc

SEQ ID NO: 77441 - DNA, 75 bp, Artificial Sequence
  Synthetic
cagggttgcctgttggtggtgtgtgtacccgaagcggagatggggtgtgcaaagacggattacacagttactgag

SEQ ID NO: 77442 - DNA, 75 bp, Artificial Sequence
  Synthetic
gccgtgcacaacgcggctatgggcattgctgctggtaacctgaccatcttccctcatcagtggattaacttgcgt

SEQ ID NO: 77443 - DNA, 75 bp, Artificial Sequence
  Synthetic
ttgctgctggtaacctgaccatcttccctcatcagtggattaacttgcgtacaaacaacagtgcaacgattattg

SEQ ID NO: 77444 - DNA, 75 bp, Artificial Sequence
  Synthetic
ctccactggaggtccaagcaggaacagccacagcagtgcccataacagtgacggttgcacccatgcaagccgaat

SEQ ID NO: 77445 - DNA, 75 bp, Artificial Sequence
  Synthetic
agccacagcagtgcccataacagtgacggttgcacccatgcaagccgaatacaacggtctgcgattggccatggc

SEQ ID NO: 77446 - DNA, 75 bp, Artificial Sequence
  Synthetic
tatgccccagtttgatgtaacgcccctgctacacataccaggtgaggtgaaaaatttgatggaggttgctgaagt

SEQ ID NO: 77447 - DNA, 75 bp, Artificial Sequence
  Synthetic
ctgctacacataccaggtgaggtgaaaaatttgatggaggttgctgaagtagactcagtggtcccagtcaacaac

SEQ ID NO: 77448 - DNA, 75 bp, Artificial Sequence
  Synthetic
atatttagctttgagttagatcctggcaacgggaccgtactaagcaagacattgttgggagagatactgaattac

SEQ ID NO: 77449 - DNA, 75 bp, Artificial Sequence
  Synthetic
gcaacgggaccgtactaagcaagacattgttgggagagatactgaattactatgcacattggtcaggcagtgtta

SEQ ID NO: 77450 - DNA, 75 bp, Artificial Sequence
  Synthetic
cagtgcccaaagacagaaaacaagctatgctgggtacccatgtgatttgggatctcggactgcaatccagttgtg

SEQ ID NO: 77451 - DNA, 75 bp, Artificial Sequence
  Synthetic
tatgctgggtacccatgtgatttgggatctcggactgcaatccagttgtgtgttgtgtgtgccatggatcagcca

SEQ ID NO: 77452 - DNA, 75 bp, Artificial Sequence
  Synthetic
ggtggtaccaccaaagaccccaacctcatgctacattctgtgctttgtgtccgcttgcaatgatttttcggtgcg

SEQ ID NO: 77453 - DNA, 75 bp, Artificial Sequence
  Synthetic
tcatgctacattctgtgctttgtgtccgcttgcaatgatttttcggtgcgcatgttaagggacaccccacacata

SEQ ID NO: 77454 - DNA, 75 bp, Artificial Sequence
  Synthetic
aacacggaacaagtcccagcgctcactgctgtggaaacgggacacacatcacaagtggaacccagtgacacagtg

SEQ ID NO: 77455 - DNA, 75 bp, Artificial Sequence
  Synthetic
ctgctgtggaaacgggacacacatcacaagtggaacccagtgacacagtgcagacaagacatgtgcaaaactttc

SEQ ID NO: 77456 - DNA, 75 bp, Artificial Sequence
  Synthetic
gttcacaagcagatctaggggacagatacacggagtggacgatctcggttagggatatggctcagataagaagaa

SEQ ID NO: 77457 - DNA, 75 bp, Artificial Sequence
  Synthetic
atacacggagtggacgatctcggttagggatatggctcagataagaagaaaatttgaaatgttcacatacctgag

SEQ ID NO: 77458 - DNA, 75 bp, Artificial Sequence
  Synthetic
cctgacacaccaaataatgtacgtgcccccaggcgggccagtaccaacaagtgtgaaaagctttgcatggcaaac

SEQ ID NO: 77459 - DNA, 75 bp, Artificial Sequence
  Synthetic
cccccaggcgggccagtaccaacaagtgtgaaaagctttgcatggcaaacgtctaccaacccaggtttattctgg

SEQ ID NO: 77460 - DNA, 75 bp, Artificial Sequence
  Synthetic
ggctggtcacacttttcacaaaccggtgtttatggtttcaacacactgaatgacatgggtagactttttattaga

SEQ ID NO: 77461 - DNA, 75 bp, Artificial Sequence
  Synthetic
gtgtttatggtttcaacacactgaatgacatgggtagactttttattagacatgttaacgagcaaagcccgtaca

SEQ ID NO: 77462 - DNA, 75 bp, Artificial Sequence
  Synthetic
caaagaacactcaagatcatgtgcgctcattgtgtttattggcttggcacaatggggagcaagaatatgaagaat

SEQ ID NO: 77463 - DNA, 75 bp, Artificial Sequence
  Synthetic
gcccgtacatcaacaaagcaaatgtcaactttaaaccacacccggttgccgactcaaggcccactataaatgacg

SEQ ID NO: 77464 - DNA, 75 bp, Artificial Sequence
  Synthetic
caactttaaaccacacccggttgccgactcaaggcccactataaatgacgtccctactgcagaacacccgccact

SEQ ID NO: 77465 - DNA, 75 bp, Artificial Sequence
  Synthetic
ggttagattctttctaaattagaggcaatttgaaataatttaaattagctcaaccctactgcacttaccgaacta

SEQ ID NO: 77466 - DNA, 75 bp, Artificial Sequence
  Synthetic
ggccacacacgcagattggactaattgtgtatgggaggattacagcagagatctccttgtgagcaccaccaccgc

SEQ ID NO: 77467 - DNA, 75 bp, Artificial Sequence
  Synthetic
tgtgtatgggaggattacagcagagatctccttgtgagcaccaccaccgcacatggttgtgataccatagccagg

SEQ ID NO: 77468 - DNA, 75 bp, Artificial Sequence
  Synthetic
cttgtggaagtgcaagagagtgagtattaccccaggagatatcaatcccatgtcctcctcgcagctgggttctca

SEQ ID NO: 77469 - DNA, 75 bp, Artificial Sequence
  Synthetic
attaccccaggagatatcaatcccatgtcctcctcgcagctgggttctcagaaccaggagactgtggtggaatac

SEQ ID NO: 77470 - DNA, 75 bp, Artificial Sequence
  Synthetic
acttgctgtggctcgaagatgatgcaatggaacaaggggtaagagactatgtagagcaactcgggaatgctttcg

SEQ ID NO: 77471 - DNA, 75 bp, Artificial Sequence
  Synthetic
aatggaacaaggggtaagagactatgtagagcaactcgggaatgctttcggtgcaggatttaccaatcagatttg

SEQ ID NO: 77472 - DNA, 75 bp, Artificial Sequence
  Synthetic
ttgggtgtccgtgtttccttttatttctatactggctgcttatggtgacaattgagagattgttaccatatagct

SEQ ID NO: 77473 - DNA, 75 bp, Artificial Sequence
  Synthetic
gaagataatatcagcccttgtgatcgtggtgaggaaccacgacgacctaatcacagtgaccgccacattagccct

SEQ ID NO: 77474 - DNA, 75 bp, Artificial Sequence
  Synthetic
gtggtgaggaaccacgacgacctaatcacagtgaccgccacattagcccttattggttgcacctcgtccccatgg

SEQ ID NO: 77475 - DNA, 75 bp, Artificial Sequence
  Synthetic
aaattttctgagatgacgaatgcctgcaagggcatggagtggatagccattaagatccaaaagttcattgagtgg

SEQ ID NO: 77476 - DNA, 75 bp, Artificial Sequence
  Synthetic
ctcaggtgtcgactcagaaaaccggggcacatgagaccagcttaaatgctagcggaaactctattattcattaca

SEQ ID NO: 77477 - DNA, 75 bp, Artificial Sequence
  Synthetic
gagagtcagattgccacgatcgagcagagtgcaccatcccagagtgatcaagagcagttgttctccaacgttcag

SEQ ID NO: 77478 - DNA, 75 bp, Artificial Sequence
  Synthetic
tccccatctgccgaagagtgtggctacagtgatagagtaaggtctatcacccttggtaactcaactatcactacc

SEQ ID NO: 77479 - DNA, 75 bp, Artificial Sequence
  Synthetic
aaaaagagtattctcccttgagaagaagatgagtaattacatacagttcaagtccaaatgccgtattgaacctgt

SEQ ID NO: 77480 - DNA, 75 bp, Artificial Sequence
  Synthetic
aagatgagtaattacatacagttcaagtccaaatgccgtattgaacctgtatgtttactcttgcacgggagccct

SEQ ID NO: 77481 - DNA, 75 bp, Artificial Sequence
  Synthetic
agtccaaatgccgtattgaacctgtatgtttactcttgcacgggagccctggtgccggcaagtcagtggcgacaa

SEQ ID NO: 77482 - DNA, 75 bp, Artificial Sequence
  Synthetic
ctgggtaggtccggttataccatacatgtgcagtgtaacgcctcaaaatttcaccaagggtgccttttagtagtg

SEQ ID NO: 77483 - DNA, 75 bp, Artificial Sequence
  Synthetic
acggctacaaacaacaggctgtagtgatcatggatgatctgtgccagaatcctgatgggaaggatgtctccttat

SEQ ID NO: 77484 - DNA, 75 bp, Artificial Sequence
  Synthetic
gatcatggatgatctgtgccagaatcctgatgggaaggatgtctccttattctgccaaatggtctcaagtgtgga

SEQ ID NO: 77485 - DNA, 75 bp, Artificial Sequence
  Synthetic
cgcagggtccataaatgctccaaccgtgtcggacagcagggcactagcaaggagattccactttgatatgaatat

SEQ ID NO: 77486 - DNA, 75 bp, Artificial Sequence
  Synthetic
gtgtcggacagcagggcactagcaaggagattccactttgatatgaatatcgaggtcatctcaatgtacagtcag

SEQ ID NO: 77487 - DNA, 75 bp, Artificial Sequence
  Synthetic
gtcatgccatacatcaacagtgtgcctatggacaatatgttccgccattataacttcacactaatgattatccca

SEQ ID NO: 77488 - DNA, 75 bp, Artificial Sequence
  Synthetic
tgtccattagtgtgtgggaaggccatccaattcatagacagaagaacccaagttagatactcccttgatatgctg

SEQ ID NO: 77489 - DNA, 75 bp, Artificial Sequence
  Synthetic
tccaattcatagacagaagaacccaagttagatactcccttgatatgctggtaactgagatgtttagagagtaca

SEQ ID NO: 77490 - DNA, 75 bp, Artificial Sequence
  Synthetic
gtgtagcaccagaaacaccaccaccaccagccattgcagacctgctcaaatcggtggacagtgaagccgtgagag

SEQ ID NO: 77491 - DNA, 75 bp, Artificial Sequence
  Synthetic
accagccattgcagacctgctcaaatcggtggacagtgaagccgtgagagagtactgtaaggaaaagggatggct

SEQ ID NO: 77492 - DNA, 75 bp, Artificial Sequence
  Synthetic
cacttttgtctcagtggcaggaatcatctatatgatttataagctcttcgcaggtttccaaggagcgtacacagg

SEQ ID NO: 77493 - DNA, 75 bp, Artificial Sequence
  Synthetic
atctatatgatttataagctcttcgcaggtttccaaggagcgtacacaggaatgcctaaccagaaacctaaggta

SEQ ID NO: 77494 - DNA, 75 bp, Artificial Sequence
  Synthetic
acggtgaagaccgagtatggtgaatacaccatgctgggcatttatgacaggtgggccgtcttaccacgccatgct

SEQ ID NO: 77495 - DNA, 75 bp, Artificial Sequence
  Synthetic
acaccatgctgggcatttatgacaggtgggccgtcttaccacgccatgctaagcctggaccaaccatactcatga

SEQ ID NO: 77496 - DNA, 75 bp, Artificial Sequence
  Synthetic
ttaagctaaaccgaaatgagaagttcagagacatcaggggcttcttggccaaagaagaggtggaggtcaatgagg

SEQ ID NO: 77497 - DNA, 75 bp, Artificial Sequence
  Synthetic
cagagacatcaggggcttcttggccaaagaagaggtggaggtcaatgaggctgtgttagcaatcaacaccagtaa

SEQ ID NO: 77498 - DNA, 75 bp, Artificial Sequence
  Synthetic
gagaatgcttatgtacaacttccccacaagggcaggccagtgtggcggagtgctcatgtccaccggcaaagtact

SEQ ID NO: 77499 - DNA, 75 bp, Artificial Sequence
  Synthetic
acaagggcaggccagtgtggcggagtgctcatgtccaccggcaaagtactggggattcatgttggtgggaatggt

SEQ ID NO: 77500 - DNA, 75 bp, Artificial Sequence
  Synthetic
agtattccagcgctcactgccgccgagacagggcatacatcacaagtggtaccaagcgacaccatccagacacgc

SEQ ID NO: 77501 - DNA, 75 bp, Artificial Sequence
  Synthetic
tcaaaggaagcgggattcccagtaatcaatacacctagtaagaccaagttggaaccaagtgttttccaccatgtt

SEQ ID NO: 77502 - DNA, 75 bp, Artificial Sequence
  Synthetic
tcaatacacctagtaagaccaagttggaaccaagtgttttccaccatgtttttgagggcaacaaagaaccagcag

SEQ ID NO: 77503 - DNA, 75 bp, Artificial Sequence
  Synthetic
acacacacgtggatgaatacatgttggaagctgtagaccattacgctggacaattggccaccttagacatcagca

SEQ ID NO: 77504 - DNA, 75 bp, Artificial Sequence
  Synthetic
ctgacacgccagcgctcacccaccagataatgtatgtaccaccagggggccccattccacaagccgtggatgact

SEQ ID NO: 77505 - DNA, 75 bp, Artificial Sequence
  Synthetic
ggaagctgtagaccattacgctggacaattggccaccttagacatcagcactgaaccaatgaaattggaggatgc

SEQ ID NO: 77506 - DNA, 75 bp, Artificial Sequence
  Synthetic
caagaagagagacatcctatcaaagaagactaaggacctgaccaagctaaaagagtgcatggacaagtatggcct

SEQ ID NO: 77507 - DNA, 75 bp, Artificial Sequence
  Synthetic
aggtggcaaaaggaaagtctaggctaattgaagcatctagtttgaacgactcagtggcaatgaggcagacatttg

SEQ ID NO: 77508 - DNA, 75 bp, Artificial Sequence
  Synthetic
ccgcccagactatgtgagtacacacacaaggacaacgtggactttgaacccaaaggcgtcaccacatcccggact

SEQ ID NO: 77509 - DNA, 75 bp, Artificial Sequence
  Synthetic
tttggagcaaaataccagtgatgttggatggacacctcatagcatttgattactccgggtatgatgctagcttaa

SEQ ID NO: 77510 - DNA, 75 bp, Artificial Sequence
  Synthetic
ggatggacacctcatagcatttgattactccgggtatgatgctagcttaagcccagtctggtttgcctgtctgaa

SEQ ID NO: 77511 - DNA, 75 bp, Artificial Sequence
  Synthetic
ggtaattacaggttggtcaataggcacttggctacacacaatgattggcaaaactgtgtgtgggaggattacaat

SEQ ID NO: 77512 - DNA, 75 bp, Artificial Sequence
  Synthetic
atacagggataagcactattttgtgaggggtggcatgccttcagggtgttctggcaccagcatttttaattcaat

SEQ ID NO: 77513 - DNA, 75 bp, Artificial Sequence
  Synthetic
cgcatatggtgacgatgtgatcgcatcatacccgtggcccatagatgcatccttgctcgctgaggccggcaagga

SEQ ID NO: 77514 - DNA, 75 bp, Artificial Sequence
  Synthetic
cgcgacctgctgtggctagaagatgatgctatggaacagggtgtgagagactacgtcgaacaacttggaaatgct

SEQ ID NO: 77515 - DNA, 75 bp, Artificial Sequence
  Synthetic
aaagaggtattttagagcagatgaacagtacccctttttggtgcaccctgttatgcccatgaaagacatacacga

SEQ ID NO: 77516 - DNA, 75 bp, Artificial Sequence
  Synthetic
cggagagcatgaatacgaggagttcattcgtaaaatcagaagcgtcccagtcgggcgttgtttgaccctgcctgc

SEQ ID NO: 77517 - DNA, 75 bp, Artificial Sequence
  Synthetic
gtggcgttggctcaaacggaaagtgtcgcagtattatgggatacccacggctgagcgtcaaaataacgggtggct

SEQ ID NO: 77518 - DNA, 75 bp, Artificial Sequence
  Synthetic
atttgatataatttaaattggcttaaccctactgcactaaccgaactagataacggtgcagtaggggtaaattct

SEQ ID NO: 77519 - DNA, 75 bp, Artificial Sequence
  Synthetic
attacggtacctttgtgcgcctgttttatccacccttccctcaaatgaaacttagaagcttaactcgaatggtca

SEQ ID NO: 77520 - DNA, 75 bp, Artificial Sequence
  Synthetic
ttatccacccttccctcaaatgaaacttagaagcttaactcgaatggtcaacaggaaacccagtacaccaactgg

SEQ ID NO: 77521 - DNA, 75 bp, Artificial Sequence
  Synthetic
tcagtactttgctcactattgcagaaaatacgcacccttgtatgctgctgaggccaaaagagtgttctctcttga

SEQ ID NO: 77522 - DNA, 75 bp, Artificial Sequence
  Synthetic
ttgttaccatatagctactggattggccatccggtgtctaacagagcgatcatttatctgtttgttggatttgtg

SEQ ID NO: 77523 - DNA, 75 bp, Artificial Sequence
  Synthetic
gccaggaggttccactttgacatgaacattgaggtcatttccatgtacagccaaaatggcaagatcaacatgccc

SEQ ID NO: 77524 - DNA, 75 bp, Artificial Sequence
  Synthetic
caacacaaaaaaccggggcccatgaaaccggtttgaatgccagtggaaactccattatacactacacaaacatca

SEQ ID NO: 77525 - DNA, 75 bp, Artificial Sequence
  Synthetic
ctcattgaaccggcaagattttacccaagaccccagcaaatttacagaaccggtaaaggatgtgatgattaagac

SEQ ID NO: 77526 - DNA, 75 bp, Artificial Sequence
  Synthetic
atgttgtccccttgtgtgtgggaaggctatccagttcatcgatagaaggactcaagtgaggtactccctggacat

SEQ ID NO: 77527 - DNA, 75 bp, Artificial Sequence
  Synthetic
cttgcccgctttaaattcacccactgtggaagaatgcggatacagtgatcgggtgcgctcgatcactttgggaaa

SEQ ID NO: 77528 - DNA, 75 bp, Artificial Sequence
  Synthetic
cccaccagtgtatagggagatcaagattagtgttgcgcctgaaatcccaccaccaccagcgatcgcagacctact

SEQ ID NO: 77529 - DNA, 75 bp, Artificial Sequence
  Synthetic
atgggagagttcatcagccgggtggtggtggaagttcccagaggccctcagcgacatggggctatttggccaaaa

SEQ ID NO: 77530 - DNA, 75 bp, Artificial Sequence
  Synthetic
tggtggaagttcccagaggccctcagcgacatggggctatttggccaaaatatgcaatatcactacttgggaagg

SEQ ID NO: 77531 - DNA, 75 bp, Artificial Sequence
  Synthetic
agggcgttcatatgtctccaagcactaacaacctttgtttctgtggccgggatcatatacattatctacaaacta

SEQ ID NO: 77532 - DNA, 75 bp, Artificial Sequence
  Synthetic
ggtgcctacattaagacaagccaaggtacaaggtcccgctttcgaatttgctgtggctatgatgaaaagaaattc

SEQ ID NO: 77533 - DNA, 75 bp, Artificial Sequence
  Synthetic
gaagctgagatgggagcagccactactgatcatgctatgaaccatacaaaattgagcaacatcggccaagcaacg

SEQ ID NO: 77534 - DNA, 75 bp, Artificial Sequence
  Synthetic
gagtttagtgcagagaagagcacagatcaaacgggaccacaaactgcagtccacaacgcaggcatgggcgtagct

SEQ ID NO: 77535 - DNA, 75 bp, Artificial Sequence
  Synthetic
tatataaatagtgtgcccatggacaacatgtacaggcattacaactttactttaatggtaatcccttttgctaag

SEQ ID NO: 77536 - DNA, 75 bp, Artificial Sequence
  Synthetic
cgtacgtaccaatcactgtcactgtggcacccatgtgcgccgaatataatgggctgcgcttagctggtcatcaag

SEQ ID NO: 77537 - DNA, 75 bp, Artificial Sequence
  Synthetic
cacagtttgatgtcaccccggaaattcaaatcccaggtcaagtgaggaatttaatggaaatagccgaggtggatt

SEQ ID NO: 77538 - DNA, 75 bp, Artificial Sequence
  Synthetic
tggtcaccaaggtttctcagcagccctcctcaagcactactttaacgacgagcaaggtgagatagagttcatcga

SEQ ID NO: 77539 - DNA, 75 bp, Artificial Sequence
  Synthetic
ggaacacgtgaactcaatggaggcgtatagaataccagtaaggccacaaaccagtagcggtgaacaagttttcgg

SEQ ID NO: 77540 - DNA, 75 bp, Artificial Sequence
  Synthetic
gcagtgctcagaaatggtgatccgcgactcaaagccaactttgaggaggcaatcttctcgaagtacatcggcaat

SEQ ID NO: 77541 - DNA, 75 bp, Artificial Sequence
  Synthetic
ctggtcagggagcatgaagctaaccttcatgtactgtggcgcagcgatggcaactggtaaattccttatagctta

SEQ ID NO: 77542 - DNA, 75 bp, Artificial Sequence
  Synthetic
caccagacataccaactacaagcaccatactatgttttgtgtccgcgtgcaacgatttctctgtgaggctgctgc

SEQ ID NO: 77543 - DNA, 75 bp, Artificial Sequence
  Synthetic
gcctgtcaacactgagcaaattcctgccttaacagcagtagagacagggcacacgtcacaagtggtgccgagtga

SEQ ID NO: 77544 - DNA, 75 bp, Artificial Sequence
  Synthetic
ggcgtgcgtgtacattgctcagtatgccacagagaaagtcaacgacgagttagacagatacaccaactgggagat

SEQ ID NO: 77545 - DNA, 75 bp, Artificial Sequence
  Synthetic
gtacgtgccgccaggaggtccaatccctaaaagttatgaagattttgcatggcagacttccaccaacccaagtgt

SEQ ID NO: 77546 - DNA, 75 bp, Artificial Sequence
  Synthetic
cccaggatgtcgataccattcatgagtgttggcaacgcatattgcaacttctatgatggatggtctcatttcagc

SEQ ID NO: 77547 - DNA, 75 bp, Artificial Sequence
  Synthetic
gtgttggcaacgcatattgcaacttctatgatggatggtctcatttcagccagagcggtgtgtacgggtacacca

SEQ ID NO: 77548 - DNA, 75 bp, Artificial Sequence
  Synthetic
gcgtctacttcaagcccaaacacgtgaaggcatgggtgccccgtgcaccacgcttgtgcccgtatctgtatgcaa

SEQ ID NO: 77549 - DNA, 75 bp, Artificial Sequence
  Synthetic
cgatccttgtgcttattggcttggcacaatggagaacacgaatatgaggagttcattaagaagatcagaagtgtc

SEQ ID NO: 77550 - DNA, 75 bp, Artificial Sequence
  Synthetic
gaaggcatgggtgccccgtgcaccacgcttgtgcccgtatctgtatgcaagaaatgtcaatttcaatgtgcaagg

SEQ ID NO: 77551 - DNA, 75 bp, Artificial Sequence
  Synthetic
tcaacaatcaggagcagtgtatgtggggaactacagggtggtgaataggcatttggccacgcacgtggattggca

SEQ ID NO: 77552 - DNA, 75 bp, Artificial Sequence
  Synthetic
gggaactacagggtggtgaataggcatttggccacgcacgtggattggcagaactgtgtgtgggaagactataat

SEQ ID NO: 77553 - DNA, 75 bp, Artificial Sequence
  Synthetic
acccacagggcccattgggcgctagcacactggtattacggtacctttgtgcgcctgttttatccaccccctccc

SEQ ID NO: 77554 - DNA, 75 bp, Artificial Sequence
  Synthetic
tacttttgccagtctaggaacaaacactacccagttagctttgaagggccaggcctggtagaagtgcaggagagc

SEQ ID NO: 77555 - DNA, 75 bp, Artificial Sequence
  Synthetic
actacccagttagctttgaagggccaggcctggtagaagtgcaggagagcgagtattacccaaagagataccaat

SEQ ID NO: 77556 - DNA, 75 bp, Artificial Sequence
  Synthetic
tcggactcgtaaccatggggggtgaaggcgtcgtcggttttgccgacatgcgtgaccttctatggctggaggacg

SEQ ID NO: 77557 - DNA, 75 bp, Artificial Sequence
  Synthetic
aggcgtcgtcggttttgccgacatgcgtgaccttctatggctggaggacgacgcaatggagcaaggtgtcaaaga

SEQ ID NO: 77558 - DNA, 75 bp, Artificial Sequence
  Synthetic
agagtcgctggtcggccaggactccatcttggaaaagtcacttaaggccctggttaagatcatatcagcccttgt

SEQ ID NO: 77559 - DNA, 75 bp, Artificial Sequence
  Synthetic
atcttggaaaagtcacttaaggccctggttaagatcatatcagcccttgtcatcgtggtgaggaaccatgatgat

SEQ ID NO: 77560 - DNA, 75 bp, Artificial Sequence
  Synthetic
tcccagtattacgggatccctatggctgaaaggcaaagcaatgggtggctaaagaagttcacagaaatgaccaat

SEQ ID NO: 77561 - DNA, 75 bp, Artificial Sequence
  Synthetic
ctgaaaggcaaagcaatgggtggctaaagaagttcacagaaatgaccaatgcatgcaagggcatggagtggatag

SEQ ID NO: 77562 - DNA, 75 bp, Artificial Sequence
  Synthetic
tgaacagactgaagcaactgcccctattggaaagccagatcgccaccattgagcaaagtgccccctcacagagcg

SEQ ID NO: 77563 - DNA, 75 bp, Artificial Sequence
  Synthetic
gaagaaaatgagtaattacatacagttcaagtccaaatgccgtattgaacctgtctgtctattgctccacgggag

SEQ ID NO: 77564 - DNA, 75 bp, Artificial Sequence
  Synthetic
ctcattaccaccagaccccgatcactttgacggttataaacagcaggccgtcgtgatcatggatgacttgtgtca

SEQ ID NO: 77565 - DNA, 75 bp, Artificial Sequence
  Synthetic
tttgacggttataaacagcaggccgtcgtgatcatggatgacttgtgtcaaaacccagacggaaaggacgtgtcc

SEQ ID NO: 77566 - DNA, 75 bp, Artificial Sequence
  Synthetic
acatcaccattcgtactcgcttcgaccaacgcgggatcaatcaacgccccaactgtgtcagacagtagagcgctt

SEQ ID NO: 77567 - DNA, 75 bp, Artificial Sequence
  Synthetic
ccaacgcgggatcaatcaacgccccaactgtgtcagacagtagagcgcttgctaggaggttccacttcgacatga

SEQ ID NO: 77568 - DNA, 75 bp, Artificial Sequence
  Synthetic
agtgctgccccgttaactttaggaggtgctgcccactagtgtgtggcaaagctattcagttcattgatagaagaa

SEQ ID NO: 77569 - DNA, 75 bp, Artificial Sequence
  Synthetic
gtgctgcccactagtgtgtggcaaagctattcagttcattgatagaagaacccagatgaggtactcattggatat

SEQ ID NO: 77570 - DNA, 75 bp, Artificial Sequence
  Synthetic
cccaccagtgtatagagagatcaagattagtgttacaccggaaaccccccccccaccagccattgctgacttgtt

SEQ ID NO: 77571 - DNA, 75 bp, Artificial Sequence
  Synthetic
attagtgttacaccggaaaccccccccccaccagccattgctgacttgttaaaatcagtggatagtgaggctgtc

SEQ ID NO: 77572 - DNA, 75 bp, Artificial Sequence
  Synthetic
tcagcctgcaacgatttctcagtcaggatgctcaaggatacgccctttataaaacaggataatttctaccaaggg

SEQ ID NO: 77573 - DNA, 75 bp, Artificial Sequence
  Synthetic
agggctttcatttgcttgcaagcacttactacctttgtttctgtggcagggatcatctatatcatatacaagctg

SEQ ID NO: 77574 - DNA, 75 bp, Artificial Sequence
  Synthetic
ttactacctttgtttctgtggcagggatcatctatatcatatacaagctgtttgcaggtttccagggagcttaca

SEQ ID NO: 77575 - DNA, 75 bp, Artificial Sequence
  Synthetic
ctgtggccatgatgaggagaaatgccagtacagttaaaactgagtatggtgagttcacaatgcttggtatctatg

SEQ ID NO: 77576 - DNA, 75 bp, Artificial Sequence
  Synthetic
accacgtacaaaaatcatggtactgatggtgacaactttggttattgggtaatcagcacgcgccaggtggcacaa

SEQ ID NO: 77577 - DNA, 75 bp, Artificial Sequence
  Synthetic
cagtacagttaaaactgagtatggtgagttcacaatgcttggtatctatgatagatgggcagtattgccccggca

SEQ ID NO: 77578 - DNA, 75 bp, Artificial Sequence
  Synthetic
ggatggcaccaatctagatctaacattactgaaactcaacaggaacgaaaagttcagagacattcgtgggtttct

SEQ ID NO: 77579 - DNA, 75 bp, Artificial Sequence
  Synthetic
ttactgaaactcaacaggaacgaaaagttcagagacattcgtgggtttctggctcgagaggaggctgaggtcaat

SEQ ID NO: 77580 - DNA, 75 bp, Artificial Sequence
  Synthetic
gtgcccacgaaagtgaacagttacagctggcagacgtccaccaaccctagtgtgttctggacagaagggagtgca

SEQ ID NO: 77581 - DNA, 75 bp, Artificial Sequence
  Synthetic
tttctcaacctgggtggaacccccaccaagcgtatgctaatgtataactttcccacccgtgctgggcagtgtggt

SEQ ID NO: 77582 - DNA, 75 bp, Artificial Sequence
  Synthetic
ccaagcgtatgctaatgtataactttcccacccgtgctgggcagtgtggtggtgtcttaatgtcaacaggtaaag

SEQ ID NO: 77583 - DNA, 75 bp, Artificial Sequence
  Synthetic
aacagggcgaaattgagttcattgagagctcaaaggaagctggattcccagtaatcaacacccccagcaaaacaa

SEQ ID NO: 77584 - DNA, 75 bp, Artificial Sequence
  Synthetic
gagctcaaaggaagctggattcccagtaatcaacacccccagcaaaacaaagcttgaacccagtgtcttccatca

SEQ ID NO: 77585 - DNA, 75 bp, Artificial Sequence
  Synthetic
catcttctctaaatacattggaaatgtgaacacacatgtggatgagtacatgatggaggctgttgaccattatgc

SEQ ID NO: 77586 - DNA, 75 bp, Artificial Sequence
  Synthetic
gtgaacacacatgtggatgagtacatgatggaggctgttgaccattatgcagggcaactagcaaccttggacatc

SEQ ID NO: 77587 - DNA, 75 bp, Artificial Sequence
  Synthetic
gcagggtacccctatgttgcccttggcatcaagaacagagatattctgtctaagaagaccaaggacttaacaaaa

SEQ ID NO: 77588 - DNA, 75 bp, Artificial Sequence
  Synthetic
gcatcaagaacagagatattctgtctaagaagaccaaggacttaacaaaactgaaggagtgcatggacaagtatg

SEQ ID NO: 77589 - DNA, 75 bp, Artificial Sequence
  Synthetic
ggctaattgaggcctcgagcctcaatgactcagtagctatgaggcaaaccttcgggaacctgtacaaaacatttc

SEQ ID NO: 77590 - DNA, 75 bp, Artificial Sequence
  Synthetic
tgactcagtagctatgaggcaaaccttcgggaacctgtacaaaacatttcacctgaacccaggcatagtgacagg

SEQ ID NO: 77591 - DNA, 75 bp, Artificial Sequence
  Synthetic
tgattatagtggatatgatgctagtttaagcccagtgtggttcgcctgcctaaaattgttattggagaaattagg

SEQ ID NO: 77592 - DNA, 75 bp, Artificial Sequence
  Synthetic
ttaagcccagtgtggttcgcctgcctaaaattgttattggagaaattaggatattcacacaaggaaaccaactac

SEQ ID NO: 77593 - DNA, 75 bp, Artificial Sequence
  Synthetic
tgttcaggaaccagcatctttaactccatgatcaataacataattattagaacattaatgttgaaggtgtataag

SEQ ID NO: 77594 - DNA, 75 bp, Artificial Sequence
  Synthetic
ccatgatcaataacataattattagaacattaatgttgaaggtgtataaggggatagatctggatcagttcagga

SEQ ID NO: 77595 - DNA, 75 bp, Artificial Sequence
  Synthetic
tcattggctgagaagcttaacagctcagtatattccttgccacctgatccagatcactttgatggctacaaacaa

SEQ ID NO: 77596 - DNA, 75 bp, Artificial Sequence
  Synthetic
aggggtacggtctgatcatgacaccagctgataagggggagtgctttaacgaagtgacatggaccaacgtcactt

SEQ ID NO: 77597 - DNA, 75 bp, Artificial Sequence
  Synthetic
gaagtgacatggaccaacgtcacttttctgaaaaggtactttagagcagatgaacaatacccctttctagttcac

SEQ ID NO: 77598 - DNA, 75 bp, Artificial Sequence
  Synthetic
tgtacagccaaaatggcaaaattaacatgcctatgtcagtcaaaacatgcgacgaagaatgctgtccagttaact

SEQ ID NO: 77599 - DNA, 75 bp, Artificial Sequence
  Synthetic
ctgcattctcaactttacgcaggaagtggctggactctttctaaattagagcacaatttggtataattgccgatt

SEQ ID NO: 77600 - DNA, 75 bp, Artificial Sequence
  Synthetic
acagtaatttagaagcacgaacaatgtggtcaacaggaagctcagtacaccaactgggtctcgaccaagcacttc

SEQ ID NO: 77601 - DNA, 75 bp, Artificial Sequence
  Synthetic
aagggatggctcgttcctgagattagctctacccttcagattgagaagcatgtcagccgagccttcatctgtctc

SEQ ID NO: 77602 - DNA, 75 bp, Artificial Sequence
  Synthetic
gcctacacagggatgcccaaccaaaagccaaaagtgcccacactaaggcaagccaaagtgcaaggccccgctttt

SEQ ID NO: 77603 - DNA, 75 bp, Artificial Sequence
  Synthetic
aatgatgaacagggcgagattgaattcattgaaagctcaaaggaagcaggtttcccagtcatcaacacaccgagc

SEQ ID NO: 77604 - DNA, 75 bp, Artificial Sequence
  Synthetic
tttcccagtcatcaacacaccgagcaggaccaaattggaaccaagcgtgttccaccaagtgtttgagggcaacaa

SEQ ID NO: 77605 - DNA, 75 bp, Artificial Sequence
  Synthetic
caggttggtggtggaagctacccgacgccttgtctaatttggggttgtttggccagaacatgcagtatcactact

SEQ ID NO: 77606 - DNA, 75 bp, Artificial Sequence
  Synthetic
cgccttgtctaatttggggttgtttggccagaacatgcagtatcactactggtcggactggtacaccatacacgt

SEQ ID NO: 77607 - DNA, 75 bp, Artificial Sequence
  Synthetic
caccagtgcaggatacccgtacgttgcattaggcatcaaaaagagagacatattgtccaagaagaccaaggactt

SEQ ID NO: 77608 - DNA, 75 bp, Artificial Sequence
  Synthetic
gccaatggacaatatgttcagacacaataatgtcacattgatggtgattccatttgtgccccttgattattgtcc

SEQ ID NO: 77609 - DNA, 75 bp, Artificial Sequence
  Synthetic
actgtcacaatagcacccatgtgtgccgagtacaacgggcttcgcttggcgggccaccaaggtcttccaacaatg

SEQ ID NO: 77610 - DNA, 75 bp, Artificial Sequence
  Synthetic
gcctgtttaaagctgctacttgaaaaactcggctatacacacaaggagactaattacatcgattatctatgcaac

SEQ ID NO: 77611 - DNA, 75 bp, Artificial Sequence
  Synthetic
gggccaccaaggtcttccaacaatgaacacaccaggaagctgccaatttctaacatcagatgatttccaatcccc

SEQ ID NO: 77612 - DNA, 75 bp, Artificial Sequence
  Synthetic
actccagagatgaagatacccggtgaggtgaagaatctaatggagatagcggaagtcgactcagtagtgccggtg

SEQ ID NO: 77613 - DNA, 75 bp, Artificial Sequence
  Synthetic
taggtccaatgaggggtctggcacccaagtgtttggtttcccactacagccagggtactcgagtgttttcagtcg

SEQ ID NO: 77614 - DNA, 75 bp, Artificial Sequence
  Synthetic
gtcaccttcttaaagaggtactttagagcagatgatcaataccctttcttggtacacccagtcatgcccatgaag

SEQ ID NO: 77615 - DNA, 75 bp, Artificial Sequence
  Synthetic
aaattggcttaaccctaccgcacttaccgaactagacaatggtgtggtaggggtaaattctccgcattcggtgcg

SEQ ID NO: 77616 - DNA, 75 bp, Artificial Sequence
  Synthetic
acccacagggcccaccgggcgctagcacactggtatcacggtacctttgtgcgcctgttttatacaccctttccc

SEQ ID NO: 77617 - DNA, 75 bp, Artificial Sequence
  Synthetic
aggccataccagcgctcaccgcagccgagacggggcacacatcccaggtggttccaggagataccatgcaaacgc

SEQ ID NO: 77618 - DNA, 75 bp, Artificial Sequence
  Synthetic
tgttaccccggactgagtatcaataggctgctcacgcggctgaaggagaaaacgttcgttacccggccaattact

SEQ ID NO: 77619 - DNA, 75 bp, Artificial Sequence
  Synthetic
acaacacgacaagcggcacagctgaggaggaagttggaattcttcacgtacataaggttcgacttagagctcact

SEQ ID NO: 77620 - DNA, 75 bp, Artificial Sequence
  Synthetic
tcagatcctcacccatcagatcatgtatgtgccaccagggggtccagtaccagataaagtggattcatatgtatg

SEQ ID NO: 77621 - DNA, 75 bp, Artificial Sequence
  Synthetic
gcaaacatccacgaatccaagtgtgttctggacagagggtaatgcaccaccacgcatgtccatacctttcctgag

SEQ ID NO: 77622 - DNA, 75 bp, Artificial Sequence
  Synthetic
ttatactggctgcttatggtgacaattgagagattgttgccatatagctattggattggccatccggtgacaaat

SEQ ID NO: 77623 - DNA, 75 bp, Artificial Sequence
  Synthetic
cacgcatgtccatacctttcctgagcattggtaacgcttattcaaatttttatgatggttggtcagaattctcca

SEQ ID NO: 77624 - DNA, 75 bp, Artificial Sequence
  Synthetic
gcacttaatacagcaagatgggagcacaagtgtcaacgcagaaaactggcgcacacgaaactgggttaagagcca

SEQ ID NO: 77625 - DNA, 75 bp, Artificial Sequence
  Synthetic
acaagtgtcaacgcagaaaactggcgcacacgaaactgggttaagagccagtggaaactccatcatccactacac

SEQ ID NO: 77626 - DNA, 75 bp, Artificial Sequence
  Synthetic
cacggagccagtaaaagacataatggtgaagtcgctgcccgcactgaattcaccatcagctgaagagtgtgggta

SEQ ID NO: 77627 - DNA, 75 bp, Artificial Sequence
  Synthetic
gtgaagtcgctgcccgcactgaattcaccatcagctgaagagtgtgggtatagtgatagggtgcgatctataaca

SEQ ID NO: 77628 - DNA, 75 bp, Artificial Sequence
  Synthetic
cgggcaacaatctggagcagtgtatgtggggaattacagggtggtgaacagacacttagcgacacacactgattg

SEQ ID NO: 77629 - DNA, 75 bp, Artificial Sequence
  Synthetic
agagacgacgaagccaccgctgaggatcaaccaacccaacctgacgtggccacgtgcaggttttacactctagag

SEQ ID NO: 77630 - DNA, 75 bp, Artificial Sequence
  Synthetic
atcaaccaacccaacctgacgtggccacgtgcaggttttacactctagagtcagtcacttgggagaaggattcac

SEQ ID NO: 77631 - DNA, 75 bp, Artificial Sequence
  Synthetic
taggaagagctggttataccatacatgtgcagtgcaacgcttctaagttccatcaaggttgcctgttggtggtgt

SEQ ID NO: 77632 - DNA, 75 bp, Artificial Sequence
  Synthetic
tgtgcagtgcaacgcttctaagttccatcaaggttgcctgttggtggtgtgcgttccagaggcagaaatggggtg

SEQ ID NO: 77633 - DNA, 75 bp, Artificial Sequence
  Synthetic
atgatgcaatggagcagggagtcaaggattacgtggaacaactgggaaatgcttttggttcagggtttaccaacc

SEQ ID NO: 77634 - DNA, 75 bp, Artificial Sequence
  Synthetic
cacgaatggtactaacacagtgcagtcaattgtgacaaatgccggcatgggtgtgggagtgggcaatctcacgat

SEQ ID NO: 77635 - DNA, 75 bp, Artificial Sequence
  Synthetic
tcaattgtgacaaatgccggcatgggtgtgggagtgggcaatctcacgattttcccacaccagtggataaacttg

SEQ ID NO: 77636 - DNA, 75 bp, Artificial Sequence
  Synthetic
aacttcacgctaatgataataccgttcgttccattgaactactcatctgattcatccacatatgtaccaataaca

SEQ ID NO: 77637 - DNA, 75 bp, Artificial Sequence
  Synthetic
tcgttccattgaactactcatctgattcatccacatatgtaccaataacagtgacagtggcacctatgtgtgcag

SEQ ID NO: 77638 - DNA, 75 bp, Artificial Sequence
  Synthetic
tggctgagcgccaaaacaatgggtggctcaagaaatttacagagatgactaatgcatgcaaagggatggagtgga

SEQ ID NO: 77639 - DNA, 75 bp, Artificial Sequence
  Synthetic
tgacgtcggatgactttcaatccccatctgccatgccacaatttgacgtcacaccagagctgaacatcccgggtg

SEQ ID NO: 77640 - DNA, 75 bp, Artificial Sequence
  Synthetic
agaatggctcaaggttaagatcctaccagaggtgaaggagaaacatgaattcctaaccagacttaaacaactccc

SEQ ID NO: 77641 - DNA, 75 bp, Artificial Sequence
  Synthetic
atctgccatgccacaatttgacgtcacaccagagctgaacatcccgggtgaagtacaaaatttgatggaaatagc

SEQ ID NO: 77642 - DNA, 75 bp, Artificial Sequence
  Synthetic
tgttcaatactttgcccactactgcagaaaatatgcacctctgtatgctactgaggccaaaagagtgttctccct

SEQ ID NO: 77643 - DNA, 75 bp, Artificial Sequence
  Synthetic
gcagagtggcaaccatcagagttcacaggtcttcggcttccaagtgcaacctggactggacggtgtcttcaaaca

SEQ ID NO: 77644 - DNA, 75 bp, Artificial Sequence
  Synthetic
caggtcttcggcttccaagtgcaacctggactggacggtgtcttcaaacacacattgttgggggagatcttgaat

SEQ ID NO: 77645 - DNA, 75 bp, Artificial Sequence
  Synthetic
tgagaagaaaatgagtaattacatacagttcaagtccaaatgccgtattgaaccagtatgtttgctgttgcacgg

SEQ ID NO: 77646 - DNA, 75 bp, Artificial Sequence
  Synthetic
ttgctagcgtacgcaccacctggagcaaacgccccaaagagcaggaaagatgcaatgttgggtactcacattatt

SEQ ID NO: 77647 - DNA, 75 bp, Artificial Sequence
  Synthetic
caaacgccccaaagagcaggaaagatgcaatgttgggtactcacattatttgggacgttggactgcaatcatcat

SEQ ID NO: 77648 - DNA, 75 bp, Artificial Sequence
  Synthetic
gtgttgactttgttccaccaatggctgctttggaagagaaaggaattttgtttacctctccctttgtcttggctt

SEQ ID NO: 77649 - DNA, 75 bp, Artificial Sequence
  Synthetic
acgttacttgctggtaccagactgggatagtcgtcccagcgggaactccaacatcgtgctctattatgtgctttg

SEQ ID NO: 77650 - DNA, 75 bp, Artificial Sequence
  Synthetic
gatagtcgtcccagcgggaactccaacatcgtgctctattatgtgctttgtatcagcatgcaacgacttctcagt

SEQ ID NO: 77651 - DNA, 75 bp, Artificial Sequence
  Synthetic
cgcagttgcgagggtagcggacacaattggaagtggtccatcaaactcgcaagcagttcccgccttgacagcagt

SEQ ID NO: 77652 - DNA, 75 bp, Artificial Sequence
  Synthetic
attggaagtggtccatcaaactcgcaagcagttcccgccttgacagcagtagaaactgggcacacatcccaggtg

SEQ ID NO: 77653 - DNA, 75 bp, Artificial Sequence
  Synthetic
cttagccgctcagcatgtgtgtacatgggagagtaccatacgactaatagtgaccaaaccaaactgtttgcatcg

SEQ ID NO: 77654 - DNA, 75 bp, Artificial Sequence
  Synthetic
tgggagagtaccatacgactaatagtgaccaaaccaaactgtttgcatcgtggaccataagcgcacggcgcatgg

SEQ ID NO: 77655 - DNA, 75 bp, Artificial Sequence
  Synthetic
actgaaatcagtagatagcgaagcagttagagagtattgtaaagagaagggatggctcgttcctgagattagctc

SEQ ID NO: 77656 - DNA, 75 bp, Artificial Sequence
  Synthetic
aacaagatcaaggcacccagctgggacaagatatgccaccactgacacaccagataatgtatattccccctggag

SEQ ID NO: 77657 - DNA, 75 bp, Artificial Sequence
  Synthetic
acaagatatgccaccactgacacaccagataatgtatattccccctggagggcccatccccaagtcagtaactga

SEQ ID NO: 77658 - DNA, 75 bp, Artificial Sequence
  Synthetic
attcattagcattggcaacgcctacagcaacttttacgatgggtggtcccatttctctcaaaatggcgtgtatgg

SEQ ID NO: 77659 - DNA, 75 bp, Artificial Sequence
  Synthetic
agcaacttttacgatgggtggtcccatttctctcaaaatggcgtgtatggatacaacacactaaatcacatgggc

SEQ ID NO: 77660 - DNA, 75 bp, Artificial Sequence
  Synthetic
ccatgcaaaacccgggccaaccatccttatgaatgaccaggaagttggcgtactagatgcaaaagaactggtgga

SEQ ID NO: 77661 - DNA, 75 bp, Artificial Sequence
  Synthetic
aaacacgtaaaggcatgggtccctagaccacccaggttgtgccaatacaagaacgcatccacagtgaacttctca

SEQ ID NO: 77662 - DNA, 75 bp, Artificial Sequence
  Synthetic
tactagatgcaaaagaactggtggataaagatggcacaaaccttgaactgacgctgttgaaacttaatcggaatg

SEQ ID NO: 77663 - DNA, 75 bp, Artificial Sequence
  Synthetic
gaccacccaggttgtgccaatacaagaacgcatccacagtgaacttctcacccacagacatcactgacaaaagaa

SEQ ID NO: 77664 - DNA, 75 bp, Artificial Sequence
  Synthetic
agaagttcagagacatcagaggcttcctggccaaagaagaggtggaggttaatgaagctgttctggcaataaaca

SEQ ID NO: 77665 - DNA, 75 bp, Artificial Sequence
  Synthetic
cggtgtacgtgggcaactacagggtagtaaacaggcatctggccacgcacaatgactggcaaaattgtgtgtggg

SEQ ID NO: 77666 - DNA, 75 bp, Artificial Sequence
  Synthetic
agtaaacaggcatctggccacgcacaatgactggcaaaattgtgtgtgggaagattacaacagagacctccttgt

SEQ ID NO: 77667 - DNA, 75 bp, Artificial Sequence
  Synthetic
cagaaacaagcactatccagtcagctttgaaggcccaggattagtggaggttcaggaaagtgagtattaccccaa

SEQ ID NO: 77668 - DNA, 75 bp, Artificial Sequence
  Synthetic
tttgaaggcccaggattagtggaggttcaggaaagtgagtattaccccaaaagataccagtcccatgtgctcctt

SEQ ID NO: 77669 - DNA, 75 bp, Artificial Sequence
  Synthetic
atgggaggtgagggcgtcgttggctttgctgacgtgcgcgaccttctatggttggaagatgatgcaatggaacag

SEQ ID NO: 77670 - DNA, 75 bp, Artificial Sequence
  Synthetic
ttgctgacgtgcgcgaccttctatggttggaagatgatgcaatggaacagggtgtcaaagactacgtggaacagc

SEQ ID NO: 77671 - DNA, 75 bp, Artificial Sequence
  Synthetic
ggcaagactccattttagagaaatccctcaaggccttggtgagaattatatcagccctcgttattgtagtgagga

SEQ ID NO: 77672 - DNA, 75 bp, Artificial Sequence
  Synthetic
cctcaaggccttggtgagaattatatcagccctcgttattgtagtgaggaaccacgatgacctcatcacagtgac

SEQ ID NO: 77673 - DNA, 75 bp, Artificial Sequence
  Synthetic
aaactgaaggagtgcatggacaaatacggtttgaacctgccaatggtgacatacgtgaaggatgagctcagatcc

SEQ ID NO: 77674 - DNA, 75 bp, Artificial Sequence
  Synthetic
acggtttgaacctgccaatggtgacatacgtgaaggatgagctcagatccgcagagaaagtggccaagggaaaat

SEQ ID NO: 77675 - DNA, 75 bp, Artificial Sequence
  Synthetic
aattcccatggctgagagacaaagcaatggctggctcaagaagtttacagaaatgactaatgcctgcaagggcat

SEQ ID NO: 77676 - DNA, 75 bp, Artificial Sequence
  Synthetic
aatggctggctcaagaagtttacagaaatgactaatgcctgcaagggcatggagtggatagccatcaagattcaa

SEQ ID NO: 77677 - DNA, 75 bp, Artificial Sequence
  Synthetic
tccatctaaacccggggattgtgacgggcagtgcagtcggttgtgatcccgatctgttctggagcaaaatacccg

SEQ ID NO: 77678 - DNA, 75 bp, Artificial Sequence
  Synthetic
cagctacctttactggaaagtcagatcgctaccatcgaacaaagtgcgccttcgcagagcgatcaggaacaactg

SEQ ID NO: 77679 - DNA, 75 bp, Artificial Sequence
  Synthetic
ggatgattgcatatggtgacgatgtgatagcatcctacccctggccgatcgacgcctccctgttggctgaagctg

SEQ ID NO: 77680 - DNA, 75 bp, Artificial Sequence
  Synthetic
accccgaccattttgacggatacaaacaacaggctgtcgtgatcatggacgatctgtgccaaaatccagatggaa

SEQ ID NO: 77681 - DNA, 75 bp, Artificial Sequence
  Synthetic
acaacaggctgtcgtgatcatggacgatctgtgccaaaatccagatggaaaagacgtgtccctattctgccagat

SEQ ID NO: 77682 - DNA, 75 bp, Artificial Sequence
  Synthetic
acccgcggataaaggggaatgcttcaacgaagtcacctgggccaacgtcacctttttaaagaggtacttcagagc

SEQ ID NO: 77683 - DNA, 75 bp, Artificial Sequence
  Synthetic
cctcgcttcaaccaacgcaggatcgatcaatgctcctaccgtgtcagacagcagagcgcttgctaggaggttcca

SEQ ID NO: 77684 - DNA, 75 bp, Artificial Sequence
  Synthetic
atcaatgctcctaccgtgtcagacagcagagcgcttgctaggaggttccattttgacatgaacatcgaagtcatt

SEQ ID NO: 77685 - DNA, 75 bp, Artificial Sequence
  Synthetic
gtgcgatctttgtgcctattggcttggcacaatggagagcatgaatacggagagtttatccaaaagatcagaagc

SEQ ID NO: 77686 - DNA, 75 bp, Artificial Sequence
  Synthetic
agagtttatccaaaagatcagaagcgtcccagtcgggcgctgtctgactttgcctgcgttttcgactttgcgcag

SEQ ID NO: 77687 - DNA, 75 bp, Artificial Sequence
  Synthetic
aacttcaaaaagtgttgcccactagtgtgtggtaaagctatccagtttatcgacagaagaacacaggtgaggtac

SEQ ID NO: 77688 - DNA, 75 bp, Artificial Sequence
  Synthetic
tgtgtggtaaagctatccagtttatcgacagaagaacacaggtgaggtactcactagacatgcttgtgactgaga

SEQ ID NO: 77689 - DNA, 75 bp, Artificial Sequence
  Synthetic
ttaaaacagcctgtgggttgcacccacccacagggcccattgggcgctagcaccctggtattacggtacctttgt

SEQ ID NO: 77690 - DNA, 75 bp, Artificial Sequence
  Synthetic
caccctggtattacggtacctttgtgcgcctgttttatacccccatccccaatcgaaacttagaagcattacaca

SEQ ID NO: 77691 - DNA, 75 bp, Artificial Sequence
  Synthetic
gcgcctgttttatacccccatccccaatcgaaacttagaagcattacacactgatcaataggaggcgcggcacgc

SEQ ID NO: 77692 - DNA, 75 bp, Artificial Sequence
  Synthetic
gagagatcaaaattagtgttgcaccagaaaccccccccccaccagcaattgctgatctgttaaaatcagtggata

SEQ ID NO: 77693 - DNA, 75 bp, Artificial Sequence
  Synthetic
agaaaccccccccccaccagcaattgctgatctgttaaaatcagtggatagtgaagcggtcagggagtattgcaa

SEQ ID NO: 77694 - DNA, 75 bp, Artificial Sequence
  Synthetic
tctacaagcacttaccacatttgtctcagttgcaggaataatatacatcatctacaaattgtttgctggcttcca

SEQ ID NO: 77695 - DNA, 75 bp, Artificial Sequence
  Synthetic
tcagttgcaggaataatatacatcatctacaaattgtttgctggcttccaaggtgcctataccgggatgcctaat

SEQ ID NO: 77696 - DNA, 75 bp, Artificial Sequence
  Synthetic
gtctattgagctagttggtgatcctccggcccctgaatgcggctaatcctaactgcggagcacacgctcacaagc

SEQ ID NO: 77697 - DNA, 75 bp, Artificial Sequence
  Synthetic
aagagaaatgcaagcaccgtaaaaaccgagtacggtgagttcacaatgcttggaatttacgatagatgggcagta

SEQ ID NO: 77698 - DNA, 75 bp, Artificial Sequence
  Synthetic
ccgagtacggtgagttcacaatgcttggaatttacgatagatgggcagtagtacctcgacatgccaaacctggac

SEQ ID NO: 77699 - DNA, 75 bp, Artificial Sequence
  Synthetic
tcattttggctgcttatggtgacaattaagaaattgttaccatatagctattggattggccatccggtgactagt

SEQ ID NO: 77700 - DNA, 75 bp, Artificial Sequence
  Synthetic
ttaagaaattgttaccatatagctattggattggccatccggtgactagtagagctattatatacttgtttgttg

SEQ ID NO: 77701 - DNA, 75 bp, Artificial Sequence
  Synthetic
tggaactgacactcctgaaactcaacagaaatgagaagttcagggatatccggggtttcttggcacgagaggaag

SEQ ID NO: 77702 - DNA, 75 bp, Artificial Sequence
  Synthetic
cagaaatgagaagttcagggatatccggggtttcttggcacgagaggaagctgaagtcaacgaagctgtacttgc

SEQ ID NO: 77703 - DNA, 75 bp, Artificial Sequence
  Synthetic
tcaagtttcaacacagaaaacaggagctcatgagactgggttgaacgcaagtgggggctcagttatccactacac

SEQ ID NO: 77704 - DNA, 75 bp, Artificial Sequence
  Synthetic
gctcatgagactgggttgaacgcaagtgggggctcagttatccactacacgaacatcaactattacaaggatgca

SEQ ID NO: 77705 - DNA, 75 bp, Artificial Sequence
  Synthetic
cggcaccccgactaagcgcatgctaatgtacaacttccctactcgtgcgggacagtgtggtggtgttttaatgtc

SEQ ID NO: 77706 - DNA, 75 bp, Artificial Sequence
  Synthetic
atgtacaacttccctactcgtgcgggacagtgtggtggtgttttaatgtcaacaggtaaggttctcgggatacac

SEQ ID NO: 77707 - DNA, 75 bp, Artificial Sequence
  Synthetic
attaaatccttaccagcattgaactcccccactgtggaggagtgtggatacagcgaccgcgttagatccataact

SEQ ID NO: 77708 - DNA, 75 bp, Artificial Sequence
  Synthetic
cccccactgtggaggagtgtggatacagcgaccgcgttagatccataactctagggaattccaccatcaccaccc

SEQ ID NO: 77709 - DNA, 75 bp, Artificial Sequence
  Synthetic
gagttcatcgaaagctccaaggaagccggtttcccagtcatcaacactcccagcaagacaaagctcgagcctagt

SEQ ID NO: 77710 - DNA, 75 bp, Artificial Sequence
  Synthetic
atcaacccacccaacctgatgtagcaacctgcaggttttataccctagactcagttgagtggcaaaagaactcac

SEQ ID NO: 77711 - DNA, 75 bp, Artificial Sequence
  Synthetic
ttcgaggaagccatcttctccaaatacattggcaatgtgaatactcacatagatgaatacatgctggaagccgtt

SEQ ID NO: 77712 - DNA, 75 bp, Artificial Sequence
  Synthetic
aacctgcaggttttataccctagactcagttgagtggcaaaagaactcaccgggatggtggtggaaattccccga

SEQ ID NO: 77713 - DNA, 75 bp, Artificial Sequence
  Synthetic
acattggcaatgtgaatactcacatagatgaatacatgctggaagccgttgatcactatgcaggacaactggcga

SEQ ID NO: 77714 - DNA, 75 bp, Artificial Sequence
  Synthetic
cgttcaatgcaacgcatcgaagttccatcaagggtgcattcttgtggtgtgtgtgccggaggcagaaatggggtg

SEQ ID NO: 77715 - DNA, 75 bp, Artificial Sequence
  Synthetic
catcaagggtgcattcttgtggtgtgtgtgccggaggcagaaatggggtgcactcaaactgacaagaccgtaaac

SEQ ID NO: 77716 - DNA, 75 bp, Artificial Sequence
  Synthetic
taaccacaagtgctggatatccttatgttgcccttggtatcaagaagagagatattttatccaagaagaccaagg

SEQ ID NO: 77717 - DNA, 75 bp, Artificial Sequence
  Synthetic
gccgccgtgtggaatgcaggattgggcgttggcgtgggcaatctaacaatcttcccacaccaatggataaatcta

SEQ ID NO: 77718 - DNA, 75 bp, Artificial Sequence
  Synthetic
tgaggtcagcagagaaagtggccaaaggtaaatccaggctaattgaggcgtcaagtctaaatgactcagtagcta

SEQ ID NO: 77719 - DNA, 75 bp, Artificial Sequence
  Synthetic
gcgttggcgtgggcaatctaacaatcttcccacaccaatggataaatctacgcactaataatagtgcgaccatag

SEQ ID NO: 77720 - DNA, 75 bp, Artificial Sequence
  Synthetic
aggtaaatccaggctaattgaggcgtcaagtctaaatgactcagtagctatgagacagaccttcgggaatctgta

SEQ ID NO: 77721 - DNA, 75 bp, Artificial Sequence
  Synthetic
ttgtccctctcgactacagcgacggtgcctctagctatgttcccatcacagtcacggtggctcccatgtgcgcag

SEQ ID NO: 77722 - DNA, 75 bp, Artificial Sequence
  Synthetic
gatcccagtcatgcttgacggccatctcattgcttttgactacagtgggtatgatgccagcttgagcccggtttg

SEQ ID NO: 77723 - DNA, 75 bp, Artificial Sequence
  Synthetic
tgcctctagctatgttcccatcacagtcacggtggctcccatgtgcgcagaatacaacggtcttaggctggcggg

SEQ ID NO: 77724 - DNA, 75 bp, Artificial Sequence
  Synthetic
ctcattgcttttgactacagtgggtatgatgccagcttgagcccggtttggttcgcctgtctaaaactgctgctg

SEQ ID NO: 77725 - DNA, 75 bp, Artificial Sequence
  Synthetic
ggccatgccacaatttgacgtgactccggaaatgaacatcccaggtgaggtaaaaaatctaatggagatcgcaga

SEQ ID NO: 77726 - DNA, 75 bp, Artificial Sequence
  Synthetic
aagcactactttgtgagagggggcatgccatctggatgttctggtactagcattttcaattcaatgatcaacaac

SEQ ID NO: 77727 - DNA, 75 bp, Artificial Sequence
  Synthetic
ccggaaatgaacatcccaggtgaggtaaaaaatctaatggagatcgcagaagtggactctgtggttccggttaat

SEQ ID NO: 77728 - DNA, 75 bp, Artificial Sequence
  Synthetic
tgccatctggatgttctggtactagcattttcaattcaatgatcaacaacattattattaggacactcatgttga

SEQ ID NO: 77729 - DNA, 75 bp, Artificial Sequence
  Synthetic
gtctttggattcaaactagatccgggatcggatgctgttctaaacagaacattacttggtgaaattatgaactac

SEQ ID NO: 77730 - DNA, 75 bp, Artificial Sequence
  Synthetic
accccatcgacgcctcactgcttgctgaagctggaaagggatatggcctaatcatgacaccagctgataagggag

SEQ ID NO: 77731 - DNA, 75 bp, Artificial Sequence
  Synthetic
gatcggatgctgttctaaacagaacattacttggtgaaattatgaactactacacccactggtcaggaagcataa

SEQ ID NO: 77732 - DNA, 75 bp, Artificial Sequence
  Synthetic
tgaagctggaaagggatatggcctaatcatgacaccagctgataagggagattgttttaatgaggtgacatggac

SEQ ID NO: 77733 - DNA, 75 bp, Artificial Sequence
  Synthetic
gtgcacctactaaacgcaaggatgccatgctggggacgcatgtggtatgggatgtggggttacaatcaagttgtg

SEQ ID NO: 77734 - DNA, 75 bp, Artificial Sequence
  Synthetic
gaaagatattcatgagtcaatcaggtggactaaggatcccaaaaatacccaggaccatgttcgatccttgtgcct

SEQ ID NO: 77735 - DNA, 75 bp, Artificial Sequence
  Synthetic
catgctggggacgcatgtggtatgggatgtggggttacaatcaagttgtgttctgtgcattccatggataagcca

SEQ ID NO: 77736 - DNA, 75 bp, Artificial Sequence
  Synthetic
attggcctggcacaatggcgagcaagaatacgaagaatttgtgtccaaaatcaggagcgttccagtagggcgctg

SEQ ID NO: 77737 - DNA, 75 bp, Artificial Sequence
  Synthetic
ggtgtccccagccggaaatcagccaaagtgttacattatgtgttttgtgtcagcatgcaacgatttttcagtgcg

SEQ ID NO: 77738 - DNA, 75 bp, Artificial Sequence
  Synthetic
aagtgttacattatgtgttttgtgtcagcatgcaacgatttttcagtgcgcttgttacgcgacaccaaatttatc

SEQ ID NO: 77739 - DNA, 75 bp, Artificial Sequence
  Synthetic
tgtgcgcctgttttatctaccctaccccattgcaacttagaagttaaacaagcacggtcgttaggcggctcagta

SEQ ID NO: 77740 - DNA, 75 bp, Artificial Sequence
  Synthetic
ccaacaggtccctcaaataatgaagctatacccaatttaacagcagtggagactggccatacctcgcaagtgaca

SEQ ID NO: 77741 - DNA, 75 bp, Artificial Sequence
  Synthetic
ctatacccaatttaacagcagtggagactggccatacctcgcaagtgacaccaggcgacacaatgcaaacacgcc

SEQ ID NO: 77742 - DNA, 75 bp, Artificial Sequence
  Synthetic
cacaaccccagtgtagatcaggtcgatgagtcaccgcattcctcacgggcgaccgtggcggtggctgcgctggcg

SEQ ID NO: 77743 - DNA, 75 bp, Artificial Sequence
  Synthetic
ttgattaccaaacgggagaagggcccggcgatcagtattttggccagtggaccattaccacgaggagggttgcgc

SEQ ID NO: 77744 - DNA, 75 bp, Artificial Sequence
  Synthetic
cggcgatcagtattttggccagtggaccattaccacgaggagggttgcgcaattgcgtcgaaagctggagatgtt

SEQ ID NO: 77745 - DNA, 75 bp, Artificial Sequence
  Synthetic
agatacaccagttttgacgcaccaaattatgtatgtaccaccaggaggaccaatcccagcaaaagtcgatgatta

SEQ ID NO: 77746 - DNA, 75 bp, Artificial Sequence
  Synthetic
attatgtatgtaccaccaggaggaccaatcccagcaaaagtcgatgattacagttggcaaacatccacgaatccc

SEQ ID NO: 77747 - DNA, 75 bp, Artificial Sequence
  Synthetic
attgaaaggttgttaccatatagctattggattggccatccagtgtctaacagagcaattgtttacttgtttgtt

SEQ ID NO: 77748 - DNA, 75 bp, Artificial Sequence
  Synthetic
agcttttatgacgggtggtcgaacttctcacaaaacgggcggtatggctacaataccctcaacaacatgggacaa

SEQ ID NO: 77749 - DNA, 75 bp, Artificial Sequence
  Synthetic
cacaagtatcaactcaaaagactggtgcgcacgaaactggcttaaacgccagcgggaactccatcatacattaca

SEQ ID NO: 77750 - DNA, 75 bp, Artificial Sequence
  Synthetic
tctcacaaaacgggcggtatggctacaataccctcaacaacatgggacaattgttctttaggcacgttaacaaac

SEQ ID NO: 77751 - DNA, 75 bp, Artificial Sequence
  Synthetic
tgcgcacgaaactggcttaaacgccagcgggaactccatcatacattacaccaacattaattattacaaagatgc

SEQ ID NO: 77752 - DNA, 75 bp, Artificial Sequence
  Synthetic
caccgcggttgtgtccatacataaatgcgggagacgtgaacttcactccgacaccagtgactgaaaagcgaaagg

SEQ ID NO: 77753 - DNA, 75 bp, Artificial Sequence
  Synthetic
gattaagtcaatgcctgcattaaactcaccgtccgcagaggagtgtggctacagcgacagggttagatcactgac

SEQ ID NO: 77754 - DNA, 75 bp, Artificial Sequence
  Synthetic
tgcgggagacgtgaacttcactccgacaccagtgactgaaaagcgaaaggacctaataaccacgggcccttatgg

SEQ ID NO: 77755 - DNA, 75 bp, Artificial Sequence
  Synthetic
tcaccgtccgcagaggagtgtggctacagcgacagggttagatcactgacgctgggaaactcgaccatcaccacc

SEQ ID NO: 77756 - DNA, 75 bp, Artificial Sequence
  Synthetic
taactgtgtgtgggaagattataatagggacttgctcgtgagcactaccacggcacaagggtgtgatgttatcgc

SEQ ID NO: 77757 - DNA, 75 bp, Artificial Sequence
  Synthetic
gaccaaccaacgcaacctgacgtagccacgtgtagattctacacgctggagtccgttcagtgggaaaagaacagc

SEQ ID NO: 77758 - DNA, 75 bp, Artificial Sequence
  Synthetic
agggacttgctcgtgagcactaccacggcacaagggtgtgatgttatcgctaggtgtcaatgcacgactggggtg

SEQ ID NO: 77759 - DNA, 75 bp, Artificial Sequence
  Synthetic
ccacgtgtagattctacacgctggagtccgttcagtgggaaaagaacagcgctggctggtggtggaagttccccg

SEQ ID NO: 77760 - DNA, 75 bp, Artificial Sequence
  Synthetic
gagtattatcccaggagataccaatcccacgttcttctcgcagcaggtttctccgagcctggtgactgtggtggg

SEQ ID NO: 77761 - DNA, 75 bp, Artificial Sequence
  Synthetic
atgttcagtgtaatgcatccaaattccaccagggatgcttgctagttgtctgtgtgcccgaagctgaaatgggtt

SEQ ID NO: 77762 - DNA, 75 bp, Artificial Sequence
  Synthetic
cccacgttcttctcgcagcaggtttctccgagcctggtgactgtggtgggattctgaggtgcgagcacggtgtca

SEQ ID NO: 77763 - DNA, 75 bp, Artificial Sequence
  Synthetic
ccaccagggatgcttgctagttgtctgtgtgcccgaagctgaaatgggttgctcacagacagacaaggaagtcgc

SEQ ID NO: 77764 - DNA, 75 bp, Artificial Sequence
  Synthetic
acgcgatggaacagggagttaaggactatgtggagcaacttggaaatgcctttggatcaggattcactaaccaaa

SEQ ID NO: 77765 - DNA, 75 bp, Artificial Sequence
  Synthetic
atcaatagtgtgcaatgcgggcatgggtgtcggtgtcggcaaccttaccatttatcctcaccagtggataaacct

SEQ ID NO: 77766 - DNA, 75 bp, Artificial Sequence
  Synthetic
ggtgtcggtgtcggcaaccttaccatttatcctcaccagtggataaacctgcgtaccaacaattgtgcaacaatt

SEQ ID NO: 77767 - DNA, 75 bp, Artificial Sequence
  Synthetic
tggtaaaaattatatcagcattggtgatagttgtgagaaaccacgaagacctaatcacagtgactgccacgctcg

SEQ ID NO: 77768 - DNA, 75 bp, Artificial Sequence
  Synthetic
gatagttgtgagaaaccacgaagacctaatcacagtgactgccacgctcgccctcattggttgcacctcgtcccc

SEQ ID NO: 77769 - DNA, 75 bp, Artificial Sequence
  Synthetic
tttgctcccctagactacactgcccaggcatctgagtatgttcctgtgactgtcacgatcgctccaatgtgtgcc

SEQ ID NO: 77770 - DNA, 75 bp, Artificial Sequence
  Synthetic
aggcatctgagtatgttcctgtgactgtcacgatcgctccaatgtgtgccgagtacaacggcctgaggttggcgt

SEQ ID NO: 77771 - DNA, 75 bp, Artificial Sequence
  Synthetic
taagaagttcactgagatgacaaatgcctgtaagggcatggagtggatagccattaaaatccagaaattcattga

SEQ ID NO: 77772 - DNA, 75 bp, Artificial Sequence
  Synthetic
cggccatgccacaattcgacgtgacgccacatatggacataccaggtgaagtgcataatctcatggagatcgcag

SEQ ID NO: 77773 - DNA, 75 bp, Artificial Sequence
  Synthetic
gccacatatggacataccaggtgaagtgcataatctcatggagatcgcagaggtcgattcggttgttccagtcaa

SEQ ID NO: 77774 - DNA, 75 bp, Artificial Sequence
  Synthetic
gaacagagtgctccttcccaaagtgatcaggaacagctcttttccaacgtccagtacttcgcccactactgcaga

SEQ ID NO: 77775 - DNA, 75 bp, Artificial Sequence
  Synthetic
aatatttgctttccaaatacaaccaggcttggattcggtattcaagagaacactgctaggagaggtgctcaacta

SEQ ID NO: 77776 - DNA, 75 bp, Artificial Sequence
  Synthetic
ggcttggattcggtattcaagagaacactgctaggagaggtgctcaactattatgcacactggtcagggagtatc

SEQ ID NO: 77777 - DNA, 75 bp, Artificial Sequence
  Synthetic
gatgtgcctgccagtaggaagcaggcaatgcttgggacccacataatttgggacatagggttgcagtctagttgc

SEQ ID NO: 77778 - DNA, 75 bp, Artificial Sequence
  Synthetic
caatgcttgggacccacataatttgggacatagggttgcagtctagttgcgttttgtgcataccgtggatcagtc

SEQ ID NO: 77779 - DNA, 75 bp, Artificial Sequence
  Synthetic
tagtggtcccacccggcacgcccaataagtgcgtggtgctgtgttttgtgtcagcatgcaatgacttttctgtgc

SEQ ID NO: 77780 - DNA, 75 bp, Artificial Sequence
  Synthetic
tagattttgtaccacctatggctgccctggaggagaaaggcatcttattcacctcaccatttgttctggcatcaa

SEQ ID NO: 77781 - DNA, 75 bp, Artificial Sequence
  Synthetic
taagtgcgtggtgctgtgttttgtgtcagcatgcaatgacttttctgtgcgcatgctacgtgacacaccattcat

SEQ ID NO: 77782 - DNA, 75 bp, Artificial Sequence
  Synthetic
cgccagtgggcccagcaactccaccagcatccctgctctcaccgcggttgagactggacacacatcacaagtaga

SEQ ID NO: 77783 - DNA, 75 bp, Artificial Sequence
  Synthetic
ccaaaacggtaaaataaatatgccgatgtcagtgaagacgtgtgatgaagaatgctgcccagttaatttcaagaa

SEQ ID NO: 77784 - DNA, 75 bp, Artificial Sequence
  Synthetic
agcatccctgctctcaccgcggttgagactggacacacatcacaagtagagccaagtgatacaatgcaaacacga

SEQ ID NO: 77785 - DNA, 75 bp, Artificial Sequence
  Synthetic
gctggtaactgagatgtttagggaatacaaccacagacacagtgttggggccacccttgaggcgctatttcaggg

SEQ ID NO: 77786 - DNA, 75 bp, Artificial Sequence
  Synthetic
gaagaatatttcaccaaggaccaggatagtgccaacagatacatgtcatggactataaacgctaggaggatggtg

SEQ ID NO: 77787 - DNA, 75 bp, Artificial Sequence
  Synthetic
tacaaccacagacacagtgttggggccacccttgaggcgctatttcagggtccaccggtatatagagagattaag

SEQ ID NO: 77788 - DNA, 75 bp, Artificial Sequence
  Synthetic
atagtgccaacagatacatgtcatggactataaacgctaggaggatggtgcaactgaggcgaaagtttgaactgt

SEQ ID NO: 77789 - DNA, 75 bp, Artificial Sequence
  Synthetic
agagagtattgcaaggaaaaaggatggttggtacctgaggtcaactcgactctccaaattgaaaaacatgtcagc

SEQ ID NO: 77790 - DNA, 75 bp, Artificial Sequence
  Synthetic
aagacatgccaccgttaacacaccaaatcatgtacataccacccgggggtcctgtaccaaacagtgtaaccgact

SEQ ID NO: 77791 - DNA, 75 bp, Artificial Sequence
  Synthetic
ggttggtacctgaggtcaactcgactctccaaattgaaaaacatgtcagccgagcatttatatgcctgcaagcat

SEQ ID NO: 77792 - DNA, 75 bp, Artificial Sequence
  Synthetic
aatcatgtacataccacccgggggtcctgtaccaaacagtgtaaccgactttgcgtggcaaacgtccaccaaccc

SEQ ID NO: 77793 - DNA, 75 bp, Artificial Sequence
  Synthetic
cagggatgcctaaccagaagcccaaagtacctaccctcaggcaggcaaaagtacaaggacctgctttcgaattcg

SEQ ID NO: 77794 - DNA, 75 bp, Artificial Sequence
  Synthetic
taacttctatgatggatggtcacacttttcacaaaacggggtgtatgggtacaacgcgttaaacaacatgggcaa

SEQ ID NO: 77795 - DNA, 75 bp, Artificial Sequence
  Synthetic
agtacctaccctcaggcaggcaaaagtacaaggacctgctttcgaattcgccgttgccatgatgaagagaaactc

SEQ ID NO: 77796 - DNA, 75 bp, Artificial Sequence
  Synthetic
ttttcacaaaacggggtgtatgggtacaacgcgttaaacaacatgggcaaattgtacgcacgtcacgtgaacaag

SEQ ID NO: 77797 - DNA, 75 bp, Artificial Sequence
  Synthetic
tgccaaacctggaccaaccatcctaatgaatgatcaagaggtcggcgtgctagatgccaaggaactagtggacaa

SEQ ID NO: 77798 - DNA, 75 bp, Artificial Sequence
  Synthetic
cccccacgcttgtgcccctacatcaagtccagtaatgttaattttgcaccaaccaacctgactgacaaaagagaa

SEQ ID NO: 77799 - DNA, 75 bp, Artificial Sequence
  Synthetic
atgaatgatcaagaggtcggcgtgctagatgccaaggaactagtggacaaggacggtaccaacctggagctgaca

SEQ ID NO: 77800 - DNA, 75 bp, Artificial Sequence
  Synthetic
agtccagtaatgttaattttgcaccaaccaacctgactgacaaaagagaaagcataacatacgtgcccgatacca

SEQ ID NO: 77801 - DNA, 75 bp, Artificial Sequence
  Synthetic
gaggctgtgctagcaattaatactagcaagttccccaacatgtacatcccagtgggacaagtcacagattatggt

SEQ ID NO: 77802 - DNA, 75 bp, Artificial Sequence
  Synthetic
tgaatagacacctcgccacacaagatgattggcaaaattgtgtgtgggagagttacaacagggacttactgatca

SEQ ID NO: 77803 - DNA, 75 bp, Artificial Sequence
  Synthetic
gcaagttccccaacatgtacatcccagtgggacaagtcacagattatggttttctaaacctaggcggcacaccca

SEQ ID NO: 77804 - DNA, 75 bp, Artificial Sequence
  Synthetic
tgattggcaaaattgtgtgtgggagagttacaacagggacttactgatcagcacaaccacagcacacggttgtga

SEQ ID NO: 77805 - DNA, 75 bp, Artificial Sequence
  Synthetic
tcctgggaatccatgttggggggaacggtcatcaaggcttttcagcagcactccttaaacactatttcaatgatg

SEQ ID NO: 77806 - DNA, 75 bp, Artificial Sequence
  Synthetic
tgaaggcccaggcctggtggaagtccaggaaagtgagtattatccaagaaggtaccaatctcacgttttgctcgc

SEQ ID NO: 77807 - DNA, 75 bp, Artificial Sequence
  Synthetic
caggaaagtgagtattatccaagaaggtaccaatctcacgttttgctcgccgctggtttttcggagcctggcgat

SEQ ID NO: 77808 - DNA, 75 bp, Artificial Sequence
  Synthetic
aacaaggggaaatcgagttcatcgagagctcaaaagacgcgggattcccagtcatcaacacacctagcaagacca

SEQ ID NO: 77809 - DNA, 75 bp, Artificial Sequence
  Synthetic
gctgacgtgcgcgacctcttatggttggaggatgatgccatggaacaaggcgttaaagattatgtggagcaactc

SEQ ID NO: 77810 - DNA, 75 bp, Artificial Sequence
  Synthetic
gcctcaaaaccaatttcgaggaggccatcttctccaaatacatcggaaacgtcaacacacacgtggatgagtaca

SEQ ID NO: 77811 - DNA, 75 bp, Artificial Sequence
  Synthetic
tggaggatgatgccatggaacaaggcgttaaagattatgtggagcaactcggaaacgcctttgggtccggtttca

SEQ ID NO: 77812 - DNA, 75 bp, Artificial Sequence
  Synthetic
tgtcagaagctatcgaccattacgctggtcaattggctaccttagacatcagtgttgaaccaatgaagttggagg

SEQ ID NO: 77813 - DNA, 75 bp, Artificial Sequence
  Synthetic
tcaaagctctggttaaaatcatatcagccctagttatagtcgtgagaaatcgtgatgacctcatcacagtgacag

SEQ ID NO: 77814 - DNA, 75 bp, Artificial Sequence
  Synthetic
agccctagttatagtcgtgagaaatcgtgatgacctcatcacagtgacagccaccctcgcactcataggatgcac

SEQ ID NO: 77815 - DNA, 75 bp, Artificial Sequence
  Synthetic
tggttggctcaagaaattcacggagatgaccaacgcctgcaagggcatggaatggatcgcaatcaaaattcaaaa

SEQ ID NO: 77816 - DNA, 75 bp, Artificial Sequence
  Synthetic
tgactccgtggcaatgagacaaacattcggcaacctatacaaaacttttcatctaaacccagggattgtgactgg

SEQ ID NO: 77817 - DNA, 75 bp, Artificial Sequence
  Synthetic
actacctctactggagagtcagatagccactattgaacagagtgcgccctcacagagtgatcaagagcaattatt

SEQ ID NO: 77818 - DNA, 75 bp, Artificial Sequence
  Synthetic
tgattattctggatatgatgctagcttgagtcccgtatggtttgcttgtctaaaactactacttgagaaacttgg

SEQ ID NO: 77819 - DNA, 75 bp, Artificial Sequence
  Synthetic
ctccctagaaaagaaaatgagcaattacatacagttcaagtccaaatgccgtattgaacccgtctgtctattgct

SEQ ID NO: 77820 - DNA, 75 bp, Artificial Sequence
  Synthetic
tacatacagttcaagtccaaatgccgtattgaacccgtctgtctattgctccatggaagtcccggtgctggaaaa

SEQ ID NO: 77821 - DNA, 75 bp, Artificial Sequence
  Synthetic
gggatcgacttggatcaattcagaatgattgcttatggtgacgatgtgatcgcatcatatccgtggcccatagat

SEQ ID NO: 77822 - DNA, 75 bp, Artificial Sequence
  Synthetic
cctgaccactttgatggctacaaacaacaggctgttgtgattatggatgatctgtgtcaaaatccagatgggaag

SEQ ID NO: 77823 - DNA, 75 bp, Artificial Sequence
  Synthetic
aacaggctgttgtgattatggatgatctgtgtcaaaatccagatgggaaggacgtgtcactattctgccaaatgg

SEQ ID NO: 77824 - DNA, 75 bp, Artificial Sequence
  Synthetic
tcgcttctacaaacgcaggatcaatcaatgctcccactgtgtcggacagtagagccttagccagaaggttccact

SEQ ID NO: 77825 - DNA, 75 bp, Artificial Sequence
  Synthetic
aatgtacagccagaatggaaaaatcaacatgccaatgtcggtagggacctgtgatgaggagtgttgcccagttaa

SEQ ID NO: 77826 - DNA, 75 bp, Artificial Sequence
  Synthetic
actagacatgctcgtgactgagatgtttagggagtacaaccacaggcatagcgtgggggcaacactcgaggcact

SEQ ID NO: 77827 - DNA, 75 bp, Artificial Sequence
  Synthetic
cacactggtatcacggtacctttgtgcgcctgttttatacccccttcccgcaaccgcaaatttagaagcaaagct

SEQ ID NO: 77828 - DNA, 75 bp, Artificial Sequence
  Synthetic
gaggcagttagagagtactgtaaagaaaaaggatggctcgtgcccgaaatcaattccaccttgcaaattgagaaa

SEQ ID NO: 77829 - DNA, 75 bp, Artificial Sequence
  Synthetic
aaaaaggatggctcgtgcccgaaatcaattccaccttgcaaattgagaaacatgtgagcagagcctttatttgtc

SEQ ID NO: 77830 - DNA, 75 bp, Artificial Sequence
  Synthetic
gagcatacactggcatgcctaatcaaaaacctaaagtgccaactttgaggcaggctaaagtacaggggccagcat

SEQ ID NO: 77831 - DNA, 75 bp, Artificial Sequence
  Synthetic
aaaacctaaagtgccaactttgaggcaggctaaagtacaggggccagcatttgaatttgcagtggccatgatgaa

SEQ ID NO: 77832 - DNA, 75 bp, Artificial Sequence
  Synthetic
acctcggcatgccaagcctgggcccactatcctaatgaatgaccaagaagtgggagttgttgatgccaaggagtt

SEQ ID NO: 77833 - DNA, 75 bp, Artificial Sequence
  Synthetic
tccaaggggcagtgtgtcgtaacgggcaactctgcagcggaaccgactactttgggtgtccgtgtttccttttat

SEQ ID NO: 77834 - DNA, 75 bp, Artificial Sequence
  Synthetic
tttgggtgtccgtgtttccttttatttttatactggctgcttatggtgacaatctcagagttgttaccatatagc

SEQ ID NO: 77835 - DNA, 75 bp, Artificial Sequence
  Synthetic
ggaatgagaagttcagggatatccgaggcttcttggccagggaggaagccgaggtcaacgaagctgtgcttgcca

SEQ ID NO: 77836 - DNA, 75 bp, Artificial Sequence
  Synthetic
gttttttttttttggaacgcttgtattcatcttaaccctcaataaggcaaaatgggagcgcaagtatcaacacaa

SEQ ID NO: 77837 - DNA, 75 bp, Artificial Sequence
  Synthetic
ttcatcttaaccctcaataaggcaaaatgggagcgcaagtatcaacacaaaagaccggtgcgcatgaaaccggct

SEQ ID NO: 77838 - DNA, 75 bp, Artificial Sequence
  Synthetic
ggacccctaccaagcgcatgctaatgtacaacttccccactcgtgcagggcagtgtggtggtgttctaatgtcaa

SEQ ID NO: 77839 - DNA, 75 bp, Artificial Sequence
  Synthetic
gtacaacttccccactcgtgcagggcagtgtggtggtgttctaatgtcaacaggtaaagtcctcggaatacacgt

SEQ ID NO: 77840 - DNA, 75 bp, Artificial Sequence
  Synthetic
ataggcaagaattttcacaagaccctggtaagttcaccgaaccagtgaaggatatcatggtgaagtcactacctg

SEQ ID NO: 77841 - DNA, 75 bp, Artificial Sequence
  Synthetic
tggtaagttcaccgaaccagtgaaggatatcatggtgaagtcactacctgcacttaactcgccgtctgctgaaga

SEQ ID NO: 77842 - DNA, 75 bp, Artificial Sequence
  Synthetic
gttcatcgagaactccagggaggcagggtttccagtcatcaacactcccagtaaaacgaagcttgagcccagcgt

SEQ ID NO: 77843 - DNA, 75 bp, Artificial Sequence
  Synthetic
gggtttccagtcatcaacactcccagtaaaacgaagcttgagcccagcgttttccatcacgtttttgaagggaac

SEQ ID NO: 77844 - DNA, 75 bp, Artificial Sequence
  Synthetic
agtagtggggtatggtcgatggcctgagtacctgaaagacaatgaggccactgctgaagatcaaccaacccagcc

SEQ ID NO: 77845 - DNA, 75 bp, Artificial Sequence
  Synthetic
gagtacctgaaagacaatgaggccactgctgaagatcaaccaacccagcctgatgtagcaacatgtaggttttac

SEQ ID NO: 77846 - DNA, 75 bp, Artificial Sequence
  Synthetic
attggtaatgtcaacactcacgtggatgagtatatgctggaagctgttgatcactacgcaggacaactggcaact

SEQ ID NO: 77847 - DNA, 75 bp, Artificial Sequence
  Synthetic
atgagtatatgctggaagctgttgatcactacgcaggacaactggcaactctagacatcagcatagaacccatga

SEQ ID NO: 77848 - DNA, 75 bp, Artificial Sequence
  Synthetic
gggctcttcggccaaaacatgtactaccactatctaggaagagccggttacacattgcatgtacaatgtaatgca

SEQ ID NO: 77849 - DNA, 75 bp, Artificial Sequence
  Synthetic
accactatctaggaagagccggttacacattgcatgtacaatgtaatgcatctaaattccatcagggatgcttgc

SEQ ID NO: 77850 - DNA, 75 bp, Artificial Sequence
  Synthetic
ttgcccttggtattaaaaagagagatattctatccaagaagaccaaggacctaacaaaattaaaagaatgcatgg

SEQ ID NO: 77851 - DNA, 75 bp, Artificial Sequence
  Synthetic
tattctatccaagaagaccaaggacctaacaaaattaaaagaatgcatggacaagtatgggctgaatctccccat

SEQ ID NO: 77852 - DNA, 75 bp, Artificial Sequence
  Synthetic
agggggagaccgctaagaaattctcttccaccagcacaaatgggaccaacacggtacagacgattgtgacaaatg

SEQ ID NO: 77853 - DNA, 75 bp, Artificial Sequence
  Synthetic
ttccaccagcacaaatgggaccaacacggtacagacgattgtgacaaatgccggtatgggagtgggagtgggcaa

SEQ ID NO: 77854 - DNA, 75 bp, Artificial Sequence
  Synthetic
gagcttaaatgactcagtagctatgcgacagactttcgggaacttgtacaaaacatttcatctgaatccaggtat

SEQ ID NO: 77855 - DNA, 75 bp, Artificial Sequence
  Synthetic
cgacagactttcgggaacttgtacaaaacatttcatctgaatccaggtatagtgacaggcagcgcagttgggtgt

SEQ ID NO: 77856 - DNA, 75 bp, Artificial Sequence
  Synthetic
caacgtaccgatggacaacatgttcagacaccacaatttcacactaatgattattccctttgtaccattagacta

SEQ ID NO: 77857 - DNA, 75 bp, Artificial Sequence
  Synthetic
agacaccacaatttcacactaatgattattccctttgtaccattagactattcttcagattcatccacgtacgtg

SEQ ID NO: 77858 - DNA, 75 bp, Artificial Sequence
  Synthetic
gatgccagcttgagcccagtctggtttgcttgtctaaagttgttgttagagaagcttgggtattcacacaaagaa

SEQ ID NO: 77859 - DNA, 75 bp, Artificial Sequence
  Synthetic
ttgcttgtctaaagttgttgttagagaagcttgggtattcacacaaagaaaccaactacatagattacctatgca

SEQ ID NO: 77860 - DNA, 75 bp, Artificial Sequence
  Synthetic
cctgtcatgaatacaccgggtagcaaccagtttctgacatcggacgacttccagtcaccatctgccatgccacaa

SEQ ID NO: 77861 - DNA, 75 bp, Artificial Sequence
  Synthetic
accagtttctgacatcggacgacttccagtcaccatctgccatgccacaatttgatgtcaccccagagttaaata

SEQ ID NO: 77862 - DNA, 75 bp, Artificial Sequence
  Synthetic
ttttcaactcaatgattaacaacatcattatcaggacactaatgctgaaggtgtataaggggatagacctagacc

SEQ ID NO: 77863 - DNA, 75 bp, Artificial Sequence
  Synthetic
aactcgacacaatggaggtctaccggattccagtgcagagtggtaatcaccaaagtgaccaagtcttcggttttc

SEQ ID NO: 77864 - DNA, 75 bp, Artificial Sequence
  Synthetic
cctattgacgccgcactgttggcggaagcggggaaagggtatggcttgatcatgacgccagccgacaagggagag

SEQ ID NO: 77865 - DNA, 75 bp, Artificial Sequence
  Synthetic
gattccagtgcagagtggtaatcaccaaagtgaccaagtcttcggttttcaagtgcaacctgggctagatagcgt

SEQ ID NO: 77866 - DNA, 75 bp, Artificial Sequence
  Synthetic
tttctgtggttccgctatggctacgggtaaattcctactagcctacgccccgcccggagcgaacgctcctaagaa

SEQ ID NO: 77867 - DNA, 75 bp, Artificial Sequence
  Synthetic
ggtaaattcctactagcctacgccccgcccggagcgaacgctcctaagaataggaaagatgcaatgctgggcaca

SEQ ID NO: 77868 - DNA, 75 bp, Artificial Sequence
  Synthetic
cttgtccatcctgtgatgccaatgaaagacatccatgaatcgatcaggtggaccaaggaccccaaaaacacacaa

SEQ ID NO: 77869 - DNA, 75 bp, Artificial Sequence
  Synthetic
agaagcgtcccagttgggcgctgtttgaccttacccgcgttttcaactttacgcaggaaatggctggactccttt

SEQ ID NO: 77870 - DNA, 75 bp, Artificial Sequence
  Synthetic
ttggtgcagcaggacgagtacacaagcgctggcaatgtcacatgctggtatcagactggaatagtcgtcccggcg

SEQ ID NO: 77871 - DNA, 75 bp, Artificial Sequence
  Synthetic
acgcaggaaatggctggactccttttaagagtacaatttgatataattcaattggcttaaccctaccacactcac

SEQ ID NO: 77872 - DNA, 75 bp, Artificial Sequence
  Synthetic
gcgctggcaatgtcacatgctggtatcagactggaatagtcgtcccggcgggcactccgacatcgtgctccatca

SEQ ID NO: 77873 - DNA, 75 bp, Artificial Sequence
  Synthetic
tactgcaaggtgatgtggtagaagctgtagagaacgccgttgcacgtgtggcagatacaattggtagtgggccgt

SEQ ID NO: 77874 - DNA, 75 bp, Artificial Sequence
  Synthetic
tgtagagaacgccgttgcacgtgtggcagatacaattggtagtgggccgtcaaattcgcaagcagtgcctgcttt

SEQ ID NO: 77875 - DNA, 75 bp, Artificial Sequence
  Synthetic
ccattccagatctgagtccagcattgaaaacttcctcagcagatctgcctgcgtttatatgggaggataccacac

SEQ ID NO: 77876 - DNA, 75 bp, Artificial Sequence
  Synthetic
gaaaacttcctcagcagatctgcctgcgtttatatgggaggataccacacaaccaacactgaccagacaaaatta

SEQ ID NO: 77877 - DNA, 75 bp, Artificial Sequence
  Synthetic
tttgatgtggaggtgacttttgtgattaccagcaagcaggaccagggctcccgattgggccaagacatgccaccc

SEQ ID NO: 77878 - DNA, 75 bp, Artificial Sequence
  Synthetic
ttaccagcaagcaggaccagggctcccgattgggccaagacatgccacccctgactcaccagatcatgtatatcc

SEQ ID NO: 77879 - DNA, 75 bp, Artificial Sequence
  Synthetic
ctgaggggaacgcgccacccagaatgtctatcccattcattagcattggtaacgcctacagtaatttttacgacg

SEQ ID NO: 77880 - DNA, 75 bp, Artificial Sequence
  Synthetic
gtctatcccattcattagcattggtaacgcctacagtaatttttacgacgggtggtctcacttctcgcaaaacgg

SEQ ID NO: 77881 - DNA, 75 bp, Artificial Sequence
  Synthetic
agctcaagtgtcgactcagaaaaccggggcacatgagaccggtttaaatgccagcggaaactccatcatccatta

SEQ ID NO: 77882 - DNA, 75 bp, Artificial Sequence
  Synthetic
tatgactagcactgttagaatgtacttcaagccgaagcatgttaaagcatgggtcccgcggcctcctaggctatg

SEQ ID NO: 77883 - DNA, 75 bp, Artificial Sequence
  Synthetic
ttcaagccgaagcatgttaaagcatgggtcccgcggcctcctaggctatgccaatacaaaaatgcatccacggtg

SEQ ID NO: 77884 - DNA, 75 bp, Artificial Sequence
  Synthetic
tcaaactacggagcttttggataccaatcaggggccgtgtacgtcgtaaactacagggtggtgaaccggcatctg

SEQ ID NO: 77885 - DNA, 75 bp, Artificial Sequence
  Synthetic
aatcaggggccgtgtacgtcgtaaactacagggtggtgaaccggcatctggcaacccataccgactggcaaaact

SEQ ID NO: 77886 - DNA, 75 bp, Artificial Sequence
  Synthetic
gtcgctgttcaacgggggtctactactgtcagtctaagggtaagcactacccagtcaattttgagggaccgggtc

SEQ ID NO: 77887 - DNA, 75 bp, Artificial Sequence
  Synthetic
ctgtcagtctaagggtaagcactacccagtcaattttgagggaccgggtcttgtggaagttcaggagagtgagta

SEQ ID NO: 77888 - DNA, 75 bp, Artificial Sequence
  Synthetic
gagatgcgagcacggtgtcatcggaattgtgaccatggggggtgaaggtgtcgttggctttgccgacgtgcgtga

SEQ ID NO: 77889 - DNA, 75 bp, Artificial Sequence
  Synthetic
attgtgaccatggggggtgaaggtgtcgttggctttgccgacgtgcgtgacctcttgtggttggaggacgatgcg

SEQ ID NO: 77890 - DNA, 75 bp, Artificial Sequence
  Synthetic
gaacaagtcaacctcctaaaagagtcactagtgggtcaagactccatcctagagaagtctctgaaagctttggtg

SEQ ID NO: 77891 - DNA, 75 bp, Artificial Sequence
  Synthetic
cactagtgggtcaagactccatcctagagaagtctctgaaagctttggtgaaaataatatcagccttagtaattg

SEQ ID NO: 77892 - DNA, 75 bp, Artificial Sequence
  Synthetic
ggtggcttaaacagaaggtatcgcaatactatgggatacccatggctgaacgtcaaaacaacgggtggctcaaga

SEQ ID NO: 77893 - DNA, 75 bp, Artificial Sequence
  Synthetic
atactatgggatacccatggctgaacgtcaaaacaacgggtggctcaagaagttcactgaaatgaccaattcttg

SEQ ID NO: 77894 - DNA, 75 bp, Artificial Sequence
  Synthetic
cagagaaaaacatgaattcctgaacagactcaagcagctccctctgttggaaagccagatcgccacaatcgagca

SEQ ID NO: 77895 - DNA, 75 bp, Artificial Sequence
  Synthetic
agactcaagcagctccctctgttggaaagccagatcgccacaatcgagcaaagtgcgccgtcccagagtgaccaa

SEQ ID NO: 77896 - DNA, 75 bp, Artificial Sequence
  Synthetic
aaacttaacagctcagtgtacacactaccaccagacccagatcactttgacggatataaacagcaggccgtggtg

SEQ ID NO: 77897 - DNA, 75 bp, Artificial Sequence
  Synthetic
taccaccagacccagatcactttgacggatataaacagcaggccgtggtgatcgtggacgacttgtgccagaatc

SEQ ID NO: 77898 - DNA, 75 bp, Artificial Sequence
  Synthetic
aagagaaaggcattctgttcacttctctattcgtcctggcgtcaactaacgcagggtctatcaacgccccaaccg

SEQ ID NO: 77899 - DNA, 75 bp, Artificial Sequence
  Synthetic
atggcaaaataaatatgccgatgtcagagaaaacgtgtgatgaagagtgttgtccagtcaactttaagagatgct

SEQ ID NO: 77900 - DNA, 75 bp, Artificial Sequence
  Synthetic
cgtggcaccagagacaccaccaccaccagccattgcagacttgctcaagtcagtggacagtgaagccgtgagaga

SEQ ID NO: 77901 - DNA, 75 bp, Artificial Sequence
  Synthetic
ccagccattgcagacttgctcaagtcagtggacagtgaagccgtgagagagtactgtaaagaaaaggggtggctg

SEQ ID NO: 77902 - DNA, 75 bp, Artificial Sequence
  Synthetic
acttttgtctcagtggctggaattatttacataatctacaagctctttgcaggcttccaaggagcatacacaggg

SEQ ID NO: 77903 - DNA, 75 bp, Artificial Sequence
  Synthetic
tttacataatctacaagctctttgcaggcttccaaggagcatacacagggatgcccaatcagaaacccaaagtgc

SEQ ID NO: 77904 - DNA, 75 bp, Artificial Sequence
  Synthetic
cagtgaagaccgaataccgagaattcactatgttgggcatttatgacaggtgggccgtactgccacgccatgcta

SEQ ID NO: 77905 - DNA, 75 bp, Artificial Sequence
  Synthetic
cactatgttgggcatttatgacaggtgggccgtactgccacgccatgctaaacctggaccaaccattctgatgaa

SEQ ID NO: 77906 - DNA, 75 bp, Artificial Sequence
  Synthetic
caagttaaaccggaatgagaagttcagagacatcagaggcttcttggccaaagaggaggtggaagctaaccaggc

SEQ ID NO: 77907 - DNA, 75 bp, Artificial Sequence
  Synthetic
agagacatcagaggcttcttggccaaagaggaggtggaagctaaccaggctgtactggcgattaacaccagcaag

SEQ ID NO: 77908 - DNA, 75 bp, Artificial Sequence
  Synthetic
agaatgctcatgtccaacttccccacacgagcgggccagtgcggcggggttctcatgtccaccggtaaggtcttg

SEQ ID NO: 77909 - DNA, 75 bp, Artificial Sequence
  Synthetic
cacgagcgggccagtgcggcggggttctcatgtccaccggtaaggtcttggggatccacgttggtggaaatggtc

SEQ ID NO: 77910 - DNA, 75 bp, Artificial Sequence
  Synthetic
caaaggatgcggggttcccaatcattaatacgcctagtaagactaagttggaaccgagcgtcttccatcaagtat

SEQ ID NO: 77911 - DNA, 75 bp, Artificial Sequence
  Synthetic
taatacgcctagtaagactaagttggaaccgagcgtcttccatcaagtattcgaaggggacaaagaaccagctgt

SEQ ID NO: 77912 - DNA, 75 bp, Artificial Sequence
  Synthetic
cacacacgtggatgaatacatgctagaggctgtcgatcattatgctggtcagctggccacactggatatcagcac

SEQ ID NO: 77913 - DNA, 75 bp, Artificial Sequence
  Synthetic
gaggctgtcgatcattatgctggtcagctggccacactggatatcagcaccgaacctatgagattggaggatgct

SEQ ID NO: 77914 - DNA, 75 bp, Artificial Sequence
  Synthetic
aagaagagagacatcctttcaaggaggaccagggatctaaccaagttgaaggaatgtatggataaatacggtttg

SEQ ID NO: 77915 - DNA, 75 bp, Artificial Sequence
  Synthetic
ggaccagggatctaaccaagttgaaggaatgtatggataaatacggtttgaacttaccgatggtgacttatgtga

SEQ ID NO: 77916 - DNA, 75 bp, Artificial Sequence
  Synthetic
ctgtagcaatgagacaaacatttggcaacctgtacagaaccttccatctaaacccagggatcgtgactggtagcg

SEQ ID NO: 77917 - DNA, 75 bp, Artificial Sequence
  Synthetic
caacctgtacagaaccttccatctaaacccagggatcgtgactggtagcgctgtcgggtgcgacccggacctctt

SEQ ID NO: 77918 - DNA, 75 bp, Artificial Sequence
  Synthetic
ccccgtgtggtttgcctgcctaaaactattacttgagaaattaggctacacacacaaggaaacaaattacattga

SEQ ID NO: 77919 - DNA, 75 bp, Artificial Sequence
  Synthetic
ctattacttgagaaattaggctacacacacaaggaaacaaattacattgactacctgtgtaattcccaccacctg

SEQ ID NO: 77920 - DNA, 75 bp, Artificial Sequence
  Synthetic
ataaacaacatcatcatcaggactctcatgctaaaagtgtataagggaattgatttggaccagtttaggatgatt

SEQ ID NO: 77921 - DNA, 75 bp, Artificial Sequence
  Synthetic
tttacttgccgaaaccggcaaaggttatgggttgattatgacaccagcagataaaggggagtgcttcaacgaagt

SEQ ID NO: 77922 - DNA, 75 bp, Artificial Sequence
  Synthetic
catgcccatgaaagacatccacgagtccattaggtggaccaaagacccaaagaacacccaagaccacgtgcgctc

SEQ ID NO: 77923 - DNA, 75 bp, Artificial Sequence
  Synthetic
tggactctttttaaactagagacaatttgaactaatttgaattggcttaaccctactgcacttaccgaactagat

SEQ ID NO: 77924 - DNA, 75 bp, Artificial Sequence
  Synthetic
ctgttaccccggactgagtatcaataagctgctcgcgtggctgaaggagaaaacgtccgttacccggccaattac

SEQ ID NO: 77925 - DNA, 75 bp, Artificial Sequence
  Synthetic
ctctcctcaaacactacttcaatgatgaacaaggtgagatcgagttcattgagagctcaaaggacgcaggattcc

SEQ ID NO: 77926 - DNA, 75 bp, Artificial Sequence
  Synthetic
gacttcgcccaagacccagggaaatttacagaaccagttaaggacattatgataaaatcattgccagccttaaat

SEQ ID NO: 77927 - DNA, 75 bp, Artificial Sequence
  Synthetic
gataaaatcattgccagccttaaattcccctacagttgaggagtgtgggtatagtgatagggtgaggtccatcac

SEQ ID NO: 77928 - DNA, 75 bp, Artificial Sequence
  Synthetic
cctgggcaactctaccattactactcaagagtgtgcaaatgtggttgtagggtacggcgtgtggccagattactt

SEQ ID NO: 77929 - DNA, 75 bp, Artificial Sequence
  Synthetic
ccaggttggtggtggaagttacccgacgccttgtctaatttggggctgtttggtcagaacatgcagtatcactac

SEQ ID NO: 77930 - DNA, 75 bp, Artificial Sequence
  Synthetic
cagaaaaagtggctaaaggtaagtccaggcttattgaagcatctagcttgaatgactccgtcgcgatgaggcaaa

SEQ ID NO: 77931 - DNA, 75 bp, Artificial Sequence
  Synthetic
taaccatcttcccacaccagtggatcaacttgcgcaccaataatagcgccacaattgtaatgccatacacaaaca

SEQ ID NO: 77932 - DNA, 75 bp, Artificial Sequence
  Synthetic
acctcttctggagtaaaatacctgtaatgctagacggacatctcatagccttcgattactccgggtacgatgcca

SEQ ID NO: 77933 - DNA, 75 bp, Artificial Sequence
  Synthetic
gaggcaatttactgcaatttaaattggcttaaccctaccacatccaccgaactagacaacggtgtggtaggggta

SEQ ID NO: 77934 - DNA, 75 bp, Artificial Sequence
  Synthetic
ttaaaacagcctgtgggttgttcccacccgcagggcccactgggcgctagcacactggtatcacggtacctttgt

SEQ ID NO: 77935 - DNA, 75 bp, Artificial Sequence
  Synthetic
ggtcacaacgcgacaagcggcacagctgagaaggaagctggaattcttcacgtacataaggttcgatttagagct

SEQ ID NO: 77936 - DNA, 75 bp, Artificial Sequence
  Synthetic
tgtgtgccagaggcggaaatggggtgcgccacgttagccaataaacctgaccagaagagcctgagcaacggggag

SEQ ID NO: 77937 - DNA, 75 bp, Artificial Sequence
  Synthetic
ggtgtcattgggcttgtaaccatgggaggcgatggagtggtcggatttgctgacgtccgtgacctactatggctg

SEQ ID NO: 77938 - DNA, 75 bp, Artificial Sequence
  Synthetic
tcttgaaagaaacattagtaggccaggattccatcttggaaaaatctcttaaagccctagtcaaaatcatttcgg

SEQ ID NO: 77939 - DNA, 75 bp, Artificial Sequence
  Synthetic
aatcgaactcaacaaacggttcccaggtctttgggtttccactgacaccaggggctagcagtgtattgaacagga

SEQ ID NO: 77940 - DNA, 75 bp, Artificial Sequence
  Synthetic
caatgttgggcactcatgtgatctgggatgtggggttgcaatcgagctgcgtgttgtgcataccatggatcagcc

SEQ ID NO: 77941 - DNA, 75 bp, Artificial Sequence
  Synthetic
tccccctcttagaaagtcagattgccaccattgagcagagcgcaccatcccagagtgatcaagagcaactcttct

SEQ ID NO: 77942 - DNA, 75 bp, Artificial Sequence
  Synthetic
gccgctgaagctaagagagtattttccctcgaaaagaaaatgagcaattacatacagttcaagtccaaatgccgt

SEQ ID NO: 77943 - DNA, 75 bp, Artificial Sequence
  Synthetic
tcactagccgaaaagttaaacagttctgtatactccttaccacctgacccagaccactttgatggttacaaacaa

SEQ ID NO: 77944 - DNA, 75 bp, Artificial Sequence
  Synthetic
tggaagcggtccagtcaactcagagtccattccagccttgactgccgcagaaacgggacacacgtcgcaggtagt

SEQ ID NO: 77945 - DNA, 75 bp, Artificial Sequence
  Synthetic
tccaaggaccaccggtgtacagagaaatcaaaatcagtgtggctcctgaaaccccaccaccaccagcaattgcag

SEQ ID NO: 77946 - DNA, 75 bp, Artificial Sequence
  Synthetic
gcgtatacagggatgcccaatcaaaagcccaaagtgcccacgttaagacaggccaaggtgcaaggtcccgctttt

SEQ ID NO: 77947 - DNA, 75 bp, Artificial Sequence
  Synthetic
tggacaaggatggcacaaaccttgaactcacactgctgaaactcaaccggaatgaaaagtttagagacattagag

SEQ ID NO: 77948 - DNA, 75 bp, Artificial Sequence
  Synthetic
caccattgagcaaagtgcgccatcccagggtgaccaggagcagcttttctcaaatgtccaatactttgcccacta

SEQ ID NO: 77949 - DNA, 75 bp, Artificial Sequence
  Synthetic
actactttgtgcgtggtggtatgccctcaggatgctctggtaccagcatctttaattcaatgatcaataacatca

SEQ ID NO: 77950 - DNA, 75 bp, Artificial Sequence
  Synthetic
tgacaccagcggataaaggggagtgcttcaatgaggtcacctggaccaatgtcactttcctgaaaaggtacttca

SEQ ID NO: 77951 - DNA, 75 bp, Artificial Sequence
  Synthetic
caggcactaacaacttttgtttctgtggccgggattatctacattatttacaaactgtttgctgggtttcagggc

SEQ ID NO: 77952 - DNA, 75 bp, Artificial Sequence
  Synthetic
agccagagtacagggccctgcctttgagtttgcggtagctatgatgaaaagaaactccagcaccgtgaagacgga

SEQ ID NO: 77953 - DNA, 75 bp, Artificial Sequence
  Synthetic
acagcctgtgggttgttcccacccacagggcccattgggcgctagcacactggtattacggtacctttgtgcgcc

SEQ ID NO: 77954 - DNA, 75 bp, Artificial Sequence
  Synthetic
ccagtgtagatcaggccgatgagtcaccgcaatccccacgggtgaccgtggcggtggctgcgctggcggcctgcc

SEQ ID NO: 77955 - DNA, 75 bp, Artificial Sequence
  Synthetic
attggctgcttatggtgacaattgagagattgttgccatatagctattggattggccatccggtgacaaacagag

SEQ ID NO: 77956 - DNA, 75 bp, Artificial Sequence
  Synthetic
tcaatacagcaaaatgggagctcaagtatcgacacaaaagactggagcacacgaaaccggtttgagtgctagtgg

SEQ ID NO: 77957 - DNA, 75 bp, Artificial Sequence
  Synthetic
acgaaaccggtttgagtgctagtggaaactccatcatccactatacgaatataaattattacaaggatgccgcct

SEQ ID NO: 77958 - DNA, 75 bp, Artificial Sequence
  Synthetic
gaacctgtgaagggcattatgattaaatcgatgcctgctctcaactctccgtcagcagaggagtgtggctacagt

SEQ ID NO: 77959 - DNA, 75 bp, Artificial Sequence
  Synthetic
gcttggcacaacggggagcgtgaatatgaagagttcatccgaaagattagaagcgtcccagttgggcgctgtttg

SEQ ID NO: 77960 - DNA, 75 bp, Artificial Sequence
  Synthetic
tgaaagattgttaccatatagctattggattggccacccggtaacaaacagagctataatttaccaatttgtggg

SEQ ID NO: 77961 - DNA, 75 bp, Artificial Sequence
  Synthetic
caggtgtcaacacaaaagaccggcgcacacgagaccagcttaagtgcaaccggcaactctatcatccactacaca

SEQ ID NO: 77962 - DNA, 75 bp, Artificial Sequence
  Synthetic
aaatggatatcccaggacaggttaacaacttgatggaaatcgcagaagtggactctgtggtacctgttaacaaca

SEQ ID NO: 77963 - DNA, 75 bp, Artificial Sequence
  Synthetic
aactcaacaaatggttcccaggtctttgggtttccactgataccaggagctagtagtgtattgaacaggacactg

SEQ ID NO: 77964 - DNA, 75 bp, Artificial Sequence
  Synthetic
cccaacggtggaggaatgtgggtacagtgatagggttagatcaataacacttggcaactcaaccataacaacaca

SEQ ID NO: 77965 - DNA, 75 bp, Artificial Sequence
  Synthetic
aacattcatgttctgtgggtcagcaatggcaacgggtaaattcctgctagcgtattcaccaccaggagctggagc

SEQ ID NO: 77966 - DNA, 75 bp, Artificial Sequence
  Synthetic
tcaacctacccaacccgatgtggcgacgtgtagattttacacgctgaattcggtgaaatgggagatgcaatcagc

SEQ ID NO: 77967 - DNA, 75 bp, Artificial Sequence
  Synthetic
acgtgtagattttacacgctgaattcggtgaaatgggagatgcaatcagcagggtggtggtggaagttcccagac

SEQ ID NO: 77968 - DNA, 75 bp, Artificial Sequence
  Synthetic
accgactacacgtaaggaggcaatgttgggcactcatgtgatctgggacgtggggttgcaatcaagctgcgtgtt

SEQ ID NO: 77969 - DNA, 75 bp, Artificial Sequence
  Synthetic
gtgcaatgcaacgcatccaaattccaccaaggctgcctcctcgtggtgtgtgtgcctgaggcggaaatggggtgt

SEQ ID NO: 77970 - DNA, 75 bp, Artificial Sequence
  Synthetic
accaaggctgcctcctcgtggtgtgtgtgcctgaggcggaaatggggtgtaccaatgcagaaaacgcacccgcat

SEQ ID NO: 77971 - DNA, 75 bp, Artificial Sequence
  Synthetic
cagctgtgtgcaatgcaggtatgggtgtgggggttggcaacctgactatttacccccaccagtggatcaacttaa

SEQ ID NO: 77972 - DNA, 75 bp, Artificial Sequence
  Synthetic
tgtgggggttggcaacctgactatttacccccaccagtggatcaacttaaggaccaataatagcgccaccattgt

SEQ ID NO: 77973 - DNA, 75 bp, Artificial Sequence
  Synthetic
tccagccttgactgctgcagaaacgggacacacgtcgcaggtagtgccagcagacactatgcaaaccagacatgt

SEQ ID NO: 77974 - DNA, 75 bp, Artificial Sequence
  Synthetic
tgcaccattggactacgtcacaggagcatcttcttacatcccaattacagtaacagtggcccccatgagcgctga

SEQ ID NO: 77975 - DNA, 75 bp, Artificial Sequence
  Synthetic
gcatcttcttacatcccaattacagtaacagtggcccccatgagcgctgagtacaatggtttgcgtctagctggt

SEQ ID NO: 77976 - DNA, 75 bp, Artificial Sequence
  Synthetic
tatttggcttccctctacaaccgggagcatcaagtgtactgcagagaactctattaggggagatactgaattatt

SEQ ID NO: 77977 - DNA, 75 bp, Artificial Sequence
  Synthetic
ataggcaatgcatatagtatgttctatgatgggtgggctaggtttgacaagcaagggacatatggcataaataca

SEQ ID NO: 77978 - DNA, 75 bp, Artificial Sequence
  Synthetic
gcaagggacatatggcataaatacactaaataacatggggacgctgtatatgagacacgtgaatgatggtagccc

SEQ ID NO: 77979 - DNA, 75 bp, Artificial Sequence
  Synthetic
atatatttcaaaccaaagcatgtcaagacatgggtcccaagaccacccaggttatgccagtaccagaaggcaggc

SEQ ID NO: 77980 - DNA, 75 bp, Artificial Sequence
  Synthetic
atgctgggaacccacgttatatgggatgttggcctacagtccagctgtgtgctatgtgtaccatggattagtcag

SEQ ID NO: 77981 - DNA, 75 bp, Artificial Sequence
  Synthetic
gttatgccagtaccagaaggcaggcaatgtgaattttgaacctactggcgtgactgaaagtaggacagacataac

SEQ ID NO: 77982 - DNA, 75 bp, Artificial Sequence
  Synthetic
cttgctatataatgtgcttcgtgtcggcatgtaacgacttctcagttcgtatgttaagagacacccaatttatca

SEQ ID NO: 77983 - DNA, 75 bp, Artificial Sequence
  Synthetic
cacgcggtccgtcaaactctgaacaaatcccagccttgacagccgttgaaaccgggcatacctctcaagtagacc

SEQ ID NO: 77984 - DNA, 75 bp, Artificial Sequence
  Synthetic
aatcccagccttgacagccgttgaaaccgggcatacctctcaagtagacccgagtgacacgatgcagactagaca

SEQ ID NO: 77985 - DNA, 75 bp, Artificial Sequence
  Synthetic
tgcgtgaccttctatggttggaggatgatgcaatggagcagggcgtgaaagactacgtagaacagcttggaaatg

SEQ ID NO: 77986 - DNA, 75 bp, Artificial Sequence
  Synthetic
aatttgtgagcaggttaaccttctcaaagaaacattgattggtcaagattccatcctggagaagtcccttaaagc

SEQ ID NO: 77987 - DNA, 75 bp, Artificial Sequence
  Synthetic
gatgtgccagtacagacgcaccaaataatgtatgtaccacctgggggccccgtaccaacatcggtcaatgattac

SEQ ID NO: 77988 - DNA, 75 bp, Artificial Sequence
  Synthetic
taatgtatgtaccacctgggggccccgtaccaacatcggtcaatgattacgtgtggcagacgtctactaacccca

SEQ ID NO: 77989 - DNA, 75 bp, Artificial Sequence
  Synthetic
tgttttacgacggatggtcaaatttttctagagatggcatatatgggtacaactcactgaacaacatgggaacca

SEQ ID NO: 77990 - DNA, 75 bp, Artificial Sequence
  Synthetic
ttctagagatggcatatatgggtacaactcactgaacaacatgggaaccatatacgcgcgacatgttaatgactc

SEQ ID NO: 77991 - DNA, 75 bp, Artificial Sequence
  Synthetic
cttgaccaggcttaagcaactcccacttttggaaagccaaattgccaccattgagcaaagtgcaccatcccaggg

SEQ ID NO: 77992 - DNA, 75 bp, Artificial Sequence
  Synthetic
accacgtttgtgtcagtacaagaaagctaagaatgtgaattttgatgttgaggccgtcacagcggagcgggcaag

SEQ ID NO: 77993 - DNA, 75 bp, Artificial Sequence
  Synthetic
cttggccacacataccgattggcaaagctgcgtgtgggaggactacaacagagacctcctcgtaagcgcgactac

SEQ ID NO: 77994 - DNA, 75 bp, Artificial Sequence
  Synthetic
agctgcgtgtgggaggactacaacagagacctcctcgtaagcgcgactacagctcacgggtgtgacacaattgct

SEQ ID NO: 77995 - DNA, 75 bp, Artificial Sequence
  Synthetic
ggctgagaagcttaacagctcagtatattccttgccacctgatccagatcactttgatggttacaagcaacaggc

SEQ ID NO: 77996 - DNA, 75 bp, Artificial Sequence
  Synthetic
cgtcgtgatcatggatgacctatgccaaaacccagatggcaaggatatatccttgttttgtcaaatggtgtccag

SEQ ID NO: 77997 - DNA, 75 bp, Artificial Sequence
  Synthetic
ccacgtattactcgcagcagggttttcagaaccgggagactgcggtggaattctcaggtgcgaacatggtgtaat

SEQ ID NO: 77998 - DNA, 75 bp, Artificial Sequence
  Synthetic
caaaacccagatggcaaggatatatccttgttttgtcaaatggtgtccagcgtggatttcgtaccaccaatggct

SEQ ID NO: 77999 - DNA, 75 bp, Artificial Sequence
  Synthetic
ccgacagtgtcagatagccgggctctggctaggagattccattttgacatgaacattgaagtcatttccatgtac

SEQ ID NO: 78000 - DNA, 75 bp, Artificial Sequence
  Synthetic
tggctaggagattccattttgacatgaacattgaagtcatttccatgtacagccaaaatggcaaaatcaacatgc

SEQ ID NO: 78001 - DNA, 75 bp, Artificial Sequence
  Synthetic
tgtgaagatcatatcagcattagtgattgtggtgaggaaccacgatgacttggtaactgtgactgccactcttgc

SEQ ID NO: 78002 - DNA, 75 bp, Artificial Sequence
  Synthetic
aggccattcagttcatcgacagacgaactcaagtcaggtattcactggatatgctagtcactgagatgttcaggg

SEQ ID NO: 78003 - DNA, 75 bp, Artificial Sequence
  Synthetic
taccagacttaaacaactcccccttttggaaagccaaattgccaccattgaacaaagtgcaccgtcccagagtga

SEQ ID NO: 78004 - DNA, 75 bp, Artificial Sequence
  Synthetic
actaacaacctttgtctccgtagccggaattatatacatcatttacaaactgttcgctggcttccagggcgcgta

SEQ ID NO: 78005 - DNA, 75 bp, Artificial Sequence
  Synthetic
ggaattatatacatcatttacaaactgttcgctggcttccagggcgcgtacacagggatgcccaatcaaaagccc

SEQ ID NO: 78006 - DNA, 75 bp, Artificial Sequence
  Synthetic
ggccaaaagagtgttctcccttgagaagaaaatgagcaattacatacagttcaagtccaaatgccgtattgaacc

SEQ ID NO: 78007 - DNA, 75 bp, Artificial Sequence
  Synthetic
tccagcacggtgaaaacagaatacggtgaatttactatgctaggcatctatgataggtgggctgtccttccgcgc

SEQ ID NO: 78008 - DNA, 75 bp, Artificial Sequence
  Synthetic
agtatgtttgctattgcatggaagccccggagctggaaaatctgttgccaccaacctaatcgggcgatcgctagc

SEQ ID NO: 78009 - DNA, 75 bp, Artificial Sequence
  Synthetic
aaggatggcacaaaccttgaactcacactgttgaaactcaatcggaatgaaaagtttagagatatcagaggtttc

SEQ ID NO: 78010 - DNA, 75 bp, Artificial Sequence
  Synthetic
ccagtaggacaagttacagactatggcttcctaaacttgggtggtacccccacaaagagaatgcttatgtacaac

SEQ ID NO: 78011 - DNA, 75 bp, Artificial Sequence
  Synthetic
acagtctcagacagccgggcactggccagaaggtttcacttcgacatgaacattgaagtcatatcaatgtacagc

SEQ ID NO: 78012 - DNA, 75 bp, Artificial Sequence
  Synthetic
gcttcctaaacttgggtggtacccccacaaagagaatgcttatgtacaacttcccgaccagagcaggtcaatgcg

SEQ ID NO: 78013 - DNA, 75 bp, Artificial Sequence
  Synthetic
ccagaaggtttcacttcgacatgaacattgaagtcatatcaatgtacagccagaatggaaagatcaacatgccca

SEQ ID NO: 78014 - DNA, 75 bp, Artificial Sequence
  Synthetic
ctctcctcaagcactactttaatgatgagcagggtgagatagagttcatcgaaaactcgaaggatgcggggttcc

SEQ ID NO: 78015 - DNA, 75 bp, Artificial Sequence
  Synthetic
ccatccagttcattgatagaaaaacccaagtgagatactctttggacatgctggtcactgaaatgtttaaagaat

SEQ ID NO: 78016 - DNA, 75 bp, Artificial Sequence
  Synthetic
ccaagtgagatactctttggacatgctggtcactgaaatgtttaaagaatacaaccacaggcacagtgtcggggc

SEQ ID NO: 78017 - DNA, 75 bp, Artificial Sequence
  Synthetic
aaaattggagccgagtgtgttccaccaggtgtttgagggtaataaggaacctgcagtgctcagaaatggtgatcc

SEQ ID NO: 78018 - DNA, 75 bp, Artificial Sequence
  Synthetic
acctccagcaatcgcagatttgttgaaatcggtggatagtgaagcagttagggagtactgtaaagagaaggggtg

SEQ ID NO: 78019 - DNA, 75 bp, Artificial Sequence
  Synthetic
atgtgaacacacatgtagatgaatatatggtggaagcagtagaccactatgcggggcaactagctaccctcgaca

SEQ ID NO: 78020 - DNA, 75 bp, Artificial Sequence
  Synthetic
aaatcggtggatagtgaagcagttagggagtactgtaaagagaaggggtggttggttcctgaggtcaactccaca

SEQ ID NO: 78021 - DNA, 75 bp, Artificial Sequence
  Synthetic
attatatatatcatttacaaactgtttgcaggattccagggtgcatatacagggatgcctaatcaaaaacccaaa

SEQ ID NO: 78022 - DNA, 75 bp, Artificial Sequence
  Synthetic
aggcattaagaagagagatattttgtccaagaagaccaaagatctaactaagttgaaggagtgtatggacaagta

SEQ ID NO: 78023 - DNA, 75 bp, Artificial Sequence
  Synthetic
ttgcaggattccagggtgcatatacagggatgcctaatcaaaaacccaaagtgcccacattacgacaagccaaag

SEQ ID NO: 78024 - DNA, 75 bp, Artificial Sequence
  Synthetic
cagacttatcgaagcgtctagcttgaatgactctgtcgcaatgaggcaaacatttggtaacttatacaagacatt

SEQ ID NO: 78025 - DNA, 75 bp, Artificial Sequence
  Synthetic
aatttaccatgctaggcatctacgatagatgggctgtccttccgcgccacgccaagcccggaccaactatcctca

SEQ ID NO: 78026 - DNA, 75 bp, Artificial Sequence
  Synthetic
aatgactctgtcgcaatgaggcaaacatttggtaacttatacaagacattccatctaaaccctgggattgtgacg

SEQ ID NO: 78027 - DNA, 75 bp, Artificial Sequence
  Synthetic
tagatgggctgtccttccgcgccacgccaagcccggaccaactatcctcatgaatgaccaggaagttggcgtgct

SEQ ID NO: 78028 - DNA, 75 bp, Artificial Sequence
  Synthetic
tttgactactccggttatgacgccagcttgagccctgtgtggttcgcttgtctgaaaatgctactcgaaaaactt

SEQ ID NO: 78029 - DNA, 75 bp, Artificial Sequence
  Synthetic
gtttagggacatcagaggctttcttgccagagaagaggtggaggttaacgaggctgtcctggcaataaacaccag

SEQ ID NO: 78030 - DNA, 75 bp, Artificial Sequence
  Synthetic
gcttgagccctgtgtggttcgcttgtctgaaaatgctactcgaaaaacttggttactcgcacaaggggacaaact

SEQ ID NO: 78031 - DNA, 75 bp, Artificial Sequence
  Synthetic
gccagagaagaggtggaggttaacgaggctgtcctggcaataaacaccagtaagtttccaaacatgtacatccct

SEQ ID NO: 78032 - DNA, 75 bp, Artificial Sequence
  Synthetic
gatgttctggtactagcatctttaactcaatgatcaataacatcataattagaacactgatgttgaaggtgtata

SEQ ID NO: 78033 - DNA, 75 bp, Artificial Sequence
  Synthetic
ccaactagggccggtcagtgtgggggcgttctaatgtcaacagggaaggttctaggcatacatgttggtggaaac

SEQ ID NO: 78034 - DNA, 75 bp, Artificial Sequence
  Synthetic
attgcatcctatccctggccgatcgatgcttccttactcgctgaggcgggtaaggggtatggattgatcatgacg

SEQ ID NO: 78035 - DNA, 75 bp, Artificial Sequence
  Synthetic
aactcgagagacgcagggtttccagtcattaacacacctagcagaactaaactggaaccaagtgtcttccaccaa

SEQ ID NO: 78036 - DNA, 75 bp, Artificial Sequence
  Synthetic
tcattaacacacctagcagaactaaactggaaccaagtgtcttccaccaagtatttgagggcaacaaggaaccgg

SEQ ID NO: 78037 - DNA, 75 bp, Artificial Sequence
  Synthetic
tgaacacacacgtggatgagtacatgatggaggccattgaccattacgcagggcaactagccactctggacatca

SEQ ID NO: 78038 - DNA, 75 bp, Artificial Sequence
  Synthetic
tcatgaatctatcaggtggacaaaagaccccaagaacacccaggaccatgtgcgatctttgtgtttattggcttg

SEQ ID NO: 78039 - DNA, 75 bp, Artificial Sequence
  Synthetic
gatggaggccattgaccattacgcagggcaactagccactctggacatcagcacggagcctatgaagctagagga

SEQ ID NO: 78040 - DNA, 75 bp, Artificial Sequence
  Synthetic
accagcgttttcaaccctgcgcaggaaatggctggactccttttaaattagagacaatttgaaaataatttaaat

SEQ ID NO: 78041 - DNA, 75 bp, Artificial Sequence
  Synthetic
tatcaagaagagggatatcctgtcaaagagaaccaaggacctaaccaagttgaaggagtgtatggataaatatgg

SEQ ID NO: 78042 - DNA, 75 bp, Artificial Sequence
  Synthetic
aagagaaccaaggacctaaccaagttgaaggagtgtatggataaatatggtttgaacctgccaatggtgacttac

SEQ ID NO: 78043 - DNA, 75 bp, Artificial Sequence
  Synthetic
gagacaatttgaaaataatttaaattggcttaaccctaccgcactcaccgaaccagataacggtgcggtaggggt

SEQ ID NO: 78044 - DNA, 75 bp, Artificial Sequence
  Synthetic
gactctgttgcaatgaggcaaacttttggtaacttatacaaatcatttcatctgaacccggggattgtaacgggc

SEQ ID NO: 78045 - DNA, 75 bp, Artificial Sequence
  Synthetic
ttggtaacttatacaaatcatttcatctgaacccggggattgtaacgggcagtgccgtcggttgtgaccccgatc

SEQ ID NO: 78046 - DNA, 75 bp, Artificial Sequence
  Synthetic
tgagccctgtgtggtttgcttgtttaaaactgctgttagaaaaacttggttactcacacaaggagacgaactaca

SEQ ID NO: 78047 - DNA, 75 bp, Artificial Sequence
  Synthetic
aaaactgctgttagaaaaacttggttactcacacaaggagacgaactacattgattacctatgcaactcccacca

SEQ ID NO: 78048 - DNA, 75 bp, Artificial Sequence
  Synthetic
gattgcctatggcgacgatgtgattgcgtcttacccctggccaattgacgcctctttgcttgctgaggccggcaa

SEQ ID NO: 78049 - DNA, 75 bp, Artificial Sequence
  Synthetic
aatgattaacaacattataattaggacattaatgttaaaggtatacaaaagcattgacttagatcaatttaggat

SEQ ID NO: 78050 - DNA, 75 bp, Artificial Sequence
  Synthetic
acattaatgttaaaggtatacaaaagcattgacttagatcaatttaggatgattgcatacggtgacgacgtaatt

SEQ ID NO: 78051 - DNA, 75 bp, Artificial Sequence
  Synthetic
gcagacaaaggagagtgtttcaatgaagtcacctgggctaacgtcacctttttaaagaggtacttcagggcagac

SEQ ID NO: 78052 - DNA, 75 bp, Artificial Sequence
  Synthetic
ccagccatgtcttgatcaagcacttctgtttccccggactgagtatcaataaactgcttgcgcggtcgaaggaga

SEQ ID NO: 78053 - DNA, 75 bp, Artificial Sequence
  Synthetic
aagtcacctgggctaacgtcacctttttaaagaggtacttcagggcagacgaacaataccctttcctggtgcacc

SEQ ID NO: 78054 - DNA, 75 bp, Artificial Sequence
  Synthetic
gatccttgtgcctattggcttggcataatggagagcacgaatacgaagattttgtccagaagattagaagtgtcc

SEQ ID NO: 78055 - DNA, 75 bp, Artificial Sequence
  Synthetic
taatggagagcacgaatacgaagattttgtccagaagattagaagtgtcccagttgggcgctgtctgactctacc

SEQ ID NO: 78056 - DNA, 75 bp, Artificial Sequence
  Synthetic
ccagggggtggcgtgtcgtaacgggcaactctgcagcggaaccgactactttgggtgtccgtgtttcttttaatt

SEQ ID NO: 78057 - DNA, 75 bp, Artificial Sequence
  Synthetic
gatttgtaccacttaccagaacaagttttcatacactgtgttacattattagactaaacacagaaaaatgggagc

SEQ ID NO: 78058 - DNA, 75 bp, Artificial Sequence
  Synthetic
ttttcatacactgtgttacattattagactaaacacagaaaaatgggagctcaagtgtcgacccagaaaactggc

SEQ ID NO: 78059 - DNA, 75 bp, Artificial Sequence
  Synthetic
gcctccaattccgcaaataggcaagacttcacgcaggacccggggaaattcacggagccagttaaagatattatg

SEQ ID NO: 78060 - DNA, 75 bp, Artificial Sequence
  Synthetic
acttcacgcaggacccggggaaattcacggagccagttaaagatattatgattaaatccatgcctgcactaaact

SEQ ID NO: 78061 - DNA, 75 bp, Artificial Sequence
  Synthetic
aagagtgcgctaatgtggtggttggatatggagtgtggcccacctacttgagggacgatgaagcgacggcagaag

SEQ ID NO: 78062 - DNA, 75 bp, Artificial Sequence
  Synthetic
atatggagtgtggcccacctacttgagggacgatgaagcgacggcagaagatcaacccactcagccagatgtggc

SEQ ID NO: 78063 - DNA, 75 bp, Artificial Sequence
  Synthetic
tgcattgtcaaacatgggattgtttggacagaacatgcaataccattatctggggagagctggatatacactaca

SEQ ID NO: 78064 - DNA, 75 bp, Artificial Sequence
  Synthetic
ggacagaacatgcaataccattatctggggagagctggatatacactacacgtgcaatgcaacgcatccaagttt

SEQ ID NO: 78065 - DNA, 75 bp, Artificial Sequence
  Synthetic
cagaagagcttgagcaatggggaaaccgccaacgtgtttgagtctcagaactcttcgggacaaacagccgtccag

SEQ ID NO: 78066 - DNA, 75 bp, Artificial Sequence
  Synthetic
ccgccaacgtgtttgagtctcagaactcttcgggacaaacagccgtccaggcaaacgtaattaacgcaggcatgg

SEQ ID NO: 78067 - DNA, 75 bp, Artificial Sequence
  Synthetic
tcatgccctacgttaacagtgttcccatggacaatatgtttaggcacaataattttactttgatgattattccat

SEQ ID NO: 78068 - DNA, 75 bp, Artificial Sequence
  Synthetic
catggacaatatgtttaggcacaataattttactttgatgattattccatttgccccgctaagttacagcacagg

SEQ ID NO: 78069 - DNA, 75 bp, Artificial Sequence
  Synthetic
caaacaggggcttcccacaatgttaacacccgggagtaatcagttcctcacatctgatgatttccaatcaccttc

SEQ ID NO: 78070 - DNA, 75 bp, Artificial Sequence
  Synthetic
acacccgggagtaatcagttcctcacatctgatgatttccaatcaccttcggcgatgccccagtttgatgtcacg

SEQ ID NO: 78071 - DNA, 75 bp, Artificial Sequence
  Synthetic
aatactgaggggaaggtgatgtccattgaagcctatcagatccctgtacaatcaaactcaaccaacggctcccag

SEQ ID NO: 78072 - DNA, 75 bp, Artificial Sequence
  Synthetic
ttgaagcctatcagatccctgtacaatcaaactcaaccaacggctcccaggtctttggattcccactgactccag

SEQ ID NO: 78073 - DNA, 75 bp, Artificial Sequence
  Synthetic
aactaacatttatgttctgcgggtcagcaatggccacaggcaagttcctactagcatactcacccccaggcgctg

SEQ ID NO: 78074 - DNA, 75 bp, Artificial Sequence
  Synthetic
agcaatggccacaggcaagttcctactagcatactcacccccaggcgctggagcgcctaccacacgcaaggaggc

SEQ ID NO: 78075 - DNA, 75 bp, Artificial Sequence
  Synthetic
aacacattacaggtacgtggtgatggacgaatacaccgctggcggttatataacctgctggtaccaaactaacat

SEQ ID NO: 78076 - DNA, 75 bp, Artificial Sequence
  Synthetic
gacgaatacaccgctggcggttatataacctgctggtaccaaactaacatcgtggtgcctgcggatacccagagt

SEQ ID NO: 78077 - DNA, 75 bp, Artificial Sequence
  Synthetic
aaacaggacagcttctttcaaggacctccaggggaagcaattgagagggccattgctcgcgtggctgacaccata

SEQ ID NO: 78078 - DNA, 75 bp, Artificial Sequence
  Synthetic
ctccaggggaagcaattgagagggccattgctcgcgtggctgacaccataggaagtggaccagtcaactcggaat

SEQ ID NO: 78079 - DNA, 75 bp, Artificial Sequence
  Synthetic
acgtgaaaaattaccactcaaggtcagaatctacagtggagaacttcttgtgtagatccgcatgtgtttactaca

SEQ ID NO: 78080 - DNA, 75 bp, Artificial Sequence
  Synthetic
agaatctacagtggagaacttcttgtgtagatccgcatgtgtttactacaccacatacaaaaatcatggcactga

SEQ ID NO: 78081 - DNA, 75 bp, Artificial Sequence
  Synthetic
gtatgctaggtttgatctggagttaacttttgtcatcacgagctcccaagagcaatccactatcaagggccaaga

SEQ ID NO: 78082 - DNA, 75 bp, Artificial Sequence
  Synthetic
acttttgtcatcacgagctcccaagagcaatccactatcaagggccaagactctccagtactcactcaccagatc

SEQ ID NO: 78083 - DNA, 75 bp, Artificial Sequence
  Synthetic
gtattctggacggagggcagtgccccacctcggatgtcgatacccttcattagcatagggaatgcatatagcatg

SEQ ID NO: 78084 - DNA, 75 bp, Artificial Sequence
  Synthetic
cacctcggatgtcgatacccttcattagcatagggaatgcatatagcatgttttatgatggatgggctagatttg

SEQ ID NO: 78085 - DNA, 75 bp, Artificial Sequence
  Synthetic
gccctggccccattgtgagcacagttcgtatctactttaaaccgaaacacgtgaagacgtgggtcccacgaccac

SEQ ID NO: 78086 - DNA, 75 bp, Artificial Sequence
  Synthetic
tcgtatctactttaaaccgaaacacgtgaagacgtgggtcccacgaccacccagattgtgccagtaccagaaagc

SEQ ID NO: 78087 - DNA, 75 bp, Artificial Sequence
  Synthetic
ctttggacagcaatccggtgccgtgtatgtcggtaattatagagtggtgaatagacacttggccacccatacaga

SEQ ID NO: 78088 - DNA, 75 bp, Artificial Sequence
  Synthetic
tatgtcggtaattatagagtggtgaatagacacttggccacccatacagattggcaaaactgtgtgtgggaagat

SEQ ID NO: 78089 - DNA, 75 bp, Artificial Sequence
  Synthetic
ggagtgtatttctgtgcatcaagaaacaagcactacccagtctcctttgaagggccagggttggttgaagtccag

SEQ ID NO: 78090 - DNA, 75 bp, Artificial Sequence
  Synthetic
acaagcactacccagtctcctttgaagggccagggttggttgaagtccaggaaagtgagtattaccctaagaggt

SEQ ID NO: 78091 - DNA, 75 bp, Artificial Sequence
  Synthetic
gtgccatcggtcttgtcaccatgggtggtgaaggtgtggtggggttcgcagatgtccgcgacctgctgtggcttg

SEQ ID NO: 78092 - DNA, 75 bp, Artificial Sequence
  Synthetic
tggtgaaggtgtggtggggttcgcagatgtccgcgacctgctgtggcttgaggacgatgccatggagcaaggagt

SEQ ID NO: 78093 - DNA, 75 bp, Artificial Sequence
  Synthetic
cctcaaagaatcactggtcggacaagactctattttagagaagtccctcaaggccttaatcaaaattgtgtcagc

SEQ ID NO: 78094 - DNA, 75 bp, Artificial Sequence
  Synthetic
gactctattttagagaagtccctcaaggccttaatcaaaattgtgtcagcactggttattgtggtaagaaatcac

SEQ ID NO: 78095 - DNA, 75 bp, Artificial Sequence
  Synthetic
aaagtatcacagtattacgggatccctatggctgaaaggcaaaacaatgggtggttgaagaagttcacagagatg

SEQ ID NO: 78096 - DNA, 75 bp, Artificial Sequence
  Synthetic
ctatggctgaaaggcaaaacaatgggtggttgaagaagttcacagagatgactaacgcctgcaagggaatggaat

SEQ ID NO: 78097 - DNA, 75 bp, Artificial Sequence
  Synthetic
aattcctaaacagacttaaacaactcccacttttggagagccagattacaaccattgagcaaagcgctccgtccc

SEQ ID NO: 78098 - DNA, 75 bp, Artificial Sequence
  Synthetic
gatcacttcgatggctataaacagcaggccgtggtgatcatggacgatctatgccagaaccccgatgggaaggat

SEQ ID NO: 78099 - DNA, 75 bp, Artificial Sequence
  Synthetic
ggctgccctggaggagaaaggcatcttgttcacttcaccatttgtcctggcatcaactaatgcagggtctataaa

SEQ ID NO: 78100 - DNA, 75 bp, Artificial Sequence
  Synthetic
tgatatgctagtaaccgagatgtttagggaatacaaccacaggcatagcgtaggggctactcttgaggcactgtt

SEQ ID NO: 78101 - DNA, 75 bp, Artificial Sequence
  Synthetic
aggcaataactacattcgtatcagtagctggaatcatctatataatatacaagctcttcgcgggctttcaaggtg

SEQ ID NO: 78102 - DNA, 75 bp, Artificial Sequence
  Synthetic
tatggtgaattcaccatgttgggcatctatgacaggtgggccgtcttgccgcgtcatgccaaacctggaccaacc

SEQ ID NO: 78103 - DNA, 75 bp, Artificial Sequence
  Synthetic
gtgtgttggatgctaaagagttggtggacaaggatggtacaaacctagaactgacactactaaagctgaacagga

SEQ ID NO: 78104 - DNA, 75 bp, Artificial Sequence
  Synthetic
acgagaagttcagagacattagaggcttcttggccaaggaggaggtggaagttaacgaagctgtgctagcaatta

SEQ ID NO: 78105 - DNA, 75 bp, Artificial Sequence
  Synthetic
caacttccccacaagagcgggccagtgtggtggagtgctcatgtccactggtaaagtcttggggatccacgttgg

SEQ ID NO: 78106 - DNA, 75 bp, Artificial Sequence
  Synthetic
cattgagaactcgaaggatgccgggttcccagtcatcaacacgcccagtaagactaagctagagccaagtgtctt

SEQ ID NO: 78107 - DNA, 75 bp, Artificial Sequence
  Synthetic
ttcccagtcatcaacacgcccagtaagactaagctagagccaagtgtcttccaccagatttttgaaggtaataag

SEQ ID NO: 78108 - DNA, 75 bp, Artificial Sequence
  Synthetic
ggaaatgtcaacacacacgtagatgaatacatgctagaagctgttgatcattatgccgggcagttggccacactg

SEQ ID NO: 78109 - DNA, 75 bp, Artificial Sequence
  Synthetic
aatacatgctagaagctgttgatcattatgccgggcagttggccacactggacattagcaccaaaccaatgaaat

SEQ ID NO: 78110 - DNA, 75 bp, Artificial Sequence
  Synthetic
cattgggcatcaagaagagagacattctttccaaaaagaccaaggatttaaccaagttaaaggaatgcatggata

SEQ ID NO: 78111 - DNA, 75 bp, Artificial Sequence
  Synthetic
accaagttaaaggaatgcatggataaatatggcttgaacttgccaatggtaacttatgttaaagacgagctcagg

SEQ ID NO: 78112 - DNA, 75 bp, Artificial Sequence
  Synthetic
gactggcagtgctgttgggtgtgacccagacctcttttggagtaaaataccggtgatgttagatggtcaccttat

SEQ ID NO: 78113 - DNA, 75 bp, Artificial Sequence
  Synthetic
aattatattgattacctgtgcaactcccatcacctgtacagggacaaacactattttgtgcggggtggcatgcct

SEQ ID NO: 78114 - DNA, 75 bp, Artificial Sequence
  Synthetic
tacaaagggattgacttggatcaatttaggatgattgcatatggtgacgacgtgatcgcatcttacccgtggccc

SEQ ID NO: 78115 - DNA, 75 bp, Artificial Sequence
  Synthetic
ttaggatgattgcatatggtgacgacgtgatcgcatcttacccgtggcccatagatgcgtctttgcttgctgaag

SEQ ID NO: 78116 - DNA, 75 bp, Artificial Sequence
  Synthetic
tcacattcctaaagaggtatttcagggcagatgaacaataccccttcttggtgcaccctgtcatgcccatgaaag

SEQ ID NO: 78117 - DNA, 75 bp, Artificial Sequence
  Synthetic
cctggcacaacggggaacacgagtatgaggagttcattcggaaaatcaggagcgttccagttggacgttgcttga

SEQ ID NO: 78118 - DNA, 75 bp, Artificial Sequence
  Synthetic
acctacagggcccactgggcgtcagcacactggtatcccggtacctttgtgcgcctgttttatattccccacccc

SEQ ID NO: 78119 - DNA, 75 bp, Artificial Sequence
  Synthetic
gttcttaaaacacttaatctcatattaaaactcaattcagcaaaatgggggcacaagtgtcaacacagaaaactg

SEQ ID NO: 78120 - DNA, 75 bp, Artificial Sequence
  Synthetic
taaaactcaattcagcaaaatgggggcacaagtgtcaacacagaaaactggcgcacatgagaccagtgtgaatgc

SEQ ID NO: 78121 - DNA, 75 bp, Artificial Sequence
  Synthetic
agatatgtcacaagaccctgccaagtttacagaacctgtgaaggacataatgctaaagtctttaccagcattgaa

SEQ ID NO: 78122 - DNA, 75 bp, Artificial Sequence
  Synthetic
tttacagaacctgtgaaggacataatgctaaagtctttaccagcattgaactccccaacagcagaggagtgtgga

SEQ ID NO: 78123 - DNA, 75 bp, Artificial Sequence
  Synthetic
gcatatggtgaatggcctagataccttagcgacaaggaagcaactgcagaggatcagcccactcagccagatgtt

SEQ ID NO: 78124 - DNA, 75 bp, Artificial Sequence
  Synthetic
ttagcgacaaggaagcaactgcagaggatcagcccactcagccagatgttgctacctgtagattttacactctcg

SEQ ID NO: 78125 - DNA, 75 bp, Artificial Sequence
  Synthetic
tcgggcaaaacatgtactatcattatctagggcgtgcgggttacaccatacacgtccaatgcaatgcatccaaat

SEQ ID NO: 78126 - DNA, 75 bp, Artificial Sequence
  Synthetic
tctagggcgtgcgggttacaccatacacgtccaatgcaatgcatccaaatttcatcaaggttgcttgctggtggt

SEQ ID NO: 78127 - DNA, 75 bp, Artificial Sequence
  Synthetic
aagacccaagcactttacagctcagaaatctgtgacagaacatgatgtgcaaactgcggtgtggaacgctgctat

SEQ ID NO: 78128 - DNA, 75 bp, Artificial Sequence
  Synthetic
aaatctgtgacagaacatgatgtgcaaactgcggtgtggaacgctgctatgggagtgggcgtagggaacttgacc

SEQ ID NO: 78129 - DNA, 75 bp, Artificial Sequence
  Synthetic
ccaatggacaccatgtatagacaccaaaactttaccctgatgataattccattcgtagagctagccaccaacagc

SEQ ID NO: 78130 - DNA, 75 bp, Artificial Sequence
  Synthetic
aaaactttaccctgatgataattccattcgtagagctagccaccaacagcaccgcttccaacaaggtgcctatca

SEQ ID NO: 78131 - DNA, 75 bp, Artificial Sequence
  Synthetic
tgacacccggcagtaaccaatttttaacatctgatgactttcagtcaccatcagcaatgccacagttcgacgtca

SEQ ID NO: 78132 - DNA, 75 bp, Artificial Sequence
  Synthetic
aacatctgatgactttcagtcaccatcagcaatgccacagttcgacgtcacaccacagatgcacattccaggaga

SEQ ID NO: 78133 - DNA, 75 bp, Artificial Sequence
  Synthetic
gcttgaagcctaccggatccctgtgaacacgggcagtcactctggtgatggcgcgatattctccttccacttaga

SEQ ID NO: 78134 - DNA, 75 bp, Artificial Sequence
  Synthetic
aacacgggcagtcactctggtgatggcgcgatattctccttccacttagaccctggtagtggttccgtcttgaag

SEQ ID NO: 78135 - DNA, 75 bp, Artificial Sequence
  Synthetic
gggactgccatgacaacaggcaaacttctgttggcttattcacctcctggagcggatgtgccaaagaaacgcaag

SEQ ID NO: 78136 - DNA, 75 bp, Artificial Sequence
  Synthetic
ttctgttggcttattcacctcctggagcggatgtgccaaagaaacgcaaggatgccatgctcggcacccatatta

SEQ ID NO: 78137 - DNA, 75 bp, Artificial Sequence
  Synthetic
acacagatgtgtatactagtgcggggtatatcacatgctggtatcaaaccagcatcgtggttccaccagacaccc

SEQ ID NO: 78138 - DNA, 75 bp, Artificial Sequence
  Synthetic
gtatatcacatgctggtatcaaaccagcatcgtggttccaccagacacccccaccaattgcaagatcttgtgctt

SEQ ID NO: 78139 - DNA, 75 bp, Artificial Sequence
  Synthetic
gggtgacgacgcaaggactgttagcaacacacaaaagagccagccatctaactctgagcaagtgcctgccttaac

SEQ ID NO: 78140 - DNA, 75 bp, Artificial Sequence
  Synthetic
aacacacaaaagagccagccatctaactctgagcaagtgcctgccttaacagcggttgagactggacacacctct

SEQ ID NO: 78141 - DNA, 75 bp, Artificial Sequence
  Synthetic
aatttctttgggagggctgcgtgtgtgagggtgagagagtactctatagggcatgatttggcagcggacgaaaca

SEQ ID NO: 78142 - DNA, 75 bp, Artificial Sequence
  Synthetic
tgagggtgagagagtactctatagggcatgatttggcagcggacgaaacatatgatagctgggccattacagtgc

SEQ ID NO: 78143 - DNA, 75 bp, Artificial Sequence
  Synthetic
tcaccagctatcaagaaccagggacaatcaccacccaggatatgcccgtcctaacccaccagattatgtatgtgc

SEQ ID NO: 78144 - DNA, 75 bp, Artificial Sequence
  Synthetic
aatcaccacccaggatatgcccgtcctaacccaccagattatgtatgtgccgccaggaggcccggtcccagccaa

SEQ ID NO: 78145 - DNA, 75 bp, Artificial Sequence
  Synthetic
gtctatcccatacattggcatcggcaatgcatatagcagcttttatgacgggtggtcgagcttcaacaactcggg

SEQ ID NO: 78146 - DNA, 75 bp, Artificial Sequence
  Synthetic
aatgcatatagcagcttttatgacgggtggtcgagcttcaacaactcgggtgtgtatggctacacaaccctgaat

SEQ ID NO: 78147 - DNA, 75 bp, Artificial Sequence
  Synthetic
ttcaagcccaagcacgtccaggcgtgggtcccaagaccaccgcgcttgtgcccgtatctgaataagagggatgtc

SEQ ID NO: 78148 - DNA, 75 bp, Artificial Sequence
  Synthetic
gggtcccaagaccaccgcgcttgtgcccgtatctgaataagagggatgtcaactttgaagtgcaacccgttacga

SEQ ID NO: 78149 - DNA, 75 bp, Artificial Sequence
  Synthetic
ctggggctgtatacgtgggcaactacagagtggttaacaggcacttggccacacacgcggactggcaaaactgcg

SEQ ID NO: 78150 - DNA, 75 bp, Artificial Sequence
  Synthetic
cagagtggttaacaggcacttggccacacacgcggactggcaaaactgcgtttgggaagactataatagggacct

SEQ ID NO: 78151 - DNA, 75 bp, Artificial Sequence
  Synthetic
ccaatccaggaataagcactacccggtcagctttgaaggaccaggcatagtggaagttcaagagagtgaatacta

SEQ ID NO: 78152 - DNA, 75 bp, Artificial Sequence
  Synthetic
gtcagctttgaaggaccaggcatagtggaagttcaagagagtgaatactaccctaggagataccaatcgcatgta

SEQ ID NO: 78153 - DNA, 75 bp, Artificial Sequence
  Synthetic
gtgaccatgggtggtgagggtgtcgtcggttttgctgacgtgcgagatctcttgtggttagaggatgatgccatg

SEQ ID NO: 78154 - DNA, 75 bp, Artificial Sequence
  Synthetic
caagtcaacctgttaaaagagtccctggtagggcaagactccattttagaaaagtctctcaaggctcttgttaag

SEQ ID NO: 78155 - DNA, 75 bp, Artificial Sequence
  Synthetic
tggtagggcaagactccattttagaaaagtctctcaaggctcttgttaagatcatatcagccttagtcattgtgg

SEQ ID NO: 78156 - DNA, 75 bp, Artificial Sequence
  Synthetic
ggctcaagcagaaagtgtcccaatactatggaattcccatggctgaaagacagaacaatggttggcttaagaagt

SEQ ID NO: 78157 - DNA, 75 bp, Artificial Sequence
  Synthetic
ctatggaattcccatggctgaaagacagaacaatggttggcttaagaagttcacggaaatgacaaatgcctgtaa

SEQ ID NO: 78158 - DNA, 75 bp, Artificial Sequence
  Synthetic
ggaaaaacatgaattcttgaacagactaaagcaattaccactattggagagtcaaatagccaccatagagcaaag

SEQ ID NO: 78159 - DNA, 75 bp, Artificial Sequence
  Synthetic
ctaaagcaattaccactattggagagtcaaatagccaccatagagcaaagtgcaccttcacagagtgatcaggaa

SEQ ID NO: 78160 - DNA, 75 bp, Artificial Sequence
  Synthetic
agggtcttctctttggaaaagaagatgagcaactatatacagttcaagtccaaatgccgtattgaacctgtttgt

SEQ ID NO: 78161 - DNA, 75 bp, Artificial Sequence
  Synthetic
tgagcaactatatacagttcaagtccaaatgccgtattgaacctgtttgtctgttgctccacggaagtcctggcg

SEQ ID NO: 78162 - DNA, 75 bp, Artificial Sequence
  Synthetic
caccagaccctgatcacttcgatggatacaaacagcaagctgttgtcatcatggatgatttgtgtcaaaacccag

SEQ ID NO: 78163 - DNA, 75 bp, Artificial Sequence
  Synthetic
atacaaacagcaagctgttgtcatcatggatgatttgtgtcaaaacccagatggtaaggacgtgtccctattctg

SEQ ID NO: 78164 - DNA, 75 bp, Artificial Sequence
  Synthetic
tttcgtcctggcttcaactaatgctggctccataaacgcaccgacagtttcagacagtcgggcattggctagaag

SEQ ID NO: 78165 - DNA, 75 bp, Artificial Sequence
  Synthetic
gtaagatcaatatgcccatgtcagtcaagacgtgcgatgaagagtgttgcccagttaacttcaagagatgttgcc

SEQ ID NO: 78166 - DNA, 75 bp, Artificial Sequence
  Synthetic
ctgcaaggagaaaggatggctagttcctgaaattaactctactctccaaattgagaaacatgttagtcgggcctt

SEQ ID NO: 78167 - DNA, 75 bp, Artificial Sequence
  Synthetic
acaaccacagcccatggctgtgacaccatagccagatgtcaatgcacaaccggggtgtatttctgtgcctcaagg

SEQ ID NO: 78168 - DNA, 75 bp, Artificial Sequence
  Synthetic
acatcatttataaattgtttgcagggttccagggcgcatatacggggatgcctaaccaaaaacccaaagtgccta

SEQ ID NO: 78169 - DNA, 75 bp, Artificial Sequence
  Synthetic
aaggagctagtggacaaagatggcacaaacctggagctgacactactgaaacttaaccggaacgagaaattcaga

SEQ ID NO: 78170 - DNA, 75 bp, Artificial Sequence
  Synthetic
cccaatatgtatattcctgtggggcaggtcacagactatggttttctaaacctaggtggcactcctactaagaga

SEQ ID NO: 78171 - DNA, 75 bp, Artificial Sequence
  Synthetic
aggtcacagactatggttttctaaacctaggtggcactcctactaagagaatgctaatgtacaactttccaacga

SEQ ID NO: 78172 - DNA, 75 bp, Artificial Sequence
  Synthetic
gctgctgaggccaaaagagtgttcgccctcgaaaagaaaatgagcaactacatacagttcaagtccaaatgccgt

SEQ ID NO: 78173 - DNA, 75 bp, Artificial Sequence
  Synthetic
gagattgagttcattgaaagctcaaaagacgcagggttcccagttatcaacacaccaagcaagacaaaattggaa

SEQ ID NO: 78174 - DNA, 75 bp, Artificial Sequence
  Synthetic
aagggaacaaagaaccagcggttctcaggaatggagacccacgtctcaaagccaactttgaagaggccatattct

SEQ ID NO: 78175 - DNA, 75 bp, Artificial Sequence
  Synthetic
tggccaccctcgacatcaacactgaaccaatgaagttggaggacgcagtgtacggtaccgagggtttggaggctc

SEQ ID NO: 78176 - DNA, 75 bp, Artificial Sequence
  Synthetic
accaatgaagttggaggacgcagtgtacggtaccgagggtttggaggctctagacctaacaaccagtgcagggta

SEQ ID NO: 78177 - DNA, 75 bp, Artificial Sequence
  Synthetic
gtgcatggataagtatggcctgaatttgccaatggttacctatgtgaaggacgagctaagatcagcagagaaagt

SEQ ID NO: 78178 - DNA, 75 bp, Artificial Sequence
  Synthetic
ttgccaatggttacctatgtgaaggacgagctaagatcagcagagaaagtggccaagggtaaatccagactcatt

SEQ ID NO: 78179 - DNA, 75 bp, Artificial Sequence
  Synthetic
ccgggaatcgtgaccggcagtgcagtcggatgcgatccagacctcttttggagtaagatacctgtaatgctggac

SEQ ID NO: 78180 - DNA, 75 bp, Artificial Sequence
  Synthetic
tgtttggtttgcttgtctaaaactgctacttgaaaaactcgggtatacacacaaggagacaaattacattgacta

SEQ ID NO: 78181 - DNA, 75 bp, Artificial Sequence
  Synthetic
tactagcatcttcaactcaatgatcaacaacattataattagaacactaatgctgaaggtgtataaaggtattga

SEQ ID NO: 78182 - DNA, 75 bp, Artificial Sequence
  Synthetic
tctggatcagttcaggatgatagcatatggtgatgatgtgatagcatcatacccgtggcctattgacgcatcctt

SEQ ID NO: 78183 - DNA, 75 bp, Artificial Sequence
  Synthetic
atgggctaatgtcacctttttaaagaggtacttcagagcagatgagcaataccctttcttagtccaccctgtcat

SEQ ID NO: 78184 - DNA, 75 bp, Artificial Sequence
  Synthetic
aggtacttcagagcagatgagcaataccctttcttagtccaccctgtcatgcccatgaaagacatccacgaatcc

SEQ ID NO: 78185 - DNA, 75 bp, Artificial Sequence
  Synthetic
gtgcttattggcctggcataatggagagcacgaatatgaggagttcatccggaagatcagaagcattccggtcgg

SEQ ID NO: 78186 - DNA, 75 bp, Artificial Sequence
  Synthetic
gagcacgaatatgaggagttcatccggaagatcagaagcattccggtcggacgctgtttgactctacctgcgttt

SEQ ID NO: 78187 - DNA, 75 bp, Artificial Sequence
  Synthetic
gtctattgagctagttagtagtcctccggcccctgaatgcggctaatcctaactgtggagcatgcgcccccactc

SEQ ID NO: 78188 - DNA, 75 bp, Artificial Sequence
  Synthetic
tgaaagattgttaccatatagctattggattggccatccggtgacaaacagagctataatttaccagtttgtggg

SEQ ID NO: 78189 - DNA, 75 bp, Artificial Sequence
  Synthetic
caggtgtcaacacaaaagaccggtgcacacgagaccagcttaagtgcaaccggcaactctattatccactataca

SEQ ID NO: 78190 - DNA, 75 bp, Artificial Sequence
  Synthetic
gcaggaaatggctggactccttttaaattagagacaatttgagaataattcaaattggcttaaccctaccgcact

SEQ ID NO: 78191 - DNA, 75 bp, Artificial Sequence
  Synthetic
taaaacagcctgtgggttgttcccacccacagggcccactgggcgccagcacactggtatcttggtacctttgtg

SEQ ID NO: 78192 - DNA, 75 bp, Artificial Sequence
  Synthetic
tatggagtgtggcccacctacttaagcgataatgaagccactgcagtggaccagccgacgcagcctgatgtggca

SEQ ID NO: 78193 - DNA, 75 bp, Artificial Sequence
  Synthetic
agggtggtggtggaagtttccagaagcccttagtgatatgggactgtttgggcagaacatgcaataccactacct

SEQ ID NO: 78194 - DNA, 75 bp, Artificial Sequence
  Synthetic
gcccttagtgatatgggactgtttgggcagaacatgcaataccactacctgggaaggactggatacaccattcat

SEQ ID NO: 78195 - DNA, 75 bp, Artificial Sequence
  Synthetic
gccaccgccgatcatgctatgaatcacacaaagctaagtaacattggtcaagcgatggagttcagtgcagagaaa

SEQ ID NO: 78196 - DNA, 75 bp, Artificial Sequence
  Synthetic
agcacagaccaaacgggaccacaaaccgcagttcataacgcgggcatgggcatagctgtggggaacttaacaata

SEQ ID NO: 78197 - DNA, 75 bp, Artificial Sequence
  Synthetic
gtggactcggtcgttcctgtgaacaacactgagggaaatgttaactcaatggaggcttacaggataccagtgagg

SEQ ID NO: 78198 - DNA, 75 bp, Artificial Sequence
  Synthetic
acactgagggaaatgttaactcaatggaggcttacaggataccagtgaggccacagaccagtagtggcgagcaag

SEQ ID NO: 78199 - DNA, 75 bp, Artificial Sequence
  Synthetic
atgctcgggacgcatgtcatatgggacgttgggttgcaatcgagctgcgtgctgtgcgtaccatggattagtcaa

SEQ ID NO: 78200 - DNA, 75 bp, Artificial Sequence
  Synthetic
caagtaccatattgtgctttgtgtccgcgtgcaatgacttctctgtgagactcctgcgtgacacaccatttataa

SEQ ID NO: 78201 - DNA, 75 bp, Artificial Sequence
  Synthetic
tcaatacgctacagagaaagtcaatgatgagttagacaggtacactaactgggagataacaaccaggcaagtggc

SEQ ID NO: 78202 - DNA, 75 bp, Artificial Sequence
  Synthetic
gatgagttagacaggtacactaactgggagataacaaccaggcaagtggcgcagctgaggcgcaaactggagatg

SEQ ID NO: 78203 - DNA, 75 bp, Artificial Sequence
  Synthetic
tcggactcccctccactaactcaccaagtaatgtacgtaccaccgggaggtccaatccctaaaagttatgaggat

SEQ ID NO: 78204 - DNA, 75 bp, Artificial Sequence
  Synthetic
aagtaatgtacgtaccaccgggaggtccaatccctaaaagttatgaggattttgcgtggcagacatccaccaacc

SEQ ID NO: 78205 - DNA, 75 bp, Artificial Sequence
  Synthetic
ttttaaattagagacaatttgactatttgagttggcttaaccctactgcatcaaccgaactagacaacgtgcagt

SEQ ID NO: 78206 - DNA, 75 bp, Artificial Sequence
  Synthetic
gcaacttctatgatgggtggtcccacttcagtcagagcggcgtttatggatacaccaccttgaacaacatgggtc

SEQ ID NO: 78207 - DNA, 75 bp, Artificial Sequence
  Synthetic
cactctggtatcacggtacctttgtgcgcctgttttattaccccttccccaattgaaaattagaagcaatgcaca

SEQ ID NO: 78208 - DNA, 75 bp, Artificial Sequence
  Synthetic
cttcagtcagagcggcgtttatggatacaccaccttgaacaacatgggtcacttatactttaggcatgtgaacaa

SEQ ID NO: 78209 - DNA, 75 bp, Artificial Sequence
  Synthetic
cagtcacgtctcgatcaagcacttctgtttccccggaccgagtatcaatagactgctcacgcggttgaaggagaa

SEQ ID NO: 78210 - DNA, 75 bp, Artificial Sequence
  Synthetic
cgcaccacgcttgtgcccgtatttgtatgcgaggaacgtcaactttaatgtgcaaggggtgaccgagtcccggga

SEQ ID NO: 78211 - DNA, 75 bp, Artificial Sequence
  Synthetic
ttttcggccaacaatcaggagcagcatatgtgggcaactacagggtggtcaacaggcatcttgccacgcacaacg

SEQ ID NO: 78212 - DNA, 75 bp, Artificial Sequence
  Synthetic
tcattgccagatgtcagtgctccacaggtgtgtacttttgcgcatctaggaataaacactacccagtatcatttg

SEQ ID NO: 78213 - DNA, 75 bp, Artificial Sequence
  Synthetic
cggggttttctgaaccaggtgactgtgggggcatcttgaggtgcgaacatggtgtcatagggcttgtgaccatgg

SEQ ID NO: 78214 - DNA, 75 bp, Artificial Sequence
  Synthetic
tgggggcatcttgaggtgcgaacatggtgtcatagggcttgtgaccatggggggcgaaggtattgtcggctttgc

SEQ ID NO: 78215 - DNA, 75 bp, Artificial Sequence
  Synthetic
ctttaacacattgaaatatatcttaaagttaaacacagcaaaatgggagctcaagtgtcaacgcagaaaacaggt

SEQ ID NO: 78216 - DNA, 75 bp, Artificial Sequence
  Synthetic
aagttaaacacagcaaaatgggagctcaagtgtcaacgcagaaaacaggtgcccacgagactagcctgagtgcta

SEQ ID NO: 78217 - DNA, 75 bp, Artificial Sequence
  Synthetic
atttctcacaagatcctagcaaattcaccgagccaatgaaagacatcatggtcaaatcactgccagccttgaact

SEQ ID NO: 78218 - DNA, 75 bp, Artificial Sequence
  Synthetic
caccgagccaatgaaagacatcatggtcaaatcactgccagccttgaactcaccgaaagccgaggagtgtggata

SEQ ID NO: 78219 - DNA, 75 bp, Artificial Sequence
  Synthetic
cgtcaccatggcgttggctcaaacagaaggtgtctcaatattatggaatacccatggccgaacgccaaaataacg

SEQ ID NO: 78220 - DNA, 75 bp, Artificial Sequence
  Synthetic
gtatggtgagtggccagattacctaagtgacaaagaagcggttgctgaagatcagcccacacaacccgatgtggc

SEQ ID NO: 78221 - DNA, 75 bp, Artificial Sequence
  Synthetic
gaaggtgtctcaatattatggaatacccatggccgaacgccaaaataacgggtggcttaagaaatttacggaaat

SEQ ID NO: 78222 - DNA, 75 bp, Artificial Sequence
  Synthetic
agtgacaaagaagcggttgctgaagatcagcccacacaacccgatgtggctacatgccgcttttacacactggat

SEQ ID NO: 78223 - DNA, 75 bp, Artificial Sequence
  Synthetic
cttgccagaggtaaaagagaagcatgaattcctcaccagactcaaacaactccccctcttagaaagccagattgc

SEQ ID NO: 78224 - DNA, 75 bp, Artificial Sequence
  Synthetic
ggacaaaacatgttgtaccactacctgggtcgaacgggatataccatacatgtgcagtgcaacgcatccaagttt

SEQ ID NO: 78225 - DNA, 75 bp, Artificial Sequence
  Synthetic
tgggtcgaacgggatataccatacatgtgcagtgcaacgcatccaagtttcatcaaggttgcctgttggtagtgt

SEQ ID NO: 78226 - DNA, 75 bp, Artificial Sequence
  Synthetic
caccatagagcagagtgcgccatctcagagtgaccaggagcaactcttttcaaacgtgcagtactttgctcacta

SEQ ID NO: 78227 - DNA, 75 bp, Artificial Sequence
  Synthetic
ctgcaatgaacttcaccaaaacacgtgcgaacactacaaacggtgtccaaacggccatccacaacgctgggatgg

SEQ ID NO: 78228 - DNA, 75 bp, Artificial Sequence
  Synthetic
catacagttcaagtccaaatgccgcattgagcctgtatgtctgctcttacatgggagccctggtgctggcaagtc

SEQ ID NO: 78229 - DNA, 75 bp, Artificial Sequence
  Synthetic
tgcgaacactacaaacggtgtccaaacggccatccacaacgctgggatgggggtggccaccggcaacttgaccat

SEQ ID NO: 78230 - DNA, 75 bp, Artificial Sequence
  Synthetic
tatggacaacatgtacagacaccataatttcacactgatgatcatcccgttcgccccattagacttcgccactgg

SEQ ID NO: 78231 - DNA, 75 bp, Artificial Sequence
  Synthetic
aatttcacactgatgatcatcccgttcgccccattagacttcgccactggagcctcatcatacgtccctataaca

SEQ ID NO: 78232 - DNA, 75 bp, Artificial Sequence
  Synthetic
acaccaggtagcaatcagttccttacatcagatgactttcaatcaccatcggcaatgccacagtttgatgtaacc

SEQ ID NO: 78233 - DNA, 75 bp, Artificial Sequence
  Synthetic
catcagatgactttcaatcaccatcggcaatgccacagtttgatgtaaccccagaaatgcacatacctggtgagg

SEQ ID NO: 78234 - DNA, 75 bp, Artificial Sequence
  Synthetic
catgcccatgtcagtgaaaacgtgcgatgaagagtgttgcccagtaaattttaaaagatgttgcccccttgtgtg

SEQ ID NO: 78235 - DNA, 75 bp, Artificial Sequence
  Synthetic
tggaggcctatcgagtgggagtggtgccgaacgcagaggcaggaaagcaaatatttgggtttcagttgcaacccg

SEQ ID NO: 78236 - DNA, 75 bp, Artificial Sequence
  Synthetic
gccgaacgcagaggcaggaaagcaaatatttgggtttcagttgcaacccggtgctagctctgtgtttaaacgcac

SEQ ID NO: 78237 - DNA, 75 bp, Artificial Sequence
  Synthetic
cagagagtacaaccacaggcacagcgtgggggcaacactcgaggcacttttccaaggcccacctgcatatagaga

SEQ ID NO: 78238 - DNA, 75 bp, Artificial Sequence
  Synthetic
ggctatggctacaggcaaatttctgctcgcatattcaccccctggtgctggtgtgcccaaagatcggaaaggagc

SEQ ID NO: 78239 - DNA, 75 bp, Artificial Sequence
  Synthetic
ctcgcatattcaccccctggtgctggtgtgcccaaagatcggaaaggagcgatgctgggaacccacgtcgtatgg

SEQ ID NO: 78240 - DNA, 75 bp, Artificial Sequence
  Synthetic
ggcagttagagagtactgcaaggaaagggggtggttggtgcctgaaattaattctactctgcaaattgagaaaca

SEQ ID NO: 78241 - DNA, 75 bp, Artificial Sequence
  Synthetic
agggggtggttggtgcctgaaattaattctactctgcaaattgagaaacatgtgagtagagcttttatctgccta

SEQ ID NO: 78242 - DNA, 75 bp, Artificial Sequence
  Synthetic
gatgtgtacacggacgcaggttttgtcacttgctggtatcaaacgagtgttgttgccccagctcatgcccagagt

SEQ ID NO: 78243 - DNA, 75 bp, Artificial Sequence
  Synthetic
tcacttgctggtatcaaacgagtgttgttgccccagctcatgcccagagtgcatgttatatacttggatttgtct

SEQ ID NO: 78244 - DNA, 75 bp, Artificial Sequence
  Synthetic
ggccaaggttcaagggccagcttttgaatttgcggtggccatgatgaagagaaacgccagtactgtaaaaaccga

SEQ ID NO: 78245 - DNA, 75 bp, Artificial Sequence
  Synthetic
atgtctgtgaggaagtagagagggctattaccagggttgcagatactgtcggacgcggtcctgctaacactgaga

SEQ ID NO: 78246 - DNA, 75 bp, Artificial Sequence
  Synthetic
tattaccagggttgcagatactgtcggacgcggtcctgctaacactgagagtgtaccagcgctgactgcagttga

SEQ ID NO: 78247 - DNA, 75 bp, Artificial Sequence
  Synthetic
gaaacgccagtactgtaaaaaccgagtacggcgagttcacgatgcttggcatctatgacaggtgggcagtgttgc

SEQ ID NO: 78248 - DNA, 75 bp, Artificial Sequence
  Synthetic
tagatagagatggcaccaatttggaattaacactcttgaaactcaatagaaatgaaaagttcagagacattcgag

SEQ ID NO: 78249 - DNA, 75 bp, Artificial Sequence
  Synthetic
agaatcatctgtggaaaatttcatgtgcagagcagcgtgtgtgtattatgtggattaccacacacaaaatgacag

SEQ ID NO: 78250 - DNA, 75 bp, Artificial Sequence
  Synthetic
tgcagagcagcgtgtgtgtattatgtggattaccacacacaaaatgacagtgaggatgaaaaatatgcatcttgg

SEQ ID NO: 78251 - DNA, 75 bp, Artificial Sequence
  Synthetic
aacaccagtaagtttccaaacatgtacatcccagttggtcaagtgacagactatggattcctcaacctgggtggt

SEQ ID NO: 78252 - DNA, 75 bp, Artificial Sequence
  Synthetic
acatcccagttggtcaagtgacagactatggattcctcaacctgggtggtaccccaactaagcgcatgttgatgt

SEQ ID NO: 78253 - DNA, 75 bp, Artificial Sequence
  Synthetic
atcacattcgtgatcaccaccacacagcagcaatccacagctcccaaccccgacactcctctgctgacacaccag

SEQ ID NO: 78254 - DNA, 75 bp, Artificial Sequence
  Synthetic
agcagcaatccacagctcccaaccccgacactcctctgctgacacaccagatcatgtatgtgcccccgggtggcc

SEQ ID NO: 78255 - DNA, 75 bp, Artificial Sequence
  Synthetic
ggcaaggtgcttgggatacacgtcggtggtaatggacaccaagggttctcggcagccttgctacgtcactacttc

SEQ ID NO: 78256 - DNA, 75 bp, Artificial Sequence
  Synthetic
caccacccagaatgtcaataccctttataagtgtgggaaatgcatacagcagtttttatgatgggtggtcacatt

SEQ ID NO: 78257 - DNA, 75 bp, Artificial Sequence
  Synthetic
tataagtgtgggaaatgcatacagcagtttttatgatgggtggtcacatttcactcagaatggggtgtacgggtt

SEQ ID NO: 78258 - DNA, 75 bp, Artificial Sequence
  Synthetic
aaaacaaagcttgagcctagcgtattctaccacatctttgaagggaataaggagccagcagtgttgaggaacggg

SEQ ID NO: 78259 - DNA, 75 bp, Artificial Sequence
  Synthetic
agcccgcatttatttcaaaccaaagcatgtgcgtgcgtgggttcccagacctcccaggctctgtgaatacaacaa

SEQ ID NO: 78260 - DNA, 75 bp, Artificial Sequence
  Synthetic
catgtgcgtgcgtgggttcccagacctcccaggctctgtgaatacaacaatcgagccaacgtgaactttgaacca

SEQ ID NO: 78261 - DNA, 75 bp, Artificial Sequence
  Synthetic
agggcttagaggctctagatctgaccacaagtgcggggtacccctacgttgccctcggtattaagaagagagaca

SEQ ID NO: 78262 - DNA, 75 bp, Artificial Sequence
  Synthetic
actggtgcgtttggtcaacaatcaggcgctgcttatgtgggcaactacagagtagtgaacagacacctagctaca

SEQ ID NO: 78263 - DNA, 75 bp, Artificial Sequence
  Synthetic
gcgctgcttatgtgggcaactacagagtagtgaacagacacctagctacacacacagactggcgaaactgcgtat

SEQ ID NO: 78264 - DNA, 75 bp, Artificial Sequence
  Synthetic
gtcagcagaaaaagtggctaaaggcaaatccaggctgattgaggcgtccagcttaaacgactcagtggcaatgag

SEQ ID NO: 78265 - DNA, 75 bp, Artificial Sequence
  Synthetic
gcacgacgggagtttatttctgtcaaagcaagaacaagcactacccagtctcatttgagggcccaggcctagttg

SEQ ID NO: 78266 - DNA, 75 bp, Artificial Sequence
  Synthetic
aagcaagaacaagcactacccagtctcatttgagggcccaggcctagttgaagtccaagagagtgagtactaccc

SEQ ID NO: 78267 - DNA, 75 bp, Artificial Sequence
  Synthetic
ccagtcatgctcgacggccacctcattgcctttgattatagtgggtatgatgctagcttgagtccggtgtggttc

SEQ ID NO: 78268 - DNA, 75 bp, Artificial Sequence
  Synthetic
cgaacatggtgtgatagggctcgttaccatgggtggtgaaggtgttgtaggatttgcagatgtacgtgacctcct

SEQ ID NO: 78269 - DNA, 75 bp, Artificial Sequence
  Synthetic
tcccaccacttgtacagagacaaacactactttgtaagagggggaatgccatccgggtgttccggaaccagcatt

SEQ ID NO: 78270 - DNA, 75 bp, Artificial Sequence
  Synthetic
ctttacaaaccaaattcatgaacagataaatcttctgaaagagtccctggtgggtcaagactccatcttggagaa

SEQ ID NO: 78271 - DNA, 75 bp, Artificial Sequence
  Synthetic
cggaatacccatggctgaacgccaaaataacggatggcttaagaaattcactgagatgacaaacgcttgcaaggg

SEQ ID NO: 78272 - DNA, 75 bp, Artificial Sequence
  Synthetic
aataacggatggcttaagaaattcactgagatgacaaacgcttgcaagggtatggaatggatagccatcaaaatt

SEQ ID NO: 78273 - DNA, 75 bp, Artificial Sequence
  Synthetic
aagcaactccctctattagaaagtcagatcgccacaatcgaacagagcgcaccatcccagagtgatcaagagcaa

SEQ ID NO: 78274 - DNA, 75 bp, Artificial Sequence
  Synthetic
aaccgaggttagaccaagcacttctgtctccccggactgagtatcaataggctgctaacgcggctgaaggagaaa

SEQ ID NO: 78275 - DNA, 75 bp, Artificial Sequence
  Synthetic
ccactttgacatgaacattgaagttatttccatgtatagccaaaatggcaagataaacatgccaatgtcagtgaa

SEQ ID NO: 78276 - DNA, 75 bp, Artificial Sequence
  Synthetic
ttacaaacactaaacctcatattatcatttaatagtgcaaaatgggagctcaggtgtcgacacagaagactgggg

SEQ ID NO: 78277 - DNA, 75 bp, Artificial Sequence
  Synthetic
catttaatagtgcaaaatgggagctcaggtgtcgacacagaagactggggcacacgagaccgggctgaatgcaca

SEQ ID NO: 78278 - DNA, 75 bp, Artificial Sequence
  Synthetic
cttccaacaggaccctggaaagttcaccgaacccatgaaagacattatgataaagtccctgccagctttaaactc

SEQ ID NO: 78279 - DNA, 75 bp, Artificial Sequence
  Synthetic
accgaacccatgaaagacattatgataaagtccctgccagctttaaactcgccatccgcagaggaatgtggttat

SEQ ID NO: 78280 - DNA, 75 bp, Artificial Sequence
  Synthetic
atgaagaggaactcaagcacagtgaaaactgaatatggtgaattcaccatgttgggcatctatgataggtgggct

SEQ ID NO: 78281 - DNA, 75 bp, Artificial Sequence
  Synthetic
tacggtgaatggccaaactatctagaagatgaccaggctactgcggaagaccaaccaacacaacctgacgtggca

SEQ ID NO: 78282 - DNA, 75 bp, Artificial Sequence
  Synthetic
aagatgaccaggctactgcggaagaccaaccaacacaacctgacgtggcaacgtgtaggttttacaccttggact

SEQ ID NO: 78283 - DNA, 75 bp, Artificial Sequence
  Synthetic
gccagaacatgtattatcattacctgggcagggctggttataccatacatgtgcagtgcaacgcatccaagttcc

SEQ ID NO: 78284 - DNA, 75 bp, Artificial Sequence
  Synthetic
gggcagggctggttataccatacatgtgcagtgcaacgcatccaagttccaccagggttgcttgctagtagtctg

SEQ ID NO: 78285 - DNA, 75 bp, Artificial Sequence
  Synthetic
agcaattaacaccagcaagttccccaacatgtacatcccagtaggacaagtcacggattacggtttcctgaatct

SEQ ID NO: 78286 - DNA, 75 bp, Artificial Sequence
  Synthetic
tgcgaaagaatttacaccaggaaatgcaaccaaggaaaatggcaaagttcagaccgcaatatgtaatgctgccat

SEQ ID NO: 78287 - DNA, 75 bp, Artificial Sequence
  Synthetic
gcaaccaaggaaaatggcaaagttcagaccgcaatatgtaatgctgccatgggggtcggtgtgggcaatctgaca

SEQ ID NO: 78288 - DNA, 75 bp, Artificial Sequence
  Synthetic
ccgatggacaacatgttcaggcattataacttcacactgatggtaataccatttgccccactaaaaacagtaggg

SEQ ID NO: 78289 - DNA, 75 bp, Artificial Sequence
  Synthetic
ataacttcacactgatggtaataccatttgccccactaaaaacagtagggggatcttcatatgtaccaatcacca

SEQ ID NO: 78290 - DNA, 75 bp, Artificial Sequence
  Synthetic
aattttgaggaagccatcttttccaaatacatcggaaatgttaacacacacgtggatgaatacatgctggaagcc

SEQ ID NO: 78291 - DNA, 75 bp, Artificial Sequence
  Synthetic
aatacatcggaaatgttaacacacacgtggatgaatacatgctggaagccgttgaccactacgctgggcaattag

SEQ ID NO: 78292 - DNA, 75 bp, Artificial Sequence
  Synthetic
ataccccaggtagtaaccagtttctaacctctgacgactatcagtcgccatgcgctatgcctgagtttgatgtca

SEQ ID NO: 78293 - DNA, 75 bp, Artificial Sequence
  Synthetic
aacctctgacgactatcagtcgccatgcgctatgcctgagtttgatgtcaccccgccccttcgcattccagggga

SEQ ID NO: 78294 - DNA, 75 bp, Artificial Sequence
  Synthetic
tattgaagcatatcaaatcccggttagtgcgcagacgacagcaaaggctgatgcaattttctcaatccaacttaa

SEQ ID NO: 78295 - DNA, 75 bp, Artificial Sequence
  Synthetic
agtgcgcagacgacagcaaaggctgatgcaattttctcaatccaacttaacccgggcggtaacaacgtgctcaat

SEQ ID NO: 78296 - DNA, 75 bp, Artificial Sequence
  Synthetic
gggacggcattagcaaccggtaaactgctactggcatactccccacctggtgcatcggtgccaaagagtcgtaag

SEQ ID NO: 78297 - DNA, 75 bp, Artificial Sequence
  Synthetic
tgctactggcatactccccacctggtgcatcggtgccaaagagtcgtaaggacgccatgttgggtacgcacgtga

SEQ ID NO: 78298 - DNA, 75 bp, Artificial Sequence
  Synthetic
catctcatagcttttgattactctgggtatgatgctagcttaagtcctgtctggtttgcttgcttaaaaatgcta

SEQ ID NO: 78299 - DNA, 75 bp, Artificial Sequence
  Synthetic
aacaggatgaatacactgcagcaggatatgtcacttgttggtatcagaccaatataatagttccgcccgagacac

SEQ ID NO: 78300 - DNA, 75 bp, Artificial Sequence
  Synthetic
atatgtcacttgttggtatcagaccaatataatagttccgcccgagacaccatctgatagtatcgtgctatgctt

SEQ ID NO: 78301 - DNA, 75 bp, Artificial Sequence
  Synthetic
gaatgatccagagcaagctatagatcgggcgctagcgagggtggcagacacagttcgtagtgggccgtctaactc

SEQ ID NO: 78302 - DNA, 75 bp, Artificial Sequence
  Synthetic
cgggcgctagcgagggtggcagacacagttcgtagtgggccgtctaactctgaacaaattcccgcactgacagcc

SEQ ID NO: 78303 - DNA, 75 bp, Artificial Sequence
  Synthetic
catggcccatagatgcatccttactcgctgaggctggtaaggattacgggttgatcatgacaccagcagacaagg

SEQ ID NO: 78304 - DNA, 75 bp, Artificial Sequence
  Synthetic
aggtcagagtcaacaatagagaactttttgtgtagatcggcttgcgtgcacatcgcaacatacaaggctaaaggc

SEQ ID NO: 78305 - DNA, 75 bp, Artificial Sequence
  Synthetic
ttttgtgtagatcggcttgcgtgcacatcgcaacatacaaggctaaaggcggagctggagacgtcgaccggtacg

SEQ ID NO: 78306 - DNA, 75 bp, Artificial Sequence
  Synthetic
atatggaggtcacctttgtgattaccagcatacaggagcagggcaaagcactgacccaggacatgccggtgctaa

SEQ ID NO: 78307 - DNA, 75 bp, Artificial Sequence
  Synthetic
cagcatacaggagcagggcaaagcactgacccaggacatgccggtgctaacgcaccaaataatgtacgttccacc

SEQ ID NO: 78308 - DNA, 75 bp, Artificial Sequence
  Synthetic
tctattggcctggcacaacggggagcacgaatatgaagagttcatccgtaaaattagaagcgttccagtcggacg

SEQ ID NO: 78309 - DNA, 75 bp, Artificial Sequence
  Synthetic
aggcaatgcaccagcacgtatgtctataccctttataagtattgggaacgcttacagtaatttctatgatgggtg

SEQ ID NO: 78310 - DNA, 75 bp, Artificial Sequence
  Synthetic
ataccctttataagtattgggaacgcttacagtaatttctatgatgggtggtcccactttacccagaacggtggt

SEQ ID NO: 78311 - DNA, 75 bp, Artificial Sequence
  Synthetic
accagcaccgtgcgaatttacttcaagcccaaacacgtgcgagcttgggtgcctcgcccgcctagactatgtcct

SEQ ID NO: 78312 - DNA, 75 bp, Artificial Sequence
  Synthetic
agcccaaacacgtgcgagcttgggtgcctcgcccgcctagactatgtccttataagaacaaggcaaatgtaaact

SEQ ID NO: 78313 - DNA, 75 bp, Artificial Sequence
  Synthetic
acctgcgcatgcacacgcacggtgcgttcggccaccaagctggcgtagtgtatgtgggtaactatagagtagtta

SEQ ID NO: 78314 - DNA, 75 bp, Artificial Sequence
  Synthetic
gttcggccaccaagctggcgtagtgtatgtgggtaactatagagtagttaatagacacctagcaactcacaatga

SEQ ID NO: 78315 - DNA, 75 bp, Artificial Sequence
  Synthetic
catcgccagatgccggtgttcgacaggagtctacttttgccactcaaagaacaagcactacccagttagttttga

SEQ ID NO: 78316 - DNA, 75 bp, Artificial Sequence
  Synthetic
tttaaaaaccctcaaccttgttttggcactcaacgctgcaaaatgggagctcaagtgtcgacacagaagaccggg

SEQ ID NO: 78317 - DNA, 75 bp, Artificial Sequence
  Synthetic
ggagtctacttttgccactcaaagaacaagcactacccagttagttttgagggcccagggctggtggaagtgcaa

SEQ ID NO: 78318 - DNA, 75 bp, Artificial Sequence
  Synthetic
gcctccaattccgccaaccgacaggacttcacgcaagatccagggaaattcacagaaccagtcaaggacataatg

SEQ ID NO: 78319 - DNA, 75 bp, Artificial Sequence
  Synthetic
ggcggcatcttgaggtgtgagcatggggtcatcggcatcgtgaccatgggcggcgagggcgttgtcggttttgcc

SEQ ID NO: 78320 - DNA, 75 bp, Artificial Sequence
  Synthetic
gggtcatcggcatcgtgaccatgggcggcgagggcgttgtcggttttgccgacgtgcgtgacctcctatggctag

SEQ ID NO: 78321 - DNA, 75 bp, Artificial Sequence
  Synthetic
atcaaatttgcgagcaggtcaacctgctaaaagaatcactggtgggtcaagactccattttggagaaatctctca

SEQ ID NO: 78322 - DNA, 75 bp, Artificial Sequence
  Synthetic
gctaaaagaatcactggtgggtcaagactccattttggagaaatctctcaaggcgttggtcaagatcatctcagc

SEQ ID NO: 78323 - DNA, 75 bp, Artificial Sequence
  Synthetic
atccccatggcgatggcttaaacagaaggtgtcccagtattatggcatccccatggctgaacgccaaaacaacgg

SEQ ID NO: 78324 - DNA, 75 bp, Artificial Sequence
  Synthetic
aaggtgtcccagtattatggcatccccatggctgaacgccaaaacaacggatggcttaaaaagttcactgaaatg

SEQ ID NO: 78325 - DNA, 75 bp, Artificial Sequence
  Synthetic
tgtgcagtgcaacgcctcaaaatttcaccaagggtgtcttttagtagtgtgcgttccagaagctgagatgggtgc

SEQ ID NO: 78326 - DNA, 75 bp, Artificial Sequence
  Synthetic
ctaccagaggtcaaggaaaaacatgaatttctaaatagactcaaacagctccccctgctggagagtcaaatcgcc

SEQ ID NO: 78327 - DNA, 75 bp, Artificial Sequence
  Synthetic
tagccaacacattttcaggcactaagtcaagcaacactaatgacgttcaacaggcggtgttcaacgctggcatgg

SEQ ID NO: 78328 - DNA, 75 bp, Artificial Sequence
  Synthetic
ccccctgctggagagtcaaatcgccaccattgaacagagtgctccctctcagagcgaccaggagcaactgttctc

SEQ ID NO: 78329 - DNA, 75 bp, Artificial Sequence
  Synthetic
acaccaaggcttacctgtgatgaacacaccgggtagcaatcaattcttaacctccgatgattaccaatctcccac

SEQ ID NO: 78330 - DNA, 75 bp, Artificial Sequence
  Synthetic
agtatactctttgcccccagacccagaccactttgacggctataaacagcaggctgtagtgatcatggatgactt

SEQ ID NO: 78331 - DNA, 75 bp, Artificial Sequence
  Synthetic
gaccactttgacggctataaacagcaggctgtagtgatcatggatgacttgtgccagaatcctgatggaaaagat

SEQ ID NO: 78332 - DNA, 75 bp, Artificial Sequence
  Synthetic
tgccatgccgcagtttgatgtgacgccggaaatgaatataccaggtgaggtgaaaaacctcatggagattgcaga

SEQ ID NO: 78333 - DNA, 75 bp, Artificial Sequence
  Synthetic
ttgttcacctccccatttgttctagcctcaaccaatgcgggttctatcaacgcaccaacggtgtctgacagtaga

SEQ ID NO: 78334 - DNA, 75 bp, Artificial Sequence
  Synthetic
cctcaaccaatgcgggttctatcaacgcaccaacggtgtctgacagtagagctcttgccaggaggtttcactttg

SEQ ID NO: 78335 - DNA, 75 bp, Artificial Sequence
  Synthetic
aactcacatttatgtactgtggatcggcgatggcaaccggaaagttccttctagcctactcacccccaggggcgg

SEQ ID NO: 78336 - DNA, 75 bp, Artificial Sequence
  Synthetic
atgaagagtgctgcccagttaactttaagaagtgttgtccccttgtgtgcggaaaggctatccagttcatcgata

SEQ ID NO: 78337 - DNA, 75 bp, Artificial Sequence
  Synthetic
taagaagtgttgtccccttgtgtgcggaaaggctatccagttcatcgatagaaggacacaggtcagatattctct

SEQ ID NO: 78338 - DNA, 75 bp, Artificial Sequence
  Synthetic
tcaaggtccaccagtgtatagggagattaaaatcagcgtcgcgcccgagaccccgccgccacctgctatagcgga

SEQ ID NO: 78339 - DNA, 75 bp, Artificial Sequence
  Synthetic
attaaaatcagcgtcgcgcccgagaccccgccgccacctgctatagcggacttgttgaaatcagtggacagtgag

SEQ ID NO: 78340 - DNA, 75 bp, Artificial Sequence
  Synthetic
cagcctgcaatgatttctcggtgcgcttgctgcgtgattcacctttcgttcgccagacagcattctatcagaatg

SEQ ID NO: 78341 - DNA, 75 bp, Artificial Sequence
  Synthetic
gttagccgtgctttcatctgtctccaagctttgacaacatttgtgtctgtggccggtatcatttacatcatatac

SEQ ID NO: 78342 - DNA, 75 bp, Artificial Sequence
  Synthetic
aagctttgacaacatttgtgtctgtggccggtatcatttacatcatatacaagctgttcgcaggctttcaaggtg

SEQ ID NO: 78343 - DNA, 75 bp, Artificial Sequence
  Synthetic
aatttgctgttgctatgatgaaaagaaactccagcacagtgaaaactgagtacggtgagttcaccatgctgggta

SEQ ID NO: 78344 - DNA, 75 bp, Artificial Sequence
  Synthetic
aaactccagcacagtgaaaactgagtacggtgagttcaccatgctgggtatctacgacagatgggctgttttacc

SEQ ID NO: 78345 - DNA, 75 bp, Artificial Sequence
  Synthetic
ggacaaggatggtacaaacctggagttgacactgctcaagctgaatcgaaatgagaagttcagggacatcagagg

SEQ ID NO: 78346 - DNA, 75 bp, Artificial Sequence
  Synthetic
ttgacactgctcaagctgaatcgaaatgagaagttcagggacatcagaggattcctagcgaaagaagaggtggag

SEQ ID NO: 78347 - DNA, 75 bp, Artificial Sequence
  Synthetic
caactggcaaacctccacaaacccaagtgttttctggaccgaaggaaatgccccacctaggatgtccattccctt

SEQ ID NO: 78348 - DNA, 75 bp, Artificial Sequence
  Synthetic
tatggcttcttgaatctaggtggcactcccaccaagaggatgctcatgtacaatttccccactagagcaggtcaa

SEQ ID NO: 78349 - DNA, 75 bp, Artificial Sequence
  Synthetic
ctcccaccaagaggatgctcatgtacaatttccccactagagcaggtcaatgtggtggggtactcatgtcgactg

SEQ ID NO: 78350 - DNA, 75 bp, Artificial Sequence
  Synthetic
acgatgagcaaggagagatcgaattcattgaaagctcgaagagtgcagggttcccggttatcaatacaccaagca

SEQ ID NO: 78351 - DNA, 75 bp, Artificial Sequence
  Synthetic
cattgaaagctcgaagagtgcagggttcccggttatcaatacaccaagcaaaaccaagctggagccaagtgtctt

SEQ ID NO: 78352 - DNA, 75 bp, Artificial Sequence
  Synthetic
caacagtccggggcggtttacgtgggtaactacaggttagtcaataggcatttagctacacacactgattggcaa

SEQ ID NO: 78353 - DNA, 75 bp, Artificial Sequence
  Synthetic
ggaagccatattctcgaaatacattggaaatatcaacacacacgtggatgagtatatgctggaggccatcgacca

SEQ ID NO: 78354 - DNA, 75 bp, Artificial Sequence
  Synthetic
ggaaatatcaacacacacgtggatgagtatatgctggaggccatcgaccactatgccgggcaactggccactctg

SEQ ID NO: 78355 - DNA, 75 bp, Artificial Sequence
  Synthetic
acaagtgcagggtacccatacgtcgccttaggcatcaagaagagggacatcctttccaaaaagactagagattta

SEQ ID NO: 78356 - DNA, 75 bp, Artificial Sequence
  Synthetic
ccttaggcatcaagaagagggacatcctttccaaaaagactagagatttaactaagctgaaagaatgcatggaca

SEQ ID NO: 78357 - DNA, 75 bp, Artificial Sequence
  Synthetic
ggagtcgttgggtttgctgatgtccgtgacttgttgtggcttgaagatgatgcaatggaacagggagtcaaagac

SEQ ID NO: 78358 - DNA, 75 bp, Artificial Sequence
  Synthetic
aatctaggctcatagaagcgtccagtctgaacgattcagtggccatgagacaaacgttcggcaacttgtataagg

SEQ ID NO: 78359 - DNA, 75 bp, Artificial Sequence
  Synthetic
tctgaacgattcagtggccatgagacaaacgttcggcaacttgtataaggctttccatctaaatccagggatagt

SEQ ID NO: 78360 - DNA, 75 bp, Artificial Sequence
  Synthetic
gagtcactggtgggccaggattctatcttagagaagtcccttaaagcacttgtcaaaatcatttccgccttggtt

SEQ ID NO: 78361 - DNA, 75 bp, Artificial Sequence
  Synthetic
agcttttgactattcagggtatgacgccagcttgagccctgtctggtttgtgtgcctaaagttgctgctggagaa

SEQ ID NO: 78362 - DNA, 75 bp, Artificial Sequence
  Synthetic
gccagcttgagccctgtctggtttgtgtgcctaaagttgctgctggagaaacttgggtacacacacaaagaaacg

SEQ ID NO: 78363 - DNA, 75 bp, Artificial Sequence
  Synthetic
cccaataccatggaattcctatggccgagaggcagagcaatggctggctcaagaagttcacagagatgaccaatg

SEQ ID NO: 78364 - DNA, 75 bp, Artificial Sequence
  Synthetic
cgagaggcagagcaatggctggctcaagaagttcacagagatgaccaatgcatgcaagggcatggagtggatagc

SEQ ID NO: 78365 - DNA, 75 bp, Artificial Sequence
  Synthetic
tctgggtgttctggtactagtatattcaactcaatgataaacaacattataattaggacactcatgctgaaggtg

SEQ ID NO: 78366 - DNA, 75 bp, Artificial Sequence
  Synthetic
tcaactcaatgataaacaacattataattaggacactcatgctgaaggtgtacaagggaattgatttggaccaat

SEQ ID NO: 78367 - DNA, 75 bp, Artificial Sequence
  Synthetic
aaacagactcaagcagctcccccttttggaaagtcaaattgccaccattgaacaaagtgctccgtcccagagtga

SEQ ID NO: 78368 - DNA, 75 bp, Artificial Sequence
  Synthetic
ttggaaagtcaaattgccaccattgaacaaagtgctccgtcccagagtgatcaggagcaacttttctcaaacgtc

SEQ ID NO: 78369 - DNA, 75 bp, Artificial Sequence
  Synthetic
ctgggaaagactatggattaatcatgacaccagcagataagggagagtgcttcaatgaagtcacctggaccaatg

SEQ ID NO: 78370 - DNA, 75 bp, Artificial Sequence
  Synthetic
gacaccagcagataagggagagtgcttcaatgaagtcacctggaccaatgtcactttcctgaagaggtatttcag

SEQ ID NO: 78371 - DNA, 75 bp, Artificial Sequence
  Synthetic
aagaaaatgagcaactacatacagttcaagtccaaatgccgtattgagcctgtatgtctgctcttgcacgggagc

SEQ ID NO: 78372 - DNA, 75 bp, Artificial Sequence
  Synthetic
tcaagtccaaatgccgtattgagcctgtatgtctgctcttgcacgggagccccggagcaggtaaatcggttgcta

SEQ ID NO: 78373 - DNA, 75 bp, Artificial Sequence
  Synthetic
caaagaccccaagaatacccaggatcacgtgcgatctttgtgcttgctggcctggcacaatggagagcacgagta

SEQ ID NO: 78374 - DNA, 75 bp, Artificial Sequence
  Synthetic
cctggcacaatggagagcacgagtacgaggaattcattcgaaaaatcaggagcgttccagttgggcgctgtctga

SEQ ID NO: 78375 - DNA, 75 bp, Artificial Sequence
  Synthetic
ttgatggctataagcaacaagccgttgtgattatggatgacttatgccagaacccagatggaaaggacgtatctt

SEQ ID NO: 78376 - DNA, 75 bp, Artificial Sequence
  Synthetic
cctccccttttgtcctagcatccacaaatgccggttccattaatgcgccaacagtctcggacagccgagccctag

SEQ ID NO: 78377 - DNA, 75 bp, Artificial Sequence
  Synthetic
acccacagggcccattgggcgctagcacactggtattccggtacccttgtgcgcctgttttatctacccttccct

SEQ ID NO: 78378 - DNA, 75 bp, Artificial Sequence
  Synthetic
ttgaaagattgttaccatatagctattggattggccatccagtgacaaacagagcaattgtctatctatttgtcg

SEQ ID NO: 78379 - DNA, 75 bp, Artificial Sequence
  Synthetic
acaagtctcgacgcaaaagactggggcacacgagaccagattgagcgcacaaggcaactctgtcattcattacac

SEQ ID NO: 78380 - DNA, 75 bp, Artificial Sequence
  Synthetic
gcacacgagaccagattgagcgcacaaggcaactctgtcattcattacacgaatatcaactactacaaagatgcg

SEQ ID NO: 78381 - DNA, 75 bp, Artificial Sequence
  Synthetic
tgaacgatcaggaagtgggtgtggttgacgccaaagagttagtagacaaggacggcactaatctggaactaacac

SEQ ID NO: 78382 - DNA, 75 bp, Artificial Sequence
  Synthetic
gtgaaatctctgccggctctcaactcaccatcggctgaggaatgtggatacagcgatcgggtgaggtccctcact

SEQ ID NO: 78383 - DNA, 75 bp, Artificial Sequence
  Synthetic
caccatcggctgaggaatgtggatacagcgatcgggtgaggtccctcactttaggtaattcaacaattacgactc

SEQ ID NO: 78384 - DNA, 75 bp, Artificial Sequence
  Synthetic
tcttgaaactcaatagaaatgagaagttcagggacattcgaggtttcctaacgcgtgaggaggccgaagtcaacg

SEQ ID NO: 78385 - DNA, 75 bp, Artificial Sequence
  Synthetic
atcaaccaacccagcccgatgtggcgacgtgccgcttttacacacttgaatcagtaaaatgggagcaaaactccc

SEQ ID NO: 78386 - DNA, 75 bp, Artificial Sequence
  Synthetic
gacgtgccgcttttacacacttgaatcagtaaaatgggagcaaaactccccaggatggtggtggaagtttcccga

SEQ ID NO: 78387 - DNA, 75 bp, Artificial Sequence
  Synthetic
tgtccagtgcaacgcgtcgcgcttccaccaaggctgcttgctagtggtttgtgttccagaagccgagatgggtag

SEQ ID NO: 78388 - DNA, 75 bp, Artificial Sequence
  Synthetic
caccaaggctgcttgctagtggtttgtgttccagaagccgagatgggtagttcaacacctgggcaagcattcaca

SEQ ID NO: 78389 - DNA, 75 bp, Artificial Sequence
  Synthetic
caaaaagccgtttgtaatgcaggtatgggtgtgggtgttggtaatttgacgatattcccacaccagtggattaac

SEQ ID NO: 78390 - DNA, 75 bp, Artificial Sequence
  Synthetic
tgggtgtgggtgttggtaatttgacgatattcccacaccagtggattaacctgcgcactaacaattgtgccacaa

SEQ ID NO: 78391 - DNA, 75 bp, Artificial Sequence
  Synthetic
cctttgtaaaattaagatctgatgggggaacgacctacgtgcccattacagtcaccattgctcccatgtgcgcag

SEQ ID NO: 78392 - DNA, 75 bp, Artificial Sequence
  Synthetic
gggaacgacctacgtgcccattacagtcaccattgctcccatgtgcgcagaatataacggtctaaggctatcggc

SEQ ID NO: 78393 - DNA, 75 bp, Artificial Sequence
  Synthetic
tgcaatgcccgagtatgatgtcacaccaccgctacacatcccgggcgaggtttcgaatctaatggaaatagctga

SEQ ID NO: 78394 - DNA, 75 bp, Artificial Sequence
  Synthetic
ccaccgctacacatcccgggcgaggtttcgaatctaatggaaatagctgaggtagactcggtggtacctgttaac

SEQ ID NO: 78395 - DNA, 75 bp, Artificial Sequence
  Synthetic
gccatcttcacattccagctagacccaggccacagccctgtgttgagaaggaccctattgggagaagttttgaac

SEQ ID NO: 78396 - DNA, 75 bp, Artificial Sequence
  Synthetic
caggccacagccctgtgttgagaaggaccctattgggagaagttttgaactactatgcacattggtctggtagca

SEQ ID NO: 78397 - DNA, 75 bp, Artificial Sequence
  Synthetic
ccggggtacccacaaagagaaaggacgcaatgctaggcacacacgtgatttgggatattgggctgcagtcgagct

SEQ ID NO: 78398 - DNA, 75 bp, Artificial Sequence
  Synthetic
cgcaatgctaggcacacacgtgatttgggatattgggctgcagtcgagctgtgtgttgtgtgtgccgtggatcag

SEQ ID NO: 78399 - DNA, 75 bp, Artificial Sequence
  Synthetic
tttaatcgtaccacctaacacaccgacaagctgtgagatcctgtgctttgtgtcagcatgcaatgaattttccgt

SEQ ID NO: 78400 - DNA, 75 bp, Artificial Sequence
  Synthetic
acaagctgtgagatcctgtgctttgtgtcagcatgcaatgaattttccgtgcgcatgttacgggacaccccattt

SEQ ID NO: 78401 - DNA, 75 bp, Artificial Sequence
  Synthetic
tgagtcaatcaggtggaccaaagaccccaaaaacactcaagaccacgtgcgatccttgtgcttattggcctggca

SEQ ID NO: 78402 - DNA, 75 bp, Artificial Sequence
  Synthetic
caaaagagtggcccgtcgaacacggagcaggtacctgcccttaccgctgttgagacagggcacacctcacaggtg

SEQ ID NO: 78403 - DNA, 75 bp, Artificial Sequence
  Synthetic
agcaggtacctgcccttaccgctgttgagacagggcacacctcacaggtggaacctagcgacacaatccaaacta

SEQ ID NO: 78404 - DNA, 75 bp, Artificial Sequence
  Synthetic
gcgcaatttgatttaattcaattggcttaaccctaccgcactcaccgaactagacaacggtgtggtaggggtaaa

SEQ ID NO: 78405 - DNA, 75 bp, Artificial Sequence
  Synthetic
tcggcacctacaacgccaaagggactcaagaaggagacactgaacagttcgccgtgtggaccattagtgttaagg

SEQ ID NO: 78406 - DNA, 75 bp, Artificial Sequence
  Synthetic
tcaagaaggagacactgaacagttcgccgtgtggaccattagtgttaaggatatggcccagatgaggaggaagtg

SEQ ID NO: 78407 - DNA, 75 bp, Artificial Sequence
  Synthetic
agtcaacaatgaagcgcccataacacatcaaattatgtatgtgccaccaggtgggcccataccaaagaaagtaga

SEQ ID NO: 78408 - DNA, 75 bp, Artificial Sequence
  Synthetic
catcaaattatgtatgtgccaccaggtgggcccataccaaagaaagtagacagctacgcatggcaaacatccact

SEQ ID NO: 78409 - DNA, 75 bp, Artificial Sequence
  Synthetic
tacagcatgttctatgatgggtggtccagcttcaaatcaaagggtgcgtatggctactcaaaccttaatcacatg

SEQ ID NO: 78410 - DNA, 75 bp, Artificial Sequence
  Synthetic
ccagcttcaaatcaaagggtgcgtatggctactcaaaccttaatcacatgggcaaactatacgtgaggcatgtgg

SEQ ID NO: 78411 - DNA, 75 bp, Artificial Sequence
  Synthetic
ttaaaacagcctgtgggttgttcccacccacagggcccatagggcgccagcactctggtatcccggtacctttgt

SEQ ID NO: 78412 - DNA, 75 bp, Artificial Sequence
  Synthetic
gtccacccagactatgcccatacatcagaaaggccaacgttgactttgcggtgacgcccattactgattatagga

SEQ ID NO: 78413 - DNA, 75 bp, Artificial Sequence
  Synthetic
cagaaaggccaacgttgactttgcggtgacgcccattactgattataggacagacatcaacactgtgacaaacct

SEQ ID NO: 78414 - DNA, 75 bp, Artificial Sequence
  Synthetic
cgcaactcacgcagattggcagaactgtgtgtgggaagactataacagagacctcctcgtgagcacaaccacagc

SEQ ID NO: 78415 - DNA, 75 bp, Artificial Sequence
  Synthetic
tgtgtgtgggaagactataacagagacctcctcgtgagcacaaccacagcgcacggatgtgacactatcgccaga

SEQ ID NO: 78416 - DNA, 75 bp, Artificial Sequence
  Synthetic
ctcgtagaggtccaagaaagtgaatattaccctaagaggtaccagtctcacgtgctccttgcggcgggtttctct

SEQ ID NO: 78417 - DNA, 75 bp, Artificial Sequence
  Synthetic
attaccctaagaggtaccagtctcacgtgctccttgcggcgggtttctctgagcccggagattgtggcggggtcc

SEQ ID NO: 78418 - DNA, 75 bp, Artificial Sequence
  Synthetic
ttttaaaaaccctcaacttagttttgtcactcaactcagcaaaatgggagctcaagtgtccacacagaaaacagg

SEQ ID NO: 78419 - DNA, 75 bp, Artificial Sequence
  Synthetic
acctcttatggttggaggatgacgccatggaacaaggggtcaaagactatgtggaacagctcggaaatgcctttg

SEQ ID NO: 78420 - DNA, 75 bp, Artificial Sequence
  Synthetic
gtcactcaactcagcaaaatgggagctcaagtgtccacacagaaaacaggagcacacgagaccagcttgaacgct

SEQ ID NO: 78421 - DNA, 75 bp, Artificial Sequence
  Synthetic
tgagcaagtcaacctcctcaaggactcacttattggacaagactccatcctggagaaatcgctcaaagccctagt

SEQ ID NO: 78422 - DNA, 75 bp, Artificial Sequence
  Synthetic
gatctaaggcaagatccctctaagttcactgaaccaataaaagatgtgatggtcaaaacactacccgctctcaat

SEQ ID NO: 78423 - DNA, 75 bp, Artificial Sequence
  Synthetic
tcactgaaccaataaaagatgtgatggtcaaaacactacccgctctcaattccccgtcagcagaagagtgcggtt

SEQ ID NO: 78424 - DNA, 75 bp, Artificial Sequence
  Synthetic
gatcggctgcacctcatcaccatggcgttggcttaaacagaaggtctcccaatattatggaatccccatggcaga

SEQ ID NO: 78425 - DNA, 75 bp, Artificial Sequence
  Synthetic
cctatggggaatggccttcgtacttaaaggacgatgaggccacggctgaagacaaaccaacacaaccagatgtgg

SEQ ID NO: 78426 - DNA, 75 bp, Artificial Sequence
  Synthetic
aaaggacgatgaggccacggctgaagacaaaccaacacaaccagatgtggccacatgtagattttacacacttga

SEQ ID NO: 78427 - DNA, 75 bp, Artificial Sequence
  Synthetic
ttgaaagtcaaaatcctaccagaggttaaggagaaacacgagttcctaaacaggctaaagcaactgcctttgcta

SEQ ID NO: 78428 - DNA, 75 bp, Artificial Sequence
  Synthetic
ttaaggagaaacacgagttcctaaacaggctaaagcaactgcctttgctagagagccaaattgccaccattgagc

SEQ ID NO: 78429 - DNA, 75 bp, Artificial Sequence
  Synthetic
tggacaaaatatgctataccattatctgggaagaaccggttacacactccacgtacagtgtaatgcgtctaagtt

SEQ ID NO: 78430 - DNA, 75 bp, Artificial Sequence
  Synthetic
ctgggaagaaccggttacacactccacgtacagtgtaatgcgtctaagttccaccaaggatgcctactggtggtg

SEQ ID NO: 78431 - DNA, 75 bp, Artificial Sequence
  Synthetic
atgcccctttgtatgctgctgaagccaaaagagtgttctccctagaaaagaaagtgagcaactatatacagttca

SEQ ID NO: 78432 - DNA, 75 bp, Artificial Sequence
  Synthetic
caaaagagtgttctccctagaaaagaaagtgagcaactatatacagttcaagtccaaatgccgtattgaacccgt

SEQ ID NO: 78433 - DNA, 75 bp, Artificial Sequence
  Synthetic
gtgccaattgagttcaccagtcaaccaacagtgggtgataacgacgttcaacgggctgttcataacgcagccatg

SEQ ID NO: 78434 - DNA, 75 bp, Artificial Sequence
  Synthetic
caacagtgggtgataacgacgttcaacgggctgttcataacgcagccatgggagtggccgttgggaatctgacca

SEQ ID NO: 78435 - DNA, 75 bp, Artificial Sequence
  Synthetic
gaagctccacagctcggtgtactcgttgccaccagacccagaccactttgatggctacaaacagcaagccgtagt

SEQ ID NO: 78436 - DNA, 75 bp, Artificial Sequence
  Synthetic
ttgccaccagacccagaccactttgatggctacaaacagcaagccgtagtgattatggatgacttgtgtcagaac

SEQ ID NO: 78437 - DNA, 75 bp, Artificial Sequence
  Synthetic
caatggacaatatgtacagacatcagaacttcactctcatgataatccctttcgtgccactggatatgcaggcgg

SEQ ID NO: 78438 - DNA, 75 bp, Artificial Sequence
  Synthetic
gaacttcactctcatgataatccctttcgtgccactggatatgcaggcgggtgcatccacgatagtgcccataac

SEQ ID NO: 78439 - DNA, 75 bp, Artificial Sequence
  Synthetic
gaggagaagggtatattgttcacctcacctttcgtccttgcctcaacaaacgcggggtcaatcaatgctcccacg

SEQ ID NO: 78440 - DNA, 75 bp, Artificial Sequence
  Synthetic
cacctttcgtccttgcctcaacaaacgcggggtcaatcaatgctcccacggtttcagacagcagggcgcttgcta

SEQ ID NO: 78441 - DNA, 75 bp, Artificial Sequence
  Synthetic
cacccctggtagcaaccaattcctgacctcagacgattaccaatcgccctcagccatgcctcaattcgacgccac

SEQ ID NO: 78442 - DNA, 75 bp, Artificial Sequence
  Synthetic
acctcagacgattaccaatcgccctcagccatgcctcaattcgacgccactccactgatgcacataccaggcgag

SEQ ID NO: 78443 - DNA, 75 bp, Artificial Sequence
  Synthetic
cagtgaagacctgcgatgacgagtgttgcccggtcaacttcaagaaatgttgcccactagtttgtggaaaagcta

SEQ ID NO: 78444 - DNA, 75 bp, Artificial Sequence
  Synthetic
ttgcccggtcaacttcaagaaatgttgcccactagtttgtggaaaagctatacagtttgttgacagaagaacaca

SEQ ID NO: 78445 - DNA, 75 bp, Artificial Sequence
  Synthetic
attgaggcataccagatcccggtttctacgggcgcacatgacagcaagaaggccattttcagtttccagttggac

SEQ ID NO: 78446 - DNA, 75 bp, Artificial Sequence
  Synthetic
ctacgggcgcacatgacagcaagaaggccattttcagtttccagttggaccccggaaatagcacagtgatgaaca

SEQ ID NO: 78447 - DNA, 75 bp, Artificial Sequence
  Synthetic
gcttgaggcactcttccagggcccaccagtttatagggagatcaagatcagcgtggcaccagaaacaccccctcc

SEQ ID NO: 78448 - DNA, 75 bp, Artificial Sequence
  Synthetic
ccagtttatagggagatcaagatcagcgtggcaccagaaacaccccctccacccgctattgcagacctactgaag

SEQ ID NO: 78449 - DNA, 75 bp, Artificial Sequence
  Synthetic
ggtccgccatggccacgggaaaaattttgttggcatattcaccacccggtgcatcagtcccagcagatagaaaac

SEQ ID NO: 78450 - DNA, 75 bp, Artificial Sequence
  Synthetic
tttgttggcatattcaccacccggtgcatcagtcccagcagatagaaaacaggctatgttaggtacgcatgtgat

SEQ ID NO: 78451 - DNA, 75 bp, Artificial Sequence
  Synthetic
caaattgaaaagcacgtgagcagagctttcatttgcctgcaagcgcttactacctttgtctccgtggcaggaatc

SEQ ID NO: 78452 - DNA, 75 bp, Artificial Sequence
  Synthetic
ctttcatttgcctgcaagcgcttactacctttgtctccgtggcaggaatcatatatatcatatacaaactgtttg

SEQ ID NO: 78453 - DNA, 75 bp, Artificial Sequence
  Synthetic
tgatgacgtgtacactagcgccgggtacataacagcatggtatcagacctcgatagtggtaccacccagcacccc

SEQ ID NO: 78454 - DNA, 75 bp, Artificial Sequence
  Synthetic
tacataacagcatggtatcagacctcgatagtggtaccacccagcacccctaccaatagtaagatactatgcttt

SEQ ID NO: 78455 - DNA, 75 bp, Artificial Sequence
  Synthetic
agggacccgcctttgaatttgccgtggctatgatgaaaagaaatgccagcactgtgaagacagagtacggtgagt

SEQ ID NO: 78456 - DNA, 75 bp, Artificial Sequence
  Synthetic
ggctatgatgaaaagaaatgccagcactgtgaagacagagtacggtgagttcacaatgcttgggatttacgacaa

SEQ ID NO: 78457 - DNA, 75 bp, Artificial Sequence
  Synthetic
ggtgatgacaagactccaccaagcacagtcgcagacacaatgccgagcggggcccggaacactgaacaagtaccg

SEQ ID NO: 78458 - DNA, 75 bp, Artificial Sequence
  Synthetic
cagtcgcagacacaatgccgagcggggcccggaacactgaacaagtaccggccctcacagctgctgagacgggac

SEQ ID NO: 78459 - DNA, 75 bp, Artificial Sequence
  Synthetic
cgccaaggaattagtggataaggacggcaccaatctggagttaacactcctgaaactcaataggaacgagaagtt

SEQ ID NO: 78460 - DNA, 75 bp, Artificial Sequence
  Synthetic
ggcaccaatctggagttaacactcctgaaactcaataggaacgagaagttcagagatatccgagggtttttggca

SEQ ID NO: 78461 - DNA, 75 bp, Artificial Sequence
  Synthetic
ccgtggaaaacttcttcgggagagcagcgtgtgtggagttcaaaacgtaccgtataggatcaagtgccgatttaa

SEQ ID NO: 78462 - DNA, 75 bp, Artificial Sequence
  Synthetic
agcgtgtgtggagttcaaaacgtaccgtataggatcaagtgccgatttaactgataaatacgcaggttggacgat

SEQ ID NO: 78463 - DNA, 75 bp, Artificial Sequence
  Synthetic
ggccaagtgacggactatggttttctcaacctgggcgggacccccaccaagcgcatgttaatgtataatttcccc

SEQ ID NO: 78464 - DNA, 75 bp, Artificial Sequence
  Synthetic
tcaacctgggcgggacccccaccaagcgcatgttaatgtataatttccccacgcgtgcggggcagtgtggcggag

SEQ ID NO: 78465 - DNA, 75 bp, Artificial Sequence
  Synthetic
cattgtcatcactagcagtcaaatccccagtactagtgtaaatcaagatatgccggtactaacacaccagatcat

SEQ ID NO: 78466 - DNA, 75 bp, Artificial Sequence
  Synthetic
cccagtactagtgtaaatcaagatatgccggtactaacacaccagatcatgtacgttccacccgggggcccaatc

SEQ ID NO: 78467 - DNA, 75 bp, Artificial Sequence
  Synthetic
tacgccactacttcaatgatgagcagggtgaaattgagttcatcgaaagctccaaggaggccggcttcccagtca

SEQ ID NO: 78468 - DNA, 75 bp, Artificial Sequence
  Synthetic
gggtgaaattgagttcatcgaaagctccaaggaggccggcttcccagtcattaacactcccagcaagacaaagct

SEQ ID NO: 78469 - DNA, 75 bp, Artificial Sequence
  Synthetic
gcaagactatccatcccattcataagcgtcggcaatgcgtacagcagcttttatgatggttggtcccattttaca

SEQ ID NO: 78470 - DNA, 75 bp, Artificial Sequence
  Synthetic
gcgtcggcaatgcgtacagcagcttttatgatggttggtcccattttacacagaatggagtgtatgggtatagta

SEQ ID NO: 78471 - DNA, 75 bp, Artificial Sequence
  Synthetic
gaaaaccaactttgaggaagccatattctctaagtacattggaaatgtgaacacacatgtagatgaatacatgat

SEQ ID NO: 78472 - DNA, 75 bp, Artificial Sequence
  Synthetic
ttctctaagtacattggaaatgtgaacacacatgtagatgaatacatgatggaagccgtggaccattatgctgga

SEQ ID NO: 78473 - DNA, 75 bp, Artificial Sequence
  Synthetic
gaatatacatgaaaccaaaacacgtccgggtttgggtgccaagaccaccacggttatgcccgtacctttataaag

SEQ ID NO: 78474 - DNA, 75 bp, Artificial Sequence
  Synthetic
ccgggtttgggtgccaagaccaccacggttatgcccgtacctttataaagccaacaccaacttcaaaccggcacc

SEQ ID NO: 78475 - DNA, 75 bp, Artificial Sequence
  Synthetic
gcgctggatctaaccacgagcgcagggtacccctacgttgcccttggtataaaaaagagagacattctatccaag

SEQ ID NO: 78476 - DNA, 75 bp, Artificial Sequence
  Synthetic
ggtacccctacgttgcccttggtataaaaaagagagacattctatccaagaaaaccaaggacttaacaaaactga

SEQ ID NO: 78477 - DNA, 75 bp, Artificial Sequence
  Synthetic
tggtcatcaagctggtgcagtgtatgtgggaaattacaggatagtgaacagacatctcgcgacccacactgattg

SEQ ID NO: 78478 - DNA, 75 bp, Artificial Sequence
  Synthetic
gtgggaaattacaggatagtgaacagacatctcgcgacccacactgattggcaaaaatgtgtttgggaggactac

SEQ ID NO: 78479 - DNA, 75 bp, Artificial Sequence
  Synthetic
aggtggcgaagggcaagtccaggttgattgaggcatcgagtttaaacgactcagtggccatgaggcaaacttttg

SEQ ID NO: 78480 - DNA, 75 bp, Artificial Sequence
  Synthetic
gattgaggcatcgagtttaaacgactcagtggccatgaggcaaacttttggaaacctgtacaaaacattccacct

SEQ ID NO: 78481 - DNA, 75 bp, Artificial Sequence
  Synthetic
gtatacttttgtgcatcaaagaacaagcactaccccgtaactttcgagggacccggactcgtggaggtgcaagag

SEQ ID NO: 78482 - DNA, 75 bp, Artificial Sequence
  Synthetic
agcactaccccgtaactttcgagggacccggactcgtggaggtgcaagagagcgaatactatcccaaaaggtatc

SEQ ID NO: 78483 - DNA, 75 bp, Artificial Sequence
  Synthetic
tgacggtcatctcatcgcttttgactacagcgggtacgatgctagtttgagcccagtatggtttgtctgtctgaa

SEQ ID NO: 78484 - DNA, 75 bp, Artificial Sequence
  Synthetic
tacagcgggtacgatgctagtttgagcccagtatggtttgtctgtctgaagatgttactggagaaattgggctac

SEQ ID NO: 78485 - DNA, 75 bp, Artificial Sequence
  Synthetic
tcatcggcattgtgaccatgggtggtgagggcgtagtaggctttgctgatgtgcgcgatcttctgtggttggaag

SEQ ID NO: 78486 - DNA, 75 bp, Artificial Sequence
  Synthetic
tgagggcgtagtaggctttgctgatgtgcgcgatcttctgtggttggaagatgaagcaatggagcagggtgtgaa

SEQ ID NO: 78487 - DNA, 75 bp, Artificial Sequence
  Synthetic
agaagagggatgccatctggatgttcgggaacaagcattttcaattcaatgatcaacaacataatcatcaggaca

SEQ ID NO: 78488 - DNA, 75 bp, Artificial Sequence
  Synthetic
cgggaacaagcattttcaattcaatgatcaacaacataatcatcaggacactaatgttgaaggtgtataagggga

SEQ ID NO: 78489 - DNA, 75 bp, Artificial Sequence
  Synthetic
caaagagtcgctagtcggtcaagattccattctagagaaatcactcaaggcattggtgaaaatcatatcagcact

SEQ ID NO: 78490 - DNA, 75 bp, Artificial Sequence
  Synthetic
tccattctagagaaatcactcaaggcattggtgaaaatcatatcagcactggtgattgtggtcaggaatcatgac

SEQ ID NO: 78491 - DNA, 75 bp, Artificial Sequence
  Synthetic
cactgctagctgaagccgggaaagggtatggtttgatcatgacaccagctgacaaaggggaatgctttaatgaag

SEQ ID NO: 78492 - DNA, 75 bp, Artificial Sequence
  Synthetic
gtatggtttgatcatgacaccagctgacaaaggggaatgctttaatgaagtgacatggaccaacgtcaccttctt

SEQ ID NO: 78493 - DNA, 75 bp, Artificial Sequence
  Synthetic
gtatcccagtactacggcatccctatggctgaaagacaaaataatgggtggctcaagaaattcactgaaatgacc

SEQ ID NO: 78494 - DNA, 75 bp, Artificial Sequence
  Synthetic
tggctgaaagacaaaataatgggtggctcaagaaattcactgaaatgaccaacgcatgtaaaggcatggagtgga

SEQ ID NO: 78495 - DNA, 75 bp, Artificial Sequence
  Synthetic
atcaatcagatggactaaagatcccaaaaacactcaagatcacgtgcgatccttgtgcctattggcctggcataa

SEQ ID NO: 78496 - DNA, 75 bp, Artificial Sequence
  Synthetic
tcctgggcaggcttaagcagttgcccctactggagagtcagattgctaccattgaacaaagtgcaccttcgcaaa

SEQ ID NO: 78497 - DNA, 75 bp, Artificial Sequence
  Synthetic
tggggagcaagaatatgaagaatttgtgtcaaaaatcaggagtgtcccagtggggcgctgcttgaccttacctgc

SEQ ID NO: 78498 - DNA, 75 bp, Artificial Sequence
  Synthetic
cctactggagagtcagattgctaccattgaacaaagtgcaccttcgcaaagtgaccaagagcaactgttcgccaa

SEQ ID NO: 78499 - DNA, 75 bp, Artificial Sequence
  Synthetic
agaaaagaaaatgagcaactacatacagttcaagtctaaatgccgtattgaacctgtctgtctcttgcttcatgg

SEQ ID NO: 78500 - DNA, 75 bp, Artificial Sequence
  Synthetic
cagttcaagtctaaatgccgtattgaacctgtctgtctcttgcttcatggtagtcctggtgctgggaagtcagtg

SEQ ID NO: 78501 - DNA, 75 bp, Artificial Sequence
  Synthetic
cattttgatggctacaagcagcaggctgttgtgatcatggatgacctatgtcaaaacccagatgggaaggatgtt

SEQ ID NO: 78502 - DNA, 75 bp, Artificial Sequence
  Synthetic
ctgttgtgatcatggatgacctatgtcaaaacccagatgggaaggatgtttccctattttgtcaaatggtttcga

SEQ ID NO: 78503 - DNA, 75 bp, Artificial Sequence
  Synthetic
ccaccaatgcaggatccatcaacgcccctaccgtgtcagatagcagagcccttgccaggaggttccactttgaca

SEQ ID NO: 78504 - DNA, 75 bp, Artificial Sequence
  Synthetic
ccctaccgtgtcagatagcagagcccttgccaggaggttccactttgacatgaacattgaggtcatctccatgta

SEQ ID NO: 78505 - DNA, 75 bp, Artificial Sequence
  Synthetic
aaagtgttgcccgctagtgtgtggtaaagccatccagttcattgatagacgaacgcaggtgagatattcactgga

SEQ ID NO: 78506 - DNA, 75 bp, Artificial Sequence
  Synthetic
aaagccatccagttcattgatagacgaacgcaggtgagatattcactggacatgcttgtgacagaaatgttcagg

SEQ ID NO: 78507 - DNA, 75 bp, Artificial Sequence
  Synthetic
ttaaaacagctctggggttgttcccacccacagggcccactgggcgctagcatactggtatcacggtacctttat

SEQ ID NO: 78508 - DNA, 75 bp, Artificial Sequence
  Synthetic
aaaattagtgtagcaccagagataccccccccccctgcgattgcagacctgctgaaatccgtggacagtgaagcg

SEQ ID NO: 78509 - DNA, 75 bp, Artificial Sequence
  Synthetic
catactggtatcacggtacctttatgcgcctgttttatccacccctccccaacgtaacctagaagacactcatgg

SEQ ID NO: 78510 - DNA, 75 bp, Artificial Sequence
  Synthetic
cccccccccctgcgattgcagacctgctgaaatccgtggacagtgaagcggtcagagagtattgcaaggaaaggg

SEQ ID NO: 78511 - DNA, 75 bp, Artificial Sequence
  Synthetic
cagctgagtctggatcaagcacttctgttgccccggaccgagtatcaataggctgctcacgcggctgaaggagaa

SEQ ID NO: 78512 - DNA, 75 bp, Artificial Sequence
  Synthetic
cgctcaccacctttgtttcagttgcgggtataatatacattatttataagttgttcgccggtttccagggtgctt

SEQ ID NO: 78513 - DNA, 75 bp, Artificial Sequence
  Synthetic
gggtataatatacattatttataagttgttcgccggtttccagggtgcttacactggactgcccaaccaaaaacc

SEQ ID NO: 78514 - DNA, 75 bp, Artificial Sequence
  Synthetic
tgctagcactgtaaagactgagtacggtgaattcacgatgcttgggatttatgacaggtgggcagtattaccccg

SEQ ID NO: 78515 - DNA, 75 bp, Artificial Sequence
  Synthetic
ggtgaattcacgatgcttgggatttatgacaggtgggcagtattaccccggcacgccaaacctggacctaccatc

SEQ ID NO: 78516 - DNA, 75 bp, Artificial Sequence
  Synthetic
tatattggctgcttatggtgacaattgagagattgttgccatatagctattggattggccatccggtttgcaata

SEQ ID NO: 78517 - DNA, 75 bp, Artificial Sequence
  Synthetic
acgcttctgaaattaagcaggaacgaaaagtttagagatatccgaggcttcttagcacgagaagaggttgaagtc

SEQ ID NO: 78518 - DNA, 75 bp, Artificial Sequence
  Synthetic
tgagagattgttgccatatagctattggattggccatccggtttgcaatagagcgattatactcctctttgttgg

SEQ ID NO: 78519 - DNA, 75 bp, Artificial Sequence
  Synthetic
aaaagtttagagatatccgaggcttcttagcacgagaagaggttgaagtcaacgaagccgtgcttgctatcaaca

SEQ ID NO: 78520 - DNA, 75 bp, Artificial Sequence
  Synthetic
caagtttcaacgcagaaaactggtgcgcacgagacaggacttagcgcgaacaatggtgctagcatacattacacc

SEQ ID NO: 78521 - DNA, 75 bp, Artificial Sequence
  Synthetic
ccacaaaacgcatgctaatgtacaacttccctacacgtgcagggcagtgtggcggtgttctaatgtcaacaggca

SEQ ID NO: 78522 - DNA, 75 bp, Artificial Sequence
  Synthetic
cgcacgagacaggacttagcgcgaacaatggtgctagcatacattacaccaacataaactattacagtgactctg

SEQ ID NO: 78523 - DNA, 75 bp, Artificial Sequence
  Synthetic
cttccctacacgtgcagggcagtgtggcggtgttctaatgtcaacaggcaaagttcttggaatacatgttggtgg

SEQ ID NO: 78524 - DNA, 75 bp, Artificial Sequence
  Synthetic
taaagtctttgccagccctgaactctccaagtgcagaggaatgtggtttcagtgacagggtgcgctcaattacac

SEQ ID NO: 78525 - DNA, 75 bp, Artificial Sequence
  Synthetic
cgaaagctccaaggaagctggtttcccagtcattaacacccctaataaaacaaaatttgaacctagcgtcttcca

SEQ ID NO: 78526 - DNA, 75 bp, Artificial Sequence
  Synthetic
tccaagtgcagaggaatgtggtttcagtgacagggtgcgctcaattacacttgggaactccacaattactactca

SEQ ID NO: 78527 - DNA, 75 bp, Artificial Sequence
  Synthetic
ccagtcattaacacccctaataaaacaaaatttgaacctagcgtcttccatcacgtttttgaagggagcaaggaa

SEQ ID NO: 78528 - DNA, 75 bp, Artificial Sequence
  Synthetic
ccaacccacccaacctgatgtagccacatgtaggttttacacgctggaatcagtgcaatggcaggagaattccag

SEQ ID NO: 78529 - DNA, 75 bp, Artificial Sequence
  Synthetic
aacgtgaacactcatgtggatgaatatatgttggaggctgttgatcattatgcaggccaattagcgaccctagac

SEQ ID NO: 78530 - DNA, 75 bp, Artificial Sequence
  Synthetic
acatgtaggttttacacgctggaatcagtgcaatggcaggagaattccagagggtggtggtggaaatttccggaa

SEQ ID NO: 78531 - DNA, 75 bp, Artificial Sequence
  Synthetic
atatgttggaggctgttgatcattatgcaggccaattagcgaccctagacatcagcacagagcccatgaaacttg

SEQ ID NO: 78532 - DNA, 75 bp, Artificial Sequence
  Synthetic
gtgcaatgcaacgcgtccaaattccatcaagggtgcttattagtggtgtgcgttcctgaagcggagatgggaagt

SEQ ID NO: 78533 - DNA, 75 bp, Artificial Sequence
  Synthetic
ttggcatcaagaagagggatattttatccaagaagacaaaagacttgtcaaagctgaaggagtgcatggataagt

SEQ ID NO: 78534 - DNA, 75 bp, Artificial Sequence
  Synthetic
atcaagggtgcttattagtggtgtgcgttcctgaagcggagatgggaagtgccaccataggtcaggcttttgact

SEQ ID NO: 78535 - DNA, 75 bp, Artificial Sequence
  Synthetic
atccaagaagacaaaagacttgtcaaagctgaaggagtgcatggataagtatggactgaacttacctatggtaac

SEQ ID NO: 78536 - DNA, 75 bp, Artificial Sequence
  Synthetic
cagtgtgcaatgcaggtatgggtataggcgttggcaacctgactatctttcctcaccaatggatcaacttgagga

SEQ ID NO: 78537 - DNA, 75 bp, Artificial Sequence
  Synthetic
gaacgactcagtggccatgaggcaaactttcgggaatttatacaagactttccacttaaatccaggcatagtgac

SEQ ID NO: 78538 - DNA, 75 bp, Artificial Sequence
  Synthetic
aggcgttggcaacctgactatctttcctcaccaatggatcaacttgaggaccaacaatagtgcgactattgtgat

SEQ ID NO: 78539 - DNA, 75 bp, Artificial Sequence
  Synthetic
actttcgggaatttatacaagactttccacttaaatccaggcatagtgacaggtagtgcggtcgggtgtgatccc

SEQ ID NO: 78540 - DNA, 75 bp, Artificial Sequence
  Synthetic
tcccttagcgtactctgcaggggcaacgacctacgtgccgataacagtcaccatcgccccaatgtgtgcagagta

SEQ ID NO: 78541 - DNA, 75 bp, Artificial Sequence
  Synthetic
agcttgagtccggtatggtttgcttgtctaaagctgttactagaaaagctggggtactcccacaaagaaactaac

SEQ ID NO: 78542 - DNA, 75 bp, Artificial Sequence
  Synthetic
acgacctacgtgccgataacagtcaccatcgccccaatgtgtgcagagtataatggtttgagactcggatccacc

SEQ ID NO: 78543 - DNA, 75 bp, Artificial Sequence
  Synthetic
gtctaaagctgttactagaaaagctggggtactcccacaaagaaactaactatatagattacttgtgcaactcac

SEQ ID NO: 78544 - DNA, 75 bp, Artificial Sequence
  Synthetic
atgccacaatttgatgtcacccctgaaatgcacatccctggtgaagtgaggaatctaatggaaattgctgaagtc

SEQ ID NO: 78545 - DNA, 75 bp, Artificial Sequence
  Synthetic
actcgatgatcaacaacataataatcaggacactaatgttgaaggtatacaaggggattgatttggaccaattta

SEQ ID NO: 78546 - DNA, 75 bp, Artificial Sequence
  Synthetic
aaatgcacatccctggtgaagtgaggaatctaatggaaattgctgaagtcgactcggtaatgccagtcaacaata

SEQ ID NO: 78547 - DNA, 75 bp, Artificial Sequence
  Synthetic
caggacactaatgttgaaggtatacaaggggattgatttggaccaatttagaatgattgcatatggtgatgacgt

SEQ ID NO: 78548 - DNA, 75 bp, Artificial Sequence
  Synthetic
ttttcagttttcaagtagacccggggtatagtacagtgttgaatcgcacactgatgggggaaatgttaaactatt

SEQ ID NO: 78549 - DNA, 75 bp, Artificial Sequence
  Synthetic
gccagctgacaagggagagtgtttcaatgaggtgacgtggactaatgtcacattcttgaaaagatacttcagagc

SEQ ID NO: 78550 - DNA, 75 bp, Artificial Sequence
  Synthetic
gtatagtacagtgttgaatcgcacactgatgggggaaatgttaaactattatgcccactggtcggggagcatgaa

SEQ ID NO: 78551 - DNA, 75 bp, Artificial Sequence
  Synthetic
aatgaggtgacgtggactaatgtcacattcttgaaaagatacttcagagcagatgagcaatatcctttccttgtg

SEQ ID NO: 78552 - DNA, 75 bp, Artificial Sequence
  Synthetic
tgtgccgactagcagaaagcaagccatgttaggcactcatatcatatgggacttgggcttacaatcaagttgcgt

SEQ ID NO: 78553 - DNA, 75 bp, Artificial Sequence
  Synthetic
atgttaggcactcatatcatatgggacttgggcttacaatcaagttgcgtactctgcgtaccgtggattagccaa

SEQ ID NO: 78554 - DNA, 75 bp, Artificial Sequence
  Synthetic
ggcacaatggagagcaagaatatgaagaatttgtatccaaaattagaagcgttccagtagggcgctgtctgaccc

SEQ ID NO: 78555 - DNA, 75 bp, Artificial Sequence
  Synthetic
gttgtgccagctgacaccccacaaaaatgcgtggtgttaggtttcgcatccgcatgtaacgatttttcagtgcgc

SEQ ID NO: 78556 - DNA, 75 bp, Artificial Sequence
  Synthetic
aatgcgtggtgttaggtttcgcatccgcatgtaacgatttttcagtgcgcttgctgcgagacaccccatttatag

SEQ ID NO: 78557 - DNA, 75 bp, Artificial Sequence
  Synthetic
acccacagggcctactgggcgccagcatactggtatcatggtacctttatgtgcctgttttatccaccctccccc

SEQ ID NO: 78558 - DNA, 75 bp, Artificial Sequence
  Synthetic
caatgcgagttcctgccctcactgcagttgaaacggggcacacttcacaggttgtacctggagataccatacaga

SEQ ID NO: 78559 - DNA, 75 bp, Artificial Sequence
  Synthetic
agttgaaacggggcacacttcacaggttgtacctggagataccatacagaccagacatgtggtcaacttccactc

SEQ ID NO: 78560 - DNA, 75 bp, Artificial Sequence
  Synthetic
gtctattgagctaattggtagtcctccggcccctgaatgcggctaatcctaactgcggagcagatgtccacaaac

SEQ ID NO: 78561 - DNA, 75 bp, Artificial Sequence
  Synthetic
cacggatgacaagacgaagcgttacacaaactgggacataaacattagggagatggtgcagttaagaaggaagtg

SEQ ID NO: 78562 - DNA, 75 bp, Artificial Sequence
  Synthetic
acaaactgggacataaacattagggagatggtgcagttaagaaggaagtgtgagttgttcacatacatgcgtttt

SEQ ID NO: 78563 - DNA, 75 bp, Artificial Sequence
  Synthetic
acacaccagataatgtacataccgcctggaggccctataccacaggaggtgaacagctatgcatggcaaacatcc

SEQ ID NO: 78564 - DNA, 75 bp, Artificial Sequence
  Synthetic
ctggaggccctataccacaggaggtgaacagctatgcatggcaaacatccaccaatcccagtgttttctggacgg

SEQ ID NO: 78565 - DNA, 75 bp, Artificial Sequence
  Synthetic
tctaaaaaccctagattttatcttagaactcaatactgcaaaatgggagcgcaagtgtcaacgcagaaaacgggc

SEQ ID NO: 78566 - DNA, 75 bp, Artificial Sequence
  Synthetic
gaactcaatactgcaaaatgggagcgcaagtgtcaacgcagaaaacgggcgcgcacgagactggagtgaatgcaa

SEQ ID NO: 78567 - DNA, 75 bp, Artificial Sequence
  Synthetic
ggtctcacttctcccaaactggggtgtacgggtacacaacgcttaattcaatgggtaagttatatatcaggcatg

SEQ ID NO: 78568 - DNA, 75 bp, Artificial Sequence
  Synthetic
gtacgggtacacaacgcttaattcaatgggtaagttatatatcaggcatgtaaacgcaagtacacctacccaaat

SEQ ID NO: 78569 - DNA, 75 bp, Artificial Sequence
  Synthetic
actttgcacaagaccccggaaagttcactgagccggtcaaggacatcatgataaaatcactccctgctctaaact

SEQ ID NO: 78570 - DNA, 75 bp, Artificial Sequence
  Synthetic
cactgagccggtcaaggacatcatgataaaatcactccctgctctaaactccccaacggttgaagagtgtgggta

SEQ ID NO: 78571 - DNA, 75 bp, Artificial Sequence
  Synthetic
gtacaagaccaaggccagtgtggactttgaagtcaccaaagtcacagaagaaagggagtcgattaacacagtacc

SEQ ID NO: 78572 - DNA, 75 bp, Artificial Sequence
  Synthetic
tttgaagtcaccaaagtcacagaagaaagggagtcgattaacacagtaccgaaagtggaccacgcgtttcaaaca

SEQ ID NO: 78573 - DNA, 75 bp, Artificial Sequence
  Synthetic
gtacggcgtgtggcctaattatctcaaagacaatgaggcaacagccgaggaccaaccaacgcaaccggatgttgc

SEQ ID NO: 78574 - DNA, 75 bp, Artificial Sequence
  Synthetic
aaagacaatgaggcaacagccgaggaccaaccaacgcaaccggatgttgccacttgcaggttttatacgcttgat

SEQ ID NO: 78575 - DNA, 75 bp, Artificial Sequence
  Synthetic
cgcaatgactgggaaaattgtgtgtgggaggattacaacagggacttgttagtcagcacaaccacggcccatgga

SEQ ID NO: 78576 - DNA, 75 bp, Artificial Sequence
  Synthetic
gggaggattacaacagggacttgttagtcagcacaaccacggcccatggatgtgacaccatagccagatgtcgat

SEQ ID NO: 78577 - DNA, 75 bp, Artificial Sequence
  Synthetic
ggtcagaatatgcaataccactacttgggccgaactgggtacaccatacacgtacaatgcaatgcatccaaattt

SEQ ID NO: 78578 - DNA, 75 bp, Artificial Sequence
  Synthetic
tgggccgaactgggtacaccatacacgtacaatgcaatgcatccaaatttcatcaagggtgcctactagtagtgt

SEQ ID NO: 78579 - DNA, 75 bp, Artificial Sequence
  Synthetic
aagttcaagaaagtgaatactatcctaaaaggtaccagtcccacgtgttactcgccgcaggtttctcagaaccag

SEQ ID NO: 78580 - DNA, 75 bp, Artificial Sequence
  Synthetic
taaaaggtaccagtcccacgtgttactcgccgcaggtttctcagaaccaggtgactgtggaggcatcctgcggtg

SEQ ID NO: 78581 - DNA, 75 bp, Artificial Sequence
  Synthetic
cagcgaaagagttcgcggacaagccagttgcggcaggctccaataaactagtgcagagagcagtgtataatgcag

SEQ ID NO: 78582 - DNA, 75 bp, Artificial Sequence
  Synthetic
agttgcggcaggctccaataaactagtgcagagagcagtgtataatgcaggcatggggataggggttggaaacct

SEQ ID NO: 78583 - DNA, 75 bp, Artificial Sequence
  Synthetic
gtggttggaagacgacgccatggagcagggcgttagggattatgtggaacagctcgggaacgccttcggatccgg

SEQ ID NO: 78584 - DNA, 75 bp, Artificial Sequence
  Synthetic
cagggcgttagggattatgtggaacagctcgggaacgccttcggatccggtttcaccaaccaaatttgtgagcaa

SEQ ID NO: 78585 - DNA, 75 bp, Artificial Sequence
  Synthetic
tgtgcctatggacagtatgtttaggcacaacaatgtgacattaatggtgattccgtttgttcccctagattactg

SEQ ID NO: 78586 - DNA, 75 bp, Artificial Sequence
  Synthetic
cacaacaatgtgacattaatggtgattccgtttgttcccctagattactgccctggatctaccacatatgtgcca

SEQ ID NO: 78587 - DNA, 75 bp, Artificial Sequence
  Synthetic
atctcagcattagtcattgtggtaagaaaccatgatgacctgatcacagtgacagccaccctagcactagtcggt

SEQ ID NO: 78588 - DNA, 75 bp, Artificial Sequence
  Synthetic
gaaaccatgatgacctgatcacagtgacagccaccctagcactagtcggttgcacctcatcaccgtggcgatggc

SEQ ID NO: 78589 - DNA, 75 bp, Artificial Sequence
  Synthetic
atgaacactccgggcagttgccaattcttgacatcagatgatttccaatctccctctgccatgcctcagtacgat

SEQ ID NO: 78590 - DNA, 75 bp, Artificial Sequence
  Synthetic
tcttgacatcagatgatttccaatctccctctgccatgcctcagtacgatgttaccccagagatgacaatacctg

SEQ ID NO: 78591 - DNA, 75 bp, Artificial Sequence
  Synthetic
cagagatgacaaatgcctgtaagggcatggagtggatagccgtcaagatccaaaaattcatagagtggctgaagg

SEQ ID NO: 78592 - DNA, 75 bp, Artificial Sequence
  Synthetic
actctatggaagcataccagatacctgtcaggtcaaatgagggaactgggactcaggtgtttggcttcccattgc

SEQ ID NO: 78593 - DNA, 75 bp, Artificial Sequence
  Synthetic
tgtcaggtcaaatgagggaactgggactcaggtgtttggcttcccattgcagccgggctattcaagcgtgttcag

SEQ ID NO: 78594 - DNA, 75 bp, Artificial Sequence
  Synthetic
aaatagccaccatcgaacagagtgctccttcacagagcgaccaggaacagctattctccaacgtacaatatttcg

SEQ ID NO: 78595 - DNA, 75 bp, Artificial Sequence
  Synthetic
tgggtctgcgatggctacgggcaaatttttactggcgtactcacccccgggcgctggcgccccgacaaggagagt

SEQ ID NO: 78596 - DNA, 75 bp, Artificial Sequence
  Synthetic
tttttactggcgtactcacccccgggcgctggcgccccgacaaggagagtggatgcgatgcttggtacacatgtt

SEQ ID NO: 78597 - DNA, 75 bp, Artificial Sequence
  Synthetic
atgccgtattgaaccagtctgtttattgcttcatggtagccctggagctgggaaatccgtggctaccaatttgat

SEQ ID NO: 78598 - DNA, 75 bp, Artificial Sequence
  Synthetic
gcttccgatgagtatacagcggggggtttcattacgtgctggtatcaaaccaacattgtggtccccgctgatgca

SEQ ID NO: 78599 - DNA, 75 bp, Artificial Sequence
  Synthetic
gtttcattacgtgctggtatcaaaccaacattgtggtccccgctgatgcacagagttcatgctacataatgtgct

SEQ ID NO: 78600 - DNA, 75 bp, Artificial Sequence
  Synthetic
taaacaacaggctgtcgtgatcatggacgacctgtgccagaacccggacgggaaggatgtatctttgttttgcca

SEQ ID NO: 78601 - DNA, 75 bp, Artificial Sequence
  Synthetic
gacgacctgtgccagaacccggacgggaaggatgtatctttgttttgccaaatggtctcaagtgtagactttgtg

SEQ ID NO: 78602 - DNA, 75 bp, Artificial Sequence
  Synthetic
aaggtccggtcgagaattcaataacagctgccattggcagggttgccgacacagtagggtctgggccaacaaatt

SEQ ID NO: 78603 - DNA, 75 bp, Artificial Sequence
  Synthetic
agctgccattggcagggttgccgacacagtagggtctgggccaacaaattctgaagctataccggctcttacagc

SEQ ID NO: 78604 - DNA, 75 bp, Artificial Sequence
  Synthetic
tttattaatgcccccactgtgtcggacagtagggccctcgctagaaggttccattttgacatgaacatcgaagtt

SEQ ID NO: 78605 - DNA, 75 bp, Artificial Sequence
  Synthetic
acagtagggccctcgctagaaggttccattttgacatgaacatcgaagttatctcaatgtatagtcagaatggta

SEQ ID NO: 78606 - DNA, 75 bp, Artificial Sequence
  Synthetic
aagatctgaatcaaccattgagaactttgtgtgcaggtctgcatgtgtttacttcactgagtacgaaaattcagg

SEQ ID NO: 78607 - DNA, 75 bp, Artificial Sequence
  Synthetic
tttgtgtgcaggtctgcatgtgtttacttcactgagtacgaaaattcagggtctaaccggtatgccgaatgggtg

SEQ ID NO: 78608 - DNA, 75 bp, Artificial Sequence
  Synthetic
tggtgtgtggtaaggccatccagtttattgacagaagaacacaggtgaggtactcactagacatgctagtaactg

SEQ ID NO: 78609 - DNA, 75 bp, Artificial Sequence
  Synthetic
tattgacagaagaacacaggtgaggtactcactagacatgctagtaactgaaatgttcagggaatacaaccatag

SEQ ID NO: 78610 - DNA, 75 bp, Artificial Sequence
  Synthetic
acctttgtcatcacgagtactcagcagccttccacaactcaaaaccaagatgctcaagttcttacccaccaaata

SEQ ID NO: 78611 - DNA, 75 bp, Artificial Sequence
  Synthetic
agccttccacaactcaaaaccaagatgctcaagttcttacccaccaaataatgtatgtgccaccaggtggtccag

SEQ ID NO: 78612 - DNA, 75 bp, Artificial Sequence
  Synthetic
accagaaacccccccccctccagcaatagcagatttattgaagtctgtggacagtgaggcagtcagggaatactg

SEQ ID NO: 78613 - DNA, 75 bp, Artificial Sequence
  Synthetic
cgccacgcatgtccattccatttttgagcatagggaacgcatactcgaacttttacgatggctggtctgagtttg

SEQ ID NO: 78614 - DNA, 75 bp, Artificial Sequence
  Synthetic
ctgcctgcaagcgctcaccacatttgtatctgtggcggggataatatacatcatttataaattgtttgcaggctt

SEQ ID NO: 78615 - DNA, 75 bp, Artificial Sequence
  Synthetic
gagcatagggaacgcatactcgaacttttacgatggctggtctgagtttgccagaagtggagtgtatggcataaa

SEQ ID NO: 78616 - DNA, 75 bp, Artificial Sequence
  Synthetic
agcatttgaattcgcagtggcaatgatgaaaagaaatgccagtactgtgaaaactgagtacggcgagttcacaat

SEQ ID NO: 78617 - DNA, 75 bp, Artificial Sequence
  Synthetic
tagaatctactttaaacctaagcacgttaaggcatggatacctagacccccaaggctgtgtcagtacgaaaaagc

SEQ ID NO: 78618 - DNA, 75 bp, Artificial Sequence
  Synthetic
atgaaaagaaatgccagtactgtgaaaactgagtacggcgagttcacaatgcttggaatctatgataggtgggcg

SEQ ID NO: 78619 - DNA, 75 bp, Artificial Sequence
  Synthetic
gttaaggcatggatacctagacccccaaggctgtgtcagtacgaaaaagcaaagaatgtcaactttcaacccagt

SEQ ID NO: 78620 - DNA, 75 bp, Artificial Sequence
  Synthetic
gaactggtagacagagatggcaccaacttggaactgactcttttgaagcttaacagaaatgagaagtttagagac

SEQ ID NO: 78621 - DNA, 75 bp, Artificial Sequence
  Synthetic
tacgtgggcaactatagggtggtgaatagacacctggccacatccgcggactggcagaactgcgtgtgggaaaac

SEQ ID NO: 78622 - DNA, 75 bp, Artificial Sequence
  Synthetic
acttggaactgactcttttgaagcttaacagaaatgagaagtttagagacattcgaggcttcttggcaagagagg

SEQ ID NO: 78623 - DNA, 75 bp, Artificial Sequence
  Synthetic
atagacacctggccacatccgcggactggcagaactgcgtgtgggaaaactacaacagagacctactggtcagca

SEQ ID NO: 78624 - DNA, 75 bp, Artificial Sequence
  Synthetic
tgatggactatggcttcctcaacttgggtggaacccccactaagcgtatgctgatgtacaacttcccaacacgtg

SEQ ID NO: 78625 - DNA, 75 bp, Artificial Sequence
  Synthetic
acaagcattacccagtcagctttgagggaccgggtcttgtggaagttcaggagagtgagtattacccgaaaagat

SEQ ID NO: 78626 - DNA, 75 bp, Artificial Sequence
  Synthetic
gggtggaacccccactaagcgtatgctgatgtacaacttcccaacacgtgcaggccaatgtgggggcgtcctaat

SEQ ID NO: 78627 - DNA, 75 bp, Artificial Sequence
  Synthetic
gggaccgggtcttgtggaagttcaggagagtgagtattacccgaaaagatatcagtcccacgtgctccttgcagc

SEQ ID NO: 78628 - DNA, 75 bp, Artificial Sequence
  Synthetic
ctatttcaatgatgagcagggagagattgagttcattgagagctccaaggatgcaggctttccagttattaatac

SEQ ID NO: 78629 - DNA, 75 bp, Artificial Sequence
  Synthetic
tggtgaaggcgtcgttggctttgccgacgtgcgcgacttactgtggctggaagacgatgcaatggaacaaggcgt

SEQ ID NO: 78630 - DNA, 75 bp, Artificial Sequence
  Synthetic
attgagttcattgagagctccaaggatgcaggctttccagttattaatacgcctagcaaaacaaagctcgagccc

SEQ ID NO: 78631 - DNA, 75 bp, Artificial Sequence
  Synthetic
gacgtgcgcgacttactgtggctggaagacgatgcaatggaacaaggcgtcaaagattacgtggaacaacttgga

SEQ ID NO: 78632 - DNA, 75 bp, Artificial Sequence
  Synthetic
aattttgaagaagccattttctccaagtacattggtaatgtcaacacccatgtggatgagtacatgttagaggct

SEQ ID NO: 78633 - DNA, 75 bp, Artificial Sequence
  Synthetic
gactcaatcttagagaaatcactcaaagccctggtcaaaatcatttcagcgttagttattgtggtgagaaaccat

SEQ ID NO: 78634 - DNA, 75 bp, Artificial Sequence
  Synthetic
agtacattggtaatgtcaacacccatgtggatgagtacatgttagaggctgttgaccactatgcgggacaactgg

SEQ ID NO: 78635 - DNA, 75 bp, Artificial Sequence
  Synthetic
aagccctggtcaaaatcatttcagcgttagttattgtggtgagaaaccatgatgacttgatcacagtaactgcca

SEQ ID NO: 78636 - DNA, 75 bp, Artificial Sequence
  Synthetic
atctgaccacaagtgcagggtacccctacgttgctcttggtatcaaaaagagggacatcctatccaagaagacca

SEQ ID NO: 78637 - DNA, 75 bp, Artificial Sequence
  Synthetic
ccatggctgaaaggcaaaataacagctggttaaagaaattcactgagatgacaaatgcctgtaagggtatggagt

SEQ ID NO: 78638 - DNA, 75 bp, Artificial Sequence
  Synthetic
ctacgttgctcttggtatcaaaaagagggacatcctatccaagaagaccaaggacctaacaaagctgaaggagtg

SEQ ID NO: 78639 - DNA, 75 bp, Artificial Sequence
  Synthetic
agtttctaaacagattaaagcaactaccactgctggagagtcagattgctaccatcgaacagagcgcgccctcac

SEQ ID NO: 78640 - DNA, 75 bp, Artificial Sequence
  Synthetic
taaaggtaaatctaggttaattgaggcatcaagtttgaatgactcggtggccatgaggcagacctttggaaacct

SEQ ID NO: 78641 - DNA, 75 bp, Artificial Sequence
  Synthetic
gcatcaagtttgaatgactcggtggccatgaggcagacctttggaaacctatacaaaactttccacctaaatcca

SEQ ID NO: 78642 - DNA, 75 bp, Artificial Sequence
  Synthetic
accactgctggagagtcagattgctaccatcgaacagagcgcgccctcacagagcgatcaggagcaattgttttc

SEQ ID NO: 78643 - DNA, 75 bp, Artificial Sequence
  Synthetic
atacagttcaagtccaaatgccgtattgaacctgtctgcctattgctccacggaagccccggtgctggaaaatca

SEQ ID NO: 78644 - DNA, 75 bp, Artificial Sequence
  Synthetic
catctcatcgcttttgattacagcggctatgatgccagcctaagtccagtgtggtttgcatgtctaaagttgttg

SEQ ID NO: 78645 - DNA, 75 bp, Artificial Sequence
  Synthetic
gctatgatgccagcctaagtccagtgtggtttgcatgtctaaagttgttgctggagaagttgggatatacgcaca

SEQ ID NO: 78646 - DNA, 75 bp, Artificial Sequence
  Synthetic
ttgaacctgtctgcctattgctccacggaagccccggtgctggaaaatcagtagcaacaaacctgatcgggcgct

SEQ ID NO: 78647 - DNA, 75 bp, Artificial Sequence
  Synthetic
gaatgccatctggatgttcggggaccagcatcttcaactcaatgattaacaacatcatcattaggacactaatgt

SEQ ID NO: 78648 - DNA, 75 bp, Artificial Sequence
  Synthetic
aagctgtagtgatcatggacgacctgtgtcaaaatccagatgggaaggatgtgtcattgttctgccaaatggtgt

SEQ ID NO: 78649 - DNA, 75 bp, Artificial Sequence
  Synthetic
gtgtcattgttctgccaaatggtgtcaagtgtcgacttcgtcccacctatggcagcgctagaagagaaaggcatc

SEQ ID NO: 78650 - DNA, 75 bp, Artificial Sequence
  Synthetic
cagcatcttcaactcaatgattaacaacatcatcattaggacactaatgttgagagtgtacaaggggatagatct

SEQ ID NO: 78651 - DNA, 75 bp, Artificial Sequence
  Synthetic
ggcagaagcagggaagaggtacggtctgatcatgacaccagccgataagggagagtgttttaacgaggtgacatg

SEQ ID NO: 78652 - DNA, 75 bp, Artificial Sequence
  Synthetic
ctgatcatgacaccagccgataagggagagtgttttaacgaggtgacatggaccaacgtcaccttcctgaaaaga

SEQ ID NO: 78653 - DNA, 75 bp, Artificial Sequence
  Synthetic
acatgaatattgaagtcatctcaatgtacagccagaatggaaagattaatatgccaatgtcggtgaagacttgcg

SEQ ID NO: 78654 - DNA, 75 bp, Artificial Sequence
  Synthetic
aggtggaccaaagacccaaaaaacactcaagaccatgtgcgatccttgtgcttgttggcctggcacaatggagag

SEQ ID NO: 78655 - DNA, 75 bp, Artificial Sequence
  Synthetic
actttacgcaggaagtggctggactccttctaaattagagttcaatttgatataattcaaatggcttaaccctac

SEQ ID NO: 78656 - DNA, 75 bp, Artificial Sequence
  Synthetic
atcaagattagtgtcgcaccagaaactcccccaccaccagcaatagcggatctactgaaatctgtggatagtgag

SEQ ID NO: 78657 - DNA, 75 bp, Artificial Sequence
  Synthetic
ccttctaaattagagttcaatttgatataattcaaatggcttaaccctaccacacttaccgaactagaaaacggt

SEQ ID NO: 78658 - DNA, 75 bp, Artificial Sequence
  Synthetic
ttaaaacagctctggggttgctcccacccacagggcccaatgggcgctagcacactagtattgaggtacttttgt

SEQ ID NO: 78659 - DNA, 75 bp, Artificial Sequence
  Synthetic
cacactagtattgaggtacttttgtgcgcctgttttatccaccctctccccacgtaacttagaagcaaaactcat

SEQ ID NO: 78660 - DNA, 75 bp, Artificial Sequence
  Synthetic
gtgagcagggcatttatttgcttacaagcactcactaccttcgtctctgtggctggaatcatatacatcatttac

SEQ ID NO: 78661 - DNA, 75 bp, Artificial Sequence
  Synthetic
aagcactcactaccttcgtctctgtggctggaatcatatacatcatttacaagttgtttgcaggtttccagggag

SEQ ID NO: 78662 - DNA, 75 bp, Artificial Sequence
  Synthetic
caactgggcaatgaccaagcacttctgttccccggactgagtatcaatagactgctcacgcggttgaaggagaaa

SEQ ID NO: 78663 - DNA, 75 bp, Artificial Sequence
  Synthetic
agtttgcggtggccatgatgaaacggaacgccagcaccgtaaagactgaatatggtgagttcacaatgcttggca

SEQ ID NO: 78664 - DNA, 75 bp, Artificial Sequence
  Synthetic
tttacgatagatgggcagtgctgccccgacacgccaagcctgggcctaccattctaatgaatgatcacgaagtgg

SEQ ID NO: 78665 - DNA, 75 bp, Artificial Sequence
  Synthetic
cttcttaacacgtgaggaggctgaagttaatgaggctgtacttgccattaacaccagcaagttcccaaacatgta

SEQ ID NO: 78666 - DNA, 75 bp, Artificial Sequence
  Synthetic
caacttcccaacacgcgcgggccaatgtggtggtgttctgatgtcaacaggtaaagtgctcgggatacacgttgg

SEQ ID NO: 78667 - DNA, 75 bp, Artificial Sequence
  Synthetic
cacagaacacatcactatgggcgcacaagtgtcaacccagaaaaccggggcacatgagaatagcgtgaaagctaa

SEQ ID NO: 78668 - DNA, 75 bp, Artificial Sequence
  Synthetic
caagtgtcaacccagaaaaccggggcacatgagaatagcgtgaaagctaatgggagctcgaccatcaactacacc

SEQ ID NO: 78669 - DNA, 75 bp, Artificial Sequence
  Synthetic
tatcgagagctccaagggagcaggctttccagtcattaacacacctagcaaaacaaagcttgaacccagtgtgtt

SEQ ID NO: 78670 - DNA, 75 bp, Artificial Sequence
  Synthetic
tttccagtcattaacacacctagcaaaacaaagcttgaacccagtgtgttccaccacgtatttgagggaaacaag

SEQ ID NO: 78671 - DNA, 75 bp, Artificial Sequence
  Synthetic
acagaacccattaaagatgtcatgatcaaaaccctcccagcactgaactcaccatctgctgaagagtgtggttat

SEQ ID NO: 78672 - DNA, 75 bp, Artificial Sequence
  Synthetic
tcaaaaccctcccagcactgaactcaccatctgctgaagagtgtggttatagcgatcgtgtccgatcgatcaccc

SEQ ID NO: 78673 - DNA, 75 bp, Artificial Sequence
  Synthetic
ggcaatgtgaacacccatgtggatgagtacatgttggaggctgttgaccactacgcaggacaactggcaactcta

SEQ ID NO: 78674 - DNA, 75 bp, Artificial Sequence
  Synthetic
agtacatgttggaggctgttgaccactacgcaggacaactggcaactctagatatcagcacagaacccatgaaac

SEQ ID NO: 78675 - DNA, 75 bp, Artificial Sequence
  Synthetic
aggatgatgaagctactgctgaggataaaccgacacagcctgatgtagctacctgcaggttttacactctggaat

SEQ ID NO: 78676 - DNA, 75 bp, Artificial Sequence
  Synthetic
taaaccgacacagcctgatgtagctacctgcaggttttacactctggaatccatcaactgggaaaagagctctgc

SEQ ID NO: 78677 - DNA, 75 bp, Artificial Sequence
  Synthetic
cccttggtataaagaagagagacattctgtctaaaaagaccaaggacctgaccaaactgaaagagtgcatggaca

SEQ ID NO: 78678 - DNA, 75 bp, Artificial Sequence
  Synthetic
tctgtctaaaaagaccaaggacctgaccaaactgaaagagtgcatggacaaatacgggttaaatctccctatggt

SEQ ID NO: 78679 - DNA, 75 bp, Artificial Sequence
  Synthetic
gggtcgcgcggggtacacaatccacgttcagtgcaacgcatccaagtttcatcaagggtgcttattggtcgtgtg

SEQ ID NO: 78680 - DNA, 75 bp, Artificial Sequence
  Synthetic
gttcagtgcaacgcatccaagtttcatcaagggtgcttattggtcgtgtgcgtgcccgaggcagagatggggtgt

SEQ ID NO: 78681 - DNA, 75 bp, Artificial Sequence
  Synthetic
cagacctttgggaatttatacaagacattccatttaaacccaggtatagtgacaggcagtgcgtttgggtgtgac

SEQ ID NO: 78682 - DNA, 75 bp, Artificial Sequence
  Synthetic
tccggtgaaacgcatggagtgcagaccgctgtgcacaatgcagccatgggagtcgccgtgggcaacctgaccatt

SEQ ID NO: 78683 - DNA, 75 bp, Artificial Sequence
  Synthetic
ccgctgtgcacaatgcagccatgggagtcgccgtgggcaacctgaccattttcccacatcagtggattaatctgc

SEQ ID NO: 78684 - DNA, 75 bp, Artificial Sequence
  Synthetic
gccagcttgagcccggtgtggtttgcttgcctgaaactgttattagagaaactggggtattcccacaaagaaacc

SEQ ID NO: 78685 - DNA, 75 bp, Artificial Sequence
  Synthetic
atttcactttaatgattatcccatttgcgccactggaggtccaagcaggcacggctacggcagtgcctataacag

SEQ ID NO: 78686 - DNA, 75 bp, Artificial Sequence
  Synthetic
tgcatcggttgctcaggaactagcatctttactcatgattataacataatcattagaacattaatgctgaaggtg

SEQ ID NO: 78687 - DNA, 75 bp, Artificial Sequence
  Synthetic
tgcgccactggaggtccaagcaggcacggctacggcagtgcctataacagtgaccgtggcgcctatgcaagcaga

SEQ ID NO: 78688 - DNA, 75 bp, Artificial Sequence
  Synthetic
tctttactcatgattataacataatcattagaacattaatgctgaaggtgtacaaggggatagacctggaccagt

SEQ ID NO: 78689 - DNA, 75 bp, Artificial Sequence
  Synthetic
atcagatgatttccagtcaccatctgcgatgccgcagtttgacgtgacgccattactacatataccgggggaggt

SEQ ID NO: 78690 - DNA, 75 bp, Artificial Sequence
  Synthetic
ctggtaaagggtatggattgatcatgacacctgctgacaagggagagtgctttaatgaggtgacatggaccaacg

SEQ ID NO: 78691 - DNA, 75 bp, Artificial Sequence
  Synthetic
gcgatgccgcagtttgacgtgacgccattactacatataccgggggaggtcaaaaacctgatggaggttgccgag

SEQ ID NO: 78692 - DNA, 75 bp, Artificial Sequence
  Synthetic
gacacctgctgacaagggagagtgctttaatgaggtgacatggaccaacgttaccttcctgaaaagatactttag

SEQ ID NO: 78693 - DNA, 75 bp, Artificial Sequence
  Synthetic
actggaacgcatgcgtcgagtaaagccatattcagttttgagctagaccccgggaatggtactgtcttgagtaaa

SEQ ID NO: 78694 - DNA, 75 bp, Artificial Sequence
  Synthetic
taaagatcctaaaaacacccaggatcacgtgcgatccttgtgcttattggcttggcacaacggagagcaggagta

SEQ ID NO: 78695 - DNA, 75 bp, Artificial Sequence
  Synthetic
ccatattcagttttgagctagaccccgggaatggtactgtcttgagtaaaaccctactgggtgagatcttaaatt

SEQ ID NO: 78696 - DNA, 75 bp, Artificial Sequence
  Synthetic
cttggcacaacggagagcaggagtatgaagaatttgtagccaaaatcagaagcgttccagtagggcgctgcctaa

SEQ ID NO: 78697 - DNA, 75 bp, Artificial Sequence
  Synthetic
tattagcttactcaccaccaggcgcttccgtgccaaaggataggaagcaagctatgttaggcacccacgtaattt

SEQ ID NO: 78698 - DNA, 75 bp, Artificial Sequence
  Synthetic
ttccgtgccaaaggataggaagcaagctatgttaggcacccacgtaatttgggatcttgggctacagtctagctg

SEQ ID NO: 78699 - DNA, 75 bp, Artificial Sequence
  Synthetic
catcacagcctggtaccagacgacgatggtagtgccgccaaaaaccccaacctcgtgttatatcctgtgcttcgt

SEQ ID NO: 78700 - DNA, 75 bp, Artificial Sequence
  Synthetic
atggtagtgccgccaaaaaccccaacctcgtgttatatcctgtgcttcgtgtccgcttgcaacgacttctcggtg

SEQ ID NO: 78701 - DNA, 75 bp, Artificial Sequence
  Synthetic
cagccatgttttgatcaagcacttctgtttccccggaccaagtatcaatagactgctcacgcggttgaaggagaa

SEQ ID NO: 78702 - DNA, 75 bp, Artificial Sequence
  Synthetic
gctgatacttcacccagcacatccagaaacacagagcaggtgcccgctctcacagcagccgagacggggcatact

SEQ ID NO: 78703 - DNA, 75 bp, Artificial Sequence
  Synthetic
cacagcagccgagacggggcatacttcgcaagtggaccccagtgacacggtgcagactcgacacgtacaaaactt

SEQ ID NO: 78704 - DNA, 75 bp, Artificial Sequence
  Synthetic
tggctcacaggcagacttgagtgatagatacacgcaatggacaatatcggtcagagatatggcccagataagacg

SEQ ID NO: 78705 - DNA, 75 bp, Artificial Sequence
  Synthetic
agatacacgcaatggacaatatcggtcagagatatggcccagataagacgcaaatttgaaatgttcacgtactta

SEQ ID NO: 78706 - DNA, 75 bp, Artificial Sequence
  Synthetic
ttacattggctgcatatggtgacgattgagagattgttgccatatagctattggattggccatccagtgtctaac

SEQ ID NO: 78707 - DNA, 75 bp, Artificial Sequence
  Synthetic
ttgagagattgttgccatatagctattggattggccatccagtgtctaacagagctattgtatatctttttgttg

SEQ ID NO: 78708 - DNA, 75 bp, Artificial Sequence
  Synthetic
gtactgacccaccaaattatgtacgtcccaccaggtggtccagtgcccacaagcgtaggaagcttcgcttggcaa

SEQ ID NO: 78709 - DNA, 75 bp, Artificial Sequence
  Synthetic
tcccaccaggtggtccagtgcccacaagcgtaggaagcttcgcttggcaaacttccacaaacccgagcttgttct

SEQ ID NO: 78710 - DNA, 75 bp, Artificial Sequence
  Synthetic
gcaagtatctacccaaaaaaccggggcacatgagactggcttgaatgctagtggaaactccatcatccattacac

SEQ ID NO: 78711 - DNA, 75 bp, Artificial Sequence
  Synthetic
gcacatgagactggcttgaatgctagtggaaactccatcatccattacacaaatataaactactacaaggatgca

SEQ ID NO: 78712 - DNA, 75 bp, Artificial Sequence
  Synthetic
atgggtggtcgcacttctcgcaaactggcgtatacggtttcaatactctaaatgatatgggcaggcttttcatca

SEQ ID NO: 78713 - DNA, 75 bp, Artificial Sequence
  Synthetic
tggcgtatacggtttcaatactctaaatgatatgggcaggcttttcatcagacatgtcaatgagcaaagcccgta

SEQ ID NO: 78714 - DNA, 75 bp, Artificial Sequence
  Synthetic
attaaatccatgccagcactaaactcgccatccgctgaagagtgcgggtacagcgatagggtgcgttcgatgaca

SEQ ID NO: 78715 - DNA, 75 bp, Artificial Sequence
  Synthetic
cgccatccgctgaagagtgcgggtacagcgatagggtgcgttcgatgacactaggtaactccaccatcacaacgc

SEQ ID NO: 78716 - DNA, 75 bp, Artificial Sequence
  Synthetic
atgcccatacatcaataaggcaaatgtcaacttcaaaccacacccagtggccgactcaaggcctaccatcaacga

SEQ ID NO: 78717 - DNA, 75 bp, Artificial Sequence
  Synthetic
gtcaacttcaaaccacacccagtggccgactcaaggcctaccatcaacgatgtacccaccgcagaacatccaccc

SEQ ID NO: 78718 - DNA, 75 bp, Artificial Sequence
  Synthetic
atcaacccacacagccagacgttgcaacgtgcagattttacaccttagagtcagtgtcttgggagacttcatcag

SEQ ID NO: 78719 - DNA, 75 bp, Artificial Sequence
  Synthetic
aacgtgcagattttacaccttagagtcagtgtcttgggagacttcatcagacggatggtggtggaagtttccaga

SEQ ID NO: 78720 - DNA, 75 bp, Artificial Sequence
  Synthetic
ctggctacacacactgattggcagaactgtgtgtgggagagttacaatagagatttgctagtgagtacaaccacg

SEQ ID NO: 78721 - DNA, 75 bp, Artificial Sequence
  Synthetic
actgtgtgtgggagagttacaatagagatttgctagtgagtacaaccacggctcacggttgtgacaccatagcaa

SEQ ID NO: 78722 - DNA, 75 bp, Artificial Sequence
  Synthetic
tgtacagtgtaacgcatccaaatttcaccaaggttgcttgctggtggtttgtgtaccagaggcggaaatgggctg

SEQ ID NO: 78723 - DNA, 75 bp, Artificial Sequence
  Synthetic
caccaaggttgcttgctggtggtttgtgtaccagaggcggaaatgggctgcgctaccacggacagggtggttaat

SEQ ID NO: 78724 - DNA, 75 bp, Artificial Sequence
  Synthetic
gcctggtggaagtccaggaaagtgaatactatccaaaaagataccaatcccatgtgctacttgccgcaggtttct

SEQ ID NO: 78725 - DNA, 75 bp, Artificial Sequence
  Synthetic
atactatccaaaaagataccaatcccatgtgctacttgccgcaggtttctcagaaccaggtgactgtggaggtat

SEQ ID NO: 78726 - DNA, 75 bp, Artificial Sequence
  Synthetic
accatagtcaccaatgctggcatgggtgtcggggttggcaacttaactatataccctcatcagtggatcaaccta

SEQ ID NO: 78727 - DNA, 75 bp, Artificial Sequence
  Synthetic
gtgtcggggttggcaacttaactatataccctcatcagtggatcaacctacgcactaacaacagtgctacaatag

SEQ ID NO: 78728 - DNA, 75 bp, Artificial Sequence
  Synthetic
tgacctcttatggttggaagatgacgccatggagcaaggcgtcagggattacgtggaacagcttggaaatgcttt

SEQ ID NO: 78729 - DNA, 75 bp, Artificial Sequence
  Synthetic
gccatggagcaaggcgtcagggattacgtggaacagcttggaaatgcttttggatctggttttaccagccagatt

SEQ ID NO: 78730 - DNA, 75 bp, Artificial Sequence
  Synthetic
tcgtaccattagagtacgcctcgacggcctccacatacgtgccgataactgtcactgtggcaccaatgtgcgctg

SEQ ID NO: 78731 - DNA, 75 bp, Artificial Sequence
  Synthetic
ggcctccacatacgtgccgataactgtcactgtggcaccaatgtgcgctgagtacaatggtctgagattggctac

SEQ ID NO: 78732 - DNA, 75 bp, Artificial Sequence
  Synthetic
gtcaagatcatatcagcgttggttattgtggtaaggaatcatgacgatctgatcacagtgactgccactcttgcc

SEQ ID NO: 78733 - DNA, 75 bp, Artificial Sequence
  Synthetic
ttgtggtaaggaatcatgacgatctgatcacagtgactgccactcttgccttaattggttgcacatcgtcaccat

SEQ ID NO: 78734 - DNA, 75 bp, Artificial Sequence
  Synthetic
gtccgctatgccccagttcgacgtgacacccgagatggacataccaggtgaagtacacaatttgatggaaattgc

SEQ ID NO: 78735 - DNA, 75 bp, Artificial Sequence
  Synthetic
acacccgagatggacataccaggtgaagtacacaatttgatggaaattgctgaggttgactctgtggtaccagta

SEQ ID NO: 78736 - DNA, 75 bp, Artificial Sequence
  Synthetic
agaagtttacggagatgaccaacgcctgcaaaggcatggagtggatagctgttaaaatccaaaagttcattgagt

SEQ ID NO: 78737 - DNA, 75 bp, Artificial Sequence
  Synthetic
accagactgaaacaactacccttattggagagtcagattgcaaccatcgagcaaagtgcaccctcacaaagtgac

SEQ ID NO: 78738 - DNA, 75 bp, Artificial Sequence
  Synthetic
caggtttttggtttccaaatgcaaccaggcttggataatgtgctaaaacacacgctgttgggggagattttgaat

SEQ ID NO: 78739 - DNA, 75 bp, Artificial Sequence
  Synthetic
caggcttggataatgtgctaaaacacacgctgttgggggagattttgaattactacgcacactggtctggtagtg

SEQ ID NO: 78740 - DNA, 75 bp, Artificial Sequence
  Synthetic
atacgcgcccctgtatgctgctgaagcaaagagagtgttttcccttgaaaagaaaatgagcaactatatacagtt

SEQ ID NO: 78741 - DNA, 75 bp, Artificial Sequence
  Synthetic
ccaatgccccaaagagtaggaaagacgctatgttgggcacgcacattatatgggatgtggggttacagtccagct

SEQ ID NO: 78742 - DNA, 75 bp, Artificial Sequence
  Synthetic
agaaaatgagcaactatatacagttcaagtccaaatgccgtattgaacctgtatgcctcttgctccatggaagcc

SEQ ID NO: 78743 - DNA, 75 bp, Artificial Sequence
  Synthetic
cgctatgttgggcacgcacattatatgggatgtggggttacagtccagctgcgtactgtgcataccatggattag

SEQ ID NO: 78744 - DNA, 75 bp, Artificial Sequence
  Synthetic
cactaccaccggatccagatcatttcgacggttataaacaacaggctgttgtgattatggacgacctgtgtcaaa

SEQ ID NO: 78745 - DNA, 75 bp, Artificial Sequence
  Synthetic
gatcgttgtgccagccgggactcccaccagttgctcgatactatgctttgcttctgcgtgtaacgacttttcagt

SEQ ID NO: 78746 - DNA, 75 bp, Artificial Sequence
  Synthetic
cgacggttataaacaacaggctgttgtgattatggacgacctgtgtcaaaacccagacgggagggatgtgtctct

SEQ ID NO: 78747 - DNA, 75 bp, Artificial Sequence
  Synthetic
accagttgctcgatactatgctttgcttctgcgtgtaacgacttttcagtacgattgctacgcgacaccccgttt

SEQ ID NO: 78748 - DNA, 75 bp, Artificial Sequence
  Synthetic
atcaccatttgttctcgcctctaccaatgcaggatccatcaatgcccccactgtgtcggacagcagagccttggc

SEQ ID NO: 78749 - DNA, 75 bp, Artificial Sequence
  Synthetic
gttagtagtgggcccagtaactctcaagcagtaccagccctcacagcagtcgaaacgggtcacacttctcaagtc

SEQ ID NO: 78750 - DNA, 75 bp, Artificial Sequence
  Synthetic
aatgcaggatccatcaatgcccccactgtgtcggacagcagagccttggccagaaggttccactttgacatgaac

SEQ ID NO: 78751 - DNA, 75 bp, Artificial Sequence
  Synthetic
aagcagtaccagccctcacagcagtcgaaacgggtcacacttctcaagtcaatcctagtgacaccatgcagacca

SEQ ID NO: 78752 - DNA, 75 bp, Artificial Sequence
  Synthetic
tgttgcccagtcaactttaagagatgttgcccgctagtgtgtggtaaagctattcagttcattgacagaaaaaca

SEQ ID NO: 78753 - DNA, 75 bp, Artificial Sequence
  Synthetic
tgggcgaatacagcacacaagcatcagatgagaccaaaaagtacatgtcatggaccataagcccaaggaggatgg

SEQ ID NO: 78754 - DNA, 75 bp, Artificial Sequence
  Synthetic
gttgcccgctagtgtgtggtaaagctattcagttcattgacagaaaaacacaggtgaggtactcactggatatgc

SEQ ID NO: 78755 - DNA, 75 bp, Artificial Sequence
  Synthetic
agatgagaccaaaaagtacatgtcatggaccataagcccaaggaggatggttcaaatgcgcaggaagtttgagct

SEQ ID NO: 78756 - DNA, 75 bp, Artificial Sequence
  Synthetic
cgcccgtgtacagagagatcaaaattagtgttactccagaaaccccccccccaccagcaatagcggacctactga

SEQ ID NO: 78757 - DNA, 75 bp, Artificial Sequence
  Synthetic
aggccaagatgcccccccgctaactcaccaagtcatgtatatacccccaggaggcccagtacctgattcagttgg

SEQ ID NO: 78758 - DNA, 75 bp, Artificial Sequence
  Synthetic
tagtgttactccagaaaccccccccccaccagcaatagcggacctactgaaatctgtggatagtgaggcggtcag

SEQ ID NO: 78759 - DNA, 75 bp, Artificial Sequence
  Synthetic
caccaagtcatgtatatacccccaggaggcccagtacctgattcagttggtgattacgcatggcagacttccact

SEQ ID NO: 78760 - DNA, 75 bp, Artificial Sequence
  Synthetic
ggcattcatttgtctacaagcactcactacttttgtctccgtggcgggtgtcatatacatcatttacaaactttt

SEQ ID NO: 78761 - DNA, 75 bp, Artificial Sequence
  Synthetic
tatagcaacttttatgacgggtggtcgcattttcaccagaatggcgtctatggatacaacacgctgaaccatatg

SEQ ID NO: 78762 - DNA, 75 bp, Artificial Sequence
  Synthetic
actacttttgtctccgtggcgggtgtcatatacatcatttacaaactttttgcaggcttccagggagcttacact

SEQ ID NO: 78763 - DNA, 75 bp, Artificial Sequence
  Synthetic
cgcattttcaccagaatggcgtctatggatacaacacgctgaaccatatggggcaactgtacgtgcggcatgtta

SEQ ID NO: 78764 - DNA, 75 bp, Artificial Sequence
  Synthetic
gtagccatgatgaaaaggaatgccagcactgtaaagactgagtatggggaattcacaatgcttggcatttatgat

SEQ ID NO: 78765 - DNA, 75 bp, Artificial Sequence
  Synthetic
cgagggcacccaggctatgtcaatatgtaaatgcatccactgtgaacttcgagccaacagacatcactgagtcac

SEQ ID NO: 78766 - DNA, 75 bp, Artificial Sequence
  Synthetic
gcactgtaaagactgagtatggggaattcacaatgcttggcatttatgatagatgggcggtgctaccccgacatg

SEQ ID NO: 78767 - DNA, 75 bp, Artificial Sequence
  Synthetic
tgtaaatgcatccactgtgaacttcgagccaacagacatcactgagtcacgcactgacatcaaccatgttccaga

SEQ ID NO: 78768 - DNA, 75 bp, Artificial Sequence
  Synthetic
atggcaccaacctagaattaacactcttgaaactcagtagaaacgagaaattcagagatatccgaggcttcttaa

SEQ ID NO: 78769 - DNA, 75 bp, Artificial Sequence
  Synthetic
agtggttaatagacacttggcatcccacgctgattggcaaaactgtgtgtgggaagactacaacagggaccttct

SEQ ID NO: 78770 - DNA, 75 bp, Artificial Sequence
  Synthetic
cttgaaactcagtagaaacgagaaattcagagatatccgaggcttcttaacacgtgaggaggctgaagtcaatga

SEQ ID NO: 78771 - DNA, 75 bp, Artificial Sequence
  Synthetic
cacgctgattggcaaaactgtgtgtgggaagactacaacagggaccttcttgtgagcaccaccaccgctcacggt

SEQ ID NO: 78772 - DNA, 75 bp, Artificial Sequence
  Synthetic
cctcaatctgggtggcacccccactaagcgcatgctaatgtataacttcccaacacgcgcgggccaatgtggagg

SEQ ID NO: 78773 - DNA, 75 bp, Artificial Sequence
  Synthetic
agttttgaaggtcctggattagtggaggttcaggagagcgattattacccaaagaagtaccaatcgcatgtgctt

SEQ ID NO: 78774 - DNA, 75 bp, Artificial Sequence
  Synthetic
aagcgcatgctaatgtataacttcccaacacgcgcgggccaatgtggaggtgtcctaatgtcgacaggcaaagta

SEQ ID NO: 78775 - DNA, 75 bp, Artificial Sequence
  Synthetic
aggttcaggagagcgattattacccaaagaagtaccaatcgcatgtgcttttggcagccgggttcactgagcctg

SEQ ID NO: 78776 - DNA, 75 bp, Artificial Sequence
  Synthetic
cagggtgaaattgagttcattgagagctctaaggaggctggcttcccggtcattaacacccccagtaaaacaaag

SEQ ID NO: 78777 - DNA, 75 bp, Artificial Sequence
  Synthetic
gctttgctgacgtccgcgacttgctttggttggaagacgatgcgatggaacagggagtcaaagattatgtggaac

SEQ ID NO: 78778 - DNA, 75 bp, Artificial Sequence
  Synthetic
gctctaaggaggctggcttcccggtcattaacacccccagtaaaacaaagcttgagcccagcgtctttcatcatg

SEQ ID NO: 78779 - DNA, 75 bp, Artificial Sequence
  Synthetic
ttggttggaagacgatgcgatggaacagggagtcaaagattatgtggaacaacttggaaacgctttcggaactgg

SEQ ID NO: 78780 - DNA, 75 bp, Artificial Sequence
  Synthetic
tcttctctaagtacattggaaatgtgaacacgcacgtggacgagtatatggtggaagctgtcgaccattatgctg

SEQ ID NO: 78781 - DNA, 75 bp, Artificial Sequence
  Synthetic
atctttgaaggccctagtaaagataatatcagccttagtaattgtggtgagaaatcatgacgatctgattaccgt

SEQ ID NO: 78782 - DNA, 75 bp, Artificial Sequence
  Synthetic
gaacacgcacgtggacgagtatatggtggaagctgtcgaccattatgctggacagcttgcaaccttggacatcag

SEQ ID NO: 78783 - DNA, 75 bp, Artificial Sequence
  Synthetic
atatcagccttagtaattgtggtgagaaatcatgacgatctgattaccgtaactgccacgttagccctcatcggc

SEQ ID NO: 78784 - DNA, 75 bp, Artificial Sequence
  Synthetic
ggggtacccctacgttgcccttggcattaaaaagagggatatcttgtcaaagaagtccaaggacttgaccaagct

SEQ ID NO: 78785 - DNA, 75 bp, Artificial Sequence
  Synthetic
aacaacgggtggctcaagaaattcacggagatgaccaatgcgtgcaaaggcatggaatggattgctgtcaagatt

SEQ ID NO: 78786 - DNA, 75 bp, Artificial Sequence
  Synthetic
attaaaaagagggatatcttgtcaaagaagtccaaggacttgaccaagctgaaggagtgcatggacaagtatgga

SEQ ID NO: 78787 - DNA, 75 bp, Artificial Sequence
  Synthetic
ctgattgaagcatcaagtctaaatgactcagtggccatgagacagaccttcgggaacctgtacaaaacattccac

SEQ ID NO: 78788 - DNA, 75 bp, Artificial Sequence
  Synthetic
aagcagctccctttactagaaagtcagattgctacaattgagcagagtgcaccgtctcaaagtgatcaggagcat

SEQ ID NO: 78789 - DNA, 75 bp, Artificial Sequence
  Synthetic
actcagtggccatgagacagaccttcgggaacctgtacaaaacattccacctgaacccaggcatagtgacaggta

SEQ ID NO: 78790 - DNA, 75 bp, Artificial Sequence
  Synthetic
agattgctacaattgagcagagtgcaccgtctcaaagtgatcaggagcatttgttttctaatatccaatacttcg

SEQ ID NO: 78791 - DNA, 75 bp, Artificial Sequence
  Synthetic
actacagtgggtatgacgccagtctaagcccagtgtggttcgcttgtctaaagatgttgttagagaagctgggat

SEQ ID NO: 78792 - DNA, 75 bp, Artificial Sequence
  Synthetic
aagcccagtgtggttcgcttgtctaaagatgttgttagagaagctgggatacacacacaaggagaccaattacat

SEQ ID NO: 78793 - DNA, 75 bp, Artificial Sequence
  Synthetic
atgccgtattgaacctgtatgtttactcctacacgggagccctggtgccggcaagtcggtggcaacaaaccttat

SEQ ID NO: 78794 - DNA, 75 bp, Artificial Sequence
  Synthetic
ttcaggtaccagcattttcaactcaatgatcaacaacattatcatcagaacactaatgttgaaagtatacaaggg

SEQ ID NO: 78795 - DNA, 75 bp, Artificial Sequence
  Synthetic
caaacaacaggccgtggtgatcatggacgatctatgccagaaccctgacggaaaggatgtttccttattctgtca

SEQ ID NO: 78796 - DNA, 75 bp, Artificial Sequence
  Synthetic
aatggtctccagtgtagactttgtaccgcctatggctgctttggaagaaaaaggcatcttgttcacctcaccgtt

SEQ ID NO: 78797 - DNA, 75 bp, Artificial Sequence
  Synthetic
cgtcttatccacaccctattgacgccgcgctgctggcagaagcagggaaaggatacggtttgatcatgacaccgg

SEQ ID NO: 78798 - DNA, 75 bp, Artificial Sequence
  Synthetic
ccactttgacatgaatattgaagtcatttccatgtacagtcaaaacggcaaaataaacatgccaatgtcagtgaa

SEQ ID NO: 78799 - DNA, 75 bp, Artificial Sequence
  Synthetic
agcagtatcctttccttgtccatcctgtgatgccaatgaaagacatccatgaatcgattaggtggaccaaagacc

SEQ ID NO: 78800 - DNA, 75 bp, Artificial Sequence
  Synthetic
aatggagagcaagaatatgaggagttcgtatctaaaatcagaagcgtcccagttgggcgctgtctgactttacct

SEQ ID NO: 78801 - DNA, 75 bp, Artificial Sequence
  Synthetic
tattccctcgacatgctggtaactgagatgttcagggaatacaaccataggcacagtgtaggggccacccttgag

SEQ ID NO: 78802 - DNA, 75 bp, Artificial Sequence
  Synthetic
agatgttcagggaatacaaccataggcacagtgtaggggccacccttgaggcactgtttcagggtccaccagtat

SEQ ID NO: 78803 - DNA, 75 bp, Artificial Sequence
  Synthetic
atagtgaagctgtgagagaatattgcaaagataagggatggttggttcctgaggtcagctccaccctccaaatag

SEQ ID NO: 78804 - DNA, 75 bp, Artificial Sequence
  Synthetic
ttcccacccacagggcccattgggcgccagcacactggtatcacggtacctttgtgcgcctgttttatacaccct

SEQ ID NO: 78805 - DNA, 75 bp, Artificial Sequence
  Synthetic
caaagataagggatggttggttcctgaggtcagctccaccctccaaatagagaaacatgttagccgggctttcat

SEQ ID NO: 78806 - DNA, 75 bp, Artificial Sequence
  Synthetic
cctagatggtcaatagaaggtccagcacaccagttggattccgaccaagcacttctgttaccccggactgagtat

SEQ ID NO: 78807 - DNA, 75 bp, Artificial Sequence
  Synthetic
ccaaggcgcgtacacaggaatgcccaaccagaaacccaaggtacccactctaaggcaagcaaaagtgcagggtcc

SEQ ID NO: 78808 - DNA, 75 bp, Artificial Sequence
  Synthetic
atctagaactgacactactcaagctgaacaggaacgagaaattcagagacattagggggttcttagccaaggagg

SEQ ID NO: 78809 - DNA, 75 bp, Artificial Sequence
  Synthetic
tcacagattatggtttcctgaatctaggcggcacacccacaaagagaatgcttatgtacaacttccccacaaggg

SEQ ID NO: 78810 - DNA, 75 bp, Artificial Sequence
  Synthetic
ttacccttgggaactccacaataaccacacaggagtgtgccaacgtggtggtggggtatggtaggtggcccacgt

SEQ ID NO: 78811 - DNA, 75 bp, Artificial Sequence
  Synthetic
gtggcgacgtgtcgtttttacacactggattcgattaaatgggaaaaaggatccgtggggtggtggtggaagttt

SEQ ID NO: 78812 - DNA, 75 bp, Artificial Sequence
  Synthetic
ccaccctagacatcagcactgaaccaatgaaattggaggatgctgtgtacgggactgaaggccttgaagctcttg

SEQ ID NO: 78813 - DNA, 75 bp, Artificial Sequence
  Synthetic
tcccttcaaccgcagtggctgacggtgacaaggcatatgagtttactagcacaacccaaagtgaacaaaccaaag

SEQ ID NO: 78814 - DNA, 75 bp, Artificial Sequence
  Synthetic
gtaccgatggacaatatgtttaggcactacaacttcacactgatggtgatacctttcgttaaattggactatgct

SEQ ID NO: 78815 - DNA, 75 bp, Artificial Sequence
  Synthetic
gaccaacgtcactttcctaaagaggtattttagagcagatgaacagtaccccttcttggtgcaccctgttatgcc

SEQ ID NO: 78816 - DNA, 75 bp, Artificial Sequence
  Synthetic
cgcaaacccaccaaagacccgaaaggatgcaatgcttggaacgcatatcatatgggatattggcttgcaatcaag

SEQ ID NO: 78817 - DNA, 75 bp, Artificial Sequence
  Synthetic
ttcttggcagatcagcctgtgtttatatggaggaatacaagaccacagacaatgatgttaacaagaaattcgtgg

SEQ ID NO: 78818 - DNA, 75 bp, Artificial Sequence
  Synthetic
ggtgcaaatgcgtaggaagctagagatgttcacctacctcaggtttgacatggaagtaacctttgtgatcacaag

SEQ ID NO: 78819 - DNA, 75 bp, Artificial Sequence
  Synthetic
gctctaatacagacatggtgcgaagagtctattgagctagttggtagtcctccggcccctgaatgcggctaatcc

SEQ ID NO: 78820 - DNA, 75 bp, Artificial Sequence
  Synthetic
tccggcccctgaatgcggctaatcctaactgcggagcacacaccctcaagccagggggcagtgtgtcgtaacggg

SEQ ID NO: 78821 - DNA, 75 bp, Artificial Sequence
  Synthetic
attggattggccatccggtgacaaacagagcgattgtatacctattcgttggacttgtaccgctcaacgttacga

SEQ ID NO: 78822 - DNA, 75 bp, Artificial Sequence
  Synthetic
cagagcgattgtatacctattcgttggacttgtaccgctcaacgttacgagtctaacgactttatactacatcat

SEQ ID NO: 78823 - DNA, 75 bp, Artificial Sequence
  Synthetic
aaaaaagcatttagtgtggattttacaccaacacccatcacggacacccgaaaggacattaacactgtaaccacc

SEQ ID NO: 78824 - DNA, 75 bp, Artificial Sequence
  Synthetic
agcggcaactccgttatacactataccaatatcaactactacaaggatgcagcctcaaattcagccaatagacaa

SEQ ID NO: 78825 - DNA, 75 bp, Artificial Sequence
  Synthetic
ccaatatcaactactacaaggatgcagcctcaaattcagccaatagacaagatttcacccaagatccaagcaagt

SEQ ID NO: 78826 - DNA, 75 bp, Artificial Sequence
  Synthetic
acagcgaccgagttaggtcgatgacgctcgggaattcaacgatcacaactcaagaatgcgcaaatgtaatcgttg

SEQ ID NO: 78827 - DNA, 75 bp, Artificial Sequence
  Synthetic
gctcgggaattcaacgatcacaactcaagaatgcgcaaatgtaatcgttgcgtacggtaggtggcccggttacct

SEQ ID NO: 78828 - DNA, 75 bp, Artificial Sequence
  Synthetic
ggaacaaacactacccagttagcttcgagggaccaggtttagttgaagtacaggagagtgaatactaccctaaaa

SEQ ID NO: 78829 - DNA, 75 bp, Artificial Sequence
  Synthetic
gtccgttgactggagcgcaaactcaaatggatggtggtggaaatttccagaagcactgaaggacatgggtctgtt

SEQ ID NO: 78830 - DNA, 75 bp, Artificial Sequence
  Synthetic
aatggatggtggtggaaatttccagaagcactgaaggacatgggtctgtttggccaaaacatgctataccactat

SEQ ID NO: 78831 - DNA, 75 bp, Artificial Sequence
  Synthetic
tgcgtgcccgaagcagaaatgggcagtgcagttccgggaaaggcactgctggctagtgacttaactggagcagag

SEQ ID NO: 78832 - DNA, 75 bp, Artificial Sequence
  Synthetic
gtgcagttccgggaaaggcactgctggctagtgacttaactggagcagaggaacccatggagtttaagaacacag

SEQ ID NO: 78833 - DNA, 75 bp, Artificial Sequence
  Synthetic
ctcaccagtggatcaacttacgaacaaacaacagcgcgaccatcgttatgccatacataaatagtgtaccaatgg

SEQ ID NO: 78834 - DNA, 75 bp, Artificial Sequence
  Synthetic
agcattggtggttgtggtgagaaaccatgatgacctaataacagtgactgccaccctcgcccttattggatgtac

SEQ ID NO: 78835 - DNA, 75 bp, Artificial Sequence
  Synthetic
aaacaacagcgcgaccatcgttatgccatacataaatagtgtaccaatggataacatgtacaggcactacaactt

SEQ ID NO: 78836 - DNA, 75 bp, Artificial Sequence
  Synthetic
tgggtggctcaagaaatttactgaaatgaccaacgcttgcaaaggaatggagtggatcgccattaaaattcagaa

SEQ ID NO: 78837 - DNA, 75 bp, Artificial Sequence
  Synthetic
cgtagcccccatgttcgcagaatacaacggtctgagattggccgggccacagggactacctgttatgaacactcc

SEQ ID NO: 78838 - DNA, 75 bp, Artificial Sequence
  Synthetic
aacggtctgagattggccgggccacagggactacctgttatgaacactccaggaagcaatcagtttctaacatcg

SEQ ID NO: 78839 - DNA, 75 bp, Artificial Sequence
  Synthetic
atcctgcctgaggtcagggataagcatgaatttctcaataggctaaaacaactccccttactggaaagccagatt

SEQ ID NO: 78840 - DNA, 75 bp, Artificial Sequence
  Synthetic
aacatgatggagattgctgaggtcgattcactagtccccatcaacaacacccaggaaaacgtgaggacgatggag

SEQ ID NO: 78841 - DNA, 75 bp, Artificial Sequence
  Synthetic
attcactagtccccatcaacaacacccaggaaaacgtgaggacgatggagtcttttcgagtcaaggttcagactg

SEQ ID NO: 78842 - DNA, 75 bp, Artificial Sequence
  Synthetic
tattgcagaaagtacgcaccattatacgctgctgaagcaaaaagggtgttctcccttgaaaagaagatgagcaac

SEQ ID NO: 78843 - DNA, 75 bp, Artificial Sequence
  Synthetic
ctcccttgaaaagaagatgagcaactacatacagttcaagtccaaatgccgtattgaacctgtatgtttactctt

SEQ ID NO: 78844 - DNA, 75 bp, Artificial Sequence
  Synthetic
tgctgggtgaaatactaaattattatgcccactggtctggtagcttaaagtttacttttatgttttgtggtacag

SEQ ID NO: 78845 - DNA, 75 bp, Artificial Sequence
  Synthetic
tgcccactggtctggtagcttaaagtttacttttatgttttgtggtacagcgatgacaactgggaagctattgct

SEQ ID NO: 78846 - DNA, 75 bp, Artificial Sequence
  Synthetic
ttcagtgtactccctaccaccagacccagaccacttcgatggttataaacaacaggccgtggtgatcatggatga

SEQ ID NO: 78847 - DNA, 75 bp, Artificial Sequence
  Synthetic
ccagaccacttcgatggttataaacaacaggccgtggtgatcatggatgacctgtgccaaaacccagacggcaag

SEQ ID NO: 78848 - DNA, 75 bp, Artificial Sequence
  Synthetic
tgtcggattgcaatccagctgtgtgctgtgcgtgccatggattagccagacacactacaggttcgtgcatactga

SEQ ID NO: 78849 - DNA, 75 bp, Artificial Sequence
  Synthetic
ctgtgcgtgccatggattagccagacacactacaggttcgtgcatactgacgagtacacgagcgcgggatacatc

SEQ ID NO: 78850 - DNA, 75 bp, Artificial Sequence
  Synthetic
atcttgttcacatcaccttttgtgttggcctcgacaaacgcggggtccattaacgcaccaacagtgtcagacagt

SEQ ID NO: 78851 - DNA, 75 bp, Artificial Sequence
  Synthetic
taacgcaccaacagtgtcagacagtcgggccttggctagaaggttccactttgatatgaatatcgaggttctatc

SEQ ID NO: 78852 - DNA, 75 bp, Artificial Sequence
  Synthetic
gcctgcaatgatttctcagtgcgcatgctcagggatacaccgttcatagatcagaaggctgaactacaaggtgat

SEQ ID NO: 78853 - DNA, 75 bp, Artificial Sequence
  Synthetic
tgctcagggatacaccgttcatagatcagaaggctgaactacaaggtgatgttgaggactcagtaaacagagcag

SEQ ID NO: 78854 - DNA, 75 bp, Artificial Sequence
  Synthetic
tttcaaaagatgctgtcctcttgtgtgtgggaaagctatccagttcattgatagaaaaacacaggtgaggtactc

SEQ ID NO: 78855 - DNA, 75 bp, Artificial Sequence
  Synthetic
caggtcacacgtctcaagtggtgcctggtgataacatccaaacacgtcatgtgcacaactaccactccagaactg

SEQ ID NO: 78856 - DNA, 75 bp, Artificial Sequence
  Synthetic
tggtgataacatccaaacacgtcatgtgcacaactaccactccagaactgaatccagtatcgaaaatttcttcgg

SEQ ID NO: 78857 - DNA, 75 bp, Artificial Sequence
  Synthetic
gagatcaagattagtgtcgcacctgaaaccccaccaccaccagcaattgcagacctgttaagatcagttgacagc

SEQ ID NO: 78858 - DNA, 75 bp, Artificial Sequence
  Synthetic
aaaccccaccaccaccagcaattgcagacctgttaagatcagttgacagcgaagcagtaagggagtactgtagag

SEQ ID NO: 78859 - DNA, 75 bp, Artificial Sequence
  Synthetic
gatgatttccattagggacatggtacaactaagacggaagtgtgaaatgttcacgtacatgagatttgatttaga

SEQ ID NO: 78860 - DNA, 75 bp, Artificial Sequence
  Synthetic
caactaagacggaagtgtgaaatgttcacgtacatgagatttgatttagagatcaccttcgtggtcacgagttac

SEQ ID NO: 78861 - DNA, 75 bp, Artificial Sequence
  Synthetic
tccaagcactaacaacttttgtttccgtggctggaatcatttacatcatttataagttgtttgcagggttccagg

SEQ ID NO: 78862 - DNA, 75 bp, Artificial Sequence
  Synthetic
cgtggctggaatcatttacatcatttataagttgtttgcagggttccagggcgcatacacagggatgcccaacca

SEQ ID NO: 78863 - DNA, 75 bp, Artificial Sequence
  Synthetic
ccggttcctgagagtgtaaatagctacgcttggcaaacgtcaaccaatcccagtatattctggactgagggtaat

SEQ ID NO: 78864 - DNA, 75 bp, Artificial Sequence
  Synthetic
acgcttggcaaacgtcaaccaatcccagtatattctggactgagggtaatgccccagcaaggatgtccattccct

SEQ ID NO: 78865 - DNA, 75 bp, Artificial Sequence
  Synthetic
aagaaacgccagcacggtgaagacagaatatggcgaattcactatgttgggcatctatgatagatgggctgtcct

SEQ ID NO: 78866 - DNA, 75 bp, Artificial Sequence
  Synthetic
gaatatggcgaattcactatgttgggcatctatgatagatgggctgtccttccgcgtcatgccaagcccggacca

SEQ ID NO: 78867 - DNA, 75 bp, Artificial Sequence
  Synthetic
ataacactctcaacaacatgggcaaattgtacatgcgacacgtgaacaaaaatagccccacagagatcataagca

SEQ ID NO: 78868 - DNA, 75 bp, Artificial Sequence
  Synthetic
attgtacatgcgacacgtgaacaaaaatagccccacagagatcataagcactcttcgtgtgtatttcaagccaaa

SEQ ID NO: 78869 - DNA, 75 bp, Artificial Sequence
  Synthetic
gagctaacattgctgaagcttaatcggaatgaaaagtttagggacatcagaggctttctcgccaaagaggaggtg

SEQ ID NO: 78870 - DNA, 75 bp, Artificial Sequence
  Synthetic
ggaatgaaaagtttagggacatcagaggctttctcgccaaagaggaggtggaggttaatgaggctgttctggcaa

SEQ ID NO: 78871 - DNA, 75 bp, Artificial Sequence
  Synthetic
gactccaatcacagacaagcgagactccataaccagcataccagtccccaagcacactcatggagcttttggtca

SEQ ID NO: 78872 - DNA, 75 bp, Artificial Sequence
  Synthetic
tccataaccagcataccagtccccaagcacactcatggagcttttggtcagcaatcgggcgcggtgtatgtaggg

SEQ ID NO: 78873 - DNA, 75 bp, Artificial Sequence
  Synthetic
gtacccccacaaagaggatgctcatgtataactttccaaccagggctggccagtgtgggggcgtcctcatgtcaa

SEQ ID NO: 78874 - DNA, 75 bp, Artificial Sequence
  Synthetic
gtataactttccaaccagggctggccagtgtgggggcgtcctcatgtcaacagggaaggttctgggtatacatgt

SEQ ID NO: 78875 - DNA, 75 bp, Artificial Sequence
  Synthetic
gacctgttggttagcacaaccacggcacacggatgtgacaccattgctagatgccggtgcataacaggcgtgtac

SEQ ID NO: 78876 - DNA, 75 bp, Artificial Sequence
  Synthetic
cacacggatgtgacaccattgctagatgccggtgcataacaggcgtgtacttttgcgcctcaaagaataaacatt

SEQ ID NO: 78877 - DNA, 75 bp, Artificial Sequence
  Synthetic
atttatcgagaattcgcgggatgcagggttcccaatcatcaatacacccagtaggactaaattggaaccaagtgt

SEQ ID NO: 78878 - DNA, 75 bp, Artificial Sequence
  Synthetic
gggttcccaatcatcaatacacccagtaggactaaattggaaccaagtgtcttctatcatgcatttgaagggaac

SEQ ID NO: 78879 - DNA, 75 bp, Artificial Sequence
  Synthetic
acgtgctccttgcagctggcttttccgaacctggcgattgcggtggcatattaaggtgtgagcacggtgtgattg

SEQ ID NO: 78880 - DNA, 75 bp, Artificial Sequence
  Synthetic
cgaacctggcgattgcggtggcatattaaggtgtgagcacggtgtgattggcattgtcaccatgggaggtgaagg

SEQ ID NO: 78881 - DNA, 75 bp, Artificial Sequence
  Synthetic
atagggaatgttaacacacacgtggatgagtacatgctggaggcagtagaccactatgcaggacagctagccacc

SEQ ID NO: 78882 - DNA, 75 bp, Artificial Sequence
  Synthetic
atgagtacatgctggaggcagtagaccactatgcaggacagctagccacccttgatatcaatattgaaccgatga

SEQ ID NO: 78883 - DNA, 75 bp, Artificial Sequence
  Synthetic
tgtcgaacaactcggcaatgcctttggttcgggcttcaccaatcaaatatgtgaacaagtcaacctcttgaaaga

SEQ ID NO: 78884 - DNA, 75 bp, Artificial Sequence
  Synthetic
ttgcactaggcattaagaagagggacatactatccaaaaagaccagggacctaaccaaattgaaggagtgtatgg

SEQ ID NO: 78885 - DNA, 75 bp, Artificial Sequence
  Synthetic
ctagaaaaatctctaaaagctctagtcaaaattatatcagccttagtgattgtggtgagaaaccacgatgacctg

SEQ ID NO: 78886 - DNA, 75 bp, Artificial Sequence
  Synthetic
catactatccaaaaagaccagggacctaaccaaattgaaggagtgtatggataagtatggtctgaacttgccaat

SEQ ID NO: 78887 - DNA, 75 bp, Artificial Sequence
  Synthetic
cagcttgaatgattctgttgcaatgagacagacgtttggcaacctgtataaagcatttcatctgaacccagggat

SEQ ID NO: 78888 - DNA, 75 bp, Artificial Sequence
  Synthetic
agacagacgtttggcaacctgtataaagcatttcatctgaacccagggatagtgacaggtagcgcagtagggtgt

SEQ ID NO: 78889 - DNA, 75 bp, Artificial Sequence
  Synthetic
gtcagggaaaaacacgaattcctgaacagactcaaacagctccccctgttagagagtcaaatcgccacaattgag

SEQ ID NO: 78890 - DNA, 75 bp, Artificial Sequence
  Synthetic
gacgctagcctgagccctgtgtggtttgcatgtctgaagctactgcttgagaaacttgggtactcgcacaaggag

SEQ ID NO: 78891 - DNA, 75 bp, Artificial Sequence
  Synthetic
ttgcatgtctgaagctactgcttgagaaacttgggtactcgcacaaggagacaaattatattgactacctatgca

SEQ ID NO: 78892 - DNA, 75 bp, Artificial Sequence
  Synthetic
caaggagagtgttctcccttgagaaaaagatgagcaattacatacagttcaagtccaaatgccgtattgaaccag

SEQ ID NO: 78893 - DNA, 75 bp, Artificial Sequence
  Synthetic
tattcaactcaatgatcaacaacattataattagaacactcatgctgaaggtatacaagggcatagacctggatc

SEQ ID NO: 78894 - DNA, 75 bp, Artificial Sequence
  Synthetic
tataattagaacactcatgctgaaggtatacaagggcatagacctggatcaatttagaatgattgcatacggtga

SEQ ID NO: 78895 - DNA, 75 bp, Artificial Sequence
  Synthetic
aaaagctcaacagttcagtatactccctaccaccagacccagaccacttcgatggttacaaacagcaggctgttg

SEQ ID NO: 78896 - DNA, 75 bp, Artificial Sequence
  Synthetic
aatgacaccagcagataaaggggagtgctttaatgaggttacctggactaacgtcacctttctaaagaggtactt

SEQ ID NO: 78897 - DNA, 75 bp, Artificial Sequence
  Synthetic
tgctttaatgaggttacctggactaacgtcacctttctaaagaggtacttcagagcagatgagcaatatcctttt

SEQ ID NO: 78898 - DNA, 75 bp, Artificial Sequence
  Synthetic
atttcgtaccaccaatggcagcactagaggagaaaggtatcctattcacctctccatttgtcctggcctcaacca

SEQ ID NO: 78899 - DNA, 75 bp, Artificial Sequence
  Synthetic
gaccacgtgcgatccttgtgtttattggcttggcacaacggagagcatgaatatgaggagttcattaaaaagatt

SEQ ID NO: 78900 - DNA, 75 bp, Artificial Sequence
  Synthetic
ttgaggtcatttctatgtacagccagaatgggaagataaacatgcctatgtcagtcaagacttgcgatgaagaat

SEQ ID NO: 78901 - DNA, 75 bp, Artificial Sequence
  Synthetic
gaatgggaagataaacatgcctatgtcagtcaagacttgcgatgaagaatgctgcccggttaacttcaaaaggtg

SEQ ID NO: 78902 - DNA, 75 bp, Artificial Sequence
  Synthetic
gcgcagaaaatggctggactccttttgaattagaggcaatttgaaatgatttgaattgacttaaccctaccgcac

SEQ ID NO: 78903 - DNA, 75 bp, Artificial Sequence
  Synthetic
actcacagggcccacgtggcgctagcacaccggtatttcggtacccttgtgcgcctgttttatgcacccctagcc

SEQ ID NO: 78904 - DNA, 75 bp, Artificial Sequence
  Synthetic
agtcacagaaatgttcagggagtacaaccacagacatagtgttggtgcgactctagaagcgctcttccaaggtcc

SEQ ID NO: 78905 - DNA, 75 bp, Artificial Sequence
  Synthetic
aaccacagacatagtgttggtgcgactctagaagcgctcttccaaggtccaccagtgtataaggagattaaaatc

SEQ ID NO: 78906 - DNA, 75 bp, Artificial Sequence
  Synthetic
gattactgtaaagaaaagggatggttggtaccagaggtcagttccactctccaaattgagaagcatgttagtcgt

SEQ ID NO: 78907 - DNA, 75 bp, Artificial Sequence
  Synthetic
tggtaccagaggtcagttccactctccaaattgagaagcatgttagtcgtgcttttatctgcctccaagctttaa

SEQ ID NO: 78908 - DNA, 75 bp, Artificial Sequence
  Synthetic
gaatgcctaaccagaaaccaaaggtgcccactctgagacaagcaaaggtgcaagggcctgccttcgaatttgctg

SEQ ID NO: 78909 - DNA, 75 bp, Artificial Sequence
  Synthetic
gcccactctgagacaagcaaaggtgcaagggcctgccttcgaatttgctgttgccatgatgaaaagaaactccag

SEQ ID NO: 78910 - DNA, 75 bp, Artificial Sequence
  Synthetic
taaaccaggacccaccatcttaatgaatgatcaagaggtgggtgtgttggatgccaaagagttggtggacaagga

SEQ ID NO: 78911 - DNA, 75 bp, Artificial Sequence
  Synthetic
tggtataaatctagaactgacactactcaagctaaacaggaacgagaagttcagagacatcaggggtttcttagc

SEQ ID NO: 78912 - DNA, 75 bp, Artificial Sequence
  Synthetic
ttttaaaaaccctcgatttcattgtcgaacttaacacagcaaaatgggagctcaggtatcaacacaaaagaccgg

SEQ ID NO: 78913 - DNA, 75 bp, Artificial Sequence
  Synthetic
aggacaagtcacagattatggcttcctgaatctaggtggcacacccacaaagagaatgcttatgtacaacttccc

SEQ ID NO: 78914 - DNA, 75 bp, Artificial Sequence
  Synthetic
tgcatctaactcatcgaaccgacaggacttccagcaagatcctatcaagtttactgaaccgatgaaggatattat

SEQ ID NO: 78915 - DNA, 75 bp, Artificial Sequence
  Synthetic
gacttccagcaagatcctatcaagtttactgaaccgatgaaggatattatgattaagtctctgccaccattaaat

SEQ ID NO: 78916 - DNA, 75 bp, Artificial Sequence
  Synthetic
tcaccaaggcttctcagctgcactccttaagcactatttcaatgatgagcaaggggaaatcgagttcatcgagag

SEQ ID NO: 78917 - DNA, 75 bp, Artificial Sequence
  Synthetic
caggaaggagccaacgtggtggtggcttatggagaatggcctagctacttagaagacgaccaagccacggcagaa

SEQ ID NO: 78918 - DNA, 75 bp, Artificial Sequence
  Synthetic
cttatggagaatggcctagctacttagaagacgaccaagccacggcagaagatcaaccaacacagcccgacgtag

SEQ ID NO: 78919 - DNA, 75 bp, Artificial Sequence
  Synthetic
aaacactacaggacatgggactttttggtcagaacatgtattatcactacctaggcatagcaggctacaccatac

SEQ ID NO: 78920 - DNA, 75 bp, Artificial Sequence
  Synthetic
tggtcagaacatgtattatcactacctaggcatagcaggctacaccatacacttccaatgcaatgcatccaagtt

SEQ ID NO: 78921 - DNA, 75 bp, Artificial Sequence
  Synthetic
gtccaacgctctcacggatggtgagcgtgctaaagagtttacaccaggaaatgccaccaaagagaatgggaaggt

SEQ ID NO: 78922 - DNA, 75 bp, Artificial Sequence
  Synthetic
cgtgctaaagagtttacaccaggaaatgccaccaaagagaatgggaaggtccagactgctgtatgcaatgcagca

SEQ ID NO: 78923 - DNA, 75 bp, Artificial Sequence
  Synthetic
aaggtagcaaaaggaaagtctaggctgattgaagcatccagtttgaatgattcagtggcaatgagacagacattt

SEQ ID NO: 78924 - DNA, 75 bp, Artificial Sequence
  Synthetic
atcgtaatgccatacataaacagtgtaccaatggataacatgtttagacactataatttcacgctgatggtaatt

SEQ ID NO: 78925 - DNA, 75 bp, Artificial Sequence
  Synthetic
taccaatggataacatgtttagacactataatttcacgctgatggtaattccatttgcacccctgaagactgttg

SEQ ID NO: 78926 - DNA, 75 bp, Artificial Sequence
  Synthetic
cacacacccaaggcctgccagtcctcaacacacctggaagcaaccagttcttgacatccgatgactatcaatcgc

SEQ ID NO: 78927 - DNA, 75 bp, Artificial Sequence
  Synthetic
caacacacctggaagcaaccagttcttgacatccgatgactatcaatcgccgtgcgcaatgccagagttcgacgt

SEQ ID NO: 78928 - DNA, 75 bp, Artificial Sequence
  Synthetic
gattacttatgcaactcccatcacctgtacagagataagcattactttgtgaggggtggcatgccctcagggtgt

SEQ ID NO: 78929 - DNA, 75 bp, Artificial Sequence
  Synthetic
caataatctgagcagccacataaattatatagaagcataccaaataccagtgagtgcacagaccacagccaaagc

SEQ ID NO: 78930 - DNA, 75 bp, Artificial Sequence
  Synthetic
actaatgctgaaagtatacaagggaattgacttggatcaattcaggatgatcgcatatggtgatgatgtaattgc

SEQ ID NO: 78931 - DNA, 75 bp, Artificial Sequence
  Synthetic
tatatagaagcataccaaataccagtgagtgcacagaccacagccaaagctgacggtattttttcaatacaactt

SEQ ID NO: 78932 - DNA, 75 bp, Artificial Sequence
  Synthetic
agtataaagctcacttttctgttctgtgggactgcactagcaacagggaaattgttgttggcttactccccgccg

SEQ ID NO: 78933 - DNA, 75 bp, Artificial Sequence
  Synthetic
ggagcatccgtacccaaaaaccgcaaggatgctatgttgggaacccatgttatatgggatttggggctgcagtct

SEQ ID NO: 78934 - DNA, 75 bp, Artificial Sequence
  Synthetic
ggttatgtcacgtgctggtatcagacaaatataattgtgcccccagagacaccatctgacagtgtagtgttgtgt

SEQ ID NO: 78935 - DNA, 75 bp, Artificial Sequence
  Synthetic
caaatataattgtgcccccagagacaccatctgacagtgtagtgttgtgtttcgcatccgcttgtaacgacttct

SEQ ID NO: 78936 - DNA, 75 bp, Artificial Sequence
  Synthetic
acagggcactagctcgggtggctgacaccgtgagaagtgggccatccaactcagagcagataccagcactgacgg

SEQ ID NO: 78937 - DNA, 75 bp, Artificial Sequence
  Synthetic
caccgtgagaagtgggccatccaactcagagcagataccagcactgacggcggtggagacgggacacacttctca

SEQ ID NO: 78938 - DNA, 75 bp, Artificial Sequence
  Synthetic
cagccatgttttgatcaagcacttctgttacccggactgagtatcaatagaccgctaacgcggttgaaggagaaa

SEQ ID NO: 78939 - DNA, 75 bp, Artificial Sequence
  Synthetic
ctttctgtgcagatcggcatgtgtgcatatagccacatacaaggcgaagggcggtgccggagacacaagtaggta

SEQ ID NO: 78940 - DNA, 75 bp, Artificial Sequence
  Synthetic
catatagccacatacaaggcgaagggcggtgccggagacacaagtaggtatgatagctgggacatcaacattaaa

SEQ ID NO: 78941 - DNA, 75 bp, Artificial Sequence
  Synthetic
accagcattcaagaacaggggactgccttaacgcaggacatgcccgtactgactcaccaaatcatgtatgttcca

SEQ ID NO: 78942 - DNA, 75 bp, Artificial Sequence
  Synthetic
gactcaccaaatcatgtatgttccaccggggggggcagtgcctagcgacgcagagagtttcgcatggcagtcatc

SEQ ID NO: 78943 - DNA, 75 bp, Artificial Sequence
  Synthetic
tgcttacagcaatttttatgatggatggtcgcacttcacacaggacgggggttatggctacaacacgcttaacaa

SEQ ID NO: 78944 - DNA, 75 bp, Artificial Sequence
  Synthetic
gttatggctacaacacgcttaacaaaatggggaagatctatgtcagacacgtcaacaaacaaacacccactgacg

SEQ ID NO: 78945 - DNA, 75 bp, Artificial Sequence
  Synthetic
gttccgcgaccaccgagattgtgcccctacaaaaacaaggccaacgtaaactttgaggtcacgagtgtgaccaca

SEQ ID NO: 78946 - DNA, 75 bp, Artificial Sequence
  Synthetic
cctacaaaaacaaggccaacgtaaactttgaggtcacgagtgtgaccacagctagaaccagtctgaatgatgtcc

SEQ ID NO: 78947 - DNA, 75 bp, Artificial Sequence
  Synthetic
cgtatgtcggcaattatcgcttggtaaacagacatttggcaacatttaaagattggcaaaactgcgtttgggaag

SEQ ID NO: 78948 - DNA, 75 bp, Artificial Sequence
  Synthetic
aaacagacatttggcaacatttaaagattggcaaaactgcgtttgggaagattacaacagggatctgctcgtgag

SEQ ID NO: 78949 - DNA, 75 bp, Artificial Sequence
  Synthetic
gaacaaacactatccagttagctttgaggggccgggccttgtggaggttcaggagagtgagtactatcccaagag

SEQ ID NO: 78950 - DNA, 75 bp, Artificial Sequence
  Synthetic
tggtgtgattgggctagttactatgggtggtgagggagtcgttgggtttgctgatgtccgtgacttgttatggct

SEQ ID NO: 78951 - DNA, 75 bp, Artificial Sequence
  Synthetic
caatcaaatcagtgagcaggttaatctcctcaaagagtcactggtgggccaggattccatcttagagaagtccct

SEQ ID NO: 78952 - DNA, 75 bp, Artificial Sequence
  Synthetic
taccctcgccctcattgggtgtacctcatcaccgtggcgatggctcaagcagaaggtatcccaatactatgggat

SEQ ID NO: 78953 - DNA, 75 bp, Artificial Sequence
  Synthetic
tcatcaccgtggcgatggctcaagcagaaggtatcccaatactatgggattcccatggctgagaggcaaaataat

SEQ ID NO: 78954 - DNA, 75 bp, Artificial Sequence
  Synthetic
tttatagaatggctcaaggttaaaattttaccagaggttaaggagaagcacgaatttctcaccagactcaaacaa

SEQ ID NO: 78955 - DNA, 75 bp, Artificial Sequence
  Synthetic
ttttaccagaggttaaggagaagcacgaatttctcaccagactcaaacaactacctctcttggaaagtcaggtcg

SEQ ID NO: 78956 - DNA, 75 bp, Artificial Sequence
  Synthetic
actgcagaaaatacgcacccctatatgcagctgaggccaagagagtattctccatggagaagaagatgagcaact

SEQ ID NO: 78957 - DNA, 75 bp, Artificial Sequence
  Synthetic
tccatggagaagaagatgagcaactacatacagttcaagtccaaatgccgtattgagcctgtatgcctcttgctc

SEQ ID NO: 78958 - DNA, 75 bp, Artificial Sequence
  Synthetic
cagaccacttcgacggttataagcaacaagccgtcgtgatcatggatgatttgtgccaaaaccccgatgggaaag

SEQ ID NO: 78959 - DNA, 75 bp, Artificial Sequence
  Synthetic
aagaaaatgagtaactacatacagttcaagtccaaatgccgtattgaacctgtatgcttgctcttgcacgggagt

SEQ ID NO: 78960 - DNA, 75 bp, Artificial Sequence
  Synthetic
tgacgaggagtgttgcccagtcaactttaagaaatgctgcccgctggtttgtggtaaagccatccaattcattga

SEQ ID NO: 78961 - DNA, 75 bp, Artificial Sequence
  Synthetic
cgtgggggcaacactcgaggcgcttttccaaggcccacctgtgtatagagagatcaaaataagtgttgcgccaga

SEQ ID NO: 78962 - DNA, 75 bp, Artificial Sequence
  Synthetic
gacctactgaaatcagtggacagtgaggtagttagagagtattgcaaagaaagggggtggttagtgcccgaaatc

SEQ ID NO: 78963 - DNA, 75 bp, Artificial Sequence
  Synthetic
gtggcagggatcatttatatcatctacaagttgtttgcaggcttccaaggagcttacactggcatgcccaaccaa

SEQ ID NO: 78964 - DNA, 75 bp, Artificial Sequence
  Synthetic
agcttacactggcatgcccaaccaaaaacctaaaataccaaccctaagacaggccaaggttcaagggccagcttt

SEQ ID NO: 78965 - DNA, 75 bp, Artificial Sequence
  Synthetic
caacgatgagcagggtgagattgagttcatcgagagttccaaggaagcaggcttcccggttattaacacacccag

SEQ ID NO: 78966 - DNA, 75 bp, Artificial Sequence
  Synthetic
caagtatgggttgaaccttcctatggtcacctatgtgaaggatgaattgaggtcagcagacaaagtggctaaagg

SEQ ID NO: 78967 - DNA, 75 bp, Artificial Sequence
  Synthetic
gaagcgtcccagtcgggcgctgcttgaccttacctgcgttttcgaccctgcgcaggaagtggttggattcctttt

SEQ ID NO: 78968 - DNA, 75 bp, Artificial Sequence
  Synthetic
cgcaggaagtggttggattccttttaaaattagagcgcaatttgatttaattcaattggcttaaccctaccgcac

SEQ ID NO: 78969 - DNA, 75 bp, Artificial Sequence
  Synthetic
ttcaattggcttaaccctaccgcactcaccgaactagataacggtgtggtaggggtaaattctccgcattcggtg

SEQ ID NO: 78970 - DNA, 75 bp, Artificial Sequence
  Synthetic
tgggtgtccgtgtttccttttattcttatactggctacttatggttacaattgagagattgtaaccatattgcta

SEQ ID NO: 78971 - DNA, 75 bp, Artificial Sequence
  Synthetic
caacggggagcacgaatatgaggagttcatccgcaaaattagaagcgtcccagttggacgttgcttgactctacc

SEQ ID NO: 78972 - DNA, 75 bp, Artificial Sequence
  Synthetic
atagagcaattgtgtatttgtttgttggtttcgtgccattaaattacaaggttctaaacacccttaatcttatta

SEQ ID NO: 78973 - DNA, 75 bp, Artificial Sequence
  Synthetic
ttcaccgagcctgtgaaggacataatgataaagtcaatgcctgccctcaactcaccctctgcggaagagtgtggg

SEQ ID NO: 78974 - DNA, 75 bp, Artificial Sequence
  Synthetic
atattcccgcaccagtggatcaacttgcgcacaaacaacagtgccacaatagtgatgccatatatcaatagtgtc

SEQ ID NO: 78975 - DNA, 75 bp, Artificial Sequence
  Synthetic
gtttgtgtccctagattactcgtctgatgcctccacatatgtgcccattaccgtcacagttgcaccaatgtgtgc

SEQ ID NO: 78976 - DNA, 75 bp, Artificial Sequence
  Synthetic
ttttactagcttactccccaccaggtgcgaatgcccccaaaactcgtaaggacgcgatgttgggcacgcatatca

SEQ ID NO: 78977 - DNA, 75 bp, Artificial Sequence
  Synthetic
attggacgattaacgcaagacgtatggtgcagatgagaaggaaacttgaaatgtttacatacatccgttttgacg

SEQ ID NO: 78978 - DNA, 75 bp, Artificial Sequence
  Synthetic
acaacgattggcaaaactgtgtgtgggaagattataacagggacctgctggtgagcaccactacagcacacgggt

SEQ ID NO: 78979 - DNA, 75 bp, Artificial Sequence
  Synthetic
tcaaaaaataaacactacccgattgtcttcgaaggtccaggtcttgtggaggtgcaggagagtgaatattaccct

SEQ ID NO: 78980 - DNA, 75 bp, Artificial Sequence
  Synthetic
tccttgaaagcgctagtcaagattgtctcagccctagtcatagtggtaagaaatcacgatgacttaatcacagtg

SEQ ID NO: 78981 - DNA, 75 bp, Artificial Sequence
  Synthetic
ggtatcccaatggccgagagacaaaacaacgggtggttaaaaaagttcactgaaatgaccaatgcttgcaaaggt

SEQ ID NO: 78982 - DNA, 75 bp, Artificial Sequence
  Synthetic
acaacgggtggttaaaaaagttcactgaaatgaccaatgcttgcaaaggtatggagtggatagccattaaaatcc

SEQ ID NO: 78983 - DNA, 75 bp, Artificial Sequence
  Synthetic
agcagttacccctgctcgaaagtcaaatcgccaccatagaacagagtgcaccgtcacagagtgaccaagaacagc

SEQ ID NO: 78984 - DNA, 75 bp, Artificial Sequence
  Synthetic
aatcgccaccatagaacagagtgcaccgtcacagagtgaccaagaacagctcttctccaacgtccagtattttgc

SEQ ID NO: 78985 - DNA, 75 bp, Artificial Sequence
  Synthetic
atggtgtccagcgtggattttgttccgccaatggcggcattggaggaaaaagggatcctctttacatccccgttc

SEQ ID NO: 78986 - DNA, 75 bp, Artificial Sequence
  Synthetic
cgccaatggcggcattggaggaaaaagggatcctctttacatccccgttcgttctagcgtcaaccaatgctgggt

SEQ ID NO: 78987 - DNA, 75 bp, Artificial Sequence
  Synthetic
tcacgtgcgctcgctgtgtctattggcttggcacaacggggagcacgaatatgaggagtttattcgtaagatcag

SEQ ID NO: 78988 - DNA, 75 bp, Artificial Sequence
  Synthetic
cagtgaggctgtgagagaatactgcaaggagagaggatggctcgtgccaaaggtgaactccactctgcagattga

SEQ ID NO: 78989 - DNA, 75 bp, Artificial Sequence
  Synthetic
tctcggtagcgggaataatatatatcatttataagctatttgcaggctttcaaggtgcctacacgggcatgccaa

SEQ ID NO: 78990 - DNA, 75 bp, Artificial Sequence
  Synthetic
actgggccgtgaccaagcacttctgttatcccggaccgagtatcaataggctgcttgcgcggctgaaggagaaag

SEQ ID NO: 78991 - DNA, 75 bp, Artificial Sequence
  Synthetic
aaccgagtacggcgaatttaccatgctgggcatctatgataggtgggcagtgttaccgcgccacgctaaaccagg

SEQ ID NO: 78992 - DNA, 75 bp, Artificial Sequence
  Synthetic
ccccagtgtagatcaggtcgatgagtcaccgcattccccacgggcgaccgtggcggtggctgcgttggcggcctg

SEQ ID NO: 78993 - DNA, 75 bp, Artificial Sequence
  Synthetic
tctagaactaactctcctgaaactcaatcgaaatgaaaagtttagagacatcagagggtttctggcaagagagga

SEQ ID NO: 78994 - DNA, 75 bp, Artificial Sequence
  Synthetic
tgagagattgttaccatatagctattggattggccatccggtgtcaaatagagcactcgtttatctatttgttgg

SEQ ID NO: 78995 - DNA, 75 bp, Artificial Sequence
  Synthetic
tagagttcattgagaattcgagagacgcaggttttcccgtgatcaacactcccagcaaaacaaaattagaaccaa

SEQ ID NO: 78996 - DNA, 75 bp, Artificial Sequence
  Synthetic
cgcaggttttcccgtgatcaacactcccagcaaaacaaaattagaaccaagtgtgtttcaccaagtttttgaggg

SEQ ID NO: 78997 - DNA, 75 bp, Artificial Sequence
  Synthetic
caagtctcaactcaaaagaccggagctcatgagactagtttgagcgccagtgggaactctatcatacattacacc

SEQ ID NO: 78998 - DNA, 75 bp, Artificial Sequence
  Synthetic
ctcatgagactagtttgagcgccagtgggaactctatcatacattacaccaatattaactattataaagatgcgg

SEQ ID NO: 78999 - DNA, 75 bp, Artificial Sequence
  Synthetic
ttaagtcaatgcccgctttaaactcaccatctgcagaggagtgcggatatagcgacagagttaggtctctgacat

SEQ ID NO: 79000 - DNA, 75 bp, Artificial Sequence
  Synthetic
gtacggagggactggaggcactagatttaaccaccagtgcaggatacccctatgtggccctgggcataaaaaaga

SEQ ID NO: 79001 - DNA, 75 bp, Artificial Sequence
  Synthetic
gagatgaagaagccaccgctgaagatcaaccaacgcagcctgatgtggctacatgcaggttttacacactagagt

SEQ ID NO: 79002 - DNA, 75 bp, Artificial Sequence
  Synthetic
ggaaacaaactacatagactacctctgcaattcccatcatttgtacagggacaaacactactttgtgagaggtgg

SEQ ID NO: 79003 - DNA, 75 bp, Artificial Sequence
  Synthetic
actacgggtgagcacacggtacaatcgatagtatgcaacgcgggcatgggtgttggcgttggaaatctgaccata

SEQ ID NO: 79004 - DNA, 75 bp, Artificial Sequence
  Synthetic
tgcaattcccatcatttgtacagggacaaacactactttgtgagaggtggtatgccctcaggatgctcaggcact

SEQ ID NO: 79005 - DNA, 75 bp, Artificial Sequence
  Synthetic
atggacaacatgttcaggcattacaactttaccctcatggtaattccattcgctcccctggactataccgcccaa

SEQ ID NO: 79006 - DNA, 75 bp, Artificial Sequence
  Synthetic
actttaccctcatggtaattccattcgctcccctggactataccgcccaagcgtctgaatatgtgccagtgaccg

SEQ ID NO: 79007 - DNA, 75 bp, Artificial Sequence
  Synthetic
caccagggagtaaccagttcatgacatcggacgattttcaatctccctcggcaatgccacaatttgatgtgacac

SEQ ID NO: 79008 - DNA, 75 bp, Artificial Sequence
  Synthetic
atcggacgattttcaatctccctcggcaatgccacaatttgatgtgacaccacacatggacataccaggtgaggt

SEQ ID NO: 79009 - DNA, 75 bp, Artificial Sequence
  Synthetic
acgaatacgaggagtttatacgaaagatcaggagcgtgcccgtcgggcgctgcttgacccttcctgcattctcaa

SEQ ID NO: 79010 - DNA, 75 bp, Artificial Sequence
  Synthetic
gcaatggctacaggaaagttgctactagcatactcccctcctggtgctgatgtgccagccagcaggaaacaggca

SEQ ID NO: 79011 - DNA, 75 bp, Artificial Sequence
  Synthetic
acacactatcgccttgtgcaacaagacgagtatacgagtgctggcaatgtcacctgctggtaccagacaggcata

SEQ ID NO: 79012 - DNA, 75 bp, Artificial Sequence
  Synthetic
ctcggtaattcaactatcaccacccaggaaagtgccaatgtagtcgtcgggtacggggtgtggccagattacctc

SEQ ID NO: 79013 - DNA, 75 bp, Artificial Sequence
  Synthetic
cgagcgacacagtgcaaactcggcatgtgaaaaactaccattcccgatctgagtcgacaatagagaatttcctca

SEQ ID NO: 79014 - DNA, 75 bp, Artificial Sequence
  Synthetic
tgtgaaaaactaccattcccgatctgagtcgacaatagagaatttcctcagtcggtctgcctgtgtgtatattga

SEQ ID NO: 79015 - DNA, 75 bp, Artificial Sequence
  Synthetic
gctcaagtgtcaacacagaagactggggcccacgaaactgggttaaacgctagtggtagctctattatccactac

SEQ ID NO: 79016 - DNA, 75 bp, Artificial Sequence
  Synthetic
ggaccagccaacccaacctgatgtggcgacttgtcgattctatactctggagtcagtcacttgggagaaagactc

SEQ ID NO: 79017 - DNA, 75 bp, Artificial Sequence
  Synthetic
acattagagtctgggtgccacgaccaccacgcctatgcccctacatcaaatctagtaatgtcaattttgatccaa

SEQ ID NO: 79018 - DNA, 75 bp, Artificial Sequence
  Synthetic
accacgcctatgcccctacatcaaatctagtaatgtcaattttgatccaactaacctaactgaaaaaagggaaag

SEQ ID NO: 79019 - DNA, 75 bp, Artificial Sequence
  Synthetic
atatatagggaattacagagtggtaaatagacatctcgccacgcacaatgactggcaaaactgcgtgtgggaaga

SEQ ID NO: 79020 - DNA, 75 bp, Artificial Sequence
  Synthetic
aatagacatctcgccacgcacaatgactggcaaaactgcgtgtgggaagactataccagagatctcttagttagc

SEQ ID NO: 79021 - DNA, 75 bp, Artificial Sequence
  Synthetic
aacaagcattatccagtctgctttgagggtccaggcttagtggaggtccaggaaaatgaatattacccaagaagg

SEQ ID NO: 79022 - DNA, 75 bp, Artificial Sequence
  Synthetic
taccagtctcatgtgcttctagctgcagggttttccgctccaggggattgtggtggtattctcaggtgcgaacac

SEQ ID NO: 79023 - DNA, 75 bp, Artificial Sequence
  Synthetic
cacaggtttttggcttccaggtccaaccaggattagacagcgtatttaaacatacgctgttgggggagatattaa

SEQ ID NO: 79024 - DNA, 75 bp, Artificial Sequence
  Synthetic
aaagccctagtgaagatcatatcagcactggtcatcgtagtaagaaaccatgatgatttaatcacagtgacagct

SEQ ID NO: 79025 - DNA, 75 bp, Artificial Sequence
  Synthetic
ggttctgccatggccactggcaaatttttgctagcttactccccaccaggtgcgaatgcccccaagactcgtaag

SEQ ID NO: 79026 - DNA, 75 bp, Artificial Sequence
  Synthetic
cccatggcagagaggcaaaacaatggctggctgaagaaattcaccgagatgacaaatgcctgcaagggcatggag

SEQ ID NO: 79027 - DNA, 75 bp, Artificial Sequence
  Synthetic
cttgccagaagttaaggaaaagcacgagtttctaaacagactaaaacaattacccttgctagagagccagatagc

SEQ ID NO: 79028 - DNA, 75 bp, Artificial Sequence
  Synthetic
caattagcaatggcccaacaaattctcaagcagtgccagcactaactgcagtggagactgggcacacctcgcaag

SEQ ID NO: 79029 - DNA, 75 bp, Artificial Sequence
  Synthetic
caagccgtcgtgattatggatgacttgtgccagaatccagatggcaaagacgtctctctcttctgtcaaatggta

SEQ ID NO: 79030 - DNA, 75 bp, Artificial Sequence
  Synthetic
accctagcattttctggactgaaggcaatgcacctcccaggatgtccattccctttatgagcatcggaaacgctt

SEQ ID NO: 79031 - DNA, 75 bp, Artificial Sequence
  Synthetic
gatgaggaatgctgtccagttaacttcaaaaagtgctgtccccttgtgtgtgggaaggctatccaatttatagac

SEQ ID NO: 79032 - DNA, 75 bp, Artificial Sequence
  Synthetic
actcgaccctccaaatcgaaaaacatgtcagcagagccttcatctgtcttcaagctctcaccacatttgtgtccg

SEQ ID NO: 79033 - DNA, 75 bp, Artificial Sequence
  Synthetic
tgtcagcagagccttcatctgtcttcaagctctcaccacatttgtgtccgtggctggtattatttatatcatcta

SEQ ID NO: 79034 - DNA, 75 bp, Artificial Sequence
  Synthetic
ttcaccaatcaaatctgtgaacaagtcaatctcctgaaagaatccttgatgggccaagactccatactggaaaaa

SEQ ID NO: 79035 - DNA, 75 bp, Artificial Sequence
  Synthetic
ctatggcttcttaaatctaggtggcacccccacaaaaagaatgctcatgtataactttcccaccagggcgggcca

SEQ ID NO: 79036 - DNA, 75 bp, Artificial Sequence
  Synthetic
acccccacaaaaagaatgctcatgtataactttcccaccagggcgggccaatgtggcggtgttcttatgtctact

SEQ ID NO: 79037 - DNA, 75 bp, Artificial Sequence
  Synthetic
gcacttcatcaccatggcggtggctcaaacaaaaggtgtcacagtactatggaatacctatggctgagcgacaaa

SEQ ID NO: 79038 - DNA, 75 bp, Artificial Sequence
  Synthetic
aacgatgaacaaggggagattgagttcattgagagctctaaggatgcagggttcccggtcattaatacaccaagt

SEQ ID NO: 79039 - DNA, 75 bp, Artificial Sequence
  Synthetic
aaaagtttattgagtggcttaaggttaagatcctgccagaggtgagagaaaagcatgaattcctcaatagattga

SEQ ID NO: 79040 - DNA, 75 bp, Artificial Sequence
  Synthetic
tcattgagagctctaaggatgcagggttcccggtcattaatacaccaagtaagactaaactggaaccaagtgtct

SEQ ID NO: 79041 - DNA, 75 bp, Artificial Sequence
  Synthetic
agcaactcccactgctagaaagtcaaatcactaccatagagcagagcgcaccatcacagagtgatcaagagcagc

SEQ ID NO: 79042 - DNA, 75 bp, Artificial Sequence
  Synthetic
aagaagctatcttctctaaatatataggaaatgtcaacacacatgtagatgagtacatgttagaagcagtagacc

SEQ ID NO: 79043 - DNA, 75 bp, Artificial Sequence
  Synthetic
aggaaatgtcaacacacatgtagatgagtacatgttagaagcagtagaccactatgcagggcagctggccaccct

SEQ ID NO: 79044 - DNA, 75 bp, Artificial Sequence
  Synthetic
caactacatacagttcaagtccaaatgccgtattgagcctgtatgtctgctcctacatggcagtccaggggcagg

SEQ ID NO: 79045 - DNA, 75 bp, Artificial Sequence
  Synthetic
cactagtgcagggtacccatatgtggcattaggcatcaagaaaagagatatcttatccaagaagaccaaggattt

SEQ ID NO: 79046 - DNA, 75 bp, Artificial Sequence
  Synthetic
agatcctgaccattttgatggttacaagcaacaagcagtcgtgatcatggatgatttgtgccagaatcccgatgg

SEQ ID NO: 79047 - DNA, 75 bp, Artificial Sequence
  Synthetic
tcttatccaagaagaccaaggatttgaccaaactgaaggagtgtatggacaaatacggtttgaacttaccaatgg

SEQ ID NO: 79048 - DNA, 75 bp, Artificial Sequence
  Synthetic
aagcaacaagcagtcgtgatcatggatgatttgtgccagaatcccgatgggaaagacgtgtccttattctgccag

SEQ ID NO: 79049 - DNA, 75 bp, Artificial Sequence
  Synthetic
gtcttagcctcgactaacgcaggctccattaacgccccaacagtgtcagacagcagggcactcgcaaggaggttc

SEQ ID NO: 79050 - DNA, 75 bp, Artificial Sequence
  Synthetic
ccattaacgccccaacagtgtcagacagcagggcactcgcaaggaggttccactttgacatgaacatcgaggtca

SEQ ID NO: 79051 - DNA, 75 bp, Artificial Sequence
  Synthetic
cgccagcctaagtcccgtgtggtttgcttgtttgaagctgctgcttgagaagctcgggtacacacacagagagac

SEQ ID NO: 79052 - DNA, 75 bp, Artificial Sequence
  Synthetic
ttaatttcaagaagtgctgtccactggtgtgcggaaaagccatccaattcattgataggagaacccaagtcagat

SEQ ID NO: 79053 - DNA, 75 bp, Artificial Sequence
  Synthetic
gcttgtttgaagctgctgcttgagaagctcgggtacacacacagagagacaaattacattgattacttgtgcaat

SEQ ID NO: 79054 - DNA, 75 bp, Artificial Sequence
  Synthetic
ggtgtgcggaaaagccatccaattcattgataggagaacccaagtcagatattcactggacatgttagtcaccga

SEQ ID NO: 79055 - DNA, 75 bp, Artificial Sequence
  Synthetic
ttcaattcgatgatcaacaacatcataatcaggactctaatgctgaaggtgtataagggtattgaccttgatcaa

SEQ ID NO: 79056 - DNA, 75 bp, Artificial Sequence
  Synthetic
tagagaaattaaaatcagtgtcgctccagagactcccccaccaccagccattgccgacttgttaaaatcagtgga

SEQ ID NO: 79057 - DNA, 75 bp, Artificial Sequence
  Synthetic
taatcaggactctaatgctgaaggtgtataagggtattgaccttgatcaattcaggatgattgcttatggtgatg

SEQ ID NO: 79058 - DNA, 75 bp, Artificial Sequence
  Synthetic
ccagagactcccccaccaccagccattgccgacttgttaaaatcagtggacagtgaggccgtaagggaatactgc

SEQ ID NO: 79059 - DNA, 75 bp, Artificial Sequence
  Synthetic
tgacaccagcagacaagggggagtgcttcaatgaagtgacatggaccaacgttacctttctgaaaagatatttta

SEQ ID NO: 79060 - DNA, 75 bp, Artificial Sequence
  Synthetic
tgcttgcaggccctaacgacgtttgtctcagttgctggcataatatacatcatatacaaactatttgcaggtttt

SEQ ID NO: 79061 - DNA, 75 bp, Artificial Sequence
  Synthetic
tctcagttgctggcataatatacatcatatacaaactatttgcaggttttcaaggcgcttacacagggatgccta

SEQ ID NO: 79062 - DNA, 75 bp, Artificial Sequence
  Synthetic
cttcaatgaagtgacatggaccaacgttacctttctgaaaagatattttagagcagatgagcaataccccttcct

SEQ ID NO: 79063 - DNA, 75 bp, Artificial Sequence
  Synthetic
tgaaaagaaatgctagcacagtgaaaaccgaatatggtgagttcaccatgctcgggatttatgacaggtgggcag

SEQ ID NO: 79064 - DNA, 75 bp, Artificial Sequence
  Synthetic
aaccgaatatggtgagttcaccatgctcgggatttatgacaggtgggcagtgttaccacgccacgccaaacctgg

SEQ ID NO: 79065 - DNA, 75 bp, Artificial Sequence
  Synthetic
gcaggaagtggttggattccttttaagctagagacaatttgatacaatttgaattggcttaaccctactacacta

SEQ ID NO: 79066 - DNA, 75 bp, Artificial Sequence
  Synthetic
agctagagacaatttgatacaatttgaattggcttaaccctactacactaaccgaactagacagcggtgtagcag

SEQ ID NO: 79067 - DNA, 75 bp, Artificial Sequence
  Synthetic
ccttgaattgactcttctgaagctcaaccgtaatgaaaagttcagagacatcagaggattcttagcgcgtgagga

SEQ ID NO: 79068 - DNA, 75 bp, Artificial Sequence
  Synthetic
ttaaaacagcctgtgggttgttcccacccacagggcccattgggcgctagcactctggtattacggtacctttgt

SEQ ID NO: 79069 - DNA, 75 bp, Artificial Sequence
  Synthetic
aaccgtaatgaaaagttcagagacatcagaggattcttagcgcgtgaggaagttgaagtgaacgaagctgtccta

SEQ ID NO: 79070 - DNA, 75 bp, Artificial Sequence
  Synthetic
ggtggaactcccacaaaaagaatgctcatgtacaattttccaaccagagcaggacagtgtggaggtgtcctcatg

SEQ ID NO: 79071 - DNA, 75 bp, Artificial Sequence
  Synthetic
tcatgtacaattttccaaccagagcaggacagtgtggaggtgtcctcatgtcaacaggaaaggtcttaggcatac

SEQ ID NO: 79072 - DNA, 75 bp, Artificial Sequence
  Synthetic
tagaattcattgagaactcgaaagatgcaggatttcctataatcaacacccctagtaagacaaaactggaaccaa

SEQ ID NO: 79073 - DNA, 75 bp, Artificial Sequence
  Synthetic
tgcaggatttcctataatcaacacccctagtaagacaaaactggaaccaagtgtgtttcaccaggtgttcgaggg

SEQ ID NO: 79074 - DNA, 75 bp, Artificial Sequence
  Synthetic
atatattggcaatgtcaacacgcacgtagatgaatacatgcaagaggctgtggatcactacgcagggcagttagc

SEQ ID NO: 79075 - DNA, 75 bp, Artificial Sequence
  Synthetic
ttggattggccatccggtgactaatagagccattatataccactttgttgggtttataccactcaacttgaaaga

SEQ ID NO: 79076 - DNA, 75 bp, Artificial Sequence
  Synthetic
agagccattatataccactttgttgggtttataccactcaacttgaaagaggtcaaaacactacagctcatcatt

SEQ ID NO: 79077 - DNA, 75 bp, Artificial Sequence
  Synthetic
gtagatgaatacatgcaagaggctgtggatcactacgcagggcagttagctacactggacatcagcacagagcct

SEQ ID NO: 79078 - DNA, 75 bp, Artificial Sequence
  Synthetic
tatgtggccctgggtatcaagaaaagagacatactatctaagaagactagagacctcactaagctgaaggaatgc

SEQ ID NO: 79079 - DNA, 75 bp, Artificial Sequence
  Synthetic
gcggtaattccatcatccattacaccaacattaattattacaaggatgctgcttctaactctgccaacagacagg

SEQ ID NO: 79080 - DNA, 75 bp, Artificial Sequence
  Synthetic
caacattaattattacaaggatgctgcttctaactctgccaacagacaggattttacacaagatcccagcaaatt

SEQ ID NO: 79081 - DNA, 75 bp, Artificial Sequence
  Synthetic
gagacatactatctaagaagactagagacctcactaagctgaaggaatgcatggataagtatggactgaatctgc

SEQ ID NO: 79082 - DNA, 75 bp, Artificial Sequence
  Synthetic
cctccagtctaaatgactcagtagcaatgaggcagacatttggaaacctatacaaggcctttcatctcaatcctg

SEQ ID NO: 79083 - DNA, 75 bp, Artificial Sequence
  Synthetic
tagtgatagggtccgctccatcacactaggcaactcaaccataacaacacaagagagtgcaaacgtggtcgttgg

SEQ ID NO: 79084 - DNA, 75 bp, Artificial Sequence
  Synthetic
ctaggcaactcaaccataacaacacaagagagtgcaaacgtggtcgttggatacggggtgtggcctacttatttg

SEQ ID NO: 79085 - DNA, 75 bp, Artificial Sequence
  Synthetic
aatgaggcagacatttggaaacctatacaaggcctttcatctcaatcctggtattgtcacgggtagcgctgttgg

SEQ ID NO: 79086 - DNA, 75 bp, Artificial Sequence
  Synthetic
ttacgatgctagcctcagtccagtgtggtttgcgtgcttgaagctcctccttgaaaaactgggatacacaaataa

SEQ ID NO: 79087 - DNA, 75 bp, Artificial Sequence
  Synthetic
tcggtgcagtggcgaaagaactcagctgggtggtggtggaaatttcccgacgctctacgtgatatggggttgttt

SEQ ID NO: 79088 - DNA, 75 bp, Artificial Sequence
  Synthetic
ctgggtggtggtggaaatttcccgacgctctacgtgatatggggttgtttggtcagaacatgttctatcattacc

SEQ ID NO: 79089 - DNA, 75 bp, Artificial Sequence
  Synthetic
tggtttgcgtgcttgaagctcctccttgaaaaactgggatacacaaataaagagacaaactacatagattacctt

SEQ ID NO: 79090 - DNA, 75 bp, Artificial Sequence
  Synthetic
agcatatttaactccatgatcaacaatatcattatcaggaccctgatgctgaaggtttacaagggcatagacctg

SEQ ID NO: 79091 - DNA, 75 bp, Artificial Sequence
  Synthetic
gcgtaccagaggctgaaatggggggctccgtgattggtgaggctatcaacaaaacattcctgagtgagggcgaca

SEQ ID NO: 79092 - DNA, 75 bp, Artificial Sequence
  Synthetic
ctccgtgattggtgaggctatcaacaaaacattcctgagtgagggcgacaccgctaaagagttcacagaggcatc

SEQ ID NO: 79093 - DNA, 75 bp, Artificial Sequence
  Synthetic
atatcattatcaggaccctgatgctgaaggtttacaagggcatagacctggatcaattcagaatgattgcctatg

SEQ ID NO: 79094 - DNA, 75 bp, Artificial Sequence
  Synthetic
tgatcatgaccccggcagacaaaggtgagtgttttaatgaggtgacctggacaaatgtaacctttttgaaaaggt

SEQ ID NO: 79095 - DNA, 75 bp, Artificial Sequence
  Synthetic
ctacccgcaccaatgggtcaatttgagaaccaacaattgcgcgactattgtcatgccgtacattaattgtgtgcc

SEQ ID NO: 79096 - DNA, 75 bp, Artificial Sequence
  Synthetic
agaaccaacaattgcgcgactattgtcatgccgtacattaattgtgtgcccatggacaacatgtttagacatcaa

SEQ ID NO: 79097 - DNA, 75 bp, Artificial Sequence
  Synthetic
tgagtgttttaatgaggtgacctggacaaatgtaacctttttgaaaaggtacttcagagcggatgagcagtatcc

SEQ ID NO: 79098 - DNA, 75 bp, Artificial Sequence
  Synthetic
acaggaccacgtgcgctcactgtgcctattggcttggcacaatggggaacacgaatatgaggagtttattcgtaa

SEQ ID NO: 79099 - DNA, 75 bp, Artificial Sequence
  Synthetic
gtgacggtagcaccaatgagcgctgagtacaacggtctccgcctggggggacaccaagggttaccaacaatgaac

SEQ ID NO: 79100 - DNA, 75 bp, Artificial Sequence
  Synthetic
agtacaacggtctccgcctggggggacaccaagggttaccaacaatgaacaccccaggcagtacacagtttttga

SEQ ID NO: 79101 - DNA, 75 bp, Artificial Sequence
  Synthetic
ctattggcttggcacaatggggaacacgaatatgaggagtttattcgtaaaatcagaagtgtgcccgttgggcgc

SEQ ID NO: 79102 - DNA, 75 bp, Artificial Sequence
  Synthetic
aaattataattggcttaaccctaccgcatgaaccgaacttgataaaagtgcggtaggggtaaattctccgcattc

SEQ ID NO: 79103 - DNA, 75 bp, Artificial Sequence
  Synthetic
ttaaaaacttgatggagattgcagaggtggactcagtgatgccgatcaacaacatcggtgaggcagtgaatcgca

SEQ ID NO: 79104 - DNA, 75 bp, Artificial Sequence
  Synthetic
ggtggactcagtgatgccgatcaacaacatcggtgaggcagtgaatcgcatggacgcgtatagggtcgagatcac

SEQ ID NO: 79105 - DNA, 75 bp, Artificial Sequence
  Synthetic
gttgatgggcgagatcctaaattattatactcactggtcagggagcattaaattaacatttatcttctgtggttc

SEQ ID NO: 79106 - DNA, 75 bp, Artificial Sequence
  Synthetic
tatactcactggtcagggagcattaaattaacatttatcttctgtggttctgcaatggccactggaaaatttcta

SEQ ID NO: 79107 - DNA, 75 bp, Artificial Sequence
  Synthetic
gatgtcggcttgcagtccagctgtgtcttatgtataccatggatcagtcagacacactatagatttgtgaaggac

SEQ ID NO: 79108 - DNA, 75 bp, Artificial Sequence
  Synthetic
tcttatgtataccatggatcagtcagacacactatagatttgtgaaggacgacccatactccaatgcgggttatg

SEQ ID NO: 79109 - DNA, 75 bp, Artificial Sequence
  Synthetic
ctgcttgcaatgacttttctgtgcgactgctaaaagacacaccatttatatcgcaagacagcttctatcaggggg

SEQ ID NO: 79110 - DNA, 75 bp, Artificial Sequence
  Synthetic
actgctaaaagacacaccatttatatcgcaagacagcttctatcagggggacgtgcacgatgcggtggttggggc

SEQ ID NO: 79111 - DNA, 75 bp, Artificial Sequence
  Synthetic
agtgatagagttagatcaataacacttggcaactccactataacaacacaagagtgtgcaaacgttgtggtgggg

SEQ ID NO: 79112 - DNA, 75 bp, Artificial Sequence
  Synthetic
gacaggacacacatcacaggtagtaccgagtgataccatgcagaccagacatgtgcggaatttccacacaagatc

SEQ ID NO: 79113 - DNA, 75 bp, Artificial Sequence
  Synthetic
ccgagtgataccatgcagaccagacatgtgcggaatttccacacaagatcagagtcttcaatagaaaatttcatg

SEQ ID NO: 79114 - DNA, 75 bp, Artificial Sequence
  Synthetic
aaggttaccaccaggcaagtggcacaactcaggaggaagatggagatgttcacttatttgcgctttgacgtagaa

SEQ ID NO: 79115 - DNA, 75 bp, Artificial Sequence
  Synthetic
aactcaggaggaagatggagatgttcacttatttgcgctttgacgtagaagtgacatttgtaataactagctcgc

SEQ ID NO: 79116 - DNA, 75 bp, Artificial Sequence
  Synthetic
cggttcccaaatcagctagggattactcatggcaatcctctactaacccaagtgttttctggactgagggtaatg

SEQ ID NO: 79117 - DNA, 75 bp, Artificial Sequence
  Synthetic
ctcatggcaatcctctactaacccaagtgttttctggactgagggtaatgcaccaccacgcatgtctattccgtt

SEQ ID NO: 79118 - DNA, 75 bp, Artificial Sequence
  Synthetic
taacactctcaatgacatgggtcaactgtattttaggcatgtgaacgagggtagcccaggggcggtaacaagcta

SEQ ID NO: 79119 - DNA, 75 bp, Artificial Sequence
  Synthetic
ctgtattttaggcatgtgaacgagggtagcccaggggcggtaacaagctacatcagaatatacttcaaacctaaa

SEQ ID NO: 79120 - DNA, 75 bp, Artificial Sequence
  Synthetic
gcatcctcctacatcccaattacagtgacagttgctcccatgagtgctgagtacaatggcttgcgtctagccggt

SEQ ID NO: 79121 - DNA, 75 bp, Artificial Sequence
  Synthetic
cagggagtaactgatgctcgtacctcgctcaccactacaggggcgttcgggcagcaatcaggagcagtttacgtg

SEQ ID NO: 79122 - DNA, 75 bp, Artificial Sequence
  Synthetic
cgctcaccactacaggggcgttcgggcagcaatcaggagcagtttacgtgggaaactacagggtggtcaataggc

SEQ ID NO: 79123 - DNA, 75 bp, Artificial Sequence
  Synthetic
gctatgccgcaattcgatgtgaccccagaaatgaacataccaggacaggtcaggaacttgatggagattgcggaa

SEQ ID NO: 79124 - DNA, 75 bp, Artificial Sequence
  Synthetic
cagcacatggctgtgatatcatagctagatgccagtgcacgacaggtgtgtacttttgtgcatcaaaaaacaagc

SEQ ID NO: 79125 - DNA, 75 bp, Artificial Sequence
  Synthetic
tagatgccagtgcacgacaggtgtgtacttttgtgcatcaaaaaacaagcactacccagtgagctttgagggacc

SEQ ID NO: 79126 - DNA, 75 bp, Artificial Sequence
  Synthetic
tatttggcttccctctgcaaccgggagcatcaagtgtattgcagagaacactattgggggagatactgaattatt

SEQ ID NO: 79127 - DNA, 75 bp, Artificial Sequence
  Synthetic
agcatcaagtgtattgcagagaacactattgggggagatactgaattattacacacactggtcagggagcctcaa

SEQ ID NO: 79128 - DNA, 75 bp, Artificial Sequence
  Synthetic
acacacactggtcagggagcctcaaattgacatttgtattctgcggatctgcaatggcgaccggtaagtttttgc

SEQ ID NO: 79129 - DNA, 75 bp, Artificial Sequence
  Synthetic
ctccgaacctggcgactgtggtggaattctgaggtgtgagcacggtgttatcggaattgtgaccatgggaggtga

SEQ ID NO: 79130 - DNA, 75 bp, Artificial Sequence
  Synthetic
attctgaggtgtgagcacggtgttatcggaattgtgaccatgggaggtgaaggtgtcgttggctttgctgatgta

SEQ ID NO: 79131 - DNA, 75 bp, Artificial Sequence
  Synthetic
atgttggtctacagtctagctgtgtgttatgtgtaccatggattagtcagactcattacaggtatgttgtagatg

SEQ ID NO: 79132 - DNA, 75 bp, Artificial Sequence
  Synthetic
ttcggatcgggctttacaaaccaaatttgtgaacaggtgaatcttctgaaagagtccctagtgggtcaagactcc

SEQ ID NO: 79133 - DNA, 75 bp, Artificial Sequence
  Synthetic
aattgtggtgagaaatcacgatgacctgatcacaatgactgccacgctggctctcattggctgtacctcatcccc

SEQ ID NO: 79134 - DNA, 75 bp, Artificial Sequence
  Synthetic
gcctgtaagggcatggagtggatagccattaaaatccagaaattcatagagtggctcaaagtcaaaatattacca

SEQ ID NO: 79135 - DNA, 75 bp, Artificial Sequence
  Synthetic
atgagcatcggcaatgcctacaccatgttttacgacggatggtcaaatttttctagagacggcatatatggatac

SEQ ID NO: 79136 - DNA, 75 bp, Artificial Sequence
  Synthetic
ttcaagtccaaatgccgtattgagcctgtatgtttactcctacatgggagccctggtgcaggcaagtcagtagca

SEQ ID NO: 79137 - DNA, 75 bp, Artificial Sequence
  Synthetic
tttgacggttacaaacaacaggccgtggtgatcatggatgacttgtgtcagaaccctgacggtaaagatgtctct

SEQ ID NO: 79138 - DNA, 75 bp, Artificial Sequence
  Synthetic
tggtgatcatggatgacttgtgtcagaaccctgacggtaaagatgtctctttattctgccaaatggtctccagtg

SEQ ID NO: 79139 - DNA, 75 bp, Artificial Sequence
  Synthetic
ctaatgcagggtccatcaatgctccaactgtatcagacagcagggccttagcaaggagattccactttgatatga

SEQ ID NO: 79140 - DNA, 75 bp, Artificial Sequence
  Synthetic
tcaaaatggtaagataaacatgccaatgtcagtgaagacgtgtgatgaggagtgttgccctgtcaacttcaagag

SEQ ID NO: 79141 - DNA, 75 bp, Artificial Sequence
  Synthetic
taaatcagtggatagcgaagccgtgagagagtattgcaaagagaagggatggttggttcctgaagttaactccac

SEQ ID NO: 79142 - DNA, 75 bp, Artificial Sequence
  Synthetic
gagtcactagtgggccaggactcaattttagagaagtctctcaaagcacttgtgaagatcatatcagcattagtg

SEQ ID NO: 79143 - DNA, 75 bp, Artificial Sequence
  Synthetic
tgataactgtgaccgccactcttgctcttatcggatgcgcatcatcaccatggcgttggcttaaacagaaggtgt

SEQ ID NO: 79144 - DNA, 75 bp, Artificial Sequence
  Synthetic
aattatttacataatatacaagctctttgcaggcttccaaggtgcatacacgggaatgcccaaccagaaacccaa

SEQ ID NO: 79145 - DNA, 75 bp, Artificial Sequence
  Synthetic
cctgcaaagggatggagtggatcgccatcaaaatccaaaagttcatagagtggcttaaggttaaaatcttaccag

SEQ ID NO: 79146 - DNA, 75 bp, Artificial Sequence
  Synthetic
ctgctcaagttaaacaggaacgagaagttcagagacatcaggggcttcttagccaaggaggaggtggaagttaac

SEQ ID NO: 79147 - DNA, 75 bp, Artificial Sequence
  Synthetic
aagaaaatgagtaattacatacagttcaagtccaaatgtcgtattgaaccagtatgtttgttgttacatgggagc

SEQ ID NO: 79148 - DNA, 75 bp, Artificial Sequence
  Synthetic
tccctaccaccggacccagaccactttgatggatacaaacagcaagctgtggtgatcatggatgatttgtgccaa

SEQ ID NO: 79149 - DNA, 75 bp, Artificial Sequence
  Synthetic
aacagggagaaattgagttcattgaaagctcaaaggaagcaggattcccagtcattaacacacctagtaagacca

SEQ ID NO: 79150 - DNA, 75 bp, Artificial Sequence
  Synthetic
ccaggaggttccactttgacatgaacattgaagtcatatcaatgtacagccaaaatggcaagatcaatatgccca

SEQ ID NO: 79151 - DNA, 75 bp, Artificial Sequence
  Synthetic
gcctcaaagccaactttgaggaggccatattttccaaatacaccggaaatgttaacacacacgtggatgagtaca

SEQ ID NO: 79152 - DNA, 75 bp, Artificial Sequence
  Synthetic
catattttccaaatacaccggaaatgttaacacacacgtggatgagtacatgctggaagctgtcgatcattacgc

SEQ ID NO: 79153 - DNA, 75 bp, Artificial Sequence
  Synthetic
cattgaagtcatatcaatgtacagccaaaatggcaagatcaatatgcccatgtcggttaagacatgtgacgagga

SEQ ID NO: 79154 - DNA, 75 bp, Artificial Sequence
  Synthetic
gcaagtgaggtactccctggatatgctggtcactgaaatgttccgagagtacaaccacagacacagcattggggc

SEQ ID NO: 79155 - DNA, 75 bp, Artificial Sequence
  Synthetic
tgaagctcttgacttaacaacaagtgcaggctacccctatgttgcactgggcatcaggaagagagacatcctttc

SEQ ID NO: 79156 - DNA, 75 bp, Artificial Sequence
  Synthetic
gcaggctacccctatgttgcactgggcatcaggaagagagacatcctttcaaagaagaccaaggacttgactaag

SEQ ID NO: 79157 - DNA, 75 bp, Artificial Sequence
  Synthetic
ccgccagcatacagggagatcaagattagtgtagcacctgaaatcccgccaccaccagcgatcgcagacttactg

SEQ ID NO: 79158 - DNA, 75 bp, Artificial Sequence
  Synthetic
gagaaggtagcaaagggaaaatctaggctgattgaagcatccagtttgaatgattcagtggctatgagacagaca

SEQ ID NO: 79159 - DNA, 75 bp, Artificial Sequence
  Synthetic
gtgcccacactgaggcaagccaaagtgcagggtcccgcttttgaatttgctgtggctatgatgaaaagaaactcc

SEQ ID NO: 79160 - DNA, 75 bp, Artificial Sequence
  Synthetic
gccaagcccggcccaactatccttatgaatgaccaagaagttggtgtgttagacgcaaaagagctggtagataga

SEQ ID NO: 79161 - DNA, 75 bp, Artificial Sequence
  Synthetic
tgaatgaccaagaagttggtgtgttagacgcaaaagagctggtagatagagatggtacaaatctcgaactaacat

SEQ ID NO: 79162 - DNA, 75 bp, Artificial Sequence
  Synthetic
gcatccttgctcgctgaggctggtaaggattacgggttgatcatgacaccagcagataagggagagtgcttcaat

SEQ ID NO: 79163 - DNA, 75 bp, Artificial Sequence
  Synthetic
aagctgtcctggcgataaataccagcaagttcccaaacatgtacatcccagtaggacaggtcacagactatggtt

SEQ ID NO: 79164 - DNA, 75 bp, Artificial Sequence
  Synthetic
gcgttctcatgtctactggcaaggtattggggatacatgttggtgggaatggccaccaaggcttctcagcagctc

SEQ ID NO: 79165 - DNA, 75 bp, Artificial Sequence
  Synthetic
cctgttatgcccatgaaagacatacatgagtcaatcagatggactaaagatccaaagaacacccaagatcatgtg

SEQ ID NO: 79166 - DNA, 75 bp, Artificial Sequence
  Synthetic
tccaaagaacacccaagatcatgtgcgctcactgtgtctattggcatggcacaacggagagcacgaatatgagga

SEQ ID NO: 79167 - DNA, 75 bp, Artificial Sequence
  Synthetic
gttcattcgtaaaattagaagcgtcccagtcggacgttgcttgaccctccctgcgttttcaaccctacgcaggaa

SEQ ID NO: 79168 - DNA, 75 bp, Artificial Sequence
  Synthetic
tcatcaatacaccaagcaaaacaaagttagaacccagcgttttccaccatgtgtttgaaggcaacaaggagccgg

SEQ ID NO: 79169 - DNA, 75 bp, Artificial Sequence
  Synthetic
gacaatttgaaataatttgaattggcttaaccctactgtactaaccgaactagataacggtgcagtaggggtaaa

SEQ ID NO: 79170 - DNA, 75 bp, Artificial Sequence
  Synthetic
atccacagggcccactgggcgccagcactctggtattgcggtactttagtgcgcctgttttatatacccatcccc

SEQ ID NO: 79171 - DNA, 75 bp, Artificial Sequence
  Synthetic
cattaagaagagggatattttgtctaagaagactaaggatctgaccaaattaaaggagtgtttggacaagtatgg

SEQ ID NO: 79172 - DNA, 75 bp, Artificial Sequence
  Synthetic
cttcgagaaacctagtaacaccatgaaggttgcgcagtgtttcgctccgcacaaccccagtgtagatcaggtcga

SEQ ID NO: 79173 - DNA, 75 bp, Artificial Sequence
  Synthetic
acttattgaagcatccagcctgaatgattctgttgcgatgaggcaaacatttggcaatctatacaaagcattcca

SEQ ID NO: 79174 - DNA, 75 bp, Artificial Sequence
  Synthetic
gattctgttgcgatgaggcaaacatttggcaatctatacaaagcattccatttgaacccaggagttgtgactggt

SEQ ID NO: 79175 - DNA, 75 bp, Artificial Sequence
  Synthetic
gattactctgggtatgacgccagtttgagccccgtgtggtttgcttgtctaaagctattgcttgagaaacttgga

SEQ ID NO: 79176 - DNA, 75 bp, Artificial Sequence
  Synthetic
tgagccccgtgtggtttgcttgtctaaagctattgcttgagaaacttggatactcacacaaggagacaaattaca

SEQ ID NO: 79177 - DNA, 75 bp, Artificial Sequence
  Synthetic
aattgagagattgttaccatatagctattggattggccatccggtgacaaatagagcaattgtgtatttgtttgt

SEQ ID NO: 79178 - DNA, 75 bp, Artificial Sequence
  Synthetic
tagtattcaatacaataaaatgggagctcaagtgtcaacacagaagactggggcccacgaaactgggataaatgc

SEQ ID NO: 79179 - DNA, 75 bp, Artificial Sequence
  Synthetic
gttctggtaccagtatctttaacacaatgatcaacaatatcatcatcagaacactgatgctcaaagtgtacaaag

SEQ ID NO: 79180 - DNA, 75 bp, Artificial Sequence
  Synthetic
gctcaagtgtcaacacagaagactggggcccacgaaactgggataaatgccagtggtagctccattatccactac

SEQ ID NO: 79181 - DNA, 75 bp, Artificial Sequence
  Synthetic
aatgatcaacaatatcatcatcagaacactgatgctcaaagtgtacaaaggcattgacttggatcaattcaggat

SEQ ID NO: 79182 - DNA, 75 bp, Artificial Sequence
  Synthetic
gggttatggattaatcatgacaccagcagacaagggagattgctttaatgaggtaacttgggccaacgtcacctt

SEQ ID NO: 79183 - DNA, 75 bp, Artificial Sequence
  Synthetic
gcagacaagggagattgctttaatgaggtaacttgggccaacgtcaccttcttgaaaagatacttcagagcagat

SEQ ID NO: 79184 - DNA, 75 bp, Artificial Sequence
  Synthetic
ccaaagaacacccaagaccacgtgcgatccttgtgcctattggcttggcacaatggcgagcacgaatatgaggag

SEQ ID NO: 79185 - DNA, 75 bp, Artificial Sequence
  Synthetic
caatggcgagcacgaatatgaggagttcattcgcaagattaggagcgtcccaattgggcgctgcttgactttacc

SEQ ID NO: 79186 - DNA, 75 bp, Artificial Sequence
  Synthetic
aattggcttaaccctaccgcactaaccgaactagacaacggtgcggtaggggtaaattctccgcattcggtgcgg

SEQ ID NO: 79187 - DNA, 75 bp, Artificial Sequence
  Synthetic
gctaccaatggagcccatacggtccaaagcatagtgacaaacgctgggatgggggttggagttggtaaccttacc

SEQ ID NO: 79188 - DNA, 75 bp, Artificial Sequence
  Synthetic
ataattttacattgatgattatcccgtttgtgtccctagattactcatcagatgcctccacatatgtgcccatta

SEQ ID NO: 79189 - DNA, 75 bp, Artificial Sequence
  Synthetic
ctacgctggctacttatggtgacaattgagagactgtaaccatattgctatcgggttggccacctggtgaagaat

SEQ ID NO: 79190 - DNA, 75 bp, Artificial Sequence
  Synthetic
ttgagagactgtaaccatattgctatcgggttggccacctggtgaagaatagaacagttgctcacttgtttgtca

SEQ ID NO: 79191 - DNA, 75 bp, Artificial Sequence
  Synthetic
gctgaggttgattctgtggtgccagttaacaacgttgagggtaagttagacacaatggacattttccgcattcct

SEQ ID NO: 79192 - DNA, 75 bp, Artificial Sequence
  Synthetic
ctcaagtgtcaacacaaaagaccggtgcacatgagaccagcttgaatgcagcgagcaattcggtcattcattaca

SEQ ID NO: 79193 - DNA, 75 bp, Artificial Sequence
  Synthetic
tgcacatgagaccagcttgaatgcagcgagcaattcggtcattcattacacaaatataaactattataaggatgc

SEQ ID NO: 79194 - DNA, 75 bp, Artificial Sequence
  Synthetic
ggtcaaatctatgcctgccctcaattctccgtcagcagaggagtgcggctatagtgacagagttagatccatcac

SEQ ID NO: 79195 - DNA, 75 bp, Artificial Sequence
  Synthetic
tctccgtcagcagaggagtgcggctatagtgacagagttagatccatcaccttggggaactcaaccataacaacc

SEQ ID NO: 79196 - DNA, 75 bp, Artificial Sequence
  Synthetic
accaagacgaatacaccagtgctggcaatgtgacatgctggtatcaaaccgggattgtcgtgccagctgggacac

SEQ ID NO: 79197 - DNA, 75 bp, Artificial Sequence
  Synthetic
gatcaacccactcaacccgacgtggccacgtgcaggttttacacgctcgagtctgtgatgtggcagcaggtttcg

SEQ ID NO: 79198 - DNA, 75 bp, Artificial Sequence
  Synthetic
ccacgtgcaggttttacacgctcgagtctgtgatgtggcagcaggtttcgccaggctggtggtggaagttccccg

SEQ ID NO: 79199 - DNA, 75 bp, Artificial Sequence
  Synthetic
cgtttcggcatgcaatgacttttccgttcggttgctaaaggacaccccattcattgagcagagtgcactactcca

SEQ ID NO: 79200 - DNA, 75 bp, Artificial Sequence
  Synthetic
tcattgagcagagtgcactactccaaggtgacgtggtggaggcaattgagggtgcagttgccagagtggcggaca

SEQ ID NO: 79201 - DNA, 75 bp, Artificial Sequence
  Synthetic
acgtgcagtgtaacgcatccaagtttcaccaggggtgcctgctggtggtatgtgtgccagaagcagaaatggggt

SEQ ID NO: 79202 - DNA, 75 bp, Artificial Sequence
  Synthetic
acgtgcagtgtaacgcatccaagtttcaccaggggtgcctgctggtggtatgtgtgccagaagctgaaatggggt

SEQ ID NO: 79203 - DNA, 75 bp, Artificial Sequence
  Synthetic
acgtgcagtgtaacgcatccaagtttcaccaggggtgcctgctggtggtatgtgtgccagaagccgaaatggggt

SEQ ID NO: 79204 - DNA, 75 bp, Artificial Sequence
  Synthetic
acgtgcagtgtaacgcatccaagtttcaccaggggtgcctgctggtggtatgtgtgccagaagcggaaatggggt

SEQ ID NO: 79205 - DNA, 75 bp, Artificial Sequence
  Synthetic
tcaccaggggtgcctgctggtggtatgtgtgccagaagcagaaatggggtgcgccacgttggccaacaagcccga

SEQ ID NO: 79206 - DNA, 75 bp, Artificial Sequence
  Synthetic
tcaccaggggtgcctgctggtggtatgtgtgccagaagctgaaatggggtgcgccacgttggccaacaagcccga

SEQ ID NO: 79207 - DNA, 75 bp, Artificial Sequence
  Synthetic
tcaccaggggtgcctgctggtggtatgtgtgccagaagccgaaatggggtgcgccacgttggccaacaagcccga

SEQ ID NO: 79208 - DNA, 75 bp, Artificial Sequence
  Synthetic
tcaccaggggtgcctgctggtggtatgtgtgccagaagcggaaatggggtgcgccacgttggccaacaagcccga

SEQ ID NO: 79209 - DNA, 75 bp, Artificial Sequence
  Synthetic
ggctaatgtgattaatgctggcatgggcgtaggcgtcggtaatttaaccatcttccctcatcagtggatcaactt

SEQ ID NO: 79210 - DNA, 75 bp, Artificial Sequence
  Synthetic
ggcgtaggcgtcggtaatttaaccatcttccctcatcagtggatcaacttgcgcaccaacaacagtgcaacgatt

SEQ ID NO: 79211 - DNA, 75 bp, Artificial Sequence
  Synthetic
attggacaattaacgcaagacgtatggtgcagatgagaaggaagcttgaaatgtttacatacatccgctttgatg

SEQ ID NO: 79212 - DNA, 75 bp, Artificial Sequence
  Synthetic
tttgccccactgagctatagcgcaggggccaccacgtacgtgccaatcaccgtgacagtggcgccgatgtgcgct

SEQ ID NO: 79213 - DNA, 75 bp, Artificial Sequence
  Synthetic
gggccaccacgtacgtgccaatcaccgtgacagtggcgccgatgtgcgctgaatataatggactgcgtctagccg

SEQ ID NO: 79214 - DNA, 75 bp, Artificial Sequence
  Synthetic
cagccatgccacaattcgacgtcactcctgagatggacataccagggcaggtcaacaatttgatggagattgcag

SEQ ID NO: 79215 - DNA, 75 bp, Artificial Sequence
  Synthetic
tcctgagatggacataccagggcaggtcaacaatttgatggagattgcagaagtggattccgtggtacctgtgaa

SEQ ID NO: 79216 - DNA, 75 bp, Artificial Sequence
  Synthetic
ggcagctgtacatgcgccacgtgaacgggccatcaccactgccaatgaccagcacagtgagagtgtacttcaaac

SEQ ID NO: 79217 - DNA, 75 bp, Artificial Sequence
  Synthetic
agtctttgggttcccattgaccccaggggccagcagtgtgttaaacaggaccttgctaggtgaaatcttgaacta

SEQ ID NO: 79218 - DNA, 75 bp, Artificial Sequence
  Synthetic
ggggccagcagtgtgttaaacaggaccttgctaggtgaaatcttgaactactatgcccattggtcaggcagcatt

SEQ ID NO: 79219 - DNA, 75 bp, Artificial Sequence
  Synthetic
ggggcaccgaccacacgcaaggaggcgatgctaggcacccacgtgatctgggatgtgggtttgcaatccagctgt

SEQ ID NO: 79220 - DNA, 75 bp, Artificial Sequence
  Synthetic
gtgttgtgcataccatggattagtcaaacacactacaggtacgtagtgatggacgagtacaccgctggtggatac

SEQ ID NO: 79221 - DNA, 75 bp, Artificial Sequence
  Synthetic
tcaaaaaataaacactacccgattgttttcgaaggtccaggtcttgtggaggtgcaggagagtgaatactaccct

SEQ ID NO: 79222 - DNA, 75 bp, Artificial Sequence
  Synthetic
ggatgctcaaggatacgccctttataaaacaggataatttcttccaagggcccccaggaggagtgacggaaggaa

SEQ ID NO: 79223 - DNA, 75 bp, Artificial Sequence
  Synthetic
aaacagggcacacgtcacaagttgtaccatcagacacaatgcaaactaggcatgtgaagaactaccactcaaggt

SEQ ID NO: 79224 - DNA, 75 bp, Artificial Sequence
  Synthetic
agggagtgaaagactacgttgaacagctgggtaacgccttcggttcaggcttcaccaatcaaatctgtgaacaag

SEQ ID NO: 79225 - DNA, 75 bp, Artificial Sequence
  Synthetic
accatcagacacaatgcaaactaggcatgtgaagaactaccactcaaggtcagagtcaaccgtggagaacttcct

SEQ ID NO: 79226 - DNA, 75 bp, Artificial Sequence
  Synthetic
catcaacgcgcggcaagttgctcaactacgccggaagctcgaaatgttcacgtatgcaagatttgatctggagtt

SEQ ID NO: 79227 - DNA, 75 bp, Artificial Sequence
  Synthetic
acagccacactggccctcattggttgcacttcatcaccatggcggtggctcaaacaaaaggtgtcacagtactat

SEQ ID NO: 79228 - DNA, 75 bp, Artificial Sequence
  Synthetic
ctacgccggaagctcgaaatgttcacgtatgcaagatttgatctggagttaactttcgtaattactagcactcag

SEQ ID NO: 79229 - DNA, 75 bp, Artificial Sequence
  Synthetic
gcacttcatcaccatggcggtggctcaaacaaaaggtgtcacagtactatggaatacccatggccgagcgtcaga

SEQ ID NO: 79230 - DNA, 75 bp, Artificial Sequence
  Synthetic
gtgcccacaaaggtgaacagttacagttggcaaacgtccaccaacccgagtgttttttggacagaaggaaacgcc

SEQ ID NO: 79231 - DNA, 75 bp, Artificial Sequence
  Synthetic
gttggcaaacgtccaccaacccgagtgttttttggacagaaggaaacgccccgcctcggatgtcgataccattca

SEQ ID NO: 79232 - DNA, 75 bp, Artificial Sequence
  Synthetic
gtacactaaataacatggggacactatatatgagacacgtgaatggtgggggccccggtcccattgtgagcacag

SEQ ID NO: 79233 - DNA, 75 bp, Artificial Sequence
  Synthetic
atatatgagacacgtgaatggtgggggccccggtcccattgtgagcacagtgcgaatatatttcaaaccaaagca

SEQ ID NO: 79234 - DNA, 75 bp, Artificial Sequence
  Synthetic
tgttctcactagaaaagaagatgagtaactacatacagttcaagtccaaatgccgtattgaacctgtatgtttgc

SEQ ID NO: 79235 - DNA, 75 bp, Artificial Sequence
  Synthetic
tagcgtgacagagggtagaacagatataacaaccatgaaaactactggtgcctttgggcagcagtctggtgctgt

SEQ ID NO: 79236 - DNA, 75 bp, Artificial Sequence
  Synthetic
ataacaaccatgaaaactactggtgcctttgggcagcagtctggtgctgtgtacgtcggcaactacaaagtattg

SEQ ID NO: 79237 - DNA, 75 bp, Artificial Sequence
  Synthetic
acagctctgtgtactccctgccaccagaccctgaccattttgatggatacaaacagcaagccgtagtgatcatgg

SEQ ID NO: 79238 - DNA, 75 bp, Artificial Sequence
  Synthetic
agaccctgaccattttgatggatacaaacagcaagccgtagtgatcatggacgatctatgccagaacccagacgg

SEQ ID NO: 79239 - DNA, 75 bp, Artificial Sequence
  Synthetic
accaccaccgcacatggctgtgacaccattgccagatgcaattgcacgtcaggggtatatttctgcgcctctaga

SEQ ID NO: 79240 - DNA, 75 bp, Artificial Sequence
  Synthetic
ccattgccagatgcaattgcacgtcaggggtatatttctgcgcctctagaaataagcactacccggtcacatttg

SEQ ID NO: 79241 - DNA, 75 bp, Artificial Sequence
  Synthetic
agggattctatttacatccccatttgtgttagcatcaaccaatgctgggtccatcaacgcgcccactgtatccga

SEQ ID NO: 79242 - DNA, 75 bp, Artificial Sequence
  Synthetic
gtgttagcatcaaccaatgctgggtccatcaacgcgcccactgtatccgacagcagggcacttgctagaaggttc

SEQ ID NO: 79243 - DNA, 75 bp, Artificial Sequence
  Synthetic
ctggatttgcagagccgggtgattgtggagggattctcaggtgccagcatggggtgattggcatagtcaccgtgg

SEQ ID NO: 79244 - DNA, 75 bp, Artificial Sequence
  Synthetic
acatgtgatgaggagtgtagcccagtcaacttcaagaggtgctgcccattggtgtgtggcaaagccattcagttc

SEQ ID NO: 79245 - DNA, 75 bp, Artificial Sequence
  Synthetic
tcaacttcaagaggtgctgcccattggtgtgtggcaaagccattcagttcattgatagaaggacccaagtcagat

SEQ ID NO: 79246 - DNA, 75 bp, Artificial Sequence
  Synthetic
gaggatgacgccatggagcaaggagttaggggatatgtggagcagctcggcaatgccttcggctcggggttcacc

SEQ ID NO: 79247 - DNA, 75 bp, Artificial Sequence
  Synthetic
ccctgtttcaaggaccaccaatctacagggagatcaaaattagtgttacccctgagacccctccaccaccagcaa

SEQ ID NO: 79248 - DNA, 75 bp, Artificial Sequence
  Synthetic
cagggagatcaaaattagtgttacccctgagacccctccaccaccagcaattgctgacttgctaaaatcagtgga

SEQ ID NO: 79249 - DNA, 75 bp, Artificial Sequence
  Synthetic
cgatgacctcattacggtcaccgccacactagcgctaataggatgcactacctcaccatggcgctggctcaaaca

SEQ ID NO: 79250 - DNA, 75 bp, Artificial Sequence
  Synthetic
gaagcacgtgagtagggcatttatatgtttacaggccctaacaacatttgtttcggttgcaggtataatatacat

SEQ ID NO: 79251 - DNA, 75 bp, Artificial Sequence
  Synthetic
tgtttacaggccctaacaacatttgtttcggttgcaggtataatatacatcatatacaaactgtttgcaggcttc

SEQ ID NO: 79252 - DNA, 75 bp, Artificial Sequence
  Synthetic
gcgtttgaattcgctgtggcaatgatgaaaagaaatgctagcacagtgaaaaccgagtacggtgagttcaccatg

SEQ ID NO: 79253 - DNA, 75 bp, Artificial Sequence
  Synthetic
gagttccttaacagacttaagcaactgccactcctagagagtcaaatagcaaccattgagcagagtgcaccatcc

SEQ ID NO: 79254 - DNA, 75 bp, Artificial Sequence
  Synthetic
tgaaaagaaatgctagcacagtgaaaaccgagtacggtgagttcaccatgcttgggatttatgataggtgggcag

SEQ ID NO: 79255 - DNA, 75 bp, Artificial Sequence
  Synthetic
agctggttgacaaagatgggacaaacctagagttgactctcctaaagcttaatcgtaatgagaagtttagagaca

SEQ ID NO: 79256 - DNA, 75 bp, Artificial Sequence
  Synthetic
cctagagttgactctcctaaagcttaatcgtaatgagaagtttagagacatcagagggttcctagcacgggagga

SEQ ID NO: 79257 - DNA, 75 bp, Artificial Sequence
  Synthetic
cggtatactcactaccaccagatccagaccattttgatggttacaaacagcaagctgttgtcatcatggatgact

SEQ ID NO: 79258 - DNA, 75 bp, Artificial Sequence
  Synthetic
aactgactatgggttcctgaacctgggtgggacccccacaaaaagaatgcttatgtacaacttcccaactaaagc

SEQ ID NO: 79259 - DNA, 75 bp, Artificial Sequence
  Synthetic
ggtgggacccccacaaaaagaatgcttatgtacaacttcccaactaaagccggccaatgtggaggtgtcctcatg

SEQ ID NO: 79260 - DNA, 75 bp, Artificial Sequence
  Synthetic
agaccattttgatggttacaaacagcaagctgttgtcatcatggatgacttgtgccagaacccggatggcaaaga

SEQ ID NO: 79261 - DNA, 75 bp, Artificial Sequence
  Synthetic
tctgttcacctcgccgttcgtcctcgcatccactaatgcggggtcggttaacgcccccacagtctccgacagtag

SEQ ID NO: 79262 - DNA, 75 bp, Artificial Sequence
  Synthetic
tacttcaatgaggaacagggtgaaatagaattcattgaaagctcaaaagacgcggggttccccgtgattaacacc

SEQ ID NO: 79263 - DNA, 75 bp, Artificial Sequence
  Synthetic
tagaattcattgaaagctcaaaagacgcggggttccccgtgattaacacccccacaaagacaaaactagaaccaa

SEQ ID NO: 79264 - DNA, 75 bp, Artificial Sequence
  Synthetic
gcatccactaatgcggggtcggttaacgcccccacagtctccgacagtagggcgcttgtgagaaggttccacttt

SEQ ID NO: 79265 - DNA, 75 bp, Artificial Sequence
  Synthetic
gatgaggaatgttgcccagtcaactttaagaagtgctgcccactagtgtgcggcaaagctatacaattcatagac

SEQ ID NO: 79266 - DNA, 75 bp, Artificial Sequence
  Synthetic
acttcgaggaagcaatcttctccaagtacattggcaatgtcaacacacacgtggatgagtacatgcaagaagccg

SEQ ID NO: 79267 - DNA, 75 bp, Artificial Sequence
  Synthetic
gtacattggcaatgtcaacacacacgtggatgagtacatgcaagaagccgtggaccattgcgcgggacaactagc

SEQ ID NO: 79268 - DNA, 75 bp, Artificial Sequence
  Synthetic
ttaagaagtgctgcccactagtgtgcggcaaagctatacaattcatagacagaagaactcaagtcaggtattcgc

SEQ ID NO: 79269 - DNA, 75 bp, Artificial Sequence
  Synthetic
tccagggaccaccagtctatagagaaatcaagattagtgttgccccggaaattcctccaccaccagcggtcgctg

SEQ ID NO: 79270 - DNA, 75 bp, Artificial Sequence
  Synthetic
tttgaccactagtgcaggttacccttatgtggccctgggcatcaagaagagagatatattatccaagaagactaa

SEQ ID NO: 79271 - DNA, 75 bp, Artificial Sequence
  Synthetic
tatgtggccctgggcatcaagaagagagatatattatccaagaagactaaggacctcaccaagctgaaggaatgc

SEQ ID NO: 79272 - DNA, 75 bp, Artificial Sequence
  Synthetic
aatcaagattagtgttgccccggaaattcctccaccaccagcggtcgctgatttgctgaaagcagtggacagtga

SEQ ID NO: 79273 - DNA, 75 bp, Artificial Sequence
  Synthetic
cgtgagtagagcattcatatgtttgcaagctctaaccacgtttgtctcggttgcaggcataatatatattatcta

SEQ ID NO: 79274 - DNA, 75 bp, Artificial Sequence
  Synthetic
aagggaaagtccagactcattgaagcctctagtctcaatgactcagtagcaatgaggcagacatttggaaaccta

SEQ ID NO: 79275 - DNA, 75 bp, Artificial Sequence
  Synthetic
cctctagtctcaatgactcagtagcaatgaggcagacatttggaaacctatataagacctttcacctcaatccag

SEQ ID NO: 79276 - DNA, 75 bp, Artificial Sequence
  Synthetic
caagctctaaccacgtttgtctcggttgcaggcataatatatattatctacaaattgcttgcaggtttccaaggc

SEQ ID NO: 79277 - DNA, 75 bp, Artificial Sequence
  Synthetic
gagtttgccgtggcgatgatgaaaaggaacgccagcacagtgaaaaccgagtacggtgagttcactatgcttggg

SEQ ID NO: 79278 - DNA, 75 bp, Artificial Sequence
  Synthetic
atctcatagcttttgattactcgggttatgacgctagcctcagcccagtgtggtttgcatgtttaaagctccttc

SEQ ID NO: 79279 - DNA, 75 bp, Artificial Sequence
  Synthetic
ttatgacgctagcctcagcccagtgtggtttgcatgtttaaagctccttctagagaaactaggatatacaaacaa

SEQ ID NO: 79280 - DNA, 75 bp, Artificial Sequence
  Synthetic
ggaacgccagcacagtgaaaaccgagtacggtgagttcactatgcttgggatttacgacaagtgggcagtgttgc

SEQ ID NO: 79281 - DNA, 75 bp, Artificial Sequence
  Synthetic
tcgacaaagatggaaccaacctggagttgactctcataaagctcaaccgtaacgagaagtttagagacatcaggg

SEQ ID NO: 79282 - DNA, 75 bp, Artificial Sequence
  Synthetic
tatgccatcgggatgctcaggtactagcatatttaactctatgatcaacaacatcataattaggactctcatgtt

SEQ ID NO: 79283 - DNA, 75 bp, Artificial Sequence
  Synthetic
agcatatttaactctatgatcaacaacatcataattaggactctcatgttgaaggtttacaaaggcatagacctg

SEQ ID NO: 79284 - DNA, 75 bp, Artificial Sequence
  Synthetic
gattcttagcacgagaggaggccgaggtgaatgaagccgtcctggcaataaacacaagcaagttcccgaatatgt

SEQ ID NO: 79285 - DNA, 75 bp, Artificial Sequence
  Synthetic
gctgaagcagggaaaggttacggtttgatcatgactccagcagacaaaggtgagtgtttcaacgaggtgacctgg

SEQ ID NO: 79286 - DNA, 75 bp, Artificial Sequence
  Synthetic
gtgtggaggtgtccttatgtcaacagggaaagtcctgggaatacacgtaggagggaatggacaccaggggttctc

SEQ ID NO: 79287 - DNA, 75 bp, Artificial Sequence
  Synthetic
gggaaagtcctgggaatacacgtaggagggaatggacaccaggggttctcagcggcactcctcagacactacttc

SEQ ID NO: 79288 - DNA, 75 bp, Artificial Sequence
  Synthetic
acttcagagcagacgagcagtacccattcctggtgcaccctgtcatgccaatgaaggatattcatgagtccatta

SEQ ID NO: 79289 - DNA, 75 bp, Artificial Sequence
  Synthetic
aagacgaaattggagccaagtgtgtttcaccacgcgtttgaaggcaccaaggaaccagcggtcctcagaaacggg

SEQ ID NO: 79290 - DNA, 75 bp, Artificial Sequence
  Synthetic
ttcaccacgcgtttgaaggcaccaaggaaccagcggtcctcagaaacggggatccacggctaaaagccgactttg

SEQ ID NO: 79291 - DNA, 75 bp, Artificial Sequence
  Synthetic
aattggcttaaccctaccgcatgaaccgaacttgacaaaagtgcggtaggggtaaattctccgcattcggtgcgg

SEQ ID NO: 79292 - DNA, 75 bp, Artificial Sequence
  Synthetic
actatgcgggacaactagccacactagacatcagcactgaacccatgaagctggaagatgctgtgtacggcactg

SEQ ID NO: 79293 - DNA, 75 bp, Artificial Sequence
  Synthetic
agacatcagcactgaacccatgaagctggaagatgctgtgtacggcactgaggggcttgaagcgttggacttgac

SEQ ID NO: 79294 - DNA, 75 bp, Artificial Sequence
  Synthetic
cgccaagctaagggaatgcatggataagtatggtctaaacttaccaatggtaacctacgtcaaagatgagttgag

SEQ ID NO: 79295 - DNA, 75 bp, Artificial Sequence
  Synthetic
aagtccaggctcattgaggcttctagccttaacgactcagtggcaatgaggcagacatttggacacctatacaag

SEQ ID NO: 79296 - DNA, 75 bp, Artificial Sequence
  Synthetic
tgtagatcaggccgatgagtcaccgcattccccacgggcgaccgtggcggtggctgcgctggcggcctgcccatg

SEQ ID NO: 79297 - DNA, 75 bp, Artificial Sequence
  Synthetic
tctcaccacctgtacagggacaaacactactttgtgaggggcggcatgccatcaggatgttcaggcaccagcata

SEQ ID NO: 79298 - DNA, 75 bp, Artificial Sequence
  Synthetic
gggcagatgagcagtacccgtttttggtccatcctgtcatgccaatgaaggacatacacgaatccattaggtgga

SEQ ID NO: 79299 - DNA, 75 bp, Artificial Sequence
  Synthetic
atgaggagtttattcgtacgatcaggagtgtgcccgtggggcgctgcttgtccctccctgcgttttcaacgctgc

SEQ ID NO: 79300 - DNA, 75 bp, Artificial Sequence
  Synthetic
aaattggagcacaattaatcaattacaattggctcaaccctaccgcatgaaccgaacttacaaaagtgcggcagg

SEQ ID NO: 79301 - DNA, 75 bp, Artificial Sequence
  Synthetic
ttctgttaccccggactgagtatcaataagctgctcgcgcggctgaaggagaaaccgtccgttacccggctaact

SEQ ID NO: 79302 - DNA, 75 bp, Artificial Sequence
  Synthetic
acttcgaaagcctagtaacatcatgaacgttgcggagtgtttcgctcagcactgcccccgtgtagatcaggtcaa

SEQ ID NO: 79303 - DNA, 75 bp, Artificial Sequence
  Synthetic
ttgagagattgttaccatatagctattggattggccatccggtgtctaacagagcaattgtttacctgtttgttg

SEQ ID NO: 79304 - DNA, 75 bp, Artificial Sequence
  Synthetic
ctcaggtttcgacccaaaagacaggagcccacgagactagtctaaacgctagtgggagctccattatacactata

SEQ ID NO: 79305 - DNA, 75 bp, Artificial Sequence
  Synthetic
agcccacgagactagtctaaacgctagtgggagctccattatacactatactaataccgatattacaaaaatgcc

SEQ ID NO: 79306 - DNA, 75 bp, Artificial Sequence
  Synthetic
atgataaaatccttgcccgcactgaactcccccaccgttgaggagtgtggatatagtgatagggtgcggtcaata

SEQ ID NO: 79307 - DNA, 75 bp, Artificial Sequence
  Synthetic
actcccccaccgttgaggagtgtggatatagtgatagggtgcggtcaataacactaggaaattcaactataacaa

SEQ ID NO: 79308 - DNA, 75 bp, Artificial Sequence
  Synthetic
aagatcaacccacccaaccagatgtcgcaacatgcaggttttacacactgaactcagtgaaatgggagatgcaat

SEQ ID NO: 79309 - DNA, 75 bp, Artificial Sequence
  Synthetic
cgcaacatgcaggttttacacactgaactcagtgaaatgggagatgcaatcagcaggtttggtggaagttcccag

SEQ ID NO: 79310 - DNA, 75 bp, Artificial Sequence
  Synthetic
cgtgcagtgtaatgcgtccaaattccaccagggttgcctactggtcgtgtgcgtaccagaggccgagatggggtg

SEQ ID NO: 79311 - DNA, 75 bp, Artificial Sequence
  Synthetic
caccagggttgcctactggtcgtgtgcgtaccagaggccgagatggggtgcaccaatgctgaaaatgcgcctacg

SEQ ID NO: 79312 - DNA, 75 bp, Artificial Sequence
  Synthetic
acggcagtgtgcaacgcaggcatgggtgtgggagttggtacctgactatataccccaccagtggattaacctaga

SEQ ID NO: 79313 - DNA, 75 bp, Artificial Sequence
  Synthetic
gtgtgggagttggtacctgactatataccccaccagtggattaacctagactaacaacagcgccccattgtgatg

SEQ ID NO: 79314 - DNA, 75 bp, Artificial Sequence
  Synthetic
cgtggatacgtcacagggggtcttcctacattcccattaccgtgacggttgcaccaatgagtgctgagtacaacg

SEQ ID NO: 79315 - DNA, 75 bp, Artificial Sequence
  Synthetic
ctacattcccattaccgtgacggttgcaccaatgagtgctgagtacaacggtttgcgattagccggccaccaagg

SEQ ID NO: 79316 - DNA, 75 bp, Artificial Sequence
  Synthetic
gcagtttgatgtgacccctgagatggccatcccagggcaagttaggaacctgatggaaatagcagaagttgactc

SEQ ID NO: 79317 - DNA, 75 bp, Artificial Sequence
  Synthetic
gccatcccagggcaagttaggaacctgatggaaatagcagaagttgactccgtggtgccactcaataatctgaaa

SEQ ID NO: 79318 - DNA, 75 bp, Artificial Sequence
  Synthetic
ttccccttacaaccaggagcatcaagtgtgttacagaggacactactaggagaaatattgaattattacacacat

SEQ ID NO: 79319 - DNA, 75 bp, Artificial Sequence
  Synthetic
gtgtgttacagaggacactactaggagaaatattgaattattacacacattggtcaggcagtttaaagttgacat

SEQ ID NO: 79320 - DNA, 75 bp, Artificial Sequence
  Synthetic
atagtagaaagaacgcaatgctgggaacacatgtcatatgggacgttgggttgcaatccagttgcgtgctatgtg

SEQ ID NO: 79321 - DNA, 75 bp, Artificial Sequence
  Synthetic
aacacatgtcatatgggacgttgggttgcaatccagttgcgtgctatgtgtgccatggatcagccaaacgcacta

SEQ ID NO: 79322 - DNA, 75 bp, Artificial Sequence
  Synthetic
agcagaagcgcaaaagtcatgctacataatgtgctttgtgtcagcgtgtaatgatttttcagtacgcatgttgag

SEQ ID NO: 79323 - DNA, 75 bp, Artificial Sequence
  Synthetic
ataatgtgctttgtgtcagcgtgtaatgatttttcagtacgcatgttgagggacacgcagttcatataaccaaga

SEQ ID NO: 79324 - DNA, 75 bp, Artificial Sequence
  Synthetic
cccatcaaattccgagcagatccctgccctgacagcagtggaaaccgggcacacctctcaggtagatcccagcga

SEQ ID NO: 79325 - DNA, 75 bp, Artificial Sequence
  Synthetic
gccctgacagcagtggaaaccgggcacacctctcaggtagatcccagcgacaccatgcaaaccagacacgtgcac

SEQ ID NO: 79326 - DNA, 75 bp, Artificial Sequence
  Synthetic
tcaagcgcttgaatctaataacttaaagcgctatgcagaatgggtcattaacacaagacaggtggcacagcttgc

SEQ ID NO: 79327 - DNA, 75 bp, Artificial Sequence
  Synthetic
aagcgctatgcagaatgggtcattaacacaagacaggtggcacagcttgcgacggaaaatggaaatgttcacata

SEQ ID NO: 79328 - DNA, 75 bp, Artificial Sequence
  Synthetic
ccagtccagacgcttaaatatgtacgtgccacctggaggccccgtgccaccactagtcagttatgctatgatgca

SEQ ID NO: 79329 - DNA, 75 bp, Artificial Sequence
  Synthetic
gtgccacctggaggccccgtgccaccactagtcagttatgctatgatgcaaccatctaccaaccctagcattttt

SEQ ID NO: 79330 - DNA, 75 bp, Artificial Sequence
  Synthetic
tgacgggctggtcaaatttctctagggatggcatatatggttacaattcactaaataacatggggactatttatg

SEQ ID NO: 79331 - DNA, 75 bp, Artificial Sequence
  Synthetic
ggatggcatatatggttacaattcactaaataacatggggactatttatgcgcgccatgttaacgattccagccc

SEQ ID NO: 79332 - DNA, 75 bp, Artificial Sequence
  Synthetic
agcctgtgccaatacaagaaggccaaaaacgtgaattttgaagttgaggctgtcaccaccgagcgtgcgaactta

SEQ ID NO: 79333 - DNA, 75 bp, Artificial Sequence
  Synthetic
aaaacgtgaattttgaagttgaggctgtcaccaccgagcgtgcgaacttagtgactactggcccccacggacaac

SEQ ID NO: 79334 - DNA, 75 bp, Artificial Sequence
  Synthetic
gcgtgtgggaggattacaacagagatcttctagtcagtacaactactgctcacggatgtgacaccatcgccaggt

SEQ ID NO: 79335 - DNA, 75 bp, Artificial Sequence
  Synthetic
tcttctagtcagtacaactactgctcacggatgtgacaccatcgccaggtgccggtgcacatctggtgtttactt

SEQ ID NO: 79336 - DNA, 75 bp, Artificial Sequence
  Synthetic
ctaccccaagaagataccagtcacacgtgttgcttgcagcgggcttttccgaaccaggggattgcggtggaatac

SEQ ID NO: 79337 - DNA, 75 bp, Artificial Sequence
  Synthetic
cgtgttgcttgcagcgggcttttccgaaccaggggattgcggtggaatactgaggtgtaacatggtgtcattggc

SEQ ID NO: 79338 - DNA, 75 bp, Artificial Sequence
  Synthetic
atggaacagggcgtcaaggattacgtggaacagcttggtaacgcttttggcactgggttcactaatcaaatttgt

SEQ ID NO: 79339 - DNA, 75 bp, Artificial Sequence
  Synthetic
tggaacagcttggtaacgcttttggcactgggttcactaatcaaatttgtgaacaagtcaacctccttaaagaat

SEQ ID NO: 79340 - DNA, 75 bp, Artificial Sequence
  Synthetic
tggtgaggaatcatgacgatctcatcacagtgacagccacccttgcactcatagggcgcactgcatcaccatggc

SEQ ID NO: 79341 - DNA, 75 bp, Artificial Sequence
  Synthetic
cacagtgacagccacccttgcactcatagggcgcactgcatcaccatggcgttggctcaagcaaaaaatagcgca

SEQ ID NO: 79342 - DNA, 75 bp, Artificial Sequence
  Synthetic
aagggcatggaatggatagccattaagattcaaaaatttatcgagtggctgaaagtcaagatcctaccagaagtc

SEQ ID NO: 79343 - DNA, 75 bp, Artificial Sequence
  Synthetic
gattgaaacaattaccattattggagagccaaattgctactatcgaacaaagtgcaccatcgcaaagtgaccagg

SEQ ID NO: 79344 - DNA, 75 bp, Artificial Sequence
  Synthetic
aaagggttttctccctagagaagaaaatgagcaactacatacagttcaagtccaaatgccgttgccgtattgaac

SEQ ID NO: 79345 - DNA, 75 bp, Artificial Sequence
  Synthetic
ctgagaaactcaacagctcagtgtattcgctaccgccggaccccgatcactttgacgggtacaaacaacaagctg

SEQ ID NO: 79346 - DNA, 75 bp, Artificial Sequence
  Synthetic
ttcgctaccgccggaccccgatcactttgacgggtacaaacaacaagctgtggtgataatggatgacctgtgtca

SEQ ID NO: 79347 - DNA, 75 bp, Artificial Sequence
  Synthetic
tctagaagaaaaggggatcctctttacctccccgtttgtgttagcatcaactaacgcagggtccattaatgcccc

SEQ ID NO: 79348 - DNA, 75 bp, Artificial Sequence
  Synthetic
acctccccgtttgtgttagcatcaactaacgcagggtccattaatgcccccactgtgtctgatagcagagtactt

SEQ ID NO: 79349 - DNA, 75 bp, Artificial Sequence
  Synthetic
atgtcctgtcaaaacatgtgatgaggagtgcttgtccagccaacttcaagaaatgctgtccattagtgtgtggta

SEQ ID NO: 79350 - DNA, 75 bp, Artificial Sequence
  Synthetic
gagtgcttgtccagccaacttcaagaaatgctgtccattagtgtgtggtaaggctatacaattcattgacaggag

SEQ ID NO: 79351 - DNA, 75 bp, Artificial Sequence
  Synthetic
gcgccactcttgaggcgctgtttcaaggaccccagtctacagggagattaagatcagcgtagccccggaaagccc

SEQ ID NO: 79352 - DNA, 75 bp, Artificial Sequence
  Synthetic
aggaccccagtctacagggagattaagatcagcgtagccccggaaagccccccccaccagcgattcccgatctat

SEQ ID NO: 79353 - DNA, 75 bp, Artificial Sequence
  Synthetic
tctcgcagattgaaaagcccgtgagcagagtattcaatttgtttcaagccttgcacgttcgtctcggtggccggt

SEQ ID NO: 79354 - DNA, 75 bp, Artificial Sequence
  Synthetic
cagagtattcaatttgtttcaagccttgcacgttcgtctcggtggccggtataatttacattatatacaagttat

SEQ ID NO: 79355 - DNA, 75 bp, Artificial Sequence
  Synthetic
tgcaaggcccggcattcgagtttgctgtggcgatgatgaaaaggaacgctagtacagttaaaacagaatacggtg

SEQ ID NO: 79356 - DNA, 75 bp, Artificial Sequence
  Synthetic
tgtggcgatgatgaaaaggaacgctagtacagttaaaacagaatacggtgagttcactatgcttggtatctatga

SEQ ID NO: 79357 - DNA, 75 bp, Artificial Sequence
  Synthetic
ggatgccaaagaactggttgacaaagatgggacaaatctggagttaacactcctcaagctcaaccgcaatgagaa

SEQ ID NO: 79358 - DNA, 75 bp, Artificial Sequence
  Synthetic
gatgggacaaatctggagttaacactcctcaagctcaaccgcaatgagaaattcagagacatcagaggatttcta

SEQ ID NO: 79359 - DNA, 75 bp, Artificial Sequence
  Synthetic
gtaggtcaggttaccgacctacggcttcctgaacttaggggggattcccaccaaaaggatgctcatgtacaattt

SEQ ID NO: 79360 - DNA, 75 bp, Artificial Sequence
  Synthetic
ttcctgaacttaggggggattcccaccaaaaggatgctcatgtacaatttcccaactagagcaggtcaatgtggt

SEQ ID NO: 79361 - DNA, 75 bp, Artificial Sequence
  Synthetic
cttctcagacactacttcaatgaagaacaagggaaatagaattcatcgagagctcaagacatgcaggctttcctg

SEQ ID NO: 79362 - DNA, 75 bp, Artificial Sequence
  Synthetic
aacaagggaaatagaattcatcgagagctcaagacatgcaggctttcctgtgatcaacacccccaacaaaaccaa

SEQ ID NO: 79363 - DNA, 75 bp, Artificial Sequence
  Synthetic
acttaaagtcaattttgaagaagcaatcttctttaagtacattggcaatgttaacacccatgtggatgaatacat

SEQ ID NO: 79364 - DNA, 75 bp, Artificial Sequence
  Synthetic
atcttctttaagtacattggcaatgttaacacccatgtggatgaatacatgctggaagctgtggaccattacgca

SEQ ID NO: 79365 - DNA, 75 bp, Artificial Sequence
  Synthetic
gaagcactagacttaactaccagtgcgggctacccttacgtggctttgggcattaagaagagggatgttctgtcc

SEQ ID NO: 79366 - DNA, 75 bp, Artificial Sequence
  Synthetic
cgggctacccttacgtggctttgggcattaagaagagggatgttctgtccaagaagaccaaagacctcactaagt

SEQ ID NO: 79367 - DNA, 75 bp, Artificial Sequence
  Synthetic
acccttcccgcattctcaacattacgcaggaggtggctggactccttctaaaattagagtacaattaactacgat

SEQ ID NO: 79368 - DNA, 75 bp, Artificial Sequence
  Synthetic
agaaagtggccaggggaaaatccagacttattgaggcctcaagtctcaacgactcggtggcaatgaggcaaacgt

SEQ ID NO: 79369 - DNA, 75 bp, Artificial Sequence
  Synthetic
acttattgaggcctcaagtctcaacgactcggtggcaatgaggcaaacgtttggaaacctatacaagaccttcca

SEQ ID NO: 79370 - DNA, 75 bp, Artificial Sequence
  Synthetic
gctcgacgggcatctcatagcttttgactactcaggctatgatgctagtctcagccctgtgtggtttgcatgtct

SEQ ID NO: 79371 - DNA, 75 bp, Artificial Sequence
  Synthetic
gactactcaggctatgatgctagtctcagccctgtgtggtttgcatgtctaaaactccttttagagaaattaggg

SEQ ID NO: 79372 - DNA, 75 bp, Artificial Sequence
  Synthetic
gtgagagcggtatgccatcaggatgttcaggcaccagcatattcaactctatgattaataatattataatcagga

SEQ ID NO: 79373 - DNA, 75 bp, Artificial Sequence
  Synthetic
ttcaggcaccagcatattcaactctatgattaataatattataatcaggactctcatgttgaaagtttacaaggg

SEQ ID NO: 79374 - DNA, 75 bp, Artificial Sequence
  Synthetic
ctcactattagctgaagcgggaaaagattatggtttgatcatgactccagcagacaaaggtgaatgctttaatga

SEQ ID NO: 79375 - DNA, 75 bp, Artificial Sequence
  Synthetic
gattatggtttgatcatgactccagcagacaaaggtgaatgctttaatgaggtaacctggacaaatgtgactttt

SEQ ID NO: 79376 - DNA, 75 bp, Artificial Sequence
  Synthetic
gagtccattagaggaccaaagatcctaaaaacacgcaggatcacgtggcctccttgtgcttattggcttggcaca

SEQ ID NO: 79377 - DNA, 75 bp, Artificial Sequence
  Synthetic
taaaaacacgcaggatcacgtggcctccttgtgcttattggcttggcacaatggagagcacccatatgaggagtt

SEQ ID NO: 79378 - DNA, 75 bp, Artificial Sequence
  Synthetic
ggttggactccttctaaatttagagtacaattagtagattacaattggcttaaccctactgcacgaaccgaactt

SEQ ID NO: 79379 - DNA, 75 bp, Artificial Sequence
  Synthetic
tacaattagtagattacaattggcttaaccctactgcacgaaccgaacttgatataagtgcggtaggggtaaatt

SEQ ID NO: 79380 - DNA, 75 bp, Artificial Sequence
  Synthetic
gcctccaactcagctaaccgccaagacttcacacaggacccgagcaaattcactgaaccggtcaaagatgtcatg

SEQ ID NO: 79381 - DNA, 75 bp, Artificial Sequence
  Synthetic
ggccagaacatgcagtaccactacttgggtcgcgcagggtacaccatacatgtgcagtgtaatgcgtctaaattt

SEQ ID NO: 79382 - DNA, 75 bp, Artificial Sequence
  Synthetic
tcaactgcagtggctgacggtgataaggcatatgagtttactagcacaacccaaagtaaacaaactaaagttcaa

SEQ ID NO: 79383 - DNA, 75 bp, Artificial Sequence
  Synthetic
tggaaatgttcaggattccagtgaccattaatgccccattacaacggcaggtttttgggttgagattacagcctg

SEQ ID NO: 79384 - DNA, 75 bp, Artificial Sequence
  Synthetic
agcaaaaagggtgttctcccttgaaaagaaaatgagcaactacatacagttcaagtccaaatgccgtattgaacc

SEQ ID NO: 79385 - DNA, 75 bp, Artificial Sequence
  Synthetic
agttaacatttgtgttctgtggctctgccatggcgacaggcaagtttttgattgcgtattcgccaccaggtgcga

SEQ ID NO: 79386 - DNA, 75 bp, Artificial Sequence
  Synthetic
tgccatggcgacaggcaagtttttgattgcgtattcgccaccaggtgcgaacccaccaaagacccggaaggatgc

SEQ ID NO: 79387 - DNA, 75 bp, Artificial Sequence
  Synthetic
aacccattacaggttggtgcaacaggatgagtacaccagtgcaggttttgtgacatgttggtaccagactggcat

SEQ ID NO: 79388 - DNA, 75 bp, Artificial Sequence
  Synthetic
aacccagatggtaaggatgtttccttgttttgtcaaatggtctccagtgtggacttcgtaccaccaatggcagca

SEQ ID NO: 79389 - DNA, 75 bp, Artificial Sequence
  Synthetic
gatgagtacaccagtgcaggttttgtgacatgttggtaccagactggcatgattgttccaccggggactcccaat

SEQ ID NO: 79390 - DNA, 75 bp, Artificial Sequence
  Synthetic
tcacaggacaacaaattgcaaggagacgtggaggaagccgttgagagggcaatcgtacacgtggctgacacatta

SEQ ID NO: 79391 - DNA, 75 bp, Artificial Sequence
  Synthetic
tatcgaggtcatctccatgtacagccagaatggaaagataaacatgcctatgtcagtcaagacctgtgatgagga

SEQ ID NO: 79392 - DNA, 75 bp, Artificial Sequence
  Synthetic
tacacacacaaggagacaaactatatagactacctttgcaattctcaccacttgtacagagacaaacactacttt

SEQ ID NO: 79393 - DNA, 75 bp, Artificial Sequence
  Synthetic
ttaaaacagcctgtgggttgttcccacccacagggcccaatgagcgctagcacactggtatcatggtacgtttgt

SEQ ID NO: 79394 - DNA, 75 bp, Artificial Sequence
  Synthetic
gcgttggtaaaaatcgtttcggcactggtgatcgtggtgagaaaccatgatgactttataacggtgacggccact

SEQ ID NO: 79395 - DNA, 75 bp, Artificial Sequence
  Synthetic
ggagccctggagctggaaaatctgtagcaaccaacttgatcgggcgctcccttgcgggaaaacttaacagctctg

SEQ ID NO: 79396 - DNA, 75 bp, Artificial Sequence
  Synthetic
ttgaaagattgttgccatatagctattggattggccatccggtaacaaacagagctattatttacctttttgttg

SEQ ID NO: 79397 - DNA, 75 bp, Artificial Sequence
  Synthetic
gccaaaacccagatggaaaagatgtgtctctattctgccagatggtctctagtgttgactttgtcccaccaatgg

SEQ ID NO: 79398 - DNA, 75 bp, Artificial Sequence
  Synthetic
tcaagtatcaacacaaaagactggagcacacgagaccggtttgagtgctagtggtaactccatcatccattatac

SEQ ID NO: 79399 - DNA, 75 bp, Artificial Sequence
  Synthetic
gtctctattctgccagatggtctctagtgttgactttgtcccaccaatggcagcacttgaagagaaaggcatcct

SEQ ID NO: 79400 - DNA, 75 bp, Artificial Sequence
  Synthetic
gcctcgaactcagcaaatagacaggatttcactcaagatccagggaagttcacagaacctgtgaaggatattatg

SEQ ID NO: 79401 - DNA, 75 bp, Artificial Sequence
  Synthetic
cacagaacctgtgaaggatattatgatcaaatccatgcctgctctcaactctccgtcagcagaggagtgcggtta

SEQ ID NO: 79402 - DNA, 75 bp, Artificial Sequence
  Synthetic
tctggccagaaggttccactttgatatgaacattgaagtcatttcaatgtacagccagaatgggaagattaacat

SEQ ID NO: 79403 - DNA, 75 bp, Artificial Sequence
  Synthetic
ctccgtcagcagaggagtgcggttacagtgatagggtgagatccatcaccttaggcaattcaaccataacaactc

SEQ ID NO: 79404 - DNA, 75 bp, Artificial Sequence
  Synthetic
taaagccatccagtttattgacaggagaacccaggtaaggtattcattggacatgctcgtgaccgagatgttcag

SEQ ID NO: 79405 - DNA, 75 bp, Artificial Sequence
  Synthetic
agaacccaggtaaggtattcattggacatgctcgtgaccgagatgttcagagagtacaaccataggcacagtgtg

SEQ ID NO: 79406 - DNA, 75 bp, Artificial Sequence
  Synthetic
cccccaccaccagcaatagcagacctactaaagtcagtggacagtgaggcagttagagagtactgcaaagagagg

SEQ ID NO: 79407 - DNA, 75 bp, Artificial Sequence
  Synthetic
cgccacgttagccaataaacctgaccagaagagcttgagcaacggggagaccgccaacgtgtttgaatcccaaaa

SEQ ID NO: 79408 - DNA, 75 bp, Artificial Sequence
  Synthetic
gagtagggctttcatctgcctgcaggcacttaccacttttgtctctgtggcagggatcatttatatcatctataa

SEQ ID NO: 79409 - DNA, 75 bp, Artificial Sequence
  Synthetic
aacttcacccttatgatcatcccatttgccccgctgagttatagcacaggtgctactacatatgtgccaatcaca

SEQ ID NO: 79410 - DNA, 75 bp, Artificial Sequence
  Synthetic
gtgacagtggcgccaatgtgtgctgaatacaacgggttgcgcttggccggcaagcagggcttgcccacaatgtta

SEQ ID NO: 79411 - DNA, 75 bp, Artificial Sequence
  Synthetic
acacctggtagcaaccaatttctcacatccgacgatttccagtctccttcagctatgccacagtttgatgttacc

SEQ ID NO: 79412 - DNA, 75 bp, Artificial Sequence
  Synthetic
cagcgaggctgtgcttgccattaacaccagtaagtatgcaaacatgtacatgccagttggtcaggtgacagacta

SEQ ID NO: 79413 - DNA, 75 bp, Artificial Sequence
  Synthetic
accagtaagtatgcaaacatgtacatgccagttggtcaggtgacagactatggattcctcaacctgggtggtgct

SEQ ID NO: 79414 - DNA, 75 bp, Artificial Sequence
  Synthetic
atcgaactcaacaaacggttcccaggtctttgggtttccactaataccaggagctagcagtgtattaaataggac

SEQ ID NO: 79415 - DNA, 75 bp, Artificial Sequence
  Synthetic
aaggtgcttgggatacatgttggcggtaacggacaccaagggttctcgacagccttggtacgtcaatatttcaat

SEQ ID NO: 79416 - DNA, 75 bp, Artificial Sequence
  Synthetic
acaaagctagagcctagggtattccaccacatctttgaggggaataaggagcctgcagtgttaaggaacggagac

SEQ ID NO: 79417 - DNA, 75 bp, Artificial Sequence
  Synthetic
accacatctttgaggggaataaggagcctgcagtgttaaggaacggagaccccaggctgaaagccaactttgagg

SEQ ID NO: 79418 - DNA, 75 bp, Artificial Sequence
  Synthetic
atgcagggcaactagcaactatggacatcagcacagaacccatgaaattggaggatgcagtttatggtactgagg

SEQ ID NO: 79419 - DNA, 75 bp, Artificial Sequence
  Synthetic
gtcatgcttgacggccacctcattgcctttgattacagtgggtatgatgctagcttgagtccggtgtggtttgcc

SEQ ID NO: 79420 - DNA, 75 bp, Artificial Sequence
  Synthetic
atcaacacacgtcagatggcccaactacggcgcaaacttgagatgtttacatatgcgagattcgatcttgagctg

SEQ ID NO: 79421 - DNA, 75 bp, Artificial Sequence
  Synthetic
caccatctgtacagagataaacactactttgtaagaggaggaatgccatccgggtgttctggcaccagcattttc

SEQ ID NO: 79422 - DNA, 75 bp, Artificial Sequence
  Synthetic
atgtatgtgcccccaggtggcccggtgcccacgaaagtgaatagttacagctggcagacgtccaccaaccctagc

SEQ ID NO: 79423 - DNA, 75 bp, Artificial Sequence
  Synthetic
aattctatgattaacaacataattatcagaacactgatgctgaaggtgcacaaaggagtagacttagaccaattt

SEQ ID NO: 79424 - DNA, 75 bp, Artificial Sequence
  Synthetic
acaagcaagggacgtatggcataaatacactgaacaacatggggacgctatacatgagacatgtgaacgatggca

SEQ ID NO: 79425 - DNA, 75 bp, Artificial Sequence
  Synthetic
taatgaagtaacatggaccaacgtcactttcctgaaaagatacttcagagcagatgagcaatatcccttcctcat

SEQ ID NO: 79426 - DNA, 75 bp, Artificial Sequence
  Synthetic
tagagcgcaattcgatttatttccaattgactcaaccctactacacgttacgaactagacaacgatgtggtaggg

SEQ ID NO: 79427 - DNA, 75 bp, Artificial Sequence
  Synthetic
cttatactggctgcttatggtgacaattgagagattgttaccatatagctattggattggccatccagtgtctaa

SEQ ID NO: 79428 - DNA, 75 bp, Artificial Sequence
  Synthetic
ggcccacgagactagtttgaatgctagtgggagttctattatacactatacaaacatcaattactataaagactc

SEQ ID NO: 79429 - DNA, 75 bp, Artificial Sequence
  Synthetic
ccctggccctcattggctgcacttcatcaccgtggcgctggcttaagcaaaaggtgtcacaatattacgggatac

SEQ ID NO: 79430 - DNA, 75 bp, Artificial Sequence
  Synthetic
aaggtgtcacaatattacgggatacccatggctgagcgtcaaaacaacgggtggctcaagaagttcacggaaatg

SEQ ID NO: 79431 - DNA, 75 bp, Artificial Sequence
  Synthetic
ccatcaagggtgcctgctcgttgtgtgtgtaccagaagccgagatgggtgcagccaccactgaccatgctatgaa

SEQ ID NO: 79432 - DNA, 75 bp, Artificial Sequence
  Synthetic
gtcaccagggtctgccaacaatgaacaccccagggagtacacaattcttgacatcagatgattttcagtccccat

SEQ ID NO: 79433 - DNA, 75 bp, Artificial Sequence
  Synthetic
gtatctttattctgtcaaatggtgtcaagtgtcgactttgtcccaccaatggctgctctggaggagaagggaatt

SEQ ID NO: 79434 - DNA, 75 bp, Artificial Sequence
  Synthetic
aaaccaactacaggtatgtcaccagtgatgcttacaccgatgcaggctacatcacttgctggtaccagacaagca

SEQ ID NO: 79435 - DNA, 75 bp, Artificial Sequence
  Synthetic
tgggggcaacactcgaggcacttttccaaggcccacccgtgtatagagagatcaaaattagtgttgcaccagaaa

SEQ ID NO: 79436 - DNA, 75 bp, Artificial Sequence
  Synthetic
ccaaggcccacccgtgtatagagagatcaaaattagtgttgcaccagaaattcccccaccgccagcaatagcaga

SEQ ID NO: 79437 - DNA, 75 bp, Artificial Sequence
  Synthetic
ccaggtgatgtacgtaccaccgggaggtccaatccctaaaagttatgaggatttcgcatggcagacatccactaa

SEQ ID NO: 79438 - DNA, 75 bp, Artificial Sequence
  Synthetic
ttctacactgcagattgagaaacatgtgagcagggcctttatctgcctacaggcactcaccacttttgtctctgt

SEQ ID NO: 79439 - DNA, 75 bp, Artificial Sequence
  Synthetic
tctatgacaggtgggcagtactgccgcgccatgccaagcctgggcccaccattttgatgaacgatcaggaagtgg

SEQ ID NO: 79440 - DNA, 75 bp, Artificial Sequence
  Synthetic
attttgatgaacgatcaggaagtggatgtggtcgatgccaaagagttagtagacaaagatggcaccaatttggaa

SEQ ID NO: 79441 - DNA, 75 bp, Artificial Sequence
  Synthetic
ggcaatgcctttggctcaggattcaccaaccaaatttgtgagcaggtcaatctcctcaaggagtcgctagtaggc

SEQ ID NO: 79442 - DNA, 75 bp, Artificial Sequence
  Synthetic
tatggattcctcaacctgggtggtacccccaccaagcgcatgttgatgtacaactttccaacacgcgcaggtcaa

SEQ ID NO: 79443 - DNA, 75 bp, Artificial Sequence
  Synthetic
tggaggacgcagtttatggtactgagggcttagaggctctagatctgaccacaagtgcggggtacccctatgttg

SEQ ID NO: 79444 - DNA, 75 bp, Artificial Sequence
  Synthetic
cccgacttattctggagcaagatcccagtcatgctcgacggccacctcattgcctttgattacagtgggtatgat

SEQ ID NO: 79445 - DNA, 75 bp, Artificial Sequence
  Synthetic
tgcctttgattacagtgggtatgatgctagtctgagtccagtgtggtttgcctgcttgaaactattattggagaa

SEQ ID NO: 79446 - DNA, 75 bp, Artificial Sequence
  Synthetic
gctgggttattcacacaaagaaactaattacatagattatttgtgcaactctcaccatctatacagagacaaaca

SEQ ID NO: 79447 - DNA, 75 bp, Artificial Sequence
  Synthetic
ctactttgtaagaggaggaatgccatctgggtgttctggaaccagcatttttaattcaatgattaacaacataat

SEQ ID NO: 79448 - DNA, 75 bp, Artificial Sequence
  Synthetic
tttaatgaagtaacatggaccaacgtcactttcctgaaaagatacttcagagcagatgagcaataccccttcctt

SEQ ID NO: 79449 - DNA, 75 bp, Artificial Sequence
  Synthetic
aattgagagattgttaccatatagctattggattggccatccggtgagcaacagagcaattgtattcctctttgt

SEQ ID NO: 79450 - DNA, 75 bp, Artificial Sequence
  Synthetic
cggtgaggtgaagaacttaatggagatagcggaagtcgactccgtagtaccagtgcaaaatattggtgaaaaggt

SEQ ID NO: 79451 - DNA, 75 bp, Artificial Sequence
  Synthetic
tgaatttctcaacagactcaaacagctccccctcttggaaagtcagattgctaccattgagcagagcgcaccatc

SEQ ID NO: 79452 - DNA, 75 bp, Artificial Sequence
  Synthetic
cgcttgtctgaaaatgctactcgagaaacttggttactcacacaaagagacaaattacatcgactacttgtgtaa

SEQ ID NO: 79453 - DNA, 75 bp, Artificial Sequence
  Synthetic
gcactcctggtagcaatcagttcctcacatcagatgacttccaatcaccatcggccctgccacagtttgacgtga

SEQ ID NO: 79454 - DNA, 75 bp, Artificial Sequence
  Synthetic
ggctcaagaagttcactgaaatgacaaacgcgtgtaagggtatggagtggatagccattaagatccagaaattta

SEQ ID NO: 79455 - DNA, 75 bp, Artificial Sequence
  Synthetic
ccctgttagagagtcagattgccaccattgaacaaagtgcaccctcccagggtgaccaggaacaactattctcca

SEQ ID NO: 79456 - DNA, 75 bp, Artificial Sequence
  Synthetic
tagtgcagggtacccatacgttgcacttggcatcaaaaagagggacatcctatccaagaagactaaggacttgac

SEQ ID NO: 79457 - DNA, 75 bp, Artificial Sequence
  Synthetic
tggacttaatacagcaaaatgggagctcaggtgtcaacacaaaagaccggggcgcacgaaacaaggttgaatgcc

SEQ ID NO: 79458 - DNA, 75 bp, Artificial Sequence
  Synthetic
gacttccagcaagatcctagtaagtttactgaaccaatgaaggatattatgattaagtctctgccagcgttaaat

SEQ ID NO: 79459 - DNA, 75 bp, Artificial Sequence
  Synthetic
cttatggagagtggcctaactacttagaagacgaccaagccacggcagaagatcagccaacacagcctgacgtag

SEQ ID NO: 79460 - DNA, 75 bp, Artificial Sequence
  Synthetic
aagcactaaaggatatgggactttttggtcaaaacatgtactatcactacctaggcagagcaggctacaccatac

SEQ ID NO: 79461 - DNA, 75 bp, Artificial Sequence
  Synthetic
tggtcaaaacatgtactatcactacctaggcagagcaggctacaccatacacgttcagtgcaatgcatccaagtt

SEQ ID NO: 79462 - DNA, 75 bp, Artificial Sequence
  Synthetic
gtccaatgctctcacggatggcgagcgtgcgaaagagtttacatcaggtaatgccactaaagagaatgggaaggt

SEQ ID NO: 79463 - DNA, 75 bp, Artificial Sequence
  Synthetic
cgtgcgaaagagtttacatcaggtaatgccactaaagagaatgggaaggttcagactgctgtttgcaacgcagca

SEQ ID NO: 79464 - DNA, 75 bp, Artificial Sequence
  Synthetic
atcgtaatgccatatataaacagcgtgccaatggacaacatgtttagacactataatttcacactgatggtgatt

SEQ ID NO: 79465 - DNA, 75 bp, Artificial Sequence
  Synthetic
tgccaatggacaacatgtttagacactataatttcacactgatggtgattccatttgcacccctgaagactgttg

SEQ ID NO: 79466 - DNA, 75 bp, Artificial Sequence
  Synthetic
cacatacccaaggcctgccagtcctcaacacacccggaagtaaccagttcttgacgtccgatgactaccaatcgc

SEQ ID NO: 79467 - DNA, 75 bp, Artificial Sequence
  Synthetic
caacacacccggaagtaaccagttcttgacgtccgatgactaccaatcgccgtgcgcgatgccagagttcgacgt

SEQ ID NO: 79468 - DNA, 75 bp, Artificial Sequence
  Synthetic
caataacctgagtagccatataaactccatagaagcataccaaataccagtgagtgcacagatcacagccaaggc

SEQ ID NO: 79469 - DNA, 75 bp, Artificial Sequence
  Synthetic
tccatagaagcataccaaataccagtgagtgcacagatcacagccaaggctgacgctattttttcaatacaactt

SEQ ID NO: 79470 - DNA, 75 bp, Artificial Sequence
  Synthetic
agcattaagctcacttttctgttctgcgggactgcactagcgacaggtaaactgctgttggcttactccccgcca

SEQ ID NO: 79471 - DNA, 75 bp, Artificial Sequence
  Synthetic
ggagcatctgtgcctaaaaaccggaaggatgctatgttgggaacccatgttatatgggacttgggcttgcaatct

SEQ ID NO: 79472 - DNA, 75 bp, Artificial Sequence
  Synthetic
caaatataattgtgcccccagagacaccatctgacagtgtagtgttgtgcttcgcatctgcttgtaacgatttct

SEQ ID NO: 79473 - DNA, 75 bp, Artificial Sequence
  Synthetic
acagggcactagctagagtggctgacaccgtgagaagcgggccatccaactcggaacaaataccggcactgacgg

SEQ ID NO: 79474 - DNA, 75 bp, Artificial Sequence
  Synthetic
caccgtgagaagcgggccatccaactcggaacaaataccggcactgacggcggtggagacgggtcacacatctca

SEQ ID NO: 79475 - DNA, 75 bp, Artificial Sequence
  Synthetic
cttcctgtgcagatcggcatgtgtacacatagctacctacaaggcgaagggcagtgccggagacacaaacaggta

SEQ ID NO: 79476 - DNA, 75 bp, Artificial Sequence
  Synthetic
cacatagctacctacaaggcgaagggcagtgccggagacacaaacaggtatgacagctgggacatcaacattaaa

SEQ ID NO: 79477 - DNA, 75 bp, Artificial Sequence
  Synthetic
accagtattcaagaacaagggactgccttaacacaggacatgcccgtactgactcaccaaatcatgtatgtccca

SEQ ID NO: 79478 - DNA, 75 bp, Artificial Sequence
  Synthetic
gactcaccaaatcatgtatgtcccaccggggggagcagtacctagtgatgcggagagtttcgcatggcagtcatc

SEQ ID NO: 79479 - DNA, 75 bp, Artificial Sequence
  Synthetic
gttccacgaccaccgagattgtgcccctacaaaaacaaggctaacgtaaactttgaggtcactagtgtgaccaca

SEQ ID NO: 79480 - DNA, 75 bp, Artificial Sequence
  Synthetic
cctacaaaaacaaggctaacgtaaactttgaggtcactagtgtgaccacagctagaaccagcttgaatgatgtcc

SEQ ID NO: 79481 - DNA, 75 bp, Artificial Sequence
  Synthetic
catatgttggcaattatcgcttagtaaacaggcacttggcgacgtttgacgattggcaaaactgcgtttgggaag

SEQ ID NO: 79482 - DNA, 75 bp, Artificial Sequence
  Synthetic
aaacaggcacttggcgacgtttgacgattggcaaaactgcgtttgggaagattacaatagggatttgctcgtgtg

SEQ ID NO: 79483 - DNA, 75 bp, Artificial Sequence
  Synthetic
gaacaaacactatccagttagctttgaggggccgggccttgtggaagtccaggagagtgaatactaccccaggag

SEQ ID NO: 79484 - DNA, 75 bp, Artificial Sequence
  Synthetic
taaagcacttgtcaaaatcatttccgccttggttattgtagtgagaaaccatgacgacctaattacggtaactgc

SEQ ID NO: 79485 - DNA, 75 bp, Artificial Sequence
  Synthetic
tcatcaccgtggcgatggctcaagcagaaggtatcccaatactatgggattcccgtggccgagaggcaaagtaat

SEQ ID NO: 79486 - DNA, 75 bp, Artificial Sequence
  Synthetic
tttattgagtggctcaaaatcaagatcttgccagaagtaaaggagaaacacgagtttctcactagacttaagcaa

SEQ ID NO: 79487 - DNA, 75 bp, Artificial Sequence
  Synthetic
ccaccatcgagcagagcgcaccatcacagagtgatcaggaacaactgttctctaatgtacagtatttcgcacact

SEQ ID NO: 79488 - DNA, 75 bp, Artificial Sequence
  Synthetic
tacttttcacatcgcctttcgtgctcgcctccaccaacgcaggttccatcaatgctcccactgtgtcagacagca

SEQ ID NO: 79489 - DNA, 75 bp, Artificial Sequence
  Synthetic
atatgccaatgtcagtgaagacctgtgacgaggagtgttgcccagtcaactttaagaaatgttgcccgctggttt

SEQ ID NO: 79490 - DNA, 75 bp, Artificial Sequence
  Synthetic
gacctactgaaatcagtggacagtgaggcggtcagggagtactgcaaagaaaaggggtggctagtgcctgaaatc

SEQ ID NO: 79491 - DNA, 75 bp, Artificial Sequence
  Synthetic
acaaattgtttgcaggcttccaaggagcttacactggcatgcccaaccaaaaacccaaagtaccaactttaagac

SEQ ID NO: 79492 - DNA, 75 bp, Artificial Sequence
  Synthetic
agtacggcgagttcacgatgcttggcatctatgacaggtgggcagtactgccccgccatgccaagcctgggccca

SEQ ID NO: 79493 - DNA, 75 bp, Artificial Sequence
  Synthetic
aactaacactcttgaaactcaatagaaatgagaaattcagagacattcgaggtttcttaacgcgtgaggaagctg

SEQ ID NO: 79494 - DNA, 75 bp, Artificial Sequence
  Synthetic
agaccccaggctgaaggccaattttgaagaggccattttctcaaagtacatcggtaacgtcaacacccatgtgga

SEQ ID NO: 79495 - DNA, 75 bp, Artificial Sequence
  Synthetic
ggtcagcagagaaagtggccaaaggcaaatccaggttgattgaggcgtccagcttaaacgactcggtggcaatga

SEQ ID NO: 79496 - DNA, 75 bp, Artificial Sequence
  Synthetic
gtgactggcagtgcagtcgggtgcgatcccgacctattctggagcaagatcccagtcatgctcgacggccacctc

SEQ ID NO: 79497 - DNA, 75 bp, Artificial Sequence
  Synthetic
atcccgacctattctggagcaagatcccagtcatgctcgacggccacctcattgcctttgattacagtgggtatg

SEQ ID NO: 79498 - DNA, 75 bp, Artificial Sequence
  Synthetic
atgacacccgcagacaagggagagtgctttaacgaagtgacatgggccaatgtcaccttcctgaaaagatacttt

SEQ ID NO: 79499 - DNA, 75 bp, Artificial Sequence
  Synthetic
ttcaattggcttaaccctaccgcacttaccgaactagacaacagtgtggtaggggtaaattctccgcattcggtg

SEQ ID NO: 79500 - DNA, 75 bp, Artificial Sequence
  Synthetic
ctctgcagcggaaccgactactttgggtgtccgtgtttcattttattcctatactggctgcttatggtgacaatt

SEQ ID NO: 79501 - DNA, 75 bp, Artificial Sequence
  Synthetic
gctgaagcaaagagggtgttctcccttgagaagaagatgagcaattacatacagttcaagtccaaatgccgtatt

SEQ ID NO: 79502 - DNA, 75 bp, Artificial Sequence
  Synthetic
ttgagaagaagatgagcaattacatacagttcaagtccaaatgccgtattgaacctgtatgtttgctcctgcacg

SEQ ID NO: 79503 - DNA, 75 bp, Artificial Sequence
  Synthetic
acagttcaagtccaaatgccgtattgaacctgtatgtttgctcctgcacgggagccctggtgccggcaagtcggt

SEQ ID NO: 79504 - DNA, 75 bp, Artificial Sequence
  Synthetic
caaagggattgacttggaccaattcaggatgatcgcatatggtgatgatgtgatcgcatcgtacccatggcctat

SEQ ID NO: 79505 - DNA, 75 bp, Artificial Sequence
  Synthetic
caccagcagataagggagagtgctttaacgaagttacctggaccaacgtcactttcctaaagaggtattttagag

SEQ ID NO: 79506 - DNA, 75 bp, Artificial Sequence
  Synthetic
aggatccaaagaacacccaagatcacgtgcgctcactgtgtctattagcttggcataacggggagcacgaatatg

SEQ ID NO: 79507 - DNA, 75 bp, Artificial Sequence
  Synthetic
cgacgcactgtccaacatgggtttgtttgggcaaaacatgcaataccattaccttggaagagctggatatacggt

SEQ ID NO: 79508 - DNA, 75 bp, Artificial Sequence
  Synthetic
acagtgacagtggcgccaatgtgcgctgaatacaacgggttgcgcttggccggcaagcagggcctgcccacaatg

SEQ ID NO: 79509 - DNA, 75 bp, Artificial Sequence
  Synthetic
aactgcggcgcaaacttgagatgtttacatatgcgagattcgatcttgagctgacctttgtgatcacgagtaccc

SEQ ID NO: 79510 - DNA, 75 bp, Artificial Sequence
  Synthetic
gtagccccggcccaattgtgagtaccgtacgtatatattttaaaccaaagcatgtcaagacatgggccccaagac

SEQ ID NO: 79511 - DNA, 75 bp, Artificial Sequence
  Synthetic
acataacaaccatgcagaccactggtgcctatggacaacaatcaggcgctgtgtacattggcaattacagggtgg

SEQ ID NO: 79512 - DNA, 75 bp, Artificial Sequence
  Synthetic
tgaaggtccgggtctcgtggaagttcaagagagtgagtactaccctaagagataccagacacatgtcttacttgc

SEQ ID NO: 79513 - DNA, 75 bp, Artificial Sequence
  Synthetic
tacccatggctgagcgtcaaaacaacgggtggctcaagaagttcacggagatgaccaatgcatgcaaagggatgg

SEQ ID NO: 79514 - DNA, 75 bp, Artificial Sequence
  Synthetic
taaattagagacaatttgagaataacttaaattggcttaacctcataccgcactcaccgaacttgataacggtgc

SEQ ID NO: 79515 - DNA, 75 bp, Artificial Sequence
  Synthetic
agccatgtcttggtcaagcacttctgtaaccccggactgagtatcaataaactgctcacgcggtcgaaggagaaa

SEQ ID NO: 79516 - DNA, 75 bp, Artificial Sequence
  Synthetic
actgctcacgcggtcgaaggagaaaacgtccgttacccggccaactacttcgagaaacctagtaacgccatgaaa

SEQ ID NO: 79517 - DNA, 75 bp, Artificial Sequence
  Synthetic
tggattggccacccagtgacaaacagagcaataatttaccaatttgtgggatttattccaataagtttgaaagtc

SEQ ID NO: 79518 - DNA, 75 bp, Artificial Sequence
  Synthetic
gagcaataatttaccaatttgtgggatttattccaataagtttgaaagtcttgaagacacttaatctagtattac

SEQ ID NO: 79519 - DNA, 75 bp, Artificial Sequence
  Synthetic
agtgatagagttagatcaataacactcggcaactccactataacaacacaagagtgtgcaaacgttgtggtgggg

SEQ ID NO: 79520 - DNA, 75 bp, Artificial Sequence
  Synthetic
acgtgtagattttacacgttgaattcggtgaaatgggaaatgcaatcagcggggtggtggtggaaatttccagac

SEQ ID NO: 79521 - DNA, 75 bp, Artificial Sequence
  Synthetic
acggagatttgtgtgggggagagacggcgaaaagctttgagcagaacgcagccacgggtgagacggctgtgcaga

SEQ ID NO: 79522 - DNA, 75 bp, Artificial Sequence
  Synthetic
ggaccaacaatagtgccaccattgtaatgccatatattaacagtgttccaatggacaatatgtttagacacaaca

SEQ ID NO: 79523 - DNA, 75 bp, Artificial Sequence
  Synthetic
tgcaccattggactacgtcacaggagcatcctcctacatcccaattacagtgacggttgctcccatgagcgctga

SEQ ID NO: 79524 - DNA, 75 bp, Artificial Sequence
  Synthetic
gcatcctcctacatcccaattacagtgacggttgctcccatgagcgctgaatacaatggtttgcgtctagccggc

SEQ ID NO: 79525 - DNA, 75 bp, Artificial Sequence
  Synthetic
cagaaatgaacataccaggacaggtcagaaacttgatggagattgcggaagttgattccgtagtaccacttaaca

SEQ ID NO: 79526 - DNA, 75 bp, Artificial Sequence
  Synthetic
acacacactggtcggggagcctcaaattgacttttgtgttctgtgggtctgcaatggcgaccggcaagtttttgc

SEQ ID NO: 79527 - DNA, 75 bp, Artificial Sequence
  Synthetic
aatcccagctttaacagccgttgaaactgggcatacctctcaagtggacccaagtgacacgatgcagactagaca

SEQ ID NO: 79528 - DNA, 75 bp, Artificial Sequence
  Synthetic
aaagtattccagtgctgagtcaaacaacttgaagcgttatgcagaatgggttatcaacacaagacaggtagctca

SEQ ID NO: 79529 - DNA, 75 bp, Artificial Sequence
  Synthetic
aacttgaagcgttatgcagaatgggttatcaacacaagacaggtagctcaactgaggcgcaagatggaaatgttc

SEQ ID NO: 79530 - DNA, 75 bp, Artificial Sequence
  Synthetic
gatgtaccagtacagacgcaccagataatgtatgtgccacctgggggccccgtgccaacatcagtcaatgactac

SEQ ID NO: 79531 - DNA, 75 bp, Artificial Sequence
  Synthetic
atgagcatcggcaatgcctataccatgttttatgacggatggtcaaatttttctagagacggcatatatgggtac

SEQ ID NO: 79532 - DNA, 75 bp, Artificial Sequence
  Synthetic
ttctagagacggcatatatgggtacaactcactgaacaacatggggaccatatacgcgcgacatgttaacgactc

SEQ ID NO: 79533 - DNA, 75 bp, Artificial Sequence
  Synthetic
atgtcaaagcgtacgtgccacgtccaccgcgtttgtgtcagtacaagaaagccaagaatgtgaactttgatgttg

SEQ ID NO: 79534 - DNA, 75 bp, Artificial Sequence
  Synthetic
gcaactataaaatagttaatagacacttggccacacatgcagattggcagagttgcgtgtgggaggactacaaca

SEQ ID NO: 79535 - DNA, 75 bp, Artificial Sequence
  Synthetic
cttggccacacatgcagattggcagagttgcgtgtgggaggactacaacagagacctcctcgtaagcacaaccac

SEQ ID NO: 79536 - DNA, 75 bp, Artificial Sequence
  Synthetic
tgggttagtcaccatgggaggcgaggggattgttggctttgctgatgtccgcgacctactatggttagaggatga

SEQ ID NO: 79537 - DNA, 75 bp, Artificial Sequence
  Synthetic
gcgacctactatggttagaggatgatgcaatggagcagggagtcaaagactatgtagaacaacttggaaatgcct

SEQ ID NO: 79538 - DNA, 75 bp, Artificial Sequence
  Synthetic
ttctagaaaagtccctcaagtcacttgtgaagatcatatcagcactggttattgtggtcaggaaccatgatgact

SEQ ID NO: 79539 - DNA, 75 bp, Artificial Sequence
  Synthetic
cctcatcgggtgcacctcttctccatggcgttggctcaaacaaaaagtgtcacaatactacggcattccaatggc

SEQ ID NO: 79540 - DNA, 75 bp, Artificial Sequence
  Synthetic
ctggaaagccagattgctactattgagcaaagtgcaccatcccagagtgaccaggaacaacttttttcgaatgtt

SEQ ID NO: 79541 - DNA, 75 bp, Artificial Sequence
  Synthetic
ggccaagagagtgttctcccttgagaagaaaatgagcaattatatacagttcaagtccaaatgccgtattgaacc

SEQ ID NO: 79542 - DNA, 75 bp, Artificial Sequence
  Synthetic
ctcgtgactgagatgttcagagagtacaaccacaggcacagcgtgggggcaacactcgaggcacttttccaaggc

SEQ ID NO: 79543 - DNA, 75 bp, Artificial Sequence
  Synthetic
ctgcagattgagaaacatgtgagcagggcctttatctgcctacaggcactcaccacttttgtctctgtggcaggg

SEQ ID NO: 79544 - DNA, 75 bp, Artificial Sequence
  Synthetic
ataccaaccctaagacaggctaaggttcaagggccagcttttgagtttgcggtggccatgatgaagagaaacgcc

SEQ ID NO: 79545 - DNA, 75 bp, Artificial Sequence
  Synthetic
tgctacgacactatttcaacgatgagcagggtgagattgagttcatcgagagttccaaggaagcaggcttcccgg

SEQ ID NO: 79546 - DNA, 75 bp, Artificial Sequence
  Synthetic
cagtattgaggaacggagaccccaggctaaaggccaactttgaagaggccatcttttcaaaatacatcggcaacg

SEQ ID NO: 79547 - DNA, 75 bp, Artificial Sequence
  Synthetic
cggggtacccctatgttgcccttggtattaagaagagagatatcctatccaagaagactaaggatctgacaaagc

SEQ ID NO: 79548 - DNA, 75 bp, Artificial Sequence
  Synthetic
ggatagacttggaccaatttaggatgattgcatatggcgacgacgtcattgcttcatatccacacccaattgatg

SEQ ID NO: 79549 - DNA, 75 bp, Artificial Sequence
  Synthetic
gggatatggtctgatcatgacaccagcggacaagggagagtgctttaatgaagtaacatggaccaacgtcacttt

SEQ ID NO: 79550 - DNA, 75 bp, Artificial Sequence
  Synthetic
acccacagggcccactgggcgctagcacactggtatcccggtacctttgtgcgcctgttttatttacccttcccc

SEQ ID NO: 79551 - DNA, 75 bp, Artificial Sequence
  Synthetic
ttgaaagattgttaccatatagctattggattggccatccagtgacaaacagagctatcgtgtacctatttgttg

SEQ ID NO: 79552 - DNA, 75 bp, Artificial Sequence
  Synthetic
tcaagtatccacccaaaaggccggatcacatgagacgaatttgaacacaggcagcaactctaccattcactatac

SEQ ID NO: 79553 - DNA, 75 bp, Artificial Sequence
  Synthetic
tcacatgagacgaatttgaacacaggcagcaactctaccattcactatacaaacataaacttttacaaggatgca

SEQ ID NO: 79554 - DNA, 75 bp, Artificial Sequence
  Synthetic
gtcaaatcgctcccagccctcaattcaccaagtgctgaggaatgtgggtacagcgatcgcgtcaggtccatcacc

SEQ ID NO: 79555 - DNA, 75 bp, Artificial Sequence
  Synthetic
caccaagtgctgaggaatgtgggtacagcgatcgcgtcaggtccatcaccttgggcaattcgaccataacaacac

SEQ ID NO: 79556 - DNA, 75 bp, Artificial Sequence
  Synthetic
accaacccactcaaccagatgtggcaacatgtaggttctatacgctggactcagtagaatggagtaaaaattccc

SEQ ID NO: 79557 - DNA, 75 bp, Artificial Sequence
  Synthetic
aacatgtaggttctatacgctggactcagtagaatggagtaaaaattcccaaggatggtggtggaagttcccaga

SEQ ID NO: 79558 - DNA, 75 bp, Artificial Sequence
  Synthetic
tgttcagtgcaacgcgtcgaagttccatcaagggtgtctgttggtagtgtgtgttcctgaagctgagatgggatg

SEQ ID NO: 79559 - DNA, 75 bp, Artificial Sequence
  Synthetic
catcaagggtgtctgttggtagtgtgtgttcctgaagctgagatgggatgtgccatgaaggatggtaaggttact

SEQ ID NO: 79560 - DNA, 75 bp, Artificial Sequence
  Synthetic
caaaatgcagtttgtaatgcagccatgggcgtaggtgttgggaacttgaccatttacccacaccagtggataaac

SEQ ID NO: 79561 - DNA, 75 bp, Artificial Sequence
  Synthetic
tgggcgtaggtgttgggaacttgaccatttacccacaccagtggataaacctgcgcaccaataatagcgccacca

SEQ ID NO: 79562 - DNA, 75 bp, Artificial Sequence
  Synthetic
cattcgcaccattgaattactcgaacactaccacattcgtgccaatcactatcactgtggcgcccatgtatgcgg

SEQ ID NO: 79563 - DNA, 75 bp, Artificial Sequence
  Synthetic
cactaccacattcgtgccaatcactatcactgtggcgcccatgtatgcggagtacaatggcttgagattgggtac

SEQ ID NO: 79564 - DNA, 75 bp, Artificial Sequence
  Synthetic
agcgctcccacagtacgacgtgacccccccaatgcagattcctggtgaggtaaaaaatttaatggagattgctga

SEQ ID NO: 79565 - DNA, 75 bp, Artificial Sequence
  Synthetic
cccccaatgcagattcctggtgaggtaaaaaatttaatggagattgctgaggtggattcagtggtacccataaac

SEQ ID NO: 79566 - DNA, 75 bp, Artificial Sequence
  Synthetic
ccaatattttcattccaacttagcccgggcagcagtagtgtgctgaagaggacattactcggggagatgctaaat

SEQ ID NO: 79567 - DNA, 75 bp, Artificial Sequence
  Synthetic
cgggcagcagtagtgtgctgaagaggacattactcggggagatgctaaattattacgcacactggtcgggcagta

SEQ ID NO: 79568 - DNA, 75 bp, Artificial Sequence
  Synthetic
catcagtccctaagaaccggaaagacgctatgctcggaacccatgtcatctgggatgttgggctacaatccagct

SEQ ID NO: 79569 - DNA, 75 bp, Artificial Sequence
  Synthetic
cgctatgctcggaacccatgtcatctgggatgttgggctacaatccagctgcgtactgtgcatcccatggataag

SEQ ID NO: 79570 - DNA, 75 bp, Artificial Sequence
  Synthetic
tatagttgttcccccggaaacccctactcaatgtgatgtcatgtgtttcgtttcggcgtgcaacgacttctctgt

SEQ ID NO: 79571 - DNA, 75 bp, Artificial Sequence
  Synthetic
actcaatgtgatgtcatgtgtttcgtttcggcgtgcaacgacttctctgtgaggatgttacgagacacacctttt

SEQ ID NO: 79572 - DNA, 75 bp, Artificial Sequence
  Synthetic
agtgggcctagcaattcggagggaataccaatgttaactgcagtggagacgggccatacatcacaagtagaaccc

SEQ ID NO: 79573 - DNA, 75 bp, Artificial Sequence
  Synthetic
taccaatgttaactgcagtggagacgggccatacatcacaagtagaacccagtgacacaatccagacaaggcatg

SEQ ID NO: 79574 - DNA, 75 bp, Artificial Sequence
  Synthetic
cttacaatgccaaaggggatgaaggttcttccaccagatatgcgtcatgggaaatcaccacgagagaactggtgc

SEQ ID NO: 79575 - DNA, 75 bp, Artificial Sequence
  Synthetic
ttcttccaccagatatgcgtcatgggaaatcaccacgagagaactggtgcagatgagaaggaaaatggaactatt

SEQ ID NO: 79576 - DNA, 75 bp, Artificial Sequence
  Synthetic
ggatatgcctgtcttgactcatcaaatcatgtacgtcccgcctggtggtcccgtaccacaaagcgccacaagtta

SEQ ID NO: 79577 - DNA, 75 bp, Artificial Sequence
  Synthetic
atcatgtacgtcccgcctggtggtcccgtaccacaaagcgccacaagttacgcgtggcagacgtctaccaacccc

SEQ ID NO: 79578 - DNA, 75 bp, Artificial Sequence
  Synthetic
aatttttatgacgggtggtcccacttcacacaggacggtgcatatggttacacagcgttgaatcgcatggggaag

SEQ ID NO: 79579 - DNA, 75 bp, Artificial Sequence
  Synthetic
tcacacaggacggtgcatatggttacacagcgttgaatcgcatggggaagatatacgtgaggcacgtgaacaagg

SEQ ID NO: 79580 - DNA, 75 bp, Artificial Sequence
  Synthetic
cacctaggttgtgtccgtatctgcgcacgaatgatctgaactttgaggtcactgcagtgaccgacacccgcgcgg

SEQ ID NO: 79581 - DNA, 75 bp, Artificial Sequence
  Synthetic
cacgaatgatctgaactttgaggtcactgcagtgaccgacacccgcgcggacataaacaccgtgccaacaccaga

SEQ ID NO: 79582 - DNA, 75 bp, Artificial Sequence
  Synthetic
gtccggggctgtgtatgtggggaactacagggtagtgaacagacatctcgccacgcacaatgactggcagaattg

SEQ ID NO: 79583 - DNA, 75 bp, Artificial Sequence
  Synthetic
tacagggtagtgaacagacatctcgccacgcacaatgactggcagaattgtgtatgggaagactacaacagggac

SEQ ID NO: 79584 - DNA, 75 bp, Artificial Sequence
  Synthetic
tgtcaatctagaaacaaacactacccagtcagctttgaaggcccaggtctggttgaagtccaggagagcgagtat

SEQ ID NO: 79585 - DNA, 75 bp, Artificial Sequence
  Synthetic
cagtcagctttgaaggcccaggtctggttgaagtccaggagagcgagtattacccaaaaaggtaccaatcccacg

SEQ ID NO: 79586 - DNA, 75 bp, Artificial Sequence
  Synthetic
tcgtgactatgggaggtgaaggcgtcgttggctttgctgatgtgcgagacctcctgtggttagaggatgatgcca

SEQ ID NO: 79587 - DNA, 75 bp, Artificial Sequence
  Synthetic
cgttggctttgctgatgtgcgagacctcctgtggttagaggatgatgccatggagcagggagttaaagactacgt

SEQ ID NO: 79588 - DNA, 75 bp, Artificial Sequence
  Synthetic
attaataggccaagattctatcttggaaaaatcacttaaagccctagtaaaaattatatcagcactggtcattgt

SEQ ID NO: 79589 - DNA, 75 bp, Artificial Sequence
  Synthetic
atggcttaagcgcaaggtatcccagtattatggaattcccatggccgagagacagaataacaactggctaaagaa

SEQ ID NO: 79590 - DNA, 75 bp, Artificial Sequence
  Synthetic
aatgagcaactacatacagttcaagtccaaatgccgtattgaacccgtatgtttgcttttacacggaagccctgg

SEQ ID NO: 79591 - DNA, 75 bp, Artificial Sequence
  Synthetic
gccacctgatccagatcactttgatggttacaaacaacaagccgtcgtgatcatggacgacctatgtcaaaaccc

SEQ ID NO: 79592 - DNA, 75 bp, Artificial Sequence
  Synthetic
tgccaaatggtgtccagtgtagactttgtaccaccaatggccgcgctagaggagaaaggcattctattcacctcc

SEQ ID NO: 79593 - DNA, 75 bp, Artificial Sequence
  Synthetic
ctcagacagtcgggctttagctagaaggtttcactttgatatgaacatagaagtggtatccatgtacagccaaaa

SEQ ID NO: 79594 - DNA, 75 bp, Artificial Sequence
  Synthetic
ccccctcgtgtgtggaaaggccattcagttcatcgacagacgaactcaagtcagatactcactggatatgctagt

SEQ ID NO: 79595 - DNA, 75 bp, Artificial Sequence
  Synthetic
gggctgtccttccgcgccacgccaagcccggaccaaccatcctcatgaacgatcaagaagttggcgtgctggatg

SEQ ID NO: 79596 - DNA, 75 bp, Artificial Sequence
  Synthetic
aaactcaaccggaatgaaaagtttagagacattagaggcttcctggctaaagaagaagtggaggtcagtgaggct

SEQ ID NO: 79597 - DNA, 75 bp, Artificial Sequence
  Synthetic
gagacattagaggcttcctggctaaagaagaagtggaggtcagtgaggctgtcctggcaataaacaccagcaagt

SEQ ID NO: 79598 - DNA, 75 bp, Artificial Sequence
  Synthetic
aggcagtggaccactatgcggggcaactagccaccctcgacatcaacactgagccaatgaaactagaggaagctg

SEQ ID NO: 79599 - DNA, 75 bp, Artificial Sequence
  Synthetic
ctacccctggccgattgatgcctccttacttgctgaggcaggtaaggggtatggattgatcatgacaccagcgga

SEQ ID NO: 79600 - DNA, 75 bp, Artificial Sequence
  Synthetic
ggactccttttaaattagagacaatttgaaaataatttaaattggctcaactctaccgcacttaccgaaccagat

SEQ ID NO: 79601 - DNA, 75 bp, Artificial Sequence
  Synthetic
ttaaaacagcctgtgggttgttcccacccacagggcccactgggcgccagcacactggtatcacggtacctttgt

SEQ ID NO: 79602 - DNA, 75 bp, Artificial Sequence
  Synthetic
acccacagggcccactgggcgccagcacactggtatcacggtacctttgtgcgcctgttttatccacccttcccc

SEQ ID NO: 79603 - DNA, 75 bp, Artificial Sequence
  Synthetic
gtttcgtgccactaaattacaaagtttttgaaactctcaacttcattttgacactcaataaagcaaaatgggagc

SEQ ID NO: 79604 - DNA, 75 bp, Artificial Sequence
  Synthetic
ttttgaaactctcaacttcattttgacactcaataaagcaaaatgggagctcaggtgtcaacgcagaagactggt

SEQ ID NO: 79605 - DNA, 75 bp, Artificial Sequence
  Synthetic
gcctcaaactcatcaaacaggcaggacatgtcacaggacccgggcaaattcaccgagccactcaaggacgtgatg

SEQ ID NO: 79606 - DNA, 75 bp, Artificial Sequence
  Synthetic
acatgtcacaggacccgggcaaattcaccgagccactcaaggacgtgatgataaaatcccttccagctctgaatt

SEQ ID NO: 79607 - DNA, 75 bp, Artificial Sequence
  Synthetic
aagagtgtgctaacgttgttgtggcgtatggagagtggccgcactacctggaagacaaagaggctgtcgctgagg

SEQ ID NO: 79608 - DNA, 75 bp, Artificial Sequence
  Synthetic
gtatggagagtggccgcactacctggaagacaaagaggctgtcgctgaggaccaacccacgcagccagatgtggc

SEQ ID NO: 79609 - DNA, 75 bp, Artificial Sequence
  Synthetic
ggcgctgaagaacatgggactgtttggacaaaacatgtactatcattatttggggagggctggatacacaatcca

SEQ ID NO: 79610 - DNA, 75 bp, Artificial Sequence
  Synthetic
ggacaaaacatgtactatcattatttggggagggctggatacacaatccatgtgcagtgtaatgcatcgaaattc

SEQ ID NO: 79611 - DNA, 75 bp, Artificial Sequence
  Synthetic
caagattccttgtctaacggcgatactccaatgaagttctctaatcagaaagagacctccgccaacaaggtgcag

SEQ ID NO: 79612 - DNA, 75 bp, Artificial Sequence
  Synthetic
ctccaatgaagttctctaatcagaaagagacctccgccaacaaggtgcagaatgcagtgtggaatgcaggaatgg

SEQ ID NO: 79613 - DNA, 75 bp, Artificial Sequence
  Synthetic
ttatgccatatataaatagtgtaccaatggacactatgtacaggcaccaaaatttcacgttaatgataatcccat

SEQ ID NO: 79614 - DNA, 75 bp, Artificial Sequence
  Synthetic
aatggacactatgtacaggcaccaaaatttcacgttaatgataatcccattcgttccactgaccgtaaacgcagc

SEQ ID NO: 79615 - DNA, 75 bp, Artificial Sequence
  Synthetic
gtcacaaggactgccggtgctcaacacaccagggagcaaccaattcctaacatcagacgacttccaatccccttc

SEQ ID NO: 79616 - DNA, 75 bp, Artificial Sequence
  Synthetic
acaccagggagcaaccaattcctaacatcagacgacttccaatccccttccgcaatgccacaatttgatgtgaca

SEQ ID NO: 79617 - DNA, 75 bp, Artificial Sequence
  Synthetic
aatacccccggaaaggttgattcactggaggccttccaaattccagtctcaactggatcacactcaggagagggt

SEQ ID NO: 79618 - DNA, 75 bp, Artificial Sequence
  Synthetic
tggaggccttccaaattccagtctcaactggatcacactcaggagagggtgccatattcgccttccagctcgacc

SEQ ID NO: 79619 - DNA, 75 bp, Artificial Sequence
  Synthetic
taagattcacattcctgttttgtggcactgctatgacaactggcaaactgctaatagcctactcaccaccaggcg

SEQ ID NO: 79620 - DNA, 75 bp, Artificial Sequence
  Synthetic
cactgctatgacaactggcaaactgctaatagcctactcaccaccaggcgccaacgtcccagggaacaggaagga

SEQ ID NO: 79621 - DNA, 75 bp, Artificial Sequence
  Synthetic
tcaaacacattacaggcaagtgaaaacggatgtatacaccagtgcagggtacatttcagggtggtatcagaccaa

SEQ ID NO: 79622 - DNA, 75 bp, Artificial Sequence
  Synthetic
acggatgtatacaccagtgcagggtacatttcagggtggtatcagaccaatatcgttgttccccctgaaacaccc

SEQ ID NO: 79623 - DNA, 75 bp, Artificial Sequence
  Synthetic
attgaacaagaagctgaactacaaggagatagggtggcaaccgtggtagacacaaaagctagtggaccaagcaac

SEQ ID NO: 79624 - DNA, 75 bp, Artificial Sequence
  Synthetic
gagatagggtggcaaccgtggtagacacaaaagctagtggaccaagcaactctgaacaggtgcctgctttgactg

SEQ ID NO: 79625 - DNA, 75 bp, Artificial Sequence
  Synthetic
ccagaactgagtcaacaatagaaaatttcttcagtcgtgccgcgtgtgtaaaggtcatggagtatacccttggac

SEQ ID NO: 79626 - DNA, 75 bp, Artificial Sequence
  Synthetic
tttcttcagtcgtgccgcgtgtgtaaaggtcatggagtatacccttggacaaaatgtcgaggcacatgacacgta

SEQ ID NO: 79627 - DNA, 75 bp, Artificial Sequence
  Synthetic
tgacttggaagtcacctgcgtgataactagctatcaggtgccgggcacactgcaaacacaagacatgccggtgtt

SEQ ID NO: 79628 - DNA, 75 bp, Artificial Sequence
  Synthetic
actagctatcaggtgccgggcacactgcaaacacaagacatgccggtgttaacacatcaagttatgtatgtccca

SEQ ID NO: 79629 - DNA, 75 bp, Artificial Sequence
  Synthetic
gaagggaatgcccctccgcgcatgtccatcccatacatgggaattggaaacgcatatagcagcttctatgatggg

SEQ ID NO: 79630 - DNA, 75 bp, Artificial Sequence
  Synthetic
ccatcccatacatgggaattggaaacgcatatagcagcttctatgatgggtggtcaaatttcaaccataccggag

SEQ ID NO: 79631 - DNA, 75 bp, Artificial Sequence
  Synthetic
tcaagagtaatgtgagggtgtacttcaaaccgaaacatgtcagcgcatgggtgccgcggcccccacgactgtgtg

SEQ ID NO: 79632 - DNA, 75 bp, Artificial Sequence
  Synthetic
caaaccgaaacatgtcagcgcatgggtgccgcggcccccacgactgtgtgcatataagaacaaaactaacgtgaa

SEQ ID NO: 79633 - DNA, 75 bp, Artificial Sequence
  Synthetic
tagttatggtgcatttggtcagcaatctggtgccgtgtatgtgggaaactacaggttggttaatagacatttggc

SEQ ID NO: 79634 - DNA, 75 bp, Artificial Sequence
  Synthetic
tctggtgccgtgtatgtgggaaactacaggttggttaatagacatttggcgacccacagcgactggcagaattgc

SEQ ID NO: 79635 - DNA, 75 bp, Artificial Sequence
  Synthetic
cagtgtaatacaggggtgtatttctgtcaatccagaaataaacattacccagttagctttgagggtccaggccta

SEQ ID NO: 79636 - DNA, 75 bp, Artificial Sequence
  Synthetic
gtcaatccagaaataaacattacccagttagctttgagggtccaggcctagtggaggtgcaagaaagtgaatact

SEQ ID NO: 79637 - DNA, 75 bp, Artificial Sequence
  Synthetic
ggtgtgaacacggagtcatcgggattgtcaccatgggtggagaaggtgtcgtggggtttgctgatgtgcgtgacc

SEQ ID NO: 79638 - DNA, 75 bp, Artificial Sequence
  Synthetic
tgtcaccatgggtggagaaggtgtcgtggggtttgctgatgtgcgtgacctcttgtggctggaagatgatgcaat

SEQ ID NO: 79639 - DNA, 75 bp, Artificial Sequence
  Synthetic
acaagtaaacctcctcaaggagtcgctggttggacaagactctatcctggagaagtctctcaaggctctagtcaa

SEQ ID NO: 79640 - DNA, 75 bp, Artificial Sequence
  Synthetic
ctggttggacaagactctatcctggagaagtctctcaaggctctagtcaagataatatcagctctagtcatcgtc

SEQ ID NO: 79641 - DNA, 75 bp, Artificial Sequence
  Synthetic
tggctcaagcagaaggtgtcgcagtattacgagatccccatggctgaaaggcaaaataacagctggctaaagaaa

SEQ ID NO: 79642 - DNA, 75 bp, Artificial Sequence
  Synthetic
attacgagatccccatggctgaaaggcaaaataacagctggctaaagaaattcacagaaatgaccaatgcctgca

SEQ ID NO: 79643 - DNA, 75 bp, Artificial Sequence
  Synthetic
gggaaaagcacgaattcttaattaggttgaaacagctacccttattggaaagtcagattgccaccatcgaacaaa

SEQ ID NO: 79644 - DNA, 75 bp, Artificial Sequence
  Synthetic
gtgctccttcgcagagtgaccaggaacaattgttctccaatgtccaatactttgcgcactactgtagaaagtatg

SEQ ID NO: 79645 - DNA, 75 bp, Artificial Sequence
  Synthetic
ccaaatgccgtattgaacctgtctgtttgctgctccatgggagccctggggctgggaagtctgtggcgactaact

SEQ ID NO: 79646 - DNA, 75 bp, Artificial Sequence
  Synthetic
gttataaacagcaggctgttgtgatcatggatgacttgtgccaaaacccggacgggaaagatgtgtccctatttt

SEQ ID NO: 79647 - DNA, 75 bp, Artificial Sequence
  Synthetic
catggatgacttgtgccaaaacccggacgggaaagatgtgtccctattttgtcaaatggtgtccagtgttgactt

SEQ ID NO: 79648 - DNA, 75 bp, Artificial Sequence
  Synthetic
agggtcaataaacgcccccacagtgtcagacagcagggcgcttgccaggagattccattttgacatgaatattga

SEQ ID NO: 79649 - DNA, 75 bp, Artificial Sequence
  Synthetic
tcagacagcagggcgcttgccaggagattccattttgacatgaatattgaggtcatctccatgtacagtcaaaac

SEQ ID NO: 79650 - DNA, 75 bp, Artificial Sequence
  Synthetic
ccattagtgtgcggtaaagccatccaattcatcgacaggaagacacaggtgaggtattcattagatatgcttgtg

SEQ ID NO: 79651 - DNA, 75 bp, Artificial Sequence
  Synthetic
aattcatcgacaggaagacacaggtgaggtattcattagatatgcttgtgactgaaatgtttagggaatacaacc

SEQ ID NO: 79652 - DNA, 75 bp, Artificial Sequence
  Synthetic
tcgcaccagaaacacctcccccaccagcaatagctgatttattaaaatctgttgacagcgaagctgtcagggagt

SEQ ID NO: 79653 - DNA, 75 bp, Artificial Sequence
  Synthetic
agcaatagctgatttattaaaatctgttgacagcgaagctgtcagggagtactgcaaagaaaaggggtggttggt

SEQ ID NO: 79654 - DNA, 75 bp, Artificial Sequence
  Synthetic
attcgtctctgtggcaggtataatatacatcatttacaagttgttcgccggcttccagggcgcttacaccgggat

SEQ ID NO: 79655 - DNA, 75 bp, Artificial Sequence
  Synthetic
tacatcatttacaagttgttcgccggcttccagggcgcttacaccgggatgcccaaccaaaaacccaaagtacca

SEQ ID NO: 79656 - DNA, 75 bp, Artificial Sequence
  Synthetic
gtgaaaactgaatatggtgagttcacaatgcttgggatctatgacaggtgggcagtactgccacggcacgccaga

SEQ ID NO: 79657 - DNA, 75 bp, Artificial Sequence
  Synthetic
caatgcttgggatctatgacaggtgggcagtactgccacggcacgccagaccaggacccactattctaatgaatg

SEQ ID NO: 79658 - DNA, 75 bp, Artificial Sequence
  Synthetic
aacttaacaggaatgagaagttcagggacatccgaggattcctgacacgcgaggaagccgaggtcaatgaggccg

SEQ ID NO: 79659 - DNA, 75 bp, Artificial Sequence
  Synthetic
ggacatccgaggattcctgacacgcgaggaagccgaggtcaatgaggccgtgctcgctattaacaccagcaaatt

SEQ ID NO: 79660 - DNA, 75 bp, Artificial Sequence
  Synthetic
catgctaatgtacaacttccccacccgtgcaggacagtgtggtggtgttctaatgtcaacgggcaaggtcctcgg

SEQ ID NO: 79661 - DNA, 75 bp, Artificial Sequence
  Synthetic
tgaaatcgagttcatcgaaaactccaaagaagctggtttcccagtcattaacactcctagtagtacgaaactcga

SEQ ID NO: 79662 - DNA, 75 bp, Artificial Sequence
  Synthetic
aaagaagctggtttcccagtcattaacactcctagtagtacgaaactcgagcccagtgtcttccaccacatcttt

SEQ ID NO: 79663 - DNA, 75 bp, Artificial Sequence
  Synthetic
tccaaatacatcggcaatgtaaacacccacgtggatgagtacatggtggaggctatcgaccactacgcaggtcag

SEQ ID NO: 79664 - DNA, 75 bp, Artificial Sequence
  Synthetic
cccacgtggatgagtacatggtggaggctatcgaccactacgcaggtcagttggcaaccctggatatcagcactg

SEQ ID NO: 79665 - DNA, 75 bp, Artificial Sequence
  Synthetic
acccttatgtggctcttggcattaagaagagggatattctgtcaaagaagaccaaggacctaacgaaactaaaag

SEQ ID NO: 79666 - DNA, 75 bp, Artificial Sequence
  Synthetic
gaagagggatattctgtcaaagaagaccaaggacctaacgaaactaaaagagtgcatggataaatatgggctgaa

SEQ ID NO: 79667 - DNA, 75 bp, Artificial Sequence
  Synthetic
tgaggcatcgagtttaaacgactcagtagccatgagacagacttttgggaacttgtataagacattccatctgaa

SEQ ID NO: 79668 - DNA, 75 bp, Artificial Sequence
  Synthetic
gtagccatgagacagacttttgggaacttgtataagacattccatctgaacccgggtatagtgacgggcagcgcg

SEQ ID NO: 79669 - DNA, 75 bp, Artificial Sequence
  Synthetic
agtgggtacgatgccagtttgagcccggtgtggtttgcttgcctgaaactgttgttagagaaactggggtattcg

SEQ ID NO: 79670 - DNA, 75 bp, Artificial Sequence
  Synthetic
cggtgtggtttgcttgcctgaaactgttgttagagaaactggggtattcgcacaaagaaactaactatattgatt

SEQ ID NO: 79671 - DNA, 75 bp, Artificial Sequence
  Synthetic
gaaccagcatctttaattcgatgatcaacaacataatcatcagaacattgatgttgaaagtgtacaaggggatag

SEQ ID NO: 79672 - DNA, 75 bp, Artificial Sequence
  Synthetic
caacaacataatcatcagaacattgatgttgaaagtgtacaaggggatagatctggatcaattcaggatgatagc

SEQ ID NO: 79673 - DNA, 75 bp, Artificial Sequence
  Synthetic
tgggttgatcatgacgccagctgataagggggagtacttcaatgaagtgacatggaccaacgttaccttcttgaa

SEQ ID NO: 79674 - DNA, 75 bp, Artificial Sequence
  Synthetic
aagggggagtacttcaatgaagtgacatggaccaacgttaccttcttgaaaagatacttcagagcagatgaacag

SEQ ID NO: 79675 - DNA, 75 bp, Artificial Sequence
  Synthetic
aatactcaggatcacgtgcgatccttgtgcctattggcatggcacaatggagagcaggagtatgaagaatttgta

SEQ ID NO: 79676 - DNA, 75 bp, Artificial Sequence
  Synthetic
aacagagcaattgtttatctatttgttggtttcataccattaaattttaaagtcttgagaaccattaacttgatt

SEQ ID NO: 79677 - DNA, 75 bp, Artificial Sequence
  Synthetic
ccagtgggaattcggtcatccactacaccaacattaattactacaaggatgcagcttcgaactcagcaaacagac

SEQ ID NO: 79678 - DNA, 75 bp, Artificial Sequence
  Synthetic
caccaacattaattactacaaggatgcagcttcgaactcagcaaacagacaagactttacacaagacccgggaaa

SEQ ID NO: 79679 - DNA, 75 bp, Artificial Sequence
  Synthetic
ctatagtgatagggtgagatccatcaccttaggcaattcaaccataacaactcaagaatgtgcaaatgtggtagt

SEQ ID NO: 79680 - DNA, 75 bp, Artificial Sequence
  Synthetic
accttaggcaattcaaccataacaactcaagaatgtgcaaatgtggtagtggggtatggggtatggccaacttat

SEQ ID NO: 79681 - DNA, 75 bp, Artificial Sequence
  Synthetic
gaatccgtgatgtggcaacaaagttcaccaggttggtggtggaaattcccagacgcattgtccaacatggggcta

SEQ ID NO: 79682 - DNA, 75 bp, Artificial Sequence
  Synthetic
caccaggttggtggtggaaattcccagacgcattgtccaacatggggctattcgggcaaaacatgcagtaccatt

SEQ ID NO: 79683 - DNA, 75 bp, Artificial Sequence
  Synthetic
tgtgtgtgcctgaggcagaaatggggtgtgccacgttagccaataagcctgaccagaagagtttgagcaatgggg

SEQ ID NO: 79684 - DNA, 75 bp, Artificial Sequence
  Synthetic
gtgtgccacgttagccaataagcctgaccagaagagtttgagcaatggggaaacagctaacatgtttgagtctca

SEQ ID NO: 79685 - DNA, 75 bp, Artificial Sequence
  Synthetic
cattttccctcaccagtggatcaacctgcgtactaacaacagcgcaacaattgtcatgccatacataaatagtgt

SEQ ID NO: 79686 - DNA, 75 bp, Artificial Sequence
  Synthetic
ctgcgtactaacaacagcgcaacaattgtcatgccatacataaatagtgtaccaatggacaatatgttcagacat

SEQ ID NO: 79687 - DNA, 75 bp, Artificial Sequence
  Synthetic
acagtaacggtggcgccaatgtgtgctgagtacaatgggttgcgattggctggcaaacaaggtctaccaacaatg

SEQ ID NO: 79688 - DNA, 75 bp, Artificial Sequence
  Synthetic
ctgagtacaatgggttgcgattggctggcaaacaaggtctaccaacaatgttgacgcccgggagcaatcagtttc

SEQ ID NO: 79689 - DNA, 75 bp, Artificial Sequence
  Synthetic
aagtcaacaatttgatggagattgcggaggtggactcagtggtgcccgtcaacaacacagaaggaaaagtaatgt

SEQ ID NO: 79690 - DNA, 75 bp, Artificial Sequence
  Synthetic
ggaggtggactcagtggtgcccgtcaacaacacagaaggaaaagtaatgtcaattgaggcataccagatacccgt

SEQ ID NO: 79691 - DNA, 75 bp, Artificial Sequence
  Synthetic
gactttgttgggagaagtcttaaattactacacgcactggtcgggcagcattaaactaacattcatgttttgtgg

SEQ ID NO: 79692 - DNA, 75 bp, Artificial Sequence
  Synthetic
tactacacgcactggtcgggcagcattaaactaacattcatgttttgtgggtcagcaatggccactgggaaattt

SEQ ID NO: 79693 - DNA, 75 bp, Artificial Sequence
  Synthetic
tgggatgtaggtttacagtcgagctgtgtgttgtgcataccatggattagccaaacccattacaggtatgtggtg

SEQ ID NO: 79694 - DNA, 75 bp, Artificial Sequence
  Synthetic
gtgtgttgtgcataccatggattagccaaacccattacaggtatgtggtgatggatgaatacactgctggagggt

SEQ ID NO: 79695 - DNA, 75 bp, Artificial Sequence
  Synthetic
tgtcagcgtgcaacgacttttcagtcaggatgctcaaagacacaccctttataaaacaagaaaatttcttccagg

SEQ ID NO: 79696 - DNA, 75 bp, Artificial Sequence
  Synthetic
caggatgctcaaagacacaccctttataaaacaagaaaatttcttccaggggcccccaggggaggcaatagaaag

SEQ ID NO: 79697 - DNA, 75 bp, Artificial Sequence
  Synthetic
ggaaacagggcatacgtcacaggtcgtgccgtctgacacaatgcaaactaggcatgtgaagaactatcactctag

SEQ ID NO: 79698 - DNA, 75 bp, Artificial Sequence
  Synthetic
gtgccgtctgacacaatgcaaactaggcatgtgaagaactatcactctagatcagaatcgacagtggagaatttt

SEQ ID NO: 79699 - DNA, 75 bp, Artificial Sequence
  Synthetic
gtgatcagcacacggcatgtcgcccagctgcgccgaaagctcgaaatgttcacatatgcaagatttgatctagag

SEQ ID NO: 79700 - DNA, 75 bp, Artificial Sequence
  Synthetic
agctgcgccgaaagctcgaaatgttcacatatgcaagatttgatctagagttgacctttgtgatcacgagcaccc

SEQ ID NO: 79701 - DNA, 75 bp, Artificial Sequence
  Synthetic
cagtgcctacaaaagtgaacagttacagctggcagacatctactaacccgagtgtgttttggacagaagggagtg

SEQ ID NO: 79702 - DNA, 75 bp, Artificial Sequence
  Synthetic
cagctggcagacatctactaacccgagtgtgttttggacagaagggagtgcaccgcctcggatgtcaataccatt

SEQ ID NO: 79703 - DNA, 75 bp, Artificial Sequence
  Synthetic
caatacactaaacaatatgggaacactatatatgagacatgtgaacgatggaagccctggacctattgtaagcac

SEQ ID NO: 79704 - DNA, 75 bp, Artificial Sequence
  Synthetic
ctatatatgagacatgtgaacgatggaagccctggacctattgtaagcacagtacggatttacttcaaaccaaaa

SEQ ID NO: 79705 - DNA, 75 bp, Artificial Sequence
  Synthetic
accggtgtaactgagggtaggacagacataacaactatgcaaaccactggcgcttttgggcagcaatccggagcg

SEQ ID NO: 79706 - DNA, 75 bp, Artificial Sequence
  Synthetic
acataacaactatgcaaaccactggcgcttttgggcagcaatccggagcggcgtatgtggggaactatagggtgg

SEQ ID NO: 79707 - DNA, 75 bp, Artificial Sequence
  Synthetic
gtaccacaacagcgcatggatgtgacactatcgctaggtgtcaatgcaccactggagtatacttttgtgcttcca

SEQ ID NO: 79708 - DNA, 75 bp, Artificial Sequence
  Synthetic
cactatcgctaggtgtcaatgcaccactggagtatacttttgtgcttccaggaacaaacattacccggtgagctt

SEQ ID NO: 79709 - DNA, 75 bp, Artificial Sequence
  Synthetic
aacaggtttctctgaaccaggagactgtggtggtatccttaggtgtgaacacggtgtcatcggacttgtcactat

SEQ ID NO: 79710 - DNA, 75 bp, Artificial Sequence
  Synthetic
tgtggtggtatccttaggtgtgaacacggtgtcatcggacttgtcactatgggaggcgatggtatggtcggattt

SEQ ID NO: 79711 - DNA, 75 bp, Artificial Sequence
  Synthetic
ggaaacgcctttggctctggcttcaccaaccagatttgtgagcaagtcaacctcctaaaggagtcgctggtgggc

SEQ ID NO: 79712 - DNA, 75 bp, Artificial Sequence
  Synthetic
ccaaccagatttgtgagcaagtcaacctcctaaaggagtcgctggtgggccaggattccatcttggaaaagtccc

SEQ ID NO: 79713 - DNA, 75 bp, Artificial Sequence
  Synthetic
ccacccttgccctcatcggctgtactacatcaccatggcgctggctcaagcaaaaagtgtcgcagtactatggaa

SEQ ID NO: 79714 - DNA, 75 bp, Artificial Sequence
  Synthetic
tacatcaccatggcgctggctcaagcaaaaagtgtcgcagtactatggaatacccatggccgagcgccagaataa

SEQ ID NO: 79715 - DNA, 75 bp, Artificial Sequence
  Synthetic
atttatagagtggctcaaagtcaaaatcctaccagaagtgaaggagaagcatgaattcttggccaggcttaagca

SEQ ID NO: 79716 - DNA, 75 bp, Artificial Sequence
  Synthetic
accaccattgagcaaagtgcgccatcccagagtgaccaggagcagcttttctcaaacgtccagtactttgcccat

SEQ ID NO: 79717 - DNA, 75 bp, Artificial Sequence
  Synthetic
tacatacaattcaagtccaaatgccgtattgaacctgtatgcttgcttctgcatggaagtcctggagctggaaaa

SEQ ID NO: 79718 - DNA, 75 bp, Artificial Sequence
  Synthetic
ccagatcattttgatggttacaagcaacaagccgtcgtgattatggatgacctatgccaaaatccagatggcagg

SEQ ID NO: 79719 - DNA, 75 bp, Artificial Sequence
  Synthetic
cctatgccaaaatccagatggcagggacgtgtccttattctgtcaaatggtgtccagtgtagattttgtaccgcc

SEQ ID NO: 79720 - DNA, 75 bp, Artificial Sequence
  Synthetic
caatgcgccgacagtgtcagacagccgggctttagctagaaggttccattttgacatgaatattgaagtcatctc

SEQ ID NO: 79721 - DNA, 75 bp, Artificial Sequence
  Synthetic
ttgacatgaatattgaagtcatctcgatgtacagccagaatggtaagatcaacatgcccatgtcggtgaaaacgt

SEQ ID NO: 79722 - DNA, 75 bp, Artificial Sequence
  Synthetic
aaactcccccaccaccagcaattgcagatctactaaaatcagtggatagtgaagcggtcagggagtattgcaaag

SEQ ID NO: 79723 - DNA, 75 bp, Artificial Sequence
  Synthetic
caagccaaagtacagggccctgcttttgaatttgcagtggctatgatgaaaagaaactccagcaccgtgaagaca

SEQ ID NO: 79724 - DNA, 75 bp, Artificial Sequence
  Synthetic
ttggtgtgttggatgcaaaagaactggtggataaagatggcacaaatctcgaactgacactgctaaagcttaacc

SEQ ID NO: 79725 - DNA, 75 bp, Artificial Sequence
  Synthetic
taaataccagcaagtttccaaacatgtacattcctgtagggcaggtcacagactacggtttcttaaacttgggtg

SEQ ID NO: 79726 - DNA, 75 bp, Artificial Sequence
  Synthetic
gtacattcctgtagggcaggtcacagactacggtttcttaaacttgggtggcacccccacaagaagaatgcttat

SEQ ID NO: 79727 - DNA, 75 bp, Artificial Sequence
  Synthetic
tggtgggaatggccaccagggcttctcagcagccctcctcaaacactacttcaacgatgagcaaggtgaaattga

SEQ ID NO: 79728 - DNA, 75 bp, Artificial Sequence
  Synthetic
tcagcagccctcctcaaacactacttcaacgatgagcaaggtgaaattgaattcattgaaagctcaaaggatgca

SEQ ID NO: 79729 - DNA, 75 bp, Artificial Sequence
  Synthetic
aaggaaccagcagtcctcagaaatggggatccgaggctcaaagtcaacttcgaggaagcgattttctccaaatac

SEQ ID NO: 79730 - DNA, 75 bp, Artificial Sequence
  Synthetic
gggatccgaggctcaaagtcaacttcgaggaagcgattttctccaaatacattggcaatgtcaacacacatgtag

SEQ ID NO: 79731 - DNA, 75 bp, Artificial Sequence
  Synthetic
agctagaagatgcagtgtatggcacagagggattggaagcacttgatctgaccaccagtgcaggttacccttatg

SEQ ID NO: 79732 - DNA, 75 bp, Artificial Sequence
  Synthetic
agagggattggaagcacttgatctgaccaccagtgcaggttacccttatgtagccctgggcatcaagaaaagaga

SEQ ID NO: 79733 - DNA, 75 bp, Artificial Sequence
  Synthetic
ggttacctatgtcaaggatgagttgaggtctgctgagaaagtggctaaagggaaatctagactcatcgaggcttc

SEQ ID NO: 79734 - DNA, 75 bp, Artificial Sequence
  Synthetic
aggtctgctgagaaagtggctaaagggaaatctagactcatcgaggcttccagtctcaacgactcagtggcaatg

SEQ ID NO: 79735 - DNA, 75 bp, Artificial Sequence
  Synthetic
gatccggatacgttttggagcaagattcctgttatgctcgatggacatctcatagcctttgactattcaagttat

SEQ ID NO: 79736 - DNA, 75 bp, Artificial Sequence
  Synthetic
ttcctgttatgctcgatggacatctcatagcctttgactattcaagttatgacgccagcctcagcccagtgtggt

SEQ ID NO: 79737 - DNA, 75 bp, Artificial Sequence
  Synthetic
attctcaccacctgtacagagacaaacattactttgtacgcggtggtatgccttcaggatgttctggtaccagta

SEQ ID NO: 79738 - DNA, 75 bp, Artificial Sequence
  Synthetic
gtgtacaaaggcattgacttagatcagttcagaatgattgcatatggtgatgatgtgattgcttcatatccatgg

SEQ ID NO: 79739 - DNA, 75 bp, Artificial Sequence
  Synthetic
tgctttaatgaggtcacctggaccaatgtcacctttctaaagaggtatttcagagcagatgagcaataccctttc

SEQ ID NO: 79740 - DNA, 75 bp, Artificial Sequence
  Synthetic
atgtcacctttctaaagaggtatttcagagcagatgagcaataccctttcttggttcatccggtcatgcctatga

SEQ ID NO: 79741 - DNA, 75 bp, Artificial Sequence
  Synthetic
tggcctggcacaatggggagcacgaatatgaagagttcatccacaagatcaggagcgtcccagtcgggcgctgtt

SEQ ID NO: 79742 - DNA, 75 bp, Artificial Sequence
  Synthetic
taaattagagtcaatttggtacaatttgaattggcttaaccctaccgcacttaccgaactagatagcggtgcggc

SEQ ID NO: 79743 - DNA, 75 bp, Artificial Sequence
  Synthetic
ttaaaacagcctgtgggttgttcccacccgcagggcccacggggcgctagcacactggtattaaggtacccttgt

SEQ ID NO: 79744 - DNA, 75 bp, Artificial Sequence
  Synthetic
cacactggtattaaggtacccttgtgcgcctgttttatacacccctccccctaatgtaacttagaagcatgactt

SEQ ID NO: 79745 - DNA, 75 bp, Artificial Sequence
  Synthetic
ctaatgtaacttagaagcatgacttaagtggtcaatagatagctcagtaatccaactgagttccgaccaagtact

SEQ ID NO: 79746 - DNA, 75 bp, Artificial Sequence
  Synthetic
cctgcccatggggcaacccatgggacgcttcaatactgacatggtgtgaagagtctattgagctggatggtatcc

SEQ ID NO: 79747 - DNA, 75 bp, Artificial Sequence
  Synthetic
gtaactctgcagcggaaccgactactttgggtgtccgtgtttccttttatccttatatcggctgcttatggtgtc

SEQ ID NO: 79748 - DNA, 75 bp, Artificial Sequence
  Synthetic
tttgggtgtccgtgtttccttttatccttatatcggctgcttatggtgtcaattgaaagattgttaccatatagc

SEQ ID NO: 79749 - DNA, 75 bp, Artificial Sequence
  Synthetic
gtattgaacacccttaatttcattttaacactcaacacaacaaaatgggggctcaggtatcaacacagaaaactg

SEQ ID NO: 79750 - DNA, 75 bp, Artificial Sequence
  Synthetic
taacactcaacacaacaaaatgggggctcaggtatcaacacagaaaactggggctcacgagactggcttgaacgc

SEQ ID NO: 79751 - DNA, 75 bp, Artificial Sequence
  Synthetic
agacttcactcaggacccaagtaagttcacagaaccagtgaaagatgttatgattaaatcactcccagccctgaa

SEQ ID NO: 79752 - DNA, 75 bp, Artificial Sequence
  Synthetic
ttcacagaaccagtgaaagatgttatgattaaatcactcccagccctgaactcaccaactgtggaggaatgtggg

SEQ ID NO: 79753 - DNA, 75 bp, Artificial Sequence
  Synthetic
gggtatggagtgtggcccacatacttgagagatgaagaggctacagcggaagatcaacccacacaaccagacgaa

SEQ ID NO: 79754 - DNA, 75 bp, Artificial Sequence
  Synthetic
tgagagatgaagaggctacagcggaagatcaacccacacaaccagacgaagccacatgtcgcttttacactctgg

SEQ ID NO: 79755 - DNA, 75 bp, Artificial Sequence
  Synthetic
ttgggcagaacatgttttatcattacttaggtaggtctggatacacaatacatgtgcagtgcaatgcctccaaat

SEQ ID NO: 79756 - DNA, 75 bp, Artificial Sequence
  Synthetic
cttaggtaggtctggatacacaatacatgtgcagtgcaatgcctccaaatttcaccagggttgtatcttagttgt

SEQ ID NO: 79757 - DNA, 75 bp, Artificial Sequence
  Synthetic
catcgccaaagagttcacagaagcttccgtttccacgtcacacggggtgcagacggcggtgcataatgctgcaat

SEQ ID NO: 79758 - DNA, 75 bp, Artificial Sequence
  Synthetic
tccgtttccacgtcacacggggtgcagacggcggtgcataatgctgcaatgggagttgctgcaggcaatttgaca

SEQ ID NO: 79759 - DNA, 75 bp, Artificial Sequence
  Synthetic
ccaatggacaacatgttcaggcatcaaaactttaccctcatggtgattccgtttgtgccattagactatgcagag

SEQ ID NO: 79760 - DNA, 75 bp, Artificial Sequence
  Synthetic
aaaactttaccctcatggtgattccgtttgtgccattagactatgcagagggcgcatcgccatacgtgcccataa

SEQ ID NO: 79761 - DNA, 75 bp, Artificial Sequence
  Synthetic
acacgccaggaagcacccaattcctaacgtctgatgacttccaatcaccatcggcgatgccccagttcgacgtga

SEQ ID NO: 79762 - DNA, 75 bp, Artificial Sequence
  Synthetic
aacgtctgatgacttccaatcaccatcggcgatgccccagttcgacgtgacgccagcgatgcacattcctggtga

SEQ ID NO: 79763 - DNA, 75 bp, Artificial Sequence
  Synthetic
catggacgcatacagagttgagattaccaacagtaccacagcagggacgcaagtgttcgggttccagttaaaccc

SEQ ID NO: 79764 - DNA, 75 bp, Artificial Sequence
  Synthetic
accaacagtaccacagcagggacgcaagtgttcgggttccagttaaacccaggctcaggcacggtcttccagaga

SEQ ID NO: 79765 - DNA, 75 bp, Artificial Sequence
  Synthetic
tcagcgatggcaactgggaagttcttgttagcatactccccaccaggggctggggccccagactcgaggaagagc

SEQ ID NO: 79766 - DNA, 75 bp, Artificial Sequence
  Synthetic
tgttagcatactccccaccaggggctggggccccagactcgaggaagagcgccatgttggggacacacgtcgtgt

SEQ ID NO: 79767 - DNA, 75 bp, Artificial Sequence
  Synthetic
atgatccctattctaatgcaggatacgtgacctgttggtatcaaactagtgtggtagctccagccagcacacaga

SEQ ID NO: 79768 - DNA, 75 bp, Artificial Sequence
  Synthetic
cgtgacctgttggtatcaaactagtgtggtagctccagccagcacacagaacaagtgctatattatgtgcatggt

SEQ ID NO: 79769 - DNA, 75 bp, Artificial Sequence
  Synthetic
ggacgtgcatgacgccgtggttggagccatgacacgtgtcgccgacaccattagtagcgggcccagcaattcaga

SEQ ID NO: 79770 - DNA, 75 bp, Artificial Sequence
  Synthetic
gccatgacacgtgtcgccgacaccattagtagcgggcccagcaattcagagagtgtaccggccttgacagcggct

SEQ ID NO: 79771 - DNA, 75 bp, Artificial Sequence
  Synthetic
tcagaatcatccattgagaatttcatgagtcggtctgcgtgtgtttattacaccaagtataagacaaaagatacg

SEQ ID NO: 79772 - DNA, 75 bp, Artificial Sequence
  Synthetic
tgagtcggtctgcgtgtgtttattacaccaagtataagacaaaagatacggacccatcagaaatgtactccagtt

SEQ ID NO: 79773 - DNA, 75 bp, Artificial Sequence
  Synthetic
aggttacgtttgtgattactagttcgcaagatcaatccacaagtgtagcccaggatgccccagtcttaacacatc

SEQ ID NO: 79774 - DNA, 75 bp, Artificial Sequence
  Synthetic
gcaagatcaatccacaagtgtagcccaggatgccccagtcttaacacatcaaataatgtacataccacctggagg

SEQ ID NO: 79775 - DNA, 75 bp, Artificial Sequence
  Synthetic
tgcaccaccacgaatgtctatccccttcattagtattggaggggcctacagctctttctacgatggatggtctca

SEQ ID NO: 79776 - DNA, 75 bp, Artificial Sequence
  Synthetic
ttcattagtattggaggggcctacagctctttctacgatggatggtctcacttcaatcaacaaggcccatatgga

SEQ ID NO: 79777 - DNA, 75 bp, Artificial Sequence
  Synthetic
tatgtcaggatatacttcaagcccaagcacgtcagagcatgggttcccagaccaccaaggttatgccagtatgag

SEQ ID NO: 79778 - DNA, 75 bp, Artificial Sequence
  Synthetic
agcacgtcagagcatgggttcccagaccaccaaggttatgccagtatgagaaacaaggaagtgtcgactttaaag

SEQ ID NO: 79779 - DNA, 75 bp, Artificial Sequence
  Synthetic
taggcaattacagggtggtcaacaggcatttagccacaccctctgactggcagaattgcgtgtgggaggattaca

SEQ ID NO: 79780 - DNA, 75 bp, Artificial Sequence
  Synthetic
cagaattgcgtgtgggaggattacaacagggaccttcttgtaagtactactactgcacacggatgtgacaccata

SEQ ID NO: 79781 - DNA, 75 bp, Artificial Sequence
  Synthetic
gtgagtactaccctaagaggtaccaatcccatgtgctgcttgctgcgggtttttcagagccaggtgattgtgggg

SEQ ID NO: 79782 - DNA, 75 bp, Artificial Sequence
  Synthetic
ttcgcgatcttctgtggctggaggatgatgccatggagcagggcgtcagaaactacgtggagcaacttggaaatg

SEQ ID NO: 79783 - DNA, 75 bp, Artificial Sequence
  Synthetic
tgatgccatggagcagggcgtcagaaactacgtggagcaacttggaaatgcttttggatccggcttcaccaatca

SEQ ID NO: 79784 - DNA, 75 bp, Artificial Sequence
  Synthetic
cctagtaaagatcatatcagcactggtgatcgtagtgcgaaaccatgacgatttaatcacagtgacggctacgct

SEQ ID NO: 79785 - DNA, 75 bp, Artificial Sequence
  Synthetic
gtgatcgtagtgcgaaaccatgacgatttaatcacagtgacggctacgctagccctcataggatgctcctcatcg

SEQ ID NO: 79786 - DNA, 75 bp, Artificial Sequence
  Synthetic
ctcaagaagtttacagagatgaccaacgcctgcaagggcatggaatggatcgcagtcaaaattcaaaaatttata

SEQ ID NO: 79787 - DNA, 75 bp, Artificial Sequence
  Synthetic
ctgctggagagtcaaattgccactatagaacagagtgcgccctcacagagtgatcaagagcaattattttccaat

SEQ ID NO: 79788 - DNA, 75 bp, Artificial Sequence
  Synthetic
tagaacagagtgcgccctcacagagtgatcaagagcaattattttccaatgttcagtattttgcacattactgca

SEQ ID NO: 79789 - DNA, 75 bp, Artificial Sequence
  Synthetic
acctgtctgcttgttgctccacggaagccccggtgctggaaaatcagtggcaacaaacctaatcgggcgctccct

SEQ ID NO: 79790 - DNA, 75 bp, Artificial Sequence
  Synthetic
tgttgtgatcatggatgacctgtgtcaaaatccagatgggaaggacgtgtcgttgttctgccaaatggtgtctag

SEQ ID NO: 79791 - DNA, 75 bp, Artificial Sequence
  Synthetic
caaaatccagatgggaaggacgtgtcgttgttctgccaaatggtgtctagtgtcgactttgtccctcctatggcg

SEQ ID NO: 79792 - DNA, 75 bp, Artificial Sequence
  Synthetic
cccaccgtgtcagacagtagagctctcgcaagaaggttccactttgatatgaacatcgaggtcatttcaatgtac

SEQ ID NO: 79793 - DNA, 75 bp, Artificial Sequence
  Synthetic
gaacatcgaggtcatttcaatgtacagtcagaacggtaagattaacatgccaatgtcagtgaaggcgtgtgatga

SEQ ID NO: 79794 - DNA, 75 bp, Artificial Sequence
  Synthetic
aacacaggtgaggtattcgttggacatgctcgtgactgagatgttcagagagtacaaccacaggcacagcgtggg

SEQ ID NO: 79795 - DNA, 75 bp, Artificial Sequence
  Synthetic
agtacaaccacaggcacagcgtgggggcaacgctcgaggcactttttcaaggcccgcccgtgtacagggaaatta

SEQ ID NO: 79796 - DNA, 75 bp, Artificial Sequence
  Synthetic
ttagggagtactgcaaagaaaagggatggttggtgcccgaaattaactctgccttgcaaattgagaagcatgtga

SEQ ID NO: 79797 - DNA, 75 bp, Artificial Sequence
  Synthetic
actcactacttttgtctccgtggcggggattatatacatcatctataagttgtttgctggtttccaaggagctta

SEQ ID NO: 79798 - DNA, 75 bp, Artificial Sequence
  Synthetic
tgcagtggccatgatgaaaaggaatgccagcactgttaaaactgagtatggcgagttcacaatgcttggtattta

SEQ ID NO: 79799 - DNA, 75 bp, Artificial Sequence
  Synthetic
gccagcactgttaaaactgagtatggcgagttcacaatgcttggtatttatgacagatgggcagtgttacctcgg

SEQ ID NO: 79800 - DNA, 75 bp, Artificial Sequence
  Synthetic
aaagatggaaccaacttggaactgacacttctgaaactcagtaggaacgagaagtttagagacatccggggcttc

SEQ ID NO: 79801 - DNA, 75 bp, Artificial Sequence
  Synthetic
cacttctgaaactcagtaggaacgagaagtttagagacatccggggcttcctggcaagggaagaggccgaagtta

SEQ ID NO: 79802 - DNA, 75 bp, Artificial Sequence
  Synthetic
gctttctcaacttgggagggacccccaccaaacgcatgctaatgtacaacttccctactcgtgcagggcagtgtg

SEQ ID NO: 79803 - DNA, 75 bp, Artificial Sequence
  Synthetic
caccaaacgcatgctaatgtacaacttccctactcgtgcagggcagtgtggtggtgttctgatgtctacaggcaa

SEQ ID NO: 79804 - DNA, 75 bp, Artificial Sequence
  Synthetic
tgaacagggtgaaattgagttcatcgagagttccaaggaagctggcttccctatcataaataccccaagcaaaac

SEQ ID NO: 79805 - DNA, 75 bp, Artificial Sequence
  Synthetic
gagagttccaaggaagctggcttccctatcataaataccccaagcaaaacgaagcttgagcccagtgttttccac

SEQ ID NO: 79806 - DNA, 75 bp, Artificial Sequence
  Synthetic
gccatcttctccaagtatattggaaatgtgaacacacatgttgatgagtacatgatggaagctattgatcactac

SEQ ID NO: 79807 - DNA, 75 bp, Artificial Sequence
  Synthetic
atgtgaacacacatgttgatgagtacatgatggaagctattgatcactacgctgggcagctggcaactttggaca

SEQ ID NO: 79808 - DNA, 75 bp, Artificial Sequence
  Synthetic
gtgcagggtatccctatgttgcccttggtataaaaaagagagacattttatccaagaagaccaaagacttggcga

SEQ ID NO: 79809 - DNA, 75 bp, Artificial Sequence
  Synthetic
tggtataaaaaagagagacattttatccaagaagaccaaagacttggcgaagctgaatgagtgcatggataaata

SEQ ID NO: 79810 - DNA, 75 bp, Artificial Sequence
  Synthetic
cagactgattgaagcatcgagcctaaatgattcagtggctatgagacagactttcgggaacctgtacaaaacatt

SEQ ID NO: 79811 - DNA, 75 bp, Artificial Sequence
  Synthetic
aatgattcagtggctatgagacagactttcgggaacctgtacaaaacattccacctaaacccgggtatagtgaca

SEQ ID NO: 79812 - DNA, 75 bp, Artificial Sequence
  Synthetic
tttgactacagtggatatgatgccagtctgagtccggtgtggttcgcttgtctgaagctgttgttggagaaactg

SEQ ID NO: 79813 - DNA, 75 bp, Artificial Sequence
  Synthetic
gtctgagtccggtgtggttcgcttgtctgaagctgttgttggagaaactggggtactcacacaaagaaaccaatt

SEQ ID NO: 79814 - DNA, 75 bp, Artificial Sequence
  Synthetic
ggtgctctgggaccagcatcttcaactcaatgattaacaatataatcatcagaacactaatcttaaaggtgtaca

SEQ ID NO: 79815 - DNA, 75 bp, Artificial Sequence
  Synthetic
ctcaatgattaacaatataatcatcagaacactaatcttaaaggtgtacaaagggatagacctagaccagtttag

SEQ ID NO: 79816 - DNA, 75 bp, Artificial Sequence
  Synthetic
caaggggtatggtttgatcatgacaccagcagacaagggggagtgctttaatgaagtgacgtggtccaacgtcac

SEQ ID NO: 79817 - DNA, 75 bp, Artificial Sequence
  Synthetic
ccagcagacaagggggagtgctttaatgaagtgacgtggtccaacgtcacttttctgaaaagatacttcagagca

SEQ ID NO: 79818 - DNA, 75 bp, Artificial Sequence
  Synthetic
gatcccaaaaacacccaggaccatgtgcgatccttatgcttattggcttggcacaatggagagcaggaatacgaa

SEQ ID NO: 79819 - DNA, 75 bp, Artificial Sequence
  Synthetic
aagtggctagattctttttaaaaattagagtacaatttgatacaattccaattgacttaaccctaccacacttac

SEQ ID NO: 79820 - DNA, 75 bp, Artificial Sequence
  Synthetic
tagagtacaatttgatacaattccaattgacttaaccctaccacacttaccgaactagacaacggtgtggtaggg

SEQ ID NO: 79821 - DNA, 75 bp, Artificial Sequence
  Synthetic
tgatcccacccatagggcccactgggcgccagcacactggtattacggtacctttgtgcgcctgttttatctacc

SEQ ID NO: 79822 - DNA, 75 bp, Artificial Sequence
  Synthetic
ctactttgggtgtccgtgtttccttttattcttatactggctgcttatggtgacaattgaaagattgttgccata

SEQ ID NO: 79823 - DNA, 75 bp, Artificial Sequence
  Synthetic
atattggtactcaactcagcaaaatgggagctcaggtatcaactcaaaagaccggagcgcacgagactggcctaa

SEQ ID NO: 79824 - DNA, 75 bp, Artificial Sequence
  Synthetic
gggagctcaggtatcaactcaaaagaccggagcgcacgagactggcctaaacgccagcgggaactccatcatcca

SEQ ID NO: 79825 - DNA, 75 bp, Artificial Sequence
  Synthetic
taaatttacagagccagtaaaagatgtgatgattaaatctctaccagctttgaactctccaacagttgaggagtg

SEQ ID NO: 79826 - DNA, 75 bp, Artificial Sequence
  Synthetic
gtgatgattaaatctctaccagctttgaactctccaacagttgaggagtgtgggtatagcgacagggtccgctca

SEQ ID NO: 79827 - DNA, 75 bp, Artificial Sequence
  Synthetic
tatctcaaggacgacgaggcagtgtcagaagatcaacccacacaacccgatgtagccacttgcagattctacaca

SEQ ID NO: 79828 - DNA, 75 bp, Artificial Sequence
  Synthetic
cagaagatcaacccacacaacccgatgtagccacttgcagattctacacattggagtctgtggtatggcagaagg

SEQ ID NO: 79829 - DNA, 75 bp, Artificial Sequence
  Synthetic
attaccttgggcgatccgggtacaccatacacgtgcagtgcaatgcctcgcggttccaccagggatgcctgctag

SEQ ID NO: 79830 - DNA, 75 bp, Artificial Sequence
  Synthetic
catacacgtgcagtgcaatgcctcgcggttccaccagggatgcctgctagtggtctgtgtgcctgaggcagaaat

SEQ ID NO: 79831 - DNA, 75 bp, Artificial Sequence
  Synthetic
ggctccaactactggctctaacgacgtgcaagcggccgcacacaatgcagggatgggcgtggctgccggtaattt

SEQ ID NO: 79832 - DNA, 75 bp, Artificial Sequence
  Synthetic
gtgcaagcggccgcacacaatgcagggatgggcgtggctgccggtaatttgaccatattcccacatcaatggatc

SEQ ID NO: 79833 - DNA, 75 bp, Artificial Sequence
  Synthetic
cactacaacttcactcttatgattattccatttgtaccactagactacagtgacggggcttctacatacgtcccc

SEQ ID NO: 79834 - DNA, 75 bp, Artificial Sequence
  Synthetic
ttccatttgtaccactagactacagtgacggggcttctacatacgtccccattacaatcaccatcgcaccgatgg

SEQ ID NO: 79835 - DNA, 75 bp, Artificial Sequence
  Synthetic
tcctcacatccgatgatttccagtcgccatcagcgatgcctcagttcgatgtaacgcctgagctgaacataccag

SEQ ID NO: 79836 - DNA, 75 bp, Artificial Sequence
  Synthetic
gccatcagcgatgcctcagttcgatgtaacgcctgagctgaacataccaggtcaggtgaagaatttgatggaaat

SEQ ID NO: 79837 - DNA, 75 bp, Artificial Sequence
  Synthetic
ggtggcatcaatgacaaactcagggcagcaagtgtttggatttcagttacaacctggctcgagttcggtgctaat

SEQ ID NO: 79838 - DNA, 75 bp, Artificial Sequence
  Synthetic
cagcaagtgtttggatttcagttacaacctggctcgagttcggtgctaatgaggacactgctgggggaaatctta

SEQ ID NO: 79839 - DNA, 75 bp, Artificial Sequence
  Synthetic
ttcctcttggcgtattcaccccctggtgctggcaagcctaaggatcgcaaggatgctatgttggggacgcatgtc

SEQ ID NO: 79840 - DNA, 75 bp, Artificial Sequence
  Synthetic
gtgctggcaagcctaaggatcgcaaggatgctatgttggggacgcatgtcatctgggatgtagggttgcagtcaa

SEQ ID NO: 79841 - DNA, 75 bp, Artificial Sequence
  Synthetic
ggtttataacctgctggtaccaaactagcattgtaaccccgcctgccactcagagcaaatgcttcattatgtgca

SEQ ID NO: 79842 - DNA, 75 bp, Artificial Sequence
  Synthetic
tagcattgtaaccccgcctgccactcagagcaaatgcttcattatgtgcatggtgtcggcgtgcaatgacttttc

SEQ ID NO: 79843 - DNA, 75 bp, Artificial Sequence
  Synthetic
tggggcgatgacccgtgtggccgacacggtggccagcgggcctgcaaactccgagagtgtcccagcactgacagc

SEQ ID NO: 79844 - DNA, 75 bp, Artificial Sequence
  Synthetic
acggtggccagcgggcctgcaaactccgagagtgtcccagcactgacagcagtagagactgggcatacatctcaa

SEQ ID NO: 79845 - DNA, 75 bp, Artificial Sequence
  Synthetic
ttcctcagtagatcagcgtgtgtctactacgccacatacaagacaactgccagtaaacctgaagatcaatttgta

SEQ ID NO: 79846 - DNA, 75 bp, Artificial Sequence
  Synthetic
actacgccacatacaagacaactgccagtaaacctgaagatcaatttgtacggtggccaatctcatacagacaag

SEQ ID NO: 79847 - DNA, 75 bp, Artificial Sequence
  Synthetic
gctcacaggacccatccacaaacgtcagtcaagatgctcccgtgttgacccatcaacttatgtacgtgccacccg

SEQ ID NO: 79848 - DNA, 75 bp, Artificial Sequence
  Synthetic
cagtcaagatgctcccgtgttgacccatcaacttatgtacgtgccacccggaggtcccgtcccaaaaagctcgcg

SEQ ID NO: 79849 - DNA, 75 bp, Artificial Sequence
  Synthetic
accatttataagcgtggggaatgcttacagctgcttctatgacggttggtcacacttttcacagactggagtata

SEQ ID NO: 79850 - DNA, 75 bp, Artificial Sequence
  Synthetic
tacagctgcttctatgacggttggtcacacttttcacagactggagtatatggttacaacacacttaatgacatg

SEQ ID NO: 79851 - DNA, 75 bp, Artificial Sequence
  Synthetic
ccaaagcacattaaagcatgggtgccgagaccccctagactgtgccaatatgtcaatgcctctacagtaaatttc

SEQ ID NO: 79852 - DNA, 75 bp, Artificial Sequence
  Synthetic
cgagaccccctagactgtgccaatatgtcaatgcctctacagtaaatttcacaccagaaggggtcaccaaatctc

SEQ ID NO: 79853 - DNA, 75 bp, Artificial Sequence
  Synthetic
acagacaccttgcaacccacgccgattggcaaaattgtgtgtgggaggattacaatagggatctcctagtcagca

SEQ ID NO: 79854 - DNA, 75 bp, Artificial Sequence
  Synthetic
ttggcaaaattgtgtgtgggaggattacaatagggatctcctagtcagcaccaccacagcacacgggtgtgatat

SEQ ID NO: 79855 - DNA, 75 bp, Artificial Sequence
  Synthetic
aggcccaggcttggttgaggtgcaagaaagtgagtattaccctaagaggtaccagtctcatgtactattggctac

SEQ ID NO: 79856 - DNA, 75 bp, Artificial Sequence
  Synthetic
gaaagtgagtattaccctaagaggtaccagtctcatgtactattggctacaggcttctcagaaccgggagattgc

SEQ ID NO: 79857 - DNA, 75 bp, Artificial Sequence
  Synthetic
gacgtgcgcgacctcctgtggctggaagacgacgccatggaacaaggtgtcaagaattatgtggaacaactcgga

SEQ ID NO: 79858 - DNA, 75 bp, Artificial Sequence
  Synthetic
aagacgacgccatggaacaaggtgtcaagaattatgtggaacaactcggaaacgcttttgggtccggcttcacca

SEQ ID NO: 79859 - DNA, 75 bp, Artificial Sequence
  Synthetic
aagctctggttaaaattatatcagcacttgttattgtggtaagaaatcatgatgacctaattacagtgaccgcaa

SEQ ID NO: 79860 - DNA, 75 bp, Artificial Sequence
  Synthetic
acttgttattgtggtaagaaatcatgatgacctaattacagtgaccgcaacgctggccctcattggttgcacctc

SEQ ID NO: 79861 - DNA, 75 bp, Artificial Sequence
  Synthetic
ctggttgaaaaagttcacagagatgaccaacgcctgcaaaggcatggagtggatagccatcaaaatccagaagtt

SEQ ID NO: 79862 - DNA, 75 bp, Artificial Sequence
  Synthetic
accattgaacaaagcgcaccctcccagggtgaccaggaacaactattctccaatgtccagtactttgcacactat

SEQ ID NO: 79863 - DNA, 75 bp, Artificial Sequence
  Synthetic
atacagttcaagtccaaatgccgtattgaacctgtctgtctcttgctccatgggagcccaggtgctggaaaatcg

SEQ ID NO: 79864 - DNA, 75 bp, Artificial Sequence
  Synthetic
ttgaacctgtctgtctcttgctccatgggagcccaggtgctggaaaatcggtagcaaccaatctgattgggcgtt

SEQ ID NO: 79865 - DNA, 75 bp, Artificial Sequence
  Synthetic
aggctgtcgtgatcatggatgacctgtgccaaaaccctgacgggaaggatgtatctctgttctgccagatggtgt

SEQ ID NO: 79866 - DNA, 75 bp, Artificial Sequence
  Synthetic
gtgccaaaaccctgacgggaaggatgtatctctgttctgccagatggtgtctagtgtagactttgtaccgccaat

SEQ ID NO: 79867 - DNA, 75 bp, Artificial Sequence
  Synthetic
atgccaatgtcagtgaaaacatgtgacgatgagtgttgtcctgttaatttcaagaagtgttgcccacttgtatgt

SEQ ID NO: 79868 - DNA, 75 bp, Artificial Sequence
  Synthetic
tgggagcaacacttgaggctcttttccaaggtccaccagtgtatagagaaatcaagattagtgttactccggaga

SEQ ID NO: 79869 - DNA, 75 bp, Artificial Sequence
  Synthetic
agggatggttggtgcctgagattaactctaccttgcaaattgaaaaacacgtgagtagagctttcatatgcttgc

SEQ ID NO: 79870 - DNA, 75 bp, Artificial Sequence
  Synthetic
gtgagtagagctttcatatgcttgcaagcactcaccacctttgtctctgtggcagggattatctatatcatatat

SEQ ID NO: 79871 - DNA, 75 bp, Artificial Sequence
  Synthetic
aattcgccgtggctatgatgaagagaaatgctagcacagtaaaaacagagtacggcgaattcacgatgcttggaa

SEQ ID NO: 79872 - DNA, 75 bp, Artificial Sequence
  Synthetic
gtgtggtcgacgccaaagaattggtggacaaggatggcaccaacttagagctgacactcctgaaactcaacagga

SEQ ID NO: 79873 - DNA, 75 bp, Artificial Sequence
  Synthetic
tgcggcggcgtcttgatgtcaacaggcaaagtccttggaatacacgtcggtggcaacgggcaccagggcttttca

SEQ ID NO: 79874 - DNA, 75 bp, Artificial Sequence
  Synthetic
ttcccagtcatcaacactcccagcagaacaaaacttgaacccagtgtttttcatcaagtgtttgaagggaataaa

SEQ ID NO: 79875 - DNA, 75 bp, Artificial Sequence
  Synthetic
agtacatgatggaggccgttgatcattacgccggacagctagcaaccttagacatcaatacagaacccatgaagc

SEQ ID NO: 79876 - DNA, 75 bp, Artificial Sequence
  Synthetic
cacttggcatcaaaaagagagacatcctatccaagaagactaaagacctgacaaagttgaaggaatgcatggaca

SEQ ID NO: 79877 - DNA, 75 bp, Artificial Sequence
  Synthetic
cctatccaagaagactaaagacctgacaaagttgaaggaatgcatggacaagtatggattgaacctccccatggt

SEQ ID NO: 79878 - DNA, 75 bp, Artificial Sequence
  Synthetic
cctcaacgactcagtggccatgaggcagacttacgggaacctgtacaaaacattccacctaaacccaggcatagt

SEQ ID NO: 79879 - DNA, 75 bp, Artificial Sequence
  Synthetic
cagacttacgggaacctgtacaaaacattccacctaaacccaggcatagtgacaggcagtgcagtcggttgtgac

SEQ ID NO: 79880 - DNA, 75 bp, Artificial Sequence
  Synthetic
gccagcctgagtccggtgtggttcgcttgcctgaaactactacttgaaaagctaggatacacacacaaggaaacc

SEQ ID NO: 79881 - DNA, 75 bp, Artificial Sequence
  Synthetic
cttgcctgaaactactacttgaaaagctaggatacacacacaaggaaaccaactacatagattacttgtgtaact

SEQ ID NO: 79882 - DNA, 75 bp, Artificial Sequence
  Synthetic
tcaattccatgatcaacaatattataatcagaacactaatgctgaaggtgtacaaagggatcgacttggatcagt

SEQ ID NO: 79883 - DNA, 75 bp, Artificial Sequence
  Synthetic
aatcagaacactaatgctgaaggtgtacaaagggatcgacttggatcagttcaggatgatagcatatggggatga

SEQ ID NO: 79884 - DNA, 75 bp, Artificial Sequence
  Synthetic
gacaccagctgataaaggggaatgctttaatgaggtgacatggactaacgtcaccttcttgaaaagatattttag

SEQ ID NO: 79885 - DNA, 75 bp, Artificial Sequence
  Synthetic
tttaatgaggtgacatggactaacgtcaccttcttgaaaagatattttagagcagatgaacaatacccatttctt

SEQ ID NO: 79886 - DNA, 75 bp, Artificial Sequence
  Synthetic
catgtgcgatccctgtgcctattggcttggcacaatggagaacaagaatacgaagagtttgtgtccaagatcagg

SEQ ID NO: 79887 - DNA, 75 bp, Artificial Sequence
  Synthetic
caggaagtggctggactctttttgaattagagcacaattagatttgattccaattggcttaaccctaccgcactt

SEQ ID NO: 79888 - DNA, 75 bp, Artificial Sequence
  Synthetic
atcacggtacctttgtgcgcctgttttataaccctttccccaacgcaacatagaagctatacacactgatcaaca

SEQ ID NO: 79889 - DNA, 75 bp, Artificial Sequence
  Synthetic
aacatggtgcgaagagtctattgagctagtcagtagtcctccggcccctgaatgcggctaatcccaactgcggag

SEQ ID NO: 79890 - DNA, 75 bp, Artificial Sequence
  Synthetic
cggaaccgactactttgggtgtccgtgtttccttttattcttatactggctgcttatggtgacaattgagagatt

SEQ ID NO: 79891 - DNA, 75 bp, Artificial Sequence
  Synthetic
tgtttccttttattcttatactggctgcttatggtgacaattgagagattgttaccatatagctattggattggc

SEQ ID NO: 79892 - DNA, 75 bp, Artificial Sequence
  Synthetic
tgcttatggtgacaattgagagattgttaccatatagctattggattggccatccggtgagtaatagagctatta

SEQ ID NO: 79893 - DNA, 75 bp, Artificial Sequence
  Synthetic
ctgcaaaatgggagcacaggtgtcgacccaaaaaaccggagctcacgagactagcttgactgccagcggcaattc

SEQ ID NO: 79894 - DNA, 75 bp, Artificial Sequence
  Synthetic
acccaaaaaaccggagctcacgagactagcttgactgccagcggcaattccaccatccattacaccaacataaac

SEQ ID NO: 79895 - DNA, 75 bp, Artificial Sequence
  Synthetic
atgaaagatgtaatgataaaatcactacccgcgctcaactcacccacggtagaggagtgtggtttttcggatagg

SEQ ID NO: 79896 - DNA, 75 bp, Artificial Sequence
  Synthetic
tacccgcgctcaactcacccacggtagaggagtgtggtttttcggatagggtacgatccattacacttggaaact

SEQ ID NO: 79897 - DNA, 75 bp, Artificial Sequence
  Synthetic
aggctacagctgaagatcagccaacacaaccagatgttgccacatgtagattttacaccctggattctatacagt

SEQ ID NO: 79898 - DNA, 75 bp, Artificial Sequence
  Synthetic
acaaccagatgttgccacatgtagattttacaccctggattctatacagtggcagaaggagtctgatgggtggtg

SEQ ID NO: 79899 - DNA, 75 bp, Artificial Sequence
  Synthetic
cgggtacacaatacacgtgcaatgcaatgcatctaagttccaccagggatgtttacttgttgtgtgtgtgccaga

SEQ ID NO: 79900 - DNA, 75 bp, Artificial Sequence
  Synthetic
aatgcatctaagttccaccagggatgtttacttgttgtgtgtgtgccagaggctgaaatggggtgttcagatgtt

SEQ ID NO: 79901 - DNA, 75 bp, Artificial Sequence
  Synthetic
caacacactgtacagactgttgtctacaatgctgggatgggtgtgggggttggaaaccttaccattttcccacac

SEQ ID NO: 79902 - DNA, 75 bp, Artificial Sequence
  Synthetic
acaatgctgggatgggtgtgggggttggaaaccttaccattttcccacaccaatggatcaatttacgcaccaaca

SEQ ID NO: 79903 - DNA, 75 bp, Artificial Sequence
  Synthetic
tgatgataatcccctttgccaagttggagtacactgaacaagcttccaactacgttcctattacggtcactgtgg

SEQ ID NO: 79904 - DNA, 75 bp, Artificial Sequence
  Synthetic
ggagtacactgaacaagcttccaactacgttcctattacggtcactgtggcgcccatgtgtgctgagtataatgg

SEQ ID NO: 79905 - DNA, 75 bp, Artificial Sequence
  Synthetic
ttttcaatcaccatctgctatgccccagtttgacgtgacgccagagatgaaaataccaggtgaagttcacaactt

SEQ ID NO: 79906 - DNA, 75 bp, Artificial Sequence
  Synthetic
cagtttgacgtgacgccagagatgaaaataccaggtgaagttcacaacttgatggaaattgcagaggtggactca

SEQ ID NO: 79907 - DNA, 75 bp, Artificial Sequence
  Synthetic
cagttgcacacacaagtctttggatttcaaatgcagcctggcctaaatagtgtttttaaacgcaccctgttagga

SEQ ID NO: 79908 - DNA, 75 bp, Artificial Sequence
  Synthetic
ttcaaatgcagcctggcctaaatagtgtttttaaacgcaccctgttaggagagatcctgaactattatgcgcatt

SEQ ID NO: 79909 - DNA, 75 bp, Artificial Sequence
  Synthetic
cacctccgggtgcttccccaccacaaaaccgcaagcaggcaatgctgggaacgcatgtgatatgggatgtgggtc

SEQ ID NO: 79910 - DNA, 75 bp, Artificial Sequence
  Synthetic
aaaccgcaagcaggcaatgctgggaacgcatgtgatatgggatgtgggtctgcaatccagttgtgtgttatgcat

SEQ ID NO: 79911 - DNA, 75 bp, Artificial Sequence
  Synthetic
gtatcagacaggtctcattgtaccaccaggcgcgcccccgtcgtgcactatattgtgttttgcttctgcatgcaa

SEQ ID NO: 79912 - DNA, 75 bp, Artificial Sequence
  Synthetic
ccaggcgcgcccccgtcgtgcactatattgtgttttgcttctgcatgcaatgacttctcagtacgcatgctcagg

SEQ ID NO: 79913 - DNA, 75 bp, Artificial Sequence
  Synthetic
gttgctgacacgatgccaacaggaccgcgcaacactgaaagtgtgcccgctttgacggcggtagagactggtcac

SEQ ID NO: 79914 - DNA, 75 bp, Artificial Sequence
  Synthetic
cgcgcaacactgaaagtgtgcccgctttgacggcggtagagactggtcacacctcacaagtggtccccggcgaca

SEQ ID NO: 79915 - DNA, 75 bp, Artificial Sequence
  Synthetic
catgcgtttacatcacaacctacaagtcggccggtggcacccccacggaacgatatgctagctggaggatcaaca

SEQ ID NO: 79916 - DNA, 75 bp, Artificial Sequence
  Synthetic
gtcggccggtggcacccccacggaacgatatgctagctggaggatcaacacccggcagatggtgcaattgagaag

SEQ ID NO: 79917 - DNA, 75 bp, Artificial Sequence
  Synthetic
aacgcagctagcacaagacatgcccgtactaacccatcagatcatgtatatcccaccaggtggtccggttccgaa

SEQ ID NO: 79918 - DNA, 75 bp, Artificial Sequence
  Synthetic
gtactaacccatcagatcatgtatatcccaccaggtggtccggttccgaatagcgccacagattttgcatggcag

SEQ ID NO: 79919 - DNA, 75 bp, Artificial Sequence
  Synthetic
gggaacgcctatagtaatttttatgatgggtggtcacactttacacaggagggtgtttacggattcaactcttta

SEQ ID NO: 79920 - DNA, 75 bp, Artificial Sequence
  Synthetic
aacaacatgggccacatttacgtgaggcacgttaatgaacaaaacttgggcgtatccaccagcacactgcgtgtg

SEQ ID NO: 79921 - DNA, 75 bp, Artificial Sequence
  Synthetic
gtgaacttcaaacctactgccgtgacaactgagcggaaagacattaatgatgtggggacgctccgccccatgggt

SEQ ID NO: 79922 - DNA, 75 bp, Artificial Sequence
  Synthetic
tgtggggacgctccgccccatgggttacaccaaccatggggcatttgggcatcagtcaggggccatttatgtggg

SEQ ID NO: 79923 - DNA, 75 bp, Artificial Sequence
  Synthetic
cggctcaggattcactaaccaaatctgtgagcaggtcaacctcctcaaagagtcactagtaggccaggactccat

SEQ ID NO: 79924 - DNA, 75 bp, Artificial Sequence
  Synthetic
gtgattatggatgacttgtgccaaaacccagatggaaaggatgtgtccttattttgccaaatggtttccagtgtg

SEQ ID NO: 79925 - DNA, 75 bp, Artificial Sequence
  Synthetic
aacgctggttccattaacgcaccaacagtctcagacagccgagctttggccagaagatttcacttcgacatgaac

SEQ ID NO: 79926 - DNA, 75 bp, Artificial Sequence
  Synthetic
cagtctcagacagccgagctttggccagaagatttcacttcgacatgaacattgaagttatatcaatgtacagcc

SEQ ID NO: 79927 - DNA, 75 bp, Artificial Sequence
  Synthetic
aagcgctcgacctgaccaccagcgcaggttacccgtacgttgcgttaggcatcaagaagagggacatcttatcta

SEQ ID NO: 79928 - DNA, 75 bp, Artificial Sequence
  Synthetic
tgaaggatgagctcagatctgcagataaagtggctaaagggaagtctaggcttattgaagcgtccagcttgaatg

SEQ ID NO: 79929 - DNA, 75 bp, Artificial Sequence
  Synthetic
tgcgtggtggcatgccctcaggatgctctggcaccagtatcttcaactcaatgattaataacatcataataagaa

SEQ ID NO: 79930 - DNA, 75 bp, Artificial Sequence
  Synthetic
ctctggcaccagtatcttcaactcaatgattaataacatcataataagaacactaatgctgaaggtgtacaaagg

SEQ ID NO: 79931 - DNA, 75 bp, Artificial Sequence
  Synthetic
catcttacccctggccaatagacgcctccttgcttgctgaagctgggaaagggtatggactgataatgacaccag

SEQ ID NO: 79932 - DNA, 75 bp, Artificial Sequence
  Synthetic
agtcatgcccatgaaggacatccatgagtccatcagatggacaaaagatccaaagaacacccaagatcatgtgcg

SEQ ID NO: 79933 - DNA, 75 bp, Artificial Sequence
  Synthetic
agttgggcgctgtttaactttacctgcattctcaacactgcgcaggaaatggctggactccttctaaattagaga

SEQ ID NO: 79934 - DNA, 75 bp, Artificial Sequence
  Synthetic
gcattctcaacactgcgcaggaaatggctggactccttctaaattagagacaatttaacacaatttgaattggct

SEQ ID NO: 79935 - DNA, 75 bp, Artificial Sequence
  Synthetic
ttaaaacagtctgtgggttgtaccccctcacagggcccacgtggcgctagcacaccggtatctcggtacccttgt

SEQ ID NO: 79936 - DNA, 75 bp, Artificial Sequence
  Synthetic
cacaccggtatctcggtacccttgtgcgcctgttttatacaccctcacccccatgtaacttagaaggaaagcaac

SEQ ID NO: 79937 - DNA, 75 bp, Artificial Sequence
  Synthetic
attgagagattgttgccatatagctattggattggccatccagtgacaaacagagctattgtgtacctgtttgtt

SEQ ID NO: 79938 - DNA, 75 bp, Artificial Sequence
  Synthetic
ctcaagtgtcaacacagaaaacaggcgcccacgagaccctgctcgaggctgcccagggtgccactataaattaca

SEQ ID NO: 79939 - DNA, 75 bp, Artificial Sequence
  Synthetic
cgcccacgagaccctgctcgaggctgcccagggtgccactataaattacaccaacatcaattattataaggatgc

SEQ ID NO: 79940 - DNA, 75 bp, Artificial Sequence
  Synthetic
ggtcaagtccatgccggcacttaattcaccctccgcagaggagtgtggatatagtgacagggtgaggtccataac

SEQ ID NO: 79941 - DNA, 75 bp, Artificial Sequence
  Synthetic
tcaccctccgcagaggagtgtggatatagtgacagggtgaggtccataacgctaggcaattccaccattaccaca

SEQ ID NO: 79942 - DNA, 75 bp, Artificial Sequence
  Synthetic
gaccaaccaacacagcctgacgtcgccacctgcagattctacactctggagtctgtgcagtgggagagcaactcc

SEQ ID NO: 79943 - DNA, 75 bp, Artificial Sequence
  Synthetic
ccacctgcagattctacactctggagtctgtgcagtgggagagcaactccgcagggtggtggtggaagtttccgg

SEQ ID NO: 79944 - DNA, 75 bp, Artificial Sequence
  Synthetic
atgtacaatgtaatgcttccaaattccatcaagggtgtttgttagtggtgtgtgtccctgaggcagaaatgggat

SEQ ID NO: 79945 - DNA, 75 bp, Artificial Sequence
  Synthetic
ccatcaagggtgtttgttagtggtgtgtgtccctgaggcagaaatgggatgcgccaaaccagatgagaacgtgag

SEQ ID NO: 79946 - DNA, 75 bp, Artificial Sequence
  Synthetic
gcagacagcagtgtgcaacgcgaccatgggggtggcagtggggaatctcaccatatttccacaccaatggatcaa

SEQ ID NO: 79947 - DNA, 75 bp, Artificial Sequence
  Synthetic
atgggggtggcagtggggaatctcaccatatttccacaccaatggatcaatctgagaactaacaactgtgccact

SEQ ID NO: 79948 - DNA, 75 bp, Artificial Sequence
  Synthetic
ccctttgtgccactaactagtatggggggctccacatatgttccaattaccgtaacaattgcaccaatgtatgca

SEQ ID NO: 79949 - DNA, 75 bp, Artificial Sequence
  Synthetic
ggggctccacatatgttccaattaccgtaacaattgcaccaatgtatgcagagtataatgggctgcgcctgtcaa

SEQ ID NO: 79950 - DNA, 75 bp, Artificial Sequence
  Synthetic
catgtgccatgcctgaatacgacgttaccccgccactagatatcccgggggaagttaacaatttgatggaaattg

SEQ ID NO: 79951 - DNA, 75 bp, Artificial Sequence
  Synthetic
taccccgccactagatatcccgggggaagttaacaatttgatggaaattgctgaggtggattctgtggttccagt

SEQ ID NO: 79952 - DNA, 75 bp, Artificial Sequence
  Synthetic
cgacgcagtgttcaaatttcagttggaccctgggagtgattcggtcctgaaacacacactgctgggagaaattat

SEQ ID NO: 79953 - DNA, 75 bp, Artificial Sequence
  Synthetic
gaccctgggagtgattcggtcctgaaacacacactgctgggagaaattataaactactatgcacactggtccgga

SEQ ID NO: 79954 - DNA, 75 bp, Artificial Sequence
  Synthetic
ggtgcatccgctccctctacgcgtaaagacgctatgctaggtacccatataatttgggaccttgggctgcaatca

SEQ ID NO: 79955 - DNA, 75 bp, Artificial Sequence
  Synthetic
aagacgctatgctaggtacccatataatttgggaccttgggctgcaatcaagctgtgtcctgtgtgtcccgtgga

SEQ ID NO: 79956 - DNA, 75 bp, Artificial Sequence
  Synthetic
ccaacataatagttcctccagatacaccatcacaatgttacatgttgtgtttggcatcagcttgcaatgacttct

SEQ ID NO: 79957 - DNA, 75 bp, Artificial Sequence
  Synthetic
accatcacaatgttacatgttgtgtttggcatcagcttgcaatgacttctctgtgaggatgctgaaggatacccc

SEQ ID NO: 79958 - DNA, 75 bp, Artificial Sequence
  Synthetic
caccataagtagtgggccaaccaattcagaacaagtaccagcacttactgcagcagaaacagggcacacatctca

SEQ ID NO: 79959 - DNA, 75 bp, Artificial Sequence
  Synthetic
tcagaacaagtaccagcacttactgcagcagaaacagggcacacatctcaggtagttccaggggacacgatacaa

SEQ ID NO: 79960 - DNA, 75 bp, Artificial Sequence
  Synthetic
catatagccaaatacgaggccagcgcgaatgcaaacaatgaggatagatttgtgaggtgggagataaataacaag

SEQ ID NO: 79961 - DNA, 75 bp, Artificial Sequence
  Synthetic
cgaatgcaaacaatgaggatagatttgtgaggtgggagataaataacaaggaattggtccaactcagaaggaagt

SEQ ID NO: 79962 - DNA, 75 bp, Artificial Sequence
  Synthetic
acctgtcccaagatatgccagtacttacccaccaaatcatgtatgtgccaccaggagggtcagtaccaagtaaag

SEQ ID NO: 79963 - DNA, 75 bp, Artificial Sequence
  Synthetic
tacccaccaaatcatgtatgtgccaccaggagggtcagtaccaagtaaagcagatagttatgcatggcagacgtc

SEQ ID NO: 79964 - DNA, 75 bp, Artificial Sequence
  Synthetic
cgcatatagcagtttttatgatgggtggtcacatttttcgcaaaagggagtttatggttacaacacactaaacaa

SEQ ID NO: 79965 - DNA, 75 bp, Artificial Sequence
  Synthetic
tggtcacatttttcgcaaaagggagtttatggttacaacacactaaacaaattaggggccctttttgtaaggcac

SEQ ID NO: 79966 - DNA, 75 bp, Artificial Sequence
  Synthetic
gtaccgcgtccgccccgattatgcccatacaaatacaaggcaaatgttaacttcgacgtgacggctgtaacggac

SEQ ID NO: 79967 - DNA, 75 bp, Artificial Sequence
  Synthetic
catacaaatacaaggcaaatgttaacttcgacgtgacggctgtaacggacagtaggcagacaatcacaactgtac

SEQ ID NO: 79968 - DNA, 75 bp, Artificial Sequence
  Synthetic
gactagtgaacaggcaccttgcaacccacaccgactggcagaactgtgtttgggaaaactacagcagggatctcc

SEQ ID NO: 79969 - DNA, 75 bp, Artificial Sequence
  Synthetic
ccacaccgactggcagaactgtgtttgggaaaactacagcagggatctcctggtaagtacgaccacagcacaagg

SEQ ID NO: 79970 - DNA, 75 bp, Artificial Sequence
  Synthetic
ttcattcgagggacctggactcgtggaggtgcaagagaatgaatactaccctaggagataccaatctcatgtgtt

SEQ ID NO: 79971 - DNA, 75 bp, Artificial Sequence
  Synthetic
gaggtgcaagagaatgaatactaccctaggagataccaatctcatgtgttgctagcagccggcttttctgagcca

SEQ ID NO: 79972 - DNA, 75 bp, Artificial Sequence
  Synthetic
ggttttgccgatgtgcgtgatctcttgtggttggaggatgatgcaatggaacaaggtgtaaaagattatgtggaa

SEQ ID NO: 79973 - DNA, 75 bp, Artificial Sequence
  Synthetic
atcggacaggataccatcctagaaaaatccctcaaggccttggtcaagattatttcagctctagtgatcgtggtg

SEQ ID NO: 79974 - DNA, 75 bp, Artificial Sequence
  Synthetic
aatccctcaaggccttggtcaagattatttcagctctagtgatcgtggtgaggaaccatgatgaccttataacag

SEQ ID NO: 79975 - DNA, 75 bp, Artificial Sequence
  Synthetic
atgggataccgatggctgagagacaaaacaacggatggctcaagaagtttacagaagcgaccaatgcctgcaagg

SEQ ID NO: 79976 - DNA, 75 bp, Artificial Sequence
  Synthetic
aaacaacggatggctcaagaagtttacagaagcgaccaatgcctgcaaggggatggagtggattgctgttaagat

SEQ ID NO: 79977 - DNA, 75 bp, Artificial Sequence
  Synthetic
taaacaactccccttgctggaaaaccaaattgctaccattgagcaaagtgcaccatctcaaagtgatcaagaaca

SEQ ID NO: 79978 - DNA, 75 bp, Artificial Sequence
  Synthetic
taacagctctgtatactcgctaccaccagacccagaccacttcgacggttataagcaacaggccgtcgtgatcat

SEQ ID NO: 79979 - DNA, 75 bp, Artificial Sequence
  Synthetic
ccagacccagaccacttcgacggttataagcaacaggccgtcgtgatcatggatgacttgtgtcaaaaccctgat

SEQ ID NO: 79980 - DNA, 75 bp, Artificial Sequence
  Synthetic
aaaggcatcctcttcacgtcaccatttgtcctcgcctctactaacgcagggtctatcaatgctcccactgtgtcg

SEQ ID NO: 79981 - DNA, 75 bp, Artificial Sequence
  Synthetic
gacagtagagccctggccagaaggttccactttgacatgaacattgaagtcatttcaatgtacagccagaatggg

SEQ ID NO: 79982 - DNA, 75 bp, Artificial Sequence
  Synthetic
aagatcaatatgcccatgtcagtgaagacctgtgatgaggattgctgcccagtcaacttcaagaaatgttgcccg

SEQ ID NO: 79983 - DNA, 75 bp, Artificial Sequence
  Synthetic
tgtctccgtggcagggatcatttatattatctacaaattgtttgcaggcttccaaggagcttacactggcatgcc

SEQ ID NO: 79984 - DNA, 75 bp, Artificial Sequence
  Synthetic
tgcttggcatctatgacaggtgggcagtactaccccgccatgccaagcctgggcccaccattctgatgaatgatc

SEQ ID NO: 79985 - DNA, 75 bp, Artificial Sequence
  Synthetic
agagttagtagacagagatggcaccaatttggaaataacactcctaaaactcaatagaaatgagaagttcagaga

SEQ ID NO: 79986 - DNA, 75 bp, Artificial Sequence
  Synthetic
gattgagttcatcgagagttccaaggaagcaggtttcccggtcatcaacacccccagcaaaacaaagcttgagcc

SEQ ID NO: 79987 - DNA, 75 bp, Artificial Sequence
  Synthetic
ccatgagattggaggacgcagtttatggtactgagggtttagaggctttagatctgactacaagtgcagggtacc

SEQ ID NO: 79988 - DNA, 75 bp, Artificial Sequence
  Synthetic
gagggacatcctatccaagaagactaaggatctaacaaagcttaaagagtgcatggacaaatatgggttaaacct

SEQ ID NO: 79989 - DNA, 75 bp, Artificial Sequence
  Synthetic
gggtgtgatcccgacttattctggagtaagatcccagtcatgctcgacggtcacctcattgccttcgattacagt

SEQ ID NO: 79990 - DNA, 75 bp, Artificial Sequence
  Synthetic
aaagaaaccaattacatagattacttgtgcaactcccaccatttgtatagagacaaacactacttcgtaagagga

SEQ ID NO: 79991 - DNA, 75 bp, Artificial Sequence
  Synthetic
gcttattggcttggcataatggagagcaagaatatgaggaatttgtatccaaaatcagaagtgtcccaatcgggc

SEQ ID NO: 79992 - DNA, 75 bp, Artificial Sequence
  Synthetic
gcaagaatatgaggaatttgtatccaaaatcagaagtgtcccaatcgggcgctgcctgaccatacctgcgttttc

SEQ ID NO: 79993 - DNA, 75 bp, Artificial Sequence
  Synthetic
caggtctcaacgcagaaaactggtgcgcatgaaacagggctaaatgccagtggaaattccataatacactataca

SEQ ID NO: 79994 - DNA, 75 bp, Artificial Sequence
  Synthetic
ctgtacagtggcagaaaacgtcaccaggttggtggtggaagttacccgacgccttgtctaatttggggctgtttg

SEQ ID NO: 79995 - DNA, 75 bp, Artificial Sequence
  Synthetic
tttgggacgtgggcctgcaatctagttgtgtcttgtgcataccatggataagtcaaacacactatcggtacgtgg

SEQ ID NO: 79996 - DNA, 75 bp, Artificial Sequence
  Synthetic
cactgggcccataaagagtactattaggatttattttaaaccaaagcacgttaaagcttggatacccaggcctcc

SEQ ID NO: 79997 - DNA, 75 bp, Artificial Sequence
  Synthetic
tctccgtggcgctggctcaagcggaaagtgtcacaatattatggtatacccatggctgagcgccaaaacaatggg

SEQ ID NO: 79998 - DNA, 75 bp, Artificial Sequence
  Synthetic
tatctctattctgccaaatggtgtccagcgtggactttgtaccaccaatggccgcactagaagagaaaggcattc

SEQ ID NO: 79999 - DNA, 75 bp, Artificial Sequence
  Synthetic
aagaaatgctgtcccctcgtgtgtggaaaggccatccagttcatcgacagacggactcaagtcagatactcactg

SEQ ID NO: 80000 - DNA, 75 bp, Artificial Sequence
  Synthetic
tgtgctggatgcaaaagagctagtggacaaggatggcacaaaccttgaactcacactgctgaaactcaaccggaa

SEQ ID NO: 80001 - DNA, 75 bp, Artificial Sequence
  Synthetic
atcccagtaggacaggtcacagactatggcttcctaaacctgggtggcacccccacaaagagaatgcttatgtac

SEQ ID NO: 80002 - DNA, 75 bp, Artificial Sequence
  Synthetic
ggaggaagctgtgtacggtaccgaagggttggaggccctcgatctgacgaccagcgcagggtacccgtatgttgc

SEQ ID NO: 80003 - DNA, 75 bp, Artificial Sequence
  Synthetic
cattcatgaatctatcaggtggacaaaagaccctaagaacacccaggaccatgtgcgatccttgtgcttattggc

SEQ ID NO: 80004 - DNA, 75 bp, Artificial Sequence
  Synthetic
ttccacaattaccacacaggagtgtgctaatgttgttgtgggatacggagtgtggcccacctacttaagtgatca

SEQ ID NO: 80005 - DNA, 75 bp, Artificial Sequence
  Synthetic
gtgaaatactaaattattacgccaactggtcagggagcatgaagctaaccttcatgtactgtggcgcagcgatgg

SEQ ID NO: 80006 - DNA, 75 bp, Artificial Sequence
  Synthetic
atatgaggtttgacctcgagattacatttgtcatcactagctcccagcgaacttcaaccacatacgcatcggact

SEQ ID NO: 80007 - DNA, 75 bp, Artificial Sequence
  Synthetic
gggaactacagggtggtgaataggcatttggccacgcacgtggattggcagaattgcgtgtgggaagactataac

SEQ ID NO: 80008 - DNA, 75 bp, Artificial Sequence
  Synthetic
tacttctgtgcctcacgaaacaaacattatccagtcagtttcgagggacctggtctagtagaagttcaggagagt

SEQ ID NO: 80009 - DNA, 75 bp, Artificial Sequence
  Synthetic
gaatactaccccaagagataccaatctcatgtgctgcttgctgcaggcttctccgaaccgggcgactgtggtggg

SEQ ID NO: 80010 - DNA, 75 bp, Artificial Sequence
  Synthetic
cgtgacctcttatggctggaggatgatgccatggaacaaggagttaaagactacgtggaacagctcggaaatgct

SEQ ID NO: 80011 - DNA, 75 bp, Artificial Sequence
  Synthetic
tcagcgaacaagtcaacctcctcaaggagtcactcgttgggcaggactccattctggaaaaatcactcagagccc

SEQ ID NO: 80012 - DNA, 75 bp, Artificial Sequence
  Synthetic
atggcgttggcttaaacagaaggtctcccaatattacggaatccccatggcagagaggcaaaacaatggatggtt

SEQ ID NO: 80013 - DNA, 75 bp, Artificial Sequence
  Synthetic
atggctgaaggttaagatcctaccagaagttaaagaaaaacacgaattcctgaacaggttaaaacaactgccgtt

SEQ ID NO: 80014 - DNA, 75 bp, Artificial Sequence
  Synthetic
gaagttaaagaaaaacacgaattcctgaacaggttaaaacaactgccgttgttggagggtcagatcgccactatt

SEQ ID NO: 80015 - DNA, 75 bp, Artificial Sequence
  Synthetic
aaatatgcacccttatatgctgctgaggctaaaagagtgttctccctagagaagaaattgagcaattacatacag

SEQ ID NO: 80016 - DNA, 75 bp, Artificial Sequence
  Synthetic
aggctaaaagagtgttctccctagagaagaaattgagcaattacatacagttcaagtccaaatgccgtattgaac

SEQ ID NO: 80017 - DNA, 75 bp, Artificial Sequence
  Synthetic
ccgagaaacttaatagttctgtatactcattaccaccagacccagaccactttgatggttacaaacagcaggccg

SEQ ID NO: 80018 - DNA, 75 bp, Artificial Sequence
  Synthetic
acttgaggagaaaggtatactattcacatcaccattcgtccttgcttcaacaaacgcaggatcaatcaatgcacc

SEQ ID NO: 80019 - DNA, 75 bp, Artificial Sequence
  Synthetic
gctattcagttcattgacaggagaacacaggtgaggtattcactagacatgctcgtgactgagatgttcagggag

SEQ ID NO: 80020 - DNA, 75 bp, Artificial Sequence
  Synthetic
cacaggtgaggtattcactagacatgctcgtgactgagatgttcagggagtacagtcacaggcatagcgtggggg

SEQ ID NO: 80021 - DNA, 75 bp, Artificial Sequence
  Synthetic
ccccaccagcaatagcggatctactgaaatctgtggatagtgaggcggtcagagagtactgcaaagaaaaagggt

SEQ ID NO: 80022 - DNA, 75 bp, Artificial Sequence
  Synthetic
gaaatctgtggatagtgaggcggtcagagagtactgcaaagaaaaagggtggctagtgcccgaaattaactccac

SEQ ID NO: 80023 - DNA, 75 bp, Artificial Sequence
  Synthetic
agagagtactgcaaagaaaaagggtggctagtgcccgaaattaactccactctgcaaattgaaaagcatgtaagc

SEQ ID NO: 80024 - DNA, 75 bp, Artificial Sequence
  Synthetic
tttgcaggattccagggagcatacactggtatacccaaccaaaaacccaaagtaccaaccttaagacaggccaag

SEQ ID NO: 80025 - DNA, 75 bp, Artificial Sequence
  Synthetic
ctggtatacccaaccaaaaacccaaagtaccaaccttaagacaggccaaggttcaagggccagcttttgagtttg

SEQ ID NO: 80026 - DNA, 75 bp, Artificial Sequence
  Synthetic
acagatgggcagtgctaccccggcatgccaaacctgggcccaccattctaatgaatgatcaggaggtgggtgtgg

SEQ ID NO: 80027 - DNA, 75 bp, Artificial Sequence
  Synthetic
ctcctgagactcaatagaaatgagaaattcagggacatccgaggcttcttaacacgtgaggaagctgaggtcaat

SEQ ID NO: 80028 - DNA, 75 bp, Artificial Sequence
  Synthetic
gaggctgtactcgccattaacaccagcaagtttccaaacatgtacattccagttggacaggtaacagactatggc

SEQ ID NO: 80029 - DNA, 75 bp, Artificial Sequence
  Synthetic
ggtgttctaatgtcaacaggcaaagtgctcggaatacacgttggtggcaatggacaccaagggttctcggcagca

SEQ ID NO: 80030 - DNA, 75 bp, Artificial Sequence
  Synthetic
tgctcggaatacacgttggtggcaatggacaccaagggttctcggcagcattgttgcgtcactatttcaatgatg

SEQ ID NO: 80031 - DNA, 75 bp, Artificial Sequence
  Synthetic
agctcgagcccagcgtattccaccacgtatttgagggaaacaaggaaccagcggtgctaagaaatggggatccta

SEQ ID NO: 80032 - DNA, 75 bp, Artificial Sequence
  Synthetic
tgttggaggccgttgaccactatgcaggacaactggcaactctagatatcaatacagaacccatgaagctagagg

SEQ ID NO: 80033 - DNA, 75 bp, Artificial Sequence
  Synthetic
taagaagaccaaggatctaacaaagctgaaagagtgcatggacaaatatgggttaaatcttcccatggtcactta

SEQ ID NO: 80034 - DNA, 75 bp, Artificial Sequence
  Synthetic
ggctgattgaggcatcaagtctgaatgactcagtggccatgagacagacttttggaaatttatacaagacattcc

SEQ ID NO: 80035 - DNA, 75 bp, Artificial Sequence
  Synthetic
tgactcagtggccatgagacagacttttggaaatttatacaagacattccatctaaacccaggcatagtgacagg

SEQ ID NO: 80036 - DNA, 75 bp, Artificial Sequence
  Synthetic
tgactatagtgggtatgatgccagcttgagcccggtgtggtttgcttgcctgaaactgttgttagagaaactggg

SEQ ID NO: 80037 - DNA, 75 bp, Artificial Sequence
  Synthetic
aacactaatgctaaaggtatacaaggggatagacctagaccagttcaggatgatagcgtacggtgatgatgtcat

SEQ ID NO: 80038 - DNA, 75 bp, Artificial Sequence
  Synthetic
cgctgacaaaggggagtgctttaatgaagtgacatggaccaacgtcaccttcctgaaaagatactttagagcgga

SEQ ID NO: 80039 - DNA, 75 bp, Artificial Sequence
  Synthetic
tgagcaatacccctttcttgtacacccagtgatgccaatgaaagacattcatgaatcaatcaggtggaccaaaga

SEQ ID NO: 80040 - DNA, 75 bp, Artificial Sequence
  Synthetic
atttgtgtccaaaatcagaagcgttccagtagggcgctgtctgaccttacctgcattctcaactttacgcaggaa

SEQ ID NO: 80041 - DNA, 75 bp, Artificial Sequence
  Synthetic
ccagtagggcgctgtctgaccttacctgcattctcaactttacgcaggaagtggctagattctttttaaattaga

SEQ ID NO: 80042 - DNA, 75 bp, Artificial Sequence
  Synthetic
acccacaggcccattgggcgctagcactctggtatcacggtacctttgtgcgcctgttttatacacccttcccaa

SEQ ID NO: 80043 - DNA, 75 bp, Artificial Sequence
  Synthetic
gcccatggggtaacccatgggacgcttcaatactgacatggtgcgaagagtctattgagctaattggtagtcctc

SEQ ID NO: 80044 - DNA, 75 bp, Artificial Sequence
  Synthetic
ttagccactctcaatttcatactattgcttaatacaacgaaatgggagctcaggtgtctacacagaagacaggag

SEQ ID NO: 80045 - DNA, 75 bp, Artificial Sequence
  Synthetic
atcaaggttgcttgcttgtagtgtgtgtgcctgaggctgagatggggtgttctaatttgaacaatacacccgaat

SEQ ID NO: 80046 - DNA, 75 bp, Artificial Sequence
  Synthetic
gtccccatggataacatgttcaggcacaataacttaacactaatgatcatcccattcgtaccgcttaattacagt

SEQ ID NO: 80047 - DNA, 75 bp, Artificial Sequence
  Synthetic
gccgaggtggactcagtggtgcctgtgaataatacagaggataatgtgagtagccttaaagcctaccagatccca

SEQ ID NO: 80048 - DNA, 75 bp, Artificial Sequence
  Synthetic
accgggtgccaacaacgtgatgaatagaaccctcttaggtgaaatcctaaactattacacccattggagtggtag

SEQ ID NO: 80049 - DNA, 75 bp, Artificial Sequence
  Synthetic
cgtgcagtggcacgtgtggcggacacgatcagctcacggcctactaactcggagtcaattccagcactcaccgcc

SEQ ID NO: 80050 - DNA, 75 bp, Artificial Sequence
  Synthetic
aagacatgtgaagaactatcactcacggtccgaatcatccattgaaaatttcctgtgccggtctgcctgtgtata

SEQ ID NO: 80051 - DNA, 75 bp, Artificial Sequence
  Synthetic
aagaagaaagttggaactcttcacatatctaagatttgacttagaactaacatttgttataacgagtgcacaaca

SEQ ID NO: 80052 - DNA, 75 bp, Artificial Sequence
  Synthetic
tatctaagatttgacttagaactaacatttgttataacgagtgcacaacaacccagcactgcctctagtgtggat

SEQ ID NO: 80053 - DNA, 75 bp, Artificial Sequence
  Synthetic
tggcaaacttccacaaaccccagcgttttctggacagagggaaacgccccaccaaggatgtccattccattcatt

SEQ ID NO: 80054 - DNA, 75 bp, Artificial Sequence
  Synthetic
ttttctggacagagggaaacgccccaccaaggatgtccattccattcattagcattggcaatgcgtatagttgtt

SEQ ID NO: 80055 - DNA, 75 bp, Artificial Sequence
  Synthetic
atatgaggcacgtcaatgaagcggggcaaggcccaatcaaaagtactgttagaatatatttcaaacccaagcacg

SEQ ID NO: 80056 - DNA, 75 bp, Artificial Sequence
  Synthetic
agaatatatttcaaacccaagcacgtgaaggcgtgggtgccgcgtccaccaagattgtgtcaatatgagaagcag

SEQ ID NO: 80057 - DNA, 75 bp, Artificial Sequence
  Synthetic
tgcatatgggaggactataatagggacctcctagtgtgcactacaacggcgcatggttgtgacaatattgcaagg

SEQ ID NO: 80058 - DNA, 75 bp, Artificial Sequence
  Synthetic
ttggtggaggtccaggaaagtgaatattatccaaaaaggtatcaatcacatgtgcttctcgccgcagggttttct

SEQ ID NO: 80059 - DNA, 75 bp, Artificial Sequence
  Synthetic
gtggaacagcttggaaacgcctttggttctggatttaccaaccagatttgcgagcaagtcagtctgttaaaagag

SEQ ID NO: 80060 - DNA, 75 bp, Artificial Sequence
  Synthetic
gttctggatttaccaaccagatttgcgagcaagtcagtctgttaaaagagtcactaatgggccaagattccatct

SEQ ID NO: 80061 - DNA, 75 bp, Artificial Sequence
  Synthetic
taacagtcacagctaccctagccctggttggctgtaccgcctcaccgtggcggtggctaaagaaaaaagtatctc

SEQ ID NO: 80062 - DNA, 75 bp, Artificial Sequence
  Synthetic
cggtggctaaagaaaaaagtatctcaatactacgggattcccatggccgagagacaaaacaatggctggctcaag

SEQ ID NO: 80063 - DNA, 75 bp, Artificial Sequence
  Synthetic
cagacttaagcaactcccccttttagaaagccaaattgccaccattgagcagagtgcaccatcccagggtgatca

SEQ ID NO: 80064 - DNA, 75 bp, Artificial Sequence
  Synthetic
agtccaaatgccgtattgaacctgtatgtttgctcttgcatggaagtcctggggcggggaagtcagtcgctacta

SEQ ID NO: 80065 - DNA, 75 bp, Artificial Sequence
  Synthetic
atggctacaaacaacaagctgtcgtgatcatggatgacctgtgccaaaacccagacggtaaagatgtgtccctct

SEQ ID NO: 80066 - DNA, 75 bp, Artificial Sequence
  Synthetic
gatcatggatgacctgtgccaaaacccagacggtaaagatgtgtccctcttctgtcaaatggtatctagtgtgga

SEQ ID NO: 80067 - DNA, 75 bp, Artificial Sequence
  Synthetic
tgctggttcgattaacgcaccaacagtgtcagatagcagagctttggctaggagatttcactttgatatgaacat

SEQ ID NO: 80068 - DNA, 75 bp, Artificial Sequence
  Synthetic
gtgtcagatagcagagctttggctaggagatttcactttgatatgaacattgaagttatctccatgtacagccaa

SEQ ID NO: 80069 - DNA, 75 bp, Artificial Sequence
  Synthetic
tgccctcttgtgtgtggcaaggctatccagttcattgatagaaagacacaggtgagatactccttggatatgtta

SEQ ID NO: 80070 - DNA, 75 bp, Artificial Sequence
  Synthetic
tccagttcattgatagaaagacacaggtgagatactccttggatatgttagtcaccgagatgttcagagagtaca

SEQ ID NO: 80071 - DNA, 75 bp, Artificial Sequence
  Synthetic
gtgttgcacctgaaaccccaccaccaccagcaatcgcggacctactaaagtcagtggatagcgaagcagtgaggg

SEQ ID NO: 80072 - DNA, 75 bp, Artificial Sequence
  Synthetic
accagcaatcgcggacctactaaagtcagtggatagcgaagcagtgagggagtactgcaaagagaagggatggtt

SEQ ID NO: 80073 - DNA, 75 bp, Artificial Sequence
  Synthetic
aacctttgtttctgtggccggaataatatacattatttataaactatttgcaggatttcagggtgcgtacacagg

SEQ ID NO: 80074 - DNA, 75 bp, Artificial Sequence
  Synthetic
atatacattatttataaactatttgcaggatttcagggtgcgtacacagggttgcccagccaaaaacccaaagtg

SEQ ID NO: 80075 - DNA, 75 bp, Artificial Sequence
  Synthetic
acggtaaaaacagaatatggcgagtttaccatgttgggcatatacgacagatgggctgttctaccacgccacgcc

SEQ ID NO: 80076 - DNA, 75 bp, Artificial Sequence
  Synthetic
ttaccatgttgggcatatacgacagatgggctgttctaccacgccacgccaagcctgggccaaccattcttatga

SEQ ID NO: 80077 - DNA, 75 bp, Artificial Sequence
  Synthetic
aagaatgcttatgtacaacttccccactagagcaggtcaatgcggtggcgtactcatgtccaccggcaaagtgtt

SEQ ID NO: 80078 - DNA, 75 bp, Artificial Sequence
  Synthetic
actagagcaggtcaatgcggtggcgtactcatgtccaccggcaaagtgttgggaatacacgttggcgggaatggc

SEQ ID NO: 80079 - DNA, 75 bp, Artificial Sequence
  Synthetic
tcgaaagatgcagggtttcccgtcatcaacacaccaagcagaacgaaattagaaccgagtgtgttccaccaggtg

SEQ ID NO: 80080 - DNA, 75 bp, Artificial Sequence
  Synthetic
tcaacacaccaagcagaacgaaattagaaccgagtgtgttccaccaggtgtttgaggggaataaggagcctgcag

SEQ ID NO: 80081 - DNA, 75 bp, Artificial Sequence
  Synthetic
acacacatgtagatgaatacatgatggaagcagtggaccactatgcagggcaactagccaccctcgatattaaca

SEQ ID NO: 80082 - DNA, 75 bp, Artificial Sequence
  Synthetic
caactagccaccctcgatattaacactgaaccaatgaaactggaggatgctgtgtatggcactgaagggttggag

SEQ ID NO: 80083 - DNA, 75 bp, Artificial Sequence
  Synthetic
tattgaagcatctagcctgaatgattctgtcgcaatgagacaaacatttggtaacttatacaaggcattccacct

SEQ ID NO: 80084 - DNA, 75 bp, Artificial Sequence
  Synthetic
agatggacatctcatagcctttgactactccggttacgatgccagtctgagtcccgtgtggtttgcttgtctaaa

SEQ ID NO: 80085 - DNA, 75 bp, Artificial Sequence
  Synthetic
actacctgtgcaattcacatcacttgtacagagacaaacactactttgtgcgtggtggcatgccctcaggatgct

SEQ ID NO: 80086 - DNA, 75 bp, Artificial Sequence
  Synthetic
ttgacctggatcagtttaggatgattgcatatggtgacgacgtgattgcatcctacccttggccgattgatgcat

SEQ ID NO: 80087 - DNA, 75 bp, Artificial Sequence
  Synthetic
gacaaaggggagtgcttcaacgaagtcacctggaccaatgtcacctttttgaaaagatacttcagagcagatgaa

SEQ ID NO: 80088 - DNA, 75 bp, Artificial Sequence
  Synthetic
gaaaagatacttcagagcagatgaacaatatccttttctagtccatccggtcatgcccatgaaggacattcatga

SEQ ID NO: 80089 - DNA, 75 bp, Artificial Sequence
  Synthetic
cggagaacacgaatatgaggagttcattaaaaaggttagaagtgtcccagtgggacgctgtttaactctacctgc

SEQ ID NO: 80090 - DNA, 75 bp, Artificial Sequence
  Synthetic
ctggactccttttaaattagagacaatttgaaacaacttaaattggcttaaccctaccgcactcaccgaactaga

SEQ ID NO: 80091 - DNA, 75 bp, Artificial Sequence
  Synthetic
ccaattgggtcttgaccaagcacttctgttaccccggactgagtatcaataggctgctcacgtggctgaaggaga

SEQ ID NO: 80092 - DNA, 75 bp, Artificial Sequence
  Synthetic
tccacatcctattgacgcctcactgttggctgaagcagggaaaggatatggactgatcatgacaccggctgataa

SEQ ID NO: 80093 - DNA, 75 bp, Artificial Sequence
  Synthetic
cccacccatagggcccactgggcgttagcacactggtattccggtacctttgtgcgcctgttttatttaccctct

SEQ ID NO: 80094 - DNA, 75 bp, Artificial Sequence
  Synthetic
ttggtttcgttccattaaattataaagttttaaacacactcaattatattttattactcaactcagggaaatggg

SEQ ID NO: 80095 - DNA, 75 bp, Artificial Sequence
  Synthetic
agttttaaacacactcaattatattttattactcaactcagggaaatgggggctcaagtgtcaacacaaaagacg

SEQ ID NO: 80096 - DNA, 75 bp, Artificial Sequence
  Synthetic
gcagcctctaactccgccaaccggcaggattttacgcaagatccaggaaaatttacagaaccagttaaagacata

SEQ ID NO: 80097 - DNA, 75 bp, Artificial Sequence
  Synthetic
aggattttacgcaagatccaggaaaatttacagaaccagttaaagacataatggtgaaatcactaccggctctaa

SEQ ID NO: 80098 - DNA, 75 bp, Artificial Sequence
  Synthetic
cgcaggaaagtgcaaatgtcgtcgttgggtatggggtgtggcctgattatctcagcgatgaggaggctactgcgg

SEQ ID NO: 80099 - DNA, 75 bp, Artificial Sequence
  Synthetic
tgggtatggggtgtggcctgattatctcagcgatgaggaggctactgcggaagatcaacccacacaaccagatgt

SEQ ID NO: 80100 - DNA, 75 bp, Artificial Sequence
  Synthetic
tgacgctttgagggatatgggactgtttgggcaaaacatgcagtaccattacttgggcaggtctgggtataccat

SEQ ID NO: 80101 - DNA, 75 bp, Artificial Sequence
  Synthetic
tttgggcaaaacatgcagtaccattacttgggcaggtctgggtataccatacatgtacagtgcaacgcctcaaag

SEQ ID NO: 80102 - DNA, 75 bp, Artificial Sequence
  Synthetic
aacagagagcatttgagcaatggcgaagtggctaacatgtttgcgggcaccaaatcaagcaacgctaatgacgtg

SEQ ID NO: 80103 - DNA, 75 bp, Artificial Sequence
  Synthetic
aagtggctaacatgtttgcgggcaccaaatcaagcaacgctaatgacgtgcaacaggcggtgtacaatgctggca

SEQ ID NO: 80104 - DNA, 75 bp, Artificial Sequence
  Synthetic
tagttatgccatacatcaatagtgtgcccatggacaacatgtttcgccactataacttcacattaatgattatcc

SEQ ID NO: 80105 - DNA, 75 bp, Artificial Sequence
  Synthetic
gcccatggacaacatgtttcgccactataacttcacattaatgattatcccattcgctaagcttgattatgcagc

SEQ ID NO: 80106 - DNA, 75 bp, Artificial Sequence
  Synthetic
tggtcaccagggtttgccagtgatgaacacaccaggtagcaaccagttcctgacttctgatgattaccaatcccc

SEQ ID NO: 80107 - DNA, 75 bp, Artificial Sequence
  Synthetic
aacacaccaggtagcaaccagttcctgacttctgatgattaccaatcccctactgccatgccacaattcgacgtg

SEQ ID NO: 80108 - DNA, 75 bp, Artificial Sequence
  Synthetic
aacaacgtaaatgagaatgtcaacagcctcgaggcttatagaataccagtacattcggtaagtgagactgggtcg

SEQ ID NO: 80109 - DNA, 75 bp, Artificial Sequence
  Synthetic
gcctcgaggcttatagaataccagtacattcggtaagtgagactgggtcgcaggtctttggtttcacactacagc

SEQ ID NO: 80110 - DNA, 75 bp, Artificial Sequence
  Synthetic
taaagctcacgttcatgtactgcgggtcagcaatggcaactggaaaattcctcttggcctactcacccccaggag

SEQ ID NO: 80111 - DNA, 75 bp, Artificial Sequence
  Synthetic
gtcagcaatggcaactggaaaattcctcttggcctactcacccccaggagctggtgtacccaagaaccgcaaaga

SEQ ID NO: 80112 - DNA, 75 bp, Artificial Sequence
  Synthetic
ccaaacacattacaggtttgtgtctaaggatagctacactgatgctgggtttatcacctgctggtaccagactag

SEQ ID NO: 80113 - DNA, 75 bp, Artificial Sequence
  Synthetic
aaggatagctacactgatgctgggtttatcacctgctggtaccagactagcattgtcgtgcccgctgaggtacaa

SEQ ID NO: 80114 - DNA, 75 bp, Artificial Sequence
  Synthetic
gtgagacagacagcgttctaccagaatgatgtgcaaaatgcaattgatcgcgctgtagtgcgtgtggccgataca

SEQ ID NO: 80115 - DNA, 75 bp, Artificial Sequence
  Synthetic
atgatgtgcaaaatgcaattgatcgcgctgtagtgcgtgtggccgatacaatgccaagtggccccagtaattcag

SEQ ID NO: 80116 - DNA, 75 bp, Artificial Sequence
  Synthetic
gccatgtcaagaactaccacgtgaggtcagaatcatccgtagagaactttcttagtaggtccgcttgtgtttaca

SEQ ID NO: 80117 - DNA, 75 bp, Artificial Sequence
  Synthetic
gtcagaatcatccgtagagaactttcttagtaggtccgcttgtgtttacattgtggagtacaagacaaaggatga

SEQ ID NO: 80118 - DNA, 75 bp, Artificial Sequence
  Synthetic
tttcacatatgtgagatttgatgtggaggttacatttgtcataaccagtgtgcaagatgactcaaccagacagaa

SEQ ID NO: 80119 - DNA, 75 bp, Artificial Sequence
  Synthetic
gaggttacatttgtcataaccagtgtgcaagatgactcaaccagacagaacactgacacgccaacactcactcac

SEQ ID NO: 80120 - DNA, 75 bp, Artificial Sequence
  Synthetic
ccaagtgtcttttggactgaaggaaatgctccacctaggatgtctatccccttcatgagtgtgggcaacgcatat

SEQ ID NO: 80121 - DNA, 75 bp, Artificial Sequence
  Synthetic
atgctccacctaggatgtctatccccttcatgagtgtgggcaacgcatatagcaacttttatgacgggtggtcac

SEQ ID NO: 80122 - DNA, 75 bp, Artificial Sequence
  Synthetic
acagaacaatcagcccaatcacgagcaaagttcgtatatacttcaagccaaaacacgtgaaagcctgggtacccc

SEQ ID NO: 80123 - DNA, 75 bp, Artificial Sequence
  Synthetic
caaagttcgtatatacttcaagccaaaacacgtgaaagcctgggtaccccggccacccaggttatgtgagtacac

SEQ ID NO: 80124 - DNA, 75 bp, Artificial Sequence
  Synthetic
gcatgtagagaaccatggagcttttggccaacagtccggagcgatctacgtgggcaactataaaataattaatag

SEQ ID NO: 80125 - DNA, 75 bp, Artificial Sequence
  Synthetic
cagagttgcgtgtgggaagattataatagagacctcctcgtgagtaccactacagctcacgggtgcgacacaatt

SEQ ID NO: 80126 - DNA, 75 bp, Artificial Sequence
  Synthetic
ccaggtctagttgaagtgcaagaaagtgaatattatcccaagagataccagtcccacgtattactcgcagcaggg

SEQ ID NO: 80127 - DNA, 75 bp, Artificial Sequence
  Synthetic
gtcccacgtattactcgcagcagggttttcgaaaccgggagactgtggtggaatcctcaggtgcgagcatggcgt

SEQ ID NO: 80128 - DNA, 75 bp, Artificial Sequence
  Synthetic
tgatgcaatggagcagggagtcaaagactatgtggaacagcttggaaatgccttcggatctgggtttaccaatca

SEQ ID NO: 80129 - DNA, 75 bp, Artificial Sequence
  Synthetic
ccatcttagagaagtctctcaaagcacttgtgaagatcatatcagcactagtaattgtggtgaggaaccacgatg

SEQ ID NO: 80130 - DNA, 75 bp, Artificial Sequence
  Synthetic
ggctgaacgccaaaataacgggtggctcaagaaattcacggagatgaccaatgcttgcaaagggatggagtggat

SEQ ID NO: 80131 - DNA, 75 bp, Artificial Sequence
  Synthetic
cttttggaaagccaaattgcaaccattgaacaaagtgcaccatcccagagtgaccaggaacaactcttctcaaat

SEQ ID NO: 80132 - DNA, 75 bp, Artificial Sequence
  Synthetic
ttgaacaaagtgcaccatcccagagtgaccaggaacaactcttctcaaatgttcaatactttgcccactattgca

SEQ ID NO: 80133 - DNA, 75 bp, Artificial Sequence
  Synthetic
agccctggagctggaaagtcggttgccaccaacctaatcgggcgatcactagctgagaaattaaatagttcagtg

SEQ ID NO: 80134 - DNA, 75 bp, Artificial Sequence
  Synthetic
atgttggtcactgaaatgttccgagagtacaaccacaggcatagtgttggggcaacccttgaggcgctgttccaa

SEQ ID NO: 80135 - DNA, 75 bp, Artificial Sequence
  Synthetic
aaagtgccaacgctgagacaagctaaagtgcagggtcctgcttttgagtttgcagtggccatgatgaagagaaac

SEQ ID NO: 80136 - DNA, 75 bp, Artificial Sequence
  Synthetic
tccagtactgtgaaaacagaatatggtgagttcaccatgctgggcatctacgacagatgggccgttttgccacgt

SEQ ID NO: 80137 - DNA, 75 bp, Artificial Sequence
  Synthetic
aaggatggcacaaatctagaactaacactgctgaagctcaaccggaacgagaaatttagagatatcagaggcttt

SEQ ID NO: 80138 - DNA, 75 bp, Artificial Sequence
  Synthetic
cactgctgaagctcaaccggaacgagaaatttagagatatcagaggctttctcgctaaagaagaggtggaggtca

SEQ ID NO: 80139 - DNA, 75 bp, Artificial Sequence
  Synthetic
gttttttaaacttaggtggcacccccacaaagagaatgctcatgtataacttccccaccagcgctggccaatgtg

SEQ ID NO: 80140 - DNA, 75 bp, Artificial Sequence
  Synthetic
ttccccaccagcgctggccaatgtggtggcgttctcatgtccaccggcaaggtgttgggaatacacgttggcgga

SEQ ID NO: 80141 - DNA, 75 bp, Artificial Sequence
  Synthetic
cagtcattaacacaccaagtaaaaccaaattggaaccgagtgtctttcatcaagtattcgagggaaataaagaac

SEQ ID NO: 80142 - DNA, 75 bp, Artificial Sequence
  Synthetic
tggactaaacctgccaatggtgacgtatgtgaaagatgaactcagatcagcagagaaggtggctaaggggaaatc

SEQ ID NO: 80143 - DNA, 75 bp, Artificial Sequence
  Synthetic
tcacctaaaccctgggattgtgacaggcagcgcggtcggatgtgatcccgatcttttctggagtaaaatacctgt

SEQ ID NO: 80144 - DNA, 75 bp, Artificial Sequence
  Synthetic
tttgaagctgctgcttgagaagcttgggtactcacataaggagacgaattacatcgattacttgtgcaactcaca

SEQ ID NO: 80145 - DNA, 75 bp, Artificial Sequence
  Synthetic
acccagttatgcccatgaaggatatacacgaatccatcaggtggacaaaagatccaaagaatacccaagaccacg

SEQ ID NO: 80146 - DNA, 75 bp, Artificial Sequence
  Synthetic
tcccagttgggcgctgtttaactttgcctgcattttcaaccctgcgcaggaaatggttggactccttctaaatta

SEQ ID NO: 80147 - DNA, 75 bp, Artificial Sequence
  Synthetic
aaatggttggactccttctaaattagagacaatttagcacaattttaaattggctcaaccctaccgcacttaccg

SEQ ID NO: 80148 - DNA, 75 bp, Artificial Sequence
  Synthetic
tgttaccccggactgagtatcaatagactgctcacgcggttgaaggagaaaacgttcgttatccggccaactact

SEQ ID NO: 80149 - DNA, 75 bp, Artificial Sequence
  Synthetic
gcaagtatcaactcaaaagacaggagctcatgagactggcttaaacgccagtggaaattccatcattcactacac

SEQ ID NO: 80150 - DNA, 75 bp, Artificial Sequence
  Synthetic
gctcatgagactggcttaaacgccagtggaaattccatcattcactacacaaacatcaactactataaggatgct

SEQ ID NO: 80151 - DNA, 75 bp, Artificial Sequence
  Synthetic
ataaagaccctaccagcactgaattcgcccactgtggaggagtgcggatatagcgacagggtaaggtctatcact

SEQ ID NO: 80152 - DNA, 75 bp, Artificial Sequence
  Synthetic
cgcccactgtggaggagtgcggatatagcgacagggtaaggtctatcactcttggcaatagcaccataaccaccc

SEQ ID NO: 80153 - DNA, 75 bp, Artificial Sequence
  Synthetic
accagccaactcaaccggatgtagcgacgtgtaggttctacactttagaatcagtggcatggtctcaaaattcag

SEQ ID NO: 80154 - DNA, 75 bp, Artificial Sequence
  Synthetic
gacgtgtaggttctacactttagaatcagtggcatggtctcaaaattcagctgggtggtggtggaaatttcctga

SEQ ID NO: 80155 - DNA, 75 bp, Artificial Sequence
  Synthetic
tgtgcagtgcaatgcctctaaattccaccaggggtgcttgctagtggtgtgcgtgccagaagcggaaatgggggc

SEQ ID NO: 80156 - DNA, 75 bp, Artificial Sequence
  Synthetic
caccaggggtgcttgctagtggtgtgcgtgccagaagcggaaatgggggcagccaacatcaacaccacgatcaac

SEQ ID NO: 80157 - DNA, 75 bp, Artificial Sequence
  Synthetic
gcagcagtatacaacgcaggcatgggtgtggcagttggcaacctcactatatttccacaccaatggatcaacttg

SEQ ID NO: 80158 - DNA, 75 bp, Artificial Sequence
  Synthetic
gtgtggcagttggcaacctcactatatttccacaccaatggatcaacttgcgtacaaacaatagtgctactattg

SEQ ID NO: 80159 - DNA, 75 bp, Artificial Sequence
  Synthetic
tcgcaaaacttgattacgctactgggtcatcgacctatgtgcctatcacagtcactgtagcgccaatgtgtgcgg

SEQ ID NO: 80160 - DNA, 75 bp, Artificial Sequence
  Synthetic
gtcatcgacctatgtgcctatcacagtcactgtagcgccaatgtgtgcggagtacaatgggcttaggctagccgg

SEQ ID NO: 80161 - DNA, 75 bp, Artificial Sequence
  Synthetic
agccatgccccagtttgacgtgacaccagagatgttgattccaggggaggtgaaaaacatgatggagatagcaga

SEQ ID NO: 80162 - DNA, 75 bp, Artificial Sequence
  Synthetic
ccagagatgttgattccaggggaggtgaaaaacatgatggagatagcagaggtggactctttagtccctgtcaac

SEQ ID NO: 80163 - DNA, 75 bp, Artificial Sequence
  Synthetic
gtatttgggtttaacctgcaacctggagcagactctgtgtttaagaggaccctattgggcgaggtcctgaactac

SEQ ID NO: 80164 - DNA, 75 bp, Artificial Sequence
  Synthetic
gagcagactctgtgtttaagaggaccctattgggcgaggtcctgaactactatgcaaattggtctggcagcatca

SEQ ID NO: 80165 - DNA, 75 bp, Artificial Sequence
  Synthetic
gagtccccaccaccagaaaggaagccatgctagggacacacatcatttgggatattgggttacaatccagttgtg

SEQ ID NO: 80166 - DNA, 75 bp, Artificial Sequence
  Synthetic
catgctagggacacacatcatttgggatattgggttacaatccagttgtgtgctatgtgtgccatggatcagcca

SEQ ID NO: 80167 - DNA, 75 bp, Artificial Sequence
  Synthetic
tgtggtgccagctgacgtgcagaataagagtactatcctctgttttgtgtctgcttgcaatgacttctctgtcag

SEQ ID NO: 80168 - DNA, 75 bp, Artificial Sequence
  Synthetic
aagagtactatcctctgttttgtgtctgcttgcaatgacttctctgtcagactgctgcgtgacacaccattcatc

SEQ ID NO: 80169 - DNA, 75 bp, Artificial Sequence
  Synthetic
gccagtgggcctgcaaactcagagcaaatccctgccctaaccgctgctgagactggtcacacctcgcaagtggtt

SEQ ID NO: 80170 - DNA, 75 bp, Artificial Sequence
  Synthetic
aaatccctgccctaaccgctgctgagactggtcacacctcgcaagtggttcccagcgacactatgcaaacccgcc

SEQ ID NO: 80171 - DNA, 75 bp, Artificial Sequence
  Synthetic
tgagttacaaaacacagggcgacgaacaaaccgacaaatacgctagttgggagatcaacacgcggcaggtggcac

SEQ ID NO: 80172 - DNA, 75 bp, Artificial Sequence
  Synthetic
acaaaccgacaaatacgctagttgggagatcaacacgcggcaggtggcacagttaaggagaaaattggaattctt

SEQ ID NO: 80173 - DNA, 75 bp, Artificial Sequence
  Synthetic
ggatacgccagtgctaacccatcaaattatgtatgtgcctcccggtggtccagtaccgacatcagccacagatta

SEQ ID NO: 80174 - DNA, 75 bp, Artificial Sequence
  Synthetic
attatgtatgtgcctcccggtggtccagtaccgacatcagccacagattacagctggcagacatctacaaatccc

SEQ ID NO: 80175 - DNA, 75 bp, Artificial Sequence
  Synthetic
aatttctatgatgggtggtcgcactttagccagtcaggggtgtatggttacaccacactcaataatatgggtacc

SEQ ID NO: 80176 - DNA, 75 bp, Artificial Sequence
  Synthetic
ttagccagtcaggggtgtatggttacaccacactcaataatatgggtaccctgtatttcaggcacgtgaacaact

SEQ ID NO: 80177 - DNA, 75 bp, Artificial Sequence
  Synthetic
cgccacggttgtgcgattacaaacacaaaaagaacgtagactttactcccacaggtgtgaccacaactagagaca

SEQ ID NO: 80178 - DNA, 75 bp, Artificial Sequence
  Synthetic
caaaaagaacgtagactttactcccacaggtgtgaccacaactagagacaagataaccttggacaaggggactca

SEQ ID NO: 80179 - DNA, 75 bp, Artificial Sequence
  Synthetic
gaacaggcacctagctactcacgcagactggcaacactgcgtgtgggaggattataacagggacttattggtcag

SEQ ID NO: 80180 - DNA, 75 bp, Artificial Sequence
  Synthetic
gactggcaacactgcgtgtgggaggattataacagggacttattggtcagcaccaccacagcacacggatgcgac

SEQ ID NO: 80181 - DNA, 75 bp, Artificial Sequence
  Synthetic
gaagggccagggctcgtggaagtgcaagagagtgagtactaccccaaaagatatcaatctcatgtcctcctcgca

SEQ ID NO: 80182 - DNA, 75 bp, Artificial Sequence
  Synthetic
gtggcggaatactcaggtgtgagcatggtgtcatcggcattgtcaccatgggtggagaaggtattgttggatttg

SEQ ID NO: 80183 - DNA, 75 bp, Artificial Sequence
  Synthetic
ctcttgaaagagtcgctggtgggtcaagactctatcctagagaagtctctaaaggctctagtcaaaataatatca

SEQ ID NO: 80184 - DNA, 75 bp, Artificial Sequence
  Synthetic
tcgtccccgtggcggtggctcaaacagaaggtgtcacaatactatgggattcccatggctgaacgccagaataat

SEQ ID NO: 80185 - DNA, 75 bp, Artificial Sequence
  Synthetic
ttcatagagtggctcaaggttaagatcctgccagaggttaaggaaagacatgaattcctgaacagacttaaacag

SEQ ID NO: 80186 - DNA, 75 bp, Artificial Sequence
  Synthetic
ctccctctattagagagtcagatcgccacaatcgagcagagcgcaccatcccagagtgaccaggaacaattattt

SEQ ID NO: 80187 - DNA, 75 bp, Artificial Sequence
  Synthetic
tcccttgagaagaagatgagcaattacatacagttcaagtccaaatgccgtattgagcctgtatgtttgctccta

SEQ ID NO: 80188 - DNA, 75 bp, Artificial Sequence
  Synthetic
acatacagttcaagtccaaatgccgtattgagcctgtatgtttgctcctacacgggagccctggtgccggtaagt

SEQ ID NO: 80189 - DNA, 75 bp, Artificial Sequence
  Synthetic
cagatcacttcgacggatacaagcaacaagctgtggtgatcatggacgatttatgccagaaccctgatggaaaag

SEQ ID NO: 80190 - DNA, 75 bp, Artificial Sequence
  Synthetic
acgtctccttgttctgccaaatggtttccagcgtagattttgtgccacccatggctgctttagaagagaaaggca

SEQ ID NO: 80191 - DNA, 75 bp, Artificial Sequence
  Synthetic
gtggaaaggccatacaattcattgacagaaggacgcaggttaggtattcgctagacatgctagttaccgagatgt

SEQ ID NO: 80192 - DNA, 75 bp, Artificial Sequence
  Synthetic
cagaaggacgcaggttaggtattcgctagacatgctagttaccgagatgttcagggaatataaccacaggcatag

SEQ ID NO: 80193 - DNA, 75 bp, Artificial Sequence
  Synthetic
gacgccaccaccgcccgccattacggacctactcaagtcagtagatagcgaagctgtgagggagtactgtaaaga

SEQ ID NO: 80194 - DNA, 75 bp, Artificial Sequence
  Synthetic
gacctactcaagtcagtagatagcgaagctgtgagggagtactgtaaagagagaggatggttggttcctgaggtt

SEQ ID NO: 80195 - DNA, 75 bp, Artificial Sequence
  Synthetic
gtagctggtatcatttacataatatacaagctctttgcgggttttcaaggtgcatatacgggaatgcccaaccag

SEQ ID NO: 80196 - DNA, 75 bp, Artificial Sequence
  Synthetic
acaagctctttgcgggttttcaaggtgcatatacgggaatgcccaaccagaagcccaaggtacccaccctaaggc

SEQ ID NO: 80197 - DNA, 75 bp, Artificial Sequence
  Synthetic
agtatggcgaattcaccatgttgggcatttacgataggtgggccgtcttgccacgtcatgctaaacctggaccaa

SEQ ID NO: 80198 - DNA, 75 bp, Artificial Sequence
  Synthetic
aactaacactactcaaactgaacaggaacgagaagtttagggacatcagggggtttttggccaaggaggaggtgg

SEQ ID NO: 80199 - DNA, 75 bp, Artificial Sequence
  Synthetic
agtgcggtggggtgctcatgtccaccggtaaagtcctggggatccacgttgggggaaatggtcaccaaggttttt

SEQ ID NO: 80200 - DNA, 75 bp, Artificial Sequence
  Synthetic
tcggaaatgtcaacacacacgtggatgagtacatgctggaagctgtcgaccattacgctgggcaattagctaccc

SEQ ID NO: 80201 - DNA, 75 bp, Artificial Sequence
  Synthetic
caaccagtgcaggctacccctatgtcgcactgggcatcaagaagagagacatcctatcaaagaaaaccaaggact

SEQ ID NO: 80202 - DNA, 75 bp, Artificial Sequence
  Synthetic
gatccgcagagaaagtagcaaagggaaaatctaggctgattgaagcatctagtctgaatgattcagtggcaatga

SEQ ID NO: 80203 - DNA, 75 bp, Artificial Sequence
  Synthetic
acccagacctcttttggagcaaaataccagtgatgctggatggacatctcatagcatttgattactctgggtatg

SEQ ID NO: 80204 - DNA, 75 bp, Artificial Sequence
  Synthetic
gctttaatgaagtcacttggaccaacgtcactttcctaaagaggtattttagagcagatgaacaatacccctttt

SEQ ID NO: 80205 - DNA, 75 bp, Artificial Sequence
  Synthetic
gtgccaatggacaatatgttcagacacaataatgtcacattgatggtgattccatttgtgcccctagattactgt

SEQ ID NO: 80206 - DNA, 75 bp, Artificial Sequence
  Synthetic
agtaccaccacgaacaagcacttctgttcccccggtgaggctgtataggctgtttccacggctaaaagcggctga

SEQ ID NO: 80207 - DNA, 75 bp, Artificial Sequence
  Synthetic
tccgttatccgctcatgtacttcgagaagcctagtatcaccttggaatcttcgatgcgttgcgctcaacactcaa

SEQ ID NO: 80208 - DNA, 75 bp, Artificial Sequence
  Synthetic
gcctattgagctacctgagagtcctccggcccctgaatgcggctaatcctaaccacggagcaggcagtggcaatc

SEQ ID NO: 80209 - DNA, 75 bp, Artificial Sequence
  Synthetic
ttacaatggctgcttatggtgacaattattgatagttatcataaagcaaattggattggccatccggtgagaatt

SEQ ID NO: 80210 - DNA, 75 bp, Artificial Sequence
  Synthetic
ttattgatagttatcataaagcaaattggattggccatccggtgagaatttgattattaaattactctcttgttg

SEQ ID NO: 80211 - DNA, 75 bp, Artificial Sequence
  Synthetic
ggcgcccaagtctcatcacagaaagttggagcccatgagaattcaaacagagcttatggtggatccaccattaat

SEQ ID NO: 80212 - DNA, 75 bp, Artificial Sequence
  Synthetic
ttggagcccatgagaattcaaacagagcttatggtggatccaccattaattacactactattaattattacaggg

SEQ ID NO: 80213 - DNA, 75 bp, Artificial Sequence
  Synthetic
ttctcattaagaccgctcccacgctaaactctcctaatatcgaggcgtgtgggtatagcgacagagtgatgcaac

SEQ ID NO: 80214 - DNA, 75 bp, Artificial Sequence
  Synthetic
aaactctcctaatatcgaggcgtgtgggtatagcgacagagtgatgcaactaaccctaggcaattctaccattac

SEQ ID NO: 80215 - DNA, 75 bp, Artificial Sequence
  Synthetic
tacgttatgtacaagctgttcgctgggcaccagggtgcatacactggtttgccaaataaacgacccaatgtaccc

SEQ ID NO: 80216 - DNA, 75 bp, Artificial Sequence
  Synthetic
tgtggaccagccaactgagccggacgttgccgcatgcaggttttacacactagacactgttacttggcgcaagga

SEQ ID NO: 80217 - DNA, 75 bp, Artificial Sequence
  Synthetic
gttgccgcatgcaggttttacacactagacactgttacttggcgcaaggagtccagagggtggtggtggaaactg

SEQ ID NO: 80218 - DNA, 75 bp, Artificial Sequence
  Synthetic
gtgcacgtacagtgtaatgcttcaaagtttcaccagggcgccctcggggtatttgcagttccagaaatgtgcctg

SEQ ID NO: 80219 - DNA, 75 bp, Artificial Sequence
  Synthetic
ttacaaaatatgagaatgcaaatccgggtgagaaagggggtgagttcaaagggagttttactctggatactaacg

SEQ ID NO: 80220 - DNA, 75 bp, Artificial Sequence
  Synthetic
ctaccaaccctgcacgcaacttttgtcccgttgattatctcttcgggagccgagtactggcgggaaatgcgtttg

SEQ ID NO: 80221 - DNA, 75 bp, Artificial Sequence
  Synthetic
tcccgttgattatctcttcgggagccgagtactggcgggaaatgcgtttgtttacccacatcagataattaatct

SEQ ID NO: 80222 - DNA, 75 bp, Artificial Sequence
  Synthetic
caattggggaattgctatccttccgctggcaccacttgactttgccaccgagtcctccactgagatacccattac

SEQ ID NO: 80223 - DNA, 75 bp, Artificial Sequence
  Synthetic
agtcctccactgagatacccattactctaactattgcccctatgtgttgtgaattcaatgggttgcgcaacatca

SEQ ID NO: 80224 - DNA, 75 bp, Artificial Sequence
  Synthetic
aatctccatgtgcgatacccgagtttgatgtgacaccacccatagacatcccgggggaagtgcgcaacatgatgg

SEQ ID NO: 80225 - DNA, 75 bp, Artificial Sequence
  Synthetic
tgatgtgacaccacccatagacatcccgggggaagtgcgcaacatgatggaattggcagagatagacactatgat

SEQ ID NO: 80226 - DNA, 75 bp, Artificial Sequence
  Synthetic
tgacacaccaatattgtgtctttcactgtctccagcatcagatcctaggctagcacacactatgctaggtgaaat

SEQ ID NO: 80227 - DNA, 75 bp, Artificial Sequence
  Synthetic
tagcacacactatgctaggtgaaatactgaactactacacacactgggcagggtctttgaagttcacatttctct

SEQ ID NO: 80228 - DNA, 75 bp, Artificial Sequence
  Synthetic
gcaaagaagcgatgctcggcacccacgtgatctgggacatcgggttacagtcatcatgcactatggtggtacctt

SEQ ID NO: 80229 - DNA, 75 bp, Artificial Sequence
  Synthetic
cgtgatctgggacatcgggttacagtcatcatgcactatggtggtaccttggattagcaacaccacatacagaca

SEQ ID NO: 80230 - DNA, 75 bp, Artificial Sequence
  Synthetic
cactcctagaaagatggacatattgggctttgtgtcagcctgcaatgacttcagtgtgcgcctgttgcgtgacac

SEQ ID NO: 80231 - DNA, 75 bp, Artificial Sequence
  Synthetic
tcagtgtgcgcctgttgcgtgacacgacgcacataagccaagaggttatgccacaaggattgggtgatttaattg

SEQ ID NO: 80232 - DNA, 75 bp, Artificial Sequence
  Synthetic
ctagcggcccagcccactctaaggaaacaccagcgctgacagccgtagagacaggggccaccaacccattggtgc

SEQ ID NO: 80233 - DNA, 75 bp, Artificial Sequence
  Synthetic
cttcagacacggtacaaactcgtcacgtcatccaaaagcggacgcggtcggagtctacggttgagtctttcttcg

SEQ ID NO: 80234 - DNA, 75 bp, Artificial Sequence
  Synthetic
ccccatgaagttgacgctagtctcctagcccaatcaggaaaagactatggactaactatgactccagctgacaaa

SEQ ID NO: 80235 - DNA, 75 bp, Artificial Sequence
  Synthetic
tctggaagataacttacaaggacaccgttcagttaagacgtaagttggagttctttacatattcaaggtttgaca

SEQ ID NO: 80236 - DNA, 75 bp, Artificial Sequence
  Synthetic
cgttcagttaagacgtaagttggagttctttacatattcaaggtttgacatggagttcacctttgtggttacatc

SEQ ID NO: 80237 - DNA, 75 bp, Artificial Sequence
  Synthetic
gatccctggcaagcggaatgattacacatggcaaacgtcatctaacccatcagtgttttacacttacggggcacc

SEQ ID NO: 80238 - DNA, 75 bp, Artificial Sequence
  Synthetic
acatggcaaacgtcatctaacccatcagtgttttacacttacggggcacctccagctagaatatcagtgccctac

SEQ ID NO: 80239 - DNA, 75 bp, Artificial Sequence
  Synthetic
gagggtgactcgctgtatggagcggcttcattgaacgacttcggatcactggctgttcgagtggtgaatgaccac

SEQ ID NO: 80240 - DNA, 75 bp, Artificial Sequence
  Synthetic
aaccctacgaaactcacttcaaaaatcagagtgtacatgaaaccaaagcacgtcagagtgtggtgtccgcgaccc

SEQ ID NO: 80241 - DNA, 75 bp, Artificial Sequence
  Synthetic
ataacctatggttttggccaccaaaataaggcagtgtacacggcaggttacaaaatttgcaattaccacctcgcc

SEQ ID NO: 80242 - DNA, 75 bp, Artificial Sequence
  Synthetic
taaacattatgtggattagagaccttttagtagtggaatccaaagcccaaggcatagactcaattgctagatgta

SEQ ID NO: 80243 - DNA, 75 bp, Artificial Sequence
  Synthetic
agtacatggaagcaaatgagtactatccagcccgataccaatcccacatgttaattggccatggttttgcatctc

SEQ ID NO: 80244 - DNA, 75 bp, Artificial Sequence
  Synthetic
tccagcccgataccaatcccacatgttaattggccatggttttgcatctccaggggactgtggtgggattctcag

SEQ ID NO: 80245 - DNA, 75 bp, Artificial Sequence
  Synthetic
gtacgcatacgaggtggaggctatggagcagggagtctccaactatattgagtcccttggggctgcatttgggag

SEQ ID NO: 80246 - DNA, 75 bp, Artificial Sequence
  Synthetic
gagcagggagtctccaactatattgagtcccttggggctgcatttgggagtggattcacccagcaaataggaaac

SEQ ID NO: 80247 - DNA, 75 bp, Artificial Sequence
  Synthetic
tcatcccttgttatcatcaccagaaactatgaagacacgaccacagtgctggctactcttgctctcctcggttgt

SEQ ID NO: 80248 - DNA, 75 bp, Artificial Sequence
  Synthetic
actatgaagacacgaccacagtgctggctactcttgctctcctcggttgtgatgcgtccccatggcaatggctaa

SEQ ID NO: 80249 - DNA, 75 bp, Artificial Sequence
  Synthetic
aggcatgcaatgcagccaagggattggaatgggtgtctaataaaatatccaaatttattgactggctcaaagaga

SEQ ID NO: 80250 - DNA, 75 bp, Artificial Sequence
  Synthetic
ggaatgggtgtctaataaaatatccaaatttattgactggctcaaagagaagatcattccacaggctagagacaa

SEQ ID NO: 80251 - DNA, 75 bp, Artificial Sequence
  Synthetic
aagtcaggagcatcaagaaatcctgttcaataacgtgagatggttatccatacagtcaaggagatttgccccgct

SEQ ID NO: 80252 - DNA, 75 bp, Artificial Sequence
  Synthetic
ttcaataacgtgagatggttatccatacagtcaaggagatttgccccgctctatgcggtcgaggctaagagaata

SEQ ID NO: 80253 - DNA, 75 bp, Artificial Sequence
  Synthetic
gtgcacggtagcccaggcacgggcaagtcagttgccaccaatttaattgccagagcaatagcagagaaggagaac

SEQ ID NO: 80254 - DNA, 75 bp, Artificial Sequence
  Synthetic
agtcagttgccaccaatttaattgccagagcaatagcagagaaggagaacacctccacatactcactaccaccag

SEQ ID NO: 80255 - DNA, 75 bp, Artificial Sequence
  Synthetic
cagacatgaagctgttttgtcagatggtctctactgtagaattcataccaccaatggcttcgctagaagaaaagg

SEQ ID NO: 80256 - DNA, 75 bp, Artificial Sequence
  Synthetic
ggtctctactgtagaattcataccaccaatggcttcgctagaagaaaagggtattttgttcacatctaattacgt

SEQ ID NO: 80257 - DNA, 75 bp, Artificial Sequence
  Synthetic
aacttgaattcgtcaccaagctcaaacagttggaaatgcttgaaaaccagatatcaaccatccatcaatcgtgcc

SEQ ID NO: 80258 - DNA, 75 bp, Artificial Sequence
  Synthetic
atttgacatggacatacaaatcatgagcgagtattctagagatggaaaattgaacatggcgatggcaactgaaat

SEQ ID NO: 80259 - DNA, 75 bp, Artificial Sequence
  Synthetic
agcgagtattctagagatggaaaattgaacatggcgatggcaactgaaatgtgtaagaactgtcatcaaccagca

SEQ ID NO: 80260 - DNA, 75 bp, Artificial Sequence
  Synthetic
agtatagatcagattactaccatgattattaatgagaggaacagaagatcaagtatcggtaattgcatggaggca

SEQ ID NO: 80261 - DNA, 75 bp, Artificial Sequence
  Synthetic
ttattaatgagaggaacagaagatcaagtatcggtaattgcatggaggcacttttccaaagtcctcttcaataca

SEQ ID NO: 80262 - DNA, 75 bp, Artificial Sequence
  Synthetic
aagaggtaagagactactgtgagaagaagggttggatagcagacatcactagtcaggtgcaaaccgaaagaaaca

SEQ ID NO: 80263 - DNA, 75 bp, Artificial Sequence
  Synthetic
gaagggttggatagcagacatcactagtcaggtgcaaaccgaaagaaacatcaatagagcgatgactattcttca

SEQ ID NO: 80264 - DNA, 75 bp, Artificial Sequence
  Synthetic
gtatacagggcttcccaacaagagacccaatgtccccaccatcaggactgccaaggttcagggcccaggatttga

SEQ ID NO: 80265 - DNA, 75 bp, Artificial Sequence
  Synthetic
cccaatgtccccaccatcaggactgccaaggttcagggcccaggatttgactacgcagtggcaatggccaaaaga

SEQ ID NO: 80266 - DNA, 75 bp, Artificial Sequence
  Synthetic
acccacgcatcaccgggtgaaacaatagtcattgatggcaaggaagtagaggtactggatgctaaagccctggag

SEQ ID NO: 80267 - DNA, 75 bp, Artificial Sequence
  Synthetic
gttcctgtcggtgctgtgactgaacaggggtatcttaatctcggtggacgccaaactgctcgtactttaatgtac

SEQ ID NO: 80268 - DNA, 75 bp, Artificial Sequence
  Synthetic
gggaacggttcacatgggttcgcagcagccctgaagcgatcctatttcactcagagtcaaggtgaaatccagtgg

SEQ ID NO: 80269 - DNA, 75 bp, Artificial Sequence
  Synthetic
cagccctgaagcgatcctatttcactcagagtcaaggtgaaatccagtggatgagaccatcaaaagaagtgggct

SEQ ID NO: 80270 - DNA, 75 bp, Artificial Sequence
  Synthetic
aaccagctgtgctcaccaaaagtgaccccagattgaagacagattttgaagaggctatcttttccaagtacgtgg

SEQ ID NO: 80271 - DNA, 75 bp, Artificial Sequence
  Synthetic
ccccagattgaagacagattttgaagaggctatcttttccaagtacgtgggaaataagattactgaagtagatga

SEQ ID NO: 80272 - DNA, 75 bp, Artificial Sequence
  Synthetic
tgaggatgcaatgtatggcactgacggtctcgaagctctagacctcagtaccagtgctgggtatccctatgtggc

SEQ ID NO: 80273 - DNA, 75 bp, Artificial Sequence
  Synthetic
ggtctcgaagctctagacctcagtaccagtgctgggtatccctatgtggcaatggggaagaagaaaagagacatt

SEQ ID NO: 80274 - DNA, 75 bp, Artificial Sequence
  Synthetic
acctatgtgaaagacgagcttagatccaagaccaaagtggaacagggcaagtccaggctaattgaggcctcaagt

SEQ ID NO: 80275 - DNA, 75 bp, Artificial Sequence
  Synthetic
tggcttttggcaacttgtacgcagcattccacaagaacccaggtgtagtgacaggatcggctgttggctgtgacc

SEQ ID NO: 80276 - DNA, 75 bp, Artificial Sequence
  Synthetic
gattacacgggttatgatgcttcactaagccccgcctggtttgaggctctcaagatggttctagagaaaattggg

SEQ ID NO: 80277 - DNA, 75 bp, Artificial Sequence
  Synthetic
atataaaaacaagacatattgtgttaagggcggtatgccatctggctgctctggcacctcaatttttaattcaat

SEQ ID NO: 80278 - DNA, 75 bp, Artificial Sequence
  Synthetic
ctcttactgaaaacctacaagggcatagatttagaccacctgaagatgatagcctatggtgatgatgtaattgct

SEQ ID NO: 80279 - DNA, 75 bp, Artificial Sequence
  Synthetic
tcacatgggagaatgtaacattcttgaaaagattctttagagcagatgaaaagtatccctttctggtacatccag

SEQ ID NO: 80280 - DNA, 75 bp, Artificial Sequence
  Synthetic
tgatgccaatgaaagaaattcacgaatcaattagatggactaaagatcccagaaacactcaggatcatgttcgct

SEQ ID NO: 80281 - DNA, 75 bp, Artificial Sequence
  Synthetic
ttaaaacagctctggggttgttcccaccccagaggcccacgtggcggctagcactctggtatcacggtacctttg

SEQ ID NO: 80282 - DNA, 75 bp, Artificial Sequence
  Synthetic
agtgttcctatgaacaagcacttctgtttccccggtgacctcgtataggctgtgcccacggctaaaaacgagcga

SEQ ID NO: 80283 - DNA, 75 bp, Artificial Sequence
  Synthetic
acccatggctcgcgccatgggacgctagatgtgaacaaggtgtgaagagcctattgagctacctaagagtcctcc

SEQ ID NO: 80284 - DNA, 75 bp, Artificial Sequence
  Synthetic
ggattggccatccggtggaagttatatacatcatctatctatttgttggatttgcttcactaacacagttcacaa

SEQ ID NO: 80285 - DNA, 75 bp, Artificial Sequence
  Synthetic
gtctggacagtccccactggcgacagtggctccagctgcgctggcggccgcgacctgtggcccaaagccacggga

SEQ ID NO: 80286 - DNA, 75 bp, Artificial Sequence
  Synthetic
tcaacttggtatatataataatagtgattagagaaaaataccataatgggcgcgcaggtttcatcccagaaagtt

SEQ ID NO: 80287 - DNA, 75 bp, Artificial Sequence
  Synthetic
catacggaggttctactattaactacaccaccattaattactatagggattcagctagcaacgcagcctcaaaac

SEQ ID NO: 80288 - DNA, 75 bp, Artificial Sequence
  Synthetic
ttgataaaaacagccccaatgctaaattctccaaacattgaagcttgtgggtacagtgatagagtcttgcagttg

SEQ ID NO: 80289 - DNA, 75 bp, Artificial Sequence
  Synthetic
ttgagggatggtgaggctaatccagtcgaccaaccgactgaaccagatgttgcagcttgtagattttacacactt

SEQ ID NO: 80290 - DNA, 75 bp, Artificial Sequence
  Synthetic
tcgaccaaccgactgaaccagatgttgcagcttgtagattttacacacttgaaacagtctcttggacgaaagaat

SEQ ID NO: 80291 - DNA, 75 bp, Artificial Sequence
  Synthetic
acctgggtaggtcagggtacacagtgcacgtgcagtgtaacgcatccaagttccaccagggtgcactcggtgtgt

SEQ ID NO: 80292 - DNA, 75 bp, Artificial Sequence
  Synthetic
gcacgtgcagtgtaacgcatccaagttccaccagggtgcactcggtgtgtttgccgtaccggaaatgtgcttggc

SEQ ID NO: 80293 - DNA, 75 bp, Artificial Sequence
  Synthetic
aggcacattcacgccagacaataaccaaacatcacccgcccgcagattctgccctgtggattatctctttggcaa

SEQ ID NO: 80294 - DNA, 75 bp, Artificial Sequence
  Synthetic
gccctgtggattatctctttggcaatggcaccctcctgggtaatgcgtttgtgtttccgcaccagataatcaact

SEQ ID NO: 80295 - DNA, 75 bp, Artificial Sequence
  Synthetic
acaactgggggatcgctataataccattggctcccttgaactttgctaatgagtcatccccagaaatccccatta

SEQ ID NO: 80296 - DNA, 75 bp, Artificial Sequence
  Synthetic
cgagttcaatggattgagaaatatcaccctaccgcggctgcagggactgcctgtaatgaacacccctggtagcaa

SEQ ID NO: 80297 - DNA, 75 bp, Artificial Sequence
  Synthetic
ctgtaatgaacacccctggtagcaaccaataccttactgctgacaactttcagtccccgtgtgcgttacctgaat

SEQ ID NO: 80298 - DNA, 75 bp, Artificial Sequence
  Synthetic
acccggggaggttaaaaacatgatggaactggccgaaatagacactatgataccttttgacctgagtgccaccaa

SEQ ID NO: 80299 - DNA, 75 bp, Artificial Sequence
  Synthetic
gaactggccgaaatagacactatgataccttttgacctgagtgccaccaaaaagaacacaatggaaatgtacagg

SEQ ID NO: 80300 - DNA, 75 bp, Artificial Sequence
  Synthetic
ttgtctcacacaatgcttggagagatcttgaattattatactcattgggcaggatccttgaagtttacattcctg

SEQ ID NO: 80301 - DNA, 75 bp, Artificial Sequence
  Synthetic
gaaagctgttggtttcctacgctccccccggtgctgacccgccaaagaagcgcaaggaagcgatgttagggacac

SEQ ID NO: 80302 - DNA, 75 bp, Artificial Sequence
  Synthetic
atgtgatctgggacattggattacaatcctcctgtactatggtggtgccgtggattagcaatactacatatagac

SEQ ID NO: 80303 - DNA, 75 bp, Artificial Sequence
  Synthetic
atcctcctgtactatggtggtgccgtggattagcaatactacatatagacagaccattgatgacagcttcaccga

SEQ ID NO: 80304 - DNA, 75 bp, Artificial Sequence
  Synthetic
cgggtttgtgtcagcttgcaacgatttcagcgtgcgtctgttacgtgacaccacacacatagaacaaaaagcgat

SEQ ID NO: 80305 - DNA, 75 bp, Artificial Sequence
  Synthetic
ttcagcgtgcgtctgttacgtgacaccacacacatagaacaaaaagcgattacacaaggtttgggccggatgctc

SEQ ID NO: 80306 - DNA, 75 bp, Artificial Sequence
  Synthetic
tccagcggcccagcccactccaaggaaattccggcgctcaccgcagtagagacgggagccacaaacccgttggtt

SEQ ID NO: 80307 - DNA, 75 bp, Artificial Sequence
  Synthetic
ccctcagacaccgtacaaactagacatgtcatacagcacagatcgcggtcagagtccagtgttgagtccttcttc

SEQ ID NO: 80308 - DNA, 75 bp, Artificial Sequence
  Synthetic
gtgtggaaaatcacgtacaaggacactgtgcagttgaggagaaaattagagtttttcacttattccaggtttgac

SEQ ID NO: 80309 - DNA, 75 bp, Artificial Sequence
  Synthetic
ctgtgcagttgaggagaaaattagagtttttcacttattccaggtttgacatggagttcacttttgtaatcacag

SEQ ID NO: 80310 - DNA, 75 bp, Artificial Sequence
  Synthetic
gtttttcacttattccaggtttgacatggagttcacttttgtaatcacagcaaactttacagagaccaataatgg

SEQ ID NO: 80311 - DNA, 75 bp, Artificial Sequence
  Synthetic
cagtgccagaaaagtgggatgattatacttggcaaacatcatcgaacccatcaattttctacacatacggcacag

SEQ ID NO: 80312 - DNA, 75 bp, Artificial Sequence
  Synthetic
tcaattttctacacatacggcacagcaccggcccgcatctccgtaccgtacgttggtatatcaaatgcctactca

SEQ ID NO: 80313 - DNA, 75 bp, Artificial Sequence
  Synthetic
gcttccctgaatgactttggcattttggctgtgagggtggttaacgaccataatccaaccaaggtcacttccaag

SEQ ID NO: 80314 - DNA, 75 bp, Artificial Sequence
  Synthetic
taatccaaccaaggtcacttccaagattagggtgtacttaaaacccaaacacatcagagtgtggtgcccccgccc

SEQ ID NO: 80315 - DNA, 75 bp, Artificial Sequence
  Synthetic
cctgaccacgtatggtcatgggcaccaaaacaaggcagtgtacacggctggttacaaaatttgcaactaccactt

SEQ ID NO: 80316 - DNA, 75 bp, Artificial Sequence
  Synthetic
caaaacaaggcagtgtacacggctggttacaaaatttgcaactaccacttggccactcaagaggacctacagaat

SEQ ID NO: 80317 - DNA, 75 bp, Artificial Sequence
  Synthetic
tgtaactgtagcgcgggtgtgtattattgtgaatccagaagaaaatactacccagtctcttttattggccccacc

SEQ ID NO: 80318 - DNA, 75 bp, Artificial Sequence
  Synthetic
catgttaattggtcatggttttgcatccccaggagactgcggaggaatcctcaggtgtcaacacggggttatagg

SEQ ID NO: 80319 - DNA, 75 bp, Artificial Sequence
  Synthetic
tcaggtgtcaacacggggttataggcatagtcactgcaggaggggaaggtcttgttgcgttctcagacatcagag

SEQ ID NO: 80320 - DNA, 75 bp, Artificial Sequence
  Synthetic
catagtcactgcaggaggggaaggtcttgttgcgttctcagacatcagagatctttacgcatatgaggaggaggc

SEQ ID NO: 80321 - DNA, 75 bp, Artificial Sequence
  Synthetic
ggacaaaatttcagaactatccagcatggttactagcaccatcacagagaaattgctaaagaatttaatcaaaat

SEQ ID NO: 80322 - DNA, 75 bp, Artificial Sequence
  Synthetic
tgttagcaacccttgcactcctcggctgtgatgtttctccctggcaatggctcaagaaaaaggcctgtgacattc

SEQ ID NO: 80323 - DNA, 75 bp, Artificial Sequence
  Synthetic
ctcaagaaaaaggcctgtgacattctggagatcccatatgtcattcgtcaaggagatagttggctcaagaagttc

SEQ ID NO: 80324 - DNA, 75 bp, Artificial Sequence
  Synthetic
tggagatcccatatgtcattcgtcaaggagatagttggctcaagaagttcacggaagcatgtaacgcagccaagg

SEQ ID NO: 80325 - DNA, 75 bp, Artificial Sequence
  Synthetic
ataaaattgaatttgtgacaaaactcaaacagttggaaatgttagaaaatcaaatatccacaatacaccaatcgt

SEQ ID NO: 80326 - DNA, 75 bp, Artificial Sequence
  Synthetic
gcccgagtcaagaacaccaagaaatactcttcaacaatgttaggtggctatccatccaatcaaagaggttcgcgc

SEQ ID NO: 80327 - DNA, 75 bp, Artificial Sequence
  Synthetic
aataactacatacagttcaagagcaaacaccgtattgaaccagtatgtctgttggtgcatggtagtccaggaaca

SEQ ID NO: 80328 - DNA, 75 bp, Artificial Sequence
  Synthetic
ccggatccctcgcactttgacgggtataaacaacaaggagtggtcattatggacgatctaaatcaaaacccagat

SEQ ID NO: 80329 - DNA, 75 bp, Artificial Sequence
  Synthetic
ataaacaacaaggagtggtcattatggacgatctaaatcaaaacccagatggagctgacatgaaattgttttgcc

SEQ ID NO: 80330 - DNA, 75 bp, Artificial Sequence
  Synthetic
atgtgctggcttccactaattccagtagaataacacccccaactgtggcccacagcgacgccttggctaggaggt

SEQ ID NO: 80331 - DNA, 75 bp, Artificial Sequence
  Synthetic
tagaataacacccccaactgtggcccacagcgacgccttggctaggaggtttgccttcgatatggatattcaggt

SEQ ID NO: 80332 - DNA, 75 bp, Artificial Sequence
  Synthetic
tgcaaattttaaaagatgttgtcctttagtgtgtggtaaagcaattcagttgatggataagtcatctagagtcag

SEQ ID NO: 80333 - DNA, 75 bp, Artificial Sequence
  Synthetic
ttagtgtgtggtaaagcaattcagttgatggataagtcatctagagtcaggtacagtgttgaccaaatcaccact

SEQ ID NO: 80334 - DNA, 75 bp, Artificial Sequence
  Synthetic
tacagagaccttaagatagatatcaaaactactcctcctccagaatgcataaatgatctgctgcaggctgtcgac

SEQ ID NO: 80335 - DNA, 75 bp, Artificial Sequence
  Synthetic
aaatgatctgctgcaggctgtcgactcccaggaggttagggaatattgtgagaagaagggctggctagttaatat

SEQ ID NO: 80336 - DNA, 75 bp, Artificial Sequence
  Synthetic
ggtggctggtgtagtttatgttatgtacaagctcttcgcaggtcatcaaggggcgtatactggactgcccaataa

SEQ ID NO: 80337 - DNA, 75 bp, Artificial Sequence
  Synthetic
tacaagctcttcgcaggtcatcaaggggcgtatactggactgcccaataagaagcccaatgtccccaccattagg

SEQ ID NO: 80338 - DNA, 75 bp, Artificial Sequence
  Synthetic
agcaagggcgaattcaccatgctcggggtgcatgacaatgtggctgtacttccaacacatgcttcaccaggagaa

SEQ ID NO: 80339 - DNA, 75 bp, Artificial Sequence
  Synthetic
gggtgcatgacaatgtggctgtacttccaacacatgcttcaccaggagaaactataatcatagatggaaaggagg

SEQ ID NO: 80340 - DNA, 75 bp, Artificial Sequence
  Synthetic
gttcaaacagagagaaacattaaccgagcaatgaccattttgcaggcagtgacaactttcgccgcagtggctggt

SEQ ID NO: 80341 - DNA, 75 bp, Artificial Sequence
  Synthetic
gaaatgaaaagttcagggacatcagaccccacatccccacccagatcactgagacgcatgacggagttttgatcg

SEQ ID NO: 80342 - DNA, 75 bp, Artificial Sequence
  Synthetic
accccacatccccacccagatcactgagacgcatgacggagttttgatcgtgaacactagtaagtaccctaacat

SEQ ID NO: 80343 - DNA, 75 bp, Artificial Sequence
  Synthetic
agtggctatggctaaaagaaacattgttacagcaactactagcaaaggggagttcacaatgctaggagtccacga

SEQ ID NO: 80344 - DNA, 75 bp, Artificial Sequence
  Synthetic
gtacaatttcccaacccgagctggtcagtgtggtggaatcatcacatgcaccggtaaggtgatcggaatgcatgt

SEQ ID NO: 80345 - DNA, 75 bp, Artificial Sequence
  Synthetic
cagtgtggtggaatcatcacatgcaccggtaaggtgatcggaatgcatgttggagggaatggttcacatgggttt

SEQ ID NO: 80346 - DNA, 75 bp, Artificial Sequence
  Synthetic
gggtacccgattatcaatgccccatccaagaccaaattggagcccagtgctttccatcatgtatttgagggtgtt

SEQ ID NO: 80347 - DNA, 75 bp, Artificial Sequence
  Synthetic
ccaagaccaaattggagcccagtgctttccatcatgtatttgagggtgttaaagaacctgccgtgctcaccaaga

SEQ ID NO: 80348 - DNA, 75 bp, Artificial Sequence
  Synthetic
atgaatacatgaaggaggcagtcgatcattacgccggtcaacttatgtccctagacattaacacagatcaaatgt

SEQ ID NO: 80349 - DNA, 75 bp, Artificial Sequence
  Synthetic
tcattacgccggtcaacttatgtccctagacattaacacagatcaaatgtgcttggaagatgctatgtatggtac

SEQ ID NO: 80350 - DNA, 75 bp, Artificial Sequence
  Synthetic
tatactaaataaacagaccagagacaccaaggaaatgcaaagattattggacacttacggcatcaacctaccttt

SEQ ID NO: 80351 - DNA, 75 bp, Artificial Sequence
  Synthetic
accaaggaaatgcaaagattattggacacttacggcatcaacctacctttagtcacttatgtcaaggatgaactt

SEQ ID NO: 80352 - DNA, 75 bp, Artificial Sequence
  Synthetic
agaatggctttcgggaatctgtatgcgtcctttcacaaaaacccaggtgtcatcacagggtcagcagttggatgc

SEQ ID NO: 80353 - DNA, 75 bp, Artificial Sequence
  Synthetic
cgtcctttcacaaaaacccaggtgtcatcacagggtcagcagttggatgcgatccagacttgttttggagtaaaa

SEQ ID NO: 80354 - DNA, 75 bp, Artificial Sequence
  Synthetic
ttgaggccctcaagatggtcttagaaaagattggctttggtgatagagtagattacattgattatctcaatcact

SEQ ID NO: 80355 - DNA, 75 bp, Artificial Sequence
  Synthetic
aaagattggctttggtgatagagtagattacattgattatctcaatcactcacaccatttatataaaaataaaac

SEQ ID NO: 80356 - DNA, 75 bp, Artificial Sequence
  Synthetic
tacaagggcatagatttagatcacctgaagatgattgcctatggtgatgatgtaattgcttcctacccccatgag

SEQ ID NO: 80357 - DNA, 75 bp, Artificial Sequence
  Synthetic
atacacccagtaatgccaatgaaggagattcatgaatcaattagatggaccaaagatcctagaaatacccaggat
